United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 23

SEQ ID NO: 858512 - RNA, 17 nt, Mycobacterium avium subsp. paratuberculosis
cgccgcggccagcgccc

SEQ ID NO: 858513 - RNA, 22 nt, Mycobacterium avium subsp. paratuberculosis
cgccgcggccagcgccccgccg

SEQ ID NO: 858514 - RNA, 23 nt, Mycobacterium avium subsp. paratuberculosis
cgccgcggccagcgccccgccgg

SEQ ID NO: 858515 - RNA, 13 nt, Mycobacterium avium subsp. paratuberculosis
cgccgcggccagg

SEQ ID NO: 858516 - RNA, 19 nt, Mycobacterium avium subsp. paratuberculosis
cgccgcggcggcucggcgg

SEQ ID NO: 858517 - RNA, 21 nt, Mycobacterium avium subsp. paratuberculosis
cgccgcggcggcucggcggcg

SEQ ID NO: 858518 - RNA, 13 nt, Mycobacterium avium subsp. paratuberculosis
cgccgcggcggug

SEQ ID NO: 858519 - RNA, 14 nt, Mycobacterium avium subsp. paratuberculosis
cgccgcggcggugg

SEQ ID NO: 858520 - RNA, 15 nt, Mycobacterium avium subsp. paratuberculosis
cgccgcggcggccug

SEQ ID NO: 858521 - RNA, 12 nt, Mycobacterium avium subsp. paratuberculosis
cgccgcgggaug

SEQ ID NO: 858522 - RNA, 12 nt, Mycobacterium avium subsp. paratuberculosis
cgccgcgggcca

SEQ ID NO: 858523 - RNA, 13 nt, Mycobacterium avium subsp. paratuberculosis
cgccgcgggccag

SEQ ID NO: 858524 - RNA, 17 nt, Mycobacterium avium subsp. paratuberculosis
cgccgcgggccagccag

SEQ ID NO: 858525 - RNA, 15 nt, Mycobacterium avium subsp. paratuberculosis
cgccgcgggucggcg

SEQ ID NO: 858526 - RNA, 22 nt, Mycobacterium avium subsp. paratuberculosis
cgccgcgggucggcgacggcgc

SEQ ID NO: 858527 - RNA, 14 nt, Mycobacterium avium subsp. paratuberculosis
cgccgcgguagcgg

SEQ ID NO: 858528 - RNA, 20 nt, Mycobacterium avium subsp. paratuberculosis
cgccgcgguagcggaccugc

SEQ ID NO: 858529 - RNA, 15 nt, Mycobacterium avium subsp. paratuberculosis
cgccgcggucaucga

SEQ ID NO: 858530 - RNA, 17 nt, Mycobacterium avium subsp. paratuberculosis
cgccgcggucaucgagc

SEQ ID NO: 858531 - RNA, 20 nt, Mycobacterium avium subsp. paratuberculosis
cgccgcggucaucgagccgg

SEQ ID NO: 858532 - RNA, 19 nt, Mycobacterium avium subsp. paratuberculosis
cgccgcgucgucaucgucu

SEQ ID NO: 858533 - RNA, 19 nt, Mycobacterium avium subsp. paratuberculosis
cgccgcgucggucagcgcc

SEQ ID NO: 858534 - RNA, 20 nt, Mycobacterium avium subsp. paratuberculosis
cgccgcgucggucagcgcca

SEQ ID NO: 858535 - RNA, 13 nt, Mycobacterium avium subsp. paratuberculosis
cgccgcguccggg

SEQ ID NO: 858536 - RNA, 17 nt, Mycobacterium avium subsp. paratuberculosis
cgccgcgucgccgccgg

SEQ ID NO: 858537 - RNA, 23 nt, Mycobacterium avium subsp. paratuberculosis
cgccgcgucgccgccgggcgcca

SEQ ID NO: 858538 - RNA, 14 nt, Mycobacterium avium subsp. paratuberculosis
cgccgcgucgccgc

SEQ ID NO: 858539 - RNA, 16 nt, Mycobacterium avium subsp. paratuberculosis
cgccgcguccucgucg

SEQ ID NO: 858540 - RNA, 19 nt, Mycobacterium avium subsp. paratuberculosis
cgccgcguccucgucgaug

SEQ ID NO: 858541 - RNA, 20 nt, Mycobacterium avium subsp. paratuberculosis
cgccgcguccucgucgaugc

SEQ ID NO: 858542 - RNA, 12 nt, Mycobacterium avium subsp. paratuberculosis
cgccgcguccgg

SEQ ID NO: 858543 - RNA, 12 nt, Mycobacterium avium subsp. paratuberculosis
cgccgcggugcg

SEQ ID NO: 858544 - RNA, 18 nt, Mycobacterium avium subsp. paratuberculosis
cgccgcggugcgccacgc

SEQ ID NO: 858545 - RNA, 12 nt, Mycobacterium avium subsp. paratuberculosis
cgccgcgguugg

SEQ ID NO: 858546 - RNA, 23 nt, Mycobacterium avium subsp. paratuberculosis
cgccgcgguuggucaccaggucg

SEQ ID NO: 858547 - RNA, 13 nt, Mycobacterium avium subsp. paratuberculosis
cgccgcguacacc

SEQ ID NO: 858548 - RNA, 17 nt, Mycobacterium avium subsp. paratuberculosis
cgccgcguacaccggcu

SEQ ID NO: 858549 - RNA, 19 nt, Mycobacterium avium subsp. paratuberculosis
cgccgcguacaccggcuga

SEQ ID NO: 858550 - RNA, 17 nt, Mycobacterium avium subsp. paratuberculosis
cgccgcguacagcagcu

SEQ ID NO: 858551 - RNA, 20 nt, Mycobacterium avium subsp. paratuberculosis
cgccgcguacagcagcugcc

SEQ ID NO: 858552 - RNA, 15 nt, Mycobacterium avium subsp. paratuberculosis
cgccgcguacagcca

SEQ ID NO: 858553 - RNA, 20 nt, Mycobacterium avium subsp. paratuberculosis
cgccgcguacagccagcccg

SEQ ID NO: 858554 - RNA, 15 nt, Mycobacterium avium subsp. paratuberculosis
cgccgcguaccagcg

SEQ ID NO: 858555 - RNA, 17 nt, Mycobacterium avium subsp. paratuberculosis
cgccgcguaccagcgcc

SEQ ID NO: 858556 - RNA, 18 nt, Mycobacterium avium subsp. paratuberculosis
cgccgcguaccagcgcca

SEQ ID NO: 858557 - RNA, 22 nt, Mycobacterium avium subsp. paratuberculosis
cgccgcguacgccgccuugacg

SEQ ID NO: 858558 - RNA, 22 nt, Mycobacterium avium subsp. paratuberculosis
cgccgcguaggccaggaccggg

SEQ ID NO: 858559 - RNA, 19 nt, Mycobacterium avium subsp. paratuberculosis
cgccgcgguggccgggaug

SEQ ID NO: 858560 - RNA, 13 nt, Mycobacterium avium subsp. paratuberculosis
cgccgcgguggcg

SEQ ID NO: 858561 - RNA, 14 nt, Mycobacterium avium subsp. paratuberculosis
cgccgcgguggugg

SEQ ID NO: 858562 - RNA, 15 nt, Mycobacterium avium subsp. paratuberculosis
cgccgcgggugacga

SEQ ID NO: 858563 - RNA, 19 nt, Mycobacterium avium subsp. paratuberculosis
cgccgcgggugcggcacgg

SEQ ID NO: 858564 - RNA, 20 nt, Mycobacterium avium subsp. paratuberculosis
cgccgcgggugcggcacggc

SEQ ID NO: 858565 - RNA, 20 nt, Mycobacterium avium subsp. paratuberculosis
cgccgcgggugucgcccucg

SEQ ID NO: 858566 - RNA, 20 nt, Mycobacterium avium subsp. paratuberculosis
cgccgcgguagacaccgccg

SEQ ID NO: 858567 - RNA, 15 nt, Mycobacterium avium subsp. paratuberculosis
cgccgcggucgcuga

SEQ ID NO: 858568 - RNA, 17 nt, Mycobacterium avium subsp. paratuberculosis
cgccgcggucgcugacc

SEQ ID NO: 858569 - RNA, 23 nt, Mycobacterium avium subsp. paratuberculosis
cgccgcggucgcugacccgccgc

SEQ ID NO: 858570 - RNA, 19 nt, Mycobacterium avium subsp. paratuberculosis
cgccaccgcggggcugggc

SEQ ID NO: 858571 - RNA, 21 nt, Mycobacterium avium subsp. paratuberculosis
cgccaccgcggggcugggcgc

SEQ ID NO: 858572 - RNA, 11 nt, Mycobacterium avium subsp. paratuberculosis
cgccaccgcga

SEQ ID NO: 858573 - RNA, 20 nt, Mycobacterium avium subsp. paratuberculosis
cgccaccgcgaaagcgucgg

SEQ ID NO: 858574 - RNA, 21 nt, Mycobacterium avium subsp. paratuberculosis
cgccaccgcgaaagcgucggc

SEQ ID NO: 858575 - RNA, 14 nt, Mycobacterium avium subsp. paratuberculosis
cgccaccgcgcaac

SEQ ID NO: 858576 - RNA, 21 nt, Mycobacterium avium subsp. paratuberculosis
cgccaccgcgcaaccgggccg

SEQ ID NO: 858577 - RNA, 22 nt, Mycobacterium avium subsp. paratuberculosis
cgccaccgcgcaaccgggccgc

SEQ ID NO: 858578 - RNA, 18 nt, Mycobacterium avium subsp. paratuberculosis
cgccaccgcccgcugacc

SEQ ID NO: 858579 - RNA, 19 nt, Mycobacterium avium subsp. paratuberculosis
cgccaccgaugcgggccag

SEQ ID NO: 858580 - RNA, 13 nt, Mycobacterium avium subsp. paratuberculosis
cgcccagccggcg

SEQ ID NO: 858581 - RNA, 15 nt, Mycobacterium avium subsp. paratuberculosis
cgcccagccggcgga

SEQ ID NO: 858582 - RNA, 21 nt, Mycobacterium avium subsp. paratuberculosis
cgcccagccgagccgggccag

SEQ ID NO: 858583 - RNA, 12 nt, Mycobacterium avium subsp. paratuberculosis
cgcccagcccga

SEQ ID NO: 858584 - RNA, 13 nt, Mycobacterium avium subsp. paratuberculosis
cgcccagcccgcg

SEQ ID NO: 858585 - RNA, 15 nt, Mycobacterium avium subsp. paratuberculosis
cgcccagcccgcggg

SEQ ID NO: 858586 - RNA, 18 nt, Mycobacterium avium subsp. paratuberculosis
cgcccagcaucgccgcga

SEQ ID NO: 858587 - RNA, 19 nt, Mycobacterium avium subsp. paratuberculosis
cgcccagcaucgccgcgac

SEQ ID NO: 858588 - RNA, 21 nt, Mycobacterium avium subsp. paratuberculosis
cgcccagcagcugcgcgucga

SEQ ID NO: 858589 - RNA, 15 nt, Mycobacterium avium subsp. paratuberculosis
cgcccagcugcaccc

SEQ ID NO: 858590 - RNA, 16 nt, Mycobacterium avium subsp. paratuberculosis
cgcccagcugcaccca

SEQ ID NO: 858591 - RNA, 22 nt, Mycobacterium avium subsp. paratuberculosis
cgcccagcugcacccaccggcc

SEQ ID NO: 858592 - RNA, 19 nt, Mycobacterium avium subsp. paratuberculosis
cgcccagcgucucggcggc

SEQ ID NO: 858593 - RNA, 20 nt, Mycobacterium avium subsp. paratuberculosis
cgcccagcgucucggcggcc

SEQ ID NO: 858594 - RNA, 21 nt, Mycobacterium avium subsp. paratuberculosis
cgcccagcgucucggcggccg

SEQ ID NO: 858595 - RNA, 22 nt, Mycobacterium avium subsp. paratuberculosis
cgcccagcgucucggcggccga

SEQ ID NO: 858596 - RNA, 17 nt, Mycobacterium avium subsp. paratuberculosis
cgcccagcgugucggcg

SEQ ID NO: 858597 - RNA, 18 nt, Mycobacterium avium subsp. paratuberculosis
cgcccagcgugucggcga

SEQ ID NO: 858598 - RNA, 20 nt, Mycobacterium avium subsp. paratuberculosis
cgcccagcgugucggcgauc

SEQ ID NO: 858599 - RNA, 19 nt, Mycobacterium avium subsp. paratuberculosis
cgcccaggaacgcgccggc

SEQ ID NO: 858600 - RNA, 20 nt, Mycobacterium avium subsp. paratuberculosis
cgcccaggaacgcgccggcg

SEQ ID NO: 858601 - RNA, 21 nt, Mycobacterium avium subsp. paratuberculosis
cgcccaggaacgcgccggcgc

SEQ ID NO: 858602 - RNA, 22 nt, Mycobacterium avium subsp. paratuberculosis
cgcccaggaacgcgccggcgca

SEQ ID NO: 858603 - RNA, 13 nt, Mycobacterium avium subsp. paratuberculosis
cgcccagcugggc

SEQ ID NO: 858604 - RNA, 15 nt, Mycobacterium avium subsp. paratuberculosis
cgcccagcugggcca

SEQ ID NO: 858605 - RNA, 19 nt, Mycobacterium avium subsp. paratuberculosis
cgcccagcugggccagcgc

SEQ ID NO: 858606 - RNA, 20 nt, Mycobacterium avium subsp. paratuberculosis
cgcccagcugggccagcgcg

SEQ ID NO: 858607 - RNA, 15 nt, Mycobacterium avium subsp. paratuberculosis
cgcccagcggcgaug

SEQ ID NO: 858608 - RNA, 16 nt, Mycobacterium avium subsp. paratuberculosis
cgcccagcggcgaugc

SEQ ID NO: 858609 - RNA, 19 nt, Mycobacterium avium subsp. paratuberculosis
cgcccagcgccgcggcgaa

SEQ ID NO: 858610 - RNA, 15 nt, Mycobacterium avium subsp. paratuberculosis
cgcccagcgccgcgu

SEQ ID NO: 858611 - RNA, 15 nt, Mycobacterium avium subsp. paratuberculosis
cgcccagcggccccg

SEQ ID NO: 858612 - RNA, 15 nt, Mycobacterium avium subsp. paratuberculosis
cgcccagcggcacga

SEQ ID NO: 858613 - RNA, 20 nt, Mycobacterium avium subsp. paratuberculosis
cgcccagcggcacgaaguug

SEQ ID NO: 858614 - RNA, 20 nt, Mycobacterium avium subsp. paratuberculosis
cgcccagcgcgcgaucgccg

SEQ ID NO: 858615 - RNA, 13 nt, Mycobacterium avium subsp. paratuberculosis
cgcccagcgcggc

SEQ ID NO: 858616 - RNA, 16 nt, Mycobacterium avium subsp. paratuberculosis
cgcccagcgcggcggc

SEQ ID NO: 858617 - RNA, 18 nt, Mycobacterium avium subsp. paratuberculosis
cgcccagcgcggcggcca

SEQ ID NO: 858618 - RNA, 20 nt, Mycobacterium avium subsp. paratuberculosis
cgcccagcgcggcggccacc

SEQ ID NO: 858619 - RNA, 18 nt, Mycobacterium avium subsp. paratuberculosis
cgcccagcgcauccacca

SEQ ID NO: 858620 - RNA, 12 nt, Mycobacterium avium subsp. paratuberculosis
cgcccagcgcca

SEQ ID NO: 858621 - RNA, 19 nt, Mycobacterium avium subsp. paratuberculosis
cgcccagcgacucggccag

SEQ ID NO: 858622 - RNA, 14 nt, Mycobacterium avium subsp. paratuberculosis
cgcccagcgcagca

SEQ ID NO: 858623 - RNA, 16 nt, Mycobacterium avium subsp. paratuberculosis
cgcccagcgcagcgcc

SEQ ID NO: 858624 - RNA, 14 nt, Mycobacterium avium subsp. paratuberculosis
cgcccagcgagcug

SEQ ID NO: 858625 - RNA, 20 nt, Mycobacterium avium subsp. paratuberculosis
cgcccagcgagcugccggcg

SEQ ID NO: 858626 - RNA, 21 nt, Mycobacterium avium subsp. paratuberculosis
cgcccagcgagcugccggcgg

SEQ ID NO: 858627 - RNA, 22 nt, Mycobacterium avium subsp. paratuberculosis
cgcccagcgagcugccggcggc

SEQ ID NO: 858628 - RNA, 14 nt, Mycobacterium avium subsp. paratuberculosis
cgcccagcgagucg

SEQ ID NO: 858629 - RNA, 16 nt, Mycobacterium avium subsp. paratuberculosis
cgcccaggugcacccg

SEQ ID NO: 858630 - RNA, 16 nt, Mycobacterium avium subsp. paratuberculosis
cgcccagucgccgccg

SEQ ID NO: 858631 - RNA, 17 nt, Mycobacterium avium subsp. paratuberculosis
cgcccagucgccgccgc

SEQ ID NO: 858632 - RNA, 18 nt, Mycobacterium avium subsp. paratuberculosis
cgcccagucgccgccgcg

SEQ ID NO: 858633 - RNA, 16 nt, Mycobacterium avium subsp. paratuberculosis
cgcccaguugcacggu

SEQ ID NO: 858634 - RNA, 17 nt, Mycobacterium avium subsp. paratuberculosis
cgcccaguugcacggug

SEQ ID NO: 858635 - RNA, 17 nt, Mycobacterium avium subsp. paratuberculosis
cgcccaucggcagcccg

SEQ ID NO: 858636 - RNA, 16 nt, Mycobacterium avium subsp. paratuberculosis
cgcccaucaccccgaa

SEQ ID NO: 858637 - RNA, 16 nt, Mycobacterium avium subsp. paratuberculosis
cgcccaucaccgcacc

SEQ ID NO: 858638 - RNA, 22 nt, Mycobacterium avium subsp. paratuberculosis
cgcccaucagcaggaccaggcc

SEQ ID NO: 858639 - RNA, 17 nt, Mycobacterium avium subsp. paratuberculosis
cgcccaugaucacaccg

SEQ ID NO: 858640 - RNA, 14 nt, Mycobacterium avium subsp. paratuberculosis
cgcccaugcacgau

SEQ ID NO: 858641 - RNA, 19 nt, Mycobacterium avium subsp. paratuberculosis
cgcccaugaacgcgucgcc

SEQ ID NO: 858642 - RNA, 23 nt, Mycobacterium avium subsp. paratuberculosis
cgcccaugaacgcgucgccgugc

SEQ ID NO: 858643 - RNA, 18 nt, Mycobacterium avium subsp. paratuberculosis
cgcccaggggagcggcgg

SEQ ID NO: 858644 - RNA, 19 nt, Mycobacterium avium subsp. paratuberculosis
cgcccaggggagcggcgga

SEQ ID NO: 858645 - RNA, 19 nt, Mycobacterium avium subsp. paratuberculosis
cgcccagguccaccaggug

SEQ ID NO: 858646 - RNA, 22 nt, Mycobacterium avium subsp. paratuberculosis
cgcccagggcgccagauuccga

SEQ ID NO: 858647 - RNA, 13 nt, Mycobacterium avium subsp. paratuberculosis
cgcccagggcgug

SEQ ID NO: 858648 - RNA, 19 nt, Mycobacterium avium subsp. paratuberculosis
cgcccagggcgugcgcggc

SEQ ID NO: 858649 - RNA, 21 nt, Mycobacterium avium subsp. paratuberculosis
cgcccagggcgugcgcggccg

SEQ ID NO: 858650 - RNA, 22 nt, Mycobacterium avium subsp. paratuberculosis
cgcccagggcgugcgcggccgc

SEQ ID NO: 858651 - RNA, 13 nt, Mycobacterium avium subsp. paratuberculosis
cgcccaggcgugc

SEQ ID NO: 858652 - RNA, 21 nt, Mycobacterium avium subsp. paratuberculosis
cgcccaggcgugcgcgugggu

SEQ ID NO: 858653 - RNA, 22 nt, Mycobacterium avium subsp. paratuberculosis
cgcccaggcgugcgcgugggug

SEQ ID NO: 858654 - RNA, 21 nt, Mycobacterium avium subsp. paratuberculosis
cgcccaggcucaggaucagca

SEQ ID NO: 858655 - RNA, 14 nt, Mycobacterium avium subsp. paratuberculosis
cgcccaggccgcca

SEQ ID NO: 858656 - RNA, 17 nt, Mycobacterium avium subsp. paratuberculosis
cgcccaggccccggccg

SEQ ID NO: 858657 - RNA, 20 nt, Mycobacterium avium subsp. paratuberculosis
cgcccaggccccggccgagc

SEQ ID NO: 858658 - RNA, 12 nt, Mycobacterium avium subsp. paratuberculosis
cgcccaggccga

SEQ ID NO: 858659 - RNA, 15 nt, Mycobacterium avium subsp. paratuberculosis
cgcccaggccgagcg

SEQ ID NO: 858660 - RNA, 16 nt, Mycobacterium avium subsp. paratuberculosis
cgcccaggccgagcgc

SEQ ID NO: 858661 - RNA, 18 nt, Mycobacterium avium subsp. paratuberculosis
cgcccaggccgagcgcaa

SEQ ID NO: 858662 - RNA, 22 nt, Mycobacterium avium subsp. paratuberculosis
cgccccagcacgaucccgccgc

SEQ ID NO: 858663 - RNA, 21 nt, Mycobacterium avium subsp. paratuberculosis
cgccccagaacugguccucca

SEQ ID NO: 858664 - RNA, 24 nt, Mycobacterium avium subsp. paratuberculosis
cgccccagacguuuccguccggcg

SEQ ID NO: 858665 - RNA, 14 nt, Mycobacterium avium subsp. paratuberculosis
cgccccacgccugg

SEQ ID NO: 858666 - RNA, 13 nt, Mycobacterium avium subsp. paratuberculosis
cgccccacggcgc

SEQ ID NO: 858667 - RNA, 16 nt, Mycobacterium avium subsp. paratuberculosis
cgccccagggccucgg

SEQ ID NO: 858668 - RNA, 18 nt, Mycobacterium avium subsp. paratuberculosis
cgccccagggccucggcg

SEQ ID NO: 858669 - RNA, 19 nt, Mycobacterium avium subsp. paratuberculosis
cgccccagggccucggcga

SEQ ID NO: 858670 - RNA, 20 nt, Mycobacterium avium subsp. paratuberculosis
cgccccagggccucggcgac

SEQ ID NO: 858671 - RNA, 21 nt, Mycobacterium avium subsp. paratuberculosis
cgccccagggccucggcgacc

SEQ ID NO: 858672 - RNA, 21 nt, Mycobacterium avium subsp. paratuberculosis
cgccccagcccggcuggcagg

SEQ ID NO: 858673 - RNA, 16 nt, Mycobacterium avium subsp. paratuberculosis
cgccccagccgaccag

SEQ ID NO: 858674 - RNA, 17 nt, Mycobacterium avium subsp. paratuberculosis
cgccccagccgaccagu

SEQ ID NO: 858675 - RNA, 14 nt, Mycobacterium avium subsp. paratuberculosis
cgcccccagcgggg

SEQ ID NO: 858676 - RNA, 19 nt, Mycobacterium avium subsp. paratuberculosis
cgccccauugccgcgccgg

SEQ ID NO: 858677 - RNA, 22 nt, Mycobacterium avium subsp. paratuberculosis
cgccccauugccgcgccggggu

SEQ ID NO: 858678 - RNA, 17 nt, Mycobacterium avium subsp. paratuberculosis
cgccccaguuggcgucg

SEQ ID NO: 858679 - RNA, 12 nt, Mycobacterium avium subsp. paratuberculosis
cgccccagcucc

SEQ ID NO: 858680 - RNA, 21 nt, Mycobacterium avium subsp. paratuberculosis
cgccccagguuccggugucga

SEQ ID NO: 858681 - RNA, 13 nt, Mycobacterium avium subsp. paratuberculosis
cgccccagugcag

SEQ ID NO: 858682 - RNA, 16 nt, Mycobacterium avium subsp. paratuberculosis
cgccccgacgugcagc

SEQ ID NO: 858683 - RNA, 19 nt, Mycobacterium avium subsp. paratuberculosis
cgccccgacgugcagcgcc

SEQ ID NO: 858684 - RNA, 20 nt, Mycobacterium avium subsp. paratuberculosis
cgccccgacgugcagcgcca

SEQ ID NO: 858685 - RNA, 23 nt, Mycobacterium avium subsp. paratuberculosis
cgccccgagaucccagcgggaca

SEQ ID NO: 858686 - RNA, 21 nt, Mycobacterium avium subsp. paratuberculosis
cgccccgaaguucgacacggu

SEQ ID NO: 858687 - RNA, 16 nt, Mycobacterium avium subsp. paratuberculosis
cgccccgacagcaacg

SEQ ID NO: 858688 - RNA, 21 nt, Mycobacterium avium subsp. paratuberculosis
cgccccgacagcaacgccagg

SEQ ID NO: 858689 - RNA, 17 nt, Mycobacterium avium subsp. paratuberculosis
cgccccgacaucgccau

SEQ ID NO: 858690 - RNA, 22 nt, Mycobacterium avium subsp. paratuberculosis
cgccccgacaucgccaucagca

SEQ ID NO: 858691 - RNA, 14 nt, Mycobacterium avium subsp. paratuberculosis
cgcccccucggccg

SEQ ID NO: 858692 - RNA, 13 nt, Mycobacterium avium subsp. paratuberculosis
cgcccccugggac

SEQ ID NO: 858693 - RNA, 17 nt, Mycobacterium avium subsp. paratuberculosis
cgccccgaacagcgcca

SEQ ID NO: 858694 - RNA, 13 nt, Mycobacterium avium subsp. paratuberculosis
cgcccccgcggcg

SEQ ID NO: 858695 - RNA, 15 nt, Mycobacterium avium subsp. paratuberculosis
cgcccccgcggcggc

SEQ ID NO: 858696 - RNA, 17 nt, Mycobacterium avium subsp. paratuberculosis
cgcccccgcggcggcca

SEQ ID NO: 858697 - RNA, 14 nt, Mycobacterium avium subsp. paratuberculosis
cgcccccgcggcgu

SEQ ID NO: 858698 - RNA, 15 nt, Mycobacterium avium subsp. paratuberculosis
cgcccccgcggcguc

SEQ ID NO: 858699 - RNA, 14 nt, Mycobacterium avium subsp. paratuberculosis
cgcccccgccgcga

SEQ ID NO: 858700 - RNA, 13 nt, Mycobacterium avium subsp. paratuberculosis
cgcccccgcgacg

SEQ ID NO: 858701 - RNA, 23 nt, Mycobacterium avium subsp. paratuberculosis
cgcccccgcgacguccaucggga

SEQ ID NO: 858702 - RNA, 14 nt, Mycobacterium avium subsp. paratuberculosis
cgcccccgcccaca

SEQ ID NO: 858703 - RNA, 13 nt, Mycobacterium avium subsp. paratuberculosis
cgcccccgacagg

SEQ ID NO: 858704 - RNA, 14 nt, Mycobacterium avium subsp. paratuberculosis
cgcccccgacaggc

SEQ ID NO: 858705 - RNA, 14 nt, Mycobacterium avium subsp. paratuberculosis
cgcccgaaccgcgu

SEQ ID NO: 858706 - RNA, 16 nt, Mycobacterium avium subsp. paratuberculosis
cgcccgaaccgcgucc

SEQ ID NO: 858707 - RNA, 17 nt, Mycobacterium avium subsp. paratuberculosis
cgcccgaaccgcgucca

SEQ ID NO: 858708 - RNA, 20 nt, Mycobacterium avium subsp. paratuberculosis
cgcccgaaccgcguccacga

SEQ ID NO: 858709 - RNA, 16 nt, Mycobacterium avium subsp. paratuberculosis
cgccccuggcgucggg

SEQ ID NO: 858710 - RNA, 20 nt, Mycobacterium avium subsp. paratuberculosis
cgcccgaacucauggcgugc

SEQ ID NO: 858711 - RNA, 14 nt, Mycobacterium avium subsp. paratuberculosis
cgcccgacgacgac

SEQ ID NO: 858712 - RNA, 18 nt, Mycobacterium avium subsp. paratuberculosis
cgccccugagggugucgg

SEQ ID NO: 858713 - RNA, 21 nt, Mycobacterium avium subsp. paratuberculosis
cgccccugagggugucggcga

SEQ ID NO: 858714 - RNA, 23 nt, Mycobacterium avium subsp. paratuberculosis
cgccccugagggugucggcgauc

SEQ ID NO: 858715 - RNA, 15 nt, Mycobacterium avium subsp. paratuberculosis
cgccccgucggucgg

SEQ ID NO: 858716 - RNA, 18 nt, Mycobacterium avium subsp. paratuberculosis
cgccccggucaccccggc

SEQ ID NO: 858717 - RNA, 16 nt, Mycobacterium avium subsp. paratuberculosis
cgccccggucccgccg

SEQ ID NO: 858718 - RNA, 14 nt, Mycobacterium avium subsp. paratuberculosis
cgccccgguccggc

SEQ ID NO: 858719 - RNA, 12 nt, Mycobacterium avium subsp. paratuberculosis
cgccccggucgu

SEQ ID NO: 858720 - RNA, 13 nt, Mycobacterium avium subsp. paratuberculosis
cgccccggcgcug

SEQ ID NO: 858721 - RNA, 14 nt, Mycobacterium avium subsp. paratuberculosis
cgccccggcggcca

SEQ ID NO: 858722 - RNA, 16 nt, Mycobacterium avium subsp. paratuberculosis
cgccccggcggccacg

SEQ ID NO: 858723 - RNA, 12 nt, Mycobacterium avium subsp. paratuberculosis
cgccccggcggg

SEQ ID NO: 858724 - RNA, 13 nt, Mycobacterium avium subsp. paratuberculosis
cgccccggcgggc

SEQ ID NO: 858725 - RNA, 18 nt, Mycobacterium avium subsp. paratuberculosis
cgccccggcgggcggccg

SEQ ID NO: 858726 - RNA, 13 nt, Mycobacterium avium subsp. paratuberculosis
cgccccggcgucg

SEQ ID NO: 858727 - RNA, 14 nt, Mycobacterium avium subsp. paratuberculosis
cgccccggcgucgg

SEQ ID NO: 858728 - RNA, 22 nt, Mycobacterium avium subsp. paratuberculosis
cgccccgggauccgaggcguca

SEQ ID NO: 858729 - RNA, 12 nt, Mycobacterium avium subsp. paratuberculosis
cgccccgggcag

SEQ ID NO: 858730 - RNA, 16 nt, Mycobacterium avium subsp. paratuberculosis
cgccccggcgccgucg

SEQ ID NO: 858731 - RNA, 18 nt, Mycobacterium avium subsp. paratuberculosis
cgccccggccgcgcaccg

SEQ ID NO: 858732 - RNA, 23 nt, Mycobacterium avium subsp. paratuberculosis
cgccccggccguucuugcgggug

SEQ ID NO: 858733 - RNA, 13 nt, Mycobacterium avium subsp. paratuberculosis
cgccccggcgacg

SEQ ID NO: 858734 - RNA, 17 nt, Mycobacterium avium subsp. paratuberculosis
cgccccggcgcagcgcc

SEQ ID NO: 858735 - RNA, 12 nt, Mycobacterium avium subsp. paratuberculosis
cgccccggccgc

SEQ ID NO: 858736 - RNA, 13 nt, Mycobacterium avium subsp. paratuberculosis
cgccccgcuggaa

SEQ ID NO: 858737 - RNA, 15 nt, Mycobacterium avium subsp. paratuberculosis
cgccccggcccggcg

SEQ ID NO: 858738 - RNA, 21 nt, Mycobacterium avium subsp. paratuberculosis
cgccccggcccguccagaucg

SEQ ID NO: 858739 - RNA, 15 nt, Mycobacterium avium subsp. paratuberculosis
cgccccgcgccucgu

SEQ ID NO: 858740 - RNA, 19 nt, Mycobacterium avium subsp. paratuberculosis
cgccccgccgggggagucg

SEQ ID NO: 858741 - RNA, 14 nt, Mycobacterium avium subsp. paratuberculosis
cgccccgccggugu

SEQ ID NO: 858742 - RNA, 13 nt, Mycobacterium avium subsp. paratuberculosis
cgccccgccgcgc

SEQ ID NO: 858743 - RNA, 16 nt, Mycobacterium avium subsp. paratuberculosis
cgccccgccgcgccgg

SEQ ID NO: 858744 - RNA, 14 nt, Mycobacterium avium subsp. paratuberculosis
cgccccgccgcggc

SEQ ID NO: 858745 - RNA, 15 nt, Mycobacterium avium subsp. paratuberculosis
cgccccgccgcggcc

SEQ ID NO: 858746 - RNA, 13 nt, Mycobacterium avium subsp. paratuberculosis
cgccccgcccgcg

SEQ ID NO: 858747 - RNA, 15 nt, Mycobacterium avium subsp. paratuberculosis
cgccccgcccgcgac

SEQ ID NO: 858748 - RNA, 15 nt, Mycobacterium avium subsp. paratuberculosis
cgccccgcccggcgg

SEQ ID NO: 858749 - RNA, 17 nt, Mycobacterium avium subsp. paratuberculosis
cgccccgcccggcggcc

SEQ ID NO: 858750 - RNA, 14 nt, Mycobacterium avium subsp. paratuberculosis
cgccccgcccugcu

SEQ ID NO: 858751 - RNA, 22 nt, Mycobacterium avium subsp. paratuberculosis
cgccccgaucggauccgccugc

SEQ ID NO: 858752 - RNA, 21 nt, Mycobacterium avium subsp. paratuberculosis
cgccccgacgaucgcgccggc

SEQ ID NO: 858753 - RNA, 23 nt, Mycobacterium avium subsp. paratuberculosis
cgccccgcaaccguucaacggcc

SEQ ID NO: 858754 - RNA, 16 nt, Mycobacterium avium subsp. paratuberculosis
cgcccgcugaccgccg

SEQ ID NO: 858755 - RNA, 23 nt, Mycobacterium avium subsp. paratuberculosis
cgcccggaccaggguggccccag

SEQ ID NO: 858756 - RNA, 17 nt, Mycobacterium avium subsp. paratuberculosis
cgcccggaccgcggucg

SEQ ID NO: 858757 - RNA, 18 nt, Mycobacterium avium subsp. paratuberculosis
cgcccggaccgcggucgg

SEQ ID NO: 858758 - RNA, 13 nt, Mycobacterium avium subsp. paratuberculosis
cgcccggaccggc

SEQ ID NO: 858759 - RNA, 20 nt, Mycobacterium avium subsp. paratuberculosis
cgcccggacgcgcacacggc

SEQ ID NO: 858760 - RNA, 15 nt, Mycobacterium avium subsp. paratuberculosis
cgcccggagcugucg

SEQ ID NO: 858761 - RNA, 18 nt, Mycobacterium avium subsp. paratuberculosis
cgcccggagcugucggug

SEQ ID NO: 858762 - RNA, 22 nt, Mycobacterium avium subsp. paratuberculosis
cgcccggagcugucggugacga

SEQ ID NO: 858763 - RNA, 22 nt, Mycobacterium avium subsp. paratuberculosis
cgcccggaggguauucgugugc

SEQ ID NO: 858764 - RNA, 15 nt, Mycobacterium avium subsp. paratuberculosis
cgcccggaucagcug

SEQ ID NO: 858765 - RNA, 12 nt, Mycobacterium avium subsp. paratuberculosis
cgcccggaugcc

SEQ ID NO: 858766 - RNA, 16 nt, Mycobacterium avium subsp. paratuberculosis
cgcccggaugccggcg

SEQ ID NO: 858767 - RNA, 18 nt, Mycobacterium avium subsp. paratuberculosis
cgcccggaugucgggcga

SEQ ID NO: 858768 - RNA, 19 nt, Mycobacterium avium subsp. paratuberculosis
cgcccggauucgcggcggc

SEQ ID NO: 858769 - RNA, 21 nt, Mycobacterium avium subsp. paratuberculosis
cgcccggauucgcggcggcgc

SEQ ID NO: 858770 - RNA, 16 nt, Mycobacterium avium subsp. paratuberculosis
cgcccggcaccgcggc

SEQ ID NO: 858771 - RNA, 15 nt, Mycobacterium avium subsp. paratuberculosis
cgcccggcaccggga

SEQ ID NO: 858772 - RNA, 17 nt, Mycobacterium avium subsp. paratuberculosis
cgcccggcacgaacgcg

SEQ ID NO: 858773 - RNA, 14 nt, Mycobacterium avium subsp. paratuberculosis
cgcccggccggucg

SEQ ID NO: 858774 - RNA, 18 nt, Mycobacterium avium subsp. paratuberculosis
cgcccggccggucgccga

SEQ ID NO: 858775 - RNA, 13 nt, Mycobacterium avium subsp. paratuberculosis
cgcccggcgacca

SEQ ID NO: 858776 - RNA, 16 nt, Mycobacterium avium subsp. paratuberculosis
cgcccggcgaccacca

SEQ ID NO: 858777 - RNA, 20 nt, Mycobacterium avium subsp. paratuberculosis
cgcccggcgaccaccagccg

SEQ ID NO: 858778 - RNA, 15 nt, Mycobacterium avium subsp. paratuberculosis
cgcccggcgacgcgg

SEQ ID NO: 858779 - RNA, 20 nt, Mycobacterium avium subsp. paratuberculosis
cgcccggcgacgcggcggga

SEQ ID NO: 858780 - RNA, 15 nt, Mycobacterium avium subsp. paratuberculosis
cgcccggcgagcagc

SEQ ID NO: 858781 - RNA, 13 nt, Mycobacterium avium subsp. paratuberculosis
cgcccggccaccu

SEQ ID NO: 858782 - RNA, 18 nt, Mycobacterium avium subsp. paratuberculosis
cgcccggccaccuggccg

SEQ ID NO: 858783 - RNA, 16 nt, Mycobacterium avium subsp. paratuberculosis
cgcccggccagccggc

SEQ ID NO: 858784 - RNA, 19 nt, Mycobacterium avium subsp. paratuberculosis
cgcccggccagccgguaug

SEQ ID NO: 858785 - RNA, 21 nt, Mycobacterium avium subsp. paratuberculosis
cgcccggccagguuccaccgg

SEQ ID NO: 858786 - RNA, 15 nt, Mycobacterium avium subsp. paratuberculosis
cgcccggcccagccg

SEQ ID NO: 858787 - RNA, 16 nt, Mycobacterium avium subsp. paratuberculosis
cgcccggcccgcaugc

SEQ ID NO: 858788 - RNA, 16 nt, Mycobacterium avium subsp. paratuberculosis
cgcccggcccggcgcg

SEQ ID NO: 858789 - RNA, 17 nt, Mycobacterium avium subsp. paratuberculosis
cgcccggcccggcgcgg

SEQ ID NO: 858790 - RNA, 19 nt, Mycobacterium avium subsp. paratuberculosis
cgcccggaaagcgcgggca

SEQ ID NO: 858791 - RNA, 16 nt, Mycobacterium avium subsp. paratuberculosis
cgcccgcuugauggcg

SEQ ID NO: 858792 - RNA, 18 nt, Mycobacterium avium subsp. paratuberculosis
cgcccgcuggggcgcacc

SEQ ID NO: 858793 - RNA, 20 nt, Mycobacterium avium subsp. paratuberculosis
cgcccgcuggggcgcaccgc

SEQ ID NO: 858794 - RNA, 22 nt, Mycobacterium avium subsp. paratuberculosis
cgcccgcuggggcgcaccgccu

SEQ ID NO: 858795 - RNA, 12 nt, Mycobacterium avium subsp. paratuberculosis
cgcccgcugcgc

SEQ ID NO: 858796 - RNA, 19 nt, Mycobacterium avium subsp. paratuberculosis
cgcccgcugcgcgggucgg

SEQ ID NO: 858797 - RNA, 22 nt, Mycobacterium avium subsp. paratuberculosis
cgcccgcugcgcgggucggcgc

SEQ ID NO: 858798 - RNA, 16 nt, Mycobacterium avium subsp. paratuberculosis
cgcccgcugcggcgca

SEQ ID NO: 858799 - RNA, 23 nt, Mycobacterium avium subsp. paratuberculosis
cgcccgcugaaagcucgcgucga

SEQ ID NO: 858800 - RNA, 19 nt, Mycobacterium avium subsp. paratuberculosis
cgcccgcgugggcaccccg

SEQ ID NO: 858801 - RNA, 17 nt, Mycobacterium avium subsp. paratuberculosis
cgcccgcguugcggcgc

SEQ ID NO: 858802 - RNA, 20 nt, Mycobacterium avium subsp. paratuberculosis
cgcccgcgucguggcccugc

SEQ ID NO: 858803 - RNA, 18 nt, Mycobacterium avium subsp. paratuberculosis
cgcccgcgggugcagccg

SEQ ID NO: 858804 - RNA, 20 nt, Mycobacterium avium subsp. paratuberculosis
cgcccgcggugugcuggcca

SEQ ID NO: 858805 - RNA, 23 nt, Mycobacterium avium subsp. paratuberculosis
cgcccgcggugugcuggccagca

SEQ ID NO: 858806 - RNA, 17 nt, Mycobacterium avium subsp. paratuberculosis
cgcccgcguacagcagu

SEQ ID NO: 858807 - RNA, 18 nt, Mycobacterium avium subsp. paratuberculosis
cgcccgcguacagcaguu

SEQ ID NO: 858808 - RNA, 22 nt, Mycobacterium avium subsp. paratuberculosis
cgcccgcuccgcgggcagcgag

SEQ ID NO: 858809 - RNA, 16 nt, Mycobacterium avium subsp. paratuberculosis
cgcccgcuccgcggug

SEQ ID NO: 858810 - RNA, 16 nt, Mycobacterium avium subsp. paratuberculosis
cgcccgcuccggcgga

SEQ ID NO: 858811 - RNA, 13 nt, Mycobacterium avium subsp. paratuberculosis
cgcccgcuccugc

SEQ ID NO: 858812 - RNA, 17 nt, Mycobacterium avium subsp. paratuberculosis
cgcccgcucgacggccg

SEQ ID NO: 858813 - RNA, 19 nt, Mycobacterium avium subsp. paratuberculosis
cgcccgcucgacggccggu

SEQ ID NO: 858814 - RNA, 18 nt, Mycobacterium avium subsp. paratuberculosis
cgcccggguugucgacgu

SEQ ID NO: 858815 - RNA, 19 nt, Mycobacterium avium subsp. paratuberculosis
cgcccggguugucgacgug

SEQ ID NO: 858816 - RNA, 17 nt, Mycobacterium avium subsp. paratuberculosis
cgcccggguacaccgac

SEQ ID NO: 858817 - RNA, 16 nt, Mycobacterium avium subsp. paratuberculosis
cgcccggucacccgug

SEQ ID NO: 858818 - RNA, 17 nt, Mycobacterium avium subsp. paratuberculosis
cgcccggucacccgugg

SEQ ID NO: 858819 - RNA, 15 nt, Mycobacterium avium subsp. paratuberculosis
cgcccggggcggcga

SEQ ID NO: 858820 - RNA, 17 nt, Mycobacterium avium subsp. paratuberculosis
cgcccggggcggcgaug

SEQ ID NO: 858821 - RNA, 20 nt, Mycobacterium avium subsp. paratuberculosis
cgcccgggcuaucgcccggc

SEQ ID NO: 858822 - RNA, 22 nt, Mycobacterium avium subsp. paratuberculosis
cgcccgggcuaucgcccggcgc

SEQ ID NO: 858823 - RNA, 23 nt, Mycobacterium avium subsp. paratuberculosis
cgcccgggcuaucgcccggcgcc

SEQ ID NO: 858824 - RNA, 15 nt, Mycobacterium avium subsp. paratuberculosis
cgcccgggucgucgg

SEQ ID NO: 858825 - RNA, 17 nt, Mycobacterium avium subsp. paratuberculosis
cgcccgggugacaacgg

SEQ ID NO: 858826 - RNA, 18 nt, Mycobacterium avium subsp. paratuberculosis
cgcccgggugcaggccca

SEQ ID NO: 858827 - RNA, 20 nt, Mycobacterium avium subsp. paratuberculosis
cgcccgggugcaggcccagc

SEQ ID NO: 858828 - RNA, 19 nt, Mycobacterium avium subsp. paratuberculosis
cgcccgggugcugcggcuc

SEQ ID NO: 858829 - RNA, 21 nt, Mycobacterium avium subsp. paratuberculosis
cgcccgggugcugcggcucca

SEQ ID NO: 858830 - RNA, 14 nt, Mycobacterium avium subsp. paratuberculosis
cgcccggguguggg

SEQ ID NO: 858831 - RNA, 13 nt, Mycobacterium avium subsp. paratuberculosis
cgcccggggcgcg

SEQ ID NO: 858832 - RNA, 14 nt, Mycobacterium avium subsp. paratuberculosis
cgcccggggcgcgg

SEQ ID NO: 858833 - RNA, 17 nt, Mycobacterium avium subsp. paratuberculosis
cgcccggggcgcggacc

SEQ ID NO: 858834 - RNA, 22 nt, Mycobacterium avium subsp. paratuberculosis
cgcccggggcgcggaccgcacc

SEQ ID NO: 858835 - RNA, 17 nt, Mycobacterium avium subsp. paratuberculosis
cgcccgggcggcccgca

SEQ ID NO: 858836 - RNA, 19 nt, Mycobacterium avium subsp. paratuberculosis
cgcccgggcggcccgcauc

SEQ ID NO: 858837 - RNA, 20 nt, Mycobacterium avium subsp. paratuberculosis
cgcccgggcggcccgcaucg

SEQ ID NO: 858838 - RNA, 16 nt, Mycobacterium avium subsp. paratuberculosis
cgcccgggcggcccgg

SEQ ID NO: 858839 - RNA, 13 nt, Mycobacterium avium subsp. paratuberculosis
cgcccgggcggcg

SEQ ID NO: 858840 - RNA, 14 nt, Mycobacterium avium subsp. paratuberculosis
cgcccgggcggcgg

SEQ ID NO: 858841 - RNA, 19 nt, Mycobacterium avium subsp. paratuberculosis
cgcccgggcggcggggcug

SEQ ID NO: 858842 - RNA, 22 nt, Mycobacterium avium subsp. paratuberculosis
cgcccgggcggcggggcugccc

SEQ ID NO: 858843 - RNA, 12 nt, Mycobacterium avium subsp. paratuberculosis
cgcccgggcgcg

SEQ ID NO: 858844 - RNA, 20 nt, Mycobacterium avium subsp. paratuberculosis
cgcccgggcacgacggucag

SEQ ID NO: 858845 - RNA, 17 nt, Mycobacterium avium subsp. paratuberculosis
cgcccgggccaggaccg

SEQ ID NO: 858846 - RNA, 17 nt, Mycobacterium avium subsp. paratuberculosis
cgcccgggccaggcgcg

SEQ ID NO: 858847 - RNA, 17 nt, Mycobacterium avium subsp. paratuberculosis
cgcccgggccgcgccca

SEQ ID NO: 858848 - RNA, 15 nt, Mycobacterium avium subsp. paratuberculosis
cgcccggcugcgccg

SEQ ID NO: 858849 - RNA, 21 nt, Mycobacterium avium subsp. paratuberculosis
cgcccggcugcgccgcgcuug

SEQ ID NO: 858850 - RNA, 15 nt, Mycobacterium avium subsp. paratuberculosis
cgcccggcuucgccg

SEQ ID NO: 858851 - RNA, 21 nt, Mycobacterium avium subsp. paratuberculosis
cgcccggcuucgccgcgcuug

SEQ ID NO: 858852 - RNA, 23 nt, Mycobacterium avium subsp. paratuberculosis
cgcccggcucaaaccguugacca

SEQ ID NO: 858853 - RNA, 20 nt, Mycobacterium avium subsp. paratuberculosis
cgcccggcuccacgaugccc

SEQ ID NO: 858854 - RNA, 14 nt, Mycobacterium avium subsp. paratuberculosis
cgcccggcucgccg

SEQ ID NO: 858855 - RNA, 20 nt, Mycobacterium avium subsp. paratuberculosis
cgcccggcuccccgaccaca

SEQ ID NO: 858856 - RNA, 15 nt, Mycobacterium avium subsp. paratuberculosis
cgcccggcggcgcug

SEQ ID NO: 858857 - RNA, 13 nt, Mycobacterium avium subsp. paratuberculosis
cgcccggcgucca

SEQ ID NO: 858858 - RNA, 13 nt, Mycobacterium avium subsp. paratuberculosis
cgcccggcgucgg

SEQ ID NO: 858859 - RNA, 12 nt, Mycobacterium avium subsp. paratuberculosis
cgcccggcggcc

SEQ ID NO: 858860 - RNA, 15 nt, Mycobacterium avium subsp. paratuberculosis
cgcccggcggccacc

SEQ ID NO: 858861 - RNA, 18 nt, Mycobacterium avium subsp. paratuberculosis
cgcccggcgcgcagccca

SEQ ID NO: 858862 - RNA, 23 nt, Mycobacterium avium subsp. paratuberculosis
cgcccggcgcgcagcccagccag

SEQ ID NO: 858863 - RNA, 14 nt, Mycobacterium avium subsp. paratuberculosis
cgcccggcgcgcca

SEQ ID NO: 858864 - RNA, 17 nt, Mycobacterium avium subsp. paratuberculosis
cgcccggcgcggcaucg

SEQ ID NO: 858865 - RNA, 20 nt, Mycobacterium avium subsp. paratuberculosis
cgcccggcgcggcaucggcg

SEQ ID NO: 858866 - RNA, 23 nt, Mycobacterium avium subsp. paratuberculosis
cgcccggcgcggcaucggcgacg

SEQ ID NO: 858867 - RNA, 14 nt, Mycobacterium avium subsp. paratuberculosis
cgcccggcgccggc

SEQ ID NO: 858868 - RNA, 15 nt, Mycobacterium avium subsp. paratuberculosis
cgcccggcgccggcc

SEQ ID NO: 858869 - RNA, 19 nt, Mycobacterium avium subsp. paratuberculosis
cgcccggcgccggcccgcg

SEQ ID NO: 858870 - RNA, 15 nt, Mycobacterium avium subsp. paratuberculosis
cgcccggcgccggcg

SEQ ID NO: 858871 - RNA, 16 nt, Mycobacterium avium subsp. paratuberculosis
cgcccggcgccggcgg

SEQ ID NO: 858872 - RNA, 17 nt, Mycobacterium avium subsp. paratuberculosis
cgcccggcgccggcggc

SEQ ID NO: 858873 - RNA, 21 nt, Mycobacterium avium subsp. paratuberculosis
cgcccggcgccggcggccacg

SEQ ID NO: 858874 - RNA, 13 nt, Mycobacterium avium subsp. paratuberculosis
cgcccggcgcccg

SEQ ID NO: 858875 - RNA, 14 nt, Mycobacterium avium subsp. paratuberculosis
cgcccggcgcccgg

SEQ ID NO: 858876 - RNA, 15 nt, Mycobacterium avium subsp. paratuberculosis
cgcccggcgcccggc

SEQ ID NO: 858877 - RNA, 18 nt, Mycobacterium avium subsp. paratuberculosis
cgcccggcgcccggccgg

SEQ ID NO: 858878 - RNA, 20 nt, Mycobacterium avium subsp. paratuberculosis
cgcccggcgcccggccggcc

SEQ ID NO: 858879 - RNA, 18 nt, Mycobacterium avium subsp. paratuberculosis
cgcccggcgcccggcgcg

SEQ ID NO: 858880 - RNA, 12 nt, Mycobacterium avium subsp. paratuberculosis
cgcccggcgccg

SEQ ID NO: 858881 - RNA, 16 nt, Mycobacterium avium subsp. paratuberculosis
cgcccggcgccgaucu

SEQ ID NO: 858882 - RNA, 16 nt, Mycobacterium avium subsp. paratuberculosis
cgcccgaucggcaccc

SEQ ID NO: 858883 - RNA, 24 nt, Mycobacterium avium subsp. paratuberculosis
cgcccgauggaggugccgcgcagc

SEQ ID NO: 858884 - RNA, 18 nt, Mycobacterium avium subsp. paratuberculosis
cgcccgauuccccggcgu

SEQ ID NO: 858885 - RNA, 20 nt, Mycobacterium avium subsp. paratuberculosis
cgcccgauuccccggcgugu

SEQ ID NO: 858886 - RNA, 16 nt, Mycobacterium avium subsp. paratuberculosis
cgcccgauucgcggcc

SEQ ID NO: 858887 - RNA, 19 nt, Mycobacterium avium subsp. paratuberculosis
cgcccgauucgcggccacc

SEQ ID NO: 858888 - RNA, 13 nt, Mycobacterium avium subsp. paratuberculosis
cgcccgcaccacg

SEQ ID NO: 858889 - RNA, 15 nt, Mycobacterium avium subsp. paratuberculosis
cgcccgcaccacgac

SEQ ID NO: 858890 - RNA, 12 nt, Mycobacterium avium subsp. paratuberculosis
cgcccgcaccag

SEQ ID NO: 858891 - RNA, 22 nt, Mycobacterium avium subsp. paratuberculosis
cgcccgcaguucggccgccgug

SEQ ID NO: 858892 - RNA, 16 nt, Mycobacterium avium subsp. paratuberculosis
cgcccgcaccugcgcg

SEQ ID NO: 858893 - RNA, 19 nt, Mycobacterium avium subsp. paratuberculosis
cgcccgcaccugcgcgccg

SEQ ID NO: 858894 - RNA, 22 nt, Mycobacterium avium subsp. paratuberculosis
cgcccgcaccugcgcgccguug

SEQ ID NO: 858895 - RNA, 14 nt, Mycobacterium avium subsp. paratuberculosis
cgcccgcagcacgc

SEQ ID NO: 858896 - RNA, 11 nt, Mycobacterium avium subsp. paratuberculosis
cgcccgcagcg

SEQ ID NO: 858897 - RNA, 14 nt, Mycobacterium avium subsp. paratuberculosis
cgcccgcagcggcg

SEQ ID NO: 858898 - RNA, 23 nt, Mycobacterium avium subsp. paratuberculosis
cgcccgcagcggcgguugcucgu

SEQ ID NO: 858899 - RNA, 13 nt, Mycobacterium avium subsp. paratuberculosis
cgcccgaucggcg

SEQ ID NO: 858900 - RNA, 20 nt, Mycobacterium avium subsp. paratuberculosis
cgcccgaucugggaucggug

SEQ ID NO: 858901 - RNA, 22 nt, Mycobacterium avium subsp. paratuberculosis
cgcccgaucugggaucggugcg

SEQ ID NO: 858902 - RNA, 19 nt, Mycobacterium avium subsp. paratuberculosis
cgcccgaucccgucgucgg

SEQ ID NO: 858903 - RNA, 21 nt, Mycobacterium avium subsp. paratuberculosis
cgcccgaucccgucgucggcg

SEQ ID NO: 858904 - RNA, 23 nt, Mycobacterium avium subsp. paratuberculosis
cgcccgaucccgucgucggcgcc

SEQ ID NO: 858905 - RNA, 17 nt, Mycobacterium avium subsp. paratuberculosis
cgcccgagucacccggc

SEQ ID NO: 858906 - RNA, 16 nt, Mycobacterium avium subsp. paratuberculosis
cgcccgagcgucauuc

SEQ ID NO: 858907 - RNA, 23 nt, Mycobacterium avium subsp. paratuberculosis
cgcccgagcgucauuccgccgcg

SEQ ID NO: 858908 - RNA, 20 nt, Mycobacterium avium subsp. paratuberculosis
cgcccgagaguccgccgccg

SEQ ID NO: 858909 - RNA, 21 nt, Mycobacterium avium subsp. paratuberculosis
cgcccgagcauuucgcgcacg

SEQ ID NO: 858910 - RNA, 23 nt, Mycobacterium avium subsp. paratuberculosis
cgcccgagcauuucgcgcacguc

SEQ ID NO: 858911 - RNA, 19 nt, Mycobacterium avium subsp. paratuberculosis
cgcccgacggucgccacca

SEQ ID NO: 858912 - RNA, 20 nt, Mycobacterium avium subsp. paratuberculosis
cgcccgacggucgccaccac

SEQ ID NO: 858913 - RNA, 14 nt, Mycobacterium avium subsp. paratuberculosis
cgcccgacgccgga

SEQ ID NO: 858914 - RNA, 16 nt, Mycobacterium avium subsp. paratuberculosis
cgcccgacgccggacc

SEQ ID NO: 858915 - RNA, 20 nt, Mycobacterium avium subsp. paratuberculosis
cgcccgacgaugcggggcgg

SEQ ID NO: 858916 - RNA, 22 nt, Mycobacterium avium subsp. paratuberculosis
cgcccgacgaugcggggcggcg

SEQ ID NO: 858917 - RNA, 18 nt, Mycobacterium avium subsp. paratuberculosis
cgcccgcccaggccgcca

SEQ ID NO: 858918 - RNA, 16 nt, Mycobacterium avium subsp. paratuberculosis
cgcccgccccgacgug

SEQ ID NO: 858919 - RNA, 12 nt, Mycobacterium avium subsp. paratuberculosis
cgcccgccaucu

SEQ ID NO: 858920 - RNA, 12 nt, Mycobacterium avium subsp. paratuberculosis
cgcccgccgcca

SEQ ID NO: 858921 - RNA, 16 nt, Mycobacterium avium subsp. paratuberculosis
cgcccgccgccaccac

SEQ ID NO: 858922 - RNA, 13 nt, Mycobacterium avium subsp. paratuberculosis
cgcccgccgaaca

SEQ ID NO: 858923 - RNA, 15 nt, Mycobacterium avium subsp. paratuberculosis
cgcccgccgaacacc

SEQ ID NO: 858924 - RNA, 18 nt, Mycobacterium avium subsp. paratuberculosis
cgcccgccgaacaccggc

SEQ ID NO: 858925 - RNA, 20 nt, Mycobacterium avium subsp. paratuberculosis
cgcccgccgaacaccggcag

SEQ ID NO: 858926 - RNA, 17 nt, Mycobacterium avium subsp. paratuberculosis
cgcccgcccggcccggc

SEQ ID NO: 858927 - RNA, 19 nt, Mycobacterium avium subsp. paratuberculosis
cgcccgcccggcccggcgc

SEQ ID NO: 858928 - RNA, 23 nt, Mycobacterium avium subsp. paratuberculosis
cgcccgccgggcacccgggugga

SEQ ID NO: 858929 - RNA, 15 nt, Mycobacterium avium subsp. paratuberculosis
cgcccgccggcccag

SEQ ID NO: 858930 - RNA, 16 nt, Mycobacterium avium subsp. paratuberculosis
cgcccgccggcccagc

SEQ ID NO: 858931 - RNA, 13 nt, Mycobacterium avium subsp. paratuberculosis
cgcccgccgcgac

SEQ ID NO: 858932 - RNA, 14 nt, Mycobacterium avium subsp. paratuberculosis
cgcccgccgcgagc

SEQ ID NO: 858933 - RNA, 16 nt, Mycobacterium avium subsp. paratuberculosis
cgcccgccgcgagccg

SEQ ID NO: 858934 - RNA, 21 nt, Mycobacterium avium subsp. paratuberculosis
cgcccgccgcgagccgcccag

SEQ ID NO: 858935 - RNA, 12 nt, Mycobacterium avium subsp. paratuberculosis
cgcccgcggcgc

SEQ ID NO: 858936 - RNA, 14 nt, Mycobacterium avium subsp. paratuberculosis
cgcccgcggcgcgc

SEQ ID NO: 858937 - RNA, 14 nt, Mycobacterium avium subsp. paratuberculosis
cgcccgcggccucc

SEQ ID NO: 858938 - RNA, 15 nt, Mycobacterium avium subsp. paratuberculosis
cgcccgcggccucca

SEQ ID NO: 858939 - RNA, 11 nt, Mycobacterium avium subsp. paratuberculosis
cgcccgcggcg

SEQ ID NO: 858940 - RNA, 13 nt, Mycobacterium avium subsp. paratuberculosis
cgcccgcggccau

SEQ ID NO: 858941 - RNA, 15 nt, Mycobacterium avium subsp. paratuberculosis
cgcccgcggccaucg

SEQ ID NO: 858942 - RNA, 12 nt, Mycobacterium avium subsp. paratuberculosis
cgcccgcggcca

SEQ ID NO: 858943 - RNA, 20 nt, Mycobacterium avium subsp. paratuberculosis
cgcccgcgcgcucgggggug

SEQ ID NO: 858944 - RNA, 14 nt, Mycobacterium avium subsp. paratuberculosis
cgcccgcgcuggug

SEQ ID NO: 858945 - RNA, 15 nt, Mycobacterium avium subsp. paratuberculosis
cgcccgcgcuggugc

SEQ ID NO: 858946 - RNA, 16 nt, Mycobacterium avium subsp. paratuberculosis
cgcccgcgcuggugcu

SEQ ID NO: 858947 - RNA, 15 nt, Mycobacterium avium subsp. paratuberculosis
cgcccgcgcgaugcg

SEQ ID NO: 858948 - RNA, 22 nt, Mycobacterium avium subsp. paratuberculosis
cgcccgcgcgaugcgggcgccg

SEQ ID NO: 858949 - RNA, 14 nt, Mycobacterium avium subsp. paratuberculosis
cgcccgcgccaccc

SEQ ID NO: 858950 - RNA, 16 nt, Mycobacterium avium subsp. paratuberculosis
cgcccgcgccaccccg

SEQ ID NO: 858951 - RNA, 18 nt, Mycobacterium avium subsp. paratuberculosis
cgcccgcgccaccccgag

SEQ ID NO: 858952 - RNA, 13 nt, Mycobacterium avium subsp. paratuberculosis
cgcccgcgaucgg

SEQ ID NO: 858953 - RNA, 15 nt, Mycobacterium avium subsp. paratuberculosis
cgcccgcgaucggcg

SEQ ID NO: 858954 - RNA, 12 nt, Mycobacterium avium subsp. paratuberculosis
cgcccgcgaccc

SEQ ID NO: 858955 - RNA, 16 nt, Mycobacterium avium subsp. paratuberculosis
cgcccgcgacccgaac

SEQ ID NO: 858956 - RNA, 17 nt, Mycobacterium avium subsp. paratuberculosis
cgccgaacaacggcgga

SEQ ID NO: 858957 - RNA, 18 nt, Mycobacterium avium subsp. paratuberculosis
cgccgaacaacggcggac

SEQ ID NO: 858958 - RNA, 20 nt, Mycobacterium avium subsp. paratuberculosis
cgccgaacaacggcggaccg

SEQ ID NO: 858959 - RNA, 23 nt, Mycobacterium avium subsp. paratuberculosis
cgccgaacaacggcggaccggcg

SEQ ID NO: 858960 - RNA, 14 nt, Mycobacterium avium subsp. paratuberculosis
cgccgaacaccacg

SEQ ID NO: 858961 - RNA, 20 nt, Mycobacterium avium subsp. paratuberculosis
cgccgaacaccacgccgagc

SEQ ID NO: 858962 - RNA, 18 nt, Mycobacterium avium subsp. paratuberculosis
cgccgaaaugccgugcca

SEQ ID NO: 858963 - RNA, 19 nt, Mycobacterium avium subsp. paratuberculosis
cgccgaaaugccgugccag

SEQ ID NO: 858964 - RNA, 13 nt, Mycobacterium avium subsp. paratuberculosis
cgccgaaacccgc

SEQ ID NO: 858965 - RNA, 16 nt, Mycobacterium avium subsp. paratuberculosis
cgccgaaacccgcugu

SEQ ID NO: 858966 - RNA, 17 nt, Mycobacterium avium subsp. paratuberculosis
cgccgaaacaccggcuu

SEQ ID NO: 858967 - RNA, 15 nt, Mycobacterium avium subsp. paratuberculosis
cgccgaacgcaccac

SEQ ID NO: 858968 - RNA, 17 nt, Mycobacterium avium subsp. paratuberculosis
cgccgaacgcaccaccg

SEQ ID NO: 858969 - RNA, 22 nt, Mycobacterium avium subsp. paratuberculosis
cgccgaacgcaccaccgcggug

SEQ ID NO: 858970 - RNA, 14 nt, Mycobacterium avium subsp. paratuberculosis
cgccgaacgccacc

SEQ ID NO: 858971 - RNA, 15 nt, Mycobacterium avium subsp. paratuberculosis
cgccgaacgccacca

SEQ ID NO: 858972 - RNA, 17 nt, Mycobacterium avium subsp. paratuberculosis
cgccgaacccgcccucg

SEQ ID NO: 858973 - RNA, 20 nt, Mycobacterium avium subsp. paratuberculosis
cgccgaacccgcccucgccc

SEQ ID NO: 858974 - RNA, 15 nt, Mycobacterium avium subsp. paratuberculosis
cgccgaaccgaucac

SEQ ID NO: 858975 - RNA, 22 nt, Mycobacterium avium subsp. paratuberculosis
cgccgaaccgaucaccggcagc

SEQ ID NO: 858976 - RNA, 15 nt, Mycobacterium avium subsp. paratuberculosis
cgccgaaccgggcgc

SEQ ID NO: 858977 - RNA, 20 nt, Mycobacterium avium subsp. paratuberculosis
cgccgaaccggggccgcacc

SEQ ID NO: 858978 - RNA, 18 nt, Mycobacterium avium subsp. paratuberculosis
cgccgaaccgggugacga

SEQ ID NO: 858979 - RNA, 22 nt, Mycobacterium avium subsp. paratuberculosis
cgccgaaccgucccacacgggu

SEQ ID NO: 858980 - RNA, 17 nt, Mycobacterium avium subsp. paratuberculosis
cgccgaacaccugcggc

SEQ ID NO: 858981 - RNA, 18 nt, Mycobacterium avium subsp. paratuberculosis
cgccgaacaccugcggcg

SEQ ID NO: 858982 - RNA, 19 nt, Mycobacterium avium subsp. paratuberculosis
cgccgaacaccugcggcgg

SEQ ID NO: 858983 - RNA, 20 nt, Mycobacterium avium subsp. paratuberculosis
cgccgaacaccugcggcggc

SEQ ID NO: 858984 - RNA, 19 nt, Mycobacterium avium subsp. paratuberculosis
cgccgaacaccggcagcgc

SEQ ID NO: 858985 - RNA, 13 nt, Mycobacterium avium subsp. paratuberculosis
cgccgaacagccg

SEQ ID NO: 858986 - RNA, 17 nt, Mycobacterium avium subsp. paratuberculosis
cgccgaacagccgggug

SEQ ID NO: 858987 - RNA, 21 nt, Mycobacterium avium subsp. paratuberculosis
cgccgaacgugcacucagggc

SEQ ID NO: 858988 - RNA, 17 nt, Mycobacterium avium subsp. paratuberculosis
cgccgaacgugcgcggc

SEQ ID NO: 858989 - RNA, 19 nt, Mycobacterium avium subsp. paratuberculosis
cgccgaacgugcgcggcgc

SEQ ID NO: 858990 - RNA, 19 nt, Mycobacterium avium subsp. paratuberculosis
cgccgaacgccaccaccuc

SEQ ID NO: 858991 - RNA, 22 nt, Mycobacterium avium subsp. paratuberculosis
cgccgaacgccggauuggcguc

SEQ ID NO: 858992 - RNA, 18 nt, Mycobacterium avium subsp. paratuberculosis
cgccgaacgccuccgccg

SEQ ID NO: 858993 - RNA, 19 nt, Mycobacterium avium subsp. paratuberculosis
cgccgaacgccuccgccgc

SEQ ID NO: 858994 - RNA, 20 nt, Mycobacterium avium subsp. paratuberculosis
cgccgaacgccuccgccgcc

SEQ ID NO: 858995 - RNA, 19 nt, Mycobacterium avium subsp. paratuberculosis
cgccgaagcccgagcguca

SEQ ID NO: 858996 - RNA, 19 nt, Mycobacterium avium subsp. paratuberculosis
cgccgaagaucagcgcguc

SEQ ID NO: 858997 - RNA, 18 nt, Mycobacterium avium subsp. paratuberculosis
cgccgaagauggccagcg

SEQ ID NO: 858998 - RNA, 21 nt, Mycobacterium avium subsp. paratuberculosis
cgccgaagauggccagcgcgg

SEQ ID NO: 858999 - RNA, 18 nt, Mycobacterium avium subsp. paratuberculosis
cgccgaacucggcgccgc

SEQ ID NO: 859000 - RNA, 20 nt, Mycobacterium avium subsp. paratuberculosis
cgccgaacucggcgccgccg

SEQ ID NO: 859001 - RNA, 21 nt, Mycobacterium avium subsp. paratuberculosis
cgccgaacucggcgccgccgg

SEQ ID NO: 859002 - RNA, 15 nt, Mycobacterium avium subsp. paratuberculosis
cgccgaagccggcuc

SEQ ID NO: 859003 - RNA, 17 nt, Mycobacterium avium subsp. paratuberculosis
cgccgaagccggcucga

SEQ ID NO: 859004 - RNA, 19 nt, Mycobacterium avium subsp. paratuberculosis
cgccgaagccggcucgaaa

SEQ ID NO: 859005 - RNA, 16 nt, Mycobacterium avium subsp. paratuberculosis
cgccgaagccgucgac

SEQ ID NO: 859006 - RNA, 23 nt, Mycobacterium avium subsp. paratuberculosis
cgccgaagccgucgaccccgccg

SEQ ID NO: 859007 - RNA, 19 nt, Mycobacterium avium subsp. paratuberculosis
cgccgaagcggcgcacgca

SEQ ID NO: 859008 - RNA, 15 nt, Mycobacterium avium subsp. paratuberculosis
cgcccugggggucgg

SEQ ID NO: 859009 - RNA, 20 nt, Mycobacterium avium subsp. paratuberculosis
cgcccugggggucggugacc

SEQ ID NO: 859010 - RNA, 18 nt, Mycobacterium avium subsp. paratuberculosis
cgcccugguaggccugga

SEQ ID NO: 859011 - RNA, 21 nt, Mycobacterium avium subsp. paratuberculosis
cgcccugguaggccuggaacc

SEQ ID NO: 859012 - RNA, 12 nt, Mycobacterium avium subsp. paratuberculosis
cgcccuggugca

SEQ ID NO: 859013 - RNA, 18 nt, Mycobacterium avium subsp. paratuberculosis
cgcccuggugcaacaccg

SEQ ID NO: 859014 - RNA, 19 nt, Mycobacterium avium subsp. paratuberculosis
cgcccuggugcaacaccga

SEQ ID NO: 859015 - RNA, 19 nt, Mycobacterium avium subsp. paratuberculosis
cgcccugguugauccagcg

SEQ ID NO: 859016 - RNA, 20 nt, Mycobacterium avium subsp. paratuberculosis
cgcccuggcuguagcggucg

SEQ ID NO: 859017 - RNA, 16 nt, Mycobacterium avium subsp. paratuberculosis
cgcccuggccgccggc

SEQ ID NO: 859018 - RNA, 18 nt, Mycobacterium avium subsp. paratuberculosis
cgcccuggccgccggccg

SEQ ID NO: 859019 - RNA, 21 nt, Mycobacterium avium subsp. paratuberculosis
cgcccuggccgccggccgcgc

SEQ ID NO: 859020 - RNA, 14 nt, Mycobacterium avium subsp. paratuberculosis
cgcccuggcauccg

SEQ ID NO: 859021 - RNA, 17 nt, Mycobacterium avium subsp. paratuberculosis
cgcccuggcauccgucg

SEQ ID NO: 859022 - RNA, 18 nt, Mycobacterium avium subsp. paratuberculosis
cgcccuggcauccgucgg

SEQ ID NO: 859023 - RNA, 21 nt, Mycobacterium avium subsp. paratuberculosis
cgcccuggcauccgucggccu

SEQ ID NO: 859024 - RNA, 13 nt, Mycobacterium avium subsp. paratuberculosis
cgcccuggcccca

SEQ ID NO: 859025 - RNA, 13 nt, Mycobacterium avium subsp. paratuberculosis
cgcccuuccagca

SEQ ID NO: 859026 - RNA, 15 nt, Mycobacterium avium subsp. paratuberculosis
cgcccuuccagcacc

SEQ ID NO: 859027 - RNA, 16 nt, Mycobacterium avium subsp. paratuberculosis
cgcccuuccagcaccc

SEQ ID NO: 859028 - RNA, 15 nt, Mycobacterium avium subsp. paratuberculosis
cgcccuucccggucg

SEQ ID NO: 859029 - RNA, 17 nt, Mycobacterium avium subsp. paratuberculosis
cgcccuucccggucggc

SEQ ID NO: 859030 - RNA, 15 nt, Mycobacterium avium subsp. paratuberculosis
cgcccuucuucgcgg

SEQ ID NO: 859031 - RNA, 16 nt, Mycobacterium avium subsp. paratuberculosis
cgcccuugagcacggu

SEQ ID NO: 859032 - RNA, 14 nt, Mycobacterium avium subsp. paratuberculosis
cgcccuugaucguc

SEQ ID NO: 859033 - RNA, 16 nt, Mycobacterium avium subsp. paratuberculosis
cgccgaaaaacgcgac

SEQ ID NO: 859034 - RNA, 17 nt, Mycobacterium avium subsp. paratuberculosis
cgcccuuguugauggug

SEQ ID NO: 859035 - RNA, 19 nt, Mycobacterium avium subsp. paratuberculosis
cgcccuugcucgcggcgua

SEQ ID NO: 859036 - RNA, 21 nt, Mycobacterium avium subsp. paratuberculosis
cgcccuugcucgcggcguagg

SEQ ID NO: 859037 - RNA, 23 nt, Mycobacterium avium subsp. paratuberculosis
cgcccuugcucgcggcguaggcg

SEQ ID NO: 859038 - RNA, 15 nt, Mycobacterium avium subsp. paratuberculosis
cgcccuuggccuccg

SEQ ID NO: 859039 - RNA, 20 nt, Mycobacterium avium subsp. paratuberculosis
cgcccuuggcgcccagcgug

SEQ ID NO: 859040 - RNA, 19 nt, Mycobacterium avium subsp. paratuberculosis
cgcccuugagcuucccggc

SEQ ID NO: 859041 - RNA, 21 nt, Mycobacterium avium subsp. paratuberculosis
cgcccuugagcuucccggcgg

SEQ ID NO: 859042 - RNA, 14 nt, Mycobacterium avium subsp. paratuberculosis
cgcccuugccgaug

SEQ ID NO: 859043 - RNA, 19 nt, Mycobacterium avium subsp. paratuberculosis
cgcccugcacccagccgug

SEQ ID NO: 859044 - RNA, 22 nt, Mycobacterium avium subsp. paratuberculosis
cgcccugcacccagccgugccc

SEQ ID NO: 859045 - RNA, 14 nt, Mycobacterium avium subsp. paratuberculosis
cgcccugcccgucg

SEQ ID NO: 859046 - RNA, 18 nt, Mycobacterium avium subsp. paratuberculosis
cgcccugcccgucgggcg

SEQ ID NO: 859047 - RNA, 21 nt, Mycobacterium avium subsp. paratuberculosis
cgcccugcccgucgggcgcgg

SEQ ID NO: 859048 - RNA, 17 nt, Mycobacterium avium subsp. paratuberculosis
cgcccugcagccgggug

SEQ ID NO: 859049 - RNA, 15 nt, Mycobacterium avium subsp. paratuberculosis
cgcccugcagcgcga

SEQ ID NO: 859050 - RNA, 19 nt, Mycobacterium avium subsp. paratuberculosis
cgcccugcgggaacagcgg

SEQ ID NO: 859051 - RNA, 15 nt, Mycobacterium avium subsp. paratuberculosis
cgcccugcugggagc

SEQ ID NO: 859052 - RNA, 21 nt, Mycobacterium avium subsp. paratuberculosis
cgcccugcugggagcggccca

SEQ ID NO: 859053 - RNA, 23 nt, Mycobacterium avium subsp. paratuberculosis
cgcccugcugggagcggcccaac

SEQ ID NO: 859054 - RNA, 18 nt, Mycobacterium avium subsp. paratuberculosis
cgcccucucacggcggua

SEQ ID NO: 859055 - RNA, 15 nt, Mycobacterium avium subsp. paratuberculosis
cgcccugacacagca

SEQ ID NO: 859056 - RNA, 23 nt, Mycobacterium avium subsp. paratuberculosis
cgcccugacacagcaccggcguc

SEQ ID NO: 859057 - RNA, 14 nt, Mycobacterium avium subsp. paratuberculosis
cgcccucggcgauc

SEQ ID NO: 859058 - RNA, 21 nt, Mycobacterium avium subsp. paratuberculosis
cgcccucgggguacucggcgg

SEQ ID NO: 859059 - RNA, 22 nt, Mycobacterium avium subsp. paratuberculosis
cgcccucgggguacucggcggc

SEQ ID NO: 859060 - RNA, 23 nt, Mycobacterium avium subsp. paratuberculosis
cgcccucgggguacucggcggcg

SEQ ID NO: 859061 - RNA, 21 nt, Mycobacterium avium subsp. paratuberculosis
cgcccucgucuuccgcggcgg

SEQ ID NO: 859062 - RNA, 21 nt, Mycobacterium avium subsp. paratuberculosis
cgcccucgauaauggcggccg

SEQ ID NO: 859063 - RNA, 17 nt, Mycobacterium avium subsp. paratuberculosis
cgcccucgaucgcgacc

SEQ ID NO: 859064 - RNA, 21 nt, Mycobacterium avium subsp. paratuberculosis
cgcccucgaucgcgaccaccg

SEQ ID NO: 859065 - RNA, 16 nt, Mycobacterium avium subsp. paratuberculosis
cgcccuccuggcgggu

SEQ ID NO: 859066 - RNA, 18 nt, Mycobacterium avium subsp. paratuberculosis
cgcccuccuggcgggugg

SEQ ID NO: 859067 - RNA, 23 nt, Mycobacterium avium subsp. paratuberculosis
cgcccuccuggcggguggcgaug

SEQ ID NO: 859068 - RNA, 20 nt, Mycobacterium avium subsp. paratuberculosis
cgcccucgaugcgcaccgug

SEQ ID NO: 859069 - RNA, 18 nt, Mycobacterium avium subsp. paratuberculosis
cgcccucgcgcagggcca

SEQ ID NO: 859070 - RNA, 17 nt, Mycobacterium avium subsp. paratuberculosis
cgcccucgcccucgcug

SEQ ID NO: 859071 - RNA, 18 nt, Mycobacterium avium subsp. paratuberculosis
cgcccucgccggcggcgc

SEQ ID NO: 859072 - RNA, 15 nt, Mycobacterium avium subsp. paratuberculosis
cgcccucggccguac

SEQ ID NO: 859073 - RNA, 22 nt, Mycobacterium avium subsp. paratuberculosis
cgcccucggccguaccggcgua

SEQ ID NO: 859074 - RNA, 17 nt, Mycobacterium avium subsp. paratuberculosis
cgcccuaacgugcccgg

SEQ ID NO: 859075 - RNA, 18 nt, Mycobacterium avium subsp. paratuberculosis
cgcccuaacgugcccggc

SEQ ID NO: 859076 - RNA, 18 nt, Mycobacterium avium subsp. paratuberculosis
cgcccguucgagcgccgg

SEQ ID NO: 859077 - RNA, 20 nt, Mycobacterium avium subsp. paratuberculosis
cgcccguucgagcgccggac

SEQ ID NO: 859078 - RNA, 15 nt, Mycobacterium avium subsp. paratuberculosis
cgcccguggcccacg

SEQ ID NO: 859079 - RNA, 20 nt, Mycobacterium avium subsp. paratuberculosis
cgcccuccccggccagcacg

SEQ ID NO: 859080 - RNA, 16 nt, Mycobacterium avium subsp. paratuberculosis
cgcccucaggcgucca

SEQ ID NO: 859081 - RNA, 20 nt, Mycobacterium avium subsp. paratuberculosis
cgcccucaggcguccagcac

SEQ ID NO: 859082 - RNA, 21 nt, Mycobacterium avium subsp. paratuberculosis
cgcccucaggcguccagcacc

SEQ ID NO: 859083 - RNA, 22 nt, Mycobacterium avium subsp. paratuberculosis
cgcccucaggcguccagcaccu

SEQ ID NO: 859084 - RNA, 23 nt, Mycobacterium avium subsp. paratuberculosis
cgcccucaggcguccagcaccug

SEQ ID NO: 859085 - RNA, 17 nt, Mycobacterium avium subsp. paratuberculosis
cgcccuagucgacgccg

SEQ ID NO: 859086 - RNA, 16 nt, Mycobacterium avium subsp. paratuberculosis
cgcccgucacgcuggc

SEQ ID NO: 859087 - RNA, 17 nt, Mycobacterium avium subsp. paratuberculosis
cgcccgucacgcuggcg

SEQ ID NO: 859088 - RNA, 22 nt, Mycobacterium avium subsp. paratuberculosis
cgcccgucgagcgucacgccgc

SEQ ID NO: 859089 - RNA, 23 nt, Mycobacterium avium subsp. paratuberculosis
cgcccgucgagcgucacgcuggc

SEQ ID NO: 859090 - RNA, 19 nt, Mycobacterium avium subsp. paratuberculosis
cgcccgucgagcgucauuc

SEQ ID NO: 859091 - RNA, 14 nt, Mycobacterium avium subsp. paratuberculosis
cgcccgucccgccg

SEQ ID NO: 859092 - RNA, 15 nt, Mycobacterium avium subsp. paratuberculosis
cgcccgucccgccga

SEQ ID NO: 859093 - RNA, 21 nt, Mycobacterium avium subsp. paratuberculosis
cgcccgucccgccgacggaga

SEQ ID NO: 859094 - RNA, 23 nt, Mycobacterium avium subsp. paratuberculosis
cgcccgucccgccgacggagacg

SEQ ID NO: 859095 - RNA, 13 nt, Mycobacterium avium subsp. paratuberculosis
cgcccgucccugc

SEQ ID NO: 859096 - RNA, 16 nt, Mycobacterium avium subsp. paratuberculosis
cgcccgucccugcgcg

SEQ ID NO: 859097 - RNA, 17 nt, Mycobacterium avium subsp. paratuberculosis
cgcccgucucggcgugc

SEQ ID NO: 859098 - RNA, 22 nt, Mycobacterium avium subsp. paratuberculosis
cgcccgucucggcgugcucggc

SEQ ID NO: 859099 - RNA, 14 nt, Mycobacterium avium subsp. paratuberculosis
cgcccgucggggcc

SEQ ID NO: 859100 - RNA, 18 nt, Mycobacterium avium subsp. paratuberculosis
cgcccgucggggcccggc

SEQ ID NO: 859101 - RNA, 19 nt, Mycobacterium avium subsp. paratuberculosis
cgcccgucggggcccggcc

SEQ ID NO: 859102 - RNA, 21 nt, Mycobacterium avium subsp. paratuberculosis
cgcccgucggggcccggcccg

SEQ ID NO: 859103 - RNA, 14 nt, Mycobacterium avium subsp. paratuberculosis
cgcccgucgguggg

SEQ ID NO: 859104 - RNA, 15 nt, Mycobacterium avium subsp. paratuberculosis
cgcccguccgggccg

SEQ ID NO: 859105 - RNA, 16 nt, Mycobacterium avium subsp. paratuberculosis
cgcccguccgggccgg

SEQ ID NO: 859106 - RNA, 17 nt, Mycobacterium avium subsp. paratuberculosis
cgcccguccgggccggc

SEQ ID NO: 859107 - RNA, 21 nt, Mycobacterium avium subsp. paratuberculosis
cgcccgguccgggucgcugag

SEQ ID NO: 859108 - RNA, 21 nt, Mycobacterium avium subsp. paratuberculosis
cgcccggucgaggucggccag

SEQ ID NO: 859109 - RNA, 22 nt, Mycobacterium avium subsp. paratuberculosis
cgcccggucgaggucggccagc

SEQ ID NO: 859110 - RNA, 23 nt, Mycobacterium avium subsp. paratuberculosis
cgcccggucgaggucggccagca

SEQ ID NO: 859111 - RNA, 21 nt, Mycobacterium avium subsp. paratuberculosis
cgcccggucgaugaucuggcg

SEQ ID NO: 859112 - RNA, 19 nt, Mycobacterium avium subsp. paratuberculosis
cgcccguagaugcggccca

SEQ ID NO: 859113 - RNA, 21 nt, Mycobacterium avium subsp. paratuberculosis
cgcccguagaugcggcccagc

SEQ ID NO: 859114 - RNA, 14 nt, Mycobacterium avium subsp. paratuberculosis
cgcccguagccgcg

SEQ ID NO: 859115 - RNA, 15 nt, Mycobacterium avium subsp. paratuberculosis
cgcccguagcggcgg

SEQ ID NO: 859116 - RNA, 23 nt, Mycobacterium avium subsp. paratuberculosis
cgcccguagaacaguucgacgua

SEQ ID NO: 859117 - RNA, 19 nt, Mycobacterium avium subsp. paratuberculosis
cgcccguagacccacagcu

SEQ ID NO: 859118 - RNA, 19 nt, Mycobacterium avium subsp. paratuberculosis
cgccgaccaguucggccac

SEQ ID NO: 859119 - RNA, 17 nt, Mycobacterium avium subsp. paratuberculosis
cgccgaccaggcucgcg

SEQ ID NO: 859120 - RNA, 19 nt, Mycobacterium avium subsp. paratuberculosis
cgccgaccagguagcgcug

SEQ ID NO: 859121 - RNA, 16 nt, Mycobacterium avium subsp. paratuberculosis
cgccgacccccgccgc

SEQ ID NO: 859122 - RNA, 19 nt, Mycobacterium avium subsp. paratuberculosis
cgccgacccccgccgcguc

SEQ ID NO: 859123 - RNA, 20 nt, Mycobacterium avium subsp. paratuberculosis
cgccgacccccgccgcgucg

SEQ ID NO: 859124 - RNA, 20 nt, Mycobacterium avium subsp. paratuberculosis
cgccgacccgguugauccgg

SEQ ID NO: 859125 - RNA, 14 nt, Mycobacterium avium subsp. paratuberculosis
cgccgaccgguccg

SEQ ID NO: 859126 - RNA, 20 nt, Mycobacterium avium subsp. paratuberculosis
cgccgaccgguccgccgccg

SEQ ID NO: 859127 - RNA, 22 nt, Mycobacterium avium subsp. paratuberculosis
cgccgaccgguccgccgccggc

SEQ ID NO: 859128 - RNA, 15 nt, Mycobacterium avium subsp. paratuberculosis
cgccgaccacgccgc

SEQ ID NO: 859129 - RNA, 13 nt, Mycobacterium avium subsp. paratuberculosis
cgccgaccucggc

SEQ ID NO: 859130 - RNA, 15 nt, Mycobacterium avium subsp. paratuberculosis
cgccgaccucgucgg

SEQ ID NO: 859131 - RNA, 17 nt, Mycobacterium avium subsp. paratuberculosis
cgccgaccucgucggcg

SEQ ID NO: 859132 - RNA, 18 nt, Mycobacterium avium subsp. paratuberculosis
cgccgaccucgucggcgg

SEQ ID NO: 859133 - RNA, 19 nt, Mycobacterium avium subsp. paratuberculosis
cgccgaccucgucggcggu

SEQ ID NO: 859134 - RNA, 20 nt, Mycobacterium avium subsp. paratuberculosis
cgccgaccucgucggcggug

SEQ ID NO: 859135 - RNA, 23 nt, Mycobacterium avium subsp. paratuberculosis
cgccgaccucgucggcggugccg

SEQ ID NO: 859136 - RNA, 15 nt, Mycobacterium avium subsp. paratuberculosis
cgccgaccgcggucg

SEQ ID NO: 859137 - RNA, 16 nt, Mycobacterium avium subsp. paratuberculosis
cgccgaccgcggucgc

SEQ ID NO: 859138 - RNA, 19 nt, Mycobacterium avium subsp. paratuberculosis
cgccgaccgcggucgcggc

SEQ ID NO: 859139 - RNA, 21 nt, Mycobacterium avium subsp. paratuberculosis
cgccgaccgcggucgcggcgc

SEQ ID NO: 859140 - RNA, 12 nt, Mycobacterium avium subsp. paratuberculosis
cgccgaccgccg

SEQ ID NO: 859141 - RNA, 15 nt, Mycobacterium avium subsp. paratuberculosis
cgccgaccgccgagc

SEQ ID NO: 859142 - RNA, 17 nt, Mycobacterium avium subsp. paratuberculosis
cgccgaccgccgagcgg

SEQ ID NO: 859143 - RNA, 17 nt, Mycobacterium avium subsp. paratuberculosis
cgccgaccgcgagcacg

SEQ ID NO: 859144 - RNA, 15 nt, Mycobacterium avium subsp. paratuberculosis
cgccgaccgcgaucg

SEQ ID NO: 859145 - RNA, 20 nt, Mycobacterium avium subsp. paratuberculosis
cgccgacggagacgaccagg

SEQ ID NO: 859146 - RNA, 12 nt, Mycobacterium avium subsp. paratuberculosis
cgccgacgcgcu

SEQ ID NO: 859147 - RNA, 14 nt, Mycobacterium avium subsp. paratuberculosis
cgccgacgcgcugc

SEQ ID NO: 859148 - RNA, 20 nt, Mycobacterium avium subsp. paratuberculosis
cgccgacgcgcugcgcgccg

SEQ ID NO: 859149 - RNA, 23 nt, Mycobacterium avium subsp. paratuberculosis
cgccgacgcgcugcgcgccgccc

SEQ ID NO: 859150 - RNA, 14 nt, Mycobacterium avium subsp. paratuberculosis
cgccgacgccgucg

SEQ ID NO: 859151 - RNA, 16 nt, Mycobacterium avium subsp. paratuberculosis
cgccgacgccugcgcg

SEQ ID NO: 859152 - RNA, 22 nt, Mycobacterium avium subsp. paratuberculosis
cgccgacgccugcgcgaacagc

SEQ ID NO: 859153 - RNA, 17 nt, Mycobacterium avium subsp. paratuberculosis
cgccgacgcauguccgc

SEQ ID NO: 859154 - RNA, 19 nt, Mycobacterium avium subsp. paratuberculosis
cgccgacgcauguccgccg

SEQ ID NO: 859155 - RNA, 22 nt, Mycobacterium avium subsp. paratuberculosis
cgccgacgcauguccgccguca

SEQ ID NO: 859156 - RNA, 15 nt, Mycobacterium avium subsp. paratuberculosis
cgccgacgccagcac

SEQ ID NO: 859157 - RNA, 16 nt, Mycobacterium avium subsp. paratuberculosis
cgccgacgccagcacg

SEQ ID NO: 859158 - RNA, 22 nt, Mycobacterium avium subsp. paratuberculosis
cgccgacgccagcacguggccg

SEQ ID NO: 859159 - RNA, 23 nt, Mycobacterium avium subsp. paratuberculosis
cgccgacgcccacagcgccagca

SEQ ID NO: 859160 - RNA, 13 nt, Mycobacterium avium subsp. paratuberculosis
cgccgacgcccag

SEQ ID NO: 859161 - RNA, 16 nt, Mycobacterium avium subsp. paratuberculosis
cgccgacgcccagcgc

SEQ ID NO: 859162 - RNA, 19 nt, Mycobacterium avium subsp. paratuberculosis
cgccgacgcccagcgcggc

SEQ ID NO: 859163 - RNA, 20 nt, Mycobacterium avium subsp. paratuberculosis
cgccgacgcccagcgcggcg

SEQ ID NO: 859164 - RNA, 21 nt, Mycobacterium avium subsp. paratuberculosis
cgccgacgcccagcgcggcga

SEQ ID NO: 859165 - RNA, 22 nt, Mycobacterium avium subsp. paratuberculosis
cgccgacgcccagcgcggcgaa

SEQ ID NO: 859166 - RNA, 20 nt, Mycobacterium avium subsp. paratuberculosis
cgccgacgaugcugucgcgg

SEQ ID NO: 859167 - RNA, 22 nt, Mycobacterium avium subsp. paratuberculosis
cgccgacgaugcugucgcgggu

SEQ ID NO: 859168 - RNA, 14 nt, Mycobacterium avium subsp. paratuberculosis
cgccgacgacggcg

SEQ ID NO: 859169 - RNA, 16 nt, Mycobacterium avium subsp. paratuberculosis
cgccgacgacgucgcg

SEQ ID NO: 859170 - RNA, 19 nt, Mycobacterium avium subsp. paratuberculosis
cgccgacgacgucgcgcag

SEQ ID NO: 859171 - RNA, 18 nt, Mycobacterium avium subsp. paratuberculosis
cgccgacgaucccggcga

SEQ ID NO: 859172 - RNA, 19 nt, Mycobacterium avium subsp. paratuberculosis
cgccgacgaucccggcgag

SEQ ID NO: 859173 - RNA, 21 nt, Mycobacterium avium subsp. paratuberculosis
cgccgacgaucccggcgagca

SEQ ID NO: 859174 - RNA, 23 nt, Mycobacterium avium subsp. paratuberculosis
cgccgacgaucccggcgagcacg

SEQ ID NO: 859175 - RNA, 18 nt, Mycobacterium avium subsp. paratuberculosis
cgccgacgaacagguucg

SEQ ID NO: 859176 - RNA, 20 nt, Mycobacterium avium subsp. paratuberculosis
cgccgaccuggucgccgaac

SEQ ID NO: 859177 - RNA, 14 nt, Mycobacterium avium subsp. paratuberculosis
cgccgaccuuggcg

SEQ ID NO: 859178 - RNA, 17 nt, Mycobacterium avium subsp. paratuberculosis
cgccgaccaggaucggg

SEQ ID NO: 859179 - RNA, 19 nt, Mycobacterium avium subsp. paratuberculosis
cgccgaccaggaucgggau

SEQ ID NO: 859180 - RNA, 15 nt, Mycobacterium avium subsp. paratuberculosis
cgccgaccagcagga

SEQ ID NO: 859181 - RNA, 23 nt, Mycobacterium avium subsp. paratuberculosis
cgccgaccagcaggacgcgcccg

SEQ ID NO: 859182 - RNA, 13 nt, Mycobacterium avium subsp. paratuberculosis
cgccgaccagccg

SEQ ID NO: 859183 - RNA, 15 nt, Mycobacterium avium subsp. paratuberculosis
cgccgaccagccgag

SEQ ID NO: 859184 - RNA, 12 nt, Mycobacterium avium subsp. paratuberculosis
cgccgaccagcg

SEQ ID NO: 859185 - RNA, 16 nt, Mycobacterium avium subsp. paratuberculosis
cgccgaccagcgcguu

SEQ ID NO: 859186 - RNA, 13 nt, Mycobacterium avium subsp. paratuberculosis
cgccgaccacggc

SEQ ID NO: 859187 - RNA, 16 nt, Mycobacterium avium subsp. paratuberculosis
cgccgaccacggcccc

SEQ ID NO: 859188 - RNA, 16 nt, Mycobacterium avium subsp. paratuberculosis
cgccgaccaccuugcg

SEQ ID NO: 859189 - RNA, 21 nt, Mycobacterium avium subsp. paratuberculosis
cgccgaccaccuugcgcagca

SEQ ID NO: 859190 - RNA, 17 nt, Mycobacterium avium subsp. paratuberculosis
cgccgacaucucccggu

SEQ ID NO: 859191 - RNA, 19 nt, Mycobacterium avium subsp. paratuberculosis
cgccgacaucucccggucg

SEQ ID NO: 859192 - RNA, 18 nt, Mycobacterium avium subsp. paratuberculosis
cgccgaccacccccagcc

SEQ ID NO: 859193 - RNA, 21 nt, Mycobacterium avium subsp. paratuberculosis
cgccgaccacccccagcccgc

SEQ ID NO: 859194 - RNA, 15 nt, Mycobacterium avium subsp. paratuberculosis
cgccgacaucgcccg

SEQ ID NO: 859195 - RNA, 16 nt, Mycobacterium avium subsp. paratuberculosis
cgccgacaucgcccgg

SEQ ID NO: 859196 - RNA, 13 nt, Mycobacterium avium subsp. paratuberculosis
cgccgacaucgcg

SEQ ID NO: 859197 - RNA, 14 nt, Mycobacterium avium subsp. paratuberculosis
cgccgacaucgcgg

SEQ ID NO: 859198 - RNA, 16 nt, Mycobacterium avium subsp. paratuberculosis
cgccgacaucgcggcg

SEQ ID NO: 859199 - RNA, 17 nt, Mycobacterium avium subsp. paratuberculosis
cgccgacaucgcggcga

SEQ ID NO: 859200 - RNA, 17 nt, Mycobacterium avium subsp. paratuberculosis
cgccgaccacaugccgu

SEQ ID NO: 859201 - RNA, 19 nt, Mycobacterium avium subsp. paratuberculosis
cgccgaccacaugccguug

SEQ ID NO: 859202 - RNA, 14 nt, Mycobacterium avium subsp. paratuberculosis
cgccgacagcgaca

SEQ ID NO: 859203 - RNA, 12 nt, Mycobacterium avium subsp. paratuberculosis
cgccgacagcgg

SEQ ID NO: 859204 - RNA, 15 nt, Mycobacterium avium subsp. paratuberculosis
cgccgacagcgucgu

SEQ ID NO: 859205 - RNA, 16 nt, Mycobacterium avium subsp. paratuberculosis
cgccgacagcgucguc

SEQ ID NO: 859206 - RNA, 18 nt, Mycobacterium avium subsp. paratuberculosis
cgccgacagcgucgucca

SEQ ID NO: 859207 - RNA, 21 nt, Mycobacterium avium subsp. paratuberculosis
cgccgacagcugagcagcccg

SEQ ID NO: 859208 - RNA, 14 nt, Mycobacterium avium subsp. paratuberculosis
cgccgacaccgucg

SEQ ID NO: 859209 - RNA, 16 nt, Mycobacterium avium subsp. paratuberculosis
cgccgacaccgucgcc

SEQ ID NO: 859210 - RNA, 19 nt, Mycobacterium avium subsp. paratuberculosis
cgccgacaccgucgccgug

SEQ ID NO: 859211 - RNA, 23 nt, Mycobacterium avium subsp. paratuberculosis
cgccgacagaugcggcaccagcc

SEQ ID NO: 859212 - RNA, 23 nt, Mycobacterium avium subsp. paratuberculosis
cgccgaauugcuuacgcaucgcc

SEQ ID NO: 859213 - RNA, 20 nt, Mycobacterium avium subsp. paratuberculosis
cgccgaauuguucggccacc

SEQ ID NO: 859214 - RNA, 16 nt, Mycobacterium avium subsp. paratuberculosis
cgccgaaugccacgcc

SEQ ID NO: 859215 - RNA, 19 nt, Mycobacterium avium subsp. paratuberculosis
cgccgaaugccacgccgau

SEQ ID NO: 859216 - RNA, 22 nt, Mycobacterium avium subsp. paratuberculosis
cgccgaaguuccagccgaucgc

SEQ ID NO: 859217 - RNA, 18 nt, Mycobacterium avium subsp. paratuberculosis
cgccgacaccaccacgaa

SEQ ID NO: 859218 - RNA, 22 nt, Mycobacterium avium subsp. paratuberculosis
cgccgacaccaccacgaacugg

SEQ ID NO: 859219 - RNA, 15 nt, Mycobacterium avium subsp. paratuberculosis
cgccgacaccaccgc

SEQ ID NO: 859220 - RNA, 14 nt, Mycobacterium avium subsp. paratuberculosis
cgccgacaccagcg

SEQ ID NO: 859221 - RNA, 18 nt, Mycobacterium avium subsp. paratuberculosis
cgccgacaccagcgcgca

SEQ ID NO: 859222 - RNA, 20 nt, Mycobacterium avium subsp. paratuberculosis
cgccgacaccagcgcgcacg

SEQ ID NO: 859223 - RNA, 22 nt, Mycobacterium avium subsp. paratuberculosis
cgccgacaccagcgcgcacgcg

SEQ ID NO: 859224 - RNA, 23 nt, Mycobacterium avium subsp. paratuberculosis
cgccgacaccagggugcgcacga

SEQ ID NO: 859225 - RNA, 15 nt, Mycobacterium avium subsp. paratuberculosis
cgccgacaccgcauu

SEQ ID NO: 859226 - RNA, 18 nt, Mycobacterium avium subsp. paratuberculosis
cgccgaaguuccagccga

SEQ ID NO: 859227 - RNA, 15 nt, Mycobacterium avium subsp. paratuberculosis
cgccgaauccggcgg

SEQ ID NO: 859228 - RNA, 17 nt, Mycobacterium avium subsp. paratuberculosis
cgccgaauccgggcaug

SEQ ID NO: 859229 - RNA, 18 nt, Mycobacterium avium subsp. paratuberculosis
cgccgaaggccgggucgg

SEQ ID NO: 859230 - RNA, 16 nt, Mycobacterium avium subsp. paratuberculosis
cgccgagcucgauguc

SEQ ID NO: 859231 - RNA, 15 nt, Mycobacterium avium subsp. paratuberculosis
cgccgagcucggcca

SEQ ID NO: 859232 - RNA, 17 nt, Mycobacterium avium subsp. paratuberculosis
cgccgagcucggccacc

SEQ ID NO: 859233 - RNA, 19 nt, Mycobacterium avium subsp. paratuberculosis
cgccgagcucggccaccag

SEQ ID NO: 859234 - RNA, 20 nt, Mycobacterium avium subsp. paratuberculosis
cgccgagcucggccaccagc

SEQ ID NO: 859235 - RNA, 17 nt, Mycobacterium avium subsp. paratuberculosis
cgccgaggacacguugg

SEQ ID NO: 859236 - RNA, 21 nt, Mycobacterium avium subsp. paratuberculosis
cgccgaggaggccgcggcgac

SEQ ID NO: 859237 - RNA, 17 nt, Mycobacterium avium subsp. paratuberculosis
cgccgaggaaccggcag

SEQ ID NO: 859238 - RNA, 20 nt, Mycobacterium avium subsp. paratuberculosis
cgccgaggaaccggcagccg

SEQ ID NO: 859239 - RNA, 21 nt, Mycobacterium avium subsp. paratuberculosis
cgccgaggaaccggcagccgg

SEQ ID NO: 859240 - RNA, 23 nt, Mycobacterium avium subsp. paratuberculosis
cgccgaggaaccggcagccggcg

SEQ ID NO: 859241 - RNA, 13 nt, Mycobacterium avium subsp. paratuberculosis
cgccgagcggguc

SEQ ID NO: 859242 - RNA, 14 nt, Mycobacterium avium subsp. paratuberculosis
cgccgagcgggucg

SEQ ID NO: 859243 - RNA, 15 nt, Mycobacterium avium subsp. paratuberculosis
cgccgagcgggucgu

SEQ ID NO: 859244 - RNA, 15 nt, Mycobacterium avium subsp. paratuberculosis
cgccgagcgcaucga

SEQ ID NO: 859245 - RNA, 18 nt, Mycobacterium avium subsp. paratuberculosis
cgccgagcgucacgcugg

SEQ ID NO: 859246 - RNA, 19 nt, Mycobacterium avium subsp. paratuberculosis
cgccgagcgucacgcuggc

SEQ ID NO: 859247 - RNA, 14 nt, Mycobacterium avium subsp. paratuberculosis
cgccgagcgggcga

SEQ ID NO: 859248 - RNA, 18 nt, Mycobacterium avium subsp. paratuberculosis
cgccgagcgggcgaucuc

SEQ ID NO: 859249 - RNA, 14 nt, Mycobacterium avium subsp. paratuberculosis
cgccgagccgucgu

SEQ ID NO: 859250 - RNA, 17 nt, Mycobacterium avium subsp. paratuberculosis
cgccgagccgucgucgc

SEQ ID NO: 859251 - RNA, 22 nt, Mycobacterium avium subsp. paratuberculosis
cgccgagcgcugguugucgacg

SEQ ID NO: 859252 - RNA, 16 nt, Mycobacterium avium subsp. paratuberculosis
cgccgacggcugcccg

SEQ ID NO: 859253 - RNA, 23 nt, Mycobacterium avium subsp. paratuberculosis
cgccgacggcugcccggcccgcc

SEQ ID NO: 859254 - RNA, 13 nt, Mycobacterium avium subsp. paratuberculosis
cgccgacgucagg

SEQ ID NO: 859255 - RNA, 17 nt, Mycobacterium avium subsp. paratuberculosis
cgccgacgucccagcac

SEQ ID NO: 859256 - RNA, 22 nt, Mycobacterium avium subsp. paratuberculosis
cgccgacgucccagcacaacgc

SEQ ID NO: 859257 - RNA, 19 nt, Mycobacterium avium subsp. paratuberculosis
cgccgacgucgugggcgau

SEQ ID NO: 859258 - RNA, 20 nt, Mycobacterium avium subsp. paratuberculosis
cgccgacgucugguuggccg

SEQ ID NO: 859259 - RNA, 13 nt, Mycobacterium avium subsp. paratuberculosis
cgccgagccgcac

SEQ ID NO: 859260 - RNA, 16 nt, Mycobacterium avium subsp. paratuberculosis
cgccgagccgcaccgc

SEQ ID NO: 859261 - RNA, 12 nt, Mycobacterium avium subsp. paratuberculosis
cgccgagccgcg

SEQ ID NO: 859262 - RNA, 15 nt, Mycobacterium avium subsp. paratuberculosis
cgccgagccgcgcca

SEQ ID NO: 859263 - RNA, 14 nt, Mycobacterium avium subsp. paratuberculosis
cgccgagccgcggg

SEQ ID NO: 859264 - RNA, 20 nt, Mycobacterium avium subsp. paratuberculosis
cgccgagccgcgggugacga

SEQ ID NO: 859265 - RNA, 15 nt, Mycobacterium avium subsp. paratuberculosis
cgccgagccgcucca

SEQ ID NO: 859266 - RNA, 14 nt, Mycobacterium avium subsp. paratuberculosis
cgccgagccggcac

SEQ ID NO: 859267 - RNA, 21 nt, Mycobacterium avium subsp. paratuberculosis
cgccgagccggcacggccggc

SEQ ID NO: 859268 - RNA, 13 nt, Mycobacterium avium subsp. paratuberculosis
cgccgacggugag

SEQ ID NO: 859269 - RNA, 18 nt, Mycobacterium avium subsp. paratuberculosis
cgccgacggugagcaccg

SEQ ID NO: 859270 - RNA, 21 nt, Mycobacterium avium subsp. paratuberculosis
cgccgacggugagcaccgccg

SEQ ID NO: 859271 - RNA, 14 nt, Mycobacterium avium subsp. paratuberculosis
cgccgacgguggcg

SEQ ID NO: 859272 - RNA, 18 nt, Mycobacterium avium subsp. paratuberculosis
cgccgacgguggcgaagc

SEQ ID NO: 859273 - RNA, 22 nt, Mycobacterium avium subsp. paratuberculosis
cgccgacgguguccgcgggcag

SEQ ID NO: 859274 - RNA, 22 nt, Mycobacterium avium subsp. paratuberculosis
cgccgacgggcccagcgcgacg

SEQ ID NO: 859275 - RNA, 23 nt, Mycobacterium avium subsp. paratuberculosis
cgccgacgggcccagcgcgacgu

SEQ ID NO: 859276 - RNA, 16 nt, Mycobacterium avium subsp. paratuberculosis
cgccgacgggcccgcg

SEQ ID NO: 859277 - RNA, 18 nt, Mycobacterium avium subsp. paratuberculosis
cgccgacgggcccgcgcc

SEQ ID NO: 859278 - RNA, 19 nt, Mycobacterium avium subsp. paratuberculosis
cgccgacguagacgagccg

SEQ ID NO: 859279 - RNA, 21 nt, Mycobacterium avium subsp. paratuberculosis
cgccgacguagacgagccggu

SEQ ID NO: 859280 - RNA, 18 nt, Mycobacterium avium subsp. paratuberculosis
cgccgacguaggacagca

SEQ ID NO: 859281 - RNA, 22 nt, Mycobacterium avium subsp. paratuberculosis
cgccgacguaggacagcaccac

SEQ ID NO: 859282 - RNA, 23 nt, Mycobacterium avium subsp. paratuberculosis
cgccgacguaggacagcaccaca

SEQ ID NO: 859283 - RNA, 12 nt, Mycobacterium avium subsp. paratuberculosis
cgccgacggcca

SEQ ID NO: 859284 - RNA, 13 nt, Mycobacterium avium subsp. paratuberculosis
cgccgacggccag

SEQ ID NO: 859285 - RNA, 14 nt, Mycobacterium avium subsp. paratuberculosis
cgccgacggccagc

SEQ ID NO: 859286 - RNA, 13 nt, Mycobacterium avium subsp. paratuberculosis
cgccgacggccgc

SEQ ID NO: 859287 - RNA, 17 nt, Mycobacterium avium subsp. paratuberculosis
cgccgacggccgcgccg

SEQ ID NO: 859288 - RNA, 18 nt, Mycobacterium avium subsp. paratuberculosis
cgccgacggccgcgccgu

SEQ ID NO: 859289 - RNA, 20 nt, Mycobacterium avium subsp. paratuberculosis
cgccgacggccgcgccguug

SEQ ID NO: 859290 - RNA, 21 nt, Mycobacterium avium subsp. paratuberculosis
cgccgauccgcugcggauccg

SEQ ID NO: 859291 - RNA, 18 nt, Mycobacterium avium subsp. paratuberculosis
cgccgaguaacucggccu

SEQ ID NO: 859292 - RNA, 14 nt, Mycobacterium avium subsp. paratuberculosis
cgccgaucgugacg

SEQ ID NO: 859293 - RNA, 21 nt, Mycobacterium avium subsp. paratuberculosis
cgccgaucgugacgccguccg

SEQ ID NO: 859294 - RNA, 23 nt, Mycobacterium avium subsp. paratuberculosis
cgccgaucgugacgccguccgac

SEQ ID NO: 859295 - RNA, 15 nt, Mycobacterium avium subsp. paratuberculosis
cgccgaucucgacca

SEQ ID NO: 859296 - RNA, 17 nt, Mycobacterium avium subsp. paratuberculosis
cgccgaucucgaccagc

SEQ ID NO: 859297 - RNA, 18 nt, Mycobacterium avium subsp. paratuberculosis
cgccgaucucgaccagcg

SEQ ID NO: 859298 - RNA, 20 nt, Mycobacterium avium subsp. paratuberculosis
cgccgaucucgaccagcgcc

SEQ ID NO: 859299 - RNA, 21 nt, Mycobacterium avium subsp. paratuberculosis
cgccgaucucgaccagcgccg

SEQ ID NO: 859300 - RNA, 17 nt, Mycobacterium avium subsp. paratuberculosis
cgccgaucucggccaac

SEQ ID NO: 859301 - RNA, 16 nt, Mycobacterium avium subsp. paratuberculosis
cgccgaucugaccgag

SEQ ID NO: 859302 - RNA, 17 nt, Mycobacterium avium subsp. paratuberculosis
cgccgaucugaccgagc

SEQ ID NO: 859303 - RNA, 19 nt, Mycobacterium avium subsp. paratuberculosis
cgccgaucugaccgagcag

SEQ ID NO: 859304 - RNA, 14 nt, Mycobacterium avium subsp. paratuberculosis
cgccgaugacggcg

SEQ ID NO: 859305 - RNA, 15 nt, Mycobacterium avium subsp. paratuberculosis
cgccgaugacggcgc

SEQ ID NO: 859306 - RNA, 16 nt, Mycobacterium avium subsp. paratuberculosis
cgccgaugacggcgcg

SEQ ID NO: 859307 - RNA, 16 nt, Mycobacterium avium subsp. paratuberculosis
cgccgaucugcucggc

SEQ ID NO: 859308 - RNA, 21 nt, Mycobacterium avium subsp. paratuberculosis
cgccgaucugcucggcugcag

SEQ ID NO: 859309 - RNA, 14 nt, Mycobacterium avium subsp. paratuberculosis
cgccgaucuggcgc

SEQ ID NO: 859310 - RNA, 14 nt, Mycobacterium avium subsp. paratuberculosis
cgccgaugacguug

SEQ ID NO: 859311 - RNA, 14 nt, Mycobacterium avium subsp. paratuberculosis
cgccgaugcccgcc

SEQ ID NO: 859312 - RNA, 15 nt, Mycobacterium avium subsp. paratuberculosis
cgccgaugaccaccc

SEQ ID NO: 859313 - RNA, 16 nt, Mycobacterium avium subsp. paratuberculosis
cgccgaugaugguggc

SEQ ID NO: 859314 - RNA, 22 nt, Mycobacterium avium subsp. paratuberculosis
cgccgaugaugguggcggccac

SEQ ID NO: 859315 - RNA, 20 nt, Mycobacterium avium subsp. paratuberculosis
cgccgaugcauuggugcacg

SEQ ID NO: 859316 - RNA, 23 nt, Mycobacterium avium subsp. paratuberculosis
cgccgaugcauuggugcacgccg

SEQ ID NO: 859317 - RNA, 16 nt, Mycobacterium avium subsp. paratuberculosis
cgccgaucgaucagcc

SEQ ID NO: 859318 - RNA, 19 nt, Mycobacterium avium subsp. paratuberculosis
cgccgaucgaucagccgcg

SEQ ID NO: 859319 - RNA, 15 nt, Mycobacterium avium subsp. paratuberculosis
cgccgaucgcccagu

SEQ ID NO: 859320 - RNA, 13 nt, Mycobacterium avium subsp. paratuberculosis
cgccgaucgcccg

SEQ ID NO: 859321 - RNA, 14 nt, Mycobacterium avium subsp. paratuberculosis
cgccgaucgcccgg

SEQ ID NO: 859322 - RNA, 15 nt, Mycobacterium avium subsp. paratuberculosis
cgccgaucgcgcgca

SEQ ID NO: 859323 - RNA, 16 nt, Mycobacterium avium subsp. paratuberculosis
cgccgaucgcgcgcag

SEQ ID NO: 859324 - RNA, 14 nt, Mycobacterium avium subsp. paratuberculosis
cgccgauccggcgc

SEQ ID NO: 859325 - RNA, 15 nt, Mycobacterium avium subsp. paratuberculosis
cgccgauccggcgcc

SEQ ID NO: 859326 - RNA, 16 nt, Mycobacterium avium subsp. paratuberculosis
cgccgauccggcgccg

SEQ ID NO: 859327 - RNA, 17 nt, Mycobacterium avium subsp. paratuberculosis
cgccgauccggcgccgc

SEQ ID NO: 859328 - RNA, 19 nt, Mycobacterium avium subsp. paratuberculosis
cgccgauccggcgccgcgg

SEQ ID NO: 859329 - RNA, 15 nt, Mycobacterium avium subsp. paratuberculosis
cgccgauccggcucc

SEQ ID NO: 859330 - RNA, 18 nt, Mycobacterium avium subsp. paratuberculosis
cgccgauccgggcggcag

SEQ ID NO: 859331 - RNA, 14 nt, Mycobacterium avium subsp. paratuberculosis
cgccgaguccgggc

SEQ ID NO: 859332 - RNA, 16 nt, Mycobacterium avium subsp. paratuberculosis
cgccgaguccgggccg

SEQ ID NO: 859333 - RNA, 17 nt, Mycobacterium avium subsp. paratuberculosis
cgccgaguccgggccgc

SEQ ID NO: 859334 - RNA, 17 nt, Mycobacterium avium subsp. paratuberculosis
cgccgagucgaucgcca

SEQ ID NO: 859335 - RNA, 20 nt, Mycobacterium avium subsp. paratuberculosis
cgccgagucgaucgccagcg

SEQ ID NO: 859336 - RNA, 22 nt, Mycobacterium avium subsp. paratuberculosis
cgccgagucgaucgccagcgcg

SEQ ID NO: 859337 - RNA, 13 nt, Mycobacterium avium subsp. paratuberculosis
cgccgagucgcgc

SEQ ID NO: 859338 - RNA, 16 nt, Mycobacterium avium subsp. paratuberculosis
cgccgagucgcgccgc

SEQ ID NO: 859339 - RNA, 14 nt, Mycobacterium avium subsp. paratuberculosis
cgccgaggccagca

SEQ ID NO: 859340 - RNA, 21 nt, Mycobacterium avium subsp. paratuberculosis
cgccgaggccagcacgccggu

SEQ ID NO: 859341 - RNA, 19 nt, Mycobacterium avium subsp. paratuberculosis
cgccgaggucaccgcggga

SEQ ID NO: 859342 - RNA, 15 nt, Mycobacterium avium subsp. paratuberculosis
cgccgagguccucga

SEQ ID NO: 859343 - RNA, 22 nt, Mycobacterium avium subsp. paratuberculosis
cgccgaggugcaacacucgagc

SEQ ID NO: 859344 - RNA, 19 nt, Mycobacterium avium subsp. paratuberculosis
cgccgaggugcugucgucg

SEQ ID NO: 859345 - RNA, 21 nt, Mycobacterium avium subsp. paratuberculosis
cgccgaggugcugucgucgcc

SEQ ID NO: 859346 - RNA, 13 nt, Mycobacterium avium subsp. paratuberculosis
cgccgagguggcc

SEQ ID NO: 859347 - RNA, 17 nt, Mycobacterium avium subsp. paratuberculosis
cgccgagguggcccgcc

SEQ ID NO: 859348 - RNA, 22 nt, Mycobacterium avium subsp. paratuberculosis
cgccgagguggcccgccacgug

SEQ ID NO: 859349 - RNA, 18 nt, Mycobacterium avium subsp. paratuberculosis
cgccgagguggccgccag

SEQ ID NO: 859350 - RNA, 19 nt, Mycobacterium avium subsp. paratuberculosis
cgccgagguggccgccagc

SEQ ID NO: 859351 - RNA, 20 nt, Mycobacterium avium subsp. paratuberculosis
cgccgagguggccgccagca

SEQ ID NO: 859352 - RNA, 22 nt, Mycobacterium avium subsp. paratuberculosis
cgccgagguggccgccagcacc

SEQ ID NO: 859353 - RNA, 23 nt, Mycobacterium avium subsp. paratuberculosis
cgccgagguggccgccagcaccu

SEQ ID NO: 859354 - RNA, 15 nt, Mycobacterium avium subsp. paratuberculosis
cgcaucacccggcgc

SEQ ID NO: 859355 - RNA, 20 nt, Mycobacterium avium subsp. paratuberculosis
cgcaucacccggcgcgcgga

SEQ ID NO: 859356 - RNA, 16 nt, Mycobacterium avium subsp. paratuberculosis
cgcaucagcgccacca

SEQ ID NO: 859357 - RNA, 13 nt, Mycobacterium avium subsp. paratuberculosis
cgcaucagcgggg

SEQ ID NO: 859358 - RNA, 19 nt, Mycobacterium avium subsp. paratuberculosis
cgcaucagcggggcgucca

SEQ ID NO: 859359 - RNA, 22 nt, Mycobacterium avium subsp. paratuberculosis
cgcaucaccuucugcgcgccgu

SEQ ID NO: 859360 - RNA, 13 nt, Mycobacterium avium subsp. paratuberculosis
cgcauccagcgcc

SEQ ID NO: 859361 - RNA, 14 nt, Mycobacterium avium subsp. paratuberculosis
cgcauccagcgccg

SEQ ID NO: 859362 - RNA, 17 nt, Mycobacterium avium subsp. paratuberculosis
cgcauccagcgccgcca

SEQ ID NO: 859363 - RNA, 12 nt, Mycobacterium avium subsp. paratuberculosis
cgcaucaucgcc

SEQ ID NO: 859364 - RNA, 21 nt, Mycobacterium avium subsp. paratuberculosis
cgcaucagcaccuccggcagc

SEQ ID NO: 859365 - RNA, 17 nt, Mycobacterium avium subsp. paratuberculosis
cgcaucagcucggcagc

SEQ ID NO: 859366 - RNA, 17 nt, Mycobacterium avium subsp. paratuberculosis
cgcaucagcucuucgac

SEQ ID NO: 859367 - RNA, 20 nt, Mycobacterium avium subsp. paratuberculosis
cgcaucagcucuucgacgau

SEQ ID NO: 859368 - RNA, 18 nt, Mycobacterium avium subsp. paratuberculosis
cgcaucagggccagccga

SEQ ID NO: 859369 - RNA, 24 nt, Mycobacterium avium subsp. paratuberculosis
cgcaucagggccagccgaugcgcc

SEQ ID NO: 859370 - RNA, 13 nt, Mycobacterium avium subsp. paratuberculosis
cgcauacaccuug

SEQ ID NO: 859371 - RNA, 20 nt, Mycobacterium avium subsp. paratuberculosis
cgcauaccagcgcugguacc

SEQ ID NO: 859372 - RNA, 19 nt, Mycobacterium avium subsp. paratuberculosis
cgcauagcgggagccggcc

SEQ ID NO: 859373 - RNA, 14 nt, Mycobacterium avium subsp. paratuberculosis
cgcauaggccgcga

SEQ ID NO: 859374 - RNA, 17 nt, Mycobacterium avium subsp. paratuberculosis
cgcauaggccgcgagga

SEQ ID NO: 859375 - RNA, 20 nt, Mycobacterium avium subsp. paratuberculosis
cgcagguuguccagccggug

SEQ ID NO: 859376 - RNA, 18 nt, Mycobacterium avium subsp. paratuberculosis
cgcagguugucggccaac

SEQ ID NO: 859377 - RNA, 16 nt, Mycobacterium avium subsp. paratuberculosis
cgcagguuucucgacc

SEQ ID NO: 859378 - RNA, 17 nt, Mycobacterium avium subsp. paratuberculosis
cgcagguuucucgacca

SEQ ID NO: 859379 - RNA, 18 nt, Mycobacterium avium subsp. paratuberculosis
cgcagucguucggccagc

SEQ ID NO: 859380 - RNA, 22 nt, Mycobacterium avium subsp. paratuberculosis
cgcagucguucggccagcacca

SEQ ID NO: 859381 - RNA, 16 nt, Mycobacterium avium subsp. paratuberculosis
cgcagucgcuggucga

SEQ ID NO: 859382 - RNA, 18 nt, Mycobacterium avium subsp. paratuberculosis
cgcagucggcgucgcggc

SEQ ID NO: 859383 - RNA, 19 nt, Mycobacterium avium subsp. paratuberculosis
cgcagucggcgucgcggcg

SEQ ID NO: 859384 - RNA, 20 nt, Mycobacterium avium subsp. paratuberculosis
cgcagucggcgucgcggcgc

SEQ ID NO: 859385 - RNA, 22 nt, Mycobacterium avium subsp. paratuberculosis
cgcagucggcgucgcggcgcac

SEQ ID NO: 859386 - RNA, 14 nt, Mycobacterium avium subsp. paratuberculosis
cgcagucgaucagc

SEQ ID NO: 859387 - RNA, 18 nt, Mycobacterium avium subsp. paratuberculosis
cgcagucgaucagcgacg

SEQ ID NO: 859388 - RNA, 22 nt, Mycobacterium avium subsp. paratuberculosis
cgcaguagcgcauaggccgcga

SEQ ID NO: 859389 - RNA, 23 nt, Mycobacterium avium subsp. paratuberculosis
cgcaguccaaaaacugcgcgucg

SEQ ID NO: 859390 - RNA, 18 nt, Mycobacterium avium subsp. paratuberculosis
cgcagugcgucagaaccg

SEQ ID NO: 859391 - RNA, 12 nt, Mycobacterium avium subsp. paratuberculosis
cgcagugcccgc

SEQ ID NO: 859392 - RNA, 14 nt, Mycobacterium avium subsp. paratuberculosis
cgcagugcccgccc

SEQ ID NO: 859393 - RNA, 15 nt, Mycobacterium avium subsp. paratuberculosis
cgcagugccgcacca

SEQ ID NO: 859394 - RNA, 17 nt, Mycobacterium avium subsp. paratuberculosis
cgcagugccgcaccagc

SEQ ID NO: 859395 - RNA, 15 nt, Mycobacterium avium subsp. paratuberculosis
cgcagugccggcgca

SEQ ID NO: 859396 - RNA, 16 nt, Mycobacterium avium subsp. paratuberculosis
cgcagugccggcgcac

SEQ ID NO: 859397 - RNA, 19 nt, Mycobacterium avium subsp. paratuberculosis
cgcagugccggcgcaccgc

SEQ ID NO: 859398 - RNA, 20 nt, Mycobacterium avium subsp. paratuberculosis
cgcagugccggcgcaccgcg

SEQ ID NO: 859399 - RNA, 16 nt, Mycobacterium avium subsp. paratuberculosis
cgcaguucggccgccg

SEQ ID NO: 859400 - RNA, 18 nt, Mycobacterium avium subsp. paratuberculosis
cgcaguucggccgccgug

SEQ ID NO: 859401 - RNA, 16 nt, Mycobacterium avium subsp. paratuberculosis
cgcaguuaccggcgua

SEQ ID NO: 859402 - RNA, 13 nt, Mycobacterium avium subsp. paratuberculosis
cgcaguucaccga

SEQ ID NO: 859403 - RNA, 22 nt, Mycobacterium avium subsp. paratuberculosis
cgcaguucaccgaaguccgcca

SEQ ID NO: 859404 - RNA, 17 nt, Mycobacterium avium subsp. paratuberculosis
cgcaguucgaccggcac

SEQ ID NO: 859405 - RNA, 22 nt, Mycobacterium avium subsp. paratuberculosis
cgcaggcauuuccagguccggg

SEQ ID NO: 859406 - RNA, 12 nt, Mycobacterium avium subsp. paratuberculosis
cgcaggcagcag

SEQ ID NO: 859407 - RNA, 13 nt, Mycobacterium avium subsp. paratuberculosis
cgcaggcagcagc

SEQ ID NO: 859408 - RNA, 17 nt, Mycobacterium avium subsp. paratuberculosis
cgcaggcagcagcaccc

SEQ ID NO: 859409 - RNA, 17 nt, Mycobacterium avium subsp. paratuberculosis
cgcaggccaugaucgaa

SEQ ID NO: 859410 - RNA, 14 nt, Mycobacterium avium subsp. paratuberculosis
cgcaggccgcccgg

SEQ ID NO: 859411 - RNA, 15 nt, Mycobacterium avium subsp. paratuberculosis
cgcaggccgcccggc

SEQ ID NO: 859412 - RNA, 18 nt, Mycobacterium avium subsp. paratuberculosis
cgcaggccgcccggccca

SEQ ID NO: 859413 - RNA, 12 nt, Mycobacterium avium subsp. paratuberculosis
cgcaggccgccg

SEQ ID NO: 859414 - RNA, 17 nt, Mycobacterium avium subsp. paratuberculosis
cgcaggccgccgacgac

SEQ ID NO: 859415 - RNA, 22 nt, Mycobacterium avium subsp. paratuberculosis
cgcaggccgccgacgacggcga

SEQ ID NO: 859416 - RNA, 13 nt, Mycobacterium avium subsp. paratuberculosis
cgcaggccccggc

SEQ ID NO: 859417 - RNA, 16 nt, Mycobacterium avium subsp. paratuberculosis
cgcaggccccggcgcg

SEQ ID NO: 859418 - RNA, 18 nt, Mycobacterium avium subsp. paratuberculosis
cgcaggccccggcgcgcg

SEQ ID NO: 859419 - RNA, 19 nt, Mycobacterium avium subsp. paratuberculosis
cgcaggccccggcgcgcgu

SEQ ID NO: 859420 - RNA, 14 nt, Mycobacterium avium subsp. paratuberculosis
cgcaggccgcgagc

SEQ ID NO: 859421 - RNA, 15 nt, Mycobacterium avium subsp. paratuberculosis
cgcagggccagcgcc

SEQ ID NO: 859422 - RNA, 17 nt, Mycobacterium avium subsp. paratuberculosis
cgcagggccagcgccuc

SEQ ID NO: 859423 - RNA, 19 nt, Mycobacterium avium subsp. paratuberculosis
cgcagggccagcgccucgg

SEQ ID NO: 859424 - RNA, 18 nt, Mycobacterium avium subsp. paratuberculosis
cgcaggugcucgccggcg

SEQ ID NO: 859425 - RNA, 20 nt, Mycobacterium avium subsp. paratuberculosis
cgcaggugcucgccggcgcg

SEQ ID NO: 859426 - RNA, 22 nt, Mycobacterium avium subsp. paratuberculosis
cgcaggugcucgccggcgcgga

SEQ ID NO: 859427 - RNA, 12 nt, Mycobacterium avium subsp. paratuberculosis
cgcaggugccgg

SEQ ID NO: 859428 - RNA, 15 nt, Mycobacterium avium subsp. paratuberculosis
cgcaggugccgguga

SEQ ID NO: 859429 - RNA, 16 nt, Mycobacterium avium subsp. paratuberculosis
cgcagggcggaaucgc

SEQ ID NO: 859430 - RNA, 13 nt, Mycobacterium avium subsp. paratuberculosis
cgcaggugcgccg

SEQ ID NO: 859431 - RNA, 16 nt, Mycobacterium avium subsp. paratuberculosis
cgcaggugggcggugc

SEQ ID NO: 859432 - RNA, 16 nt, Mycobacterium avium subsp. paratuberculosis
cgcagguggugggcgu

SEQ ID NO: 859433 - RNA, 20 nt, Mycobacterium avium subsp. paratuberculosis
cgcagguguccagcccuacc

SEQ ID NO: 859434 - RNA, 16 nt, Mycobacterium avium subsp. paratuberculosis
cgcaggucgggccggc

SEQ ID NO: 859435 - RNA, 18 nt, Mycobacterium avium subsp. paratuberculosis
cgcaggucgggccggccg

SEQ ID NO: 859436 - RNA, 19 nt, Mycobacterium avium subsp. paratuberculosis
cgcaggucgggccggccga

SEQ ID NO: 859437 - RNA, 18 nt, Mycobacterium avium subsp. paratuberculosis
cgcaggucguccgacagg

SEQ ID NO: 859438 - RNA, 20 nt, Mycobacterium avium subsp. paratuberculosis
cgcagggcguucgacgucca

SEQ ID NO: 859439 - RNA, 17 nt, Mycobacterium avium subsp. paratuberculosis
cgcagggcggccggcca

SEQ ID NO: 859440 - RNA, 16 nt, Mycobacterium avium subsp. paratuberculosis
cgcagggcgaacggcg

SEQ ID NO: 859441 - RNA, 14 nt, Mycobacterium avium subsp. paratuberculosis
cgcagggcgccggu

SEQ ID NO: 859442 - RNA, 15 nt, Mycobacterium avium subsp. paratuberculosis
cgcagggcgccggug

SEQ ID NO: 859443 - RNA, 12 nt, Mycobacterium avium subsp. paratuberculosis
cgcagggccgcu

SEQ ID NO: 859444 - RNA, 18 nt, Mycobacterium avium subsp. paratuberculosis
cgcaggauggccugcacg

SEQ ID NO: 859445 - RNA, 22 nt, Mycobacterium avium subsp. paratuberculosis
cgcaggauggccugcacggugc

SEQ ID NO: 859446 - RNA, 20 nt, Mycobacterium avium subsp. paratuberculosis
cgcaggaugcccagcaccac

SEQ ID NO: 859447 - RNA, 13 nt, Mycobacterium avium subsp. paratuberculosis
cgcaggaugccga

SEQ ID NO: 859448 - RNA, 16 nt, Mycobacterium avium subsp. paratuberculosis
cgcaggaugccgaugu

SEQ ID NO: 859449 - RNA, 17 nt, Mycobacterium avium subsp. paratuberculosis
cgcagcgaacgcggcug

SEQ ID NO: 859450 - RNA, 15 nt, Mycobacterium avium subsp. paratuberculosis
cgcaggagaucggcg

SEQ ID NO: 859451 - RNA, 17 nt, Mycobacterium avium subsp. paratuberculosis
cgcaggagaucggcgcg

SEQ ID NO: 859452 - RNA, 15 nt, Mycobacterium avium subsp. paratuberculosis
cgcaggaggcggcca

SEQ ID NO: 859453 - RNA, 18 nt, Mycobacterium avium subsp. paratuberculosis
cgcagccuucuucgccgg

SEQ ID NO: 859454 - RNA, 20 nt, Mycobacterium avium subsp. paratuberculosis
cgcagccuucuucgccgggg

SEQ ID NO: 859455 - RNA, 21 nt, Mycobacterium avium subsp. paratuberculosis
cgcagccuucuuggcgggcgc

SEQ ID NO: 859456 - RNA, 16 nt, Mycobacterium avium subsp. paratuberculosis
cgcagcgaacgucagg

SEQ ID NO: 859457 - RNA, 22 nt, Mycobacterium avium subsp. paratuberculosis
cgcagccgggugcgggccagca

SEQ ID NO: 859458 - RNA, 21 nt, Mycobacterium avium subsp. paratuberculosis
cgcagccgggugggcggcaca

SEQ ID NO: 859459 - RNA, 14 nt, Mycobacterium avium subsp. paratuberculosis
cgcagccgggcggc

SEQ ID NO: 859460 - RNA, 15 nt, Mycobacterium avium subsp. paratuberculosis
cgcagccgggcggcg

SEQ ID NO: 859461 - RNA, 15 nt, Mycobacterium avium subsp. paratuberculosis
cgcagccgggcggug

SEQ ID NO: 859462 - RNA, 20 nt, Mycobacterium avium subsp. paratuberculosis
cgcagccgucgaucuugacg

SEQ ID NO: 859463 - RNA, 18 nt, Mycobacterium avium subsp. paratuberculosis
cgcagccgucgcaucagc

SEQ ID NO: 859464 - RNA, 23 nt, Mycobacterium avium subsp. paratuberculosis
cgcagccgucgcaucagcucggc

SEQ ID NO: 859465 - RNA, 13 nt, Mycobacterium avium subsp. paratuberculosis
cgcagccggccgu

SEQ ID NO: 859466 - RNA, 22 nt, Mycobacterium avium subsp. paratuberculosis
cgcagccggccguccacggcgg

SEQ ID NO: 859467 - RNA, 14 nt, Mycobacterium avium subsp. paratuberculosis
cgcagccggaucac

SEQ ID NO: 859468 - RNA, 21 nt, Mycobacterium avium subsp. paratuberculosis
cgcagccgcuggccgcgccac

SEQ ID NO: 859469 - RNA, 14 nt, Mycobacterium avium subsp. paratuberculosis
cgcagccggccacc

SEQ ID NO: 859470 - RNA, 11 nt, Mycobacterium avium subsp. paratuberculosis
cgcagccgggc

SEQ ID NO: 859471 - RNA, 16 nt, Mycobacterium avium subsp. paratuberculosis
cgcagcccgggugcga

SEQ ID NO: 859472 - RNA, 22 nt, Mycobacterium avium subsp. paratuberculosis
cgcagcccguacuugcuggcgc

SEQ ID NO: 859473 - RNA, 19 nt, Mycobacterium avium subsp. paratuberculosis
cgcagcccgucgaucccgg

SEQ ID NO: 859474 - RNA, 13 nt, Mycobacterium avium subsp. paratuberculosis
cgcagcccggcgg

SEQ ID NO: 859475 - RNA, 14 nt, Mycobacterium avium subsp. paratuberculosis
cgcagcccggcggu

SEQ ID NO: 859476 - RNA, 15 nt, Mycobacterium avium subsp. paratuberculosis
cgcagcccggcgguu

SEQ ID NO: 859477 - RNA, 17 nt, Mycobacterium avium subsp. paratuberculosis
cgcagcccggcgguuga

SEQ ID NO: 859478 - RNA, 15 nt, Mycobacterium avium subsp. paratuberculosis
cgcagcccaggccca

SEQ ID NO: 859479 - RNA, 20 nt, Mycobacterium avium subsp. paratuberculosis
cgcagcccaggcccagcagc

SEQ ID NO: 859480 - RNA, 16 nt, Mycobacterium avium subsp. paratuberculosis
cgcagccagucgccgg

SEQ ID NO: 859481 - RNA, 18 nt, Mycobacterium avium subsp. paratuberculosis
cgcagccagucgccggcc

SEQ ID NO: 859482 - RNA, 14 nt, Mycobacterium avium subsp. paratuberculosis
cgcagcccgagcgg

SEQ ID NO: 859483 - RNA, 15 nt, Mycobacterium avium subsp. paratuberculosis
cgcagcccgagcggc

SEQ ID NO: 859484 - RNA, 14 nt, Mycobacterium avium subsp. paratuberculosis
cgcagcccgccggg

SEQ ID NO: 859485 - RNA, 17 nt, Mycobacterium avium subsp. paratuberculosis
cgcaucguugccggcgg

SEQ ID NO: 859486 - RNA, 18 nt, Mycobacterium avium subsp. paratuberculosis
cgcaucguugccggcggc

SEQ ID NO: 859487 - RNA, 20 nt, Mycobacterium avium subsp. paratuberculosis
cgcaucguugccggcggcga

SEQ ID NO: 859488 - RNA, 22 nt, Mycobacterium avium subsp. paratuberculosis
cgcaucguugccggcggcgaag

SEQ ID NO: 859489 - RNA, 18 nt, Mycobacterium avium subsp. paratuberculosis
cgcaucggucaccagcuc

SEQ ID NO: 859490 - RNA, 20 nt, Mycobacterium avium subsp. paratuberculosis
cgcaucggucaccagcuccc

SEQ ID NO: 859491 - RNA, 19 nt, Mycobacterium avium subsp. paratuberculosis
cgcaucggugagacgaccc

SEQ ID NO: 859492 - RNA, 14 nt, Mycobacterium avium subsp. paratuberculosis
cgcaucgggcgaca

SEQ ID NO: 859493 - RNA, 14 nt, Mycobacterium avium subsp. paratuberculosis
cgcaucggcgccgg

SEQ ID NO: 859494 - RNA, 15 nt, Mycobacterium avium subsp. paratuberculosis
cgcaucggcgccgga

SEQ ID NO: 859495 - RNA, 12 nt, Mycobacterium avium subsp. paratuberculosis
cgcaucggcgac

SEQ ID NO: 859496 - RNA, 17 nt, Mycobacterium avium subsp. paratuberculosis
cgcaucggcgacgccgc

SEQ ID NO: 859497 - RNA, 18 nt, Mycobacterium avium subsp. paratuberculosis
cgcaucggcgacgccgcc

SEQ ID NO: 859498 - RNA, 19 nt, Mycobacterium avium subsp. paratuberculosis
cgcaucggcgacgccgccg

SEQ ID NO: 859499 - RNA, 23 nt, Mycobacterium avium subsp. paratuberculosis
cgcaucggcgacgccgccgucgu

SEQ ID NO: 859500 - RNA, 16 nt, Mycobacterium avium subsp. paratuberculosis
cgcaucgucgcggcgc

SEQ ID NO: 859501 - RNA, 19 nt, Mycobacterium avium subsp. paratuberculosis
cgcaucguugguccaggcg

SEQ ID NO: 859502 - RNA, 24 nt, Mycobacterium avium subsp. paratuberculosis
cgcaucucgaaugcggcugccggc

SEQ ID NO: 859503 - RNA, 14 nt, Mycobacterium avium subsp. paratuberculosis
cgcaucugcucggc

SEQ ID NO: 859504 - RNA, 17 nt, Mycobacterium avium subsp. paratuberculosis
cgcaucugcucggcguc

SEQ ID NO: 859505 - RNA, 19 nt, Mycobacterium avium subsp. paratuberculosis
cgcaucugcucggcgucca

SEQ ID NO: 859506 - RNA, 19 nt, Mycobacterium avium subsp. paratuberculosis
cgcaucugguauucgaugg

SEQ ID NO: 859507 - RNA, 18 nt, Mycobacterium avium subsp. paratuberculosis
cgcaugacggccugcacc

SEQ ID NO: 859508 - RNA, 20 nt, Mycobacterium avium subsp. paratuberculosis
cgcaugacggccugcaccac

SEQ ID NO: 859509 - RNA, 22 nt, Mycobacterium avium subsp. paratuberculosis
cgcaugacggccugcaccacca

SEQ ID NO: 859510 - RNA, 21 nt, Mycobacterium avium subsp. paratuberculosis
cgcauggagaugcuucagccc

SEQ ID NO: 859511 - RNA, 22 nt, Mycobacterium avium subsp. paratuberculosis
cgcaugcuuccgaucaacggca

SEQ ID NO: 859512 - RNA, 14 nt, Mycobacterium avium subsp. paratuberculosis
cgcaugcccuuguc

SEQ ID NO: 859513 - RNA, 16 nt, Mycobacterium avium subsp. paratuberculosis
cgcaugcccgggcgac

SEQ ID NO: 859514 - RNA, 13 nt, Mycobacterium avium subsp. paratuberculosis
cgcaugccagacc

SEQ ID NO: 859515 - RNA, 18 nt, Mycobacterium avium subsp. paratuberculosis
cgcaugccagaccacaag

SEQ ID NO: 859516 - RNA, 13 nt, Mycobacterium avium subsp. paratuberculosis
cgcaugcaccggu

SEQ ID NO: 859517 - RNA, 16 nt, Mycobacterium avium subsp. paratuberculosis
cgcaucgcggcgaugg

SEQ ID NO: 859518 - RNA, 15 nt, Mycobacterium avium subsp. paratuberculosis
cgcaucgcgggccac

SEQ ID NO: 859519 - RNA, 17 nt, Mycobacterium avium subsp. paratuberculosis
cgcaucgcgggccaccg

SEQ ID NO: 859520 - RNA, 18 nt, Mycobacterium avium subsp. paratuberculosis
cgcaucgcgggccaccgg

SEQ ID NO: 859521 - RNA, 19 nt, Mycobacterium avium subsp. paratuberculosis
cgcaucgcgggccaccggc

SEQ ID NO: 859522 - RNA, 18 nt, Mycobacterium avium subsp. paratuberculosis
cgcaucgccgaaccgggc

SEQ ID NO: 859523 - RNA, 17 nt, Mycobacterium avium subsp. paratuberculosis
cgcaucgccgagggcga

SEQ ID NO: 859524 - RNA, 14 nt, Mycobacterium avium subsp. paratuberculosis
cgcaucgccggcgc

SEQ ID NO: 859525 - RNA, 13 nt, Mycobacterium avium subsp. paratuberculosis
cgcaucgccucgg

SEQ ID NO: 859526 - RNA, 15 nt, Mycobacterium avium subsp. paratuberculosis
cgcaucgccucggcg

SEQ ID NO: 859527 - RNA, 19 nt, Mycobacterium avium subsp. paratuberculosis
cgcaucgccucggcggccg

SEQ ID NO: 859528 - RNA, 23 nt, Mycobacterium avium subsp. paratuberculosis
cgcaucgagcugcaacgcgucgg

SEQ ID NO: 859529 - RNA, 18 nt, Mycobacterium avium subsp. paratuberculosis
cgcaucgacugcgacacc

SEQ ID NO: 859530 - RNA, 21 nt, Mycobacterium avium subsp. paratuberculosis
cgcauccucauagccggccgc

SEQ ID NO: 859531 - RNA, 16 nt, Mycobacterium avium subsp. paratuberculosis
cgcaucgaaccgccgc

SEQ ID NO: 859532 - RNA, 23 nt, Mycobacterium avium subsp. paratuberculosis
cgcaucccgucgaccaggacguc

SEQ ID NO: 859533 - RNA, 18 nt, Mycobacterium avium subsp. paratuberculosis
cgcaucccccucggcggg

SEQ ID NO: 859534 - RNA, 18 nt, Mycobacterium avium subsp. paratuberculosis
cgcaucccgaucgacguc

SEQ ID NO: 859535 - RNA, 16 nt, Mycobacterium avium subsp. paratuberculosis
cgcauccgcgagccga

SEQ ID NO: 859536 - RNA, 12 nt, Mycobacterium avium subsp. paratuberculosis
cgcauccgcacc

SEQ ID NO: 859537 - RNA, 20 nt, Mycobacterium avium subsp. paratuberculosis
cgccaacggauucagcgucg

SEQ ID NO: 859538 - RNA, 22 nt, Mycobacterium avium subsp. paratuberculosis
cgccacaacagguucgacagcg

SEQ ID NO: 859539 - RNA, 16 nt, Mycobacterium avium subsp. paratuberculosis
cgccacaaacagcgcg

SEQ ID NO: 859540 - RNA, 17 nt, Mycobacterium avium subsp. paratuberculosis
cgccacaaacagcgcgg

SEQ ID NO: 859541 - RNA, 20 nt, Mycobacterium avium subsp. paratuberculosis
cgccacaaacagcgcggccg

SEQ ID NO: 859542 - RNA, 22 nt, Mycobacterium avium subsp. paratuberculosis
cgccacaaacagcgcggccgga

SEQ ID NO: 859543 - RNA, 15 nt, Mycobacterium avium subsp. paratuberculosis
cgccacaacuggccg

SEQ ID NO: 859544 - RNA, 20 nt, Mycobacterium avium subsp. paratuberculosis
cgccacaacuggccgggauu

SEQ ID NO: 859545 - RNA, 16 nt, Mycobacterium avium subsp. paratuberculosis
cgccacaacuggucgu

SEQ ID NO: 859546 - RNA, 18 nt, Mycobacterium avium subsp. paratuberculosis
cgccacaacuggucgugc

SEQ ID NO: 859547 - RNA, 23 nt, Mycobacterium avium subsp. paratuberculosis
cgccacaacuggucgugcucguc

SEQ ID NO: 859548 - RNA, 13 nt, Mycobacterium avium subsp. paratuberculosis
cgccaaccagguc

SEQ ID NO: 859549 - RNA, 20 nt, Mycobacterium avium subsp. paratuberculosis
cgccaaccaggucgcggcgc

SEQ ID NO: 859550 - RNA, 15 nt, Mycobacterium avium subsp. paratuberculosis
cgcauucaccagcug

SEQ ID NO: 859551 - RNA, 16 nt, Mycobacterium avium subsp. paratuberculosis
cgcauguccgccguca

SEQ ID NO: 859552 - RNA, 19 nt, Mycobacterium avium subsp. paratuberculosis
cgcauguccgccgucaucg

SEQ ID NO: 859553 - RNA, 15 nt, Mycobacterium avium subsp. paratuberculosis
cgcauguucucgagc

SEQ ID NO: 859554 - RNA, 19 nt, Mycobacterium avium subsp. paratuberculosis
cgcauguucucgagcccga

SEQ ID NO: 859555 - RNA, 22 nt, Mycobacterium avium subsp. paratuberculosis
cgcauguugugcccgacggcgc

SEQ ID NO: 859556 - RNA, 20 nt, Mycobacterium avium subsp. paratuberculosis
cgcauguaggacaccccggc

SEQ ID NO: 859557 - RNA, 18 nt, Mycobacterium avium subsp. paratuberculosis
cgccaacaacucgacgcu

SEQ ID NO: 859558 - RNA, 21 nt, Mycobacterium avium subsp. paratuberculosis
cgcauggucagguaggcgucg

SEQ ID NO: 859559 - RNA, 22 nt, Mycobacterium avium subsp. paratuberculosis
cgcauggucagguaggcgucga

SEQ ID NO: 859560 - RNA, 16 nt, Mycobacterium avium subsp. paratuberculosis
cgcaugucgaccucgg

SEQ ID NO: 859561 - RNA, 22 nt, Mycobacterium avium subsp. paratuberculosis
cgcaugucgaccucggccacca

SEQ ID NO: 859562 - RNA, 23 nt, Mycobacterium avium subsp. paratuberculosis
cgcaugucgaccucggccaccac

SEQ ID NO: 859563 - RNA, 19 nt, Mycobacterium avium subsp. paratuberculosis
cgccacagcagcaccagcg

SEQ ID NO: 859564 - RNA, 21 nt, Mycobacterium avium subsp. paratuberculosis
cgccacagcagcaccagcgcg

SEQ ID NO: 859565 - RNA, 15 nt, Mycobacterium avium subsp. paratuberculosis
cgccacaccucggcg

SEQ ID NO: 859566 - RNA, 16 nt, Mycobacterium avium subsp. paratuberculosis
cgccacaccucggcga

SEQ ID NO: 859567 - RNA, 18 nt, Mycobacterium avium subsp. paratuberculosis
cgccacaccucggcgacc

SEQ ID NO: 859568 - RNA, 17 nt, Mycobacterium avium subsp. paratuberculosis
cgccaauugugugacaa

SEQ ID NO: 859569 - RNA, 13 nt, Mycobacterium avium subsp. paratuberculosis
cgccacaccgaag

SEQ ID NO: 859570 - RNA, 18 nt, Mycobacterium avium subsp. paratuberculosis
cgccacaucagcucggcg

SEQ ID NO: 859571 - RNA, 19 nt, Mycobacterium avium subsp. paratuberculosis
cgccacaucagcucggcgg

SEQ ID NO: 859572 - RNA, 20 nt, Mycobacterium avium subsp. paratuberculosis
cgccacaucagcucggcggc

SEQ ID NO: 859573 - RNA, 22 nt, Mycobacterium avium subsp. paratuberculosis
cgccacaucgggauuggcggcc

SEQ ID NO: 859574 - RNA, 13 nt, Mycobacterium avium subsp. paratuberculosis
cgccacagcgccu

SEQ ID NO: 859575 - RNA, 14 nt, Mycobacterium avium subsp. paratuberculosis
cgccacagcgccuc

SEQ ID NO: 859576 - RNA, 15 nt, Mycobacterium avium subsp. paratuberculosis
cgccacagcgccucg

SEQ ID NO: 859577 - RNA, 17 nt, Mycobacterium avium subsp. paratuberculosis
cgccacagcgccucgcg

SEQ ID NO: 859578 - RNA, 21 nt, Mycobacterium avium subsp. paratuberculosis
cgccacagcgucucgaccgcg

SEQ ID NO: 859579 - RNA, 17 nt, Mycobacterium avium subsp. paratuberculosis
cgccaccgacaccaccg

SEQ ID NO: 859580 - RNA, 19 nt, Mycobacterium avium subsp. paratuberculosis
cgccaccgacaccaccggc

SEQ ID NO: 859581 - RNA, 14 nt, Mycobacterium avium subsp. paratuberculosis
cgccaccgagucgc

SEQ ID NO: 859582 - RNA, 18 nt, Mycobacterium avium subsp. paratuberculosis
cgccaccgagucgcgcga

SEQ ID NO: 859583 - RNA, 21 nt, Mycobacterium avium subsp. paratuberculosis
cgccaccgagucgcgcgacca

SEQ ID NO: 859584 - RNA, 22 nt, Mycobacterium avium subsp. paratuberculosis
cgccaccgagucgcgcgaccag

SEQ ID NO: 859585 - RNA, 23 nt, Mycobacterium avium subsp. paratuberculosis
cgccaccgagucgcgcgaccagu

SEQ ID NO: 859586 - RNA, 20 nt, Mycobacterium avium subsp. paratuberculosis
cgccaccccgagcucgggcg

SEQ ID NO: 859587 - RNA, 21 nt, Mycobacterium avium subsp. paratuberculosis
cgccaccccgagcucgggcgc

SEQ ID NO: 859588 - RNA, 15 nt, Mycobacterium avium subsp. paratuberculosis
cgccaccccgcgcca

SEQ ID NO: 859589 - RNA, 16 nt, Mycobacterium avium subsp. paratuberculosis
cgccaccccgcgccac

SEQ ID NO: 859590 - RNA, 17 nt, Mycobacterium avium subsp. paratuberculosis
cgccaccccgcgccacg

SEQ ID NO: 859591 - RNA, 18 nt, Mycobacterium avium subsp. paratuberculosis
cgccaccccgcgccacgc

SEQ ID NO: 859592 - RNA, 12 nt, Mycobacterium avium subsp. paratuberculosis
cgccacccgcac

SEQ ID NO: 859593 - RNA, 16 nt, Mycobacterium avium subsp. paratuberculosis
cgccacccgcaccucg

SEQ ID NO: 859594 - RNA, 21 nt, Mycobacterium avium subsp. paratuberculosis
cgccacccgcaccucgcuggc

SEQ ID NO: 859595 - RNA, 13 nt, Mycobacterium avium subsp. paratuberculosis
cgcaagugcgguc

SEQ ID NO: 859596 - RNA, 14 nt, Mycobacterium avium subsp. paratuberculosis
cgcaagugcgguca

SEQ ID NO: 859597 - RNA, 15 nt, Mycobacterium avium subsp. paratuberculosis
cgcaagugcggucag

SEQ ID NO: 859598 - RNA, 14 nt, Mycobacterium avium subsp. paratuberculosis
cgcaauacggugcc

SEQ ID NO: 859599 - RNA, 20 nt, Mycobacterium avium subsp. paratuberculosis
cgcaauacggugcccgccgc

SEQ ID NO: 859600 - RNA, 22 nt, Mycobacterium avium subsp. paratuberculosis
cgcaauacggugcccgccgcga

SEQ ID NO: 859601 - RNA, 15 nt, Mycobacterium avium subsp. paratuberculosis
cgcaauacaccgcga

SEQ ID NO: 859602 - RNA, 15 nt, Mycobacterium avium subsp. paratuberculosis
cgcaauacccgacca

SEQ ID NO: 859603 - RNA, 20 nt, Mycobacterium avium subsp. paratuberculosis
cgcaauacccgaccagcacc

SEQ ID NO: 859604 - RNA, 21 nt, Mycobacterium avium subsp. paratuberculosis
cgcaauacccgaccagcaccg

SEQ ID NO: 859605 - RNA, 20 nt, Mycobacterium avium subsp. paratuberculosis
cgcaaggugauucgcgcggc

SEQ ID NO: 859606 - RNA, 14 nt, Mycobacterium avium subsp. paratuberculosis
cgcaagggccgaca

SEQ ID NO: 859607 - RNA, 17 nt, Mycobacterium avium subsp. paratuberculosis
cgcaagggccgacaucg

SEQ ID NO: 859608 - RNA, 22 nt, Mycobacterium avium subsp. paratuberculosis
cgcaagggccgacaucgucggc

SEQ ID NO: 859609 - RNA, 14 nt, Mycobacterium avium subsp. paratuberculosis
cgcaaugccgccgc

SEQ ID NO: 859610 - RNA, 16 nt, Mycobacterium avium subsp. paratuberculosis
cgcaaugccgccgcga

SEQ ID NO: 859611 - RNA, 13 nt, Mycobacterium avium subsp. paratuberculosis
cgcaaugcgucgc

SEQ ID NO: 859612 - RNA, 18 nt, Mycobacterium avium subsp. paratuberculosis
cgcaaugcgucgcggcgg

SEQ ID NO: 859613 - RNA, 20 nt, Mycobacterium avium subsp. paratuberculosis
cgcaaugcgucgcggcggcg

SEQ ID NO: 859614 - RNA, 18 nt, Mycobacterium avium subsp. paratuberculosis
cgcaaucgcccagucccg

SEQ ID NO: 859615 - RNA, 15 nt, Mycobacterium avium subsp. paratuberculosis
cgcaaucggcgccgg

SEQ ID NO: 859616 - RNA, 21 nt, Mycobacterium avium subsp. paratuberculosis
cgcaaucggggccgacccgca

SEQ ID NO: 859617 - RNA, 23 nt, Mycobacterium avium subsp. paratuberculosis
cgcaauccugcccggucugcggc

SEQ ID NO: 859618 - RNA, 20 nt, Mycobacterium avium subsp. paratuberculosis
cgcacagcuaggucguggcg

SEQ ID NO: 859619 - RNA, 18 nt, Mycobacterium avium subsp. paratuberculosis
cgcacagcuuucgggcgg

SEQ ID NO: 859620 - RNA, 19 nt, Mycobacterium avium subsp. paratuberculosis
cgcacagcuuucgggcggc

SEQ ID NO: 859621 - RNA, 18 nt, Mycobacterium avium subsp. paratuberculosis
cgcacaggaacgcgucga

SEQ ID NO: 859622 - RNA, 19 nt, Mycobacterium avium subsp. paratuberculosis
cgcacaggaacgcgucgac

SEQ ID NO: 859623 - RNA, 20 nt, Mycobacterium avium subsp. paratuberculosis
cgcacaggaacgcgucgacc

SEQ ID NO: 859624 - RNA, 12 nt, Mycobacterium avium subsp. paratuberculosis
cgcacagcgcca

SEQ ID NO: 859625 - RNA, 13 nt, Mycobacterium avium subsp. paratuberculosis
cgcacagcgccac

SEQ ID NO: 859626 - RNA, 14 nt, Mycobacterium avium subsp. paratuberculosis
cgcacagccggcgc

SEQ ID NO: 859627 - RNA, 16 nt, Mycobacterium avium subsp. paratuberculosis
cgcacagccggcgcgc

SEQ ID NO: 859628 - RNA, 18 nt, Mycobacterium avium subsp. paratuberculosis
cgcacagccggcgcgcgg

SEQ ID NO: 859629 - RNA, 16 nt, Mycobacterium avium subsp. paratuberculosis
cgcacagccggcggcg

SEQ ID NO: 859630 - RNA, 17 nt, Mycobacterium avium subsp. paratuberculosis
cgcacagccggcggcgg

SEQ ID NO: 859631 - RNA, 17 nt, Mycobacterium avium subsp. paratuberculosis
cgcacaucacgguggcc

SEQ ID NO: 859632 - RNA, 23 nt, Mycobacterium avium subsp. paratuberculosis
cgcacaucacgguggccgccacc

SEQ ID NO: 859633 - RNA, 14 nt, Mycobacterium avium subsp. paratuberculosis
cgcacaucguggcg

SEQ ID NO: 859634 - RNA, 15 nt, Mycobacterium avium subsp. paratuberculosis
cgcaccacgucgggu

SEQ ID NO: 859635 - RNA, 22 nt, Mycobacterium avium subsp. paratuberculosis
cgcaccacgucggguucgccgg

SEQ ID NO: 859636 - RNA, 17 nt, Mycobacterium avium subsp. paratuberculosis
cgcaccacgugcgcgaa

SEQ ID NO: 859637 - RNA, 22 nt, Mycobacterium avium subsp. paratuberculosis
cgcacaauccggucagcguggc

SEQ ID NO: 859638 - RNA, 15 nt, Mycobacterium avium subsp. paratuberculosis
cgcacacggccucgc

SEQ ID NO: 859639 - RNA, 23 nt, Mycobacterium avium subsp. paratuberculosis
cgcacacggccucgcccagcgcc

SEQ ID NO: 859640 - RNA, 22 nt, Mycobacterium avium subsp. paratuberculosis
cgcacagcauguccucggggug

SEQ ID NO: 859641 - RNA, 19 nt, Mycobacterium avium subsp. paratuberculosis
cgcacagccgcagcagccg

SEQ ID NO: 859642 - RNA, 14 nt, Mycobacterium avium subsp. paratuberculosis
cgcacagcaccagu

SEQ ID NO: 859643 - RNA, 23 nt, Mycobacterium avium subsp. paratuberculosis
cgcacagcaccaguugcaccggc

SEQ ID NO: 859644 - RNA, 16 nt, Mycobacterium avium subsp. paratuberculosis
cgcacaccagcacggc

SEQ ID NO: 859645 - RNA, 19 nt, Mycobacterium avium subsp. paratuberculosis
cgcacaccagcacggcggc

SEQ ID NO: 859646 - RNA, 21 nt, Mycobacterium avium subsp. paratuberculosis
cgcacaccagcacggcggcgc

SEQ ID NO: 859647 - RNA, 13 nt, Mycobacterium avium subsp. paratuberculosis
cgcacaccgcgcg

SEQ ID NO: 859648 - RNA, 17 nt, Mycobacterium avium subsp. paratuberculosis
cgcacaccgcggcggcg

SEQ ID NO: 859649 - RNA, 22 nt, Mycobacterium avium subsp. paratuberculosis
cgcacaccgcggcggcgucggc

SEQ ID NO: 859650 - RNA, 23 nt, Mycobacterium avium subsp. paratuberculosis
cgcacaccgcggcggcgucggcg

SEQ ID NO: 859651 - RNA, 12 nt, Mycobacterium avium subsp. paratuberculosis
cgcacaccggcc

SEQ ID NO: 859652 - RNA, 15 nt, Mycobacterium avium subsp. paratuberculosis
cgcaauugcgccagc

SEQ ID NO: 859653 - RNA, 16 nt, Mycobacterium avium subsp. paratuberculosis
cgcaauugcgccagca

SEQ ID NO: 859654 - RNA, 16 nt, Mycobacterium avium subsp. paratuberculosis
cgcacaaccgggccaa

SEQ ID NO: 859655 - RNA, 23 nt, Mycobacterium avium subsp. paratuberculosis
cgcacaaccgggccaacgguucg

SEQ ID NO: 859656 - RNA, 13 nt, Mycobacterium avium subsp. paratuberculosis
cgcacaacgaggc

SEQ ID NO: 859657 - RNA, 22 nt, Mycobacterium avium subsp. paratuberculosis
cgcacaacgaggcccggacggc

SEQ ID NO: 859658 - RNA, 18 nt, Mycobacterium avium subsp. paratuberculosis
cgcacaacagacgaucac

SEQ ID NO: 859659 - RNA, 21 nt, Mycobacterium avium subsp. paratuberculosis
cgcacaacccggacagcgcga

SEQ ID NO: 859660 - RNA, 19 nt, Mycobacterium avium subsp. paratuberculosis
cgcaaaucagccgagccgg

SEQ ID NO: 859661 - RNA, 15 nt, Mycobacterium avium subsp. paratuberculosis
cgcaacaacuucgcg

SEQ ID NO: 859662 - RNA, 16 nt, Mycobacterium avium subsp. paratuberculosis
cgcaacaccacgucgg

SEQ ID NO: 859663 - RNA, 13 nt, Mycobacterium avium subsp. paratuberculosis
cgcaacaccagca

SEQ ID NO: 859664 - RNA, 14 nt, Mycobacterium avium subsp. paratuberculosis
cgcaacaccagcac

SEQ ID NO: 859665 - RNA, 16 nt, Mycobacterium avium subsp. paratuberculosis
cgcaacacggccucga

SEQ ID NO: 859666 - RNA, 17 nt, Mycobacterium avium subsp. paratuberculosis
cgcaacgcgcgcgacgg

SEQ ID NO: 859667 - RNA, 18 nt, Mycobacterium avium subsp. paratuberculosis
cgcaacgcgcgcgacggc

SEQ ID NO: 859668 - RNA, 21 nt, Mycobacterium avium subsp. paratuberculosis
cgcaacgcgcgcgacggcgcg

SEQ ID NO: 859669 - RNA, 15 nt, Mycobacterium avium subsp. paratuberculosis
cgcaacgcggcggug

SEQ ID NO: 859670 - RNA, 16 nt, Mycobacterium avium subsp. paratuberculosis
cgcaacgcggcgguga

SEQ ID NO: 859671 - RNA, 12 nt, Mycobacterium avium subsp. paratuberculosis
cgcaacggcggu

SEQ ID NO: 859672 - RNA, 13 nt, Mycobacterium avium subsp. paratuberculosis
cgcaacggcgguc

SEQ ID NO: 859673 - RNA, 13 nt, Mycobacterium avium subsp. paratuberculosis
cgcaacggcgucg

SEQ ID NO: 859674 - RNA, 14 nt, Mycobacterium avium subsp. paratuberculosis
cgcaacggcgucga

SEQ ID NO: 859675 - RNA, 11 nt, Mycobacterium avium subsp. paratuberculosis
cgcaacagcac

SEQ ID NO: 859676 - RNA, 13 nt, Mycobacterium avium subsp. paratuberculosis
cgcaacagcaccu

SEQ ID NO: 859677 - RNA, 22 nt, Mycobacterium avium subsp. paratuberculosis
cgcaacagcaccucgucgcccg

SEQ ID NO: 859678 - RNA, 13 nt, Mycobacterium avium subsp. paratuberculosis
cgcaacagccggc

SEQ ID NO: 859679 - RNA, 20 nt, Mycobacterium avium subsp. paratuberculosis
cgcaacagcgucucgacggc

SEQ ID NO: 859680 - RNA, 20 nt, Mycobacterium avium subsp. paratuberculosis
cgcaacaccgaaagccgaca

SEQ ID NO: 859681 - RNA, 15 nt, Mycobacterium avium subsp. paratuberculosis
cgcaacaccucggcg

SEQ ID NO: 859682 - RNA, 22 nt, Mycobacterium avium subsp. paratuberculosis
cgcaacuguucgcggcuggccg

SEQ ID NO: 859683 - RNA, 23 nt, Mycobacterium avium subsp. paratuberculosis
cgcaacuguucgcggcuggccgc

SEQ ID NO: 859684 - RNA, 14 nt, Mycobacterium avium subsp. paratuberculosis
cgcaagaagggcga

SEQ ID NO: 859685 - RNA, 17 nt, Mycobacterium avium subsp. paratuberculosis
cgcaagaagucgguguu

SEQ ID NO: 859686 - RNA, 16 nt, Mycobacterium avium subsp. paratuberculosis
cgcaacucguccacca

SEQ ID NO: 859687 - RNA, 19 nt, Mycobacterium avium subsp. paratuberculosis
cgcaacucguccagcgucg

SEQ ID NO: 859688 - RNA, 16 nt, Mycobacterium avium subsp. paratuberculosis
cgcaacgugcgccggc

SEQ ID NO: 859689 - RNA, 17 nt, Mycobacterium avium subsp. paratuberculosis
cgcaacgugcgccggcc

SEQ ID NO: 859690 - RNA, 18 nt, Mycobacterium avium subsp. paratuberculosis
cgcaagcaccggcuggcc

SEQ ID NO: 859691 - RNA, 15 nt, Mycobacterium avium subsp. paratuberculosis
cgcaacuugcccgac

SEQ ID NO: 859692 - RNA, 16 nt, Mycobacterium avium subsp. paratuberculosis
cgaugcucccggucgu

SEQ ID NO: 859693 - RNA, 18 nt, Mycobacterium avium subsp. paratuberculosis
cgaugcugagcgggucgg

SEQ ID NO: 859694 - RNA, 20 nt, Mycobacterium avium subsp. paratuberculosis
cgaugcugauacccgcgcgg

SEQ ID NO: 859695 - RNA, 21 nt, Mycobacterium avium subsp. paratuberculosis
cgaugcugauacccgcgcggc

SEQ ID NO: 859696 - RNA, 19 nt, Mycobacterium avium subsp. paratuberculosis
cgaugcguugcgccagcac

SEQ ID NO: 859697 - RNA, 13 nt, Mycobacterium avium subsp. paratuberculosis
cgauggcccgcgc

SEQ ID NO: 859698 - RNA, 16 nt, Mycobacterium avium subsp. paratuberculosis
cgauggcccgcucggu

SEQ ID NO: 859699 - RNA, 18 nt, Mycobacterium avium subsp. paratuberculosis
cgauggcccgcugcgccg

SEQ ID NO: 859700 - RNA, 20 nt, Mycobacterium avium subsp. paratuberculosis
cgauggcccgcugcgccgac

SEQ ID NO: 859701 - RNA, 21 nt, Mycobacterium avium subsp. paratuberculosis
cgauggcccgcugcgccgacu

SEQ ID NO: 859702 - RNA, 17 nt, Mycobacterium avium subsp. paratuberculosis
cgauggccagcgcgucg

SEQ ID NO: 859703 - RNA, 17 nt, Mycobacterium avium subsp. paratuberculosis
cgauggccaggcccagc

SEQ ID NO: 859704 - RNA, 14 nt, Mycobacterium avium subsp. paratuberculosis
cgauggccagcgcg

SEQ ID NO: 859705 - RNA, 17 nt, Mycobacterium avium subsp. paratuberculosis
cgauggccaccgggcgu

SEQ ID NO: 859706 - RNA, 15 nt, Mycobacterium avium subsp. paratuberculosis
cgauuucgcggccga

SEQ ID NO: 859707 - RNA, 20 nt, Mycobacterium avium subsp. paratuberculosis
cgauuucgccugcagccgcc

SEQ ID NO: 859708 - RNA, 14 nt, Mycobacterium avium subsp. paratuberculosis
cgauuucggccagc

SEQ ID NO: 859709 - RNA, 16 nt, Mycobacterium avium subsp. paratuberculosis
cgauuucggccagccg

SEQ ID NO: 859710 - RNA, 17 nt, Mycobacterium avium subsp. paratuberculosis
cgauuucggccgugauc

SEQ ID NO: 859711 - RNA, 18 nt, Mycobacterium avium subsp. paratuberculosis
cgauggcccaggccgcgg

SEQ ID NO: 859712 - RNA, 19 nt, Mycobacterium avium subsp. paratuberculosis
cgauggcccggaccgccgc

SEQ ID NO: 859713 - RNA, 22 nt, Mycobacterium avium subsp. paratuberculosis
cgauggcccggaccgccgcggc

SEQ ID NO: 859714 - RNA, 16 nt, Mycobacterium avium subsp. paratuberculosis
cgauggcccgggccac

SEQ ID NO: 859715 - RNA, 19 nt, Mycobacterium avium subsp. paratuberculosis
cgauggcccgggccacacc

SEQ ID NO: 859716 - RNA, 14 nt, Mycobacterium avium subsp. paratuberculosis
cgauggccgacaac

SEQ ID NO: 859717 - RNA, 23 nt, Mycobacterium avium subsp. paratuberculosis
cgauuucauauugguucgcucgu

SEQ ID NO: 859718 - RNA, 22 nt, Mycobacterium avium subsp. paratuberculosis
cgcacggcgaacggccgcgaug

SEQ ID NO: 859719 - RNA, 22 nt, Mycobacterium avium subsp. paratuberculosis
cgcacggcgcccagguccacca

SEQ ID NO: 859720 - RNA, 16 nt, Mycobacterium avium subsp. paratuberculosis
cgcacggcgcgcaccg

SEQ ID NO: 859721 - RNA, 14 nt, Mycobacterium avium subsp. paratuberculosis
cgcaccuucccggc

SEQ ID NO: 859722 - RNA, 17 nt, Mycobacterium avium subsp. paratuberculosis
cgcaccuucccggccgc

SEQ ID NO: 859723 - RNA, 18 nt, Mycobacterium avium subsp. paratuberculosis
cgcaccuggucggucagc

SEQ ID NO: 859724 - RNA, 13 nt, Mycobacterium avium subsp. paratuberculosis
cgcaccuggcagc

SEQ ID NO: 859725 - RNA, 15 nt, Mycobacterium avium subsp. paratuberculosis
cgcaccuggcgcagc

SEQ ID NO: 859726 - RNA, 16 nt, Mycobacterium avium subsp. paratuberculosis
cgcaccuggcgcagca

SEQ ID NO: 859727 - RNA, 18 nt, Mycobacterium avium subsp. paratuberculosis
cgcaccuggcgcagcacc

SEQ ID NO: 859728 - RNA, 20 nt, Mycobacterium avium subsp. paratuberculosis
cgcaccuggcgcagcaccga

SEQ ID NO: 859729 - RNA, 15 nt, Mycobacterium avium subsp. paratuberculosis
cgcaccugccgucga

SEQ ID NO: 859730 - RNA, 13 nt, Mycobacterium avium subsp. paratuberculosis
cgcaccugcggcc

SEQ ID NO: 859731 - RNA, 16 nt, Mycobacterium avium subsp. paratuberculosis
cgcaccugcuccucga

SEQ ID NO: 859732 - RNA, 17 nt, Mycobacterium avium subsp. paratuberculosis
cgcaccugcuccucgaa

SEQ ID NO: 859733 - RNA, 18 nt, Mycobacterium avium subsp. paratuberculosis
cgcaccugaucgaugccg

SEQ ID NO: 859734 - RNA, 16 nt, Mycobacterium avium subsp. paratuberculosis
cgcaccugcgcgccgu

SEQ ID NO: 859735 - RNA, 19 nt, Mycobacterium avium subsp. paratuberculosis
cgcaccugcgcgccguugg

SEQ ID NO: 859736 - RNA, 13 nt, Mycobacterium avium subsp. paratuberculosis
cgcaccucggccg

SEQ ID NO: 859737 - RNA, 15 nt, Mycobacterium avium subsp. paratuberculosis
cgcaccucggccggg

SEQ ID NO: 859738 - RNA, 18 nt, Mycobacterium avium subsp. paratuberculosis
cgcaccucggccgggucc

SEQ ID NO: 859739 - RNA, 18 nt, Mycobacterium avium subsp. paratuberculosis
cgcaccucggggcguggc

SEQ ID NO: 859740 - RNA, 20 nt, Mycobacterium avium subsp. paratuberculosis
cgcaccucggggcguggcgg

SEQ ID NO: 859741 - RNA, 13 nt, Mycobacterium avium subsp. paratuberculosis
cgcacucggugug

SEQ ID NO: 859742 - RNA, 18 nt, Mycobacterium avium subsp. paratuberculosis
cgcacucgguguggccca

SEQ ID NO: 859743 - RNA, 14 nt, Mycobacterium avium subsp. paratuberculosis
cgcacuccgucgcg

SEQ ID NO: 859744 - RNA, 18 nt, Mycobacterium avium subsp. paratuberculosis
cgcacuccgucgcgauca

SEQ ID NO: 859745 - RNA, 18 nt, Mycobacterium avium subsp. paratuberculosis
cgcacucgaacggcccgg

SEQ ID NO: 859746 - RNA, 21 nt, Mycobacterium avium subsp. paratuberculosis
cgcacucgaacggcccggacg

SEQ ID NO: 859747 - RNA, 14 nt, Mycobacterium avium subsp. paratuberculosis
cgcacgggcggcgg

SEQ ID NO: 859748 - RNA, 17 nt, Mycobacterium avium subsp. paratuberculosis
cgcacggucgcgguguc

SEQ ID NO: 859749 - RNA, 22 nt, Mycobacterium avium subsp. paratuberculosis
cgcacggucgcggugucggcgu

SEQ ID NO: 859750 - RNA, 15 nt, Mycobacterium avium subsp. paratuberculosis
cgcacggugcagcag

SEQ ID NO: 859751 - RNA, 17 nt, Mycobacterium avium subsp. paratuberculosis
cgcacggugcagcagcg

SEQ ID NO: 859752 - RNA, 19 nt, Mycobacterium avium subsp. paratuberculosis
cgcacggugcagcagcgcc

SEQ ID NO: 859753 - RNA, 20 nt, Mycobacterium avium subsp. paratuberculosis
cgcacggugcagcagcgccg

SEQ ID NO: 859754 - RNA, 19 nt, Mycobacterium avium subsp. paratuberculosis
cgcacggugcccgucggca

SEQ ID NO: 859755 - RNA, 12 nt, Mycobacterium avium subsp. paratuberculosis
cgcaccucgccc

SEQ ID NO: 859756 - RNA, 15 nt, Mycobacterium avium subsp. paratuberculosis
cgcaccucgcccggc

SEQ ID NO: 859757 - RNA, 16 nt, Mycobacterium avium subsp. paratuberculosis
cgcaccucgcccggcu

SEQ ID NO: 859758 - RNA, 18 nt, Mycobacterium avium subsp. paratuberculosis
cgcaccucgcccggcucg

SEQ ID NO: 859759 - RNA, 21 nt, Mycobacterium avium subsp. paratuberculosis
cgcaccucgcccggcucgaag

SEQ ID NO: 859760 - RNA, 17 nt, Mycobacterium avium subsp. paratuberculosis
cgcaccucgccgaucuc

SEQ ID NO: 859761 - RNA, 16 nt, Mycobacterium avium subsp. paratuberculosis
cgcaccucgccggccg

SEQ ID NO: 859762 - RNA, 19 nt, Mycobacterium avium subsp. paratuberculosis
cgcaccucgccggccgccg

SEQ ID NO: 859763 - RNA, 20 nt, Mycobacterium avium subsp. paratuberculosis
cgcaccucgccggccgccgu

SEQ ID NO: 859764 - RNA, 18 nt, Mycobacterium avium subsp. paratuberculosis
cgcaccucgcucagcccg

SEQ ID NO: 859765 - RNA, 13 nt, Mycobacterium avium subsp. paratuberculosis
cgcaccgucaucg

SEQ ID NO: 859766 - RNA, 16 nt, Mycobacterium avium subsp. paratuberculosis
cgcaccgucaucgcgg

SEQ ID NO: 859767 - RNA, 18 nt, Mycobacterium avium subsp. paratuberculosis
cgcaccgucaucgcggcg

SEQ ID NO: 859768 - RNA, 22 nt, Mycobacterium avium subsp. paratuberculosis
cgcaccgucaucgcggcgaaca

SEQ ID NO: 859769 - RNA, 20 nt, Mycobacterium avium subsp. paratuberculosis
cgcaccgucgugccagcgca

SEQ ID NO: 859770 - RNA, 21 nt, Mycobacterium avium subsp. paratuberculosis
cgcaccguguagccgaccgac

SEQ ID NO: 859771 - RNA, 17 nt, Mycobacterium avium subsp. paratuberculosis
cgcaccggucagcgcua

SEQ ID NO: 859772 - RNA, 12 nt, Mycobacterium avium subsp. paratuberculosis
cgcaccggucca

SEQ ID NO: 859773 - RNA, 15 nt, Mycobacterium avium subsp. paratuberculosis
cgcaccgggaccagc

SEQ ID NO: 859774 - RNA, 17 nt, Mycobacterium avium subsp. paratuberculosis
cgcaccgggaccagcgc

SEQ ID NO: 859775 - RNA, 18 nt, Mycobacterium avium subsp. paratuberculosis
cgcaccgggaccagcgcg

SEQ ID NO: 859776 - RNA, 21 nt, Mycobacterium avium subsp. paratuberculosis
cgcaccgggaccagcgcggug

SEQ ID NO: 859777 - RNA, 22 nt, Mycobacterium avium subsp. paratuberculosis
cgcaccgggaccagcgcggugc

SEQ ID NO: 859778 - RNA, 14 nt, Mycobacterium avium subsp. paratuberculosis
cgcaccggcugccc

SEQ ID NO: 859779 - RNA, 16 nt, Mycobacterium avium subsp. paratuberculosis
cgcaccggcugcccca

SEQ ID NO: 859780 - RNA, 12 nt, Mycobacterium avium subsp. paratuberculosis
cgcaccgggccc

SEQ ID NO: 859781 - RNA, 23 nt, Mycobacterium avium subsp. paratuberculosis
cgcaccgggcccgcccgcagcgg

SEQ ID NO: 859782 - RNA, 16 nt, Mycobacterium avium subsp. paratuberculosis
cgcaccggccggcccc

SEQ ID NO: 859783 - RNA, 21 nt, Mycobacterium avium subsp. paratuberculosis
cgcaccggcgaugcagaucac

SEQ ID NO: 859784 - RNA, 15 nt, Mycobacterium avium subsp. paratuberculosis
cgcaccggcgcuggu

SEQ ID NO: 859785 - RNA, 14 nt, Mycobacterium avium subsp. paratuberculosis
cgcaccggcgccgc

SEQ ID NO: 859786 - RNA, 15 nt, Mycobacterium avium subsp. paratuberculosis
cgcaccggcgccgcc

SEQ ID NO: 859787 - RNA, 16 nt, Mycobacterium avium subsp. paratuberculosis
cgcaccggcgccgcca

SEQ ID NO: 859788 - RNA, 16 nt, Mycobacterium avium subsp. paratuberculosis
cgcaccggcgccucga

SEQ ID NO: 859789 - RNA, 13 nt, Mycobacterium avium subsp. paratuberculosis
cgcaccggcagug

SEQ ID NO: 859790 - RNA, 15 nt, Mycobacterium avium subsp. paratuberculosis
cgcaccaggccgacg

SEQ ID NO: 859791 - RNA, 16 nt, Mycobacterium avium subsp. paratuberculosis
cgcaccaggcgccaca

SEQ ID NO: 859792 - RNA, 15 nt, Mycobacterium avium subsp. paratuberculosis
cgcaccagggccgcg

SEQ ID NO: 859793 - RNA, 18 nt, Mycobacterium avium subsp. paratuberculosis
cgcaccagggccgcgagc

SEQ ID NO: 859794 - RNA, 19 nt, Mycobacterium avium subsp. paratuberculosis
cgcaccagggccgcgagcg

SEQ ID NO: 859795 - RNA, 19 nt, Mycobacterium avium subsp. paratuberculosis
cgcaccagggccugcagca

SEQ ID NO: 859796 - RNA, 21 nt, Mycobacterium avium subsp. paratuberculosis
cgcaccagggccugcagcacc

SEQ ID NO: 859797 - RNA, 22 nt, Mycobacterium avium subsp. paratuberculosis
cgcaccagggccugcagcacca

SEQ ID NO: 859798 - RNA, 13 nt, Mycobacterium avium subsp. paratuberculosis
cgcaccagcucga

SEQ ID NO: 859799 - RNA, 22 nt, Mycobacterium avium subsp. paratuberculosis
cgcaccagcucgaggccgcggg

SEQ ID NO: 859800 - RNA, 23 nt, Mycobacterium avium subsp. paratuberculosis
cgcaccagcucgaggccgcgggc

SEQ ID NO: 859801 - RNA, 13 nt, Mycobacterium avium subsp. paratuberculosis
cgcaccagcucgg

SEQ ID NO: 859802 - RNA, 15 nt, Mycobacterium avium subsp. paratuberculosis
cgcaccagcucggcg

SEQ ID NO: 859803 - RNA, 16 nt, Mycobacterium avium subsp. paratuberculosis
cgcaccagcucggcgc

SEQ ID NO: 859804 - RNA, 16 nt, Mycobacterium avium subsp. paratuberculosis
cgcaccagaucgucgg

SEQ ID NO: 859805 - RNA, 17 nt, Mycobacterium avium subsp. paratuberculosis
cgcaccagaucgucggg

SEQ ID NO: 859806 - RNA, 20 nt, Mycobacterium avium subsp. paratuberculosis
cgcaccagauucaccagcgc

SEQ ID NO: 859807 - RNA, 18 nt, Mycobacterium avium subsp. paratuberculosis
cgcaccagcaccccgccg

SEQ ID NO: 859808 - RNA, 21 nt, Mycobacterium avium subsp. paratuberculosis
cgcaccaaagugccguugagc

SEQ ID NO: 859809 - RNA, 16 nt, Mycobacterium avium subsp. paratuberculosis
cgcaccagcaggucca

SEQ ID NO: 859810 - RNA, 12 nt, Mycobacterium avium subsp. paratuberculosis
cgcagcaccgau

SEQ ID NO: 859811 - RNA, 18 nt, Mycobacterium avium subsp. paratuberculosis
cgcagcaccgcgucggcg

SEQ ID NO: 859812 - RNA, 21 nt, Mycobacterium avium subsp. paratuberculosis
cgcagcaccgcgucggcgcug

SEQ ID NO: 859813 - RNA, 12 nt, Mycobacterium avium subsp. paratuberculosis
cgcagcaccgcg

SEQ ID NO: 859814 - RNA, 12 nt, Mycobacterium avium subsp. paratuberculosis
cgcagcaccagg

SEQ ID NO: 859815 - RNA, 18 nt, Mycobacterium avium subsp. paratuberculosis
cgcagcaccaggcccucc

SEQ ID NO: 859816 - RNA, 16 nt, Mycobacterium avium subsp. paratuberculosis
cgcagcaccauccgcg

SEQ ID NO: 859817 - RNA, 18 nt, Mycobacterium avium subsp. paratuberculosis
cgcagcaauugacgccga

SEQ ID NO: 859818 - RNA, 21 nt, Mycobacterium avium subsp. paratuberculosis
cgcagcacguguucgggaucg

SEQ ID NO: 859819 - RNA, 17 nt, Mycobacterium avium subsp. paratuberculosis
cgcagcacggccacugc

SEQ ID NO: 859820 - RNA, 19 nt, Mycobacterium avium subsp. paratuberculosis
cgcagcaccuugccggucg

SEQ ID NO: 859821 - RNA, 20 nt, Mycobacterium avium subsp. paratuberculosis
cgcagcaccuugccggucgg

SEQ ID NO: 859822 - RNA, 22 nt, Mycobacterium avium subsp. paratuberculosis
cgcagcaccuugccggucgggu

SEQ ID NO: 859823 - RNA, 15 nt, Mycobacterium avium subsp. paratuberculosis
cgcagcaccgucacc

SEQ ID NO: 859824 - RNA, 13 nt, Mycobacterium avium subsp. paratuberculosis
cgcagccagcggu

SEQ ID NO: 859825 - RNA, 19 nt, Mycobacterium avium subsp. paratuberculosis
cgcagccagcggucacgga

SEQ ID NO: 859826 - RNA, 15 nt, Mycobacterium avium subsp. paratuberculosis
cgcagccagcucggc

SEQ ID NO: 859827 - RNA, 16 nt, Mycobacterium avium subsp. paratuberculosis
cgcagccagcucggcg

SEQ ID NO: 859828 - RNA, 18 nt, Mycobacterium avium subsp. paratuberculosis
cgcagccagcucggcgua

SEQ ID NO: 859829 - RNA, 17 nt, Mycobacterium avium subsp. paratuberculosis
cgcagcaucacgucggc

SEQ ID NO: 859830 - RNA, 19 nt, Mycobacterium avium subsp. paratuberculosis
cgcagcaucacgucggcga

SEQ ID NO: 859831 - RNA, 20 nt, Mycobacterium avium subsp. paratuberculosis
cgcagcaucacgucggcgag

SEQ ID NO: 859832 - RNA, 19 nt, Mycobacterium avium subsp. paratuberculosis
cgcagcaggugcaucgcca

SEQ ID NO: 859833 - RNA, 21 nt, Mycobacterium avium subsp. paratuberculosis
cgcagcaggugcaucgccacc

SEQ ID NO: 859834 - RNA, 13 nt, Mycobacterium avium subsp. paratuberculosis
cgcagcagccgcg

SEQ ID NO: 859835 - RNA, 18 nt, Mycobacterium avium subsp. paratuberculosis
cgcagcagcgccagcagc

SEQ ID NO: 859836 - RNA, 14 nt, Mycobacterium avium subsp. paratuberculosis
cgcagcaggcgccg

SEQ ID NO: 859837 - RNA, 15 nt, Mycobacterium avium subsp. paratuberculosis
cgcagcaggcgccgg

SEQ ID NO: 859838 - RNA, 17 nt, Mycobacterium avium subsp. paratuberculosis
cgcagcaggcgccgguc

SEQ ID NO: 859839 - RNA, 20 nt, Mycobacterium avium subsp. paratuberculosis
cgcagcaggcggacggcgac

SEQ ID NO: 859840 - RNA, 21 nt, Mycobacterium avium subsp. paratuberculosis
cgcagcaggcggacggcgacc

SEQ ID NO: 859841 - RNA, 20 nt, Mycobacterium avium subsp. paratuberculosis
cgcagcagcguuccgucggc

SEQ ID NO: 859842 - RNA, 21 nt, Mycobacterium avium subsp. paratuberculosis
cgcagcagcgaggccucgccg

SEQ ID NO: 859843 - RNA, 13 nt, Mycobacterium avium subsp. paratuberculosis
cgcagcagcgcca

SEQ ID NO: 859844 - RNA, 16 nt, Mycobacterium avium subsp. paratuberculosis
cgcagcagcaggucgg

SEQ ID NO: 859845 - RNA, 20 nt, Mycobacterium avium subsp. paratuberculosis
cgcacugcaucucgaccugg

SEQ ID NO: 859846 - RNA, 17 nt, Mycobacterium avium subsp. paratuberculosis
cgcacugcacggccucg

SEQ ID NO: 859847 - RNA, 22 nt, Mycobacterium avium subsp. paratuberculosis
cgcacucuugcgugcgggucgc

SEQ ID NO: 859848 - RNA, 18 nt, Mycobacterium avium subsp. paratuberculosis
cgcagaucagggcgaugg

SEQ ID NO: 859849 - RNA, 16 nt, Mycobacterium avium subsp. paratuberculosis
cgcagauacaucucgg

SEQ ID NO: 859850 - RNA, 19 nt, Mycobacterium avium subsp. paratuberculosis
cgcagauacaucucggugg

SEQ ID NO: 859851 - RNA, 21 nt, Mycobacterium avium subsp. paratuberculosis
cgcagauagaucgacgcgacc

SEQ ID NO: 859852 - RNA, 23 nt, Mycobacterium avium subsp. paratuberculosis
cgcagauagccguacacggcggc

SEQ ID NO: 859853 - RNA, 13 nt, Mycobacterium avium subsp. paratuberculosis
cgcagaucgaugg

SEQ ID NO: 859854 - RNA, 18 nt, Mycobacterium avium subsp. paratuberculosis
cgcagaucgccagcaccg

SEQ ID NO: 859855 - RNA, 20 nt, Mycobacterium avium subsp. paratuberculosis
cgcagaucgccagcaccggc

SEQ ID NO: 859856 - RNA, 16 nt, Mycobacterium avium subsp. paratuberculosis
cgcagaucccgccggc

SEQ ID NO: 859857 - RNA, 17 nt, Mycobacterium avium subsp. paratuberculosis
cgcagaucccgccggcg

SEQ ID NO: 859858 - RNA, 21 nt, Mycobacterium avium subsp. paratuberculosis
cgcagaucccgccggcggcca

SEQ ID NO: 859859 - RNA, 22 nt, Mycobacterium avium subsp. paratuberculosis
cgcagaucccgccggcggccac

SEQ ID NO: 859860 - RNA, 22 nt, Mycobacterium avium subsp. paratuberculosis
cgcagcaacgguacgugcgccg

SEQ ID NO: 859861 - RNA, 23 nt, Mycobacterium avium subsp. paratuberculosis
cgcagcaacgguacgugcgccgg

SEQ ID NO: 859862 - RNA, 20 nt, Mycobacterium avium subsp. paratuberculosis
cgcagauggucgggacgucg

SEQ ID NO: 859863 - RNA, 21 nt, Mycobacterium avium subsp. paratuberculosis
cgcagauggucgggacgucgg

SEQ ID NO: 859864 - RNA, 20 nt, Mycobacterium avium subsp. paratuberculosis
cgcagaucgucgaccugcuc

SEQ ID NO: 859865 - RNA, 20 nt, Mycobacterium avium subsp. paratuberculosis
cgcagaucuugugccagccg

SEQ ID NO: 859866 - RNA, 23 nt, Mycobacterium avium subsp. paratuberculosis
cgcagaucuugugccagccgaag

SEQ ID NO: 859867 - RNA, 18 nt, Mycobacterium avium subsp. paratuberculosis
cgcagaugaccggccugc

SEQ ID NO: 859868 - RNA, 23 nt, Mycobacterium avium subsp. paratuberculosis
cgcagaugauuucgaagcugucg

SEQ ID NO: 859869 - RNA, 16 nt, Mycobacterium avium subsp. paratuberculosis
cgauaguagccagcau

SEQ ID NO: 859870 - RNA, 14 nt, Mycobacterium avium subsp. paratuberculosis
cgauaggcggccag

SEQ ID NO: 859871 - RNA, 12 nt, Mycobacterium avium subsp. paratuberculosis
cgauagggccgg

SEQ ID NO: 859872 - RNA, 21 nt, Mycobacterium avium subsp. paratuberculosis
cgauagcuucccuugcccgga

SEQ ID NO: 859873 - RNA, 21 nt, Mycobacterium avium subsp. paratuberculosis
cgauagcuugagccccgccgg

SEQ ID NO: 859874 - RNA, 15 nt, Mycobacterium avium subsp. paratuberculosis
cgauagccccgccag

SEQ ID NO: 859875 - RNA, 22 nt, Mycobacterium avium subsp. paratuberculosis
cgauagccccgccaggcggcga

SEQ ID NO: 859876 - RNA, 13 nt, Mycobacterium avium subsp. paratuberculosis
cgaucaccccggc

SEQ ID NO: 859877 - RNA, 15 nt, Mycobacterium avium subsp. paratuberculosis
cgaucaccccggcga

SEQ ID NO: 859878 - RNA, 19 nt, Mycobacterium avium subsp. paratuberculosis
cgaucaccccggcgacggc

SEQ ID NO: 859879 - RNA, 20 nt, Mycobacterium avium subsp. paratuberculosis
cgaucaccccggcgacggcg

SEQ ID NO: 859880 - RNA, 21 nt, Mycobacterium avium subsp. paratuberculosis
cgaucaccccggcgacggcgg

SEQ ID NO: 859881 - RNA, 22 nt, Mycobacterium avium subsp. paratuberculosis
cgaucaccccggcgacggcggu

SEQ ID NO: 859882 - RNA, 16 nt, Mycobacterium avium subsp. paratuberculosis
cgaucaacaccgccag

SEQ ID NO: 859883 - RNA, 19 nt, Mycobacterium avium subsp. paratuberculosis
cgaucaacaccgccagcac

SEQ ID NO: 859884 - RNA, 20 nt, Mycobacterium avium subsp. paratuberculosis
cgaucaacaccgccagcacc

SEQ ID NO: 859885 - RNA, 21 nt, Mycobacterium avium subsp. paratuberculosis
cgaucaacaccgccagcaccg

SEQ ID NO: 859886 - RNA, 18 nt, Mycobacterium avium subsp. paratuberculosis
cgaucaacaggcccagca

SEQ ID NO: 859887 - RNA, 20 nt, Mycobacterium avium subsp. paratuberculosis
cgaucaacaggcccagcagc

SEQ ID NO: 859888 - RNA, 21 nt, Mycobacterium avium subsp. paratuberculosis
cgaucaacaggcccagcagcg

SEQ ID NO: 859889 - RNA, 23 nt, Mycobacterium avium subsp. paratuberculosis
cgaucaacaggcccagcagcgca

SEQ ID NO: 859890 - RNA, 23 nt, Mycobacterium avium subsp. paratuberculosis
cgaucaacugaucgagcucggcc

SEQ ID NO: 859891 - RNA, 22 nt, Mycobacterium avium subsp. paratuberculosis
cgaucaacgccgggucgacgcc

SEQ ID NO: 859892 - RNA, 14 nt, Mycobacterium avium subsp. paratuberculosis
cgaucaacggcagc

SEQ ID NO: 859893 - RNA, 15 nt, Mycobacterium avium subsp. paratuberculosis
cgaucaacggcagcg

SEQ ID NO: 859894 - RNA, 18 nt, Mycobacterium avium subsp. paratuberculosis
cgauaaccucggcggcgg

SEQ ID NO: 859895 - RNA, 22 nt, Mycobacterium avium subsp. paratuberculosis
cgauaaccucggcggcggcgcg

SEQ ID NO: 859896 - RNA, 15 nt, Mycobacterium avium subsp. paratuberculosis
cgauaauggcggccg

SEQ ID NO: 859897 - RNA, 16 nt, Mycobacterium avium subsp. paratuberculosis
cgauagaccucacggu

SEQ ID NO: 859898 - RNA, 22 nt, Mycobacterium avium subsp. paratuberculosis
cgauagaccucacggucggcgu

SEQ ID NO: 859899 - RNA, 19 nt, Mycobacterium avium subsp. paratuberculosis
cgauacgugcucccgccga

SEQ ID NO: 859900 - RNA, 13 nt, Mycobacterium avium subsp. paratuberculosis
cgagugccggcag

SEQ ID NO: 859901 - RNA, 14 nt, Mycobacterium avium subsp. paratuberculosis
cgagugccggcagc

SEQ ID NO: 859902 - RNA, 16 nt, Mycobacterium avium subsp. paratuberculosis
cgagugccggcagccc

SEQ ID NO: 859903 - RNA, 21 nt, Mycobacterium avium subsp. paratuberculosis
cgagugccggccagcucgccg

SEQ ID NO: 859904 - RNA, 17 nt, Mycobacterium avium subsp. paratuberculosis
cgagugcgaaacucacc

SEQ ID NO: 859905 - RNA, 21 nt, Mycobacterium avium subsp. paratuberculosis
cgagugcgaaacucaccgcgu

SEQ ID NO: 859906 - RNA, 22 nt, Mycobacterium avium subsp. paratuberculosis
cgagugcgaaucaucguggcgc

SEQ ID NO: 859907 - RNA, 16 nt, Mycobacterium avium subsp. paratuberculosis
cgagugaggacgaggc

SEQ ID NO: 859908 - RNA, 17 nt, Mycobacterium avium subsp. paratuberculosis
cgagugaggccgaggcg

SEQ ID NO: 859909 - RNA, 14 nt, Mycobacterium avium subsp. paratuberculosis
cgagucggcgucgg

SEQ ID NO: 859910 - RNA, 15 nt, Mycobacterium avium subsp. paratuberculosis
cgagucgcgccgcgu

SEQ ID NO: 859911 - RNA, 16 nt, Mycobacterium avium subsp. paratuberculosis
cgagucgcgccgcguc

SEQ ID NO: 859912 - RNA, 17 nt, Mycobacterium avium subsp. paratuberculosis
cgagucgcgccgcgucg

SEQ ID NO: 859913 - RNA, 19 nt, Mycobacterium avium subsp. paratuberculosis
cgagucgcgccgcgucgcg

SEQ ID NO: 859914 - RNA, 12 nt, Mycobacterium avium subsp. paratuberculosis
cgagucgcugca

SEQ ID NO: 859915 - RNA, 18 nt, Mycobacterium avium subsp. paratuberculosis
cgagucggagacccgccc

SEQ ID NO: 859916 - RNA, 23 nt, Mycobacterium avium subsp. paratuberculosis
cgagucggccaccgcggucgacg

SEQ ID NO: 859917 - RNA, 19 nt, Mycobacterium avium subsp. paratuberculosis
cgagucggcgaaggcgcgc

SEQ ID NO: 859918 - RNA, 23 nt, Mycobacterium avium subsp. paratuberculosis
cgagucguacuucgcccccggaa

SEQ ID NO: 859919 - RNA, 19 nt, Mycobacterium avium subsp. paratuberculosis
cgagucguagaggggccgg

SEQ ID NO: 859920 - RNA, 12 nt, Mycobacterium avium subsp. paratuberculosis
cgagucgucgcg

SEQ ID NO: 859921 - RNA, 14 nt, Mycobacterium avium subsp. paratuberculosis
cgagucgucgcgca

SEQ ID NO: 859922 - RNA, 18 nt, Mycobacterium avium subsp. paratuberculosis
cgagucgucgcgcaccag

SEQ ID NO: 859923 - RNA, 14 nt, Mycobacterium avium subsp. paratuberculosis
cgaucacggugauc

SEQ ID NO: 859924 - RNA, 21 nt, Mycobacterium avium subsp. paratuberculosis
cgaucacgguguuguucaccg

SEQ ID NO: 859925 - RNA, 19 nt, Mycobacterium avium subsp. paratuberculosis
cgaucacgucggugacgcc

SEQ ID NO: 859926 - RNA, 20 nt, Mycobacterium avium subsp. paratuberculosis
cgaucacgucggugacgccc

SEQ ID NO: 859927 - RNA, 15 nt, Mycobacterium avium subsp. paratuberculosis
cgaucaccugcgggc

SEQ ID NO: 859928 - RNA, 14 nt, Mycobacterium avium subsp. paratuberculosis
cgaucagcagccgg

SEQ ID NO: 859929 - RNA, 20 nt, Mycobacterium avium subsp. paratuberculosis
cgaucagcagccgggccugc

SEQ ID NO: 859930 - RNA, 14 nt, Mycobacterium avium subsp. paratuberculosis
cgaucagccacacc

SEQ ID NO: 859931 - RNA, 17 nt, Mycobacterium avium subsp. paratuberculosis
cgaucagccacaccgcc

SEQ ID NO: 859932 - RNA, 18 nt, Mycobacterium avium subsp. paratuberculosis
cgaucagccacaccgccg

SEQ ID NO: 859933 - RNA, 19 nt, Mycobacterium avium subsp. paratuberculosis
cgaucagccacaccgccgg

SEQ ID NO: 859934 - RNA, 21 nt, Mycobacterium avium subsp. paratuberculosis
cgaucagccacaccgccggcg

SEQ ID NO: 859935 - RNA, 22 nt, Mycobacterium avium subsp. paratuberculosis
cgaucagccacaccgccggcgc

SEQ ID NO: 859936 - RNA, 24 nt, Mycobacterium avium subsp. paratuberculosis
cgaucagcaccagguugucgccgc

SEQ ID NO: 859937 - RNA, 20 nt, Mycobacterium avium subsp. paratuberculosis
cgaucagcaccgccacgccg

SEQ ID NO: 859938 - RNA, 16 nt, Mycobacterium avium subsp. paratuberculosis
cgaucagcacgucgcg

SEQ ID NO: 859939 - RNA, 18 nt, Mycobacterium avium subsp. paratuberculosis
cgaucagcacgucgcggc

SEQ ID NO: 859940 - RNA, 20 nt, Mycobacterium avium subsp. paratuberculosis
cgaucagcagcacccgggcc

SEQ ID NO: 859941 - RNA, 19 nt, Mycobacterium avium subsp. paratuberculosis
cgaucaccgccgcggcgac

SEQ ID NO: 859942 - RNA, 20 nt, Mycobacterium avium subsp. paratuberculosis
cgaucaccgccgcggcgacc

SEQ ID NO: 859943 - RNA, 14 nt, Mycobacterium avium subsp. paratuberculosis
cgaucaccaggccc

SEQ ID NO: 859944 - RNA, 15 nt, Mycobacterium avium subsp. paratuberculosis
cgaucaccgacagcg

SEQ ID NO: 859945 - RNA, 20 nt, Mycobacterium avium subsp. paratuberculosis
cgaucaccgcguugucggcg

SEQ ID NO: 859946 - RNA, 23 nt, Mycobacterium avium subsp. paratuberculosis
cgaucaccgcguugucggcgacg

SEQ ID NO: 859947 - RNA, 14 nt, Mycobacterium avium subsp. paratuberculosis
cgaucaccgcggcc

SEQ ID NO: 859948 - RNA, 15 nt, Mycobacterium avium subsp. paratuberculosis
cgaucaccgcggcca

SEQ ID NO: 859949 - RNA, 17 nt, Mycobacterium avium subsp. paratuberculosis
cgaucaccgcggcgagc

SEQ ID NO: 859950 - RNA, 12 nt, Mycobacterium avium subsp. paratuberculosis
cgaucaccgcgu

SEQ ID NO: 859951 - RNA, 13 nt, Mycobacterium avium subsp. paratuberculosis
cgaucaccggcag

SEQ ID NO: 859952 - RNA, 19 nt, Mycobacterium avium subsp. paratuberculosis
cgaucaccggcagcagcgc

SEQ ID NO: 859953 - RNA, 21 nt, Mycobacterium avium subsp. paratuberculosis
cgaucaccggcagcagcgcgu

SEQ ID NO: 859954 - RNA, 13 nt, Mycobacterium avium subsp. paratuberculosis
cgaucaccggcgc

SEQ ID NO: 859955 - RNA, 14 nt, Mycobacterium avium subsp. paratuberculosis
cgaucaccggcgcg

SEQ ID NO: 859956 - RNA, 22 nt, Mycobacterium avium subsp. paratuberculosis
cgaucaccggcgcguuggcccg

SEQ ID NO: 859957 - RNA, 22 nt, Mycobacterium avium subsp. paratuberculosis
cgaucaccgggacaccgcuggc

SEQ ID NO: 859958 - RNA, 13 nt, Mycobacterium avium subsp. paratuberculosis
cgaucaccgggcg

SEQ ID NO: 859959 - RNA, 16 nt, Mycobacterium avium subsp. paratuberculosis
cgaucaccgggcggcc

SEQ ID NO: 859960 - RNA, 17 nt, Mycobacterium avium subsp. paratuberculosis
cgaucacgaacaggucc

SEQ ID NO: 859961 - RNA, 12 nt, Mycobacterium avium subsp. paratuberculosis
cgaucaccuugc

SEQ ID NO: 859962 - RNA, 16 nt, Mycobacterium avium subsp. paratuberculosis
cgaucaccuugcggcc

SEQ ID NO: 859963 - RNA, 21 nt, Mycobacterium avium subsp. paratuberculosis
cgaucaccuugcggccggcgg

SEQ ID NO: 859964 - RNA, 23 nt, Mycobacterium avium subsp. paratuberculosis
cgaucaccuugcggccggcggcg

SEQ ID NO: 859965 - RNA, 20 nt, Mycobacterium avium subsp. paratuberculosis
cgaucaccuuguugcgggcg

SEQ ID NO: 859966 - RNA, 15 nt, Mycobacterium avium subsp. paratuberculosis
cgaucaccucgaacu

SEQ ID NO: 859967 - RNA, 17 nt, Mycobacterium avium subsp. paratuberculosis
cgaucaccucgccggcc

SEQ ID NO: 859968 - RNA, 19 nt, Mycobacterium avium subsp. paratuberculosis
cgaucaccucgccggccgg

SEQ ID NO: 859969 - RNA, 14 nt, Mycobacterium avium subsp. paratuberculosis
cgaucagcccgccc

SEQ ID NO: 859970 - RNA, 17 nt, Mycobacterium avium subsp. paratuberculosis
cgaucagcccgcccacc

SEQ ID NO: 859971 - RNA, 22 nt, Mycobacterium avium subsp. paratuberculosis
cgaucagccggguagcgccgcc

SEQ ID NO: 859972 - RNA, 16 nt, Mycobacterium avium subsp. paratuberculosis
cgaucagcccggcccg

SEQ ID NO: 859973 - RNA, 17 nt, Mycobacterium avium subsp. paratuberculosis
cgaucagccgcgacagc

SEQ ID NO: 859974 - RNA, 19 nt, Mycobacterium avium subsp. paratuberculosis
cgaucagccgcgacagccg

SEQ ID NO: 859975 - RNA, 15 nt, Mycobacterium avium subsp. paratuberculosis
cgaucagcgacggcc

SEQ ID NO: 859976 - RNA, 17 nt, Mycobacterium avium subsp. paratuberculosis
cgaucagcgacggcccg

SEQ ID NO: 859977 - RNA, 21 nt, Mycobacterium avium subsp. paratuberculosis
cgaucagcgacggcccgccgg

SEQ ID NO: 859978 - RNA, 17 nt, Mycobacterium avium subsp. paratuberculosis
cgaucagcgucagcacc

SEQ ID NO: 859979 - RNA, 13 nt, Mycobacterium avium subsp. paratuberculosis
cgaucagcgucau

SEQ ID NO: 859980 - RNA, 17 nt, Mycobacterium avium subsp. paratuberculosis
cgaucagcgucaucacg

SEQ ID NO: 859981 - RNA, 21 nt, Mycobacterium avium subsp. paratuberculosis
cgaucagcucguggcgggccc

SEQ ID NO: 859982 - RNA, 14 nt, Mycobacterium avium subsp. paratuberculosis
cgaucagcugcccg

SEQ ID NO: 859983 - RNA, 17 nt, Mycobacterium avium subsp. paratuberculosis
cgaucagcugcucggcc

SEQ ID NO: 859984 - RNA, 17 nt, Mycobacterium avium subsp. paratuberculosis
cgaucagcgcgucgagg

SEQ ID NO: 859985 - RNA, 15 nt, Mycobacterium avium subsp. paratuberculosis
cgaucagcggcaucg

SEQ ID NO: 859986 - RNA, 17 nt, Mycobacterium avium subsp. paratuberculosis
cgaucagcggcgggccc

SEQ ID NO: 859987 - RNA, 12 nt, Mycobacterium avium subsp. paratuberculosis
cgaucagcgcgc

SEQ ID NO: 859988 - RNA, 19 nt, Mycobacterium avium subsp. paratuberculosis
cgaucagcgcgcacagcgc

SEQ ID NO: 859989 - RNA, 16 nt, Mycobacterium avium subsp. paratuberculosis
cgaucagcgcgccgcc

SEQ ID NO: 859990 - RNA, 21 nt, Mycobacterium avium subsp. paratuberculosis
cgaucagcgcgccgcccagcg

SEQ ID NO: 859991 - RNA, 15 nt, Mycobacterium avium subsp. paratuberculosis
cgaucagggcccaca

SEQ ID NO: 859992 - RNA, 22 nt, Mycobacterium avium subsp. paratuberculosis
cgaucagggcccacagcagccg

SEQ ID NO: 859993 - RNA, 14 nt, Mycobacterium avium subsp. paratuberculosis
cgaucagggccgcg

SEQ ID NO: 859994 - RNA, 15 nt, Mycobacterium avium subsp. paratuberculosis
cgaucagggccgcgg

SEQ ID NO: 859995 - RNA, 18 nt, Mycobacterium avium subsp. paratuberculosis
cgaucagggccgcggccg

SEQ ID NO: 859996 - RNA, 23 nt, Mycobacterium avium subsp. paratuberculosis
cgaucagggccgcggccgccgcg

SEQ ID NO: 859997 - RNA, 17 nt, Mycobacterium avium subsp. paratuberculosis
cgaucaggcugccgcug

SEQ ID NO: 859998 - RNA, 19 nt, Mycobacterium avium subsp. paratuberculosis
cgaucaggcugccgcugcg

SEQ ID NO: 859999 - RNA, 21 nt, Mycobacterium avium subsp. paratuberculosis
cgaucaggcugccgcugcgcc

SEQ ID NO: 860000 - RNA, 23 nt, Mycobacterium avium subsp. paratuberculosis
cgaucaggcugccgcugcgccgg

SEQ ID NO: 860001 - RNA, 17 nt, Mycobacterium avium subsp. paratuberculosis
cgaucaggcuggacacc

SEQ ID NO: 860002 - RNA, 14 nt, Mycobacterium avium subsp. paratuberculosis
cgaucaggcgcagc

SEQ ID NO: 860003 - RNA, 22 nt, Mycobacterium avium subsp. paratuberculosis
cgaucaggcgcagcccgagcgg

SEQ ID NO: 860004 - RNA, 16 nt, Mycobacterium avium subsp. paratuberculosis
cgaucaggccggccac

SEQ ID NO: 860005 - RNA, 18 nt, Mycobacterium avium subsp. paratuberculosis
cgaucaggccggccacca

SEQ ID NO: 860006 - RNA, 13 nt, Mycobacterium avium subsp. paratuberculosis
cgaucagucgucc

SEQ ID NO: 860007 - RNA, 15 nt, Mycobacterium avium subsp. paratuberculosis
cgaucagugccgcgc

SEQ ID NO: 860008 - RNA, 18 nt, Mycobacterium avium subsp. paratuberculosis
cgaucagugccgcgccaa

SEQ ID NO: 860009 - RNA, 17 nt, Mycobacterium avium subsp. paratuberculosis
cgaucagggcggcgccg

SEQ ID NO: 860010 - RNA, 21 nt, Mycobacterium avium subsp. paratuberculosis
cgaucagggugucgaacagca

SEQ ID NO: 860011 - RNA, 18 nt, Mycobacterium avium subsp. paratuberculosis
cgagcugaucgcggccgg

SEQ ID NO: 860012 - RNA, 19 nt, Mycobacterium avium subsp. paratuberculosis
cgagcuuccgccgagucgc

SEQ ID NO: 860013 - RNA, 23 nt, Mycobacterium avium subsp. paratuberculosis
cgagcuugccgucguugacgccc

SEQ ID NO: 860014 - RNA, 14 nt, Mycobacterium avium subsp. paratuberculosis
cgagcuuggcgggc

SEQ ID NO: 860015 - RNA, 20 nt, Mycobacterium avium subsp. paratuberculosis
cgagcuuggcgggcgucacg

SEQ ID NO: 860016 - RNA, 19 nt, Mycobacterium avium subsp. paratuberculosis
cgagcuugggccggugcag

SEQ ID NO: 860017 - RNA, 21 nt, Mycobacterium avium subsp. paratuberculosis
cgagcuugggccggugcagca

SEQ ID NO: 860018 - RNA, 17 nt, Mycobacterium avium subsp. paratuberculosis
cgagcuuguccugcacc

SEQ ID NO: 860019 - RNA, 18 nt, Mycobacterium avium subsp. paratuberculosis
cgagcuuguccugcaccg

SEQ ID NO: 860020 - RNA, 17 nt, Mycobacterium avium subsp. paratuberculosis
cgaggagacgucggccg

SEQ ID NO: 860021 - RNA, 16 nt, Mycobacterium avium subsp. paratuberculosis
cgaggacgucgucgac

SEQ ID NO: 860022 - RNA, 17 nt, Mycobacterium avium subsp. paratuberculosis
cgaggacgucgucgacg

SEQ ID NO: 860023 - RNA, 18 nt, Mycobacterium avium subsp. paratuberculosis
cgaggacgucgucgacgu

SEQ ID NO: 860024 - RNA, 19 nt, Mycobacterium avium subsp. paratuberculosis
cgaggacgucgucgacguc

SEQ ID NO: 860025 - RNA, 14 nt, Mycobacterium avium subsp. paratuberculosis
cgaggaggccgcgg

SEQ ID NO: 860026 - RNA, 15 nt, Mycobacterium avium subsp. paratuberculosis
cgaggaggccgcggc

SEQ ID NO: 860027 - RNA, 20 nt, Mycobacterium avium subsp. paratuberculosis
cgaggaggccgcggcgacac

SEQ ID NO: 860028 - RNA, 21 nt, Mycobacterium avium subsp. paratuberculosis
cgaggaggccgcggcgacacc

SEQ ID NO: 860029 - RNA, 17 nt, Mycobacterium avium subsp. paratuberculosis
cgaggccggccagcggg

SEQ ID NO: 860030 - RNA, 18 nt, Mycobacterium avium subsp. paratuberculosis
cgaggccggccagcgggu

SEQ ID NO: 860031 - RNA, 13 nt, Mycobacterium avium subsp. paratuberculosis
cgaggccgcgccg

SEQ ID NO: 860032 - RNA, 16 nt, Mycobacterium avium subsp. paratuberculosis
cgaggccgcgccgugc

SEQ ID NO: 860033 - RNA, 23 nt, Mycobacterium avium subsp. paratuberculosis
cgaggccgcccgcuccugcaggc

SEQ ID NO: 860034 - RNA, 20 nt, Mycobacterium avium subsp. paratuberculosis
cgaggccccgcgugacggcc

SEQ ID NO: 860035 - RNA, 16 nt, Mycobacterium avium subsp. paratuberculosis
cgaggcccucgacacc

SEQ ID NO: 860036 - RNA, 22 nt, Mycobacterium avium subsp. paratuberculosis
cgaggccgaaccgcagccggau

SEQ ID NO: 860037 - RNA, 16 nt, Mycobacterium avium subsp. paratuberculosis
cgaggaucugggcggc

SEQ ID NO: 860038 - RNA, 19 nt, Mycobacterium avium subsp. paratuberculosis
cgaggccgaggucggucgc

SEQ ID NO: 860039 - RNA, 16 nt, Mycobacterium avium subsp. paratuberculosis
cgaggccagggcccgc

SEQ ID NO: 860040 - RNA, 18 nt, Mycobacterium avium subsp. paratuberculosis
cgaggccagggcccgcag

SEQ ID NO: 860041 - RNA, 19 nt, Mycobacterium avium subsp. paratuberculosis
cgaggccagggcccgcagc

SEQ ID NO: 860042 - RNA, 14 nt, Mycobacterium avium subsp. paratuberculosis
cgaggccagcacgc

SEQ ID NO: 860043 - RNA, 19 nt, Mycobacterium avium subsp. paratuberculosis
cgaggccagcacgccgguc

SEQ ID NO: 860044 - RNA, 21 nt, Mycobacterium avium subsp. paratuberculosis
cgaggccagcacgccggucag

SEQ ID NO: 860045 - RNA, 22 nt, Mycobacterium avium subsp. paratuberculosis
cgaggccagcacgccggucagc

SEQ ID NO: 860046 - RNA, 12 nt, Mycobacterium avium subsp. paratuberculosis
cgaggccagcgc

SEQ ID NO: 860047 - RNA, 20 nt, Mycobacterium avium subsp. paratuberculosis
cgaggccagcgcgaucgccg

SEQ ID NO: 860048 - RNA, 17 nt, Mycobacterium avium subsp. paratuberculosis
cgaggaggggucggugc

SEQ ID NO: 860049 - RNA, 16 nt, Mycobacterium avium subsp. paratuberculosis
cgaggagggugucggc

SEQ ID NO: 860050 - RNA, 23 nt, Mycobacterium avium subsp. paratuberculosis
cgaggagggugucggcggggccg

SEQ ID NO: 860051 - RNA, 12 nt, Mycobacterium avium subsp. paratuberculosis
cgaggaucgcca

SEQ ID NO: 860052 - RNA, 14 nt, Mycobacterium avium subsp. paratuberculosis
cgaggaucgcggcc

SEQ ID NO: 860053 - RNA, 17 nt, Mycobacterium avium subsp. paratuberculosis
cgaggaucgcggccacg

SEQ ID NO: 860054 - RNA, 14 nt, Mycobacterium avium subsp. paratuberculosis
cgagcugaccggcc

SEQ ID NO: 860055 - RNA, 15 nt, Mycobacterium avium subsp. paratuberculosis
cgagcugaccggcca

SEQ ID NO: 860056 - RNA, 17 nt, Mycobacterium avium subsp. paratuberculosis
cgagcugaccggccacc

SEQ ID NO: 860057 - RNA, 19 nt, Mycobacterium avium subsp. paratuberculosis
cgagcugaccggccaccuc

SEQ ID NO: 860058 - RNA, 23 nt, Mycobacterium avium subsp. paratuberculosis
cgagcugaccggccaccucgucg

SEQ ID NO: 860059 - RNA, 15 nt, Mycobacterium avium subsp. paratuberculosis
cgagcgucgccgcgu

SEQ ID NO: 860060 - RNA, 17 nt, Mycobacterium avium subsp. paratuberculosis
cgagcucgccgcugucg

SEQ ID NO: 860061 - RNA, 22 nt, Mycobacterium avium subsp. paratuberculosis
cgagcucgccgcugucgucgaa

SEQ ID NO: 860062 - RNA, 18 nt, Mycobacterium avium subsp. paratuberculosis
cgagcucgcggccguagc

SEQ ID NO: 860063 - RNA, 18 nt, Mycobacterium avium subsp. paratuberculosis
cgagcucggccaccagcg

SEQ ID NO: 860064 - RNA, 20 nt, Mycobacterium avium subsp. paratuberculosis
cgagcucggccaccagcgcc

SEQ ID NO: 860065 - RNA, 19 nt, Mycobacterium avium subsp. paratuberculosis
cgagcucggccuugagccg

SEQ ID NO: 860066 - RNA, 14 nt, Mycobacterium avium subsp. paratuberculosis
cgagcucggcgagg

SEQ ID NO: 860067 - RNA, 13 nt, Mycobacterium avium subsp. paratuberculosis
cgagcucgggcgc

SEQ ID NO: 860068 - RNA, 17 nt, Mycobacterium avium subsp. paratuberculosis
cgagcucgggcgcgaac

SEQ ID NO: 860069 - RNA, 19 nt, Mycobacterium avium subsp. paratuberculosis
cgagcucgucggguguggc

SEQ ID NO: 860070 - RNA, 23 nt, Mycobacterium avium subsp. paratuberculosis
cgagcucgugaugguccagcacc

SEQ ID NO: 860071 - RNA, 17 nt, Mycobacterium avium subsp. paratuberculosis
cgagcgguccaacgggc

SEQ ID NO: 860072 - RNA, 19 nt, Mycobacterium avium subsp. paratuberculosis
cgagcgguccaacgggcuc

SEQ ID NO: 860073 - RNA, 21 nt, Mycobacterium avium subsp. paratuberculosis
cgagcgggugaaucgacaccg

SEQ ID NO: 860074 - RNA, 18 nt, Mycobacterium avium subsp. paratuberculosis
cgagcgucacgccagcgu

SEQ ID NO: 860075 - RNA, 20 nt, Mycobacterium avium subsp. paratuberculosis
cgagcgucacgccagcguga

SEQ ID NO: 860076 - RNA, 18 nt, Mycobacterium avium subsp. paratuberculosis
cgagcgucacgccagugu

SEQ ID NO: 860077 - RNA, 14 nt, Mycobacterium avium subsp. paratuberculosis
cgagcgucacgccg

SEQ ID NO: 860078 - RNA, 16 nt, Mycobacterium avium subsp. paratuberculosis
cgagcgucacgccgcg

SEQ ID NO: 860079 - RNA, 17 nt, Mycobacterium avium subsp. paratuberculosis
cgagcgucacgccgcgc

SEQ ID NO: 860080 - RNA, 20 nt, Mycobacterium avium subsp. paratuberculosis
cgagcgucacgccgcgcccg

SEQ ID NO: 860081 - RNA, 22 nt, Mycobacterium avium subsp. paratuberculosis
cgagcgucacgccgcgcccguc

SEQ ID NO: 860082 - RNA, 16 nt, Mycobacterium avium subsp. paratuberculosis
cgagcgucacgcuagc

SEQ ID NO: 860083 - RNA, 20 nt, Mycobacterium avium subsp. paratuberculosis
cgagcgucacgcuagcguga

SEQ ID NO: 860084 - RNA, 20 nt, Mycobacterium avium subsp. paratuberculosis
cgagcgucacgcuggcguga

SEQ ID NO: 860085 - RNA, 20 nt, Mycobacterium avium subsp. paratuberculosis
cgagcgguuggcgacgcuga

SEQ ID NO: 860086 - RNA, 18 nt, Mycobacterium avium subsp. paratuberculosis
cgagcgucauuccgccgc

SEQ ID NO: 860087 - RNA, 19 nt, Mycobacterium avium subsp. paratuberculosis
cgagcgucauuccgccgcg

SEQ ID NO: 860088 - RNA, 17 nt, Mycobacterium avium subsp. paratuberculosis
cgagcaccgcguccgcg

SEQ ID NO: 860089 - RNA, 14 nt, Mycobacterium avium subsp. paratuberculosis
cgagcaccggcagc

SEQ ID NO: 860090 - RNA, 17 nt, Mycobacterium avium subsp. paratuberculosis
cgagcaccggcagcacc

SEQ ID NO: 860091 - RNA, 22 nt, Mycobacterium avium subsp. paratuberculosis
cgagcaccggcagcaccgccga

SEQ ID NO: 860092 - RNA, 23 nt, Mycobacterium avium subsp. paratuberculosis
cgagcaccggcagccgcagcgac

SEQ ID NO: 860093 - RNA, 17 nt, Mycobacterium avium subsp. paratuberculosis
cgagcaccggcggcagc

SEQ ID NO: 860094 - RNA, 12 nt, Mycobacterium avium subsp. paratuberculosis
cgagcaccgcga

SEQ ID NO: 860095 - RNA, 13 nt, Mycobacterium avium subsp. paratuberculosis
cgagcaccgcgau

SEQ ID NO: 860096 - RNA, 14 nt, Mycobacterium avium subsp. paratuberculosis
cgagcaccgcgauc

SEQ ID NO: 860097 - RNA, 16 nt, Mycobacterium avium subsp. paratuberculosis
cgagcaccgcgaucac

SEQ ID NO: 860098 - RNA, 21 nt, Mycobacterium avium subsp. paratuberculosis
cgagcaccgcgaucgccgacg

SEQ ID NO: 860099 - RNA, 15 nt, Mycobacterium avium subsp. paratuberculosis
cgagcaccggcuggu

SEQ ID NO: 860100 - RNA, 13 nt, Mycobacterium avium subsp. paratuberculosis
cgagcaccgggcc

SEQ ID NO: 860101 - RNA, 14 nt, Mycobacterium avium subsp. paratuberculosis
cgagcaccgggccg

SEQ ID NO: 860102 - RNA, 15 nt, Mycobacterium avium subsp. paratuberculosis
cgagcaccgggccga

SEQ ID NO: 860103 - RNA, 20 nt, Mycobacterium avium subsp. paratuberculosis
cgagcaccgggccgaaggcg

SEQ ID NO: 860104 - RNA, 14 nt, Mycobacterium avium subsp. paratuberculosis
cgagcaccgggcgu

SEQ ID NO: 860105 - RNA, 15 nt, Mycobacterium avium subsp. paratuberculosis
cgagcaccgggcguc

SEQ ID NO: 860106 - RNA, 17 nt, Mycobacterium avium subsp. paratuberculosis
cgagcaccgggcgucgg

SEQ ID NO: 860107 - RNA, 18 nt, Mycobacterium avium subsp. paratuberculosis
cgagcaccgggcgucggg

SEQ ID NO: 860108 - RNA, 20 nt, Mycobacterium avium subsp. paratuberculosis
cgagcaccgggcgucggggc

SEQ ID NO: 860109 - RNA, 22 nt, Mycobacterium avium subsp. paratuberculosis
cgagcaccgggcgucggggccc

SEQ ID NO: 860110 - RNA, 14 nt, Mycobacterium avium subsp. paratuberculosis
cgagcaccgggcug

SEQ ID NO: 860111 - RNA, 18 nt, Mycobacterium avium subsp. paratuberculosis
cgagcaccgggcugucgg

SEQ ID NO: 860112 - RNA, 18 nt, Mycobacterium avium subsp. paratuberculosis
cgagcaccgugccgucgg

SEQ ID NO: 860113 - RNA, 18 nt, Mycobacterium avium subsp. paratuberculosis
cgagcaccuccgacauca

SEQ ID NO: 860114 - RNA, 16 nt, Mycobacterium avium subsp. paratuberculosis
cgagcgggcgggcuca

SEQ ID NO: 860115 - RNA, 16 nt, Mycobacterium avium subsp. paratuberculosis
cgagggcgcgcagcga

SEQ ID NO: 860116 - RNA, 16 nt, Mycobacterium avium subsp. paratuberculosis
cgagggcgggccagcu

SEQ ID NO: 860117 - RNA, 18 nt, Mycobacterium avium subsp. paratuberculosis
cgagggcgggccagcucg

SEQ ID NO: 860118 - RNA, 19 nt, Mycobacterium avium subsp. paratuberculosis
cgagggccguugcggccaa

SEQ ID NO: 860119 - RNA, 16 nt, Mycobacterium avium subsp. paratuberculosis
cgagggccuccaccac

SEQ ID NO: 860120 - RNA, 19 nt, Mycobacterium avium subsp. paratuberculosis
cgagggccuccaccaccau

SEQ ID NO: 860121 - RNA, 16 nt, Mycobacterium avium subsp. paratuberculosis
cgagggccaccggcuc

SEQ ID NO: 860122 - RNA, 19 nt, Mycobacterium avium subsp. paratuberculosis
cgagggccagcagccagcu

SEQ ID NO: 860123 - RNA, 15 nt, Mycobacterium avium subsp. paratuberculosis
cgagggcccgggcag

SEQ ID NO: 860124 - RNA, 19 nt, Mycobacterium avium subsp. paratuberculosis
cgaggcgucagggguuggc

SEQ ID NO: 860125 - RNA, 21 nt, Mycobacterium avium subsp. paratuberculosis
cgaggcgucagggguuggcgc

SEQ ID NO: 860126 - RNA, 15 nt, Mycobacterium avium subsp. paratuberculosis
cgaggcguccagcgc

SEQ ID NO: 860127 - RNA, 16 nt, Mycobacterium avium subsp. paratuberculosis
cgaggcguccagcgcg

SEQ ID NO: 860128 - RNA, 19 nt, Mycobacterium avium subsp. paratuberculosis
cgaggcguccagcgcgucg

SEQ ID NO: 860129 - RNA, 15 nt, Mycobacterium avium subsp. paratuberculosis
cgaggcgggcgaucu

SEQ ID NO: 860130 - RNA, 18 nt, Mycobacterium avium subsp. paratuberculosis
cgaggcgggugaggacgc

SEQ ID NO: 860131 - RNA, 14 nt, Mycobacterium avium subsp. paratuberculosis
cgaggcggucggcg

SEQ ID NO: 860132 - RNA, 21 nt, Mycobacterium avium subsp. paratuberculosis
cgaggcggucggcggaggcga

SEQ ID NO: 860133 - RNA, 13 nt, Mycobacterium avium subsp. paratuberculosis
cgaggcggccagc

SEQ ID NO: 860134 - RNA, 15 nt, Mycobacterium avium subsp. paratuberculosis
cgaggcggccagcgg

SEQ ID NO: 860135 - RNA, 22 nt, Mycobacterium avium subsp. paratuberculosis
cgaggcgcucgcacaacccgcc

SEQ ID NO: 860136 - RNA, 13 nt, Mycobacterium avium subsp. paratuberculosis
cgaggcgcucggc

SEQ ID NO: 860137 - RNA, 14 nt, Mycobacterium avium subsp. paratuberculosis
cgaggcgcugcagc

SEQ ID NO: 860138 - RNA, 19 nt, Mycobacterium avium subsp. paratuberculosis
cgaggcgcgaaagcgcgag

SEQ ID NO: 860139 - RNA, 13 nt, Mycobacterium avium subsp. paratuberculosis
cgaggcgaugccg

SEQ ID NO: 860140 - RNA, 14 nt, Mycobacterium avium subsp. paratuberculosis
cgaggcgauggugc

SEQ ID NO: 860141 - RNA, 15 nt, Mycobacterium avium subsp. paratuberculosis
cgaggcgauggugcc

SEQ ID NO: 860142 - RNA, 15 nt, Mycobacterium avium subsp. paratuberculosis
cgaggcgcaacaccg

SEQ ID NO: 860143 - RNA, 14 nt, Mycobacterium avium subsp. paratuberculosis
cgaggcgcaggagg

SEQ ID NO: 860144 - RNA, 24 nt, Mycobacterium avium subsp. paratuberculosis
cgaggccuccagguagacgaugcc

SEQ ID NO: 860145 - RNA, 19 nt, Mycobacterium avium subsp. paratuberculosis
cgaggcgacgucgaacgcg

SEQ ID NO: 860146 - RNA, 21 nt, Mycobacterium avium subsp. paratuberculosis
cgaggcgaagguggcgucggc

SEQ ID NO: 860147 - RNA, 21 nt, Mycobacterium avium subsp. paratuberculosis
cgaggcgagugaggacgaggc

SEQ ID NO: 860148 - RNA, 22 nt, Mycobacterium avium subsp. paratuberculosis
cgagggcuucccacgccuugcg

SEQ ID NO: 860149 - RNA, 18 nt, Mycobacterium avium subsp. paratuberculosis
cgaggggcuugagcgcgu

SEQ ID NO: 860150 - RNA, 21 nt, Mycobacterium avium subsp. paratuberculosis
cgaggggcuugagcgcgucgu

SEQ ID NO: 860151 - RNA, 14 nt, Mycobacterium avium subsp. paratuberculosis
cgaggggcuuggcg

SEQ ID NO: 860152 - RNA, 14 nt, Mycobacterium avium subsp. paratuberculosis
cgagggcgcggcgu

SEQ ID NO: 860153 - RNA, 21 nt, Mycobacterium avium subsp. paratuberculosis
cgagggcgcgggaucggugcc

SEQ ID NO: 860154 - RNA, 13 nt, Mycobacterium avium subsp. paratuberculosis
cgagggcgcggcg

SEQ ID NO: 860155 - RNA, 18 nt, Mycobacterium avium subsp. paratuberculosis
cgagggcguucgcggugg

SEQ ID NO: 860156 - RNA, 20 nt, Mycobacterium avium subsp. paratuberculosis
cgagggcucaacaggcgagu

SEQ ID NO: 860157 - RNA, 18 nt, Mycobacterium avium subsp. paratuberculosis
cgagggugaugucgcugc

SEQ ID NO: 860158 - RNA, 19 nt, Mycobacterium avium subsp. paratuberculosis
cgagggugaugucgcugcc

SEQ ID NO: 860159 - RNA, 23 nt, Mycobacterium avium subsp. paratuberculosis
cgagggugaugucgcugccgccg

SEQ ID NO: 860160 - RNA, 19 nt, Mycobacterium avium subsp. paratuberculosis
cgagggugccggccaccgg

SEQ ID NO: 860161 - RNA, 22 nt, Mycobacterium avium subsp. paratuberculosis
cgaggucuuggugaugcgcugc

SEQ ID NO: 860162 - RNA, 22 nt, Mycobacterium avium subsp. paratuberculosis
cgaggucuuucaucgccccggc

SEQ ID NO: 860163 - RNA, 15 nt, Mycobacterium avium subsp. paratuberculosis
cgaggugaaccgcga

SEQ ID NO: 860164 - RNA, 20 nt, Mycobacterium avium subsp. paratuberculosis
cgaggugaaccgcgacgcga

SEQ ID NO: 860165 - RNA, 19 nt, Mycobacterium avium subsp. paratuberculosis
cgaggugaagucguccagc

SEQ ID NO: 860166 - RNA, 23 nt, Mycobacterium avium subsp. paratuberculosis
cgaggugaagucguccagcgucg

SEQ ID NO: 860167 - RNA, 14 nt, Mycobacterium avium subsp. paratuberculosis
cgaggugaccggcg

SEQ ID NO: 860168 - RNA, 15 nt, Mycobacterium avium subsp. paratuberculosis
cgaggugaccggcga

SEQ ID NO: 860169 - RNA, 16 nt, Mycobacterium avium subsp. paratuberculosis
cgaggugaccggcgag

SEQ ID NO: 860170 - RNA, 22 nt, Mycobacterium avium subsp. paratuberculosis
cgagggggucaucagugaccgc

SEQ ID NO: 860171 - RNA, 20 nt, Mycobacterium avium subsp. paratuberculosis
cgaggggguggguccgguca

SEQ ID NO: 860172 - RNA, 21 nt, Mycobacterium avium subsp. paratuberculosis
cgaggggguggguccggucag

SEQ ID NO: 860173 - RNA, 14 nt, Mycobacterium avium subsp. paratuberculosis
cgagggucgccagg

SEQ ID NO: 860174 - RNA, 17 nt, Mycobacterium avium subsp. paratuberculosis
cgagggucgccaggcca

SEQ ID NO: 860175 - RNA, 18 nt, Mycobacterium avium subsp. paratuberculosis
cgagggucgccaggccac

SEQ ID NO: 860176 - RNA, 22 nt, Mycobacterium avium subsp. paratuberculosis
cgagggucgccaggccaccgca

SEQ ID NO: 860177 - RNA, 18 nt, Mycobacterium avium subsp. paratuberculosis
cgagggugacccgggcga

SEQ ID NO: 860178 - RNA, 14 nt, Mycobacterium avium subsp. paratuberculosis
cgaggggcagcagc

SEQ ID NO: 860179 - RNA, 23 nt, Mycobacterium avium subsp. paratuberculosis
cgaguaguccgggaugacaccgc

SEQ ID NO: 860180 - RNA, 20 nt, Mycobacterium avium subsp. paratuberculosis
cgaguauccgcgcagcgucu

SEQ ID NO: 860181 - RNA, 19 nt, Mycobacterium avium subsp. paratuberculosis
cgaguaggcgaagagcggc

SEQ ID NO: 860182 - RNA, 13 nt, Mycobacterium avium subsp. paratuberculosis
cgaguaggcgacc

SEQ ID NO: 860183 - RNA, 15 nt, Mycobacterium avium subsp. paratuberculosis
cgaguaggcgaccac

SEQ ID NO: 860184 - RNA, 17 nt, Mycobacterium avium subsp. paratuberculosis
cgaguagaacuucgcca

SEQ ID NO: 860185 - RNA, 23 nt, Mycobacterium avium subsp. paratuberculosis
cgaguagaacuucgccagcgggc

SEQ ID NO: 860186 - RNA, 14 nt, Mycobacterium avium subsp. paratuberculosis
cgagucaucgccac

SEQ ID NO: 860187 - RNA, 22 nt, Mycobacterium avium subsp. paratuberculosis
cgaguccacgacguccucgacg

SEQ ID NO: 860188 - RNA, 16 nt, Mycobacterium avium subsp. paratuberculosis
cgaguccagccagccg

SEQ ID NO: 860189 - RNA, 21 nt, Mycobacterium avium subsp. paratuberculosis
cgaguccagccagccgcgccg

SEQ ID NO: 860190 - RNA, 15 nt, Mycobacterium avium subsp. paratuberculosis
cgagucccgcgcggc

SEQ ID NO: 860191 - RNA, 15 nt, Mycobacterium avium subsp. paratuberculosis
cgagucccggcgcac

SEQ ID NO: 860192 - RNA, 17 nt, Mycobacterium avium subsp. paratuberculosis
cgagucccggcgcacca

SEQ ID NO: 860193 - RNA, 16 nt, Mycobacterium avium subsp. paratuberculosis
cgagguggcccagccg

SEQ ID NO: 860194 - RNA, 18 nt, Mycobacterium avium subsp. paratuberculosis
cgagguggcccgccacgu

SEQ ID NO: 860195 - RNA, 17 nt, Mycobacterium avium subsp. paratuberculosis
cgaguacccgccgcacc

SEQ ID NO: 860196 - RNA, 22 nt, Mycobacterium avium subsp. paratuberculosis
cgaguacccgccgcaccucgcc

SEQ ID NO: 860197 - RNA, 20 nt, Mycobacterium avium subsp. paratuberculosis
cgaggugauguuggccgcga

SEQ ID NO: 860198 - RNA, 22 nt, Mycobacterium avium subsp. paratuberculosis
cgaggugauguuggccgcgacg

SEQ ID NO: 860199 - RNA, 22 nt, Mycobacterium avium subsp. paratuberculosis
cgaggugcaacacucgagcgcg

SEQ ID NO: 860200 - RNA, 23 nt, Mycobacterium avium subsp. paratuberculosis
cgaggugcaacacucgagcgcgc

SEQ ID NO: 860201 - RNA, 15 nt, Mycobacterium avium subsp. paratuberculosis
cgaggugacgucgcg

SEQ ID NO: 860202 - RNA, 18 nt, Mycobacterium avium subsp. paratuberculosis
cgaggugacgucgcgccg

SEQ ID NO: 860203 - RNA, 23 nt, Mycobacterium avium subsp. paratuberculosis
cgaggugacgucgcgccgcucgg

SEQ ID NO: 860204 - RNA, 21 nt, Mycobacterium avium subsp. paratuberculosis
cgaggugaucgcgaacgcgcc

SEQ ID NO: 860205 - RNA, 17 nt, Mycobacterium avium subsp. paratuberculosis
cgaggugaugccgucca

SEQ ID NO: 860206 - RNA, 19 nt, Mycobacterium avium subsp. paratuberculosis
cgaggugaugccguccagc

SEQ ID NO: 860207 - RNA, 15 nt, Mycobacterium avium subsp. paratuberculosis
cgaugacguugcgcg

SEQ ID NO: 860208 - RNA, 18 nt, Mycobacterium avium subsp. paratuberculosis
cgaugacguugcgcgcca

SEQ ID NO: 860209 - RNA, 22 nt, Mycobacterium avium subsp. paratuberculosis
cgaugagccucagcgcgcaacg

SEQ ID NO: 860210 - RNA, 15 nt, Mycobacterium avium subsp. paratuberculosis
cgaugaucgucggca

SEQ ID NO: 860211 - RNA, 20 nt, Mycobacterium avium subsp. paratuberculosis
cgaugaucuggcggucccgc

SEQ ID NO: 860212 - RNA, 22 nt, Mycobacterium avium subsp. paratuberculosis
cgaugaugaaaccggccagcag

SEQ ID NO: 860213 - RNA, 23 nt, Mycobacterium avium subsp. paratuberculosis
cgaugaugaaaccggccagcagc

SEQ ID NO: 860214 - RNA, 17 nt, Mycobacterium avium subsp. paratuberculosis
cgaugauggcgucgacg

SEQ ID NO: 860215 - RNA, 17 nt, Mycobacterium avium subsp. paratuberculosis
cgaugaugggcgaucga

SEQ ID NO: 860216 - RNA, 18 nt, Mycobacterium avium subsp. paratuberculosis
cgaugaugggcgaucgac

SEQ ID NO: 860217 - RNA, 16 nt, Mycobacterium avium subsp. paratuberculosis
cgaugaugccggcgga

SEQ ID NO: 860218 - RNA, 16 nt, Mycobacterium avium subsp. paratuberculosis
cgaugccgcgcaggcc

SEQ ID NO: 860219 - RNA, 13 nt, Mycobacterium avium subsp. paratuberculosis
cgaugcccgcgcc

SEQ ID NO: 860220 - RNA, 14 nt, Mycobacterium avium subsp. paratuberculosis
cgaugcccgcgccg

SEQ ID NO: 860221 - RNA, 15 nt, Mycobacterium avium subsp. paratuberculosis
cgaugcccgcgccga

SEQ ID NO: 860222 - RNA, 24 nt, Mycobacterium avium subsp. paratuberculosis
cgaugcccgcguccugcagcgccg

SEQ ID NO: 860223 - RNA, 20 nt, Mycobacterium avium subsp. paratuberculosis
cgaugcccggggugcuggcg

SEQ ID NO: 860224 - RNA, 15 nt, Mycobacterium avium subsp. paratuberculosis
cgaugcccgucacgg

SEQ ID NO: 860225 - RNA, 22 nt, Mycobacterium avium subsp. paratuberculosis
cgaugcccgugaucgccacggc

SEQ ID NO: 860226 - RNA, 17 nt, Mycobacterium avium subsp. paratuberculosis
cgaugcccuccagcacc

SEQ ID NO: 860227 - RNA, 13 nt, Mycobacterium avium subsp. paratuberculosis
cgaugcccgccgg

SEQ ID NO: 860228 - RNA, 14 nt, Mycobacterium avium subsp. paratuberculosis
cgaugcccgccggc

SEQ ID NO: 860229 - RNA, 15 nt, Mycobacterium avium subsp. paratuberculosis
cgaugcccgccggcc

SEQ ID NO: 860230 - RNA, 15 nt, Mycobacterium avium subsp. paratuberculosis
cgaugcccagcagcg

SEQ ID NO: 860231 - RNA, 13 nt, Mycobacterium avium subsp. paratuberculosis
cgaugcccagccc

SEQ ID NO: 860232 - RNA, 18 nt, Mycobacterium avium subsp. paratuberculosis
cgaugcccagccccucga

SEQ ID NO: 860233 - RNA, 18 nt, Mycobacterium avium subsp. paratuberculosis
cgaugcccagcgcgcggu

SEQ ID NO: 860234 - RNA, 19 nt, Mycobacterium avium subsp. paratuberculosis
cgaugcccagcgcgcggug

SEQ ID NO: 860235 - RNA, 17 nt, Mycobacterium avium subsp. paratuberculosis
cgaugaugguggcggcc

SEQ ID NO: 860236 - RNA, 17 nt, Mycobacterium avium subsp. paratuberculosis
cgaugcggucccgcggg

SEQ ID NO: 860237 - RNA, 23 nt, Mycobacterium avium subsp. paratuberculosis
cgaugcggguguugcgcagcguc

SEQ ID NO: 860238 - RNA, 18 nt, Mycobacterium avium subsp. paratuberculosis
cgaugcggugccgggugc

SEQ ID NO: 860239 - RNA, 13 nt, Mycobacterium avium subsp. paratuberculosis
cgaugcgggccag

SEQ ID NO: 860240 - RNA, 15 nt, Mycobacterium avium subsp. paratuberculosis
cgaugcggcucacca

SEQ ID NO: 860241 - RNA, 17 nt, Mycobacterium avium subsp. paratuberculosis
cgaugcggcucaccagg

SEQ ID NO: 860242 - RNA, 14 nt, Mycobacterium avium subsp. paratuberculosis
cgaugcgggcgccg

SEQ ID NO: 860243 - RNA, 15 nt, Mycobacterium avium subsp. paratuberculosis
cgaugcgggcgccga

SEQ ID NO: 860244 - RNA, 17 nt, Mycobacterium avium subsp. paratuberculosis
cgaugcgggcgccgaac

SEQ ID NO: 860245 - RNA, 16 nt, Mycobacterium avium subsp. paratuberculosis
cgaugcggggccggcg

SEQ ID NO: 860246 - RNA, 16 nt, Mycobacterium avium subsp. paratuberculosis
cgaugcggggcggcgg

SEQ ID NO: 860247 - RNA, 17 nt, Mycobacterium avium subsp. paratuberculosis
cgaugcgcaccaucacc

SEQ ID NO: 860248 - RNA, 19 nt, Mycobacterium avium subsp. paratuberculosis
cgaugcgcaccaucaccug

SEQ ID NO: 860249 - RNA, 19 nt, Mycobacterium avium subsp. paratuberculosis
cgaugcgcacccccggggc

SEQ ID NO: 860250 - RNA, 18 nt, Mycobacterium avium subsp. paratuberculosis
cgaugcgcaccgugccgc

SEQ ID NO: 860251 - RNA, 19 nt, Mycobacterium avium subsp. paratuberculosis
cgaugcgcaccgugccgcc

SEQ ID NO: 860252 - RNA, 19 nt, Mycobacterium avium subsp. paratuberculosis
cgaugcgcacgucggccgc

SEQ ID NO: 860253 - RNA, 20 nt, Mycobacterium avium subsp. paratuberculosis
cgaugcgcacgucggccgcc

SEQ ID NO: 860254 - RNA, 20 nt, Mycobacterium avium subsp. paratuberculosis
cgaugcggaucucggugccg

SEQ ID NO: 860255 - RNA, 14 nt, Mycobacterium avium subsp. paratuberculosis
cgaugcggcccugg

SEQ ID NO: 860256 - RNA, 12 nt, Mycobacterium avium subsp. paratuberculosis
cgaugcggccgg

SEQ ID NO: 860257 - RNA, 14 nt, Mycobacterium avium subsp. paratuberculosis
cgaugcggccggcg

SEQ ID NO: 860258 - RNA, 15 nt, Mycobacterium avium subsp. paratuberculosis
cgaugcggccggcgg

SEQ ID NO: 860259 - RNA, 16 nt, Mycobacterium avium subsp. paratuberculosis
cgaugcggccggcggg

SEQ ID NO: 860260 - RNA, 14 nt, Mycobacterium avium subsp. paratuberculosis
cgaugcggccgucg

SEQ ID NO: 860261 - RNA, 15 nt, Mycobacterium avium subsp. paratuberculosis
cgaugcggccgucgg

SEQ ID NO: 860262 - RNA, 14 nt, Mycobacterium avium subsp. paratuberculosis
cgaugccguucgcg

SEQ ID NO: 860263 - RNA, 15 nt, Mycobacterium avium subsp. paratuberculosis
cgaugccguucgcgc

SEQ ID NO: 860264 - RNA, 17 nt, Mycobacterium avium subsp. paratuberculosis
cgaugccguucgcgccg

SEQ ID NO: 860265 - RNA, 18 nt, Mycobacterium avium subsp. paratuberculosis
cgaugccguugaucaccg

SEQ ID NO: 860266 - RNA, 20 nt, Mycobacterium avium subsp. paratuberculosis
cgaugccguugaucaccgug

SEQ ID NO: 860267 - RNA, 21 nt, Mycobacterium avium subsp. paratuberculosis
cgaugccguugaucaccguga

SEQ ID NO: 860268 - RNA, 20 nt, Mycobacterium avium subsp. paratuberculosis
cgaugccguugugcaccauc

SEQ ID NO: 860269 - RNA, 20 nt, Mycobacterium avium subsp. paratuberculosis
cgaugccuacaggugccggc

SEQ ID NO: 860270 - RNA, 12 nt, Mycobacterium avium subsp. paratuberculosis
cgaugcgacgca

SEQ ID NO: 860271 - RNA, 14 nt, Mycobacterium avium subsp. paratuberculosis
cgaugcgacgcacc

SEQ ID NO: 860272 - RNA, 17 nt, Mycobacterium avium subsp. paratuberculosis
cgaugccgugcugggcg

SEQ ID NO: 860273 - RNA, 17 nt, Mycobacterium avium subsp. paratuberculosis
cgaugccguagaccagc

SEQ ID NO: 860274 - RNA, 14 nt, Mycobacterium avium subsp. paratuberculosis
cgaugccguagagc

SEQ ID NO: 860275 - RNA, 12 nt, Mycobacterium avium subsp. paratuberculosis
cgaugccggcgu

SEQ ID NO: 860276 - RNA, 16 nt, Mycobacterium avium subsp. paratuberculosis
cgaugccggcgucguc

SEQ ID NO: 860277 - RNA, 17 nt, Mycobacterium avium subsp. paratuberculosis
cgaugccggcgucgucg

SEQ ID NO: 860278 - RNA, 18 nt, Mycobacterium avium subsp. paratuberculosis
cgaugccggcgucgucgu

SEQ ID NO: 860279 - RNA, 11 nt, Mycobacterium avium subsp. paratuberculosis
cgaugccgggc

SEQ ID NO: 860280 - RNA, 12 nt, Mycobacterium avium subsp. paratuberculosis
cgaugccggccu

SEQ ID NO: 860281 - RNA, 20 nt, Mycobacterium avium subsp. paratuberculosis
cgaugccggcgacgaacgcu

SEQ ID NO: 860282 - RNA, 13 nt, Mycobacterium avium subsp. paratuberculosis
cgaugccggccug

SEQ ID NO: 860283 - RNA, 12 nt, Mycobacterium avium subsp. paratuberculosis
cgaugccggcga

SEQ ID NO: 860284 - RNA, 17 nt, Mycobacterium avium subsp. paratuberculosis
cgaugccggccagcggc

SEQ ID NO: 860285 - RNA, 19 nt, Mycobacterium avium subsp. paratuberculosis
cgaugccggccagcggcca

SEQ ID NO: 860286 - RNA, 20 nt, Mycobacterium avium subsp. paratuberculosis
cgaugccggccagcggccag

SEQ ID NO: 860287 - RNA, 13 nt, Mycobacterium avium subsp. paratuberculosis
cgaugccggccgg

SEQ ID NO: 860288 - RNA, 15 nt, Mycobacterium avium subsp. paratuberculosis
cgaugccgcggcguc

SEQ ID NO: 860289 - RNA, 13 nt, Mycobacterium avium subsp. paratuberculosis
cgaugccggaaaa

SEQ ID NO: 860290 - RNA, 19 nt, Mycobacterium avium subsp. paratuberculosis
cgaugccggaaaaguucgg

SEQ ID NO: 860291 - RNA, 21 nt, Mycobacterium avium subsp. paratuberculosis
cgaugccggaaaaguucggcg

SEQ ID NO: 860292 - RNA, 14 nt, Mycobacterium avium subsp. paratuberculosis
cgaucucuucgccg

SEQ ID NO: 860293 - RNA, 16 nt, Mycobacterium avium subsp. paratuberculosis
cgaucucuucgccgga

SEQ ID NO: 860294 - RNA, 17 nt, Mycobacterium avium subsp. paratuberculosis
cgaucucggucaccgag

SEQ ID NO: 860295 - RNA, 19 nt, Mycobacterium avium subsp. paratuberculosis
cgaucucggucaccgagcg

SEQ ID NO: 860296 - RNA, 14 nt, Mycobacterium avium subsp. paratuberculosis
cgaucucggucgcc

SEQ ID NO: 860297 - RNA, 13 nt, Mycobacterium avium subsp. paratuberculosis
cgaucucggcggc

SEQ ID NO: 860298 - RNA, 18 nt, Mycobacterium avium subsp. paratuberculosis
cgaucucggcggccgcgu

SEQ ID NO: 860299 - RNA, 15 nt, Mycobacterium avium subsp. paratuberculosis
cgaucucggugagcc

SEQ ID NO: 860300 - RNA, 15 nt, Mycobacterium avium subsp. paratuberculosis
cgaugaagccggcga

SEQ ID NO: 860301 - RNA, 19 nt, Mycobacterium avium subsp. paratuberculosis
cgaugaagccgugcccgcg

SEQ ID NO: 860302 - RNA, 15 nt, Mycobacterium avium subsp. paratuberculosis
cgaucugcgucaugg

SEQ ID NO: 860303 - RNA, 16 nt, Mycobacterium avium subsp. paratuberculosis
cgaucugcggcacggu

SEQ ID NO: 860304 - RNA, 18 nt, Mycobacterium avium subsp. paratuberculosis
cgaucugcggcacggugc

SEQ ID NO: 860305 - RNA, 13 nt, Mycobacterium avium subsp. paratuberculosis
cgaucugcaggcc

SEQ ID NO: 860306 - RNA, 17 nt, Mycobacterium avium subsp. paratuberculosis
cgaucugcaggccccag

SEQ ID NO: 860307 - RNA, 15 nt, Mycobacterium avium subsp. paratuberculosis
cgaucugcaccagcg

SEQ ID NO: 860308 - RNA, 17 nt, Mycobacterium avium subsp. paratuberculosis
cgaucugcaccagcgcg

SEQ ID NO: 860309 - RNA, 18 nt, Mycobacterium avium subsp. paratuberculosis
cgaucugcaccagcgcgg

SEQ ID NO: 860310 - RNA, 18 nt, Mycobacterium avium subsp. paratuberculosis
cgaucucgucccacggcg

SEQ ID NO: 860311 - RNA, 14 nt, Mycobacterium avium subsp. paratuberculosis
cgaucugcagccgg

SEQ ID NO: 860312 - RNA, 19 nt, Mycobacterium avium subsp. paratuberculosis
cgaucugcagccggcgcgg

SEQ ID NO: 860313 - RNA, 17 nt, Mycobacterium avium subsp. paratuberculosis
cgaugaaguacccgguc

SEQ ID NO: 860314 - RNA, 19 nt, Mycobacterium avium subsp. paratuberculosis
cgaucugcucgaugcggcc

SEQ ID NO: 860315 - RNA, 15 nt, Mycobacterium avium subsp. paratuberculosis
cgaugaagucgguga

SEQ ID NO: 860316 - RNA, 20 nt, Mycobacterium avium subsp. paratuberculosis
cgaugaaguugaagacgcga

SEQ ID NO: 860317 - RNA, 21 nt, Mycobacterium avium subsp. paratuberculosis
cgaugaauccgcgcagcagcg

SEQ ID NO: 860318 - RNA, 16 nt, Mycobacterium avium subsp. paratuberculosis
cgaugaauuccggugu

SEQ ID NO: 860319 - RNA, 22 nt, Mycobacterium avium subsp. paratuberculosis
cgaugacauggaucggacccau

SEQ ID NO: 860320 - RNA, 15 nt, Mycobacterium avium subsp. paratuberculosis
cgaugacccaccagc

SEQ ID NO: 860321 - RNA, 18 nt, Mycobacterium avium subsp. paratuberculosis
cgaugacccaccagccga

SEQ ID NO: 860322 - RNA, 14 nt, Mycobacterium avium subsp. paratuberculosis
cgaugacccagccc

SEQ ID NO: 860323 - RNA, 20 nt, Mycobacterium avium subsp. paratuberculosis
cgaugaccagcgcgaacagc

SEQ ID NO: 860324 - RNA, 23 nt, Mycobacterium avium subsp. paratuberculosis
cgaugacgcgcuuguacaggucg

SEQ ID NO: 860325 - RNA, 12 nt, Mycobacterium avium subsp. paratuberculosis
cgaugacgcggu

SEQ ID NO: 860326 - RNA, 19 nt, Mycobacterium avium subsp. paratuberculosis
cgaugacgcugccgcgccg

SEQ ID NO: 860327 - RNA, 20 nt, Mycobacterium avium subsp. paratuberculosis
cgaugacgcugccgcgccgc

SEQ ID NO: 860328 - RNA, 16 nt, Mycobacterium avium subsp. paratuberculosis
cgaugacggcgcgaac

SEQ ID NO: 860329 - RNA, 17 nt, Mycobacterium avium subsp. paratuberculosis
cgaugacggcggcgccc

SEQ ID NO: 860330 - RNA, 19 nt, Mycobacterium avium subsp. paratuberculosis
cgaugacggucuugcggcc

SEQ ID NO: 860331 - RNA, 20 nt, Mycobacterium avium subsp. paratuberculosis
cgaugacggucuugcggccg

SEQ ID NO: 860332 - RNA, 23 nt, Mycobacterium avium subsp. paratuberculosis
cgaugacggugguggccuugacg

SEQ ID NO: 860333 - RNA, 15 nt, Mycobacterium avium subsp. paratuberculosis
cgaugacguccacca

SEQ ID NO: 860334 - RNA, 14 nt, Mycobacterium avium subsp. paratuberculosis
cgaugacgucgcgc

SEQ ID NO: 860335 - RNA, 15 nt, Mycobacterium avium subsp. paratuberculosis
cgaugacgucgcgcu

SEQ ID NO: 860336 - RNA, 17 nt, Mycobacterium avium subsp. paratuberculosis
cgaugacgucgcgcugc

SEQ ID NO: 860337 - RNA, 20 nt, Mycobacterium avium subsp. paratuberculosis
cgaugacgucgcgcugccgg

SEQ ID NO: 860338 - RNA, 13 nt, Mycobacterium avium subsp. paratuberculosis
cgaugacgucguc

SEQ ID NO: 860339 - RNA, 18 nt, Mycobacterium avium subsp. paratuberculosis
cgaugacgucgucgcggc

SEQ ID NO: 860340 - RNA, 19 nt, Mycobacterium avium subsp. paratuberculosis
cgaugacgucgucgcggcg

SEQ ID NO: 860341 - RNA, 22 nt, Mycobacterium avium subsp. paratuberculosis
cgaugacgucgucgcggcgcug

SEQ ID NO: 860342 - RNA, 13 nt, Mycobacterium avium subsp. paratuberculosis
cgaucucgcgcgg

SEQ ID NO: 860343 - RNA, 18 nt, Mycobacterium avium subsp. paratuberculosis
cgaucucgcgcgggucga

SEQ ID NO: 860344 - RNA, 21 nt, Mycobacterium avium subsp. paratuberculosis
cgaucucggagaccuuggcgc

SEQ ID NO: 860345 - RNA, 20 nt, Mycobacterium avium subsp. paratuberculosis
cgaucucggccaccgucagc

SEQ ID NO: 860346 - RNA, 21 nt, Mycobacterium avium subsp. paratuberculosis
cgaucucggccaccgucagcg

SEQ ID NO: 860347 - RNA, 14 nt, Mycobacterium avium subsp. paratuberculosis
cgaucucggccagc

SEQ ID NO: 860348 - RNA, 16 nt, Mycobacterium avium subsp. paratuberculosis
cgaucucggccagcgg

SEQ ID NO: 860349 - RNA, 17 nt, Mycobacterium avium subsp. paratuberculosis
cgaucucggccagcggg

SEQ ID NO: 860350 - RNA, 21 nt, Mycobacterium avium subsp. paratuberculosis
cgaucucggccagcgggcggc

SEQ ID NO: 860351 - RNA, 15 nt, Mycobacterium avium subsp. paratuberculosis
cgaucucgcggucga

SEQ ID NO: 860352 - RNA, 14 nt, Mycobacterium avium subsp. paratuberculosis
cgaucucggcgcag

SEQ ID NO: 860353 - RNA, 13 nt, Mycobacterium avium subsp. paratuberculosis
cgaucucgccgaa

SEQ ID NO: 860354 - RNA, 17 nt, Mycobacterium avium subsp. paratuberculosis
cgaucucgauggccucg

SEQ ID NO: 860355 - RNA, 20 nt, Mycobacterium avium subsp. paratuberculosis
cgaucucgauggccucgucg

SEQ ID NO: 860356 - RNA, 14 nt, Mycobacterium avium subsp. paratuberculosis
cgaucucgauguag

SEQ ID NO: 860357 - RNA, 18 nt, Mycobacterium avium subsp. paratuberculosis
cgaucucgaccagcgccg

SEQ ID NO: 860358 - RNA, 17 nt, Mycobacterium avium subsp. paratuberculosis
cgaucucgaccaggccg

SEQ ID NO: 860359 - RNA, 15 nt, Mycobacterium avium subsp. paratuberculosis
cgaucucgaccagcg

SEQ ID NO: 860360 - RNA, 14 nt, Mycobacterium avium subsp. paratuberculosis
cgaucuccaccgag

SEQ ID NO: 860361 - RNA, 20 nt, Mycobacterium avium subsp. paratuberculosis
cgaucuccaccgagugcggc

SEQ ID NO: 860362 - RNA, 22 nt, Mycobacterium avium subsp. paratuberculosis
cgaucuccaccgagugcggcgc

SEQ ID NO: 860363 - RNA, 14 nt, Mycobacterium avium subsp. paratuberculosis
cgaucuccagcggc

SEQ ID NO: 860364 - RNA, 15 nt, Mycobacterium avium subsp. paratuberculosis
cgaucuccagcggcc

SEQ ID NO: 860365 - RNA, 16 nt, Mycobacterium avium subsp. paratuberculosis
cgaucuccagcggccg

SEQ ID NO: 860366 - RNA, 20 nt, Mycobacterium avium subsp. paratuberculosis
cgaucuccagcggccgggcg

SEQ ID NO: 860367 - RNA, 19 nt, Mycobacterium avium subsp. paratuberculosis
cgaucucccaacgcagcgc

SEQ ID NO: 860368 - RNA, 13 nt, Mycobacterium avium subsp. paratuberculosis
cgaucuccucgcg

SEQ ID NO: 860369 - RNA, 20 nt, Mycobacterium avium subsp. paratuberculosis
cgaucuccucgcgcggcacc

SEQ ID NO: 860370 - RNA, 15 nt, Mycobacterium avium subsp. paratuberculosis
cgaucgucaccgugc

SEQ ID NO: 860371 - RNA, 21 nt, Mycobacterium avium subsp. paratuberculosis
cgaucgucaccgugccgucgc

SEQ ID NO: 860372 - RNA, 22 nt, Mycobacterium avium subsp. paratuberculosis
cgaucguccgaggccccgccag

SEQ ID NO: 860373 - RNA, 16 nt, Mycobacterium avium subsp. paratuberculosis
cgaucguccggcgcca

SEQ ID NO: 860374 - RNA, 17 nt, Mycobacterium avium subsp. paratuberculosis
cgaucguccggcgccac

SEQ ID NO: 860375 - RNA, 20 nt, Mycobacterium avium subsp. paratuberculosis
cgaucguccggcgccacgac

SEQ ID NO: 860376 - RNA, 12 nt, Mycobacterium avium subsp. paratuberculosis
cgaucggggcca

SEQ ID NO: 860377 - RNA, 15 nt, Mycobacterium avium subsp. paratuberculosis
cgaucggggcgcagc

SEQ ID NO: 860378 - RNA, 22 nt, Mycobacterium avium subsp. paratuberculosis
cgaucggggcgcagcccggcgg

SEQ ID NO: 860379 - RNA, 23 nt, Mycobacterium avium subsp. paratuberculosis
cgaucggggcgcagcccggcggu

SEQ ID NO: 860380 - RNA, 18 nt, Mycobacterium avium subsp. paratuberculosis
cgaucggguagacgucgg

SEQ ID NO: 860381 - RNA, 21 nt, Mycobacterium avium subsp. paratuberculosis
cgaucggguagacgucgggcu

SEQ ID NO: 860382 - RNA, 23 nt, Mycobacterium avium subsp. paratuberculosis
cgaucggguagacgucgggcugg

SEQ ID NO: 860383 - RNA, 18 nt, Mycobacterium avium subsp. paratuberculosis
cgaucgggucaccggccg

SEQ ID NO: 860384 - RNA, 19 nt, Mycobacterium avium subsp. paratuberculosis
cgaucgggucaccggccga

SEQ ID NO: 860385 - RNA, 14 nt, Mycobacterium avium subsp. paratuberculosis
cgaucggguggccc

SEQ ID NO: 860386 - RNA, 18 nt, Mycobacterium avium subsp. paratuberculosis
cgaucggugaacccgccg

SEQ ID NO: 860387 - RNA, 18 nt, Mycobacterium avium subsp. paratuberculosis
cgaucgugaauucggccg

SEQ ID NO: 860388 - RNA, 21 nt, Mycobacterium avium subsp. paratuberculosis
cgaucgugaauucggccgggu

SEQ ID NO: 860389 - RNA, 15 nt, Mycobacterium avium subsp. paratuberculosis
cgaucgugacgccgu

SEQ ID NO: 860390 - RNA, 21 nt, Mycobacterium avium subsp. paratuberculosis
cgaucgucgccgccaacgcga

SEQ ID NO: 860391 - RNA, 13 nt, Mycobacterium avium subsp. paratuberculosis
cgaucgucgccgu

SEQ ID NO: 860392 - RNA, 15 nt, Mycobacterium avium subsp. paratuberculosis
cgaucgucgccguca

SEQ ID NO: 860393 - RNA, 21 nt, Mycobacterium avium subsp. paratuberculosis
cgaucgucgccgucaccucga

SEQ ID NO: 860394 - RNA, 13 nt, Mycobacterium avium subsp. paratuberculosis
cgaucgucgacgu

SEQ ID NO: 860395 - RNA, 20 nt, Mycobacterium avium subsp. paratuberculosis
cgaucgucgacgucaacacc

SEQ ID NO: 860396 - RNA, 21 nt, Mycobacterium avium subsp. paratuberculosis
cgaucgucgacgucaacaccg

SEQ ID NO: 860397 - RNA, 22 nt, Mycobacterium avium subsp. paratuberculosis
cgaucgugcgcccauccggcgc

SEQ ID NO: 860398 - RNA, 16 nt, Mycobacterium avium subsp. paratuberculosis
cgaucgucgaccacca

SEQ ID NO: 860399 - RNA, 15 nt, Mycobacterium avium subsp. paratuberculosis
cgaucgugggcaaca

SEQ ID NO: 860400 - RNA, 14 nt, Mycobacterium avium subsp. paratuberculosis
cgaucgcgccggcc

SEQ ID NO: 860401 - RNA, 15 nt, Mycobacterium avium subsp. paratuberculosis
cgaucgcgccggccg

SEQ ID NO: 860402 - RNA, 17 nt, Mycobacterium avium subsp. paratuberculosis
cgaucgcgccggccgcc

SEQ ID NO: 860403 - RNA, 21 nt, Mycobacterium avium subsp. paratuberculosis
cgaucgcgccggccgccgcga

SEQ ID NO: 860404 - RNA, 17 nt, Mycobacterium avium subsp. paratuberculosis
cgaucgcgcgcaggaac

SEQ ID NO: 860405 - RNA, 14 nt, Mycobacterium avium subsp. paratuberculosis
cgaucgcggccacc

SEQ ID NO: 860406 - RNA, 16 nt, Mycobacterium avium subsp. paratuberculosis
cgaucgcggccagcgu

SEQ ID NO: 860407 - RNA, 18 nt, Mycobacterium avium subsp. paratuberculosis
cgaucgcggccagcguga

SEQ ID NO: 860408 - RNA, 14 nt, Mycobacterium avium subsp. paratuberculosis
cgaucgcggcgaug

SEQ ID NO: 860409 - RNA, 14 nt, Mycobacterium avium subsp. paratuberculosis
cgaucgcgucgacg

SEQ ID NO: 860410 - RNA, 14 nt, Mycobacterium avium subsp. paratuberculosis
cgaucgcgucgaug

SEQ ID NO: 860411 - RNA, 14 nt, Mycobacterium avium subsp. paratuberculosis
cgaucgcggucacc

SEQ ID NO: 860412 - RNA, 17 nt, Mycobacterium avium subsp. paratuberculosis
cgaucgcggucaccuug

SEQ ID NO: 860413 - RNA, 12 nt, Mycobacterium avium subsp. paratuberculosis
cgaucgcgguga

SEQ ID NO: 860414 - RNA, 18 nt, Mycobacterium avium subsp. paratuberculosis
cgaucgcggugacgcgcc

SEQ ID NO: 860415 - RNA, 21 nt, Mycobacterium avium subsp. paratuberculosis
cgaucgcggugacgcgccggc

SEQ ID NO: 860416 - RNA, 12 nt, Mycobacterium avium subsp. paratuberculosis
cgaucgcggugc

SEQ ID NO: 860417 - RNA, 21 nt, Mycobacterium avium subsp. paratuberculosis
cgaucgcguaggguucgccga

SEQ ID NO: 860418 - RNA, 24 nt, Mycobacterium avium subsp. paratuberculosis
cgaucgcguucugcaccagcucgg

SEQ ID NO: 860419 - RNA, 17 nt, Mycobacterium avium subsp. paratuberculosis
cgaucggcaugacgccc

SEQ ID NO: 860420 - RNA, 13 nt, Mycobacterium avium subsp. paratuberculosis
cgaucggcccggc

SEQ ID NO: 860421 - RNA, 14 nt, Mycobacterium avium subsp. paratuberculosis
cgaucggcgcgccg

SEQ ID NO: 860422 - RNA, 14 nt, Mycobacterium avium subsp. paratuberculosis
cgaucggcgagccg

SEQ ID NO: 860423 - RNA, 22 nt, Mycobacterium avium subsp. paratuberculosis
cgaucggcgccacgaccagcgg

SEQ ID NO: 860424 - RNA, 22 nt, Mycobacterium avium subsp. paratuberculosis
cgaucggauggugcccaccggg

SEQ ID NO: 860425 - RNA, 14 nt, Mycobacterium avium subsp. paratuberculosis
cgaucggcacgucg

SEQ ID NO: 860426 - RNA, 16 nt, Mycobacterium avium subsp. paratuberculosis
cgaucggcacgucgag

SEQ ID NO: 860427 - RNA, 13 nt, Mycobacterium avium subsp. paratuberculosis
cgaucggcagcgc

SEQ ID NO: 860428 - RNA, 16 nt, Mycobacterium avium subsp. paratuberculosis
cgaucggcagcgccaa

SEQ ID NO: 860429 - RNA, 19 nt, Mycobacterium avium subsp. paratuberculosis
cgaucggcagcgccaacau

SEQ ID NO: 860430 - RNA, 18 nt, Mycobacterium avium subsp. paratuberculosis
cgaucggcaggucgucga

SEQ ID NO: 860431 - RNA, 20 nt, Mycobacterium avium subsp. paratuberculosis
cgaucggcaggucgucgacg

SEQ ID NO: 860432 - RNA, 14 nt, Mycobacterium avium subsp. paratuberculosis
cgaucgggcgucgc

SEQ ID NO: 860433 - RNA, 15 nt, Mycobacterium avium subsp. paratuberculosis
cgaucgggcgucgca

SEQ ID NO: 860434 - RNA, 20 nt, Mycobacterium avium subsp. paratuberculosis
cgaucggggaauccuggccg

SEQ ID NO: 860435 - RNA, 21 nt, Mycobacterium avium subsp. paratuberculosis
cgaucggggaauccuggccga

SEQ ID NO: 860436 - RNA, 15 nt, Mycobacterium avium subsp. paratuberculosis
cgaucggcgcggcga

SEQ ID NO: 860437 - RNA, 17 nt, Mycobacterium avium subsp. paratuberculosis
cgaucggcggcucgccg

SEQ ID NO: 860438 - RNA, 12 nt, Mycobacterium avium subsp. paratuberculosis
cgaucggcgguc

SEQ ID NO: 860439 - RNA, 18 nt, Mycobacterium avium subsp. paratuberculosis
cgaucggcgguccgccgc

SEQ ID NO: 860440 - RNA, 15 nt, Mycobacterium avium subsp. paratuberculosis
cgaucggcgugccgg

SEQ ID NO: 860441 - RNA, 15 nt, Mycobacterium avium subsp. paratuberculosis
cgaucggcuccagcg

SEQ ID NO: 860442 - RNA, 17 nt, Mycobacterium avium subsp. paratuberculosis
cgaucggcuccagcgcc

SEQ ID NO: 860443 - RNA, 20 nt, Mycobacterium avium subsp. paratuberculosis
cgaucggcucgagcucgucg

SEQ ID NO: 860444 - RNA, 19 nt, Mycobacterium avium subsp. paratuberculosis
cgaucggcucggcgcccca

SEQ ID NO: 860445 - RNA, 12 nt, Mycobacterium avium subsp. paratuberculosis
cgaucgggaaca

SEQ ID NO: 860446 - RNA, 17 nt, Mycobacterium avium subsp. paratuberculosis
cgaucgggaacagcccg

SEQ ID NO: 860447 - RNA, 15 nt, Mycobacterium avium subsp. paratuberculosis
cgaucgcgagggccg

SEQ ID NO: 860448 - RNA, 13 nt, Mycobacterium avium subsp. paratuberculosis
cgaucgcgaucac

SEQ ID NO: 860449 - RNA, 15 nt, Mycobacterium avium subsp. paratuberculosis
cgaucgcgaucaccg

SEQ ID NO: 860450 - RNA, 18 nt, Mycobacterium avium subsp. paratuberculosis
cgaucgcgaucaccgcgg

SEQ ID NO: 860451 - RNA, 19 nt, Mycobacterium avium subsp. paratuberculosis
cgaucgcgaucaccgcggc

SEQ ID NO: 860452 - RNA, 12 nt, Mycobacterium avium subsp. paratuberculosis
cgaucgcgacca

SEQ ID NO: 860453 - RNA, 15 nt, Mycobacterium avium subsp. paratuberculosis
cgaucgcgaccaccg

SEQ ID NO: 860454 - RNA, 16 nt, Mycobacterium avium subsp. paratuberculosis
cgaucgcgaccaccgg

SEQ ID NO: 860455 - RNA, 19 nt, Mycobacterium avium subsp. paratuberculosis
cgaucgcgaccaccggccg

SEQ ID NO: 860456 - RNA, 15 nt, Mycobacterium avium subsp. paratuberculosis
cgaucgcgacggccg

SEQ ID NO: 860457 - RNA, 13 nt, Mycobacterium avium subsp. paratuberculosis
cgaucgccgggga

SEQ ID NO: 860458 - RNA, 16 nt, Mycobacterium avium subsp. paratuberculosis
cgaucgccggugcggc

SEQ ID NO: 860459 - RNA, 21 nt, Mycobacterium avium subsp. paratuberculosis
cgaucgccggugcggccgcga

SEQ ID NO: 860460 - RNA, 13 nt, Mycobacterium avium subsp. paratuberculosis
cgaucgccgucac

SEQ ID NO: 860461 - RNA, 15 nt, Mycobacterium avium subsp. paratuberculosis
cgaucgccgucacgu

SEQ ID NO: 860462 - RNA, 23 nt, Mycobacterium avium subsp. paratuberculosis
cgaucgccgucacguagcgcggc

SEQ ID NO: 860463 - RNA, 18 nt, Mycobacterium avium subsp. paratuberculosis
cgaucgccgacgccagca

SEQ ID NO: 860464 - RNA, 13 nt, Mycobacterium avium subsp. paratuberculosis
cgaucgccgacgu

SEQ ID NO: 860465 - RNA, 14 nt, Mycobacterium avium subsp. paratuberculosis
cgaucgccucggcc

SEQ ID NO: 860466 - RNA, 20 nt, Mycobacterium avium subsp. paratuberculosis
cgaucgccucggccuuggcc

SEQ ID NO: 860467 - RNA, 22 nt, Mycobacterium avium subsp. paratuberculosis
cgaucgccgcgcauucaccagc

SEQ ID NO: 860468 - RNA, 13 nt, Mycobacterium avium subsp. paratuberculosis
cgaucgccgcgcc

SEQ ID NO: 860469 - RNA, 15 nt, Mycobacterium avium subsp. paratuberculosis
cgaucgccgagucga

SEQ ID NO: 860470 - RNA, 18 nt, Mycobacterium avium subsp. paratuberculosis
cgaucgccgagucgaucg

SEQ ID NO: 860471 - RNA, 19 nt, Mycobacterium avium subsp. paratuberculosis
cgaucgccgauccggcgcc

SEQ ID NO: 860472 - RNA, 23 nt, Mycobacterium avium subsp. paratuberculosis
cgaucgccgauccggcgccgcgg

SEQ ID NO: 860473 - RNA, 18 nt, Mycobacterium avium subsp. paratuberculosis
cgaucgccgcgcccagca

SEQ ID NO: 860474 - RNA, 12 nt, Mycobacterium avium subsp. paratuberculosis
cgaucgccgacg

SEQ ID NO: 860475 - RNA, 17 nt, Mycobacterium avium subsp. paratuberculosis
cgaucgcccgcuccgcg

SEQ ID NO: 860476 - RNA, 22 nt, Mycobacterium avium subsp. paratuberculosis
cgaucgcccgguaggccgccgc

SEQ ID NO: 860477 - RNA, 14 nt, Mycobacterium avium subsp. paratuberculosis
cgaucgccagcgcc

SEQ ID NO: 860478 - RNA, 15 nt, Mycobacterium avium subsp. paratuberculosis
cgaucgccagcgccc

SEQ ID NO: 860479 - RNA, 16 nt, Mycobacterium avium subsp. paratuberculosis
cgaucgccagcgcggu

SEQ ID NO: 860480 - RNA, 18 nt, Mycobacterium avium subsp. paratuberculosis
cgaucgccagcgcggugu

SEQ ID NO: 860481 - RNA, 15 nt, Mycobacterium avium subsp. paratuberculosis
cgaucgacaccagcg

SEQ ID NO: 860482 - RNA, 17 nt, Mycobacterium avium subsp. paratuberculosis
cgaucgacaccagcgug

SEQ ID NO: 860483 - RNA, 17 nt, Mycobacterium avium subsp. paratuberculosis
cgaucgaauacaccugc

SEQ ID NO: 860484 - RNA, 19 nt, Mycobacterium avium subsp. paratuberculosis
cgaucgaauacaccugccg

SEQ ID NO: 860485 - RNA, 21 nt, Mycobacterium avium subsp. paratuberculosis
cgaucgagaccaugucggcca

SEQ ID NO: 860486 - RNA, 22 nt, Mycobacterium avium subsp. paratuberculosis
cgaucgagaccaugucggccag

SEQ ID NO: 860487 - RNA, 18 nt, Mycobacterium avium subsp. paratuberculosis
cgaucgacgacgccagcu

SEQ ID NO: 860488 - RNA, 15 nt, Mycobacterium avium subsp. paratuberculosis
cgaucgccaccgaga

SEQ ID NO: 860489 - RNA, 13 nt, Mycobacterium avium subsp. paratuberculosis
cgaucgccagcac

SEQ ID NO: 860490 - RNA, 18 nt, Mycobacterium avium subsp. paratuberculosis
cgaucgccaacgcgcuca

SEQ ID NO: 860491 - RNA, 21 nt, Mycobacterium avium subsp. paratuberculosis
cgaucgaucccuuggcggcgg

SEQ ID NO: 860492 - RNA, 15 nt, Mycobacterium avium subsp. paratuberculosis
cgaucgaugcccagc

SEQ ID NO: 860493 - RNA, 16 nt, Mycobacterium avium subsp. paratuberculosis
cgaucgaugcccagcg

SEQ ID NO: 860494 - RNA, 19 nt, Mycobacterium avium subsp. paratuberculosis
cgaucgaugcccagcgcgc

SEQ ID NO: 860495 - RNA, 16 nt, Mycobacterium avium subsp. paratuberculosis
cgaucgagccgguggu

SEQ ID NO: 860496 - RNA, 23 nt, Mycobacterium avium subsp. paratuberculosis
cgaucgaggucuucggucccggc

SEQ ID NO: 860497 - RNA, 22 nt, Mycobacterium avium subsp. paratuberculosis
cgaucgaggugauguuggccgc

SEQ ID NO: 860498 - RNA, 16 nt, Mycobacterium avium subsp. paratuberculosis
cgauccacucccgcgc

SEQ ID NO: 860499 - RNA, 15 nt, Mycobacterium avium subsp. paratuberculosis
cgauccagggcccgc

SEQ ID NO: 860500 - RNA, 14 nt, Mycobacterium avium subsp. paratuberculosis
cgauccagccgucg

SEQ ID NO: 860501 - RNA, 18 nt, Mycobacterium avium subsp. paratuberculosis
cgauccagccgucguugc

SEQ ID NO: 860502 - RNA, 22 nt, Mycobacterium avium subsp. paratuberculosis
cgauccagcgcuggccggccac

SEQ ID NO: 860503 - RNA, 17 nt, Mycobacterium avium subsp. paratuberculosis
cgaucccgaugcggacg

SEQ ID NO: 860504 - RNA, 12 nt, Mycobacterium avium subsp. paratuberculosis
cgaucccgccgc

SEQ ID NO: 860505 - RNA, 14 nt, Mycobacterium avium subsp. paratuberculosis
cgauccccgcagcu

SEQ ID NO: 860506 - RNA, 16 nt, Mycobacterium avium subsp. paratuberculosis
cgauccccgcagcucc

SEQ ID NO: 860507 - RNA, 23 nt, Mycobacterium avium subsp. paratuberculosis
cgauccccgcagcucccccggcg

SEQ ID NO: 860508 - RNA, 17 nt, Mycobacterium avium subsp. paratuberculosis
cgaucaucaccaccgcc

SEQ ID NO: 860509 - RNA, 20 nt, Mycobacterium avium subsp. paratuberculosis
cgaucaucaccaccgccgcc

SEQ ID NO: 860510 - RNA, 18 nt, Mycobacterium avium subsp. paratuberculosis
cgaucauccaggugaaca

SEQ ID NO: 860511 - RNA, 16 nt, Mycobacterium avium subsp. paratuberculosis
cgaucaucgccucggu

SEQ ID NO: 860512 - RNA, 21 nt, Mycobacterium avium subsp. paratuberculosis
cgaucaucgccucggucgcgu

SEQ ID NO: 860513 - RNA, 16 nt, Mycobacterium avium subsp. paratuberculosis
cgaucaucgcgucggu

SEQ ID NO: 860514 - RNA, 18 nt, Mycobacterium avium subsp. paratuberculosis
cgaucaucgcgucggugu

SEQ ID NO: 860515 - RNA, 18 nt, Mycobacterium avium subsp. paratuberculosis
cgaucaucucaccgacga

SEQ ID NO: 860516 - RNA, 20 nt, Mycobacterium avium subsp. paratuberculosis
cgaucaucucaccgacgacc

SEQ ID NO: 860517 - RNA, 14 nt, Mycobacterium avium subsp. paratuberculosis
cgaucauggucggc

SEQ ID NO: 860518 - RNA, 18 nt, Mycobacterium avium subsp. paratuberculosis
cgaucauggucggcgacg

SEQ ID NO: 860519 - RNA, 21 nt, Mycobacterium avium subsp. paratuberculosis
cgaucauggucggcgacgccg

SEQ ID NO: 860520 - RNA, 22 nt, Mycobacterium avium subsp. paratuberculosis
cgaucauggucggcgacgccgu

SEQ ID NO: 860521 - RNA, 15 nt, Mycobacterium avium subsp. paratuberculosis
cgauccacagcgcga

SEQ ID NO: 860522 - RNA, 20 nt, Mycobacterium avium subsp. paratuberculosis
cgaucccguagccguagauc

SEQ ID NO: 860523 - RNA, 17 nt, Mycobacterium avium subsp. paratuberculosis
cgauccgcaccggacgc

SEQ ID NO: 860524 - RNA, 14 nt, Mycobacterium avium subsp. paratuberculosis
cgauccgcagccgc

SEQ ID NO: 860525 - RNA, 20 nt, Mycobacterium avium subsp. paratuberculosis
cgauccgcaggccgucgccg

SEQ ID NO: 860526 - RNA, 13 nt, Mycobacterium avium subsp. paratuberculosis
cgauccgcgccgc

SEQ ID NO: 860527 - RNA, 15 nt, Mycobacterium avium subsp. paratuberculosis
cgauccgcgccgccg

SEQ ID NO: 860528 - RNA, 16 nt, Mycobacterium avium subsp. paratuberculosis
cgauccgcgccgccgc

SEQ ID NO: 860529 - RNA, 18 nt, Mycobacterium avium subsp. paratuberculosis
cgauccgcgccgccgcca

SEQ ID NO: 860530 - RNA, 20 nt, Mycobacterium avium subsp. paratuberculosis
cgauccgcgccgccgccagc

SEQ ID NO: 860531 - RNA, 14 nt, Mycobacterium avium subsp. paratuberculosis
cgauccgcgccgcg

SEQ ID NO: 860532 - RNA, 15 nt, Mycobacterium avium subsp. paratuberculosis
cgauccgcgccgcga

SEQ ID NO: 860533 - RNA, 13 nt, Mycobacterium avium subsp. paratuberculosis
cgaucccggccag

SEQ ID NO: 860534 - RNA, 19 nt, Mycobacterium avium subsp. paratuberculosis
cgaucccggccagcacccg

SEQ ID NO: 860535 - RNA, 14 nt, Mycobacterium avium subsp. paratuberculosis
cgaucccgccgccc

SEQ ID NO: 860536 - RNA, 14 nt, Mycobacterium avium subsp. paratuberculosis
cgaucccgccggcg

SEQ ID NO: 860537 - RNA, 17 nt, Mycobacterium avium subsp. paratuberculosis
cgaucccgccggcgauc

SEQ ID NO: 860538 - RNA, 21 nt, Mycobacterium avium subsp. paratuberculosis
cgaucccggcgagcacgccgc

SEQ ID NO: 860539 - RNA, 14 nt, Mycobacterium avium subsp. paratuberculosis
cgaucccgggccgu

SEQ ID NO: 860540 - RNA, 19 nt, Mycobacterium avium subsp. paratuberculosis
cgaucccgggccguucagc

SEQ ID NO: 860541 - RNA, 18 nt, Mycobacterium avium subsp. paratuberculosis
cgaucccgggugcgaugg

SEQ ID NO: 860542 - RNA, 15 nt, Mycobacterium avium subsp. paratuberculosis
cgaucccgucggcca

SEQ ID NO: 860543 - RNA, 22 nt, Mycobacterium avium subsp. paratuberculosis
cgaucccgucggccaucagccg

SEQ ID NO: 860544 - RNA, 14 nt, Mycobacterium avium subsp. paratuberculosis
cgaucccgucgucg

SEQ ID NO: 860545 - RNA, 16 nt, Mycobacterium avium subsp. paratuberculosis
cgaucccgucgucggc

SEQ ID NO: 860546 - RNA, 17 nt, Mycobacterium avium subsp. paratuberculosis
cgaucccgucgucggcg

SEQ ID NO: 860547 - RNA, 15 nt, Mycobacterium avium subsp. paratuberculosis
cgauccgcgcggcca

SEQ ID NO: 860548 - RNA, 18 nt, Mycobacterium avium subsp. paratuberculosis
cgauccgcgcggccacca

SEQ ID NO: 860549 - RNA, 21 nt, Mycobacterium avium subsp. paratuberculosis
cgauccgcgcggccaccagcg

SEQ ID NO: 860550 - RNA, 23 nt, Mycobacterium avium subsp. paratuberculosis
cgauccgcgcggccaccagcgcg

SEQ ID NO: 860551 - RNA, 15 nt, Mycobacterium avium subsp. paratuberculosis
cgauccgcgcggcga

SEQ ID NO: 860552 - RNA, 17 nt, Mycobacterium avium subsp. paratuberculosis
cgauccgccggcgaagc

SEQ ID NO: 860553 - RNA, 14 nt, Mycobacterium avium subsp. paratuberculosis
cgauccgccggugc

SEQ ID NO: 860554 - RNA, 15 nt, Mycobacterium avium subsp. paratuberculosis
cgauccgcgggccgg

SEQ ID NO: 860555 - RNA, 18 nt, Mycobacterium avium subsp. paratuberculosis
cgauccgcgggccggcac

SEQ ID NO: 860556 - RNA, 17 nt, Mycobacterium avium subsp. paratuberculosis
cgauccggcgcccgaug

SEQ ID NO: 860557 - RNA, 13 nt, Mycobacterium avium subsp. paratuberculosis
cgauccggccggc

SEQ ID NO: 860558 - RNA, 17 nt, Mycobacterium avium subsp. paratuberculosis
cgauccggccggcggcg

SEQ ID NO: 860559 - RNA, 18 nt, Mycobacterium avium subsp. paratuberculosis
cgauccggccggcggcgg

SEQ ID NO: 860560 - RNA, 18 nt, Mycobacterium avium subsp. paratuberculosis
cgauccgggcacgcagcg

SEQ ID NO: 860561 - RNA, 14 nt, Mycobacterium avium subsp. paratuberculosis
cgauccgggcaugg

SEQ ID NO: 860562 - RNA, 13 nt, Mycobacterium avium subsp. paratuberculosis
cgauccgggccgg

SEQ ID NO: 860563 - RNA, 14 nt, Mycobacterium avium subsp. paratuberculosis
cgauccgggccggu

SEQ ID NO: 860564 - RNA, 12 nt, Mycobacterium avium subsp. paratuberculosis
cgauccgggcgc

SEQ ID NO: 860565 - RNA, 13 nt, Mycobacterium avium subsp. paratuberculosis
cgauccgggcgcc

SEQ ID NO: 860566 - RNA, 16 nt, Mycobacterium avium subsp. paratuberculosis
cgauccgggcgccggc

SEQ ID NO: 860567 - RNA, 17 nt, Mycobacterium avium subsp. paratuberculosis
cgauccgggcgccggcc

SEQ ID NO: 860568 - RNA, 22 nt, Mycobacterium avium subsp. paratuberculosis
cgauccgggcgccggccggcgc

SEQ ID NO: 860569 - RNA, 22 nt, Mycobacterium avium subsp. paratuberculosis
cgauccggcgucucagucggcc

SEQ ID NO: 860570 - RNA, 20 nt, Mycobacterium avium subsp. paratuberculosis
cgauccgguagaagaccacc

SEQ ID NO: 860571 - RNA, 16 nt, Mycobacterium avium subsp. paratuberculosis
cgauccgguccagccc

SEQ ID NO: 860572 - RNA, 21 nt, Mycobacterium avium subsp. paratuberculosis
cgauccgguccagcccggugu

SEQ ID NO: 860573 - RNA, 15 nt, Mycobacterium avium subsp. paratuberculosis
cgauccggucgauga

SEQ ID NO: 860574 - RNA, 22 nt, Mycobacterium avium subsp. paratuberculosis
cgaacaggcgcaacagcaccuc

SEQ ID NO: 860575 - RNA, 21 nt, Mycobacterium avium subsp. paratuberculosis
cgaacagguuugagcgugccg

SEQ ID NO: 860576 - RNA, 18 nt, Mycobacterium avium subsp. paratuberculosis
cgaacagggcgacggcgg

SEQ ID NO: 860577 - RNA, 19 nt, Mycobacterium avium subsp. paratuberculosis
cgaacagggcgacggcggc

SEQ ID NO: 860578 - RNA, 21 nt, Mycobacterium avium subsp. paratuberculosis
cgaacagggcgacggcggcga

SEQ ID NO: 860579 - RNA, 17 nt, Mycobacterium avium subsp. paratuberculosis
cgaacagggcggcgggc

SEQ ID NO: 860580 - RNA, 19 nt, Mycobacterium avium subsp. paratuberculosis
cgaacagggcggcgggccc

SEQ ID NO: 860581 - RNA, 20 nt, Mycobacterium avium subsp. paratuberculosis
cgaacagggcggcgggcccg

SEQ ID NO: 860582 - RNA, 12 nt, Mycobacterium avium subsp. paratuberculosis
cgaacagcgggc

SEQ ID NO: 860583 - RNA, 14 nt, Mycobacterium avium subsp. paratuberculosis
cgaacagcggggug

SEQ ID NO: 860584 - RNA, 14 nt, Mycobacterium avium subsp. paratuberculosis
cgaacagcgccgac

SEQ ID NO: 860585 - RNA, 18 nt, Mycobacterium avium subsp. paratuberculosis
cgaacagcgcgcccgacg

SEQ ID NO: 860586 - RNA, 15 nt, Mycobacterium avium subsp. paratuberculosis
cgaacagcgcggcca

SEQ ID NO: 860587 - RNA, 17 nt, Mycobacterium avium subsp. paratuberculosis
cgaacagcgcggccacc

SEQ ID NO: 860588 - RNA, 18 nt, Mycobacterium avium subsp. paratuberculosis
cgaacaggaugcggguga

SEQ ID NO: 860589 - RNA, 17 nt, Mycobacterium avium subsp. paratuberculosis
cgaacagcucgaccagc

SEQ ID NO: 860590 - RNA, 17 nt, Mycobacterium avium subsp. paratuberculosis
cgaacagcuugccgauc

SEQ ID NO: 860591 - RNA, 12 nt, Mycobacterium avium subsp. paratuberculosis
cgaacagcacgc

SEQ ID NO: 860592 - RNA, 16 nt, Mycobacterium avium subsp. paratuberculosis
cgaacagcacgccggc

SEQ ID NO: 860593 - RNA, 19 nt, Mycobacterium avium subsp. paratuberculosis
cgaacagcacgccggccgg

SEQ ID NO: 860594 - RNA, 14 nt, Mycobacterium avium subsp. paratuberculosis
cgaacacgccgucg

SEQ ID NO: 860595 - RNA, 23 nt, Mycobacterium avium subsp. paratuberculosis
cgaacacgcgaugaucagcucgc

SEQ ID NO: 860596 - RNA, 21 nt, Mycobacterium avium subsp. paratuberculosis
cgaacacguugcgcaucagcg

SEQ ID NO: 860597 - RNA, 15 nt, Mycobacterium avium subsp. paratuberculosis
cgaacagcagcgcgc

SEQ ID NO: 860598 - RNA, 20 nt, Mycobacterium avium subsp. paratuberculosis
cgaacagcagcgcgccgacc

SEQ ID NO: 860599 - RNA, 24 nt, Mycobacterium avium subsp. paratuberculosis
cgaacagcgacgucugcggcucgg

SEQ ID NO: 860600 - RNA, 16 nt, Mycobacterium avium subsp. paratuberculosis
cgaacagccgggccgc

SEQ ID NO: 860601 - RNA, 19 nt, Mycobacterium avium subsp. paratuberculosis
cgaacagccgggccgcccg

SEQ ID NO: 860602 - RNA, 22 nt, Mycobacterium avium subsp. paratuberculosis
cgaacagccgggccgcccgcgc

SEQ ID NO: 860603 - RNA, 23 nt, Mycobacterium avium subsp. paratuberculosis
cgaacagccgggccgcccgcgcg

SEQ ID NO: 860604 - RNA, 17 nt, Mycobacterium avium subsp. paratuberculosis
cgaacagccgggcggcc

SEQ ID NO: 860605 - RNA, 20 nt, Mycobacterium avium subsp. paratuberculosis
cgaacagccgggcggccggg

SEQ ID NO: 860606 - RNA, 13 nt, Mycobacterium avium subsp. paratuberculosis
cgaacagccgguc

SEQ ID NO: 860607 - RNA, 15 nt, Mycobacterium avium subsp. paratuberculosis
cgaacacggccgccu

SEQ ID NO: 860608 - RNA, 18 nt, Mycobacterium avium subsp. paratuberculosis
cgaacacggccgccucca

SEQ ID NO: 860609 - RNA, 17 nt, Mycobacterium avium subsp. paratuberculosis
cgaacacguacagcggc

SEQ ID NO: 860610 - RNA, 18 nt, Mycobacterium avium subsp. paratuberculosis
cgaacacguacagcggcg

SEQ ID NO: 860611 - RNA, 14 nt, Mycobacterium avium subsp. paratuberculosis
cgaacacgucggcc

SEQ ID NO: 860612 - RNA, 21 nt, Mycobacterium avium subsp. paratuberculosis
cgaacacgucggccagcgcgu

SEQ ID NO: 860613 - RNA, 14 nt, Mycobacterium avium subsp. paratuberculosis
cgaacaccucggcg

SEQ ID NO: 860614 - RNA, 16 nt, Mycobacterium avium subsp. paratuberculosis
cgaacaccucggcgau

SEQ ID NO: 860615 - RNA, 12 nt, Mycobacterium avium subsp. paratuberculosis
cgaacaccugcg

SEQ ID NO: 860616 - RNA, 18 nt, Mycobacterium avium subsp. paratuberculosis
cgaacaccugcggcggca

SEQ ID NO: 860617 - RNA, 18 nt, Mycobacterium avium subsp. paratuberculosis
cgaacaccgugccgucac

SEQ ID NO: 860618 - RNA, 12 nt, Mycobacterium avium subsp. paratuberculosis
cgaacaccucgg

SEQ ID NO: 860619 - RNA, 16 nt, Mycobacterium avium subsp. paratuberculosis
cgaacaccggcgcgac

SEQ ID NO: 860620 - RNA, 17 nt, Mycobacterium avium subsp. paratuberculosis
cgaacaccggcgcgacc

SEQ ID NO: 860621 - RNA, 18 nt, Mycobacterium avium subsp. paratuberculosis
cgaacaccggcgcgacca

SEQ ID NO: 860622 - RNA, 13 nt, Mycobacterium avium subsp. paratuberculosis
cgaacaccggcgg

SEQ ID NO: 860623 - RNA, 14 nt, Mycobacterium avium subsp. paratuberculosis
cgaacaccggcgga

SEQ ID NO: 860624 - RNA, 19 nt, Mycobacterium avium subsp. paratuberculosis
cgaaaugccuuggcggcgu

SEQ ID NO: 860625 - RNA, 20 nt, Mycobacterium avium subsp. paratuberculosis
cgaaaugccuuggcggcgug

SEQ ID NO: 860626 - RNA, 19 nt, Mycobacterium avium subsp. paratuberculosis
cgaacaacagggccgcgcg

SEQ ID NO: 860627 - RNA, 17 nt, Mycobacterium avium subsp. paratuberculosis
cgaacaacgcggugacc

SEQ ID NO: 860628 - RNA, 19 nt, Mycobacterium avium subsp. paratuberculosis
cgaacaacgcggugaccgc

SEQ ID NO: 860629 - RNA, 20 nt, Mycobacterium avium subsp. paratuberculosis
cgaacaacgcggugaccgcg

SEQ ID NO: 860630 - RNA, 23 nt, Mycobacterium avium subsp. paratuberculosis
cgaacaacgcggugaccgcggcc

SEQ ID NO: 860631 - RNA, 18 nt, Mycobacterium avium subsp. paratuberculosis
cgaacaacggcggaccgg

SEQ ID NO: 860632 - RNA, 21 nt, Mycobacterium avium subsp. paratuberculosis
cgaacaacggcggaccggcgg

SEQ ID NO: 860633 - RNA, 23 nt, Mycobacterium avium subsp. paratuberculosis
cgaacaacggcggaccggcggcc

SEQ ID NO: 860634 - RNA, 23 nt, Mycobacterium avium subsp. paratuberculosis
cgaacaacugaccgauggccgcc

SEQ ID NO: 860635 - RNA, 20 nt, Mycobacterium avium subsp. paratuberculosis
cgaacaaucgcugcgagccc

SEQ ID NO: 860636 - RNA, 22 nt, Mycobacterium avium subsp. paratuberculosis
cgaacaauuccucugcgcgcca

SEQ ID NO: 860637 - RNA, 16 nt, Mycobacterium avium subsp. paratuberculosis
cgaacaccgcaccggu

SEQ ID NO: 860638 - RNA, 15 nt, Mycobacterium avium subsp. paratuberculosis
cgaacaccggcagcg

SEQ ID NO: 860639 - RNA, 17 nt, Mycobacterium avium subsp. paratuberculosis
cgaacaccggcagcgcc

SEQ ID NO: 860640 - RNA, 18 nt, Mycobacterium avium subsp. paratuberculosis
cgaacaccggcagcgcca

SEQ ID NO: 860641 - RNA, 21 nt, Mycobacterium avium subsp. paratuberculosis
cgaacaccggcagcgccacca

SEQ ID NO: 860642 - RNA, 23 nt, Mycobacterium avium subsp. paratuberculosis
cgaacaccaccggcaaccgccac

SEQ ID NO: 860643 - RNA, 19 nt, Mycobacterium avium subsp. paratuberculosis
cgaacaccacguagccgac

SEQ ID NO: 860644 - RNA, 13 nt, Mycobacterium avium subsp. paratuberculosis
cgaacaccagcac

SEQ ID NO: 860645 - RNA, 14 nt, Mycobacterium avium subsp. paratuberculosis
cgaacaccagcacc

SEQ ID NO: 860646 - RNA, 15 nt, Mycobacterium avium subsp. paratuberculosis
cgaacaccagcaccc

SEQ ID NO: 860647 - RNA, 19 nt, Mycobacterium avium subsp. paratuberculosis
cgaacaccagcccggccga

SEQ ID NO: 860648 - RNA, 15 nt, Mycobacterium avium subsp. paratuberculosis
cgaaauaaccgcgcg

SEQ ID NO: 860649 - RNA, 21 nt, Mycobacterium avium subsp. paratuberculosis
cgaaauaaccgcgcggcgccc

SEQ ID NO: 860650 - RNA, 20 nt, Mycobacterium avium subsp. paratuberculosis
cgaaagugcaacugccgacg

SEQ ID NO: 860651 - RNA, 18 nt, Mycobacterium avium subsp. paratuberculosis
cgaaauacgacgagccga

SEQ ID NO: 860652 - RNA, 20 nt, Mycobacterium avium subsp. paratuberculosis
cgaaaucgucgggccggauc

SEQ ID NO: 860653 - RNA, 13 nt, Mycobacterium avium subsp. paratuberculosis
cgaaaugaccgcg

SEQ ID NO: 860654 - RNA, 15 nt, Mycobacterium avium subsp. paratuberculosis
cgaaaugaccgcgcc

SEQ ID NO: 860655 - RNA, 18 nt, Mycobacterium avium subsp. paratuberculosis
cgaaaugcaucagcguga

SEQ ID NO: 860656 - RNA, 17 nt, Mycobacterium avium subsp. paratuberculosis
cgaaaucggugaagccg

SEQ ID NO: 860657 - RNA, 20 nt, Mycobacterium avium subsp. paratuberculosis
cgaaaucggugaagccgacg

SEQ ID NO: 860658 - RNA, 17 nt, Mycobacterium avium subsp. paratuberculosis
cgaaccguucgucgucg

SEQ ID NO: 860659 - RNA, 17 nt, Mycobacterium avium subsp. paratuberculosis
cgaaccgguugcgggcc

SEQ ID NO: 860660 - RNA, 17 nt, Mycobacterium avium subsp. paratuberculosis
cgaaccgcucgaacacc

SEQ ID NO: 860661 - RNA, 21 nt, Mycobacterium avium subsp. paratuberculosis
cgaaccgcucgaacacccggc

SEQ ID NO: 860662 - RNA, 16 nt, Mycobacterium avium subsp. paratuberculosis
cgaaccgcucgucggg

SEQ ID NO: 860663 - RNA, 20 nt, Mycobacterium avium subsp. paratuberculosis
cgaaccgcuugcccagcccc

SEQ ID NO: 860664 - RNA, 18 nt, Mycobacterium avium subsp. paratuberculosis
cgaaccgcgagcgcgcgg

SEQ ID NO: 860665 - RNA, 17 nt, Mycobacterium avium subsp. paratuberculosis
cgaaccggaucaugucg

SEQ ID NO: 860666 - RNA, 21 nt, Mycobacterium avium subsp. paratuberculosis
cgaaccgggacagccgcgccg

SEQ ID NO: 860667 - RNA, 17 nt, Mycobacterium avium subsp. paratuberculosis
cgaaccgggccaggaug

SEQ ID NO: 860668 - RNA, 21 nt, Mycobacterium avium subsp. paratuberculosis
cgaaccgggccaggaugaccg

SEQ ID NO: 860669 - RNA, 13 nt, Mycobacterium avium subsp. paratuberculosis
cgaaccgggcgcg

SEQ ID NO: 860670 - RNA, 16 nt, Mycobacterium avium subsp. paratuberculosis
cgaaccgggcgcgcag

SEQ ID NO: 860671 - RNA, 15 nt, Mycobacterium avium subsp. paratuberculosis
cgaaccgggcgguga

SEQ ID NO: 860672 - RNA, 12 nt, Mycobacterium avium subsp. paratuberculosis
cgaaccggggca

SEQ ID NO: 860673 - RNA, 16 nt, Mycobacterium avium subsp. paratuberculosis
cgaaccggggccgcac

SEQ ID NO: 860674 - RNA, 15 nt, Mycobacterium avium subsp. paratuberculosis
cgaacgccgaggugc

SEQ ID NO: 860675 - RNA, 15 nt, Mycobacterium avium subsp. paratuberculosis
cgaacgcccggucga

SEQ ID NO: 860676 - RNA, 16 nt, Mycobacterium avium subsp. paratuberculosis
cgaacgcccgcaccac

SEQ ID NO: 860677 - RNA, 15 nt, Mycobacterium avium subsp. paratuberculosis
cgaacgccagcagcu

SEQ ID NO: 860678 - RNA, 17 nt, Mycobacterium avium subsp. paratuberculosis
cgaacgccagcgccgca

SEQ ID NO: 860679 - RNA, 18 nt, Mycobacterium avium subsp. paratuberculosis
cgaacgccaccacggcgu

SEQ ID NO: 860680 - RNA, 12 nt, Mycobacterium avium subsp. paratuberculosis
cgaacgccaccu

SEQ ID NO: 860681 - RNA, 14 nt, Mycobacterium avium subsp. paratuberculosis
cgaacgccaccuuc

SEQ ID NO: 860682 - RNA, 19 nt, Mycobacterium avium subsp. paratuberculosis
cgaacgccaccuucaccgc

SEQ ID NO: 860683 - RNA, 21 nt, Mycobacterium avium subsp. paratuberculosis
cgaacgccaccuucaccgcgc

SEQ ID NO: 860684 - RNA, 23 nt, Mycobacterium avium subsp. paratuberculosis
cgaacgccaccuucaccgcgccg

SEQ ID NO: 860685 - RNA, 23 nt, Mycobacterium avium subsp. paratuberculosis
cgaacgcaacagggccaccgcgu

SEQ ID NO: 860686 - RNA, 17 nt, Mycobacterium avium subsp. paratuberculosis
cgaacgcaccaccgcgg

SEQ ID NO: 860687 - RNA, 14 nt, Mycobacterium avium subsp. paratuberculosis
cgaaccucgcggcg

SEQ ID NO: 860688 - RNA, 15 nt, Mycobacterium avium subsp. paratuberculosis
cgaaccucgcggcgg

SEQ ID NO: 860689 - RNA, 15 nt, Mycobacterium avium subsp. paratuberculosis
cgaacgacgucgagg

SEQ ID NO: 860690 - RNA, 16 nt, Mycobacterium avium subsp. paratuberculosis
cgaacgacgucgaggu

SEQ ID NO: 860691 - RNA, 20 nt, Mycobacterium avium subsp. paratuberculosis
cgaacgacguguucaacgcg

SEQ ID NO: 860692 - RNA, 13 nt, Mycobacterium avium subsp. paratuberculosis
cgaacgaccgggu

SEQ ID NO: 860693 - RNA, 14 nt, Mycobacterium avium subsp. paratuberculosis
cgaacgacgagccg

SEQ ID NO: 860694 - RNA, 14 nt, Mycobacterium avium subsp. paratuberculosis
cgaacgacgcggca

SEQ ID NO: 860695 - RNA, 15 nt, Mycobacterium avium subsp. paratuberculosis
cgaacgacgcggcac

SEQ ID NO: 860696 - RNA, 16 nt, Mycobacterium avium subsp. paratuberculosis
cgaacgacgcggcacg

SEQ ID NO: 860697 - RNA, 22 nt, Mycobacterium avium subsp. paratuberculosis
cgaacgacgcggcacgccgcuc

SEQ ID NO: 860698 - RNA, 17 nt, Mycobacterium avium subsp. paratuberculosis
cgaacgagaaggcggcg

SEQ ID NO: 860699 - RNA, 18 nt, Mycobacterium avium subsp. paratuberculosis
cgaacgagaaggcggcgu

SEQ ID NO: 860700 - RNA, 19 nt, Mycobacterium avium subsp. paratuberculosis
cgaacgagaaggcggcguc

SEQ ID NO: 860701 - RNA, 16 nt, Mycobacterium avium subsp. paratuberculosis
cgaacgaguugccccg

SEQ ID NO: 860702 - RNA, 15 nt, Mycobacterium avium subsp. paratuberculosis
cgaacgauggugugc

SEQ ID NO: 860703 - RNA, 18 nt, Mycobacterium avium subsp. paratuberculosis
cgaacaucacccggcggc

SEQ ID NO: 860704 - RNA, 19 nt, Mycobacterium avium subsp. paratuberculosis
cgaacaucacccggcggca

SEQ ID NO: 860705 - RNA, 12 nt, Mycobacterium avium subsp. paratuberculosis
cgaacaucagcc

SEQ ID NO: 860706 - RNA, 19 nt, Mycobacterium avium subsp. paratuberculosis
cgaacaucgagcccaccgc

SEQ ID NO: 860707 - RNA, 23 nt, Mycobacterium avium subsp. paratuberculosis
cgaacaucgagcccaccgcgccc

SEQ ID NO: 860708 - RNA, 14 nt, Mycobacterium avium subsp. paratuberculosis
cgaacauggcggcc

SEQ ID NO: 860709 - RNA, 15 nt, Mycobacterium avium subsp. paratuberculosis
cgaacauggcggcca

SEQ ID NO: 860710 - RNA, 16 nt, Mycobacterium avium subsp. paratuberculosis
cgaacauggcggccag

SEQ ID NO: 860711 - RNA, 17 nt, Mycobacterium avium subsp. paratuberculosis
cgaacauggucgcccac

SEQ ID NO: 860712 - RNA, 17 nt, Mycobacterium avium subsp. paratuberculosis
cgaacaucgccucggcc

SEQ ID NO: 860713 - RNA, 18 nt, Mycobacterium avium subsp. paratuberculosis
cgaacaucgccucggccg

SEQ ID NO: 860714 - RNA, 17 nt, Mycobacterium avium subsp. paratuberculosis
cgaacaugcugccgccg

SEQ ID NO: 860715 - RNA, 21 nt, Mycobacterium avium subsp. paratuberculosis
cgaacaugcugccgccggcga

SEQ ID NO: 860716 - RNA, 23 nt, Mycobacterium avium subsp. paratuberculosis
cgaacaugcugccgccggcgaau

SEQ ID NO: 860717 - RNA, 16 nt, Mycobacterium avium subsp. paratuberculosis
cgaaccagaucggcgg

SEQ ID NO: 860718 - RNA, 17 nt, Mycobacterium avium subsp. paratuberculosis
cgaaccagcaugcgcca

SEQ ID NO: 860719 - RNA, 14 nt, Mycobacterium avium subsp. paratuberculosis
cgaaccacgcggcg

SEQ ID NO: 860720 - RNA, 20 nt, Mycobacterium avium subsp. paratuberculosis
cgaaccacgcggcggcggug

SEQ ID NO: 860721 - RNA, 22 nt, Mycobacterium avium subsp. paratuberculosis
cgaacaugguggucgaacuggc

SEQ ID NO: 860722 - RNA, 15 nt, Mycobacterium avium subsp. paratuberculosis
cgaaccaguucgcca

SEQ ID NO: 860723 - RNA, 13 nt, Mycobacterium avium subsp. paratuberculosis
cgaaccagcgccc

SEQ ID NO: 860724 - RNA, 18 nt, Mycobacterium avium subsp. paratuberculosis
cgaaccagcgcccgcuug

SEQ ID NO: 860725 - RNA, 15 nt, Mycobacterium avium subsp. paratuberculosis
cgaaccauucguggc

SEQ ID NO: 860726 - RNA, 15 nt, Mycobacterium avium subsp. paratuberculosis
cgaacccaccagcgc

SEQ ID NO: 860727 - RNA, 17 nt, Mycobacterium avium subsp. paratuberculosis
cgaacccaccagcgccu

SEQ ID NO: 860728 - RNA, 13 nt, Mycobacterium avium subsp. paratuberculosis
cgaacccagcgcc

SEQ ID NO: 860729 - RNA, 14 nt, Mycobacterium avium subsp. paratuberculosis
cgaacccagcgccu

SEQ ID NO: 860730 - RNA, 16 nt, Mycobacterium avium subsp. paratuberculosis
cgaacccagcgccucg

SEQ ID NO: 860731 - RNA, 21 nt, Mycobacterium avium subsp. paratuberculosis
cgaacccgaaaagcaccaggc

SEQ ID NO: 860732 - RNA, 17 nt, Mycobacterium avium subsp. paratuberculosis
cgaacccgccagggcga

SEQ ID NO: 860733 - RNA, 14 nt, Mycobacterium avium subsp. paratuberculosis
cgaacccgcccucg

SEQ ID NO: 860734 - RNA, 23 nt, Mycobacterium avium subsp. paratuberculosis
cgaacccgcccucgccccggaug

SEQ ID NO: 860735 - RNA, 14 nt, Mycobacterium avium subsp. paratuberculosis
cgaacccgccgcgg

SEQ ID NO: 860736 - RNA, 18 nt, Mycobacterium avium subsp. paratuberculosis
cgaacccgccgcggccga

SEQ ID NO: 860737 - RNA, 18 nt, Mycobacterium avium subsp. paratuberculosis
cgaacccggccagcgucu

SEQ ID NO: 860738 - RNA, 13 nt, Mycobacterium avium subsp. paratuberculosis
cgaacccggcgcc

SEQ ID NO: 860739 - RNA, 17 nt, Mycobacterium avium subsp. paratuberculosis
cgaacccggcgcccggc

SEQ ID NO: 860740 - RNA, 21 nt, Mycobacterium avium subsp. paratuberculosis
cgaacccggcgcccggccggu

SEQ ID NO: 860741 - RNA, 12 nt, Mycobacterium avium subsp. paratuberculosis
cgaacccggcgg

SEQ ID NO: 860742 - RNA, 12 nt, Mycobacterium avium subsp. paratuberculosis
cgaacccgggcg

SEQ ID NO: 860743 - RNA, 13 nt, Mycobacterium avium subsp. paratuberculosis
cgaacccgggcgc

SEQ ID NO: 860744 - RNA, 20 nt, Mycobacterium avium subsp. paratuberculosis
cgaacccgggcgcgcccacc

SEQ ID NO: 860745 - RNA, 12 nt, Mycobacterium avium subsp. paratuberculosis
cgaaccgcggcg

SEQ ID NO: 860746 - RNA, 13 nt, Mycobacterium avium subsp. paratuberculosis
cgaaccgcggcgg

SEQ ID NO: 860747 - RNA, 15 nt, Mycobacterium avium subsp. paratuberculosis
cgaaccgcggcggca

SEQ ID NO: 860748 - RNA, 17 nt, Mycobacterium avium subsp. paratuberculosis
cgaaccgaucaccggca

SEQ ID NO: 860749 - RNA, 18 nt, Mycobacterium avium subsp. paratuberculosis
cgaaccgaucaccggcag

SEQ ID NO: 860750 - RNA, 20 nt, Mycobacterium avium subsp. paratuberculosis
cgaaccgaucaccggcagca

SEQ ID NO: 860751 - RNA, 15 nt, Mycobacterium avium subsp. paratuberculosis
cgaaccgccccgcgc

SEQ ID NO: 860752 - RNA, 16 nt, Mycobacterium avium subsp. paratuberculosis
cgaaccgccccgcgcg

SEQ ID NO: 860753 - RNA, 17 nt, Mycobacterium avium subsp. paratuberculosis
cgaaccgccccgcgcga

SEQ ID NO: 860754 - RNA, 14 nt, Mycobacterium avium subsp. paratuberculosis
cgaaccgccgcacc

SEQ ID NO: 860755 - RNA, 16 nt, Mycobacterium avium subsp. paratuberculosis
cgaaccgccgcaccca

SEQ ID NO: 860756 - RNA, 21 nt, Mycobacterium avium subsp. paratuberculosis
cgaaccgccgcacccagcggg

SEQ ID NO: 860757 - RNA, 16 nt, Mycobacterium avium subsp. paratuberculosis
cgaauauuucgccgau

SEQ ID NO: 860758 - RNA, 18 nt, Mycobacterium avium subsp. paratuberculosis
cgaaucguugagcaccac

SEQ ID NO: 860759 - RNA, 20 nt, Mycobacterium avium subsp. paratuberculosis
cgaaucguugagcaccacga

SEQ ID NO: 860760 - RNA, 15 nt, Mycobacterium avium subsp. paratuberculosis
cgaaucugucgaugg

SEQ ID NO: 860761 - RNA, 14 nt, Mycobacterium avium subsp. paratuberculosis
cgaaucggucgacc

SEQ ID NO: 860762 - RNA, 16 nt, Mycobacterium avium subsp. paratuberculosis
cgaaucgucggcgaug

SEQ ID NO: 860763 - RNA, 17 nt, Mycobacterium avium subsp. paratuberculosis
cgaaucgucggcgaugg

SEQ ID NO: 860764 - RNA, 16 nt, Mycobacterium avium subsp. paratuberculosis
cgaaguuggcgucggg

SEQ ID NO: 860765 - RNA, 21 nt, Mycobacterium avium subsp. paratuberculosis
cgaaguugcgguugacguccg

SEQ ID NO: 860766 - RNA, 19 nt, Mycobacterium avium subsp. paratuberculosis
cgaauacaccugccgcaca

SEQ ID NO: 860767 - RNA, 17 nt, Mycobacterium avium subsp. paratuberculosis
cgaauacccuccgggcg

SEQ ID NO: 860768 - RNA, 18 nt, Mycobacterium avium subsp. paratuberculosis
cgaauacccuccgggcgg

SEQ ID NO: 860769 - RNA, 18 nt, Mycobacterium avium subsp. paratuberculosis
cgaauacccuucggccgg

SEQ ID NO: 860770 - RNA, 23 nt, Mycobacterium avium subsp. paratuberculosis
cgaauacccuucggccggcagcg

SEQ ID NO: 860771 - RNA, 17 nt, Mycobacterium avium subsp. paratuberculosis
cgaaguuccagccgauc

SEQ ID NO: 860772 - RNA, 23 nt, Mycobacterium avium subsp. paratuberculosis
cgaagugcucgaacgcgccgauc

SEQ ID NO: 860773 - RNA, 13 nt, Mycobacterium avium subsp. paratuberculosis
cgaagugcucgag

SEQ ID NO: 860774 - RNA, 22 nt, Mycobacterium avium subsp. paratuberculosis
cgaagugcucgagcacaucggc

SEQ ID NO: 860775 - RNA, 22 nt, Mycobacterium avium subsp. paratuberculosis
cgaaguggacaugcagccgccg

SEQ ID NO: 860776 - RNA, 18 nt, Mycobacterium avium subsp. paratuberculosis
cgaaguucgacacgguga

SEQ ID NO: 860777 - RNA, 15 nt, Mycobacterium avium subsp. paratuberculosis
cgaaguucggcaucc

SEQ ID NO: 860778 - RNA, 15 nt, Mycobacterium avium subsp. paratuberculosis
cgaaguucggcaucu

SEQ ID NO: 860779 - RNA, 17 nt, Mycobacterium avium subsp. paratuberculosis
cgaaguagagccgcugc

SEQ ID NO: 860780 - RNA, 22 nt, Mycobacterium avium subsp. paratuberculosis
cgaaguagagccgcugcacgcg

SEQ ID NO: 860781 - RNA, 14 nt, Mycobacterium avium subsp. paratuberculosis
cgaagugcccggcg

SEQ ID NO: 860782 - RNA, 17 nt, Mycobacterium avium subsp. paratuberculosis
cgaagugcccggcgccg

SEQ ID NO: 860783 - RNA, 18 nt, Mycobacterium avium subsp. paratuberculosis
cgaagugcccggcgccgg

SEQ ID NO: 860784 - RNA, 15 nt, Mycobacterium avium subsp. paratuberculosis
cgaagcuggcgaaca

SEQ ID NO: 860785 - RNA, 18 nt, Mycobacterium avium subsp. paratuberculosis
cgaagcuggcgaacagca

SEQ ID NO: 860786 - RNA, 15 nt, Mycobacterium avium subsp. paratuberculosis
cgaagcugagguggc

SEQ ID NO: 860787 - RNA, 17 nt, Mycobacterium avium subsp. paratuberculosis
cgaaggugaucuuguug

SEQ ID NO: 860788 - RNA, 15 nt, Mycobacterium avium subsp. paratuberculosis
cgaagcugucgccga

SEQ ID NO: 860789 - RNA, 16 nt, Mycobacterium avium subsp. paratuberculosis
cgaaggugcccgcauc

SEQ ID NO: 860790 - RNA, 14 nt, Mycobacterium avium subsp. paratuberculosis
cgaaggugccgcga

SEQ ID NO: 860791 - RNA, 13 nt, Mycobacterium avium subsp. paratuberculosis
cgaagguggcacg

SEQ ID NO: 860792 - RNA, 12 nt, Mycobacterium avium subsp. paratuberculosis
cgaagguggugg

SEQ ID NO: 860793 - RNA, 23 nt, Mycobacterium avium subsp. paratuberculosis
cgaaggugguggcguuggcgauc

SEQ ID NO: 860794 - RNA, 14 nt, Mycobacterium avium subsp. paratuberculosis
cgaagguggcgccg

SEQ ID NO: 860795 - RNA, 16 nt, Mycobacterium avium subsp. paratuberculosis
cgaagguggcgccggu

SEQ ID NO: 860796 - RNA, 16 nt, Mycobacterium avium subsp. paratuberculosis
cgaaggugggcagcgc

SEQ ID NO: 860797 - RNA, 20 nt, Mycobacterium avium subsp. paratuberculosis
cgaaggugggcagcgccacc

SEQ ID NO: 860798 - RNA, 21 nt, Mycobacterium avium subsp. paratuberculosis
cgaaggugggcagcgccacca

SEQ ID NO: 860799 - RNA, 12 nt, Mycobacterium avium subsp. paratuberculosis
cgaaguacgccg

SEQ ID NO: 860800 - RNA, 23 nt, Mycobacterium avium subsp. paratuberculosis
cgaagguguccucgagcugcacg

SEQ ID NO: 860801 - RNA, 16 nt, Mycobacterium avium subsp. paratuberculosis
cgaagcucaucaccgg

SEQ ID NO: 860802 - RNA, 15 nt, Mycobacterium avium subsp. paratuberculosis
cgaagcggucgcgga

SEQ ID NO: 860803 - RNA, 17 nt, Mycobacterium avium subsp. paratuberculosis
cgaagcggugcaccacc

SEQ ID NO: 860804 - RNA, 18 nt, Mycobacterium avium subsp. paratuberculosis
cgaagcggugcaccaccg

SEQ ID NO: 860805 - RNA, 15 nt, Mycobacterium avium subsp. paratuberculosis
cgaagcgaggcgcca

SEQ ID NO: 860806 - RNA, 21 nt, Mycobacterium avium subsp. paratuberculosis
cgaagcgggacugcagcgcgg

SEQ ID NO: 860807 - RNA, 15 nt, Mycobacterium avium subsp. paratuberculosis
cgaagcgggcggcga

SEQ ID NO: 860808 - RNA, 18 nt, Mycobacterium avium subsp. paratuberculosis
cgaagcgggcggcgaaca

SEQ ID NO: 860809 - RNA, 15 nt, Mycobacterium avium subsp. paratuberculosis
cgaagccggugccca

SEQ ID NO: 860810 - RNA, 16 nt, Mycobacterium avium subsp. paratuberculosis
cgaagccguccaggcc

SEQ ID NO: 860811 - RNA, 20 nt, Mycobacterium avium subsp. paratuberculosis
cgaagccguccaggccgcug

SEQ ID NO: 860812 - RNA, 21 nt, Mycobacterium avium subsp. paratuberculosis
cgaagccguccaggccgcuga

SEQ ID NO: 860813 - RNA, 21 nt, Mycobacterium avium subsp. paratuberculosis
cgaagccgugacccgccguga

SEQ ID NO: 860814 - RNA, 20 nt, Mycobacterium avium subsp. paratuberculosis
cgaagccguggcaggcacga

SEQ ID NO: 860815 - RNA, 15 nt, Mycobacterium avium subsp. paratuberculosis
cgaacgggugcggcg

SEQ ID NO: 860816 - RNA, 12 nt, Mycobacterium avium subsp. paratuberculosis
cgaacgggccgg

SEQ ID NO: 860817 - RNA, 17 nt, Mycobacterium avium subsp. paratuberculosis
cgaacgggccgggcacc

SEQ ID NO: 860818 - RNA, 18 nt, Mycobacterium avium subsp. paratuberculosis
cgaacgggccgggcaccg

SEQ ID NO: 860819 - RNA, 20 nt, Mycobacterium avium subsp. paratuberculosis
cgaacgguucgggaaccugg

SEQ ID NO: 860820 - RNA, 21 nt, Mycobacterium avium subsp. paratuberculosis
cgaacgguucgggaaccuggc

SEQ ID NO: 860821 - RNA, 23 nt, Mycobacterium avium subsp. paratuberculosis
cgaacgguucgggaaccuggccg

SEQ ID NO: 860822 - RNA, 13 nt, Mycobacterium avium subsp. paratuberculosis
cgaacuccgcgcg

SEQ ID NO: 860823 - RNA, 21 nt, Mycobacterium avium subsp. paratuberculosis
cgaacuccgcgcgcggcacgg

SEQ ID NO: 860824 - RNA, 21 nt, Mycobacterium avium subsp. paratuberculosis
cgaacggguaggugcccgggu

SEQ ID NO: 860825 - RNA, 19 nt, Mycobacterium avium subsp. paratuberculosis
cgaacggguccuugccggc

SEQ ID NO: 860826 - RNA, 23 nt, Mycobacterium avium subsp. paratuberculosis
cgaacggguccuugccggcggcg

SEQ ID NO: 860827 - RNA, 19 nt, Mycobacterium avium subsp. paratuberculosis
cgaacgggucgagggucgc

SEQ ID NO: 860828 - RNA, 15 nt, Mycobacterium avium subsp. paratuberculosis
cgaacgggucggcga

SEQ ID NO: 860829 - RNA, 15 nt, Mycobacterium avium subsp. paratuberculosis
cgaacggccgcgaug

SEQ ID NO: 860830 - RNA, 16 nt, Mycobacterium avium subsp. paratuberculosis
cgaacggcccgccgcc

SEQ ID NO: 860831 - RNA, 17 nt, Mycobacterium avium subsp. paratuberculosis
cgaacggcccgccgccg

SEQ ID NO: 860832 - RNA, 22 nt, Mycobacterium avium subsp. paratuberculosis
cgaacggccaguccaggccgcc

SEQ ID NO: 860833 - RNA, 21 nt, Mycobacterium avium subsp. paratuberculosis
cgaacggcaaccugggcggcg

SEQ ID NO: 860834 - RNA, 22 nt, Mycobacterium avium subsp. paratuberculosis
cgaacggcaaccugggcggcgg

SEQ ID NO: 860835 - RNA, 20 nt, Mycobacterium avium subsp. paratuberculosis
cgaacggcaacggcggcggc

SEQ ID NO: 860836 - RNA, 13 nt, Mycobacterium avium subsp. paratuberculosis
cgaacggcaccuc

SEQ ID NO: 860837 - RNA, 15 nt, Mycobacterium avium subsp. paratuberculosis
cgaacggcaccucga

SEQ ID NO: 860838 - RNA, 20 nt, Mycobacterium avium subsp. paratuberculosis
cgaacggcaccucgaucacc

SEQ ID NO: 860839 - RNA, 12 nt, Mycobacterium avium subsp. paratuberculosis
cgaacggcgcga

SEQ ID NO: 860840 - RNA, 18 nt, Mycobacterium avium subsp. paratuberculosis
cgaacggcgcgaaccggg

SEQ ID NO: 860841 - RNA, 18 nt, Mycobacterium avium subsp. paratuberculosis
cgaacggcgcucccgaug

SEQ ID NO: 860842 - RNA, 22 nt, Mycobacterium avium subsp. paratuberculosis
cgaacggcggaaccgggccgcu

SEQ ID NO: 860843 - RNA, 17 nt, Mycobacterium avium subsp. paratuberculosis
cgaacggcggauccagg

SEQ ID NO: 860844 - RNA, 23 nt, Mycobacterium avium subsp. paratuberculosis
cgaacggcggauccagguggggc

SEQ ID NO: 860845 - RNA, 18 nt, Mycobacterium avium subsp. paratuberculosis
cgaacggcgucuggccgg

SEQ ID NO: 860846 - RNA, 23 nt, Mycobacterium avium subsp. paratuberculosis
cgaacggcgucuggccggagcgg

SEQ ID NO: 860847 - RNA, 15 nt, Mycobacterium avium subsp. paratuberculosis
cgaacgcugccaggc

SEQ ID NO: 860848 - RNA, 16 nt, Mycobacterium avium subsp. paratuberculosis
cgaacgcuuccagcac

SEQ ID NO: 860849 - RNA, 16 nt, Mycobacterium avium subsp. paratuberculosis
cgaacgcguucgucgg

SEQ ID NO: 860850 - RNA, 18 nt, Mycobacterium avium subsp. paratuberculosis
cgaacgcguucgucggcg

SEQ ID NO: 860851 - RNA, 21 nt, Mycobacterium avium subsp. paratuberculosis
cgaacgcguucgucggcgcgu

SEQ ID NO: 860852 - RNA, 23 nt, Mycobacterium avium subsp. paratuberculosis
cgaacgcguucgucggcgcgucg

SEQ ID NO: 860853 - RNA, 16 nt, Mycobacterium avium subsp. paratuberculosis
cgaacgcggcugauca

SEQ ID NO: 860854 - RNA, 14 nt, Mycobacterium avium subsp. paratuberculosis
cgaacgcggugagc

SEQ ID NO: 860855 - RNA, 23 nt, Mycobacterium avium subsp. paratuberculosis
cgaacgcguacacggcccgcggc

SEQ ID NO: 860856 - RNA, 14 nt, Mycobacterium avium subsp. paratuberculosis
cgaacgcgucccgg

SEQ ID NO: 860857 - RNA, 16 nt, Mycobacterium avium subsp. paratuberculosis
cgaacgcgucccgggc

SEQ ID NO: 860858 - RNA, 17 nt, Mycobacterium avium subsp. paratuberculosis
cgaacgcgucccgggcc

SEQ ID NO: 860859 - RNA, 13 nt, Mycobacterium avium subsp. paratuberculosis
cgaacgcgucguc

SEQ ID NO: 860860 - RNA, 13 nt, Mycobacterium avium subsp. paratuberculosis
cgaacgcggccag

SEQ ID NO: 860861 - RNA, 17 nt, Mycobacterium avium subsp. paratuberculosis
cgaacgcggccagcggg

SEQ ID NO: 860862 - RNA, 18 nt, Mycobacterium avium subsp. paratuberculosis
cgaacgcggccagcgggc

SEQ ID NO: 860863 - RNA, 12 nt, Mycobacterium avium subsp. paratuberculosis
cgaacgcggccg

SEQ ID NO: 860864 - RNA, 15 nt, Mycobacterium avium subsp. paratuberculosis
cgaacgcggccgcca

SEQ ID NO: 860865 - RNA, 18 nt, Mycobacterium avium subsp. paratuberculosis
cgaacgcggccgccaucg

SEQ ID NO: 860866 - RNA, 21 nt, Mycobacterium avium subsp. paratuberculosis
cgaacgcggccgccaucgauc

SEQ ID NO: 860867 - RNA, 16 nt, Mycobacterium avium subsp. paratuberculosis
cgaacgcggcgaagca

SEQ ID NO: 860868 - RNA, 18 nt, Mycobacterium avium subsp. paratuberculosis
cgaacgcggcgaagcagg

SEQ ID NO: 860869 - RNA, 12 nt, Mycobacterium avium subsp. paratuberculosis
cgaacgcggcgc

SEQ ID NO: 860870 - RNA, 15 nt, Mycobacterium avium subsp. paratuberculosis
cgaacgcggcgccga

SEQ ID NO: 860871 - RNA, 17 nt, Mycobacterium avium subsp. paratuberculosis
cgaacgcggcgccgacg

SEQ ID NO: 860872 - RNA, 20 nt, Mycobacterium avium subsp. paratuberculosis
cgaacgcggcggaggccugc

SEQ ID NO: 860873 - RNA, 23 nt, Mycobacterium avium subsp. paratuberculosis
cgaacgcggcggaggccugcgcg

SEQ ID NO: 860874 - RNA, 20 nt, Mycobacterium avium subsp. paratuberculosis
cgaacgcgccggugaccccg

SEQ ID NO: 860875 - RNA, 14 nt, Mycobacterium avium subsp. paratuberculosis
cgaacgcgcggucg

SEQ ID NO: 860876 - RNA, 14 nt, Mycobacterium avium subsp. paratuberculosis
cgaacgcgcugucg

SEQ ID NO: 860877 - RNA, 14 nt, Mycobacterium avium subsp. paratuberculosis
cgaacgcgccgauc

SEQ ID NO: 860878 - RNA, 15 nt, Mycobacterium avium subsp. paratuberculosis
cgaacgcgccgaucg

SEQ ID NO: 860879 - RNA, 12 nt, Mycobacterium avium subsp. paratuberculosis
cgaacgcgaccu

SEQ ID NO: 860880 - RNA, 14 nt, Mycobacterium avium subsp. paratuberculosis
cgaacgccucggcg

SEQ ID NO: 860881 - RNA, 15 nt, Mycobacterium avium subsp. paratuberculosis
cgaacgccucggcga

SEQ ID NO: 860882 - RNA, 13 nt, Mycobacterium avium subsp. paratuberculosis
cgaacgccgccgu

SEQ ID NO: 860883 - RNA, 15 nt, Mycobacterium avium subsp. paratuberculosis
cgaacugcaccagca

SEQ ID NO: 860884 - RNA, 16 nt, Mycobacterium avium subsp. paratuberculosis
cgaacugcaccagcac

SEQ ID NO: 860885 - RNA, 17 nt, Mycobacterium avium subsp. paratuberculosis
cgaacugcaccagcacg

SEQ ID NO: 860886 - RNA, 17 nt, Mycobacterium avium subsp. paratuberculosis
cgaacucggcgccgccg

SEQ ID NO: 860887 - RNA, 14 nt, Mycobacterium avium subsp. paratuberculosis
cgaacucgucgacg

SEQ ID NO: 860888 - RNA, 21 nt, Mycobacterium avium subsp. paratuberculosis
cgaacucgucgacgcccaccu

SEQ ID NO: 860889 - RNA, 14 nt, Mycobacterium avium subsp. paratuberculosis
cgaacucgucgaug

SEQ ID NO: 860890 - RNA, 21 nt, Mycobacterium avium subsp. paratuberculosis
cgaacucgucgaugcacgccg

SEQ ID NO: 860891 - RNA, 18 nt, Mycobacterium avium subsp. paratuberculosis
cgaacucguuggcguggc

SEQ ID NO: 860892 - RNA, 13 nt, Mycobacterium avium subsp. paratuberculosis
cgaacucgcggcg

SEQ ID NO: 860893 - RNA, 16 nt, Mycobacterium avium subsp. paratuberculosis
cgaacucgcggcgggu

SEQ ID NO: 860894 - RNA, 18 nt, Mycobacterium avium subsp. paratuberculosis
cgaacucgcggcggguca

SEQ ID NO: 860895 - RNA, 17 nt, Mycobacterium avium subsp. paratuberculosis
cgaacgggucggcgacc

SEQ ID NO: 860896 - RNA, 21 nt, Mycobacterium avium subsp. paratuberculosis
cgaacgggugaccggcggcca

SEQ ID NO: 860897 - RNA, 23 nt, Mycobacterium avium subsp. paratuberculosis
cgaacgggugaccggcggccagc

SEQ ID NO: 860898 - RNA, 17 nt, Mycobacterium avium subsp. paratuberculosis
cgaacucgaugggggug

SEQ ID NO: 860899 - RNA, 21 nt, Mycobacterium avium subsp. paratuberculosis
cgaacucgaugggggugccgc

SEQ ID NO: 860900 - RNA, 19 nt, Mycobacterium avium subsp. paratuberculosis
cgaacuccugcucgcgggc

SEQ ID NO: 860901 - RNA, 18 nt, Mycobacterium avium subsp. paratuberculosis
cgaacuccuugacccggc

SEQ ID NO: 860902 - RNA, 20 nt, Mycobacterium avium subsp. paratuberculosis
cgaagaaguauucgccgucg

SEQ ID NO: 860903 - RNA, 21 nt, Mycobacterium avium subsp. paratuberculosis
cgaagaaguauucgccgucgu

SEQ ID NO: 860904 - RNA, 23 nt, Mycobacterium avium subsp. paratuberculosis
cgaagaaguauucgccgucgugg

SEQ ID NO: 860905 - RNA, 14 nt, Mycobacterium avium subsp. paratuberculosis
cgaagaagcggccg

SEQ ID NO: 860906 - RNA, 15 nt, Mycobacterium avium subsp. paratuberculosis
cgaagaagcggccga

SEQ ID NO: 860907 - RNA, 20 nt, Mycobacterium avium subsp. paratuberculosis
cgaagaacuugucgucgucg

SEQ ID NO: 860908 - RNA, 21 nt, Mycobacterium avium subsp. paratuberculosis
cgaagaagagggcgugacgcc

SEQ ID NO: 860909 - RNA, 22 nt, Mycobacterium avium subsp. paratuberculosis
cgaagaagauguugcggcggcc

SEQ ID NO: 860910 - RNA, 18 nt, Mycobacterium avium subsp. paratuberculosis
cgaacugcagccggccaa

SEQ ID NO: 860911 - RNA, 21 nt, Mycobacterium avium subsp. paratuberculosis
cgaagaaccgcaacaccagca

SEQ ID NO: 860912 - RNA, 17 nt, Mycobacterium avium subsp. paratuberculosis
cgaagaacgacuggcgg

SEQ ID NO: 860913 - RNA, 16 nt, Mycobacterium avium subsp. paratuberculosis
cgaagaacucagccga

SEQ ID NO: 860914 - RNA, 13 nt, Mycobacterium avium subsp. paratuberculosis
cgaagacccgaaa

SEQ ID NO: 860915 - RNA, 14 nt, Mycobacterium avium subsp. paratuberculosis
cgaagacccgaaac

SEQ ID NO: 860916 - RNA, 20 nt, Mycobacterium avium subsp. paratuberculosis
cgaagaccagcgugucgccg

SEQ ID NO: 860917 - RNA, 18 nt, Mycobacterium avium subsp. paratuberculosis
cgaagcccaagugcccgc

SEQ ID NO: 860918 - RNA, 18 nt, Mycobacterium avium subsp. paratuberculosis
cgaagcccgagcgucacg

SEQ ID NO: 860919 - RNA, 15 nt, Mycobacterium avium subsp. paratuberculosis
cgaagcccgccguca

SEQ ID NO: 860920 - RNA, 23 nt, Mycobacterium avium subsp. paratuberculosis
cgaagccggccccgcccggggcg

SEQ ID NO: 860921 - RNA, 13 nt, Mycobacterium avium subsp. paratuberculosis
cgaagccggcgca

SEQ ID NO: 860922 - RNA, 20 nt, Mycobacterium avium subsp. paratuberculosis
cgaagccgccguccccgcgc

SEQ ID NO: 860923 - RNA, 20 nt, Mycobacterium avium subsp. paratuberculosis
cgaagccgaucaccggcgcg

SEQ ID NO: 860924 - RNA, 15 nt, Mycobacterium avium subsp. paratuberculosis
cgaagccgaucgcgg

SEQ ID NO: 860925 - RNA, 17 nt, Mycobacterium avium subsp. paratuberculosis
cgaagccgaucgcggcg

SEQ ID NO: 860926 - RNA, 18 nt, Mycobacterium avium subsp. paratuberculosis
cgaagccgaucgcggcga

SEQ ID NO: 860927 - RNA, 14 nt, Mycobacterium avium subsp. paratuberculosis
cgaagccgacgucc

SEQ ID NO: 860928 - RNA, 17 nt, Mycobacterium avium subsp. paratuberculosis
cgaagccgacgucgacc

SEQ ID NO: 860929 - RNA, 18 nt, Mycobacterium avium subsp. paratuberculosis
cgaagccgacgucgacca

SEQ ID NO: 860930 - RNA, 21 nt, Mycobacterium avium subsp. paratuberculosis
cgaaaagcccgccgccucacc

SEQ ID NO: 860931 - RNA, 20 nt, Mycobacterium avium subsp. paratuberculosis
cgaaaacgccugcgccgccg

SEQ ID NO: 860932 - RNA, 22 nt, Mycobacterium avium subsp. paratuberculosis
cgaaaauaccgccggccgcgcg

SEQ ID NO: 860933 - RNA, 20 nt, Mycobacterium avium subsp. paratuberculosis
ccuuugccgugcucggcggc

SEQ ID NO: 860934 - RNA, 18 nt, Mycobacterium avium subsp. paratuberculosis
cgaaacccccgggaugcc

SEQ ID NO: 860935 - RNA, 17 nt, Mycobacterium avium subsp. paratuberculosis
cgaaacccggcggacgg

SEQ ID NO: 860936 - RNA, 20 nt, Mycobacterium avium subsp. paratuberculosis
cgaaacccguugccaacacc

SEQ ID NO: 860937 - RNA, 14 nt, Mycobacterium avium subsp. paratuberculosis
cgaaaccgucgacc

SEQ ID NO: 860938 - RNA, 18 nt, Mycobacterium avium subsp. paratuberculosis
cgaaaccgucuccggcgc

SEQ ID NO: 860939 - RNA, 23 nt, Mycobacterium avium subsp. paratuberculosis
cgaaaccguggaagucgccgucc

SEQ ID NO: 860940 - RNA, 17 nt, Mycobacterium avium subsp. paratuberculosis
cgaaaccgcguggcgca

SEQ ID NO: 860941 - RNA, 23 nt, Mycobacterium avium subsp. paratuberculosis
cgaaacgccgcgcucgugcugcu

SEQ ID NO: 860942 - RNA, 16 nt, Mycobacterium avium subsp. paratuberculosis
cgaaacgcaacagcga

SEQ ID NO: 860943 - RNA, 17 nt, Mycobacterium avium subsp. paratuberculosis
cgaaagccuccaaccca

SEQ ID NO: 860944 - RNA, 19 nt, Mycobacterium avium subsp. paratuberculosis
cgaaagccuccgcgaucag

SEQ ID NO: 860945 - RNA, 18 nt, Mycobacterium avium subsp. paratuberculosis
cgaaagcccaggcccggc

SEQ ID NO: 860946 - RNA, 14 nt, Mycobacterium avium subsp. paratuberculosis
cgaaagccgacacc

SEQ ID NO: 860947 - RNA, 20 nt, Mycobacterium avium subsp. paratuberculosis
cgaaagccacccgcgccucc

SEQ ID NO: 860948 - RNA, 18 nt, Mycobacterium avium subsp. paratuberculosis
cgaaacggugcccgcagc

SEQ ID NO: 860949 - RNA, 17 nt, Mycobacterium avium subsp. paratuberculosis
cgaaacggcugcugcgc

SEQ ID NO: 860950 - RNA, 20 nt, Mycobacterium avium subsp. paratuberculosis
cgaaacggcugcugcgcggc

SEQ ID NO: 860951 - RNA, 21 nt, Mycobacterium avium subsp. paratuberculosis
cgaaacuuguggaaggcgccg

SEQ ID NO: 860952 - RNA, 20 nt, Mycobacterium avium subsp. paratuberculosis
cgaaacucguugccagccgg

SEQ ID NO: 860953 - RNA, 18 nt, Mycobacterium avium subsp. paratuberculosis
ccuuggugucggcgagcu

SEQ ID NO: 860954 - RNA, 16 nt, Mycobacterium avium subsp. paratuberculosis
ccuugucgggccgcgg

SEQ ID NO: 860955 - RNA, 19 nt, Mycobacterium avium subsp. paratuberculosis
ccuuguggcccaggccggc

SEQ ID NO: 860956 - RNA, 14 nt, Mycobacterium avium subsp. paratuberculosis
ccuugucaccgaac

SEQ ID NO: 860957 - RNA, 14 nt, Mycobacterium avium subsp. paratuberculosis
ccuugguggccgcg

SEQ ID NO: 860958 - RNA, 17 nt, Mycobacterium avium subsp. paratuberculosis
ccuugguggccgcggcc

SEQ ID NO: 860959 - RNA, 19 nt, Mycobacterium avium subsp. paratuberculosis
ccuugguggccgcggccgc

SEQ ID NO: 860960 - RNA, 16 nt, Mycobacterium avium subsp. paratuberculosis
ccuugucgcuggcgua

SEQ ID NO: 860961 - RNA, 22 nt, Mycobacterium avium subsp. paratuberculosis
ccuugucgcuggcguacgccau

SEQ ID NO: 860962 - RNA, 18 nt, Mycobacterium avium subsp. paratuberculosis
ccuuguccaggauccccg

SEQ ID NO: 860963 - RNA, 18 nt, Mycobacterium avium subsp. paratuberculosis
ccuuggucagcucccggc

SEQ ID NO: 860964 - RNA, 15 nt, Mycobacterium avium subsp. paratuberculosis
ccuuggugacggccu

SEQ ID NO: 860965 - RNA, 16 nt, Mycobacterium avium subsp. paratuberculosis
ccuuggugacggccuc

SEQ ID NO: 860966 - RNA, 11 nt, Mycobacterium avium subsp. paratuberculosis
ccuuggucgcg

SEQ ID NO: 860967 - RNA, 14 nt, Mycobacterium avium subsp. paratuberculosis
ccuuggucgcggcc

SEQ ID NO: 860968 - RNA, 14 nt, Mycobacterium avium subsp. paratuberculosis
ccuuggcggcggcc

SEQ ID NO: 860969 - RNA, 17 nt, Mycobacterium avium subsp. paratuberculosis
ccuugcugauccccagc

SEQ ID NO: 860970 - RNA, 17 nt, Mycobacterium avium subsp. paratuberculosis
ccuugcugcccagggcg

SEQ ID NO: 860971 - RNA, 16 nt, Mycobacterium avium subsp. paratuberculosis
ccuuggacaccugcag

SEQ ID NO: 860972 - RNA, 16 nt, Mycobacterium avium subsp. paratuberculosis
ccuugcggccgccgau

SEQ ID NO: 860973 - RNA, 14 nt, Mycobacterium avium subsp. paratuberculosis
ccuugcggccggcg

SEQ ID NO: 860974 - RNA, 17 nt, Mycobacterium avium subsp. paratuberculosis
ccuugcggccggcggcg

SEQ ID NO: 860975 - RNA, 17 nt, Mycobacterium avium subsp. paratuberculosis
ccuuggggcugaccucg

SEQ ID NO: 860976 - RNA, 18 nt, Mycobacterium avium subsp. paratuberculosis
ccuuggggcugaccucgc

SEQ ID NO: 860977 - RNA, 15 nt, Mycobacterium avium subsp. paratuberculosis
ccuuggcucgggcca

SEQ ID NO: 860978 - RNA, 15 nt, Mycobacterium avium subsp. paratuberculosis
ccuuggccaacgcgu

SEQ ID NO: 860979 - RNA, 14 nt, Mycobacterium avium subsp. paratuberculosis
ccuuggcgcccagc

SEQ ID NO: 860980 - RNA, 19 nt, Mycobacterium avium subsp. paratuberculosis
ccuuggcgcccagcguggu

SEQ ID NO: 860981 - RNA, 18 nt, Mycobacterium avium subsp. paratuberculosis
ccuuggcggcaagcccuu

SEQ ID NO: 860982 - RNA, 21 nt, Mycobacterium avium subsp. paratuberculosis
ccuuggcccgcgcggccgcca

SEQ ID NO: 860983 - RNA, 16 nt, Mycobacterium avium subsp. paratuberculosis
ccuugcggaugcgggc

SEQ ID NO: 860984 - RNA, 18 nt, Mycobacterium avium subsp. paratuberculosis
ccuugcggaugcgggcca

SEQ ID NO: 860985 - RNA, 16 nt, Mycobacterium avium subsp. paratuberculosis
ccuugcgcgccgcgac

SEQ ID NO: 860986 - RNA, 18 nt, Mycobacterium avium subsp. paratuberculosis
ccuugcgcccguagcggc

SEQ ID NO: 860987 - RNA, 18 nt, Mycobacterium avium subsp. paratuberculosis
ccuugcgcaccacgucgg

SEQ ID NO: 860988 - RNA, 21 nt, Mycobacterium avium subsp. paratuberculosis
ccuugcgcccacaguccgccc

SEQ ID NO: 860989 - RNA, 17 nt, Mycobacterium avium subsp. paratuberculosis
ccuugcgccccggcggg

SEQ ID NO: 860990 - RNA, 14 nt, Mycobacterium avium subsp. paratuberculosis
ccuugcgcagcacc

SEQ ID NO: 860991 - RNA, 15 nt, Mycobacterium avium subsp. paratuberculosis
ccuugcgcagcaccu

SEQ ID NO: 860992 - RNA, 22 nt, Mycobacterium avium subsp. paratuberculosis
ccuugcgcagcagcaggucggc

SEQ ID NO: 860993 - RNA, 14 nt, Mycobacterium avium subsp. paratuberculosis
ccuugccggcggcg

SEQ ID NO: 860994 - RNA, 15 nt, Mycobacterium avium subsp. paratuberculosis
ccuugcccggcucgg

SEQ ID NO: 860995 - RNA, 16 nt, Mycobacterium avium subsp. paratuberculosis
ccuugccgaugccggc

SEQ ID NO: 860996 - RNA, 16 nt, Mycobacterium avium subsp. paratuberculosis
ccuugcagcccgcuga

SEQ ID NO: 860997 - RNA, 16 nt, Mycobacterium avium subsp. paratuberculosis
ccuugaucuuggccug

SEQ ID NO: 860998 - RNA, 22 nt, Mycobacterium avium subsp. paratuberculosis
ccuugagcacggugaucagcag

SEQ ID NO: 860999 - RNA, 18 nt, Mycobacterium avium subsp. paratuberculosis
ccuugcccaacaacucgg

SEQ ID NO: 861000 - RNA, 19 nt, Mycobacterium avium subsp. paratuberculosis
ccuugcccggacgaugccg

SEQ ID NO: 861001 - RNA, 19 nt, Mycobacterium avium subsp. paratuberculosis
ccuucuccgccgggcugag

SEQ ID NO: 861002 - RNA, 21 nt, Mycobacterium avium subsp. paratuberculosis
ccuucguagauaagcggauug

SEQ ID NO: 861003 - RNA, 12 nt, Mycobacterium avium subsp. paratuberculosis
ccuucggccggc

SEQ ID NO: 861004 - RNA, 12 nt, Mycobacterium avium subsp. paratuberculosis
ccuucgggccga

SEQ ID NO: 861005 - RNA, 17 nt, Mycobacterium avium subsp. paratuberculosis
ccuugaacggcaccagc

SEQ ID NO: 861006 - RNA, 14 nt, Mycobacterium avium subsp. paratuberculosis
ccuugaccaccgag

SEQ ID NO: 861007 - RNA, 21 nt, Mycobacterium avium subsp. paratuberculosis
ccuugaccacggugcgcucgu

SEQ ID NO: 861008 - RNA, 12 nt, Mycobacterium avium subsp. paratuberculosis
ccuugaccagcu

SEQ ID NO: 861009 - RNA, 20 nt, Mycobacterium avium subsp. paratuberculosis
ccuucuugaacagcgccgga

SEQ ID NO: 861010 - RNA, 21 nt, Mycobacterium avium subsp. paratuberculosis
ccuucuugaacagcgccggac

SEQ ID NO: 861011 - RNA, 16 nt, Mycobacterium avium subsp. paratuberculosis
ccuucuugaccgcagc

SEQ ID NO: 861012 - RNA, 14 nt, Mycobacterium avium subsp. paratuberculosis
ccuucuuggccgcg

SEQ ID NO: 861013 - RNA, 15 nt, Mycobacterium avium subsp. paratuberculosis
ccuucuuggcggcgg

SEQ ID NO: 861014 - RNA, 19 nt, Mycobacterium avium subsp. paratuberculosis
ccuucuugggcucgcgggu

SEQ ID NO: 861015 - RNA, 17 nt, Mycobacterium avium subsp. paratuberculosis
ccuugagccgccgcggc

SEQ ID NO: 861016 - RNA, 22 nt, Mycobacterium avium subsp. paratuberculosis
ccuugagccgguccgacggcug

SEQ ID NO: 861017 - RNA, 15 nt, Mycobacterium avium subsp. paratuberculosis
ccuugagccggucgu

SEQ ID NO: 861018 - RNA, 14 nt, Mycobacterium avium subsp. paratuberculosis
ccuugagcucggcc

SEQ ID NO: 861019 - RNA, 20 nt, Mycobacterium avium subsp. paratuberculosis
ccuugacguacuggcgccgg

SEQ ID NO: 861020 - RNA, 13 nt, Mycobacterium avium subsp. paratuberculosis
ccuugagcaccgc

SEQ ID NO: 861021 - RNA, 20 nt, Mycobacterium avium subsp. paratuberculosis
ccuugacccggccgcacacc

SEQ ID NO: 861022 - RNA, 16 nt, Mycobacterium avium subsp. paratuberculosis
ccuucaucaccgcccc

SEQ ID NO: 861023 - RNA, 20 nt, Mycobacterium avium subsp. paratuberculosis
ccuucaucaccgccccgacg

SEQ ID NO: 861024 - RNA, 23 nt, Mycobacterium avium subsp. paratuberculosis
ccuucaucagcaccgcgaacauc

SEQ ID NO: 861025 - RNA, 14 nt, Mycobacterium avium subsp. paratuberculosis
ccuucaucgaucgg

SEQ ID NO: 861026 - RNA, 17 nt, Mycobacterium avium subsp. paratuberculosis
ccuucaucgccgucgcc

SEQ ID NO: 861027 - RNA, 15 nt, Mycobacterium avium subsp. paratuberculosis
ccuuccaucgacgcu

SEQ ID NO: 861028 - RNA, 18 nt, Mycobacterium avium subsp. paratuberculosis
ccuuccgaggccgcugac

SEQ ID NO: 861029 - RNA, 23 nt, Mycobacterium avium subsp. paratuberculosis
ccuuccacgaccuggcgggccag

SEQ ID NO: 861030 - RNA, 23 nt, Mycobacterium avium subsp. paratuberculosis
ccuucaccucggccuugccgcug

SEQ ID NO: 861031 - RNA, 14 nt, Mycobacterium avium subsp. paratuberculosis
ccuucagccagauc

SEQ ID NO: 861032 - RNA, 18 nt, Mycobacterium avium subsp. paratuberculosis
ccuuccggaacgacgcgu

SEQ ID NO: 861033 - RNA, 22 nt, Mycobacterium avium subsp. paratuberculosis
ccuucgaacgcgacgaagcggu

SEQ ID NO: 861034 - RNA, 16 nt, Mycobacterium avium subsp. paratuberculosis
ccuucgccucguucga

SEQ ID NO: 861035 - RNA, 14 nt, Mycobacterium avium subsp. paratuberculosis
ccuucgcgaucacg

SEQ ID NO: 861036 - RNA, 16 nt, Mycobacterium avium subsp. paratuberculosis
ccuucgcggucggcaa

SEQ ID NO: 861037 - RNA, 14 nt, Mycobacterium avium subsp. paratuberculosis
ccuguuugaacacc

SEQ ID NO: 861038 - RNA, 20 nt, Mycobacterium avium subsp. paratuberculosis
ccuguuugcaggcgaucucg

SEQ ID NO: 861039 - RNA, 15 nt, Mycobacterium avium subsp. paratuberculosis
ccuuagcccggccgc

SEQ ID NO: 861040 - RNA, 14 nt, Mycobacterium avium subsp. paratuberculosis
ccuucaccgcgccg

SEQ ID NO: 861041 - RNA, 16 nt, Mycobacterium avium subsp. paratuberculosis
ccuucacgaccggcag

SEQ ID NO: 861042 - RNA, 21 nt, Mycobacterium avium subsp. paratuberculosis
ccuucacgaccggcagcaccg

SEQ ID NO: 861043 - RNA, 13 nt, Mycobacterium avium subsp. paratuberculosis
ccuguuggcccug

SEQ ID NO: 861044 - RNA, 16 nt, Mycobacterium avium subsp. paratuberculosis
ccuguucgccgucgcg

SEQ ID NO: 861045 - RNA, 16 nt, Mycobacterium avium subsp. paratuberculosis
ccuguucgcgccggua

SEQ ID NO: 861046 - RNA, 18 nt, Mycobacterium avium subsp. paratuberculosis
ccugugguuuucgaaacc

SEQ ID NO: 861047 - RNA, 15 nt, Mycobacterium avium subsp. paratuberculosis
ccugugaggcaccga

SEQ ID NO: 861048 - RNA, 15 nt, Mycobacterium avium subsp. paratuberculosis
ccugugcgacggcgu

SEQ ID NO: 861049 - RNA, 17 nt, Mycobacterium avium subsp. paratuberculosis
ccugugcgacggcgucg

SEQ ID NO: 861050 - RNA, 21 nt, Mycobacterium avium subsp. paratuberculosis
ccugugcgccccacggcgcgu

SEQ ID NO: 861051 - RNA, 12 nt, Mycobacterium avium subsp. paratuberculosis
ccucgucggcga

SEQ ID NO: 861052 - RNA, 15 nt, Mycobacterium avium subsp. paratuberculosis
ccucgucggcgagca

SEQ ID NO: 861053 - RNA, 14 nt, Mycobacterium avium subsp. paratuberculosis
ccucgucggcgccg

SEQ ID NO: 861054 - RNA, 17 nt, Mycobacterium avium subsp. paratuberculosis
ccucgucggcggcgacg

SEQ ID NO: 861055 - RNA, 21 nt, Mycobacterium avium subsp. paratuberculosis
ccucgucggcggcgacggcga

SEQ ID NO: 861056 - RNA, 14 nt, Mycobacterium avium subsp. paratuberculosis
ccucgucggcgguc

SEQ ID NO: 861057 - RNA, 12 nt, Mycobacterium avium subsp. paratuberculosis
ccucgucgggaa

SEQ ID NO: 861058 - RNA, 16 nt, Mycobacterium avium subsp. paratuberculosis
ccucgucgggcgccag

SEQ ID NO: 861059 - RNA, 20 nt, Mycobacterium avium subsp. paratuberculosis
ccucgucgggcgccagcccg

SEQ ID NO: 861060 - RNA, 18 nt, Mycobacterium avium subsp. paratuberculosis
ccucgucgagcagcgccc

SEQ ID NO: 861061 - RNA, 21 nt, Mycobacterium avium subsp. paratuberculosis
ccucgucgagcagcgcccggc

SEQ ID NO: 861062 - RNA, 12 nt, Mycobacterium avium subsp. paratuberculosis
ccucgucgaucg

SEQ ID NO: 861063 - RNA, 18 nt, Mycobacterium avium subsp. paratuberculosis
ccucgucgaucgcggcga

SEQ ID NO: 861064 - RNA, 21 nt, Mycobacterium avium subsp. paratuberculosis
ccucgucgaucgcggcgaugg

SEQ ID NO: 861065 - RNA, 23 nt, Mycobacterium avium subsp. paratuberculosis
ccucgucgagccgggcccgggug

SEQ ID NO: 861066 - RNA, 19 nt, Mycobacterium avium subsp. paratuberculosis
ccucgucgaugucggcggc

SEQ ID NO: 861067 - RNA, 20 nt, Mycobacterium avium subsp. paratuberculosis
ccucgucgaugucggcggcc

SEQ ID NO: 861068 - RNA, 13 nt, Mycobacterium avium subsp. paratuberculosis
ccucgucgccauc

SEQ ID NO: 861069 - RNA, 15 nt, Mycobacterium avium subsp. paratuberculosis
ccucgucgccgucgg

SEQ ID NO: 861070 - RNA, 15 nt, Mycobacterium avium subsp. paratuberculosis
ccucgucggaggcgu

SEQ ID NO: 861071 - RNA, 23 nt, Mycobacterium avium subsp. paratuberculosis
ccucgucggaggcgucgacgcgc

SEQ ID NO: 861072 - RNA, 19 nt, Mycobacterium avium subsp. paratuberculosis
cgaauugcgcugcaccgca

SEQ ID NO: 861073 - RNA, 15 nt, Mycobacterium avium subsp. paratuberculosis
cgaauuguggcggcc

SEQ ID NO: 861074 - RNA, 22 nt, Mycobacterium avium subsp. paratuberculosis
cgaauuguucggccaccgcgcg

SEQ ID NO: 861075 - RNA, 13 nt, Mycobacterium avium subsp. paratuberculosis
cgaaugcagcggc

SEQ ID NO: 861076 - RNA, 18 nt, Mycobacterium avium subsp. paratuberculosis
cgaaugcagcggcuccga

SEQ ID NO: 861077 - RNA, 17 nt, Mycobacterium avium subsp. paratuberculosis
cgaaugagacgacccga

SEQ ID NO: 861078 - RNA, 15 nt, Mycobacterium avium subsp. paratuberculosis
cgacauaggucaggu

SEQ ID NO: 861079 - RNA, 22 nt, Mycobacterium avium subsp. paratuberculosis
cgacaacauccgcgacgacacc

SEQ ID NO: 861080 - RNA, 11 nt, Mycobacterium avium subsp. paratuberculosis
cgacaucgccg

SEQ ID NO: 861081 - RNA, 12 nt, Mycobacterium avium subsp. paratuberculosis
cgacaucgccga

SEQ ID NO: 861082 - RNA, 14 nt, Mycobacterium avium subsp. paratuberculosis
cgacaucgccgcgg

SEQ ID NO: 861083 - RNA, 16 nt, Mycobacterium avium subsp. paratuberculosis
cgacaucgccgcggcc

SEQ ID NO: 861084 - RNA, 19 nt, Mycobacterium avium subsp. paratuberculosis
cgacaucgccgcggccgga

SEQ ID NO: 861085 - RNA, 13 nt, Mycobacterium avium subsp. paratuberculosis
cgacaucgccggc

SEQ ID NO: 861086 - RNA, 14 nt, Mycobacterium avium subsp. paratuberculosis
cgacaucgccggcg

SEQ ID NO: 861087 - RNA, 16 nt, Mycobacterium avium subsp. paratuberculosis
cgacaucgccggcgac

SEQ ID NO: 861088 - RNA, 17 nt, Mycobacterium avium subsp. paratuberculosis
cgacaucgccggcgacc

SEQ ID NO: 861089 - RNA, 23 nt, Mycobacterium avium subsp. paratuberculosis
cgacaucgaaugcagcggcuccg

SEQ ID NO: 861090 - RNA, 18 nt, Mycobacterium avium subsp. paratuberculosis
cgacaucaccaccgccgg

SEQ ID NO: 861091 - RNA, 16 nt, Mycobacterium avium subsp. paratuberculosis
cgacaucaccgcgggc

SEQ ID NO: 861092 - RNA, 21 nt, Mycobacterium avium subsp. paratuberculosis
cgacaucaccgcgggcgcgcc

SEQ ID NO: 861093 - RNA, 22 nt, Mycobacterium avium subsp. paratuberculosis
cgacaucaccgcgggcgcgccg

SEQ ID NO: 861094 - RNA, 17 nt, Mycobacterium avium subsp. paratuberculosis
cgacaucagaucgccga

SEQ ID NO: 861095 - RNA, 19 nt, Mycobacterium avium subsp. paratuberculosis
cgacaucagaucgccgacg

SEQ ID NO: 861096 - RNA, 22 nt, Mycobacterium avium subsp. paratuberculosis
cgacaucaccaccgccggggug

SEQ ID NO: 861097 - RNA, 22 nt, Mycobacterium avium subsp. paratuberculosis
cgacauccagaugcccagcagg

SEQ ID NO: 861098 - RNA, 18 nt, Mycobacterium avium subsp. paratuberculosis
cgacauccaggaccgcgc

SEQ ID NO: 861099 - RNA, 20 nt, Mycobacterium avium subsp. paratuberculosis
cgacauccaggaccgcgcgc

SEQ ID NO: 861100 - RNA, 21 nt, Mycobacterium avium subsp. paratuberculosis
cgacauccaggaccgcgcgcc

SEQ ID NO: 861101 - RNA, 16 nt, Mycobacterium avium subsp. paratuberculosis
cgacaugucgccgggc

SEQ ID NO: 861102 - RNA, 15 nt, Mycobacterium avium subsp. paratuberculosis
cgacauuggccgcgc

SEQ ID NO: 861103 - RNA, 18 nt, Mycobacterium avium subsp. paratuberculosis
cgacauuggccgcgcgca

SEQ ID NO: 861104 - RNA, 17 nt, Mycobacterium avium subsp. paratuberculosis
cgacaugaccaccgcgu

SEQ ID NO: 861105 - RNA, 17 nt, Mycobacterium avium subsp. paratuberculosis
cgaccaaacgcagcguc

SEQ ID NO: 861106 - RNA, 21 nt, Mycobacterium avium subsp. paratuberculosis
cgaccaacacccccgcgcugc

SEQ ID NO: 861107 - RNA, 14 nt, Mycobacterium avium subsp. paratuberculosis
cgaccaaugcccug

SEQ ID NO: 861108 - RNA, 21 nt, Mycobacterium avium subsp. paratuberculosis
cgaccaaugcccugaccccgg

SEQ ID NO: 861109 - RNA, 17 nt, Mycobacterium avium subsp. paratuberculosis
cgaccaauugcgagcag

SEQ ID NO: 861110 - RNA, 14 nt, Mycobacterium avium subsp. paratuberculosis
cgaccaacgggcgg

SEQ ID NO: 861111 - RNA, 20 nt, Mycobacterium avium subsp. paratuberculosis
cgaccaacgggcggcggauc

SEQ ID NO: 861112 - RNA, 21 nt, Mycobacterium avium subsp. paratuberculosis
cgaccaacgggcggcggauca

SEQ ID NO: 861113 - RNA, 17 nt, Mycobacterium avium subsp. paratuberculosis
cgaccaacuccaccgcc

SEQ ID NO: 861114 - RNA, 23 nt, Mycobacterium avium subsp. paratuberculosis
cgaccaagacggugggcccgccg

SEQ ID NO: 861115 - RNA, 13 nt, Mycobacterium avium subsp. paratuberculosis
cgacaugcccgcg

SEQ ID NO: 861116 - RNA, 14 nt, Mycobacterium avium subsp. paratuberculosis
cgacaugcccggcg

SEQ ID NO: 861117 - RNA, 19 nt, Mycobacterium avium subsp. paratuberculosis
cgacaugcccggcgacggc

SEQ ID NO: 861118 - RNA, 22 nt, Mycobacterium avium subsp. paratuberculosis
cgacaugcccggcgacggcgcc

SEQ ID NO: 861119 - RNA, 13 nt, Mycobacterium avium subsp. paratuberculosis
cgacaugcugggc

SEQ ID NO: 861120 - RNA, 23 nt, Mycobacterium avium subsp. paratuberculosis
cgacaugcuguuccagacgucgg

SEQ ID NO: 861121 - RNA, 14 nt, Mycobacterium avium subsp. paratuberculosis
cgacauggacgcgg

SEQ ID NO: 861122 - RNA, 15 nt, Mycobacterium avium subsp. paratuberculosis
cgacauggacgcggc

SEQ ID NO: 861123 - RNA, 16 nt, Mycobacterium avium subsp. paratuberculosis
cgacauggacgcggcc

SEQ ID NO: 861124 - RNA, 16 nt, Mycobacterium avium subsp. paratuberculosis
cgacauggccagcacc

SEQ ID NO: 861125 - RNA, 17 nt, Mycobacterium avium subsp. paratuberculosis
cgacauggccagcacca

SEQ ID NO: 861126 - RNA, 17 nt, Mycobacterium avium subsp. paratuberculosis
cgacaugcgcagcgccc

SEQ ID NO: 861127 - RNA, 13 nt, Mycobacterium avium subsp. paratuberculosis
cgacaucgcggcg

SEQ ID NO: 861128 - RNA, 14 nt, Mycobacterium avium subsp. paratuberculosis
cgacaucgcggcga

SEQ ID NO: 861129 - RNA, 16 nt, Mycobacterium avium subsp. paratuberculosis
cgacaucgcggcgauc

SEQ ID NO: 861130 - RNA, 18 nt, Mycobacterium avium subsp. paratuberculosis
cgacaucgaugcgaucga

SEQ ID NO: 861131 - RNA, 15 nt, Mycobacterium avium subsp. paratuberculosis
cgacaucggccgccu

SEQ ID NO: 861132 - RNA, 19 nt, Mycobacterium avium subsp. paratuberculosis
cgacaucggccgccuugau

SEQ ID NO: 861133 - RNA, 13 nt, Mycobacterium avium subsp. paratuberculosis
cgacaucggcgcc

SEQ ID NO: 861134 - RNA, 15 nt, Mycobacterium avium subsp. paratuberculosis
cgacaucggcgccga

SEQ ID NO: 861135 - RNA, 17 nt, Mycobacterium avium subsp. paratuberculosis
cgacaucggcgccgacg

SEQ ID NO: 861136 - RNA, 19 nt, Mycobacterium avium subsp. paratuberculosis
cgacaucggugaccgucgc

SEQ ID NO: 861137 - RNA, 23 nt, Mycobacterium avium subsp. paratuberculosis
cgacaucggugaccgucgccgac

SEQ ID NO: 861138 - RNA, 19 nt, Mycobacterium avium subsp. paratuberculosis
cgacaucgccaucagcagc

SEQ ID NO: 861139 - RNA, 22 nt, Mycobacterium avium subsp. paratuberculosis
cgacaucgccaucagcagcgcc

SEQ ID NO: 861140 - RNA, 17 nt, Mycobacterium avium subsp. paratuberculosis
cgacaucucccggucga

SEQ ID NO: 861141 - RNA, 12 nt, Mycobacterium avium subsp. paratuberculosis
cgacaucucgac

SEQ ID NO: 861142 - RNA, 14 nt, Mycobacterium avium subsp. paratuberculosis
cgacaucucgguga

SEQ ID NO: 861143 - RNA, 14 nt, Mycobacterium avium subsp. paratuberculosis
cgacaucugccggg

SEQ ID NO: 861144 - RNA, 15 nt, Mycobacterium avium subsp. paratuberculosis
cgacaucugccgggc

SEQ ID NO: 861145 - RNA, 20 nt, Mycobacterium avium subsp. paratuberculosis
cgacaucugccgggcggcga

SEQ ID NO: 861146 - RNA, 20 nt, Mycobacterium avium subsp. paratuberculosis
cgaccaccucuucgcggucc

SEQ ID NO: 861147 - RNA, 20 nt, Mycobacterium avium subsp. paratuberculosis
cgaccagauaggccagcgcg

SEQ ID NO: 861148 - RNA, 21 nt, Mycobacterium avium subsp. paratuberculosis
cgaccagauaggccagcgcgu

SEQ ID NO: 861149 - RNA, 15 nt, Mycobacterium avium subsp. paratuberculosis
cgaccacggccccag

SEQ ID NO: 861150 - RNA, 14 nt, Mycobacterium avium subsp. paratuberculosis
cgaccacggccggu

SEQ ID NO: 861151 - RNA, 16 nt, Mycobacterium avium subsp. paratuberculosis
cgaccacggccggucc

SEQ ID NO: 861152 - RNA, 17 nt, Mycobacterium avium subsp. paratuberculosis
cgaccacggccgguccg

SEQ ID NO: 861153 - RNA, 23 nt, Mycobacterium avium subsp. paratuberculosis
cgaccacgaucgucuggccguug

SEQ ID NO: 861154 - RNA, 14 nt, Mycobacterium avium subsp. paratuberculosis
cgaccacgccgcgc

SEQ ID NO: 861155 - RNA, 15 nt, Mycobacterium avium subsp. paratuberculosis
cgaccacgccgcggu

SEQ ID NO: 861156 - RNA, 23 nt, Mycobacterium avium subsp. paratuberculosis
cgaccacgccgcggucgcugacc

SEQ ID NO: 861157 - RNA, 18 nt, Mycobacterium avium subsp. paratuberculosis
cgaccacgcacaccaccg

SEQ ID NO: 861158 - RNA, 19 nt, Mycobacterium avium subsp. paratuberculosis
cgaccacgcacaccaccga

SEQ ID NO: 861159 - RNA, 20 nt, Mycobacterium avium subsp. paratuberculosis
cgaccacgaacaccggcgcg

SEQ ID NO: 861160 - RNA, 19 nt, Mycobacterium avium subsp. paratuberculosis
cgaccacgaagggcgccag

SEQ ID NO: 861161 - RNA, 23 nt, Mycobacterium avium subsp. paratuberculosis
cgaccaccggguagcccgcgugc

SEQ ID NO: 861162 - RNA, 16 nt, Mycobacterium avium subsp. paratuberculosis
cgaccaccucggcgac

SEQ ID NO: 861163 - RNA, 21 nt, Mycobacterium avium subsp. paratuberculosis
cgaccaccaggagcaccugcg

SEQ ID NO: 861164 - RNA, 13 nt, Mycobacterium avium subsp. paratuberculosis
cgaccacccggcg

SEQ ID NO: 861165 - RNA, 14 nt, Mycobacterium avium subsp. paratuberculosis
cgaccacccggcgg

SEQ ID NO: 861166 - RNA, 15 nt, Mycobacterium avium subsp. paratuberculosis
cgaccacccgcuggu

SEQ ID NO: 861167 - RNA, 15 nt, Mycobacterium avium subsp. paratuberculosis
cgaccacccggacga

SEQ ID NO: 861168 - RNA, 20 nt, Mycobacterium avium subsp. paratuberculosis
cgaccacccgcagcucgccg

SEQ ID NO: 861169 - RNA, 23 nt, Mycobacterium avium subsp. paratuberculosis
cgaccacccgcagcucgccggug

SEQ ID NO: 861170 - RNA, 14 nt, Mycobacterium avium subsp. paratuberculosis
cgaccaccgccggc

SEQ ID NO: 861171 - RNA, 18 nt, Mycobacterium avium subsp. paratuberculosis
cgaccaccgccggcccgg

SEQ ID NO: 861172 - RNA, 17 nt, Mycobacterium avium subsp. paratuberculosis
cgaccaccucaccugcg

SEQ ID NO: 861173 - RNA, 19 nt, Mycobacterium avium subsp. paratuberculosis
cgaccaccucaccugcguu

SEQ ID NO: 861174 - RNA, 19 nt, Mycobacterium avium subsp. paratuberculosis
cgaccaccuccccgcggug

SEQ ID NO: 861175 - RNA, 20 nt, Mycobacterium avium subsp. paratuberculosis
cgaccaccuccccgcggugc

SEQ ID NO: 861176 - RNA, 21 nt, Mycobacterium avium subsp. paratuberculosis
cgaccaccuccccgcggugcc

SEQ ID NO: 861177 - RNA, 22 nt, Mycobacterium avium subsp. paratuberculosis
cgaccaccuccccgcggugccg

SEQ ID NO: 861178 - RNA, 14 nt, Mycobacterium avium subsp. paratuberculosis
cgaccaccucggcg

SEQ ID NO: 861179 - RNA, 17 nt, Mycobacterium avium subsp. paratuberculosis
cgaccacccccagcccg

SEQ ID NO: 861180 - RNA, 20 nt, Mycobacterium avium subsp. paratuberculosis
cgaccacccccagcccgccg

SEQ ID NO: 861181 - RNA, 21 nt, Mycobacterium avium subsp. paratuberculosis
cgaccacccccagcccgccgg

SEQ ID NO: 861182 - RNA, 22 nt, Mycobacterium avium subsp. paratuberculosis
cgaccacccccagcccgccggg

SEQ ID NO: 861183 - RNA, 16 nt, Mycobacterium avium subsp. paratuberculosis
cgaccaccagccgcag

SEQ ID NO: 861184 - RNA, 20 nt, Mycobacterium avium subsp. paratuberculosis
cgaccaccacgaccagugcc

SEQ ID NO: 861185 - RNA, 19 nt, Mycobacterium avium subsp. paratuberculosis
cgaccaccacggccgcagc

SEQ ID NO: 861186 - RNA, 22 nt, Mycobacterium avium subsp. paratuberculosis
cgaccacaugccguugccaggc

SEQ ID NO: 861187 - RNA, 17 nt, Mycobacterium avium subsp. paratuberculosis
cgaccacacccgcacgc

SEQ ID NO: 861188 - RNA, 14 nt, Mycobacterium avium subsp. paratuberculosis
cgaccacaccgccg

SEQ ID NO: 861189 - RNA, 16 nt, Mycobacterium avium subsp. paratuberculosis
cgaccacaccgccggc

SEQ ID NO: 861190 - RNA, 18 nt, Mycobacterium avium subsp. paratuberculosis
cgaccacaccgccggcca

SEQ ID NO: 861191 - RNA, 13 nt, Mycobacterium avium subsp. paratuberculosis
cgaccacaccggc

SEQ ID NO: 861192 - RNA, 14 nt, Mycobacterium avium subsp. paratuberculosis
cgaccacaccggcg

SEQ ID NO: 861193 - RNA, 15 nt, Mycobacterium avium subsp. paratuberculosis
cgaccacaccggcgc

SEQ ID NO: 861194 - RNA, 17 nt, Mycobacterium avium subsp. paratuberculosis
cgaccacaccgucgacg

SEQ ID NO: 861195 - RNA, 19 nt, Mycobacterium avium subsp. paratuberculosis
cgaccacaccgucgacgac

SEQ ID NO: 861196 - RNA, 19 nt, Mycobacterium avium subsp. paratuberculosis
cgaccacagcgccucgucg

SEQ ID NO: 861197 - RNA, 20 nt, Mycobacterium avium subsp. paratuberculosis
cgacccgaacuucagcgcgu

SEQ ID NO: 861198 - RNA, 14 nt, Mycobacterium avium subsp. paratuberculosis
cgaccccggcggca

SEQ ID NO: 861199 - RNA, 20 nt, Mycobacterium avium subsp. paratuberculosis
cgaccccggcggcaccgccg

SEQ ID NO: 861200 - RNA, 23 nt, Mycobacterium avium subsp. paratuberculosis
cgaccccggcggcaccgccgcgg

SEQ ID NO: 861201 - RNA, 19 nt, Mycobacterium avium subsp. paratuberculosis
cgaccccguucgccgacag

SEQ ID NO: 861202 - RNA, 13 nt, Mycobacterium avium subsp. paratuberculosis
cgaccccucggcg

SEQ ID NO: 861203 - RNA, 15 nt, Mycobacterium avium subsp. paratuberculosis
cgaccccucggcggc

SEQ ID NO: 861204 - RNA, 16 nt, Mycobacterium avium subsp. paratuberculosis
cgaccccucggcggcc

SEQ ID NO: 861205 - RNA, 18 nt, Mycobacterium avium subsp. paratuberculosis
cgaccccucggcggccgu

SEQ ID NO: 861206 - RNA, 19 nt, Mycobacterium avium subsp. paratuberculosis
cgaccccucggcggccguc

SEQ ID NO: 861207 - RNA, 12 nt, Mycobacterium avium subsp. paratuberculosis
cgacccgaaccg

SEQ ID NO: 861208 - RNA, 16 nt, Mycobacterium avium subsp. paratuberculosis
cgacccgaaccggauc

SEQ ID NO: 861209 - RNA, 12 nt, Mycobacterium avium subsp. paratuberculosis
cgacccgcacga

SEQ ID NO: 861210 - RNA, 18 nt, Mycobacterium avium subsp. paratuberculosis
cgacccgcacgaugccgc

SEQ ID NO: 861211 - RNA, 21 nt, Mycobacterium avium subsp. paratuberculosis
cgacccgcacgaugccgcgcu

SEQ ID NO: 861212 - RNA, 18 nt, Mycobacterium avium subsp. paratuberculosis
cgacccgcauccgccggg

SEQ ID NO: 861213 - RNA, 21 nt, Mycobacterium avium subsp. paratuberculosis
cgacccgcauccgccgggcgg

SEQ ID NO: 861214 - RNA, 14 nt, Mycobacterium avium subsp. paratuberculosis
cgacccgcaccacc

SEQ ID NO: 861215 - RNA, 17 nt, Mycobacterium avium subsp. paratuberculosis
cgacccgcaccaccgcc

SEQ ID NO: 861216 - RNA, 21 nt, Mycobacterium avium subsp. paratuberculosis
cgacccgcaccaccgcccgga

SEQ ID NO: 861217 - RNA, 15 nt, Mycobacterium avium subsp. paratuberculosis
cgaccaucugccggc

SEQ ID NO: 861218 - RNA, 18 nt, Mycobacterium avium subsp. paratuberculosis
cgaccaucugccggcgcu

SEQ ID NO: 861219 - RNA, 23 nt, Mycobacterium avium subsp. paratuberculosis
cgaccagcgccgagaccagccag

SEQ ID NO: 861220 - RNA, 15 nt, Mycobacterium avium subsp. paratuberculosis
cgaccaugcccagca

SEQ ID NO: 861221 - RNA, 17 nt, Mycobacterium avium subsp. paratuberculosis
cgaccaugcccagcagu

SEQ ID NO: 861222 - RNA, 20 nt, Mycobacterium avium subsp. paratuberculosis
cgaccaugcccagcaguccg

SEQ ID NO: 861223 - RNA, 15 nt, Mycobacterium avium subsp. paratuberculosis
cgaccaugcccggcg

SEQ ID NO: 861224 - RNA, 13 nt, Mycobacterium avium subsp. paratuberculosis
cgaccaugccgcg

SEQ ID NO: 861225 - RNA, 17 nt, Mycobacterium avium subsp. paratuberculosis
cgaccaugccguagcgg

SEQ ID NO: 861226 - RNA, 22 nt, Mycobacterium avium subsp. paratuberculosis
cgaccaugccguagcggucgcc

SEQ ID NO: 861227 - RNA, 16 nt, Mycobacterium avium subsp. paratuberculosis
cgacccaccgucgaag

SEQ ID NO: 861228 - RNA, 17 nt, Mycobacterium avium subsp. paratuberculosis
cgaccaugucggcgacc

SEQ ID NO: 861229 - RNA, 19 nt, Mycobacterium avium subsp. paratuberculosis
cgaccaugucggcgacccg

SEQ ID NO: 861230 - RNA, 12 nt, Mycobacterium avium subsp. paratuberculosis
cgaccagcgccg

SEQ ID NO: 861231 - RNA, 11 nt, Mycobacterium avium subsp. paratuberculosis
cgaccagcgcg

SEQ ID NO: 861232 - RNA, 14 nt, Mycobacterium avium subsp. paratuberculosis
cgaccagcgcgauc

SEQ ID NO: 861233 - RNA, 18 nt, Mycobacterium avium subsp. paratuberculosis
cgaccagauugcggcacc

SEQ ID NO: 861234 - RNA, 12 nt, Mycobacterium avium subsp. paratuberculosis
cgaccagcaccc

SEQ ID NO: 861235 - RNA, 12 nt, Mycobacterium avium subsp. paratuberculosis
cgaccagcgcgu

SEQ ID NO: 861236 - RNA, 15 nt, Mycobacterium avium subsp. paratuberculosis
cgaccagcgcguuga

SEQ ID NO: 861237 - RNA, 20 nt, Mycobacterium avium subsp. paratuberculosis
cgaccagcgcguugaugacg

SEQ ID NO: 861238 - RNA, 12 nt, Mycobacterium avium subsp. paratuberculosis
cgaccagcggca

SEQ ID NO: 861239 - RNA, 15 nt, Mycobacterium avium subsp. paratuberculosis
cgaccagcggcagca

SEQ ID NO: 861240 - RNA, 17 nt, Mycobacterium avium subsp. paratuberculosis
cgaccagcggcagcacg

SEQ ID NO: 861241 - RNA, 18 nt, Mycobacterium avium subsp. paratuberculosis
cgaccagcggcagcacgu

SEQ ID NO: 861242 - RNA, 20 nt, Mycobacterium avium subsp. paratuberculosis
cgaccagcggcagcagcacc

SEQ ID NO: 861243 - RNA, 21 nt, Mycobacterium avium subsp. paratuberculosis
cgaccagcggcagcagcacca

SEQ ID NO: 861244 - RNA, 17 nt, Mycobacterium avium subsp. paratuberculosis
cgaccagcggcccaccg

SEQ ID NO: 861245 - RNA, 21 nt, Mycobacterium avium subsp. paratuberculosis
cgaccagcggcccaccgcgac

SEQ ID NO: 861246 - RNA, 22 nt, Mycobacterium avium subsp. paratuberculosis
cgaccagcggcccaccgcgacc

SEQ ID NO: 861247 - RNA, 23 nt, Mycobacterium avium subsp. paratuberculosis
cgaccagcugauuguugacggug

SEQ ID NO: 861248 - RNA, 12 nt, Mycobacterium avium subsp. paratuberculosis
cgaccagcgcgc

SEQ ID NO: 861249 - RNA, 14 nt, Mycobacterium avium subsp. paratuberculosis
cgaccagcgcgccg

SEQ ID NO: 861250 - RNA, 16 nt, Mycobacterium avium subsp. paratuberculosis
cgaccagcgcgccggc

SEQ ID NO: 861251 - RNA, 18 nt, Mycobacterium avium subsp. paratuberculosis
cgaccagcgcgccggcca

SEQ ID NO: 861252 - RNA, 22 nt, Mycobacterium avium subsp. paratuberculosis
cgaccagcgcgccggccagcag

SEQ ID NO: 861253 - RNA, 14 nt, Mycobacterium avium subsp. paratuberculosis
cgaccagcgggccg

SEQ ID NO: 861254 - RNA, 18 nt, Mycobacterium avium subsp. paratuberculosis
cgaccagcgggccgacag

SEQ ID NO: 861255 - RNA, 19 nt, Mycobacterium avium subsp. paratuberculosis
cgaccagcgggccgacagc

SEQ ID NO: 861256 - RNA, 20 nt, Mycobacterium avium subsp. paratuberculosis
cgaccagcgggccgacagca

SEQ ID NO: 861257 - RNA, 22 nt, Mycobacterium avium subsp. paratuberculosis
cgaccagcgggccgacagcacg

SEQ ID NO: 861258 - RNA, 14 nt, Mycobacterium avium subsp. paratuberculosis
cgaccagcgggcug

SEQ ID NO: 861259 - RNA, 20 nt, Mycobacterium avium subsp. paratuberculosis
cgaccagcgggcugucggcg

SEQ ID NO: 861260 - RNA, 22 nt, Mycobacterium avium subsp. paratuberculosis
cgaccagcgggcugucggcgcc

SEQ ID NO: 861261 - RNA, 18 nt, Mycobacterium avium subsp. paratuberculosis
cgaccgccuugucggcga

SEQ ID NO: 861262 - RNA, 17 nt, Mycobacterium avium subsp. paratuberculosis
cgacccguccagcagca

SEQ ID NO: 861263 - RNA, 14 nt, Mycobacterium avium subsp. paratuberculosis
cgaccgcgacgacc

SEQ ID NO: 861264 - RNA, 14 nt, Mycobacterium avium subsp. paratuberculosis
cgaccgcgacgauc

SEQ ID NO: 861265 - RNA, 15 nt, Mycobacterium avium subsp. paratuberculosis
cgaccgcgacgauca

SEQ ID NO: 861266 - RNA, 21 nt, Mycobacterium avium subsp. paratuberculosis
cgaccgcgacgaucacggugu

SEQ ID NO: 861267 - RNA, 14 nt, Mycobacterium avium subsp. paratuberculosis
cgaccgcgacggcg

SEQ ID NO: 861268 - RNA, 17 nt, Mycobacterium avium subsp. paratuberculosis
cgaccgcgacggcgccc

SEQ ID NO: 861269 - RNA, 15 nt, Mycobacterium avium subsp. paratuberculosis
cgaccgcgacggugg

SEQ ID NO: 861270 - RNA, 18 nt, Mycobacterium avium subsp. paratuberculosis
cgaccgcgacgguggacc

SEQ ID NO: 861271 - RNA, 20 nt, Mycobacterium avium subsp. paratuberculosis
cgaccgcgacgguggacccg

SEQ ID NO: 861272 - RNA, 15 nt, Mycobacterium avium subsp. paratuberculosis
cgaccgcgacguggc

SEQ ID NO: 861273 - RNA, 22 nt, Mycobacterium avium subsp. paratuberculosis
cgaccgcgaucagggccgcggc

SEQ ID NO: 861274 - RNA, 23 nt, Mycobacterium avium subsp. paratuberculosis
cgaccgcgaucagggccgcggcc

SEQ ID NO: 861275 - RNA, 11 nt, Mycobacterium avium subsp. paratuberculosis
cgaccgcgaug

SEQ ID NO: 861276 - RNA, 18 nt, Mycobacterium avium subsp. paratuberculosis
cgaccgcgaugcgacacc

SEQ ID NO: 861277 - RNA, 14 nt, Mycobacterium avium subsp. paratuberculosis
cgaccgcgcaccgg

SEQ ID NO: 861278 - RNA, 15 nt, Mycobacterium avium subsp. paratuberculosis
cgaccgcgcaccggc

SEQ ID NO: 861279 - RNA, 16 nt, Mycobacterium avium subsp. paratuberculosis
cgaccgcgcaccggcg

SEQ ID NO: 861280 - RNA, 12 nt, Mycobacterium avium subsp. paratuberculosis
cgaccgcgcagg

SEQ ID NO: 861281 - RNA, 18 nt, Mycobacterium avium subsp. paratuberculosis
cgaccgcgcaggcggcga

SEQ ID NO: 861282 - RNA, 23 nt, Mycobacterium avium subsp. paratuberculosis
cgaccgcgcaggcggcgacggcc

SEQ ID NO: 861283 - RNA, 13 nt, Mycobacterium avium subsp. paratuberculosis
cgaccgcgccgaa

SEQ ID NO: 861284 - RNA, 14 nt, Mycobacterium avium subsp. paratuberculosis
cgaccggacgaaca

SEQ ID NO: 861285 - RNA, 23 nt, Mycobacterium avium subsp. paratuberculosis
cgaccggacgaacaucgagccca

SEQ ID NO: 861286 - RNA, 15 nt, Mycobacterium avium subsp. paratuberculosis
cgaccggagccgucu

SEQ ID NO: 861287 - RNA, 16 nt, Mycobacterium avium subsp. paratuberculosis
cgaccggcaccagcag

SEQ ID NO: 861288 - RNA, 15 nt, Mycobacterium avium subsp. paratuberculosis
cgaccggcagcaccg

SEQ ID NO: 861289 - RNA, 18 nt, Mycobacterium avium subsp. paratuberculosis
cgaccggcagcaccggcc

SEQ ID NO: 861290 - RNA, 19 nt, Mycobacterium avium subsp. paratuberculosis
cgaccggcagcaccggccg

SEQ ID NO: 861291 - RNA, 20 nt, Mycobacterium avium subsp. paratuberculosis
cgaccggcagcaccggccgg

SEQ ID NO: 861292 - RNA, 17 nt, Mycobacterium avium subsp. paratuberculosis
cgaccggcagccgcgcc

SEQ ID NO: 861293 - RNA, 15 nt, Mycobacterium avium subsp. paratuberculosis
cgaccgccucgaugg

SEQ ID NO: 861294 - RNA, 14 nt, Mycobacterium avium subsp. paratuberculosis
cgaccgccucgucg

SEQ ID NO: 861295 - RNA, 14 nt, Mycobacterium avium subsp. paratuberculosis
cgaccgccgguggg

SEQ ID NO: 861296 - RNA, 12 nt, Mycobacterium avium subsp. paratuberculosis
cgacccgucggg

SEQ ID NO: 861297 - RNA, 13 nt, Mycobacterium avium subsp. paratuberculosis
cgacccgucgggg

SEQ ID NO: 861298 - RNA, 23 nt, Mycobacterium avium subsp. paratuberculosis
cgacccgucggggugcgccaggc

SEQ ID NO: 861299 - RNA, 19 nt, Mycobacterium avium subsp. paratuberculosis
cgacccguuccccggccga

SEQ ID NO: 861300 - RNA, 16 nt, Mycobacterium avium subsp. paratuberculosis
cgacccguuccggcga

SEQ ID NO: 861301 - RNA, 18 nt, Mycobacterium avium subsp. paratuberculosis
cgacccguuccggcgaga

SEQ ID NO: 861302 - RNA, 22 nt, Mycobacterium avium subsp. paratuberculosis
cgaccgccggacaccaccgcgg

SEQ ID NO: 861303 - RNA, 22 nt, Mycobacterium avium subsp. paratuberculosis
cgacccgguggcccggucgucg

SEQ ID NO: 861304 - RNA, 23 nt, Mycobacterium avium subsp. paratuberculosis
cgacccgguggcccggucgucga

SEQ ID NO: 861305 - RNA, 18 nt, Mycobacterium avium subsp. paratuberculosis
cgacccguaauugaucgu

SEQ ID NO: 861306 - RNA, 14 nt, Mycobacterium avium subsp. paratuberculosis
cgacccgcccgccg

SEQ ID NO: 861307 - RNA, 15 nt, Mycobacterium avium subsp. paratuberculosis
cgacccgcccgccgg

SEQ ID NO: 861308 - RNA, 16 nt, Mycobacterium avium subsp. paratuberculosis
cgacccgcccgccggg

SEQ ID NO: 861309 - RNA, 19 nt, Mycobacterium avium subsp. paratuberculosis
cgacccgcccgccgggcac

SEQ ID NO: 861310 - RNA, 20 nt, Mycobacterium avium subsp. paratuberculosis
cgacccgcccgccgggcacc

SEQ ID NO: 861311 - RNA, 14 nt, Mycobacterium avium subsp. paratuberculosis
cgacccgccgcagc

SEQ ID NO: 861312 - RNA, 22 nt, Mycobacterium avium subsp. paratuberculosis
cgacccgggccgccacggcgcc

SEQ ID NO: 861313 - RNA, 23 nt, Mycobacterium avium subsp. paratuberculosis
cgacccgggccgccacggcgcca

SEQ ID NO: 861314 - RNA, 21 nt, Mycobacterium avium subsp. paratuberculosis
cgacccgggcuagacgcgcac

SEQ ID NO: 861315 - RNA, 23 nt, Mycobacterium avium subsp. paratuberculosis
cgacccgggcuagacgcgcacca

SEQ ID NO: 861316 - RNA, 18 nt, Mycobacterium avium subsp. paratuberculosis
cgacccgguagcgcagca

SEQ ID NO: 861317 - RNA, 19 nt, Mycobacterium avium subsp. paratuberculosis
cgacccggucagcucgccg

SEQ ID NO: 861318 - RNA, 22 nt, Mycobacterium avium subsp. paratuberculosis
cgacccggucagcucgccgucc

SEQ ID NO: 861319 - RNA, 23 nt, Mycobacterium avium subsp. paratuberculosis
cgacccggucagcucgccguccg

SEQ ID NO: 861320 - RNA, 17 nt, Mycobacterium avium subsp. paratuberculosis
cgaccgguucgucaacg

SEQ ID NO: 861321 - RNA, 21 nt, Mycobacterium avium subsp. paratuberculosis
cgaccgguucgucaacgcccc

SEQ ID NO: 861322 - RNA, 23 nt, Mycobacterium avium subsp. paratuberculosis
cgaccgguucgucaacgccccgg

SEQ ID NO: 861323 - RNA, 15 nt, Mycobacterium avium subsp. paratuberculosis
cgaccguagccgguc

SEQ ID NO: 861324 - RNA, 16 nt, Mycobacterium avium subsp. paratuberculosis
cgaccguagccggucg

SEQ ID NO: 861325 - RNA, 17 nt, Mycobacterium avium subsp. paratuberculosis
cgaccguagccggucgg

SEQ ID NO: 861326 - RNA, 22 nt, Mycobacterium avium subsp. paratuberculosis
cgaccguagccggucggcccgc

SEQ ID NO: 861327 - RNA, 12 nt, Mycobacterium avium subsp. paratuberculosis
cgaccggccauc

SEQ ID NO: 861328 - RNA, 20 nt, Mycobacterium avium subsp. paratuberculosis
cgaccggccaucuccugcac

SEQ ID NO: 861329 - RNA, 24 nt, Mycobacterium avium subsp. paratuberculosis
cgaccggccaucuccugcacgcgc

SEQ ID NO: 861330 - RNA, 22 nt, Mycobacterium avium subsp. paratuberculosis
cgaccggccccaacggcgugca

SEQ ID NO: 861331 - RNA, 12 nt, Mycobacterium avium subsp. paratuberculosis
cgaccggccggu

SEQ ID NO: 861332 - RNA, 22 nt, Mycobacterium avium subsp. paratuberculosis
cgaccggucucgaccgcggcgc

SEQ ID NO: 861333 - RNA, 24 nt, Mycobacterium avium subsp. paratuberculosis
cgaccggucucgaccgcggcgccg

SEQ ID NO: 861334 - RNA, 18 nt, Mycobacterium avium subsp. paratuberculosis
cgaccgucaucaucaccg

SEQ ID NO: 861335 - RNA, 20 nt, Mycobacterium avium subsp. paratuberculosis
cgaccgucaucaucaccggg

SEQ ID NO: 861336 - RNA, 23 nt, Mycobacterium avium subsp. paratuberculosis
cgaccgucaucaucaccgggaug

SEQ ID NO: 861337 - RNA, 18 nt, Mycobacterium avium subsp. paratuberculosis
cgaccgucgggacggcca

SEQ ID NO: 861338 - RNA, 17 nt, Mycobacterium avium subsp. paratuberculosis
cgaccuccucgaccccg

SEQ ID NO: 861339 - RNA, 13 nt, Mycobacterium avium subsp. paratuberculosis
cgaccucgaacac

SEQ ID NO: 861340 - RNA, 22 nt, Mycobacterium avium subsp. paratuberculosis
cgaccucgaagaagagggcgug

SEQ ID NO: 861341 - RNA, 23 nt, Mycobacterium avium subsp. paratuberculosis
cgaccucgaagaagagggcguga

SEQ ID NO: 861342 - RNA, 20 nt, Mycobacterium avium subsp. paratuberculosis
cgaccugcgggcccaccgcg

SEQ ID NO: 861343 - RNA, 21 nt, Mycobacterium avium subsp. paratuberculosis
cgaccugcgggcccaccgcgc

SEQ ID NO: 861344 - RNA, 22 nt, Mycobacterium avium subsp. paratuberculosis
cgaccugcgggcccaccgcgcg

SEQ ID NO: 861345 - RNA, 23 nt, Mycobacterium avium subsp. paratuberculosis
cgaccugcgggcccaccgcgcgc

SEQ ID NO: 861346 - RNA, 15 nt, Mycobacterium avium subsp. paratuberculosis
cgaccugcgggugca

SEQ ID NO: 861347 - RNA, 14 nt, Mycobacterium avium subsp. paratuberculosis
cgaccugcgcgacg

SEQ ID NO: 861348 - RNA, 20 nt, Mycobacterium avium subsp. paratuberculosis
cgaccugcgcgacggcgcug

SEQ ID NO: 861349 - RNA, 15 nt, Mycobacterium avium subsp. paratuberculosis
cgaccugcccgggcc

SEQ ID NO: 861350 - RNA, 17 nt, Mycobacterium avium subsp. paratuberculosis
cgaccugcccgggcccg

SEQ ID NO: 861351 - RNA, 18 nt, Mycobacterium avium subsp. paratuberculosis
cgaccugcccgggcccga

SEQ ID NO: 861352 - RNA, 14 nt, Mycobacterium avium subsp. paratuberculosis
cgaccucggcgacg

SEQ ID NO: 861353 - RNA, 14 nt, Mycobacterium avium subsp. paratuberculosis
cgaccucggcggcc

SEQ ID NO: 861354 - RNA, 15 nt, Mycobacterium avium subsp. paratuberculosis
cgaccucggcgacca

SEQ ID NO: 861355 - RNA, 17 nt, Mycobacterium avium subsp. paratuberculosis
cgaccucggcgaccagc

SEQ ID NO: 861356 - RNA, 19 nt, Mycobacterium avium subsp. paratuberculosis
cgaccucggcgaccagcga

SEQ ID NO: 861357 - RNA, 23 nt, Mycobacterium avium subsp. paratuberculosis
cgaccucggcgaccagcgacggc

SEQ ID NO: 861358 - RNA, 12 nt, Mycobacterium avium subsp. paratuberculosis
cgaccucggcca

SEQ ID NO: 861359 - RNA, 14 nt, Mycobacterium avium subsp. paratuberculosis
cgaccucggccacc

SEQ ID NO: 861360 - RNA, 15 nt, Mycobacterium avium subsp. paratuberculosis
cgaccucggccacca

SEQ ID NO: 861361 - RNA, 17 nt, Mycobacterium avium subsp. paratuberculosis
cgaccucggccaccacc

SEQ ID NO: 861362 - RNA, 22 nt, Mycobacterium avium subsp. paratuberculosis
cgaccucggccaccaccucgcg

SEQ ID NO: 861363 - RNA, 17 nt, Mycobacterium avium subsp. paratuberculosis
cgaccucggccagcgug

SEQ ID NO: 861364 - RNA, 18 nt, Mycobacterium avium subsp. paratuberculosis
cgaccucggccagcgugu

SEQ ID NO: 861365 - RNA, 16 nt, Mycobacterium avium subsp. paratuberculosis
cgaccucgaucagucg

SEQ ID NO: 861366 - RNA, 15 nt, Mycobacterium avium subsp. paratuberculosis
cgaccucgcccgccg

SEQ ID NO: 861367 - RNA, 17 nt, Mycobacterium avium subsp. paratuberculosis
cgaccucgcccgccgcg

SEQ ID NO: 861368 - RNA, 18 nt, Mycobacterium avium subsp. paratuberculosis
cgaccucgcccgccgcga

SEQ ID NO: 861369 - RNA, 14 nt, Mycobacterium avium subsp. paratuberculosis
cgaccucgccgacg

SEQ ID NO: 861370 - RNA, 22 nt, Mycobacterium avium subsp. paratuberculosis
cgaccucgccgacgucccagca

SEQ ID NO: 861371 - RNA, 17 nt, Mycobacterium avium subsp. paratuberculosis
cgaccucgcgcgucacg

SEQ ID NO: 861372 - RNA, 23 nt, Mycobacterium avium subsp. paratuberculosis
cgaccucgcgcgucacgcuggcg

SEQ ID NO: 861373 - RNA, 17 nt, Mycobacterium avium subsp. paratuberculosis
cgaccucgagcgucacg

SEQ ID NO: 861374 - RNA, 22 nt, Mycobacterium avium subsp. paratuberculosis
cgaccuucuggccuugcagccc

SEQ ID NO: 861375 - RNA, 17 nt, Mycobacterium avium subsp. paratuberculosis
cgaccuugacccaggcc

SEQ ID NO: 861376 - RNA, 23 nt, Mycobacterium avium subsp. paratuberculosis
cgaccuguuuggccagccaguug

SEQ ID NO: 861377 - RNA, 13 nt, Mycobacterium avium subsp. paratuberculosis
cgaccuucgagcc

SEQ ID NO: 861378 - RNA, 18 nt, Mycobacterium avium subsp. paratuberculosis
cgaccuucgagccgccgc

SEQ ID NO: 861379 - RNA, 19 nt, Mycobacterium avium subsp. paratuberculosis
cgaccuucgagccgccgcc

SEQ ID NO: 861380 - RNA, 19 nt, Mycobacterium avium subsp. paratuberculosis
cgaccugguugacaccacc

SEQ ID NO: 861381 - RNA, 23 nt, Mycobacterium avium subsp. paratuberculosis
cgaccugguugacaccaccgaga

SEQ ID NO: 861382 - RNA, 16 nt, Mycobacterium avium subsp. paratuberculosis
cgaccuggugcucgau

SEQ ID NO: 861383 - RNA, 20 nt, Mycobacterium avium subsp. paratuberculosis
cgaccuguagggcgagcucg

SEQ ID NO: 861384 - RNA, 14 nt, Mycobacterium avium subsp. paratuberculosis
cgaccuguccgauc

SEQ ID NO: 861385 - RNA, 17 nt, Mycobacterium avium subsp. paratuberculosis
cgaccuguccgaucacc

SEQ ID NO: 861386 - RNA, 15 nt, Mycobacterium avium subsp. paratuberculosis
cgaccuggacgccgc

SEQ ID NO: 861387 - RNA, 16 nt, Mycobacterium avium subsp. paratuberculosis
cgaccuggacgccgca

SEQ ID NO: 861388 - RNA, 17 nt, Mycobacterium avium subsp. paratuberculosis
cgaccuggacgccgcac

SEQ ID NO: 861389 - RNA, 21 nt, Mycobacterium avium subsp. paratuberculosis
cgaccuggacgccgcacgcga

SEQ ID NO: 861390 - RNA, 16 nt, Mycobacterium avium subsp. paratuberculosis
cgaccugcucgucggu

SEQ ID NO: 861391 - RNA, 14 nt, Mycobacterium avium subsp. paratuberculosis
cgaccuggcggccg

SEQ ID NO: 861392 - RNA, 15 nt, Mycobacterium avium subsp. paratuberculosis
cgaccuggcggccgg

SEQ ID NO: 861393 - RNA, 15 nt, Mycobacterium avium subsp. paratuberculosis
cgaccugggcggcca

SEQ ID NO: 861394 - RNA, 17 nt, Mycobacterium avium subsp. paratuberculosis
cgaccugguccaccgcg

SEQ ID NO: 861395 - RNA, 18 nt, Mycobacterium avium subsp. paratuberculosis
cgaccugguccaccgcgg

SEQ ID NO: 861396 - RNA, 19 nt, Mycobacterium avium subsp. paratuberculosis
cgaccugguccaccgcggc

SEQ ID NO: 861397 - RNA, 20 nt, Mycobacterium avium subsp. paratuberculosis
cgaccugguccaccgcggcg

SEQ ID NO: 861398 - RNA, 21 nt, Mycobacterium avium subsp. paratuberculosis
cgaccugguccaccgcggcgg

SEQ ID NO: 861399 - RNA, 15 nt, Mycobacterium avium subsp. paratuberculosis
cgaccuggucgccga

SEQ ID NO: 861400 - RNA, 16 nt, Mycobacterium avium subsp. paratuberculosis
cgaccuggucgccgcc

SEQ ID NO: 861401 - RNA, 21 nt, Mycobacterium avium subsp. paratuberculosis
cgaccuggucgccgccgucca

SEQ ID NO: 861402 - RNA, 18 nt, Mycobacterium avium subsp. paratuberculosis
cgacgaaucccgccucgg

SEQ ID NO: 861403 - RNA, 19 nt, Mycobacterium avium subsp. paratuberculosis
cgacgaaucccgccucggu

SEQ ID NO: 861404 - RNA, 15 nt, Mycobacterium avium subsp. paratuberculosis
cgacgaauccgguga

SEQ ID NO: 861405 - RNA, 15 nt, Mycobacterium avium subsp. paratuberculosis
cgacgaacaccaccg

SEQ ID NO: 861406 - RNA, 15 nt, Mycobacterium avium subsp. paratuberculosis
cgacgaagucgacgg

SEQ ID NO: 861407 - RNA, 18 nt, Mycobacterium avium subsp. paratuberculosis
cgacgaagucgacggcgg

SEQ ID NO: 861408 - RNA, 15 nt, Mycobacterium avium subsp. paratuberculosis
cgacgaagucgguca

SEQ ID NO: 861409 - RNA, 17 nt, Mycobacterium avium subsp. paratuberculosis
cgacgaagucggucagc

SEQ ID NO: 861410 - RNA, 22 nt, Mycobacterium avium subsp. paratuberculosis
cgacgaagucggucagcgucgc

SEQ ID NO: 861411 - RNA, 24 nt, Mycobacterium avium subsp. paratuberculosis
cgacgaagucggucagcgucgccg

SEQ ID NO: 861412 - RNA, 21 nt, Mycobacterium avium subsp. paratuberculosis
cgaccuugcagcccgcgucca

SEQ ID NO: 861413 - RNA, 15 nt, Mycobacterium avium subsp. paratuberculosis
cgaccuugcgcagcc

SEQ ID NO: 861414 - RNA, 17 nt, Mycobacterium avium subsp. paratuberculosis
cgaccuuuugcccggcg

SEQ ID NO: 861415 - RNA, 18 nt, Mycobacterium avium subsp. paratuberculosis
cgaccuuuugcccggcga

SEQ ID NO: 861416 - RNA, 20 nt, Mycobacterium avium subsp. paratuberculosis
cgaccuuuugcccggcgaug

SEQ ID NO: 861417 - RNA, 21 nt, Mycobacterium avium subsp. paratuberculosis
cgaccuuuugcccggcgaugg

SEQ ID NO: 861418 - RNA, 16 nt, Mycobacterium avium subsp. paratuberculosis
cgacgaaaucgucggg

SEQ ID NO: 861419 - RNA, 17 nt, Mycobacterium avium subsp. paratuberculosis
cgacgaaaucgucgggc

SEQ ID NO: 861420 - RNA, 20 nt, Mycobacterium avium subsp. paratuberculosis
cgacgaaaucgucgggcacc

SEQ ID NO: 861421 - RNA, 18 nt, Mycobacterium avium subsp. paratuberculosis
cgacgaaaucgucgggcc

SEQ ID NO: 861422 - RNA, 19 nt, Mycobacterium avium subsp. paratuberculosis
cgacgaaaucgucgggccg

SEQ ID NO: 861423 - RNA, 20 nt, Mycobacterium avium subsp. paratuberculosis
cgacgaaaucgucgggccgg

SEQ ID NO: 861424 - RNA, 21 nt, Mycobacterium avium subsp. paratuberculosis
cgacgauacgugcucccgccg

SEQ ID NO: 861425 - RNA, 22 nt, Mycobacterium avium subsp. paratuberculosis
cgacgauacgugcucccgccga

SEQ ID NO: 861426 - RNA, 23 nt, Mycobacterium avium subsp. paratuberculosis
cgacgauacgugcucccgccgag

SEQ ID NO: 861427 - RNA, 14 nt, Mycobacterium avium subsp. paratuberculosis
cgacgagucgacgc

SEQ ID NO: 861428 - RNA, 16 nt, Mycobacterium avium subsp. paratuberculosis
cgacgagucgccguug

SEQ ID NO: 861429 - RNA, 19 nt, Mycobacterium avium subsp. paratuberculosis
cgacgaguuccucgugcgu

SEQ ID NO: 861430 - RNA, 15 nt, Mycobacterium avium subsp. paratuberculosis
cgacgauaucggccg

SEQ ID NO: 861431 - RNA, 16 nt, Mycobacterium avium subsp. paratuberculosis
cgacgauaucggccgc

SEQ ID NO: 861432 - RNA, 22 nt, Mycobacterium avium subsp. paratuberculosis
cgacgauaucggccgcggggcc

SEQ ID NO: 861433 - RNA, 21 nt, Mycobacterium avium subsp. paratuberculosis
cgacgaucagcacgucgcggc

SEQ ID NO: 861434 - RNA, 16 nt, Mycobacterium avium subsp. paratuberculosis
cgacgaucagcagccg

SEQ ID NO: 861435 - RNA, 22 nt, Mycobacterium avium subsp. paratuberculosis
cgacgaucagcagccgggccug

SEQ ID NO: 861436 - RNA, 17 nt, Mycobacterium avium subsp. paratuberculosis
cgacgaugccguagagc

SEQ ID NO: 861437 - RNA, 15 nt, Mycobacterium avium subsp. paratuberculosis
cgacgaugcggggcg

SEQ ID NO: 861438 - RNA, 14 nt, Mycobacterium avium subsp. paratuberculosis
cgacgaugcugucg

SEQ ID NO: 861439 - RNA, 16 nt, Mycobacterium avium subsp. paratuberculosis
cgacgauggccaggcc

SEQ ID NO: 861440 - RNA, 12 nt, Mycobacterium avium subsp. paratuberculosis
cgacgauggccc

SEQ ID NO: 861441 - RNA, 23 nt, Mycobacterium avium subsp. paratuberculosis
cgacgauggcccggaccgccgcg

SEQ ID NO: 861442 - RNA, 18 nt, Mycobacterium avium subsp. paratuberculosis
cgacgauggcccgggcca

SEQ ID NO: 861443 - RNA, 20 nt, Mycobacterium avium subsp. paratuberculosis
cgacgauggcccgggccaca

SEQ ID NO: 861444 - RNA, 23 nt, Mycobacterium avium subsp. paratuberculosis
cgacgauggcccgggccacaccc

SEQ ID NO: 861445 - RNA, 19 nt, Mycobacterium avium subsp. paratuberculosis
cgacgaucccggcgagcac

SEQ ID NO: 861446 - RNA, 22 nt, Mycobacterium avium subsp. paratuberculosis
cgacgaucccggcgagcacgcc

SEQ ID NO: 861447 - RNA, 19 nt, Mycobacterium avium subsp. paratuberculosis
cgacgauccgcgcccuggu

SEQ ID NO: 861448 - RNA, 20 nt, Mycobacterium avium subsp. paratuberculosis
cgacgauccgcgccgcgaug

SEQ ID NO: 861449 - RNA, 18 nt, Mycobacterium avium subsp. paratuberculosis
cgacgaugccggccggga

SEQ ID NO: 861450 - RNA, 15 nt, Mycobacterium avium subsp. paratuberculosis
cgacgaugccggcgu

SEQ ID NO: 861451 - RNA, 15 nt, Mycobacterium avium subsp. paratuberculosis
cgacgaucagcacgu

SEQ ID NO: 861452 - RNA, 16 nt, Mycobacterium avium subsp. paratuberculosis
cgacgagaucagcacc

SEQ ID NO: 861453 - RNA, 20 nt, Mycobacterium avium subsp. paratuberculosis
cgacgagaucagcaccaggu

SEQ ID NO: 861454 - RNA, 16 nt, Mycobacterium avium subsp. paratuberculosis
cgacgagagcggaucg

SEQ ID NO: 861455 - RNA, 19 nt, Mycobacterium avium subsp. paratuberculosis
cgacgagagcggaucggcg

SEQ ID NO: 861456 - RNA, 14 nt, Mycobacterium avium subsp. paratuberculosis
cgacgacgucgucg

SEQ ID NO: 861457 - RNA, 17 nt, Mycobacterium avium subsp. paratuberculosis
cgacgacgugacgaccu

SEQ ID NO: 861458 - RNA, 20 nt, Mycobacterium avium subsp. paratuberculosis
cgacgacgugacgaccuggu

SEQ ID NO: 861459 - RNA, 22 nt, Mycobacterium avium subsp. paratuberculosis
cgacgacgugacgaccuggucg

SEQ ID NO: 861460 - RNA, 18 nt, Mycobacterium avium subsp. paratuberculosis
cgacgacguugcgggcca

SEQ ID NO: 861461 - RNA, 23 nt, Mycobacterium avium subsp. paratuberculosis
cgacgacugggugcgcgggcgcc

SEQ ID NO: 861462 - RNA, 14 nt, Mycobacterium avium subsp. paratuberculosis
cgacgacuucggcc

SEQ ID NO: 861463 - RNA, 13 nt, Mycobacterium avium subsp. paratuberculosis
cgacgaccaccag

SEQ ID NO: 861464 - RNA, 18 nt, Mycobacterium avium subsp. paratuberculosis
cgacgacggcgccgcguc

SEQ ID NO: 861465 - RNA, 19 nt, Mycobacterium avium subsp. paratuberculosis
cgacgacggcgccgcgucg

SEQ ID NO: 861466 - RNA, 12 nt, Mycobacterium avium subsp. paratuberculosis
cgacgacggcgg

SEQ ID NO: 861467 - RNA, 19 nt, Mycobacterium avium subsp. paratuberculosis
cgacgacggucuucccgcc

SEQ ID NO: 861468 - RNA, 21 nt, Mycobacterium avium subsp. paratuberculosis
cgacgacggucuucccgccgc

SEQ ID NO: 861469 - RNA, 19 nt, Mycobacterium avium subsp. paratuberculosis
cgacgacaggucgagcacc

SEQ ID NO: 861470 - RNA, 21 nt, Mycobacterium avium subsp. paratuberculosis
cgacgacacccuucaucagca

SEQ ID NO: 861471 - RNA, 17 nt, Mycobacterium avium subsp. paratuberculosis
cgagaucaacaccgcgc

SEQ ID NO: 861472 - RNA, 16 nt, Mycobacterium avium subsp. paratuberculosis
cgagaucccagcggga

SEQ ID NO: 861473 - RNA, 17 nt, Mycobacterium avium subsp. paratuberculosis
cgagaucaugccggcga

SEQ ID NO: 861474 - RNA, 22 nt, Mycobacterium avium subsp. paratuberculosis
cgagaucaugccggcgaacucg

SEQ ID NO: 861475 - RNA, 14 nt, Mycobacterium avium subsp. paratuberculosis
cgagaucccagcgg

SEQ ID NO: 861476 - RNA, 15 nt, Mycobacterium avium subsp. paratuberculosis
cgagaucgacgcuga

SEQ ID NO: 861477 - RNA, 14 nt, Mycobacterium avium subsp. paratuberculosis
cgagaucagcgcca

SEQ ID NO: 861478 - RNA, 19 nt, Mycobacterium avium subsp. paratuberculosis
cgagaucagcgccaugcug

SEQ ID NO: 861479 - RNA, 17 nt, Mycobacterium avium subsp. paratuberculosis
cgagaucagggcgcgca

SEQ ID NO: 861480 - RNA, 22 nt, Mycobacterium avium subsp. paratuberculosis
cgagaucagggcgcgcaccggu

SEQ ID NO: 861481 - RNA, 22 nt, Mycobacterium avium subsp. paratuberculosis
cgagaucaccggcuuggcggug

SEQ ID NO: 861482 - RNA, 15 nt, Mycobacterium avium subsp. paratuberculosis
cgagaucagcaccag

SEQ ID NO: 861483 - RNA, 16 nt, Mycobacterium avium subsp. paratuberculosis
cgagaucagcaccagg

SEQ ID NO: 861484 - RNA, 19 nt, Mycobacterium avium subsp. paratuberculosis
cgagaucagcaccaggugg

SEQ ID NO: 861485 - RNA, 14 nt, Mycobacterium avium subsp. paratuberculosis
cgagaucagcaccg

SEQ ID NO: 861486 - RNA, 21 nt, Mycobacterium avium subsp. paratuberculosis
cgagcaauuaaccggcaggcc

SEQ ID NO: 861487 - RNA, 19 nt, Mycobacterium avium subsp. paratuberculosis
cgagcacaccgucgcccgc

SEQ ID NO: 861488 - RNA, 21 nt, Mycobacterium avium subsp. paratuberculosis
cgagcacaccgucgcccgccc

SEQ ID NO: 861489 - RNA, 19 nt, Mycobacterium avium subsp. paratuberculosis
cgagaucgcgggcugcggc

SEQ ID NO: 861490 - RNA, 20 nt, Mycobacterium avium subsp. paratuberculosis
cgagaucgcgggcugcggcg

SEQ ID NO: 861491 - RNA, 21 nt, Mycobacterium avium subsp. paratuberculosis
cgagaucgcgggcugcggcga

SEQ ID NO: 861492 - RNA, 22 nt, Mycobacterium avium subsp. paratuberculosis
cgagaucgcgggcugcggcgag

SEQ ID NO: 861493 - RNA, 12 nt, Mycobacterium avium subsp. paratuberculosis
cgagcaccacca

SEQ ID NO: 861494 - RNA, 13 nt, Mycobacterium avium subsp. paratuberculosis
cgagcaccaccag

SEQ ID NO: 861495 - RNA, 16 nt, Mycobacterium avium subsp. paratuberculosis
cgagcacaggaacgcg

SEQ ID NO: 861496 - RNA, 17 nt, Mycobacterium avium subsp. paratuberculosis
cgagcacaggaacgcga

SEQ ID NO: 861497 - RNA, 12 nt, Mycobacterium avium subsp. paratuberculosis
cgagcacaucgg

SEQ ID NO: 861498 - RNA, 14 nt, Mycobacterium avium subsp. paratuberculosis
cgagcacaucggcg

SEQ ID NO: 861499 - RNA, 17 nt, Mycobacterium avium subsp. paratuberculosis
cgagcaccacccgggug

SEQ ID NO: 861500 - RNA, 21 nt, Mycobacterium avium subsp. paratuberculosis
cgagcaccacggcccgcgccc

SEQ ID NO: 861501 - RNA, 14 nt, Mycobacterium avium subsp. paratuberculosis
cgagcaccagcaac

SEQ ID NO: 861502 - RNA, 19 nt, Mycobacterium avium subsp. paratuberculosis
cgagcacacccucaccccg

SEQ ID NO: 861503 - RNA, 14 nt, Mycobacterium avium subsp. paratuberculosis
cgagcacaccgucg

SEQ ID NO: 861504 - RNA, 23 nt, Mycobacterium avium subsp. paratuberculosis
cgagcaccaggucguugccggug

SEQ ID NO: 861505 - RNA, 16 nt, Mycobacterium avium subsp. paratuberculosis
cgagcacccggauggu

SEQ ID NO: 861506 - RNA, 15 nt, Mycobacterium avium subsp. paratuberculosis
cgagcacccggcggg

SEQ ID NO: 861507 - RNA, 17 nt, Mycobacterium avium subsp. paratuberculosis
cgagcacccggcgggga

SEQ ID NO: 861508 - RNA, 14 nt, Mycobacterium avium subsp. paratuberculosis
cgagcaccagcgga

SEQ ID NO: 861509 - RNA, 15 nt, Mycobacterium avium subsp. paratuberculosis
cgagcaccagcggac

SEQ ID NO: 861510 - RNA, 14 nt, Mycobacterium avium subsp. paratuberculosis
cgagcaccagcguc

SEQ ID NO: 861511 - RNA, 15 nt, Mycobacterium avium subsp. paratuberculosis
cgagcaccagcgucg

SEQ ID NO: 861512 - RNA, 16 nt, Mycobacterium avium subsp. paratuberculosis
cgagcaccagcgucga

SEQ ID NO: 861513 - RNA, 18 nt, Mycobacterium avium subsp. paratuberculosis
cgagcaccagcgucgacg

SEQ ID NO: 861514 - RNA, 19 nt, Mycobacterium avium subsp. paratuberculosis
cgagcaccagcgucgacgc

SEQ ID NO: 861515 - RNA, 19 nt, Mycobacterium avium subsp. paratuberculosis
cgagcaccaggcgcaccag

SEQ ID NO: 861516 - RNA, 13 nt, Mycobacterium avium subsp. paratuberculosis
cgagcaccccggc

SEQ ID NO: 861517 - RNA, 18 nt, Mycobacterium avium subsp. paratuberculosis
cgagcaccccggcggccg

SEQ ID NO: 861518 - RNA, 21 nt, Mycobacterium avium subsp. paratuberculosis
cgagcaccccggcggccgcgu

SEQ ID NO: 861519 - RNA, 15 nt, Mycobacterium avium subsp. paratuberculosis
cgagcaccccgucga

SEQ ID NO: 861520 - RNA, 16 nt, Mycobacterium avium subsp. paratuberculosis
cgagcaccccgucgag

SEQ ID NO: 861521 - RNA, 21 nt, Mycobacterium avium subsp. paratuberculosis
cgagcaccccgucgagcagcc

SEQ ID NO: 861522 - RNA, 17 nt, Mycobacterium avium subsp. paratuberculosis
cgacugcgugcugggca

SEQ ID NO: 861523 - RNA, 15 nt, Mycobacterium avium subsp. paratuberculosis
cgacuggcggcggcg

SEQ ID NO: 861524 - RNA, 14 nt, Mycobacterium avium subsp. paratuberculosis
cgacugggcgccca

SEQ ID NO: 861525 - RNA, 18 nt, Mycobacterium avium subsp. paratuberculosis
cgacugggugcucccgcc

SEQ ID NO: 861526 - RNA, 15 nt, Mycobacterium avium subsp. paratuberculosis
cgacuuacggcguga

SEQ ID NO: 861527 - RNA, 16 nt, Mycobacterium avium subsp. paratuberculosis
cgacuggucgucgagc

SEQ ID NO: 861528 - RNA, 17 nt, Mycobacterium avium subsp. paratuberculosis
cgacuggucgucgagcu

SEQ ID NO: 861529 - RNA, 15 nt, Mycobacterium avium subsp. paratuberculosis
cgacugucggcgccc

SEQ ID NO: 861530 - RNA, 17 nt, Mycobacterium avium subsp. paratuberculosis
cgacugucggcgccccg

SEQ ID NO: 861531 - RNA, 20 nt, Mycobacterium avium subsp. paratuberculosis
cgacugucggcgccccgccc

SEQ ID NO: 861532 - RNA, 15 nt, Mycobacterium avium subsp. paratuberculosis
cgacuggaucaucga

SEQ ID NO: 861533 - RNA, 13 nt, Mycobacterium avium subsp. paratuberculosis
cgacugcgacacc

SEQ ID NO: 861534 - RNA, 18 nt, Mycobacterium avium subsp. paratuberculosis
cgacugcgcggccggcgu

SEQ ID NO: 861535 - RNA, 19 nt, Mycobacterium avium subsp. paratuberculosis
cgacugcaggaacaaccgc

SEQ ID NO: 861536 - RNA, 14 nt, Mycobacterium avium subsp. paratuberculosis
cgagaaggcggcgu

SEQ ID NO: 861537 - RNA, 16 nt, Mycobacterium avium subsp. paratuberculosis
cgagaaggcggcgucg

SEQ ID NO: 861538 - RNA, 14 nt, Mycobacterium avium subsp. paratuberculosis
cgagaagucgccga

SEQ ID NO: 861539 - RNA, 19 nt, Mycobacterium avium subsp. paratuberculosis
cgagaagucgccgacgccg

SEQ ID NO: 861540 - RNA, 17 nt, Mycobacterium avium subsp. paratuberculosis
cgagaagucgcucagcg

SEQ ID NO: 861541 - RNA, 14 nt, Mycobacterium avium subsp. paratuberculosis
cgagaagggccgcc

SEQ ID NO: 861542 - RNA, 15 nt, Mycobacterium avium subsp. paratuberculosis
cgagaagggccgccg

SEQ ID NO: 861543 - RNA, 20 nt, Mycobacterium avium subsp. paratuberculosis
cgagacugaugguggcgcgc

SEQ ID NO: 861544 - RNA, 14 nt, Mycobacterium avium subsp. paratuberculosis
cgagacgucggcgu

SEQ ID NO: 861545 - RNA, 18 nt, Mycobacterium avium subsp. paratuberculosis
cgagacguaagccauggc

SEQ ID NO: 861546 - RNA, 16 nt, Mycobacterium avium subsp. paratuberculosis
cgagacguggucgggc

SEQ ID NO: 861547 - RNA, 21 nt, Mycobacterium avium subsp. paratuberculosis
cgagacgugguggugcggacg

SEQ ID NO: 861548 - RNA, 22 nt, Mycobacterium avium subsp. paratuberculosis
cgagacgugguggugcggacgg

SEQ ID NO: 861549 - RNA, 20 nt, Mycobacterium avium subsp. paratuberculosis
cgagacacauucgcgugugc

SEQ ID NO: 861550 - RNA, 13 nt, Mycobacterium avium subsp. paratuberculosis
cgagacaccgucg

SEQ ID NO: 861551 - RNA, 15 nt, Mycobacterium avium subsp. paratuberculosis
cgagacaccgucgcg

SEQ ID NO: 861552 - RNA, 22 nt, Mycobacterium avium subsp. paratuberculosis
cgagacaccgucgcgcacccag

SEQ ID NO: 861553 - RNA, 18 nt, Mycobacterium avium subsp. paratuberculosis
cgagacaccucgucgauc

SEQ ID NO: 861554 - RNA, 17 nt, Mycobacterium avium subsp. paratuberculosis
cgagacacgcgccggcg

SEQ ID NO: 861555 - RNA, 22 nt, Mycobacterium avium subsp. paratuberculosis
cgagacacgcgccggcgcgggc

SEQ ID NO: 861556 - RNA, 15 nt, Mycobacterium avium subsp. paratuberculosis
aacaauggccccggc

SEQ ID NO: 861557 - RNA, 22 nt, Mycobacterium avium subsp. paratuberculosis
aacaagguguggaucaccauca

SEQ ID NO: 861558 - RNA, 14 nt, Mycobacterium avium subsp. paratuberculosis
cgacguccgggccg

SEQ ID NO: 861559 - RNA, 19 nt, Mycobacterium avium subsp. paratuberculosis
cgacguccgggccgccucg

SEQ ID NO: 861560 - RNA, 20 nt, Mycobacterium avium subsp. paratuberculosis
cgacguccucgacgaucagc

SEQ ID NO: 861561 - RNA, 21 nt, Mycobacterium avium subsp. paratuberculosis
cgacguccucgacgaucagca

SEQ ID NO: 861562 - RNA, 17 nt, Mycobacterium avium subsp. paratuberculosis
cgacguccucgaugccg

SEQ ID NO: 861563 - RNA, 19 nt, Mycobacterium avium subsp. paratuberculosis
cgacguccucgaugccgac

SEQ ID NO: 861564 - RNA, 20 nt, Mycobacterium avium subsp. paratuberculosis
cgacguccuugaucagcaug

SEQ ID NO: 861565 - RNA, 18 nt, Mycobacterium avium subsp. paratuberculosis
cgacgucagcucccccga

SEQ ID NO: 861566 - RNA, 23 nt, Mycobacterium avium subsp. paratuberculosis
cgacgucagcucccccgacaccg

SEQ ID NO: 861567 - RNA, 20 nt, Mycobacterium avium subsp. paratuberculosis
cgacguaggugagcaacgcc

SEQ ID NO: 861568 - RNA, 21 nt, Mycobacterium avium subsp. paratuberculosis
cgacguaggugagcaacgcca

SEQ ID NO: 861569 - RNA, 14 nt, Mycobacterium avium subsp. paratuberculosis
cgacgucaggucga

SEQ ID NO: 861570 - RNA, 20 nt, Mycobacterium avium subsp. paratuberculosis
cgacgucaggucgaccggcu

SEQ ID NO: 861571 - RNA, 14 nt, Mycobacterium avium subsp. paratuberculosis
cgacgucaacaccg

SEQ ID NO: 861572 - RNA, 17 nt, Mycobacterium avium subsp. paratuberculosis
cgacgucaacaccgugg

SEQ ID NO: 861573 - RNA, 21 nt, Mycobacterium avium subsp. paratuberculosis
cgacgucauccggcugcccug

SEQ ID NO: 861574 - RNA, 14 nt, Mycobacterium avium subsp. paratuberculosis
cgacgucccagcac

SEQ ID NO: 861575 - RNA, 17 nt, Mycobacterium avium subsp. paratuberculosis
cgacgucccagcacaac

SEQ ID NO: 861576 - RNA, 15 nt, Mycobacterium avium subsp. paratuberculosis
cgacguccaggccgg

SEQ ID NO: 861577 - RNA, 16 nt, Mycobacterium avium subsp. paratuberculosis
cgacguccaggccggc

SEQ ID NO: 861578 - RNA, 19 nt, Mycobacterium avium subsp. paratuberculosis
cgacguccaggccggcgcc

SEQ ID NO: 861579 - RNA, 17 nt, Mycobacterium avium subsp. paratuberculosis
cgacguaguccggccag

SEQ ID NO: 861580 - RNA, 15 nt, Mycobacterium avium subsp. paratuberculosis
cgacguccacguuga

SEQ ID NO: 861581 - RNA, 13 nt, Mycobacterium avium subsp. paratuberculosis
cgacgucaccacc

SEQ ID NO: 861582 - RNA, 15 nt, Mycobacterium avium subsp. paratuberculosis
cgacgucaccaccgg

SEQ ID NO: 861583 - RNA, 16 nt, Mycobacterium avium subsp. paratuberculosis
cgacgucaccaccggg

SEQ ID NO: 861584 - RNA, 18 nt, Mycobacterium avium subsp. paratuberculosis
cgacgucaccaccggguc

SEQ ID NO: 861585 - RNA, 15 nt, Mycobacterium avium subsp. paratuberculosis
cgacgucacgacggu

SEQ ID NO: 861586 - RNA, 17 nt, Mycobacterium avium subsp. paratuberculosis
cgacgucacgacgguca

SEQ ID NO: 861587 - RNA, 21 nt, Mycobacterium avium subsp. paratuberculosis
cgacgucacgacggucacggc

SEQ ID NO: 861588 - RNA, 17 nt, Mycobacterium avium subsp. paratuberculosis
cgacguacccccgcacg

SEQ ID NO: 861589 - RNA, 19 nt, Mycobacterium avium subsp. paratuberculosis
cgacguacccccgcacgcc

SEQ ID NO: 861590 - RNA, 23 nt, Mycobacterium avium subsp. paratuberculosis
cgacguacagcgagccgucgacc

SEQ ID NO: 861591 - RNA, 16 nt, Mycobacterium avium subsp. paratuberculosis
cgacguagacgagccg

SEQ ID NO: 861592 - RNA, 16 nt, Mycobacterium avium subsp. paratuberculosis
cgacguagcccgccga

SEQ ID NO: 861593 - RNA, 17 nt, Mycobacterium avium subsp. paratuberculosis
cgacguaggacagcacc

SEQ ID NO: 861594 - RNA, 18 nt, Mycobacterium avium subsp. paratuberculosis
cgacguaggacagcacca

SEQ ID NO: 861595 - RNA, 14 nt, Mycobacterium avium subsp. paratuberculosis
cgacguaggccaga

SEQ ID NO: 861596 - RNA, 17 nt, Mycobacterium avium subsp. paratuberculosis
cgacguuggccagcacc

SEQ ID NO: 861597 - RNA, 22 nt, Mycobacterium avium subsp. paratuberculosis
cgacguuggccagcaccgcggc

SEQ ID NO: 861598 - RNA, 17 nt, Mycobacterium avium subsp. paratuberculosis
cgacguugcgggccagg

SEQ ID NO: 861599 - RNA, 18 nt, Mycobacterium avium subsp. paratuberculosis
cgacguugcgggccaggu

SEQ ID NO: 861600 - RNA, 15 nt, Mycobacterium avium subsp. paratuberculosis
cgacguugccgcugg

SEQ ID NO: 861601 - RNA, 15 nt, Mycobacterium avium subsp. paratuberculosis
cgacuagcgcggcgg

SEQ ID NO: 861602 - RNA, 18 nt, Mycobacterium avium subsp. paratuberculosis
cgacucgaccccgcccag

SEQ ID NO: 861603 - RNA, 21 nt, Mycobacterium avium subsp. paratuberculosis
cgacucgauguagccgggcuc

SEQ ID NO: 861604 - RNA, 21 nt, Mycobacterium avium subsp. paratuberculosis
cgacucgcaggugccggugac

SEQ ID NO: 861605 - RNA, 23 nt, Mycobacterium avium subsp. paratuberculosis
cgacucgcaggugccggugacgg

SEQ ID NO: 861606 - RNA, 17 nt, Mycobacterium avium subsp. paratuberculosis
cgacugaucgacgagcc

SEQ ID NO: 861607 - RNA, 18 nt, Mycobacterium avium subsp. paratuberculosis
cgacugaucgacgagccg

SEQ ID NO: 861608 - RNA, 19 nt, Mycobacterium avium subsp. paratuberculosis
cgacugaucgacgagccgg

SEQ ID NO: 861609 - RNA, 13 nt, Mycobacterium avium subsp. paratuberculosis
cgacugcacccga

SEQ ID NO: 861610 - RNA, 22 nt, Mycobacterium avium subsp. paratuberculosis
cgacugcacccgaacggaccgg

SEQ ID NO: 861611 - RNA, 14 nt, Mycobacterium avium subsp. paratuberculosis
cgacugcacccggg

SEQ ID NO: 861612 - RNA, 17 nt, Mycobacterium avium subsp. paratuberculosis
cgacugcacccggguca

SEQ ID NO: 861613 - RNA, 14 nt, Mycobacterium avium subsp. paratuberculosis
cgacucguuggccg

SEQ ID NO: 861614 - RNA, 18 nt, Mycobacterium avium subsp. paratuberculosis
cgacucggccuccgcgcg

SEQ ID NO: 861615 - RNA, 20 nt, Mycobacterium avium subsp. paratuberculosis
cgacucggccuccgcgcgcg

SEQ ID NO: 861616 - RNA, 13 nt, Mycobacterium avium subsp. paratuberculosis
cgacucggccagg

SEQ ID NO: 861617 - RNA, 17 nt, Mycobacterium avium subsp. paratuberculosis
cgacucguucgacgccg

SEQ ID NO: 861618 - RNA, 15 nt, Mycobacterium avium subsp. paratuberculosis
cgacucugcacucag

SEQ ID NO: 861619 - RNA, 21 nt, Mycobacterium avium subsp. paratuberculosis
cgacucugcacucagagcagc

SEQ ID NO: 861620 - RNA, 14 nt, Mycobacterium avium subsp. paratuberculosis
cgacucggugucgc

SEQ ID NO: 861621 - RNA, 16 nt, Mycobacterium avium subsp. paratuberculosis
cgacggggucggacag

SEQ ID NO: 861622 - RNA, 20 nt, Mycobacterium avium subsp. paratuberculosis
cgacggggugguucguccgg

SEQ ID NO: 861623 - RNA, 23 nt, Mycobacterium avium subsp. paratuberculosis
cgacgggguucaguagcagcguc

SEQ ID NO: 861624 - RNA, 13 nt, Mycobacterium avium subsp. paratuberculosis
cgacgggcguccg

SEQ ID NO: 861625 - RNA, 15 nt, Mycobacterium avium subsp. paratuberculosis
cgacgggcgugccgg

SEQ ID NO: 861626 - RNA, 18 nt, Mycobacterium avium subsp. paratuberculosis
cgacgggcgugccggcgg

SEQ ID NO: 861627 - RNA, 19 nt, Mycobacterium avium subsp. paratuberculosis
cgacgggcgugccggcggc

SEQ ID NO: 861628 - RNA, 20 nt, Mycobacterium avium subsp. paratuberculosis
cgacgggcgugccggcggcg

SEQ ID NO: 861629 - RNA, 21 nt, Mycobacterium avium subsp. paratuberculosis
cgacgggcgugccggcggcgg

SEQ ID NO: 861630 - RNA, 18 nt, Mycobacterium avium subsp. paratuberculosis
cgacggggaacucgguga

SEQ ID NO: 861631 - RNA, 22 nt, Mycobacterium avium subsp. paratuberculosis
cgacggguucgcgcagccaccg

SEQ ID NO: 861632 - RNA, 18 nt, Mycobacterium avium subsp. paratuberculosis
cgacggguugcggaucgg

SEQ ID NO: 861633 - RNA, 23 nt, Mycobacterium avium subsp. paratuberculosis
cgacggguugcggaucggugcag

SEQ ID NO: 861634 - RNA, 17 nt, Mycobacterium avium subsp. paratuberculosis
cgacggucuucccgccg

SEQ ID NO: 861635 - RNA, 20 nt, Mycobacterium avium subsp. paratuberculosis
cgacggucuucccgccgccg

SEQ ID NO: 861636 - RNA, 16 nt, Mycobacterium avium subsp. paratuberculosis
cgacggucaguccggg

SEQ ID NO: 861637 - RNA, 17 nt, Mycobacterium avium subsp. paratuberculosis
cgacggucccacucggg

SEQ ID NO: 861638 - RNA, 12 nt, Mycobacterium avium subsp. paratuberculosis
cgacggucgcca

SEQ ID NO: 861639 - RNA, 14 nt, Mycobacterium avium subsp. paratuberculosis
cgacggucgccacc

SEQ ID NO: 861640 - RNA, 15 nt, Mycobacterium avium subsp. paratuberculosis
cgacggucgccacca

SEQ ID NO: 861641 - RNA, 22 nt, Mycobacterium avium subsp. paratuberculosis
cgacggucgccaccaccacggg

SEQ ID NO: 861642 - RNA, 14 nt, Mycobacterium avium subsp. paratuberculosis
cgacggucacgcug

SEQ ID NO: 861643 - RNA, 15 nt, Mycobacterium avium subsp. paratuberculosis
cgacggucacgcugg

SEQ ID NO: 861644 - RNA, 17 nt, Mycobacterium avium subsp. paratuberculosis
cgacggucacgcuggcg

SEQ ID NO: 861645 - RNA, 20 nt, Mycobacterium avium subsp. paratuberculosis
cgacggucacgcuggcguga

SEQ ID NO: 861646 - RNA, 17 nt, Mycobacterium avium subsp. paratuberculosis
cgacggucacggccgcc

SEQ ID NO: 861647 - RNA, 18 nt, Mycobacterium avium subsp. paratuberculosis
cgacggucacggccgcca

SEQ ID NO: 861648 - RNA, 16 nt, Mycobacterium avium subsp. paratuberculosis
cgacggucaccggcag

SEQ ID NO: 861649 - RNA, 18 nt, Mycobacterium avium subsp. paratuberculosis
cgacggucaccggcaggc

SEQ ID NO: 861650 - RNA, 17 nt, Mycobacterium avium subsp. paratuberculosis
cgacggucagcacgcug

SEQ ID NO: 861651 - RNA, 16 nt, Mycobacterium avium subsp. paratuberculosis
cgacgguuugcccggc

SEQ ID NO: 861652 - RNA, 20 nt, Mycobacterium avium subsp. paratuberculosis
cgacgguuugcccggcgaug

SEQ ID NO: 861653 - RNA, 21 nt, Mycobacterium avium subsp. paratuberculosis
cgacgguuugcccggcgaugu

SEQ ID NO: 861654 - RNA, 15 nt, Mycobacterium avium subsp. paratuberculosis
cgacgguuguucagc

SEQ ID NO: 861655 - RNA, 22 nt, Mycobacterium avium subsp. paratuberculosis
cgacgguuguucagcccgguca

SEQ ID NO: 861656 - RNA, 23 nt, Mycobacterium avium subsp. paratuberculosis
cgacgguuguucagcccggucag

SEQ ID NO: 861657 - RNA, 15 nt, Mycobacterium avium subsp. paratuberculosis
cgacgguggcggcga

SEQ ID NO: 861658 - RNA, 20 nt, Mycobacterium avium subsp. paratuberculosis
cgacgguggcggcgaugucg

SEQ ID NO: 861659 - RNA, 16 nt, Mycobacterium avium subsp. paratuberculosis
cgacgguggcgggccg

SEQ ID NO: 861660 - RNA, 19 nt, Mycobacterium avium subsp. paratuberculosis
cgacgguggcgggccgccg

SEQ ID NO: 861661 - RNA, 20 nt, Mycobacterium avium subsp. paratuberculosis
cgacgguggcgggccgccgg

SEQ ID NO: 861662 - RNA, 16 nt, Mycobacterium avium subsp. paratuberculosis
cgacgguguaggacgc

SEQ ID NO: 861663 - RNA, 18 nt, Mycobacterium avium subsp. paratuberculosis
cgacgguguaggacgccg

SEQ ID NO: 861664 - RNA, 14 nt, Mycobacterium avium subsp. paratuberculosis
cgacgguguccgcg

SEQ ID NO: 861665 - RNA, 16 nt, Mycobacterium avium subsp. paratuberculosis
cgacgguguccgcggc

SEQ ID NO: 861666 - RNA, 17 nt, Mycobacterium avium subsp. paratuberculosis
cgacgguguccgcggcg

SEQ ID NO: 861667 - RNA, 20 nt, Mycobacterium avium subsp. paratuberculosis
cgacgguguccgcggcgucg

SEQ ID NO: 861668 - RNA, 17 nt, Mycobacterium avium subsp. paratuberculosis
cgacgguguccgcgggc

SEQ ID NO: 861669 - RNA, 19 nt, Mycobacterium avium subsp. paratuberculosis
cgacgguguccgcgggcag

SEQ ID NO: 861670 - RNA, 19 nt, Mycobacterium avium subsp. paratuberculosis
cgacggugucguagacgac

SEQ ID NO: 861671 - RNA, 21 nt, Mycobacterium avium subsp. paratuberculosis
cgacggugucguagacgacgu

SEQ ID NO: 861672 - RNA, 22 nt, Mycobacterium avium subsp. paratuberculosis
cgacggucgugcugggccgggc

SEQ ID NO: 861673 - RNA, 17 nt, Mycobacterium avium subsp. paratuberculosis
cgacggucugccgggac

SEQ ID NO: 861674 - RNA, 23 nt, Mycobacterium avium subsp. paratuberculosis
cgacggugcugccguugggcacg

SEQ ID NO: 861675 - RNA, 15 nt, Mycobacterium avium subsp. paratuberculosis
cgacgguggagcggc

SEQ ID NO: 861676 - RNA, 21 nt, Mycobacterium avium subsp. paratuberculosis
cgacgguggagcggcccagcu

SEQ ID NO: 861677 - RNA, 23 nt, Mycobacterium avium subsp. paratuberculosis
cgacgguggagcggcccagcucg

SEQ ID NO: 861678 - RNA, 15 nt, Mycobacterium avium subsp. paratuberculosis
cgacgguggccccca

SEQ ID NO: 861679 - RNA, 16 nt, Mycobacterium avium subsp. paratuberculosis
cgacgguggccucggc

SEQ ID NO: 861680 - RNA, 17 nt, Mycobacterium avium subsp. paratuberculosis
cgacgguggccucggcg

SEQ ID NO: 861681 - RNA, 20 nt, Mycobacterium avium subsp. paratuberculosis
cgacgguggccucggcgcug

SEQ ID NO: 861682 - RNA, 21 nt, Mycobacterium avium subsp. paratuberculosis
cgacgguggccucggcgcugc

SEQ ID NO: 861683 - RNA, 13 nt, Mycobacterium avium subsp. paratuberculosis
cgacggugaccgg

SEQ ID NO: 861684 - RNA, 15 nt, Mycobacterium avium subsp. paratuberculosis
cgacggugaccggcu

SEQ ID NO: 861685 - RNA, 16 nt, Mycobacterium avium subsp. paratuberculosis
cgacggugaccggcuc

SEQ ID NO: 861686 - RNA, 18 nt, Mycobacterium avium subsp. paratuberculosis
cgacggugaccucgucgg

SEQ ID NO: 861687 - RNA, 22 nt, Mycobacterium avium subsp. paratuberculosis
cgacggugaccucgucgggcgc

SEQ ID NO: 861688 - RNA, 23 nt, Mycobacterium avium subsp. paratuberculosis
cgacggugaccucgucgggcgcc

SEQ ID NO: 861689 - RNA, 19 nt, Mycobacterium avium subsp. paratuberculosis
cgacggugagcaacaccgg

SEQ ID NO: 861690 - RNA, 22 nt, Mycobacterium avium subsp. paratuberculosis
cgacggugagcaacaccggcac

SEQ ID NO: 861691 - RNA, 15 nt, Mycobacterium avium subsp. paratuberculosis
cgacggugagcaccg

SEQ ID NO: 861692 - RNA, 17 nt, Mycobacterium avium subsp. paratuberculosis
cgacggugagcaccgcc

SEQ ID NO: 861693 - RNA, 20 nt, Mycobacterium avium subsp. paratuberculosis
cgacggugaugucgccggcg

SEQ ID NO: 861694 - RNA, 15 nt, Mycobacterium avium subsp. paratuberculosis
cgacggugcaugcgc

SEQ ID NO: 861695 - RNA, 20 nt, Mycobacterium avium subsp. paratuberculosis
cgacggugcaugcgcuggcg

SEQ ID NO: 861696 - RNA, 21 nt, Mycobacterium avium subsp. paratuberculosis
cgacggugcaugcgcuggcga

SEQ ID NO: 861697 - RNA, 13 nt, Mycobacterium avium subsp. paratuberculosis
cgacgggcucggc

SEQ ID NO: 861698 - RNA, 14 nt, Mycobacterium avium subsp. paratuberculosis
cgacgggcucggcg

SEQ ID NO: 861699 - RNA, 20 nt, Mycobacterium avium subsp. paratuberculosis
cgacgggcucggcguacagg

SEQ ID NO: 861700 - RNA, 18 nt, Mycobacterium avium subsp. paratuberculosis
cgacgggcugcugcacgu

SEQ ID NO: 861701 - RNA, 20 nt, Mycobacterium avium subsp. paratuberculosis
cgacgggcugucccggccgc

SEQ ID NO: 861702 - RNA, 22 nt, Mycobacterium avium subsp. paratuberculosis
cgacgggcugucccggccgcga

SEQ ID NO: 861703 - RNA, 17 nt, Mycobacterium avium subsp. paratuberculosis
cgacgggcacccgcgcg

SEQ ID NO: 861704 - RNA, 20 nt, Mycobacterium avium subsp. paratuberculosis
cgacgggcacccgcgcgucg

SEQ ID NO: 861705 - RNA, 15 nt, Mycobacterium avium subsp. paratuberculosis
cgacgggccgggcac

SEQ ID NO: 861706 - RNA, 22 nt, Mycobacterium avium subsp. paratuberculosis
cgacgggccgggcacgucgacg

SEQ ID NO: 861707 - RNA, 14 nt, Mycobacterium avium subsp. paratuberculosis
cgacgggcagggug

SEQ ID NO: 861708 - RNA, 15 nt, Mycobacterium avium subsp. paratuberculosis
cgacgggcaggguga

SEQ ID NO: 861709 - RNA, 17 nt, Mycobacterium avium subsp. paratuberculosis
cgacgggcagggugacc

SEQ ID NO: 861710 - RNA, 14 nt, Mycobacterium avium subsp. paratuberculosis
cgacgggcaugccg

SEQ ID NO: 861711 - RNA, 19 nt, Mycobacterium avium subsp. paratuberculosis
cgacgggcaugccgucggc

SEQ ID NO: 861712 - RNA, 20 nt, Mycobacterium avium subsp. paratuberculosis
cgacgggcaugccgucggcg

SEQ ID NO: 861713 - RNA, 22 nt, Mycobacterium avium subsp. paratuberculosis
cgacgggcaugccgucggcgcc

SEQ ID NO: 861714 - RNA, 16 nt, Mycobacterium avium subsp. paratuberculosis
cgacgggccaccagcg

SEQ ID NO: 861715 - RNA, 18 nt, Mycobacterium avium subsp. paratuberculosis
cgacgggccaccagcgca

SEQ ID NO: 861716 - RNA, 17 nt, Mycobacterium avium subsp. paratuberculosis
cgacgggcccagcgcga

SEQ ID NO: 861717 - RNA, 19 nt, Mycobacterium avium subsp. paratuberculosis
cgacgggcccagcgcgacg

SEQ ID NO: 861718 - RNA, 12 nt, Mycobacterium avium subsp. paratuberculosis
cgacgggcccgc

SEQ ID NO: 861719 - RNA, 14 nt, Mycobacterium avium subsp. paratuberculosis
cgacgggcccgcgc

SEQ ID NO: 861720 - RNA, 13 nt, Mycobacterium avium subsp. paratuberculosis
cgacgggccgauc

SEQ ID NO: 861721 - RNA, 17 nt, Mycobacterium avium subsp. paratuberculosis
cgacgggauaguccggc

SEQ ID NO: 861722 - RNA, 23 nt, Mycobacterium avium subsp. paratuberculosis
cgacgggauccggauugccgggc

SEQ ID NO: 861723 - RNA, 19 nt, Mycobacterium avium subsp. paratuberculosis
cgacggcugcgguuggccg

SEQ ID NO: 861724 - RNA, 21 nt, Mycobacterium avium subsp. paratuberculosis
cgacggcugcgguuggccggc

SEQ ID NO: 861725 - RNA, 16 nt, Mycobacterium avium subsp. paratuberculosis
cgacgggaacucggcc

SEQ ID NO: 861726 - RNA, 18 nt, Mycobacterium avium subsp. paratuberculosis
cgacgggaacucggccag

SEQ ID NO: 861727 - RNA, 22 nt, Mycobacterium avium subsp. paratuberculosis
cgacgggaacucggccagcugg

SEQ ID NO: 861728 - RNA, 18 nt, Mycobacterium avium subsp. paratuberculosis
cgacggcguugcuggcgc

SEQ ID NO: 861729 - RNA, 20 nt, Mycobacterium avium subsp. paratuberculosis
cgacggcguugcuggcgcga

SEQ ID NO: 861730 - RNA, 22 nt, Mycobacterium avium subsp. paratuberculosis
cgacggcuccuaugucggugcg

SEQ ID NO: 861731 - RNA, 18 nt, Mycobacterium avium subsp. paratuberculosis
cgacggcugcccggcccg

SEQ ID NO: 861732 - RNA, 19 nt, Mycobacterium avium subsp. paratuberculosis
cgacggcugcccggcccgc

SEQ ID NO: 861733 - RNA, 21 nt, Mycobacterium avium subsp. paratuberculosis
cgacggcugcccggcccgccg

SEQ ID NO: 861734 - RNA, 15 nt, Mycobacterium avium subsp. paratuberculosis
cgacggcuggguggc

SEQ ID NO: 861735 - RNA, 19 nt, Mycobacterium avium subsp. paratuberculosis
cgacggcuggguggcgaaa

SEQ ID NO: 861736 - RNA, 14 nt, Mycobacterium avium subsp. paratuberculosis
cgacggcgucggcg

SEQ ID NO: 861737 - RNA, 15 nt, Mycobacterium avium subsp. paratuberculosis
cgacggcgucggcga

SEQ ID NO: 861738 - RNA, 15 nt, Mycobacterium avium subsp. paratuberculosis
cgacggcgucggcgg

SEQ ID NO: 861739 - RNA, 17 nt, Mycobacterium avium subsp. paratuberculosis
cgacggcgucggcggcc

SEQ ID NO: 861740 - RNA, 17 nt, Mycobacterium avium subsp. paratuberculosis
cgacggcggugggcucg

SEQ ID NO: 861741 - RNA, 22 nt, Mycobacterium avium subsp. paratuberculosis
cgacggcggugggcucggccau

SEQ ID NO: 861742 - RNA, 18 nt, Mycobacterium avium subsp. paratuberculosis
cgacggcgguucgaagcg

SEQ ID NO: 861743 - RNA, 14 nt, Mycobacterium avium subsp. paratuberculosis
cgacggcguccggg

SEQ ID NO: 861744 - RNA, 17 nt, Mycobacterium avium subsp. paratuberculosis
cgacggcguccgggcgc

SEQ ID NO: 861745 - RNA, 17 nt, Mycobacterium avium subsp. paratuberculosis
cgacggcggcgaagacg

SEQ ID NO: 861746 - RNA, 15 nt, Mycobacterium avium subsp. paratuberculosis
cgacggcggcguccc

SEQ ID NO: 861747 - RNA, 18 nt, Mycobacterium avium subsp. paratuberculosis
cgacggcggggugcgcgg

SEQ ID NO: 861748 - RNA, 19 nt, Mycobacterium avium subsp. paratuberculosis
cgacggcggggugcgcggc

SEQ ID NO: 861749 - RNA, 23 nt, Mycobacterium avium subsp. paratuberculosis
cgacggcggggugcgcggcgagc

SEQ ID NO: 861750 - RNA, 22 nt, Mycobacterium avium subsp. paratuberculosis
cgacggcggugacguuccagcc

SEQ ID NO: 861751 - RNA, 23 nt, Mycobacterium avium subsp. paratuberculosis
cgacggcggugacguuccagccg

SEQ ID NO: 861752 - RNA, 15 nt, Mycobacterium avium subsp. paratuberculosis
cgacggcgcgugauc

SEQ ID NO: 861753 - RNA, 19 nt, Mycobacterium avium subsp. paratuberculosis
cgacggcgcucaccggcgu

SEQ ID NO: 861754 - RNA, 20 nt, Mycobacterium avium subsp. paratuberculosis
cgacggcgcucaccggcgug

SEQ ID NO: 861755 - RNA, 21 nt, Mycobacterium avium subsp. paratuberculosis
cgacggcgcucaccggcgugg

SEQ ID NO: 861756 - RNA, 17 nt, Mycobacterium avium subsp. paratuberculosis
cgacggcgcuggccgcg

SEQ ID NO: 861757 - RNA, 19 nt, Mycobacterium avium subsp. paratuberculosis
cgacggcgcuggccgcggc

SEQ ID NO: 861758 - RNA, 21 nt, Mycobacterium avium subsp. paratuberculosis
cgacggcgcuggccgcggcca

SEQ ID NO: 861759 - RNA, 14 nt, Mycobacterium avium subsp. paratuberculosis
cgacggcgcugugg

SEQ ID NO: 861760 - RNA, 17 nt, Mycobacterium avium subsp. paratuberculosis
cgacggcgcuguggccg

SEQ ID NO: 861761 - RNA, 18 nt, Mycobacterium avium subsp. paratuberculosis
cgacggcgcuguggccgu

SEQ ID NO: 861762 - RNA, 14 nt, Mycobacterium avium subsp. paratuberculosis
cgacggcgcgcccg

SEQ ID NO: 861763 - RNA, 15 nt, Mycobacterium avium subsp. paratuberculosis
cgacggcgcgcccga

SEQ ID NO: 861764 - RNA, 21 nt, Mycobacterium avium subsp. paratuberculosis
cgacggcgcgcccgacgaugc

SEQ ID NO: 861765 - RNA, 12 nt, Mycobacterium avium subsp. paratuberculosis
cgacggcgcgcc

SEQ ID NO: 861766 - RNA, 13 nt, Mycobacterium avium subsp. paratuberculosis
cgacggcgcgccc

SEQ ID NO: 861767 - RNA, 15 nt, Mycobacterium avium subsp. paratuberculosis
cgacggcgcccgccc

SEQ ID NO: 861768 - RNA, 20 nt, Mycobacterium avium subsp. paratuberculosis
cgacggcgcccgccccgacg

SEQ ID NO: 861769 - RNA, 12 nt, Mycobacterium avium subsp. paratuberculosis
cgacggcgccgc

SEQ ID NO: 861770 - RNA, 14 nt, Mycobacterium avium subsp. paratuberculosis
cgacggcgccgccc

SEQ ID NO: 861771 - RNA, 20 nt, Mycobacterium avium subsp. paratuberculosis
cgacggcgccggugcccacg

SEQ ID NO: 861772 - RNA, 13 nt, Mycobacterium avium subsp. paratuberculosis
cgacggcgccuga

SEQ ID NO: 861773 - RNA, 14 nt, Mycobacterium avium subsp. paratuberculosis
cgacggcgccugau

SEQ ID NO: 861774 - RNA, 18 nt, Mycobacterium avium subsp. paratuberculosis
cgacggcaggucggugcg

SEQ ID NO: 861775 - RNA, 21 nt, Mycobacterium avium subsp. paratuberculosis
cgacggccaccgcgacgcugc

SEQ ID NO: 861776 - RNA, 23 nt, Mycobacterium avium subsp. paratuberculosis
cgacggccaccgcgacgcugccg

SEQ ID NO: 861777 - RNA, 14 nt, Mycobacterium avium subsp. paratuberculosis
cgacggccagaccg

SEQ ID NO: 861778 - RNA, 15 nt, Mycobacterium avium subsp. paratuberculosis
cgacggccagcgcgg

SEQ ID NO: 861779 - RNA, 18 nt, Mycobacterium avium subsp. paratuberculosis
cgacggccagcgcggcgg

SEQ ID NO: 861780 - RNA, 15 nt, Mycobacterium avium subsp. paratuberculosis
cgacggccccccggg

SEQ ID NO: 861781 - RNA, 21 nt, Mycobacterium avium subsp. paratuberculosis
cgacggccccccgggcaccag

SEQ ID NO: 861782 - RNA, 12 nt, Mycobacterium avium subsp. paratuberculosis
cgacggcccgcc

SEQ ID NO: 861783 - RNA, 14 nt, Mycobacterium avium subsp. paratuberculosis
cgacggcccgccgg

SEQ ID NO: 861784 - RNA, 16 nt, Mycobacterium avium subsp. paratuberculosis
cgacggcccgccggag

SEQ ID NO: 861785 - RNA, 19 nt, Mycobacterium avium subsp. paratuberculosis
cgacggcccgccggagccg

SEQ ID NO: 861786 - RNA, 20 nt, Mycobacterium avium subsp. paratuberculosis
cgacggcccgccggagccga

SEQ ID NO: 861787 - RNA, 12 nt, Mycobacterium avium subsp. paratuberculosis
cgacggccagcu

SEQ ID NO: 861788 - RNA, 13 nt, Mycobacterium avium subsp. paratuberculosis
cgacggccagcug

SEQ ID NO: 861789 - RNA, 14 nt, Mycobacterium avium subsp. paratuberculosis
cgacggccagcuga

SEQ ID NO: 861790 - RNA, 23 nt, Mycobacterium avium subsp. paratuberculosis
cgacggcauugcagcggaugccg

SEQ ID NO: 861791 - RNA, 22 nt, Mycobacterium avium subsp. paratuberculosis
cgacgcuucguggacgaacgcg

SEQ ID NO: 861792 - RNA, 20 nt, Mycobacterium avium subsp. paratuberculosis
cgacggcaauccggccccgc

SEQ ID NO: 861793 - RNA, 21 nt, Mycobacterium avium subsp. paratuberculosis
cgacggcaauccggccccgcu

SEQ ID NO: 861794 - RNA, 22 nt, Mycobacterium avium subsp. paratuberculosis
cgacggcaauccggccccgcug

SEQ ID NO: 861795 - RNA, 23 nt, Mycobacterium avium subsp. paratuberculosis
cgacggcaauccggccccgcugc

SEQ ID NO: 861796 - RNA, 23 nt, Mycobacterium avium subsp. paratuberculosis
cgacggauaacucuacugcugcg

SEQ ID NO: 861797 - RNA, 14 nt, Mycobacterium avium subsp. paratuberculosis
cgacggcacccggc

SEQ ID NO: 861798 - RNA, 15 nt, Mycobacterium avium subsp. paratuberculosis
cgacggcacccggcc

SEQ ID NO: 861799 - RNA, 13 nt, Mycobacterium avium subsp. paratuberculosis
cgacggcagcacc

SEQ ID NO: 861800 - RNA, 15 nt, Mycobacterium avium subsp. paratuberculosis
cgacggcagcaccuc

SEQ ID NO: 861801 - RNA, 13 nt, Mycobacterium avium subsp. paratuberculosis
cgacggcagcgcg

SEQ ID NO: 861802 - RNA, 16 nt, Mycobacterium avium subsp. paratuberculosis
cgacggcagcgcgauc

SEQ ID NO: 861803 - RNA, 18 nt, Mycobacterium avium subsp. paratuberculosis
cgacggcagcgcgauccg

SEQ ID NO: 861804 - RNA, 23 nt, Mycobacterium avium subsp. paratuberculosis
cgacggcagcggcaccaacccga

SEQ ID NO: 861805 - RNA, 15 nt, Mycobacterium avium subsp. paratuberculosis
cgacggccugcacgu

SEQ ID NO: 861806 - RNA, 14 nt, Mycobacterium avium subsp. paratuberculosis
cgacggccucgccg

SEQ ID NO: 861807 - RNA, 17 nt, Mycobacterium avium subsp. paratuberculosis
cgacggccucgccgucg

SEQ ID NO: 861808 - RNA, 21 nt, Mycobacterium avium subsp. paratuberculosis
cgacggccucgccgucgcgau

SEQ ID NO: 861809 - RNA, 16 nt, Mycobacterium avium subsp. paratuberculosis
cgacggccgcacccca

SEQ ID NO: 861810 - RNA, 23 nt, Mycobacterium avium subsp. paratuberculosis
cgacggccggcgucacucuggcg

SEQ ID NO: 861811 - RNA, 13 nt, Mycobacterium avium subsp. paratuberculosis
cgacggccggggc

SEQ ID NO: 861812 - RNA, 19 nt, Mycobacterium avium subsp. paratuberculosis
cgacggccggggccagcac

SEQ ID NO: 861813 - RNA, 21 nt, Mycobacterium avium subsp. paratuberculosis
cgacggccggggccagcaccc

SEQ ID NO: 861814 - RNA, 15 nt, Mycobacterium avium subsp. paratuberculosis
cgacggccgggucag

SEQ ID NO: 861815 - RNA, 14 nt, Mycobacterium avium subsp. paratuberculosis
cgacggccguccgg

SEQ ID NO: 861816 - RNA, 17 nt, Mycobacterium avium subsp. paratuberculosis
cgacggccguccggucg

SEQ ID NO: 861817 - RNA, 13 nt, Mycobacterium avium subsp. paratuberculosis
cgacggccgccga

SEQ ID NO: 861818 - RNA, 15 nt, Mycobacterium avium subsp. paratuberculosis
cgacggccgccgcga

SEQ ID NO: 861819 - RNA, 17 nt, Mycobacterium avium subsp. paratuberculosis
cgacggccgccgcgacg

SEQ ID NO: 861820 - RNA, 18 nt, Mycobacterium avium subsp. paratuberculosis
cgacggccgccgcgacgc

SEQ ID NO: 861821 - RNA, 20 nt, Mycobacterium avium subsp. paratuberculosis
cgacggccgccgcgacgccg

SEQ ID NO: 861822 - RNA, 13 nt, Mycobacterium avium subsp. paratuberculosis
cgacggccgcgcc

SEQ ID NO: 861823 - RNA, 14 nt, Mycobacterium avium subsp. paratuberculosis
cgacggccgcgccg

SEQ ID NO: 861824 - RNA, 13 nt, Mycobacterium avium subsp. paratuberculosis
cgacggcgaacgg

SEQ ID NO: 861825 - RNA, 18 nt, Mycobacterium avium subsp. paratuberculosis
cgacggcgaacgucgaug

SEQ ID NO: 861826 - RNA, 14 nt, Mycobacterium avium subsp. paratuberculosis
cgacggcgaagccg

SEQ ID NO: 861827 - RNA, 15 nt, Mycobacterium avium subsp. paratuberculosis
cgacggcgaagccgg

SEQ ID NO: 861828 - RNA, 18 nt, Mycobacterium avium subsp. paratuberculosis
cgacggcgaagccggcgu

SEQ ID NO: 861829 - RNA, 14 nt, Mycobacterium avium subsp. paratuberculosis
cgacggcgaccaca

SEQ ID NO: 861830 - RNA, 17 nt, Mycobacterium avium subsp. paratuberculosis
cgacggcgaccacaccg

SEQ ID NO: 861831 - RNA, 22 nt, Mycobacterium avium subsp. paratuberculosis
cgacggcgaccacaccgucgac

SEQ ID NO: 861832 - RNA, 20 nt, Mycobacterium avium subsp. paratuberculosis
cgacggcgaccauccacucg

SEQ ID NO: 861833 - RNA, 17 nt, Mycobacterium avium subsp. paratuberculosis
cgacggcgacggcgucc

SEQ ID NO: 861834 - RNA, 14 nt, Mycobacterium avium subsp. paratuberculosis
cgacggcgagccgg

SEQ ID NO: 861835 - RNA, 18 nt, Mycobacterium avium subsp. paratuberculosis
cgacggcgagccgggccg

SEQ ID NO: 861836 - RNA, 19 nt, Mycobacterium avium subsp. paratuberculosis
cgacggcgagccgggccgg

SEQ ID NO: 861837 - RNA, 16 nt, Mycobacterium avium subsp. paratuberculosis
cgacggcgccgcccgg

SEQ ID NO: 861838 - RNA, 17 nt, Mycobacterium avium subsp. paratuberculosis
cgacggcgccgcccggg

SEQ ID NO: 861839 - RNA, 19 nt, Mycobacterium avium subsp. paratuberculosis
cgacggcgccgcccgggcc

SEQ ID NO: 861840 - RNA, 21 nt, Mycobacterium avium subsp. paratuberculosis
cgacggcgccgcccgggcccg

SEQ ID NO: 861841 - RNA, 15 nt, Mycobacterium avium subsp. paratuberculosis
cgacggcgccgcggc

SEQ ID NO: 861842 - RNA, 17 nt, Mycobacterium avium subsp. paratuberculosis
cgacggcgccgcgucgg

SEQ ID NO: 861843 - RNA, 18 nt, Mycobacterium avium subsp. paratuberculosis
cgacggcgccgcgucgga

SEQ ID NO: 861844 - RNA, 12 nt, Mycobacterium avium subsp. paratuberculosis
cgacgccagcug

SEQ ID NO: 861845 - RNA, 19 nt, Mycobacterium avium subsp. paratuberculosis
cgacgccagcugccgcgac

SEQ ID NO: 861846 - RNA, 20 nt, Mycobacterium avium subsp. paratuberculosis
cgacgccaguucgucggccg

SEQ ID NO: 861847 - RNA, 23 nt, Mycobacterium avium subsp. paratuberculosis
cgacgccaguucgucggccgucg

SEQ ID NO: 861848 - RNA, 14 nt, Mycobacterium avium subsp. paratuberculosis
cgacgccagcaccu

SEQ ID NO: 861849 - RNA, 12 nt, Mycobacterium avium subsp. paratuberculosis
cgacgccagcgg

SEQ ID NO: 861850 - RNA, 13 nt, Mycobacterium avium subsp. paratuberculosis
cgacgccagcggc

SEQ ID NO: 861851 - RNA, 18 nt, Mycobacterium avium subsp. paratuberculosis
cgacgccagcggcagcgc

SEQ ID NO: 861852 - RNA, 14 nt, Mycobacterium avium subsp. paratuberculosis
cgacgccacgucgu

SEQ ID NO: 861853 - RNA, 16 nt, Mycobacterium avium subsp. paratuberculosis
cgacgccacgucguuc

SEQ ID NO: 861854 - RNA, 20 nt, Mycobacterium avium subsp. paratuberculosis
cgacgccagaaccggcaaca

SEQ ID NO: 861855 - RNA, 23 nt, Mycobacterium avium subsp. paratuberculosis
cgacgccaacaacuacgagcagc

SEQ ID NO: 861856 - RNA, 24 nt, Mycobacterium avium subsp. paratuberculosis
cgacgccaacaacuacgagcagca

SEQ ID NO: 861857 - RNA, 16 nt, Mycobacterium avium subsp. paratuberculosis
cgacgcauguccgccg

SEQ ID NO: 861858 - RNA, 17 nt, Mycobacterium avium subsp. paratuberculosis
cgacgcauguccgccgu

SEQ ID NO: 861859 - RNA, 21 nt, Mycobacterium avium subsp. paratuberculosis
cgacgcauguccgccgucauc

SEQ ID NO: 861860 - RNA, 13 nt, Mycobacterium avium subsp. paratuberculosis
cgacgauugucgg

SEQ ID NO: 861861 - RNA, 18 nt, Mycobacterium avium subsp. paratuberculosis
cgacgauugucggggccg

SEQ ID NO: 861862 - RNA, 21 nt, Mycobacterium avium subsp. paratuberculosis
cgacgauugugugccaagcgg

SEQ ID NO: 861863 - RNA, 23 nt, Mycobacterium avium subsp. paratuberculosis
cgacgaugucgaaacccaggaac

SEQ ID NO: 861864 - RNA, 14 nt, Mycobacterium avium subsp. paratuberculosis
cgacgaugucgacc

SEQ ID NO: 861865 - RNA, 23 nt, Mycobacterium avium subsp. paratuberculosis
cgacgaugucgacccgcggcgcc

SEQ ID NO: 861866 - RNA, 24 nt, Mycobacterium avium subsp. paratuberculosis
cgacgaugucgacccgcggcgccg

SEQ ID NO: 861867 - RNA, 16 nt, Mycobacterium avium subsp. paratuberculosis
cgacgaugucgacgcc

SEQ ID NO: 861868 - RNA, 17 nt, Mycobacterium avium subsp. paratuberculosis
cgacgauguuggcgacg

SEQ ID NO: 861869 - RNA, 23 nt, Mycobacterium avium subsp. paratuberculosis
cgacgauguuggcgacgacggcg

SEQ ID NO: 861870 - RNA, 18 nt, Mycobacterium avium subsp. paratuberculosis
cgacgcugagcgccaggc

SEQ ID NO: 861871 - RNA, 15 nt, Mycobacterium avium subsp. paratuberculosis
cgacgcugccggggc

SEQ ID NO: 861872 - RNA, 17 nt, Mycobacterium avium subsp. paratuberculosis
cgacgcugugcucggga

SEQ ID NO: 861873 - RNA, 19 nt, Mycobacterium avium subsp. paratuberculosis
cgacgcugugcucgggagu

SEQ ID NO: 861874 - RNA, 21 nt, Mycobacterium avium subsp. paratuberculosis
cgacgcugcagguggcccaca

SEQ ID NO: 861875 - RNA, 22 nt, Mycobacterium avium subsp. paratuberculosis
cgacgcugcagguggcccacac

SEQ ID NO: 861876 - RNA, 15 nt, Mycobacterium avium subsp. paratuberculosis
cgacggacgggucgu

SEQ ID NO: 861877 - RNA, 15 nt, Mycobacterium avium subsp. paratuberculosis
cgacggagacgacca

SEQ ID NO: 861878 - RNA, 17 nt, Mycobacterium avium subsp. paratuberculosis
cgacggagacgaccagg

SEQ ID NO: 861879 - RNA, 16 nt, Mycobacterium avium subsp. paratuberculosis
cgacggagacgacgac

SEQ ID NO: 861880 - RNA, 22 nt, Mycobacterium avium subsp. paratuberculosis
cgacggagacgacgacgaacgc

SEQ ID NO: 861881 - RNA, 22 nt, Mycobacterium avium subsp. paratuberculosis
cgacggagccgagcaccaggcg

SEQ ID NO: 861882 - RNA, 17 nt, Mycobacterium avium subsp. paratuberculosis
cgacggagucgucggcg

SEQ ID NO: 861883 - RNA, 13 nt, Mycobacterium avium subsp. paratuberculosis
cgacggaucggcc

SEQ ID NO: 861884 - RNA, 17 nt, Mycobacterium avium subsp. paratuberculosis
cgacggaucggccgcgu

SEQ ID NO: 861885 - RNA, 20 nt, Mycobacterium avium subsp. paratuberculosis
cgacggaucggccgcgucgg

SEQ ID NO: 861886 - RNA, 23 nt, Mycobacterium avium subsp. paratuberculosis
cgacggaucggccgcgucgggca

SEQ ID NO: 861887 - RNA, 19 nt, Mycobacterium avium subsp. paratuberculosis
ccgggccgucaucgccgac

SEQ ID NO: 861888 - RNA, 12 nt, Mycobacterium avium subsp. paratuberculosis
ccgggccguccg

SEQ ID NO: 861889 - RNA, 17 nt, Mycobacterium avium subsp. paratuberculosis
ccgggccguccgggugc

SEQ ID NO: 861890 - RNA, 15 nt, Mycobacterium avium subsp. paratuberculosis
ccgggccggccagac

SEQ ID NO: 861891 - RNA, 16 nt, Mycobacterium avium subsp. paratuberculosis
ccgggccggcggccag

SEQ ID NO: 861892 - RNA, 18 nt, Mycobacterium avium subsp. paratuberculosis
ccgggccggcggccaguu

SEQ ID NO: 861893 - RNA, 21 nt, Mycobacterium avium subsp. paratuberculosis
ccgggccggcggccaguucga

SEQ ID NO: 861894 - RNA, 13 nt, Mycobacterium avium subsp. paratuberculosis
ccgggccggcguc

SEQ ID NO: 861895 - RNA, 18 nt, Mycobacterium avium subsp. paratuberculosis
ccgggccggcgucgcggu

SEQ ID NO: 861896 - RNA, 17 nt, Mycobacterium avium subsp. paratuberculosis
ccgggccgccgcggaca

SEQ ID NO: 861897 - RNA, 18 nt, Mycobacterium avium subsp. paratuberculosis
ccgggccgccgcggccac

SEQ ID NO: 861898 - RNA, 16 nt, Mycobacterium avium subsp. paratuberculosis
ccgggccgccggccgc

SEQ ID NO: 861899 - RNA, 19 nt, Mycobacterium avium subsp. paratuberculosis
ccgggccgccggccgcggc

SEQ ID NO: 861900 - RNA, 20 nt, Mycobacterium avium subsp. paratuberculosis
ccgggccgccggccgcggcg

SEQ ID NO: 861901 - RNA, 22 nt, Mycobacterium avium subsp. paratuberculosis
ccgggccgccggccgcggcgug

SEQ ID NO: 861902 - RNA, 22 nt, Mycobacterium avium subsp. paratuberculosis
ccgggccgccucgaagucgccg

SEQ ID NO: 861903 - RNA, 23 nt, Mycobacterium avium subsp. paratuberculosis
ccgggccgccuucuccgggucgc

SEQ ID NO: 861904 - RNA, 14 nt, Mycobacterium avium subsp. paratuberculosis
ccgggccgcggcgg

SEQ ID NO: 861905 - RNA, 13 nt, Mycobacterium avium subsp. paratuberculosis
ccgggccgcuggu

SEQ ID NO: 861906 - RNA, 23 nt, Mycobacterium avium subsp. paratuberculosis
ccgggccgcuggugaggucgcgc

SEQ ID NO: 861907 - RNA, 18 nt, Mycobacterium avium subsp. paratuberculosis
ccgggccggaacgcccga

SEQ ID NO: 861908 - RNA, 17 nt, Mycobacterium avium subsp. paratuberculosis
ccgggccggacacggcu

SEQ ID NO: 861909 - RNA, 15 nt, Mycobacterium avium subsp. paratuberculosis
ccgggccggaggugc

SEQ ID NO: 861910 - RNA, 16 nt, Mycobacterium avium subsp. paratuberculosis
ccgggcagugcgcggc

SEQ ID NO: 861911 - RNA, 22 nt, Mycobacterium avium subsp. paratuberculosis
ccgggcaguuccuugcgcagca

SEQ ID NO: 861912 - RNA, 17 nt, Mycobacterium avium subsp. paratuberculosis
ccgggcaucccgccgaa

SEQ ID NO: 861913 - RNA, 21 nt, Mycobacterium avium subsp. paratuberculosis
ccgggcaucccgccgaacccg

SEQ ID NO: 861914 - RNA, 14 nt, Mycobacterium avium subsp. paratuberculosis
ccgggcauccgggc

SEQ ID NO: 861915 - RNA, 18 nt, Mycobacterium avium subsp. paratuberculosis
ccgggcauccgggccgcc

SEQ ID NO: 861916 - RNA, 19 nt, Mycobacterium avium subsp. paratuberculosis
ccgggcauccgggccgccg

SEQ ID NO: 861917 - RNA, 20 nt, Mycobacterium avium subsp. paratuberculosis
ccgggcauccgggccgccgc

SEQ ID NO: 861918 - RNA, 18 nt, Mycobacterium avium subsp. paratuberculosis
ccgggcagcccgccgcgg

SEQ ID NO: 861919 - RNA, 13 nt, Mycobacterium avium subsp. paratuberculosis
ccgggcagcgcgc

SEQ ID NO: 861920 - RNA, 21 nt, Mycobacterium avium subsp. paratuberculosis
ccgggcagcgcgcgagacacc

SEQ ID NO: 861921 - RNA, 15 nt, Mycobacterium avium subsp. paratuberculosis
ccgggcagcggcccc

SEQ ID NO: 861922 - RNA, 18 nt, Mycobacterium avium subsp. paratuberculosis
ccgggcagguggucggcg

SEQ ID NO: 861923 - RNA, 22 nt, Mycobacterium avium subsp. paratuberculosis
ccgggcagguggucggcgaacu

SEQ ID NO: 861924 - RNA, 13 nt, Mycobacterium avium subsp. paratuberculosis
ccgggcaggcggc

SEQ ID NO: 861925 - RNA, 21 nt, Mycobacterium avium subsp. paratuberculosis
ccgggcagcuuccgccucggc

SEQ ID NO: 861926 - RNA, 19 nt, Mycobacterium avium subsp. paratuberculosis
ccgggcaggaugccgcguu

SEQ ID NO: 861927 - RNA, 15 nt, Mycobacterium avium subsp. paratuberculosis
ccgggcagccgcaca

SEQ ID NO: 861928 - RNA, 18 nt, Mycobacterium avium subsp. paratuberculosis
ccgggcagccgcacaccg

SEQ ID NO: 861929 - RNA, 16 nt, Mycobacterium avium subsp. paratuberculosis
ccggcuggugcagcag

SEQ ID NO: 861930 - RNA, 20 nt, Mycobacterium avium subsp. paratuberculosis
ccggcuuccgagacgugguc

SEQ ID NO: 861931 - RNA, 20 nt, Mycobacterium avium subsp. paratuberculosis
ccggcuucaccgucagggug

SEQ ID NO: 861932 - RNA, 15 nt, Mycobacterium avium subsp. paratuberculosis
ccggcuuaccgaccu

SEQ ID NO: 861933 - RNA, 20 nt, Mycobacterium avium subsp. paratuberculosis
ccgggauaacccagcaccac

SEQ ID NO: 861934 - RNA, 15 nt, Mycobacterium avium subsp. paratuberculosis
ccgggauaccgcgac

SEQ ID NO: 861935 - RNA, 16 nt, Mycobacterium avium subsp. paratuberculosis
ccgggauaccgcgacc

SEQ ID NO: 861936 - RNA, 17 nt, Mycobacterium avium subsp. paratuberculosis
ccgggauaccgcgaccg

SEQ ID NO: 861937 - RNA, 14 nt, Mycobacterium avium subsp. paratuberculosis
ccggcuucgccgcc

SEQ ID NO: 861938 - RNA, 15 nt, Mycobacterium avium subsp. paratuberculosis
ccggcuucgccgccg

SEQ ID NO: 861939 - RNA, 16 nt, Mycobacterium avium subsp. paratuberculosis
ccggcuucgccgccgc

SEQ ID NO: 861940 - RNA, 15 nt, Mycobacterium avium subsp. paratuberculosis
ccggcuucgccgcgc

SEQ ID NO: 861941 - RNA, 17 nt, Mycobacterium avium subsp. paratuberculosis
ccggcuucgccgcgcuu

SEQ ID NO: 861942 - RNA, 16 nt, Mycobacterium avium subsp. paratuberculosis
ccggcuucgcugcgcc

SEQ ID NO: 861943 - RNA, 19 nt, Mycobacterium avium subsp. paratuberculosis
ccggcuucgcugcgccggc

SEQ ID NO: 861944 - RNA, 20 nt, Mycobacterium avium subsp. paratuberculosis
ccggcuucgggaucagcggg

SEQ ID NO: 861945 - RNA, 21 nt, Mycobacterium avium subsp. paratuberculosis
ccggcuucgggaucagcggga

SEQ ID NO: 861946 - RNA, 19 nt, Mycobacterium avium subsp. paratuberculosis
ccgggagaaccucaacgug

SEQ ID NO: 861947 - RNA, 17 nt, Mycobacterium avium subsp. paratuberculosis
ccgggagacguccugug

SEQ ID NO: 861948 - RNA, 21 nt, Mycobacterium avium subsp. paratuberculosis
ccgggagauacggucgcaccg

SEQ ID NO: 861949 - RNA, 13 nt, Mycobacterium avium subsp. paratuberculosis
ccgggagcaucgg

SEQ ID NO: 861950 - RNA, 15 nt, Mycobacterium avium subsp. paratuberculosis
ccgggaucacacgcg

SEQ ID NO: 861951 - RNA, 17 nt, Mycobacterium avium subsp. paratuberculosis
ccgggauagagcaccgc

SEQ ID NO: 861952 - RNA, 17 nt, Mycobacterium avium subsp. paratuberculosis
ccgggauaguucgccgc

SEQ ID NO: 861953 - RNA, 18 nt, Mycobacterium avium subsp. paratuberculosis
ccgggauaguucgccgcc

SEQ ID NO: 861954 - RNA, 22 nt, Mycobacterium avium subsp. paratuberculosis
ccgggauaguucgccgccgcca

SEQ ID NO: 861955 - RNA, 20 nt, Mycobacterium avium subsp. paratuberculosis
ccgggaucacccucggcguc

SEQ ID NO: 861956 - RNA, 14 nt, Mycobacterium avium subsp. paratuberculosis
ccgggauccgaggc

SEQ ID NO: 861957 - RNA, 18 nt, Mycobacterium avium subsp. paratuberculosis
ccgggauccgaggcguca

SEQ ID NO: 861958 - RNA, 17 nt, Mycobacterium avium subsp. paratuberculosis
ccgggauccggcgcgcc

SEQ ID NO: 861959 - RNA, 14 nt, Mycobacterium avium subsp. paratuberculosis
ccgggaucggcagc

SEQ ID NO: 861960 - RNA, 16 nt, Mycobacterium avium subsp. paratuberculosis
ccgggaucggcagcgc

SEQ ID NO: 861961 - RNA, 18 nt, Mycobacterium avium subsp. paratuberculosis
ccgggaucggcagcgcgc

SEQ ID NO: 861962 - RNA, 18 nt, Mycobacterium avium subsp. paratuberculosis
ccgggaucggcggggcgc

SEQ ID NO: 861963 - RNA, 20 nt, Mycobacterium avium subsp. paratuberculosis
ccgggaucggggugccgccg

SEQ ID NO: 861964 - RNA, 19 nt, Mycobacterium avium subsp. paratuberculosis
ccgggaucguguggccgcc

SEQ ID NO: 861965 - RNA, 19 nt, Mycobacterium avium subsp. paratuberculosis
ccgggaucuggccggugag

SEQ ID NO: 861966 - RNA, 15 nt, Mycobacterium avium subsp. paratuberculosis
ccgggauggacgacg

SEQ ID NO: 861967 - RNA, 12 nt, Mycobacterium avium subsp. paratuberculosis
ccgggauggcgu

SEQ ID NO: 861968 - RNA, 17 nt, Mycobacterium avium subsp. paratuberculosis
ccgggauggcguucugc

SEQ ID NO: 861969 - RNA, 14 nt, Mycobacterium avium subsp. paratuberculosis
ccgggaugccaguc

SEQ ID NO: 861970 - RNA, 19 nt, Mycobacterium avium subsp. paratuberculosis
ccgggauuucccgggcgau

SEQ ID NO: 861971 - RNA, 19 nt, Mycobacterium avium subsp. paratuberculosis
ccgggcaacagcgcgccgg

SEQ ID NO: 861972 - RNA, 22 nt, Mycobacterium avium subsp. paratuberculosis
ccgggcaacagcgcgccggccg

SEQ ID NO: 861973 - RNA, 23 nt, Mycobacterium avium subsp. paratuberculosis
ccgggcaacagcgcgccggccgg

SEQ ID NO: 861974 - RNA, 24 nt, Mycobacterium avium subsp. paratuberculosis
ccgggcaacagcgcgccggccggc

SEQ ID NO: 861975 - RNA, 18 nt, Mycobacterium avium subsp. paratuberculosis
ccgggaugacaccgcgga

SEQ ID NO: 861976 - RNA, 15 nt, Mycobacterium avium subsp. paratuberculosis
ccgggaugccgccgg

SEQ ID NO: 861977 - RNA, 16 nt, Mycobacterium avium subsp. paratuberculosis
ccgggaugccgccggu

SEQ ID NO: 861978 - RNA, 18 nt, Mycobacterium avium subsp. paratuberculosis
ccgggaugcgccaccgac

SEQ ID NO: 861979 - RNA, 20 nt, Mycobacterium avium subsp. paratuberculosis
ccgggaugcgccaccgacac

SEQ ID NO: 861980 - RNA, 17 nt, Mycobacterium avium subsp. paratuberculosis
ccgggauggugaccagc

SEQ ID NO: 861981 - RNA, 18 nt, Mycobacterium avium subsp. paratuberculosis
ccgggauggugaccagcg

SEQ ID NO: 861982 - RNA, 20 nt, Mycobacterium avium subsp. paratuberculosis
ccgggauggugaccagcgcc

SEQ ID NO: 861983 - RNA, 21 nt, Mycobacterium avium subsp. paratuberculosis
ccgggauggugaccagcgccc

SEQ ID NO: 861984 - RNA, 14 nt, Mycobacterium avium subsp. paratuberculosis
ccgggauggugagc

SEQ ID NO: 861985 - RNA, 18 nt, Mycobacterium avium subsp. paratuberculosis
ccgggcgagcgucgccgc

SEQ ID NO: 861986 - RNA, 17 nt, Mycobacterium avium subsp. paratuberculosis
ccgggcgaucagcccgc

SEQ ID NO: 861987 - RNA, 21 nt, Mycobacterium avium subsp. paratuberculosis
ccgggcgaucagcccgcccac

SEQ ID NO: 861988 - RNA, 18 nt, Mycobacterium avium subsp. paratuberculosis
ccgggcgaucauccaggu

SEQ ID NO: 861989 - RNA, 17 nt, Mycobacterium avium subsp. paratuberculosis
ccgggcgauggugccgc

SEQ ID NO: 861990 - RNA, 23 nt, Mycobacterium avium subsp. paratuberculosis
ccgggcgauggugccgccgguga

SEQ ID NO: 861991 - RNA, 18 nt, Mycobacterium avium subsp. paratuberculosis
ccgggcgccacgcuggcg

SEQ ID NO: 861992 - RNA, 20 nt, Mycobacterium avium subsp. paratuberculosis
ccgggcgccacgcuggcgug

SEQ ID NO: 861993 - RNA, 19 nt, Mycobacterium avium subsp. paratuberculosis
ccgggcgccauccgcagcc

SEQ ID NO: 861994 - RNA, 21 nt, Mycobacterium avium subsp. paratuberculosis
ccgggcgccauccgcagcccg

SEQ ID NO: 861995 - RNA, 12 nt, Mycobacterium avium subsp. paratuberculosis
ccgggcgccccg

SEQ ID NO: 861996 - RNA, 17 nt, Mycobacterium avium subsp. paratuberculosis
ccgggcgccccgacauc

SEQ ID NO: 861997 - RNA, 13 nt, Mycobacterium avium subsp. paratuberculosis
ccgggcgcccgag

SEQ ID NO: 861998 - RNA, 13 nt, Mycobacterium avium subsp. paratuberculosis
ccgggcgcccgcg

SEQ ID NO: 861999 - RNA, 18 nt, Mycobacterium avium subsp. paratuberculosis
ccgggccguucagcgggc

SEQ ID NO: 862000 - RNA, 13 nt, Mycobacterium avium subsp. paratuberculosis
ccgggcgaccccg

SEQ ID NO: 862001 - RNA, 21 nt, Mycobacterium avium subsp. paratuberculosis
ccgggcgaccccggccaggau

SEQ ID NO: 862002 - RNA, 20 nt, Mycobacterium avium subsp. paratuberculosis
ccgggcgaccgucuucuuca

SEQ ID NO: 862003 - RNA, 15 nt, Mycobacterium avium subsp. paratuberculosis
ccgggcgaacgucgg

SEQ ID NO: 862004 - RNA, 21 nt, Mycobacterium avium subsp. paratuberculosis
ccgggcgaagucgccggccag

SEQ ID NO: 862005 - RNA, 23 nt, Mycobacterium avium subsp. paratuberculosis
ccgggccuugacggccugggcga

SEQ ID NO: 862006 - RNA, 16 nt, Mycobacterium avium subsp. paratuberculosis
ccgggccuuggccaac

SEQ ID NO: 862007 - RNA, 19 nt, Mycobacterium avium subsp. paratuberculosis
ccgggccuuggccaacgcg

SEQ ID NO: 862008 - RNA, 13 nt, Mycobacterium avium subsp. paratuberculosis
ccgggccugucca

SEQ ID NO: 862009 - RNA, 21 nt, Mycobacterium avium subsp. paratuberculosis
ccgggccuguuucugcgccuu

SEQ ID NO: 862010 - RNA, 15 nt, Mycobacterium avium subsp. paratuberculosis
ccgggccugcgcgcc

SEQ ID NO: 862011 - RNA, 16 nt, Mycobacterium avium subsp. paratuberculosis
ccgggccugcgcgccg

SEQ ID NO: 862012 - RNA, 18 nt, Mycobacterium avium subsp. paratuberculosis
ccgggccugcggcggccg

SEQ ID NO: 862013 - RNA, 21 nt, Mycobacterium avium subsp. paratuberculosis
ccgggccugcggcggccgcag

SEQ ID NO: 862014 - RNA, 22 nt, Mycobacterium avium subsp. paratuberculosis
ccgggcguagugcagcugcagc

SEQ ID NO: 862015 - RNA, 23 nt, Mycobacterium avium subsp. paratuberculosis
ccgggcguagugcagcugcagcg

SEQ ID NO: 862016 - RNA, 24 nt, Mycobacterium avium subsp. paratuberculosis
ccgggcguagugcagcugcagcga

SEQ ID NO: 862017 - RNA, 12 nt, Mycobacterium avium subsp. paratuberculosis
ccgggcgucacg

SEQ ID NO: 862018 - RNA, 17 nt, Mycobacterium avium subsp. paratuberculosis
ccgggcgucacgccagc

SEQ ID NO: 862019 - RNA, 22 nt, Mycobacterium avium subsp. paratuberculosis
ccgggcgucacucuggcgugac

SEQ ID NO: 862020 - RNA, 15 nt, Mycobacterium avium subsp. paratuberculosis
ccgggcgucggcggu

SEQ ID NO: 862021 - RNA, 22 nt, Mycobacterium avium subsp. paratuberculosis
ccgggcgucggcggugguccgc

SEQ ID NO: 862022 - RNA, 16 nt, Mycobacterium avium subsp. paratuberculosis
ccgggcgucggggccc

SEQ ID NO: 862023 - RNA, 22 nt, Mycobacterium avium subsp. paratuberculosis
ccgggcgucggggcccuccgcg

SEQ ID NO: 862024 - RNA, 19 nt, Mycobacterium avium subsp. paratuberculosis
ccgggcgugccggacaccg

SEQ ID NO: 862025 - RNA, 21 nt, Mycobacterium avium subsp. paratuberculosis
ccgggcgugccggacaccggc

SEQ ID NO: 862026 - RNA, 14 nt, Mycobacterium avium subsp. paratuberculosis
ccgggcgucgacga

SEQ ID NO: 862027 - RNA, 15 nt, Mycobacterium avium subsp. paratuberculosis
ccgggcguucccgcg

SEQ ID NO: 862028 - RNA, 17 nt, Mycobacterium avium subsp. paratuberculosis
ccgggcguugcccgccg

SEQ ID NO: 862029 - RNA, 18 nt, Mycobacterium avium subsp. paratuberculosis
ccgggcguugcccgccgc

SEQ ID NO: 862030 - RNA, 20 nt, Mycobacterium avium subsp. paratuberculosis
ccgggcguugcccgccgcgg

SEQ ID NO: 862031 - RNA, 21 nt, Mycobacterium avium subsp. paratuberculosis
ccgggcguugcccgccgcggc

SEQ ID NO: 862032 - RNA, 23 nt, Mycobacterium avium subsp. paratuberculosis
ccgggcguugcccgccgcggcga

SEQ ID NO: 862033 - RNA, 19 nt, Mycobacterium avium subsp. paratuberculosis
ccgggcucggucaccccgg

SEQ ID NO: 862034 - RNA, 23 nt, Mycobacterium avium subsp. paratuberculosis
ccgggcugcacgcugcgcacccg

SEQ ID NO: 862035 - RNA, 15 nt, Mycobacterium avium subsp. paratuberculosis
ccgggcugcagcagc

SEQ ID NO: 862036 - RNA, 14 nt, Mycobacterium avium subsp. paratuberculosis
ccgggcugacccgg

SEQ ID NO: 862037 - RNA, 17 nt, Mycobacterium avium subsp. paratuberculosis
ccgggcugaccgucgac

SEQ ID NO: 862038 - RNA, 19 nt, Mycobacterium avium subsp. paratuberculosis
ccgggcugagcugugccgc

SEQ ID NO: 862039 - RNA, 17 nt, Mycobacterium avium subsp. paratuberculosis
ccgggcuccagcggguc

SEQ ID NO: 862040 - RNA, 17 nt, Mycobacterium avium subsp. paratuberculosis
ccgggcuccgcguucga

SEQ ID NO: 862041 - RNA, 18 nt, Mycobacterium avium subsp. paratuberculosis
ccgggcucgagcaccgaa

SEQ ID NO: 862042 - RNA, 21 nt, Mycobacterium avium subsp. paratuberculosis
ccgggcucgagggcggcgacc

SEQ ID NO: 862043 - RNA, 23 nt, Mycobacterium avium subsp. paratuberculosis
ccgggcucgagggcggcgaccug

SEQ ID NO: 862044 - RNA, 23 nt, Mycobacterium avium subsp. paratuberculosis
ccgggcuaagucguugcccgcca

SEQ ID NO: 862045 - RNA, 24 nt, Mycobacterium avium subsp. paratuberculosis
ccgggcuaagucguugcccgccag

SEQ ID NO: 862046 - RNA, 19 nt, Mycobacterium avium subsp. paratuberculosis
ccgggcuaucgcccggcgc

SEQ ID NO: 862047 - RNA, 15 nt, Mycobacterium avium subsp. paratuberculosis
ccgggcugccguaga

SEQ ID NO: 862048 - RNA, 14 nt, Mycobacterium avium subsp. paratuberculosis
ccgggcugcgcagc

SEQ ID NO: 862049 - RNA, 18 nt, Mycobacterium avium subsp. paratuberculosis
ccgggcugcgcagcaccg

SEQ ID NO: 862050 - RNA, 19 nt, Mycobacterium avium subsp. paratuberculosis
ccgggcugcgguuccgggc

SEQ ID NO: 862051 - RNA, 21 nt, Mycobacterium avium subsp. paratuberculosis
ccgggcugcgguuccgggcgc

SEQ ID NO: 862052 - RNA, 18 nt, Mycobacterium avium subsp. paratuberculosis
ccgggcuggugucccgcg

SEQ ID NO: 862053 - RNA, 17 nt, Mycobacterium avium subsp. paratuberculosis
ccgggcuggccgucggc

SEQ ID NO: 862054 - RNA, 18 nt, Mycobacterium avium subsp. paratuberculosis
ccgggcuggccgucggcg

SEQ ID NO: 862055 - RNA, 14 nt, Mycobacterium avium subsp. paratuberculosis
ccgggcuggcgcug

SEQ ID NO: 862056 - RNA, 16 nt, Mycobacterium avium subsp. paratuberculosis
ccgggcugucgggcag

SEQ ID NO: 862057 - RNA, 21 nt, Mycobacterium avium subsp. paratuberculosis
ccgggcugucgggcaggccgg

SEQ ID NO: 862058 - RNA, 15 nt, Mycobacterium avium subsp. paratuberculosis
ccgggcugugggcgc

SEQ ID NO: 862059 - RNA, 21 nt, Mycobacterium avium subsp. paratuberculosis
ccgggcugugggcgcagggcc

SEQ ID NO: 862060 - RNA, 14 nt, Mycobacterium avium subsp. paratuberculosis
ccgggcuggccguc

SEQ ID NO: 862061 - RNA, 14 nt, Mycobacterium avium subsp. paratuberculosis
ccggggacccgcac

SEQ ID NO: 862062 - RNA, 22 nt, Mycobacterium avium subsp. paratuberculosis
ccgggcuguugaccacggccug

SEQ ID NO: 862063 - RNA, 20 nt, Mycobacterium avium subsp. paratuberculosis
ccggggccaacuccggcggc

SEQ ID NO: 862064 - RNA, 21 nt, Mycobacterium avium subsp. paratuberculosis
ccggggccaacuccggcggca

SEQ ID NO: 862065 - RNA, 14 nt, Mycobacterium avium subsp. paratuberculosis
ccggggcagcaccc

SEQ ID NO: 862066 - RNA, 13 nt, Mycobacterium avium subsp. paratuberculosis
ccggggcagcagc

SEQ ID NO: 862067 - RNA, 16 nt, Mycobacterium avium subsp. paratuberculosis
ccggggaucgcgcagc

SEQ ID NO: 862068 - RNA, 13 nt, Mycobacterium avium subsp. paratuberculosis
ccggggcagcugc

SEQ ID NO: 862069 - RNA, 21 nt, Mycobacterium avium subsp. paratuberculosis
ccggggacggguugcggucca

SEQ ID NO: 862070 - RNA, 15 nt, Mycobacterium avium subsp. paratuberculosis
ccggggacggugcag

SEQ ID NO: 862071 - RNA, 18 nt, Mycobacterium avium subsp. paratuberculosis
ccggggacggugcagccg

SEQ ID NO: 862072 - RNA, 16 nt, Mycobacterium avium subsp. paratuberculosis
ccggggaucaccucgc

SEQ ID NO: 862073 - RNA, 16 nt, Mycobacterium avium subsp. paratuberculosis
ccggggcacgaugaac

SEQ ID NO: 862074 - RNA, 20 nt, Mycobacterium avium subsp. paratuberculosis
ccggggcacgcgcgcccggc

SEQ ID NO: 862075 - RNA, 14 nt, Mycobacterium avium subsp. paratuberculosis
ccggggcacggugg

SEQ ID NO: 862076 - RNA, 15 nt, Mycobacterium avium subsp. paratuberculosis
ccggggcagacccgc

SEQ ID NO: 862077 - RNA, 14 nt, Mycobacterium avium subsp. paratuberculosis
ccggggcgcagcug

SEQ ID NO: 862078 - RNA, 13 nt, Mycobacterium avium subsp. paratuberculosis
ccggggcgccccg

SEQ ID NO: 862079 - RNA, 14 nt, Mycobacterium avium subsp. paratuberculosis
ccggggcgccccgc

SEQ ID NO: 862080 - RNA, 18 nt, Mycobacterium avium subsp. paratuberculosis
ccggggcgccccgcuggu

SEQ ID NO: 862081 - RNA, 12 nt, Mycobacterium avium subsp. paratuberculosis
ccggggccagca

SEQ ID NO: 862082 - RNA, 20 nt, Mycobacterium avium subsp. paratuberculosis
ccggggccagcacgcccccg

SEQ ID NO: 862083 - RNA, 17 nt, Mycobacterium avium subsp. paratuberculosis
ccggggccgcggcucgc

SEQ ID NO: 862084 - RNA, 21 nt, Mycobacterium avium subsp. paratuberculosis
ccggggccgcggcucgcgacg

SEQ ID NO: 862085 - RNA, 13 nt, Mycobacterium avium subsp. paratuberculosis
ccggggccguccg

SEQ ID NO: 862086 - RNA, 16 nt, Mycobacterium avium subsp. paratuberculosis
ccggggccuccagcca

SEQ ID NO: 862087 - RNA, 22 nt, Mycobacterium avium subsp. paratuberculosis
ccggggccuucuuggcggcggc

SEQ ID NO: 862088 - RNA, 16 nt, Mycobacterium avium subsp. paratuberculosis
ccggggcgcggaccgc

SEQ ID NO: 862089 - RNA, 12 nt, Mycobacterium avium subsp. paratuberculosis
ccggggcgccgc

SEQ ID NO: 862090 - RNA, 20 nt, Mycobacterium avium subsp. paratuberculosis
ccggcgucguaaugcgucau

SEQ ID NO: 862091 - RNA, 13 nt, Mycobacterium avium subsp. paratuberculosis
ccggcgucgucga

SEQ ID NO: 862092 - RNA, 16 nt, Mycobacterium avium subsp. paratuberculosis
ccggcgucgucgagca

SEQ ID NO: 862093 - RNA, 23 nt, Mycobacterium avium subsp. paratuberculosis
ccggcgucgucgagcaccggcag

SEQ ID NO: 862094 - RNA, 13 nt, Mycobacterium avium subsp. paratuberculosis
ccggcgucgucgu

SEQ ID NO: 862095 - RNA, 19 nt, Mycobacterium avium subsp. paratuberculosis
ccggcgucgucgucgcagu

SEQ ID NO: 862096 - RNA, 12 nt, Mycobacterium avium subsp. paratuberculosis
ccggcgucgaug

SEQ ID NO: 862097 - RNA, 16 nt, Mycobacterium avium subsp. paratuberculosis
ccggcgucgaugaugc

SEQ ID NO: 862098 - RNA, 21 nt, Mycobacterium avium subsp. paratuberculosis
ccggcgucgaugaugccggcg

SEQ ID NO: 862099 - RNA, 22 nt, Mycobacterium avium subsp. paratuberculosis
ccggcgucgaugaugccggcgg

SEQ ID NO: 862100 - RNA, 13 nt, Mycobacterium avium subsp. paratuberculosis
ccggcgucgccgc

SEQ ID NO: 862101 - RNA, 18 nt, Mycobacterium avium subsp. paratuberculosis
ccggcgucgcggugaagu

SEQ ID NO: 862102 - RNA, 18 nt, Mycobacterium avium subsp. paratuberculosis
ccggcguccugcagcagc

SEQ ID NO: 862103 - RNA, 19 nt, Mycobacterium avium subsp. paratuberculosis
ccggcguccugcagcagcc

SEQ ID NO: 862104 - RNA, 13 nt, Mycobacterium avium subsp. paratuberculosis
ccggcgucgacgu

SEQ ID NO: 862105 - RNA, 14 nt, Mycobacterium avium subsp. paratuberculosis
ccggcguccgcgaa

SEQ ID NO: 862106 - RNA, 20 nt, Mycobacterium avium subsp. paratuberculosis
ccggcguccaggcgcaccgc

SEQ ID NO: 862107 - RNA, 22 nt, Mycobacterium avium subsp. paratuberculosis
ccggcguccaguagccgccggg

SEQ ID NO: 862108 - RNA, 23 nt, Mycobacterium avium subsp. paratuberculosis
ccggcguccaguagccgccgggc

SEQ ID NO: 862109 - RNA, 23 nt, Mycobacterium avium subsp. paratuberculosis
ccggcguccagugcaugccggcc

SEQ ID NO: 862110 - RNA, 14 nt, Mycobacterium avium subsp. paratuberculosis
ccggcguccaccgg

SEQ ID NO: 862111 - RNA, 15 nt, Mycobacterium avium subsp. paratuberculosis
ccggcguggugggca

SEQ ID NO: 862112 - RNA, 14 nt, Mycobacterium avium subsp. paratuberculosis
ccggcgugggccgc

SEQ ID NO: 862113 - RNA, 22 nt, Mycobacterium avium subsp. paratuberculosis
ccggcgugggccgcagcgcggc

SEQ ID NO: 862114 - RNA, 19 nt, Mycobacterium avium subsp. paratuberculosis
ccggcgugcugggccacga

SEQ ID NO: 862115 - RNA, 18 nt, Mycobacterium avium subsp. paratuberculosis
ccggcguuacccgaaccc

SEQ ID NO: 862116 - RNA, 21 nt, Mycobacterium avium subsp. paratuberculosis
ccggcguguaguacugcucga

SEQ ID NO: 862117 - RNA, 23 nt, Mycobacterium avium subsp. paratuberculosis
ccggcguguaguacugcucgacg

SEQ ID NO: 862118 - RNA, 15 nt, Mycobacterium avium subsp. paratuberculosis
ccggcgugcagcacg

SEQ ID NO: 862119 - RNA, 17 nt, Mycobacterium avium subsp. paratuberculosis
ccggcgugcagcacgcc

SEQ ID NO: 862120 - RNA, 16 nt, Mycobacterium avium subsp. paratuberculosis
ccggcgugccaccgcu

SEQ ID NO: 862121 - RNA, 17 nt, Mycobacterium avium subsp. paratuberculosis
ccggcgugccaccgcug

SEQ ID NO: 862122 - RNA, 22 nt, Mycobacterium avium subsp. paratuberculosis
ccggcgugccaccgcugggcgg

SEQ ID NO: 862123 - RNA, 18 nt, Mycobacterium avium subsp. paratuberculosis
ccggcgugaugacggcgg

SEQ ID NO: 862124 - RNA, 16 nt, Mycobacterium avium subsp. paratuberculosis
ccggcgugcuccagca

SEQ ID NO: 862125 - RNA, 21 nt, Mycobacterium avium subsp. paratuberculosis
ccggcgugcuccagcaggcgc

SEQ ID NO: 862126 - RNA, 15 nt, Mycobacterium avium subsp. paratuberculosis
ccggcgugcacaggc

SEQ ID NO: 862127 - RNA, 19 nt, Mycobacterium avium subsp. paratuberculosis
ccggcgugcacaggccgcc

SEQ ID NO: 862128 - RNA, 20 nt, Mycobacterium avium subsp. paratuberculosis
ccggcgugcacaggccgccg

SEQ ID NO: 862129 - RNA, 22 nt, Mycobacterium avium subsp. paratuberculosis
ccggcgucuugaucucggcggc

SEQ ID NO: 862130 - RNA, 17 nt, Mycobacterium avium subsp. paratuberculosis
ccggcgucucagucggc

SEQ ID NO: 862131 - RNA, 13 nt, Mycobacterium avium subsp. paratuberculosis
ccggcgucucggc

SEQ ID NO: 862132 - RNA, 16 nt, Mycobacterium avium subsp. paratuberculosis
ccggcgucucggcguc

SEQ ID NO: 862133 - RNA, 13 nt, Mycobacterium avium subsp. paratuberculosis
ccggcucagcggc

SEQ ID NO: 862134 - RNA, 15 nt, Mycobacterium avium subsp. paratuberculosis
ccggcucagcggcaa

SEQ ID NO: 862135 - RNA, 19 nt, Mycobacterium avium subsp. paratuberculosis
ccggcucagcggcaacugc

SEQ ID NO: 862136 - RNA, 13 nt, Mycobacterium avium subsp. paratuberculosis
ccggcguugucca

SEQ ID NO: 862137 - RNA, 19 nt, Mycobacterium avium subsp. paratuberculosis
ccggcguuguccagguagc

SEQ ID NO: 862138 - RNA, 20 nt, Mycobacterium avium subsp. paratuberculosis
ccggcguuguccagguagcc

SEQ ID NO: 862139 - RNA, 13 nt, Mycobacterium avium subsp. paratuberculosis
ccggcuccacagc

SEQ ID NO: 862140 - RNA, 20 nt, Mycobacterium avium subsp. paratuberculosis
ccggcuccccgaccacaccg

SEQ ID NO: 862141 - RNA, 22 nt, Mycobacterium avium subsp. paratuberculosis
ccggcuccccgaccacaccggc

SEQ ID NO: 862142 - RNA, 15 nt, Mycobacterium avium subsp. paratuberculosis
ccggcuccaccgcgc

SEQ ID NO: 862143 - RNA, 19 nt, Mycobacterium avium subsp. paratuberculosis
ccggcuccaccgcgccggc

SEQ ID NO: 862144 - RNA, 21 nt, Mycobacterium avium subsp. paratuberculosis
ccggcuccaccgcgccggcgg

SEQ ID NO: 862145 - RNA, 20 nt, Mycobacterium avium subsp. paratuberculosis
ccggcguuggacagcucgac

SEQ ID NO: 862146 - RNA, 16 nt, Mycobacterium avium subsp. paratuberculosis
ccggcgugggugucga

SEQ ID NO: 862147 - RNA, 17 nt, Mycobacterium avium subsp. paratuberculosis
ccggcguugacgaugac

SEQ ID NO: 862148 - RNA, 21 nt, Mycobacterium avium subsp. paratuberculosis
ccggcguugacgaugacgcgg

SEQ ID NO: 862149 - RNA, 22 nt, Mycobacterium avium subsp. paratuberculosis
ccggcguugacgaugacgcggu

SEQ ID NO: 862150 - RNA, 19 nt, Mycobacterium avium subsp. paratuberculosis
ccggcguugcauuucggcg

SEQ ID NO: 862151 - RNA, 17 nt, Mycobacterium avium subsp. paratuberculosis
ccggcguuccagcgcac

SEQ ID NO: 862152 - RNA, 17 nt, Mycobacterium avium subsp. paratuberculosis
ccggcugagcgucgguc

SEQ ID NO: 862153 - RNA, 23 nt, Mycobacterium avium subsp. paratuberculosis
ccggcugagcgucggucucgacg

SEQ ID NO: 862154 - RNA, 16 nt, Mycobacterium avium subsp. paratuberculosis
ccggcugacugccggc

SEQ ID NO: 862155 - RNA, 17 nt, Mycobacterium avium subsp. paratuberculosis
ccggcugacugccggcg

SEQ ID NO: 862156 - RNA, 19 nt, Mycobacterium avium subsp. paratuberculosis
ccggcugacugccggcgac

SEQ ID NO: 862157 - RNA, 17 nt, Mycobacterium avium subsp. paratuberculosis
ccggcugagcagcucgc

SEQ ID NO: 862158 - RNA, 20 nt, Mycobacterium avium subsp. paratuberculosis
ccggcugagcagcucgcgga

SEQ ID NO: 862159 - RNA, 17 nt, Mycobacterium avium subsp. paratuberculosis
ccggcugcagccgggcg

SEQ ID NO: 862160 - RNA, 14 nt, Mycobacterium avium subsp. paratuberculosis
ccggcugcccgacc

SEQ ID NO: 862161 - RNA, 15 nt, Mycobacterium avium subsp. paratuberculosis
ccggcugcccgaccc

SEQ ID NO: 862162 - RNA, 15 nt, Mycobacterium avium subsp. paratuberculosis
ccggcugcccgcgac

SEQ ID NO: 862163 - RNA, 17 nt, Mycobacterium avium subsp. paratuberculosis
ccggcugcccgcgacug

SEQ ID NO: 862164 - RNA, 14 nt, Mycobacterium avium subsp. paratuberculosis
ccggcucgaucgcg

SEQ ID NO: 862165 - RNA, 18 nt, Mycobacterium avium subsp. paratuberculosis
ccggcucgaucgcgguca

SEQ ID NO: 862166 - RNA, 14 nt, Mycobacterium avium subsp. paratuberculosis
ccggcugaccggcg

SEQ ID NO: 862167 - RNA, 15 nt, Mycobacterium avium subsp. paratuberculosis
ccggcugaccggcgg

SEQ ID NO: 862168 - RNA, 18 nt, Mycobacterium avium subsp. paratuberculosis
ccggcugaccggcggugc

SEQ ID NO: 862169 - RNA, 20 nt, Mycobacterium avium subsp. paratuberculosis
ccggcugaccggcggugccg

SEQ ID NO: 862170 - RNA, 18 nt, Mycobacterium avium subsp. paratuberculosis
ccggcucgaaguggcagc

SEQ ID NO: 862171 - RNA, 13 nt, Mycobacterium avium subsp. paratuberculosis
ccggcgggucagc

SEQ ID NO: 862172 - RNA, 14 nt, Mycobacterium avium subsp. paratuberculosis
ccggcgggucagca

SEQ ID NO: 862173 - RNA, 18 nt, Mycobacterium avium subsp. paratuberculosis
ccggcgggucagcaccgc

SEQ ID NO: 862174 - RNA, 19 nt, Mycobacterium avium subsp. paratuberculosis
ccggcgggucagcaccgcg

SEQ ID NO: 862175 - RNA, 20 nt, Mycobacterium avium subsp. paratuberculosis
ccggcgggucagcaccgcgg

SEQ ID NO: 862176 - RNA, 15 nt, Mycobacterium avium subsp. paratuberculosis
ccggcgggucagcag

SEQ ID NO: 862177 - RNA, 19 nt, Mycobacterium avium subsp. paratuberculosis
ccggcgggucugugaccac

SEQ ID NO: 862178 - RNA, 20 nt, Mycobacterium avium subsp. paratuberculosis
ccggcgggucugugaccacg

SEQ ID NO: 862179 - RNA, 17 nt, Mycobacterium avium subsp. paratuberculosis
ccggcgggugagccggu

SEQ ID NO: 862180 - RNA, 18 nt, Mycobacterium avium subsp. paratuberculosis
ccggcgggugagccgguc

SEQ ID NO: 862181 - RNA, 13 nt, Mycobacterium avium subsp. paratuberculosis
ccggcggucgccg

SEQ ID NO: 862182 - RNA, 15 nt, Mycobacterium avium subsp. paratuberculosis
ccggcggucgccgaa

SEQ ID NO: 862183 - RNA, 16 nt, Mycobacterium avium subsp. paratuberculosis
ccggcggucagcucag

SEQ ID NO: 862184 - RNA, 17 nt, Mycobacterium avium subsp. paratuberculosis
ccggcgguaccgccgau

SEQ ID NO: 862185 - RNA, 18 nt, Mycobacterium avium subsp. paratuberculosis
ccggcgguaccgccgauc

SEQ ID NO: 862186 - RNA, 20 nt, Mycobacterium avium subsp. paratuberculosis
ccggcgguaugcccgggccg

SEQ ID NO: 862187 - RNA, 12 nt, Mycobacterium avium subsp. paratuberculosis
ccggcggucagc

SEQ ID NO: 862188 - RNA, 16 nt, Mycobacterium avium subsp. paratuberculosis
ccggcggucagcaccg

SEQ ID NO: 862189 - RNA, 18 nt, Mycobacterium avium subsp. paratuberculosis
ccggcggucagcaccguc

SEQ ID NO: 862190 - RNA, 20 nt, Mycobacterium avium subsp. paratuberculosis
ccggcggucagcaccgucac

SEQ ID NO: 862191 - RNA, 14 nt, Mycobacterium avium subsp. paratuberculosis
ccggcgggcggccg

SEQ ID NO: 862192 - RNA, 16 nt, Mycobacterium avium subsp. paratuberculosis
ccggcgggcggcggcg

SEQ ID NO: 862193 - RNA, 13 nt, Mycobacterium avium subsp. paratuberculosis
ccggcgggcaggu

SEQ ID NO: 862194 - RNA, 16 nt, Mycobacterium avium subsp. paratuberculosis
ccggcgggcaucaucg

SEQ ID NO: 862195 - RNA, 19 nt, Mycobacterium avium subsp. paratuberculosis
ccggcgggcgccggucggc

SEQ ID NO: 862196 - RNA, 22 nt, Mycobacterium avium subsp. paratuberculosis
ccggcgggcgaaaucgcgggcc

SEQ ID NO: 862197 - RNA, 15 nt, Mycobacterium avium subsp. paratuberculosis
ccggcggggguucga

SEQ ID NO: 862198 - RNA, 20 nt, Mycobacterium avium subsp. paratuberculosis
ccggcggggguucgacguca

SEQ ID NO: 862199 - RNA, 14 nt, Mycobacterium avium subsp. paratuberculosis
ccggcggggacgug

SEQ ID NO: 862200 - RNA, 23 nt, Mycobacterium avium subsp. paratuberculosis
ccggcggggcgucgcccgccgac

SEQ ID NO: 862201 - RNA, 16 nt, Mycobacterium avium subsp. paratuberculosis
ccggcgggggaucggg

SEQ ID NO: 862202 - RNA, 18 nt, Mycobacterium avium subsp. paratuberculosis
ccggcgggggcgcguccg

SEQ ID NO: 862203 - RNA, 22 nt, Mycobacterium avium subsp. paratuberculosis
ccggcgggggcgcguccgcggg

SEQ ID NO: 862204 - RNA, 13 nt, Mycobacterium avium subsp. paratuberculosis
ccggcgggcucgc

SEQ ID NO: 862205 - RNA, 21 nt, Mycobacterium avium subsp. paratuberculosis
ccggcgggcucgccggcccga

SEQ ID NO: 862206 - RNA, 20 nt, Mycobacterium avium subsp. paratuberculosis
ccggcgggcuggugcgcagc

SEQ ID NO: 862207 - RNA, 22 nt, Mycobacterium avium subsp. paratuberculosis
ccggcgggcuggugcgcagccg

SEQ ID NO: 862208 - RNA, 15 nt, Mycobacterium avium subsp. paratuberculosis
ccggcgucacucugg

SEQ ID NO: 862209 - RNA, 21 nt, Mycobacterium avium subsp. paratuberculosis
ccggcgucacucuggcgugac

SEQ ID NO: 862210 - RNA, 22 nt, Mycobacterium avium subsp. paratuberculosis
ccggcgucacucuggcgugacg

SEQ ID NO: 862211 - RNA, 17 nt, Mycobacterium avium subsp. paratuberculosis
ccggcguaguucgucga

SEQ ID NO: 862212 - RNA, 18 nt, Mycobacterium avium subsp. paratuberculosis
ccggcguaguucgucgaa

SEQ ID NO: 862213 - RNA, 20 nt, Mycobacterium avium subsp. paratuberculosis
ccggcguaguucgucgaaca

SEQ ID NO: 862214 - RNA, 21 nt, Mycobacterium avium subsp. paratuberculosis
ccggcguaucuccaccgucga

SEQ ID NO: 862215 - RNA, 23 nt, Mycobacterium avium subsp. paratuberculosis
ccggcguaucuccaccgucgaug

SEQ ID NO: 862216 - RNA, 15 nt, Mycobacterium avium subsp. paratuberculosis
ccggcguagaacacc

SEQ ID NO: 862217 - RNA, 16 nt, Mycobacterium avium subsp. paratuberculosis
ccggcguagaacaccg

SEQ ID NO: 862218 - RNA, 20 nt, Mycobacterium avium subsp. paratuberculosis
ccggcguagaacaccgaauu

SEQ ID NO: 862219 - RNA, 16 nt, Mycobacterium avium subsp. paratuberculosis
ccggcguagaccagcg

SEQ ID NO: 862220 - RNA, 17 nt, Mycobacterium avium subsp. paratuberculosis
ccggcgguuuuguugac

SEQ ID NO: 862221 - RNA, 15 nt, Mycobacterium avium subsp. paratuberculosis
ccggcggugauccgc

SEQ ID NO: 862222 - RNA, 19 nt, Mycobacterium avium subsp. paratuberculosis
ccggcggugauccgcccgg

SEQ ID NO: 862223 - RNA, 16 nt, Mycobacterium avium subsp. paratuberculosis
ccggcggugccgaacc

SEQ ID NO: 862224 - RNA, 14 nt, Mycobacterium avium subsp. paratuberculosis
ccggcggugccggc

SEQ ID NO: 862225 - RNA, 15 nt, Mycobacterium avium subsp. paratuberculosis
ccggcggugccggcc

SEQ ID NO: 862226 - RNA, 16 nt, Mycobacterium avium subsp. paratuberculosis
ccggcggucgcugcag

SEQ ID NO: 862227 - RNA, 17 nt, Mycobacterium avium subsp. paratuberculosis
ccggcggucgcugcagc

SEQ ID NO: 862228 - RNA, 18 nt, Mycobacterium avium subsp. paratuberculosis
ccggcggucgcugcagcg

SEQ ID NO: 862229 - RNA, 23 nt, Mycobacterium avium subsp. paratuberculosis
ccggcggucgcugcagcggcggc

SEQ ID NO: 862230 - RNA, 20 nt, Mycobacterium avium subsp. paratuberculosis
ccggcggugcggacccguug

SEQ ID NO: 862231 - RNA, 17 nt, Mycobacterium avium subsp. paratuberculosis
ccggcggugcggcgggg

SEQ ID NO: 862232 - RNA, 14 nt, Mycobacterium avium subsp. paratuberculosis
ccggcggugcgggu

SEQ ID NO: 862233 - RNA, 21 nt, Mycobacterium avium subsp. paratuberculosis
ccggcggugcgucgaaucaca

SEQ ID NO: 862234 - RNA, 13 nt, Mycobacterium avium subsp. paratuberculosis
ccggcgguggugc

SEQ ID NO: 862235 - RNA, 14 nt, Mycobacterium avium subsp. paratuberculosis
ccggcgguguccac

SEQ ID NO: 862236 - RNA, 22 nt, Mycobacterium avium subsp. paratuberculosis
ccggcgguguccacgaugcggu

SEQ ID NO: 862237 - RNA, 14 nt, Mycobacterium avium subsp. paratuberculosis
ccggcgguucggcg

SEQ ID NO: 862238 - RNA, 17 nt, Mycobacterium avium subsp. paratuberculosis
ccggcgguucggcgggc

SEQ ID NO: 862239 - RNA, 17 nt, Mycobacterium avium subsp. paratuberculosis
ccggcggauauagccga

SEQ ID NO: 862240 - RNA, 15 nt, Mycobacterium avium subsp. paratuberculosis
ccggcggccggcggc

SEQ ID NO: 862241 - RNA, 15 nt, Mycobacterium avium subsp. paratuberculosis
ccggcggccgccacg

SEQ ID NO: 862242 - RNA, 19 nt, Mycobacterium avium subsp. paratuberculosis
ccggcggccgccacgcugg

SEQ ID NO: 862243 - RNA, 23 nt, Mycobacterium avium subsp. paratuberculosis
ccggcggccgccacgcuggugug

SEQ ID NO: 862244 - RNA, 13 nt, Mycobacterium avium subsp. paratuberculosis
ccggcggccgccg

SEQ ID NO: 862245 - RNA, 16 nt, Mycobacterium avium subsp. paratuberculosis
ccggcggccgccgccc

SEQ ID NO: 862246 - RNA, 18 nt, Mycobacterium avium subsp. paratuberculosis
ccggcggccgccgcccgc

SEQ ID NO: 862247 - RNA, 14 nt, Mycobacterium avium subsp. paratuberculosis
ccggcggccgccgg

SEQ ID NO: 862248 - RNA, 16 nt, Mycobacterium avium subsp. paratuberculosis
ccggcggccgccggca

SEQ ID NO: 862249 - RNA, 17 nt, Mycobacterium avium subsp. paratuberculosis
ccggcggccgccggcac

SEQ ID NO: 862250 - RNA, 18 nt, Mycobacterium avium subsp. paratuberculosis
ccggcggccgccggcacc

SEQ ID NO: 862251 - RNA, 13 nt, Mycobacterium avium subsp. paratuberculosis
ccggcggccgcga

SEQ ID NO: 862252 - RNA, 16 nt, Mycobacterium avium subsp. paratuberculosis
ccggcggccgcgacgg

SEQ ID NO: 862253 - RNA, 21 nt, Mycobacterium avium subsp. paratuberculosis
ccggcggccgcgacggaccag

SEQ ID NO: 862254 - RNA, 17 nt, Mycobacterium avium subsp. paratuberculosis
ccggcggccgcgucggc

SEQ ID NO: 862255 - RNA, 20 nt, Mycobacterium avium subsp. paratuberculosis
ccggcggccgcgucggcggu

SEQ ID NO: 862256 - RNA, 12 nt, Mycobacterium avium subsp. paratuberculosis
ccggcggccggc

SEQ ID NO: 862257 - RNA, 13 nt, Mycobacterium avium subsp. paratuberculosis
ccggcggccggcc

SEQ ID NO: 862258 - RNA, 14 nt, Mycobacterium avium subsp. paratuberculosis
ccggcggccggccc

SEQ ID NO: 862259 - RNA, 18 nt, Mycobacterium avium subsp. paratuberculosis
ccggcggccggccccggc

SEQ ID NO: 862260 - RNA, 23 nt, Mycobacterium avium subsp. paratuberculosis
ccggcggccggccccggccgggc

SEQ ID NO: 862261 - RNA, 17 nt, Mycobacterium avium subsp. paratuberculosis
ccggcggccggccgcgc

SEQ ID NO: 862262 - RNA, 17 nt, Mycobacterium avium subsp. paratuberculosis
ccggcggcgcccgcggc

SEQ ID NO: 862263 - RNA, 20 nt, Mycobacterium avium subsp. paratuberculosis
ccggcggcgcccgcggccuc

SEQ ID NO: 862264 - RNA, 13 nt, Mycobacterium avium subsp. paratuberculosis
ccggcggcgccgg

SEQ ID NO: 862265 - RNA, 19 nt, Mycobacterium avium subsp. paratuberculosis
ccggcggcgccggaggcca

SEQ ID NO: 862266 - RNA, 23 nt, Mycobacterium avium subsp. paratuberculosis
ccggcggcgccggaggccagcuc

SEQ ID NO: 862267 - RNA, 13 nt, Mycobacterium avium subsp. paratuberculosis
ccggcggcgauga

SEQ ID NO: 862268 - RNA, 14 nt, Mycobacterium avium subsp. paratuberculosis
ccggcggcgacggc

SEQ ID NO: 862269 - RNA, 18 nt, Mycobacterium avium subsp. paratuberculosis
ccggcggcgaucgccgcg

SEQ ID NO: 862270 - RNA, 22 nt, Mycobacterium avium subsp. paratuberculosis
ccggcggcgaucgccgcgaaca

SEQ ID NO: 862271 - RNA, 17 nt, Mycobacterium avium subsp. paratuberculosis
ccggcggcgaucggcgc

SEQ ID NO: 862272 - RNA, 19 nt, Mycobacterium avium subsp. paratuberculosis
ccggcggcgaucggcgcgg

SEQ ID NO: 862273 - RNA, 15 nt, Mycobacterium avium subsp. paratuberculosis
ccggcggcgaagccg

SEQ ID NO: 862274 - RNA, 16 nt, Mycobacterium avium subsp. paratuberculosis
ccggcggcgacggcac

SEQ ID NO: 862275 - RNA, 19 nt, Mycobacterium avium subsp. paratuberculosis
ccggcggcgucgugaccga

SEQ ID NO: 862276 - RNA, 16 nt, Mycobacterium avium subsp. paratuberculosis
ccggcggcugggcagc

SEQ ID NO: 862277 - RNA, 19 nt, Mycobacterium avium subsp. paratuberculosis
ccggcggcugggcagccgc

SEQ ID NO: 862278 - RNA, 17 nt, Mycobacterium avium subsp. paratuberculosis
ccggcggcugugaucgc

SEQ ID NO: 862279 - RNA, 18 nt, Mycobacterium avium subsp. paratuberculosis
ccggcggcguugaggcgu

SEQ ID NO: 862280 - RNA, 14 nt, Mycobacterium avium subsp. paratuberculosis
ccggcggcggugag

SEQ ID NO: 862281 - RNA, 15 nt, Mycobacterium avium subsp. paratuberculosis
ccggcggcggugagc

SEQ ID NO: 862282 - RNA, 18 nt, Mycobacterium avium subsp. paratuberculosis
ccggcggcggugagcgcg

SEQ ID NO: 862283 - RNA, 21 nt, Mycobacterium avium subsp. paratuberculosis
ccggcggcgguuuuggucggc

SEQ ID NO: 862284 - RNA, 22 nt, Mycobacterium avium subsp. paratuberculosis
ccggcggcgguuuuggucggca

SEQ ID NO: 862285 - RNA, 13 nt, Mycobacterium avium subsp. paratuberculosis
ccggcggcggacc

SEQ ID NO: 862286 - RNA, 16 nt, Mycobacterium avium subsp. paratuberculosis
ccggcggcggaccguc

SEQ ID NO: 862287 - RNA, 23 nt, Mycobacterium avium subsp. paratuberculosis
ccggcggcggaccgucggugucg

SEQ ID NO: 862288 - RNA, 15 nt, Mycobacterium avium subsp. paratuberculosis
ccggcggcggccagc

SEQ ID NO: 862289 - RNA, 23 nt, Mycobacterium avium subsp. paratuberculosis
ccggcggcggcgguccguucggc

SEQ ID NO: 862290 - RNA, 18 nt, Mycobacterium avium subsp. paratuberculosis
ccggcggcggcggucggc

SEQ ID NO: 862291 - RNA, 19 nt, Mycobacterium avium subsp. paratuberculosis
ccggcggcggcggucggca

SEQ ID NO: 862292 - RNA, 20 nt, Mycobacterium avium subsp. paratuberculosis
ccggcggcggcggucggcau

SEQ ID NO: 862293 - RNA, 12 nt, Mycobacterium avium subsp. paratuberculosis
ccggcggcgcgg

SEQ ID NO: 862294 - RNA, 17 nt, Mycobacterium avium subsp. paratuberculosis
ccggcggcgcucagcgc

SEQ ID NO: 862295 - RNA, 19 nt, Mycobacterium avium subsp. paratuberculosis
ccggcggcgcucagcgcgg

SEQ ID NO: 862296 - RNA, 20 nt, Mycobacterium avium subsp. paratuberculosis
ccggcggcgcucagcgcggc

SEQ ID NO: 862297 - RNA, 22 nt, Mycobacterium avium subsp. paratuberculosis
ccggcggcgcucagcgcggcgg

SEQ ID NO: 862298 - RNA, 13 nt, Mycobacterium avium subsp. paratuberculosis
ccggcggcgcggc

SEQ ID NO: 862299 - RNA, 14 nt, Mycobacterium avium subsp. paratuberculosis
ccggccaguccgcg

SEQ ID NO: 862300 - RNA, 17 nt, Mycobacterium avium subsp. paratuberculosis
ccggccaguccgcguga

SEQ ID NO: 862301 - RNA, 14 nt, Mycobacterium avium subsp. paratuberculosis
ccggccaguccggc

SEQ ID NO: 862302 - RNA, 16 nt, Mycobacterium avium subsp. paratuberculosis
ccggccaguccggcag

SEQ ID NO: 862303 - RNA, 17 nt, Mycobacterium avium subsp. paratuberculosis
ccggccaguccggcagc

SEQ ID NO: 862304 - RNA, 20 nt, Mycobacterium avium subsp. paratuberculosis
ccggccagguuccaccgggc

SEQ ID NO: 862305 - RNA, 20 nt, Mycobacterium avium subsp. paratuberculosis
ccggccagguugaccaccag

SEQ ID NO: 862306 - RNA, 18 nt, Mycobacterium avium subsp. paratuberculosis
ccggccagcgucgcgccg

SEQ ID NO: 862307 - RNA, 13 nt, Mycobacterium avium subsp. paratuberculosis
ccggccagggugc

SEQ ID NO: 862308 - RNA, 15 nt, Mycobacterium avium subsp. paratuberculosis
ccggccagggugccg

SEQ ID NO: 862309 - RNA, 17 nt, Mycobacterium avium subsp. paratuberculosis
ccggccagggugccgac

SEQ ID NO: 862310 - RNA, 19 nt, Mycobacterium avium subsp. paratuberculosis
ccggccagggugccgacga

SEQ ID NO: 862311 - RNA, 12 nt, Mycobacterium avium subsp. paratuberculosis
ccggccagcggg

SEQ ID NO: 862312 - RNA, 13 nt, Mycobacterium avium subsp. paratuberculosis
ccggccagcgucg

SEQ ID NO: 862313 - RNA, 13 nt, Mycobacterium avium subsp. paratuberculosis
ccggccaggucca

SEQ ID NO: 862314 - RNA, 21 nt, Mycobacterium avium subsp. paratuberculosis
ccggccccgcccggcgcgcag

SEQ ID NO: 862315 - RNA, 15 nt, Mycobacterium avium subsp. paratuberculosis
ccggccccgcccggg

SEQ ID NO: 862316 - RNA, 13 nt, Mycobacterium avium subsp. paratuberculosis
ccggccccgcugc

SEQ ID NO: 862317 - RNA, 15 nt, Mycobacterium avium subsp. paratuberculosis
ccggccccgcugccg

SEQ ID NO: 862318 - RNA, 23 nt, Mycobacterium avium subsp. paratuberculosis
ccggccccgcugccguccggcgg

SEQ ID NO: 862319 - RNA, 17 nt, Mycobacterium avium subsp. paratuberculosis
ccggccaguucccgggc

SEQ ID NO: 862320 - RNA, 21 nt, Mycobacterium avium subsp. paratuberculosis
ccggccaguugaaguccggcg

SEQ ID NO: 862321 - RNA, 19 nt, Mycobacterium avium subsp. paratuberculosis
ccggccaucaugcccacca

SEQ ID NO: 862322 - RNA, 14 nt, Mycobacterium avium subsp. paratuberculosis
ccggccaucucggc

SEQ ID NO: 862323 - RNA, 16 nt, Mycobacterium avium subsp. paratuberculosis
ccggccaucucggcgg

SEQ ID NO: 862324 - RNA, 17 nt, Mycobacterium avium subsp. paratuberculosis
ccggccaucugcgcgac

SEQ ID NO: 862325 - RNA, 12 nt, Mycobacterium avium subsp. paratuberculosis
ccggccaucuuc

SEQ ID NO: 862326 - RNA, 19 nt, Mycobacterium avium subsp. paratuberculosis
ccggccaugaccaugucga

SEQ ID NO: 862327 - RNA, 17 nt, Mycobacterium avium subsp. paratuberculosis
ccggcccgcaucgcggc

SEQ ID NO: 862328 - RNA, 19 nt, Mycobacterium avium subsp. paratuberculosis
ccggcccgcaucgcggcga

SEQ ID NO: 862329 - RNA, 20 nt, Mycobacterium avium subsp. paratuberculosis
ccggcccgcaucgcggcgau

SEQ ID NO: 862330 - RNA, 15 nt, Mycobacterium avium subsp. paratuberculosis
ccggccccggccggc

SEQ ID NO: 862331 - RNA, 16 nt, Mycobacterium avium subsp. paratuberculosis
ccggccccggccggcg

SEQ ID NO: 862332 - RNA, 17 nt, Mycobacterium avium subsp. paratuberculosis
ccggccccggccggcgg

SEQ ID NO: 862333 - RNA, 19 nt, Mycobacterium avium subsp. paratuberculosis
ccggccccggccggcgggu

SEQ ID NO: 862334 - RNA, 13 nt, Mycobacterium avium subsp. paratuberculosis
ccggccccggcga

SEQ ID NO: 862335 - RNA, 14 nt, Mycobacterium avium subsp. paratuberculosis
ccggccccggcgac

SEQ ID NO: 862336 - RNA, 14 nt, Mycobacterium avium subsp. paratuberculosis
ccggcccgagcacc

SEQ ID NO: 862337 - RNA, 19 nt, Mycobacterium avium subsp. paratuberculosis
ccggcccgagcaccaccag

SEQ ID NO: 862338 - RNA, 13 nt, Mycobacterium avium subsp. paratuberculosis
ccggcccgauagc

SEQ ID NO: 862339 - RNA, 18 nt, Mycobacterium avium subsp. paratuberculosis
ccggcccgauaggccgac

SEQ ID NO: 862340 - RNA, 12 nt, Mycobacterium avium subsp. paratuberculosis
ccggcccgaugc

SEQ ID NO: 862341 - RNA, 16 nt, Mycobacterium avium subsp. paratuberculosis
ccggccgacgggcgug

SEQ ID NO: 862342 - RNA, 12 nt, Mycobacterium avium subsp. paratuberculosis
ccggccgacgau

SEQ ID NO: 862343 - RNA, 14 nt, Mycobacterium avium subsp. paratuberculosis
ccggccgacgauga

SEQ ID NO: 862344 - RNA, 16 nt, Mycobacterium avium subsp. paratuberculosis
ccggccgacgaugaac

SEQ ID NO: 862345 - RNA, 23 nt, Mycobacterium avium subsp. paratuberculosis
ccggccgacgaugaacagucggc

SEQ ID NO: 862346 - RNA, 18 nt, Mycobacterium avium subsp. paratuberculosis
ccggccgacgcggccucg

SEQ ID NO: 862347 - RNA, 19 nt, Mycobacterium avium subsp. paratuberculosis
ccggccgacauggacgcgg

SEQ ID NO: 862348 - RNA, 22 nt, Mycobacterium avium subsp. paratuberculosis
ccggccgacauggacgcggccu

SEQ ID NO: 862349 - RNA, 15 nt, Mycobacterium avium subsp. paratuberculosis
ccggccgaacacggc

SEQ ID NO: 862350 - RNA, 22 nt, Mycobacterium avium subsp. paratuberculosis
ccggccgaacacggccgccucc

SEQ ID NO: 862351 - RNA, 22 nt, Mycobacterium avium subsp. paratuberculosis
ccggccgacaacgacagcaccc

SEQ ID NO: 862352 - RNA, 21 nt, Mycobacterium avium subsp. paratuberculosis
ccggcccgcagccagcgcagc

SEQ ID NO: 862353 - RNA, 16 nt, Mycobacterium avium subsp. paratuberculosis
ccggcccugcggccag

SEQ ID NO: 862354 - RNA, 18 nt, Mycobacterium avium subsp. paratuberculosis
ccggcccuggucggccag

SEQ ID NO: 862355 - RNA, 22 nt, Mycobacterium avium subsp. paratuberculosis
ccggccuaccugguugacgccc

SEQ ID NO: 862356 - RNA, 15 nt, Mycobacterium avium subsp. paratuberculosis
ccggccggcggcggu

SEQ ID NO: 862357 - RNA, 19 nt, Mycobacterium avium subsp. paratuberculosis
ccggccgggcugcgcagca

SEQ ID NO: 862358 - RNA, 16 nt, Mycobacterium avium subsp. paratuberculosis
ccggccgggcgacugc

SEQ ID NO: 862359 - RNA, 18 nt, Mycobacterium avium subsp. paratuberculosis
ccggccgggcggacggca

SEQ ID NO: 862360 - RNA, 13 nt, Mycobacterium avium subsp. paratuberculosis
ccggccggcgggu

SEQ ID NO: 862361 - RNA, 23 nt, Mycobacterium avium subsp. paratuberculosis
ccggccggcggguucugauacac

SEQ ID NO: 862362 - RNA, 14 nt, Mycobacterium avium subsp. paratuberculosis
ccggccggcgguca

SEQ ID NO: 862363 - RNA, 19 nt, Mycobacterium avium subsp. paratuberculosis
ccggccggcggucaggccg

SEQ ID NO: 862364 - RNA, 16 nt, Mycobacterium avium subsp. paratuberculosis
ccggccggcgcgacca

SEQ ID NO: 862365 - RNA, 19 nt, Mycobacterium avium subsp. paratuberculosis
ccggccggcgcgaccagcg

SEQ ID NO: 862366 - RNA, 22 nt, Mycobacterium avium subsp. paratuberculosis
ccggccggcgcgcacggcagcc

SEQ ID NO: 862367 - RNA, 15 nt, Mycobacterium avium subsp. paratuberculosis
ccggccggcgcgugc

SEQ ID NO: 862368 - RNA, 20 nt, Mycobacterium avium subsp. paratuberculosis
ccggccggcggacgcggcca

SEQ ID NO: 862369 - RNA, 21 nt, Mycobacterium avium subsp. paratuberculosis
ccggccggcggacgcggccag

SEQ ID NO: 862370 - RNA, 22 nt, Mycobacterium avium subsp. paratuberculosis
ccggccggcggacgcggccagc

SEQ ID NO: 862371 - RNA, 12 nt, Mycobacterium avium subsp. paratuberculosis
ccggccggcggc

SEQ ID NO: 862372 - RNA, 19 nt, Mycobacterium avium subsp. paratuberculosis
ccggccggcgaagccgcuc

SEQ ID NO: 862373 - RNA, 15 nt, Mycobacterium avium subsp. paratuberculosis
ccggccggccgccgg

SEQ ID NO: 862374 - RNA, 15 nt, Mycobacterium avium subsp. paratuberculosis
ccggccggccgccug

SEQ ID NO: 862375 - RNA, 14 nt, Mycobacterium avium subsp. paratuberculosis
ccggccggccgugc

SEQ ID NO: 862376 - RNA, 16 nt, Mycobacterium avium subsp. paratuberculosis
ccggccggcaggucga

SEQ ID NO: 862377 - RNA, 14 nt, Mycobacterium avium subsp. paratuberculosis
ccggccgcgcccau

SEQ ID NO: 862378 - RNA, 16 nt, Mycobacterium avium subsp. paratuberculosis
ccggccucgucggcga

SEQ ID NO: 862379 - RNA, 17 nt, Mycobacterium avium subsp. paratuberculosis
ccggccucgucggcgag

SEQ ID NO: 862380 - RNA, 21 nt, Mycobacterium avium subsp. paratuberculosis
ccggccucgucggcgagcagc

SEQ ID NO: 862381 - RNA, 16 nt, Mycobacterium avium subsp. paratuberculosis
ccggccucgccggcgc

SEQ ID NO: 862382 - RNA, 17 nt, Mycobacterium avium subsp. paratuberculosis
ccggccucgccggcgcc

SEQ ID NO: 862383 - RNA, 19 nt, Mycobacterium avium subsp. paratuberculosis
ccggccucgccggcgccgg

SEQ ID NO: 862384 - RNA, 21 nt, Mycobacterium avium subsp. paratuberculosis
ccggccucgccggcgccgggc

SEQ ID NO: 862385 - RNA, 15 nt, Mycobacterium avium subsp. paratuberculosis
ccggccgggacgggu

SEQ ID NO: 862386 - RNA, 13 nt, Mycobacterium avium subsp. paratuberculosis
ccggccggcacga

SEQ ID NO: 862387 - RNA, 17 nt, Mycobacterium avium subsp. paratuberculosis
ccggccggcacgauggc

SEQ ID NO: 862388 - RNA, 12 nt, Mycobacterium avium subsp. paratuberculosis
ccggccgcucgc

SEQ ID NO: 862389 - RNA, 18 nt, Mycobacterium avium subsp. paratuberculosis
ccggccgcucgcgggcca

SEQ ID NO: 862390 - RNA, 14 nt, Mycobacterium avium subsp. paratuberculosis
ccggccgcugagga

SEQ ID NO: 862391 - RNA, 13 nt, Mycobacterium avium subsp. paratuberculosis
ccggccggacacc

SEQ ID NO: 862392 - RNA, 17 nt, Mycobacterium avium subsp. paratuberculosis
ccggccggacagaucgc

SEQ ID NO: 862393 - RNA, 12 nt, Mycobacterium avium subsp. paratuberculosis
ccggccgcgcgc

SEQ ID NO: 862394 - RNA, 14 nt, Mycobacterium avium subsp. paratuberculosis
ccggccgcggccca

SEQ ID NO: 862395 - RNA, 17 nt, Mycobacterium avium subsp. paratuberculosis
ccggccgcgucgccgac

SEQ ID NO: 862396 - RNA, 18 nt, Mycobacterium avium subsp. paratuberculosis
ccggccgcgucgccgacc

SEQ ID NO: 862397 - RNA, 21 nt, Mycobacterium avium subsp. paratuberculosis
ccggccgcgucgccgaccagc

SEQ ID NO: 862398 - RNA, 23 nt, Mycobacterium avium subsp. paratuberculosis
ccggccgcgucgccgaccagcag

SEQ ID NO: 862399 - RNA, 16 nt, Mycobacterium avium subsp. paratuberculosis
ccggccgcgcgcggcg

SEQ ID NO: 862400 - RNA, 18 nt, Mycobacterium avium subsp. paratuberculosis
ccggccgcgcgcggcgcg

SEQ ID NO: 862401 - RNA, 12 nt, Mycobacterium avium subsp. paratuberculosis
ccggccgcgccg

SEQ ID NO: 862402 - RNA, 15 nt, Mycobacterium avium subsp. paratuberculosis
ccggccgcgccggau

SEQ ID NO: 862403 - RNA, 15 nt, Mycobacterium avium subsp. paratuberculosis
ccggccgcgccggcc

SEQ ID NO: 862404 - RNA, 15 nt, Mycobacterium avium subsp. paratuberculosis
ccggccgcggcgugc

SEQ ID NO: 862405 - RNA, 17 nt, Mycobacterium avium subsp. paratuberculosis
ccggccgcggcgugcaa

SEQ ID NO: 862406 - RNA, 15 nt, Mycobacterium avium subsp. paratuberculosis
ccggccgcgggcgau

SEQ ID NO: 862407 - RNA, 15 nt, Mycobacterium avium subsp. paratuberculosis
ccggccgcggugacc

SEQ ID NO: 862408 - RNA, 18 nt, Mycobacterium avium subsp. paratuberculosis
ccggccgcggugaccgcg

SEQ ID NO: 862409 - RNA, 21 nt, Mycobacterium avium subsp. paratuberculosis
ccggccgcggugaccgcgccg

SEQ ID NO: 862410 - RNA, 15 nt, Mycobacterium avium subsp. paratuberculosis
ccggccgcggugugc

SEQ ID NO: 862411 - RNA, 23 nt, Mycobacterium avium subsp. paratuberculosis
ccggccgcguacuucgcgcccug

SEQ ID NO: 862412 - RNA, 15 nt, Mycobacterium avium subsp. paratuberculosis
ccggccgagcgcagc

SEQ ID NO: 862413 - RNA, 19 nt, Mycobacterium avium subsp. paratuberculosis
ccggccgagcgcgccgagc

SEQ ID NO: 862414 - RNA, 22 nt, Mycobacterium avium subsp. paratuberculosis
ccggccgagcgcgccgagcagc

SEQ ID NO: 862415 - RNA, 21 nt, Mycobacterium avium subsp. paratuberculosis
ccggccgagccgagccgaccc

SEQ ID NO: 862416 - RNA, 14 nt, Mycobacterium avium subsp. paratuberculosis
ccggccgcgacagc

SEQ ID NO: 862417 - RNA, 17 nt, Mycobacterium avium subsp. paratuberculosis
ccggccgcgacagccgg

SEQ ID NO: 862418 - RNA, 20 nt, Mycobacterium avium subsp. paratuberculosis
ccggccgcgcaccgccccgc

SEQ ID NO: 862419 - RNA, 14 nt, Mycobacterium avium subsp. paratuberculosis
ccggccagccgcgc

SEQ ID NO: 862420 - RNA, 16 nt, Mycobacterium avium subsp. paratuberculosis
ccggccagcggcagcg

SEQ ID NO: 862421 - RNA, 16 nt, Mycobacterium avium subsp. paratuberculosis
ccggccagcggcaucc

SEQ ID NO: 862422 - RNA, 14 nt, Mycobacterium avium subsp. paratuberculosis
ccggccagcggcca

SEQ ID NO: 862423 - RNA, 15 nt, Mycobacterium avium subsp. paratuberculosis
ccggccagcggccag

SEQ ID NO: 862424 - RNA, 16 nt, Mycobacterium avium subsp. paratuberculosis
ccggccagcggccagc

SEQ ID NO: 862425 - RNA, 19 nt, Mycobacterium avium subsp. paratuberculosis
ccggccagcauggucucgc

SEQ ID NO: 862426 - RNA, 12 nt, Mycobacterium avium subsp. paratuberculosis
ccggccagccgc

SEQ ID NO: 862427 - RNA, 15 nt, Mycobacterium avium subsp. paratuberculosis
ccggccagccgcgcg

SEQ ID NO: 862428 - RNA, 14 nt, Mycobacterium avium subsp. paratuberculosis
ccggccagccggcc

SEQ ID NO: 862429 - RNA, 20 nt, Mycobacterium avium subsp. paratuberculosis
ccggccagccggccgcugac

SEQ ID NO: 862430 - RNA, 17 nt, Mycobacterium avium subsp. paratuberculosis
ccggccagccgggcggc

SEQ ID NO: 862431 - RNA, 14 nt, Mycobacterium avium subsp. paratuberculosis
ccggccagccgggg

SEQ ID NO: 862432 - RNA, 20 nt, Mycobacterium avium subsp. paratuberculosis
ccggccagccgguaugcgau

SEQ ID NO: 862433 - RNA, 13 nt, Mycobacterium avium subsp. paratuberculosis
ccggccagcacgc

SEQ ID NO: 862434 - RNA, 15 nt, Mycobacterium avium subsp. paratuberculosis
ccggccagcagcggc

SEQ ID NO: 862435 - RNA, 18 nt, Mycobacterium avium subsp. paratuberculosis
ccggccagcagcggcuug

SEQ ID NO: 862436 - RNA, 13 nt, Mycobacterium avium subsp. paratuberculosis
ccggccagcaggu

SEQ ID NO: 862437 - RNA, 13 nt, Mycobacterium avium subsp. paratuberculosis
ccggccagcagca

SEQ ID NO: 862438 - RNA, 16 nt, Mycobacterium avium subsp. paratuberculosis
ccggccagcagcagcc

SEQ ID NO: 862439 - RNA, 17 nt, Mycobacterium avium subsp. paratuberculosis
ccggccagcagcaggua

SEQ ID NO: 862440 - RNA, 19 nt, Mycobacterium avium subsp. paratuberculosis
ccggccagcagcagguagc

SEQ ID NO: 862441 - RNA, 14 nt, Mycobacterium avium subsp. paratuberculosis
ccggccagcagccg

SEQ ID NO: 862442 - RNA, 17 nt, Mycobacterium avium subsp. paratuberculosis
ccggccagcagccgcuc

SEQ ID NO: 862443 - RNA, 13 nt, Mycobacterium avium subsp. paratuberculosis
ccggccagcagcg

SEQ ID NO: 862444 - RNA, 16 nt, Mycobacterium avium subsp. paratuberculosis
ccggccagcacgccgu

SEQ ID NO: 862445 - RNA, 15 nt, Mycobacterium avium subsp. paratuberculosis
ccggccagcacgccu

SEQ ID NO: 862446 - RNA, 20 nt, Mycobacterium avium subsp. paratuberculosis
ccggccagcacggccagcca

SEQ ID NO: 862447 - RNA, 16 nt, Mycobacterium avium subsp. paratuberculosis
ccggccagcacggcgg

SEQ ID NO: 862448 - RNA, 20 nt, Mycobacterium avium subsp. paratuberculosis
ccggccagcacggcggcgug

SEQ ID NO: 862449 - RNA, 13 nt, Mycobacterium avium subsp. paratuberculosis
ccggccacgucga

SEQ ID NO: 862450 - RNA, 13 nt, Mycobacterium avium subsp. paratuberculosis
ccggccagaucga

SEQ ID NO: 862451 - RNA, 21 nt, Mycobacterium avium subsp. paratuberculosis
ccggccagaucgacgccgcgg

SEQ ID NO: 862452 - RNA, 13 nt, Mycobacterium avium subsp. paratuberculosis
ccggccagcacac

SEQ ID NO: 862453 - RNA, 12 nt, Mycobacterium avium subsp. paratuberculosis
ccggccagcacc

SEQ ID NO: 862454 - RNA, 13 nt, Mycobacterium avium subsp. paratuberculosis
ccggccagcaccc

SEQ ID NO: 862455 - RNA, 13 nt, Mycobacterium avium subsp. paratuberculosis
ccggccagcacga

SEQ ID NO: 862456 - RNA, 11 nt, Mycobacterium avium subsp. paratuberculosis
ccggccacgcc

SEQ ID NO: 862457 - RNA, 12 nt, Mycobacterium avium subsp. paratuberculosis
ccggccacgccg

SEQ ID NO: 862458 - RNA, 16 nt, Mycobacterium avium subsp. paratuberculosis
ccggccaccuggccgg

SEQ ID NO: 862459 - RNA, 18 nt, Mycobacterium avium subsp. paratuberculosis
ccggccaccucgucggcg

SEQ ID NO: 862460 - RNA, 20 nt, Mycobacterium avium subsp. paratuberculosis
ccggccaccucgucggcggu

SEQ ID NO: 862461 - RNA, 12 nt, Mycobacterium avium subsp. paratuberculosis
ccggccaccacg

SEQ ID NO: 862462 - RNA, 11 nt, Mycobacterium avium subsp. paratuberculosis
ccggccacgcu

SEQ ID NO: 862463 - RNA, 15 nt, Mycobacterium avium subsp. paratuberculosis
ccggccacgcucggc

SEQ ID NO: 862464 - RNA, 16 nt, Mycobacterium avium subsp. paratuberculosis
ccggccacgcucggcg

SEQ ID NO: 862465 - RNA, 17 nt, Mycobacterium avium subsp. paratuberculosis
ccggccacgcucggcgg

SEQ ID NO: 862466 - RNA, 18 nt, Mycobacterium avium subsp. paratuberculosis
ccggccacgcucggcggc

SEQ ID NO: 862467 - RNA, 21 nt, Mycobacterium avium subsp. paratuberculosis
ccggccacgcucggcggcgcg

SEQ ID NO: 862468 - RNA, 22 nt, Mycobacterium avium subsp. paratuberculosis
ccggccacgcucggcggcgcgc

SEQ ID NO: 862469 - RNA, 23 nt, Mycobacterium avium subsp. paratuberculosis
ccggccacgcucggcggcgcgca

SEQ ID NO: 862470 - RNA, 13 nt, Mycobacterium avium subsp. paratuberculosis
ccggccaccggcg

SEQ ID NO: 862471 - RNA, 15 nt, Mycobacterium avium subsp. paratuberculosis
ccggccaccggcgcg

SEQ ID NO: 862472 - RNA, 16 nt, Mycobacterium avium subsp. paratuberculosis
ccggccaccggcgcga

SEQ ID NO: 862473 - RNA, 21 nt, Mycobacterium avium subsp. paratuberculosis
ccggccaccagggcgaccgcc

SEQ ID NO: 862474 - RNA, 22 nt, Mycobacterium avium subsp. paratuberculosis
ccggccaccaggucgcacacca

SEQ ID NO: 862475 - RNA, 17 nt, Mycobacterium avium subsp. paratuberculosis
ccggccaccgccccagc

SEQ ID NO: 862476 - RNA, 12 nt, Mycobacterium avium subsp. paratuberculosis
ccggccaccaac

SEQ ID NO: 862477 - RNA, 19 nt, Mycobacterium avium subsp. paratuberculosis
ccggccaccaacaggucgg

SEQ ID NO: 862478 - RNA, 20 nt, Mycobacterium avium subsp. paratuberculosis
ccggccaccaacaggucggc

SEQ ID NO: 862479 - RNA, 21 nt, Mycobacterium avium subsp. paratuberculosis
ccggccaccaacaggucggcg

SEQ ID NO: 862480 - RNA, 15 nt, Mycobacterium avium subsp. paratuberculosis
ccggcauucgugugg

SEQ ID NO: 862481 - RNA, 18 nt, Mycobacterium avium subsp. paratuberculosis
ccggcauucguguggcgc

SEQ ID NO: 862482 - RNA, 13 nt, Mycobacterium avium subsp. paratuberculosis
ccggcaugguucc

SEQ ID NO: 862483 - RNA, 23 nt, Mycobacterium avium subsp. paratuberculosis
ccggcauguacaggaucaacucg

SEQ ID NO: 862484 - RNA, 22 nt, Mycobacterium avium subsp. paratuberculosis
ccggaaaaagcguugcgccagc

SEQ ID NO: 862485 - RNA, 14 nt, Mycobacterium avium subsp. paratuberculosis
ccgcuugccgacgu

SEQ ID NO: 862486 - RNA, 18 nt, Mycobacterium avium subsp. paratuberculosis
ccgcuugccggauugcga

SEQ ID NO: 862487 - RNA, 17 nt, Mycobacterium avium subsp. paratuberculosis
ccgcuuuccaccccggc

SEQ ID NO: 862488 - RNA, 18 nt, Mycobacterium avium subsp. paratuberculosis
ccgcuuuccaccccggcg

SEQ ID NO: 862489 - RNA, 23 nt, Mycobacterium avium subsp. paratuberculosis
ccgcuuugaauugagcgccgggg

SEQ ID NO: 862490 - RNA, 22 nt, Mycobacterium avium subsp. paratuberculosis
ccgcuuugugaggcgcgccggu

SEQ ID NO: 862491 - RNA, 20 nt, Mycobacterium avium subsp. paratuberculosis
ccgcuugcgcagcgucgugu

SEQ ID NO: 862492 - RNA, 15 nt, Mycobacterium avium subsp. paratuberculosis
ccgcuuggcccaccg

SEQ ID NO: 862493 - RNA, 14 nt, Mycobacterium avium subsp. paratuberculosis
ccgcuugguggcgc

SEQ ID NO: 862494 - RNA, 18 nt, Mycobacterium avium subsp. paratuberculosis
ccgcuugguggcgccggu

SEQ ID NO: 862495 - RNA, 13 nt, Mycobacterium avium subsp. paratuberculosis
ccgcuugacgccg

SEQ ID NO: 862496 - RNA, 18 nt, Mycobacterium avium subsp. paratuberculosis
ccgcuucuggcgggcgaa

SEQ ID NO: 862497 - RNA, 16 nt, Mycobacterium avium subsp. paratuberculosis
ccggcgaaacacagca

SEQ ID NO: 862498 - RNA, 20 nt, Mycobacterium avium subsp. paratuberculosis
ccggcgaaacacagcagcac

SEQ ID NO: 862499 - RNA, 21 nt, Mycobacterium avium subsp. paratuberculosis
ccggcgaaacacagcagcacg

SEQ ID NO: 862500 - RNA, 14 nt, Mycobacterium avium subsp. paratuberculosis
ccggccugccaccg

SEQ ID NO: 862501 - RNA, 21 nt, Mycobacterium avium subsp. paratuberculosis
ccggccuuggcccgcgcccgc

SEQ ID NO: 862502 - RNA, 20 nt, Mycobacterium avium subsp. paratuberculosis
ccggccugcagcgcggucau

SEQ ID NO: 862503 - RNA, 15 nt, Mycobacterium avium subsp. paratuberculosis
ccggcgaacaccacg

SEQ ID NO: 862504 - RNA, 16 nt, Mycobacterium avium subsp. paratuberculosis
ccggcgaacaccacgg

SEQ ID NO: 862505 - RNA, 22 nt, Mycobacterium avium subsp. paratuberculosis
ccggcgaacaccacgguccccg

SEQ ID NO: 862506 - RNA, 15 nt, Mycobacterium avium subsp. paratuberculosis
ccggcgaaccgccgc

SEQ ID NO: 862507 - RNA, 18 nt, Mycobacterium avium subsp. paratuberculosis
ccggcgaaccgccgcacc

SEQ ID NO: 862508 - RNA, 22 nt, Mycobacterium avium subsp. paratuberculosis
ccggcgaaccgccgcacccagc

SEQ ID NO: 862509 - RNA, 19 nt, Mycobacterium avium subsp. paratuberculosis
ccggcgaaccgggacagcc

SEQ ID NO: 862510 - RNA, 23 nt, Mycobacterium avium subsp. paratuberculosis
ccggcgaaccgggacagccgcgc

SEQ ID NO: 862511 - RNA, 14 nt, Mycobacterium avium subsp. paratuberculosis
ccggcgaacgccuc

SEQ ID NO: 862512 - RNA, 16 nt, Mycobacterium avium subsp. paratuberculosis
ccggcgaacgccucgg

SEQ ID NO: 862513 - RNA, 20 nt, Mycobacterium avium subsp. paratuberculosis
ccggcgaacgacgucgaggu

SEQ ID NO: 862514 - RNA, 16 nt, Mycobacterium avium subsp. paratuberculosis
ccggcgaacucgcggc

SEQ ID NO: 862515 - RNA, 18 nt, Mycobacterium avium subsp. paratuberculosis
ccggcgaacucgcggcgg

SEQ ID NO: 862516 - RNA, 19 nt, Mycobacterium avium subsp. paratuberculosis
ccggcgaacucgcggcggg

SEQ ID NO: 862517 - RNA, 20 nt, Mycobacterium avium subsp. paratuberculosis
ccggcgaagcucgacgauga

SEQ ID NO: 862518 - RNA, 16 nt, Mycobacterium avium subsp. paratuberculosis
ccggcgaaggacagcc

SEQ ID NO: 862519 - RNA, 21 nt, Mycobacterium avium subsp. paratuberculosis
ccggcgaaggacagccggacg

SEQ ID NO: 862520 - RNA, 22 nt, Mycobacterium avium subsp. paratuberculosis
ccggcgcacaucguggcgacga

SEQ ID NO: 862521 - RNA, 13 nt, Mycobacterium avium subsp. paratuberculosis
ccggcgcaccagg

SEQ ID NO: 862522 - RNA, 14 nt, Mycobacterium avium subsp. paratuberculosis
ccggcgcaccaggc

SEQ ID NO: 862523 - RNA, 16 nt, Mycobacterium avium subsp. paratuberculosis
ccggcgcaccaggcgc

SEQ ID NO: 862524 - RNA, 17 nt, Mycobacterium avium subsp. paratuberculosis
ccggcgcaccaggcgcc

SEQ ID NO: 862525 - RNA, 18 nt, Mycobacterium avium subsp. paratuberculosis
ccggcgcaccaggcgcca

SEQ ID NO: 862526 - RNA, 12 nt, Mycobacterium avium subsp. paratuberculosis
ccggcgcacccg

SEQ ID NO: 862527 - RNA, 13 nt, Mycobacterium avium subsp. paratuberculosis
ccggcgcaccgcg

SEQ ID NO: 862528 - RNA, 14 nt, Mycobacterium avium subsp. paratuberculosis
ccggcgcaccgcgu

SEQ ID NO: 862529 - RNA, 16 nt, Mycobacterium avium subsp. paratuberculosis
ccggcgcaccgcgucg

SEQ ID NO: 862530 - RNA, 17 nt, Mycobacterium avium subsp. paratuberculosis
ccggcgcaccgcgucga

SEQ ID NO: 862531 - RNA, 21 nt, Mycobacterium avium subsp. paratuberculosis
ccggcgcaucaucucggcgaa

SEQ ID NO: 862532 - RNA, 15 nt, Mycobacterium avium subsp. paratuberculosis
ccggcgccacgacug

SEQ ID NO: 862533 - RNA, 21 nt, Mycobacterium avium subsp. paratuberculosis
ccggcgccacgacugcgcggc

SEQ ID NO: 862534 - RNA, 23 nt, Mycobacterium avium subsp. paratuberculosis
ccggcgccacgacugcgcggccg

SEQ ID NO: 862535 - RNA, 14 nt, Mycobacterium avium subsp. paratuberculosis
ccggcgccacgccg

SEQ ID NO: 862536 - RNA, 19 nt, Mycobacterium avium subsp. paratuberculosis
ccggcgcaguccagggugg

SEQ ID NO: 862537 - RNA, 22 nt, Mycobacterium avium subsp. paratuberculosis
ccggcgcaguccaggguggugg

SEQ ID NO: 862538 - RNA, 19 nt, Mycobacterium avium subsp. paratuberculosis
ccggcgcagcgccgcgccg

SEQ ID NO: 862539 - RNA, 14 nt, Mycobacterium avium subsp. paratuberculosis
ccggcgcagcgcgu

SEQ ID NO: 862540 - RNA, 20 nt, Mycobacterium avium subsp. paratuberculosis
ccggcgcagcgcgucgcgcc

SEQ ID NO: 862541 - RNA, 22 nt, Mycobacterium avium subsp. paratuberculosis
ccggcgcagcgcgucgcgcccg

SEQ ID NO: 862542 - RNA, 13 nt, Mycobacterium avium subsp. paratuberculosis
ccggcgcagcggc

SEQ ID NO: 862543 - RNA, 14 nt, Mycobacterium avium subsp. paratuberculosis
ccggcgcagcggcc

SEQ ID NO: 862544 - RNA, 22 nt, Mycobacterium avium subsp. paratuberculosis
ccggcgaagcuaaaccccacgg

SEQ ID NO: 862545 - RNA, 18 nt, Mycobacterium avium subsp. paratuberculosis
ccggcgauuucggccgug

SEQ ID NO: 862546 - RNA, 16 nt, Mycobacterium avium subsp. paratuberculosis
ccggcgcaacucgucc

SEQ ID NO: 862547 - RNA, 24 nt, Mycobacterium avium subsp. paratuberculosis
ccggcgcaacucguccagcgucgc

SEQ ID NO: 862548 - RNA, 14 nt, Mycobacterium avium subsp. paratuberculosis
ccggcgcacggcgc

SEQ ID NO: 862549 - RNA, 21 nt, Mycobacterium avium subsp. paratuberculosis
ccggcgcacggcgcccagguc

SEQ ID NO: 862550 - RNA, 16 nt, Mycobacterium avium subsp. paratuberculosis
ccggcgcacucccgcg

SEQ ID NO: 862551 - RNA, 15 nt, Mycobacterium avium subsp. paratuberculosis
ccggcgcagcaacuc

SEQ ID NO: 862552 - RNA, 13 nt, Mycobacterium avium subsp. paratuberculosis
ccggcgcagccgg

SEQ ID NO: 862553 - RNA, 16 nt, Mycobacterium avium subsp. paratuberculosis
ccggcgcagccggcca

SEQ ID NO: 862554 - RNA, 17 nt, Mycobacterium avium subsp. paratuberculosis
ccggcgcagccggccac

SEQ ID NO: 862555 - RNA, 19 nt, Mycobacterium avium subsp. paratuberculosis
ccggcgcagccggccaccg

SEQ ID NO: 862556 - RNA, 15 nt, Mycobacterium avium subsp. paratuberculosis
ccggcgccgggucgc

SEQ ID NO: 862557 - RNA, 18 nt, Mycobacterium avium subsp. paratuberculosis
ccggcgccgggucgcggu

SEQ ID NO: 862558 - RNA, 12 nt, Mycobacterium avium subsp. paratuberculosis
ccggcgccgguc

SEQ ID NO: 862559 - RNA, 13 nt, Mycobacterium avium subsp. paratuberculosis
ccggcgccgguca

SEQ ID NO: 862560 - RNA, 14 nt, Mycobacterium avium subsp. paratuberculosis
ccggcgccggucag

SEQ ID NO: 862561 - RNA, 16 nt, Mycobacterium avium subsp. paratuberculosis
ccggcgccggucagcg

SEQ ID NO: 862562 - RNA, 18 nt, Mycobacterium avium subsp. paratuberculosis
ccggcgccggucguuacg

SEQ ID NO: 862563 - RNA, 12 nt, Mycobacterium avium subsp. paratuberculosis
ccggcgccggug

SEQ ID NO: 862564 - RNA, 13 nt, Mycobacterium avium subsp. paratuberculosis
ccggcgccggugc

SEQ ID NO: 862565 - RNA, 23 nt, Mycobacterium avium subsp. paratuberculosis
ccggcgccggugccgcagccguc

SEQ ID NO: 862566 - RNA, 15 nt, Mycobacterium avium subsp. paratuberculosis
ccggcgccgucguuc

SEQ ID NO: 862567 - RNA, 21 nt, Mycobacterium avium subsp. paratuberculosis
ccggcgccgucguucuccauc

SEQ ID NO: 862568 - RNA, 23 nt, Mycobacterium avium subsp. paratuberculosis
ccggcgccucgaugcggguguug

SEQ ID NO: 862569 - RNA, 16 nt, Mycobacterium avium subsp. paratuberculosis
ccggcgccucggcgcc

SEQ ID NO: 862570 - RNA, 20 nt, Mycobacterium avium subsp. paratuberculosis
ccggcgccucggcgccucgg

SEQ ID NO: 862571 - RNA, 18 nt, Mycobacterium avium subsp. paratuberculosis
ccggcgccgggcagcccg

SEQ ID NO: 862572 - RNA, 12 nt, Mycobacterium avium subsp. paratuberculosis
ccggcgccgggc

SEQ ID NO: 862573 - RNA, 13 nt, Mycobacterium avium subsp. paratuberculosis
ccggcgccggcgg

SEQ ID NO: 862574 - RNA, 16 nt, Mycobacterium avium subsp. paratuberculosis
ccggcgccggcggcca

SEQ ID NO: 862575 - RNA, 16 nt, Mycobacterium avium subsp. paratuberculosis
ccggcgccggcgguca

SEQ ID NO: 862576 - RNA, 18 nt, Mycobacterium avium subsp. paratuberculosis
ccggcgccggcggucagc

SEQ ID NO: 862577 - RNA, 21 nt, Mycobacterium avium subsp. paratuberculosis
ccggcgccggcggucagcuca

SEQ ID NO: 862578 - RNA, 14 nt, Mycobacterium avium subsp. paratuberculosis
ccggcgccggccga

SEQ ID NO: 862579 - RNA, 15 nt, Mycobacterium avium subsp. paratuberculosis
ccggcgccggccgac

SEQ ID NO: 862580 - RNA, 16 nt, Mycobacterium avium subsp. paratuberculosis
ccggcgccggccgaca

SEQ ID NO: 862581 - RNA, 15 nt, Mycobacterium avium subsp. paratuberculosis
ccggcgccggccgcc

SEQ ID NO: 862582 - RNA, 16 nt, Mycobacterium avium subsp. paratuberculosis
ccggcgccggccgccg

SEQ ID NO: 862583 - RNA, 17 nt, Mycobacterium avium subsp. paratuberculosis
ccggcgccggccgccgg

SEQ ID NO: 862584 - RNA, 12 nt, Mycobacterium avium subsp. paratuberculosis
ccggcgccggcg

SEQ ID NO: 862585 - RNA, 21 nt, Mycobacterium avium subsp. paratuberculosis
ccggcgccgccgaccgcccgc

SEQ ID NO: 862586 - RNA, 17 nt, Mycobacterium avium subsp. paratuberculosis
ccggcgccgccaccacg

SEQ ID NO: 862587 - RNA, 15 nt, Mycobacterium avium subsp. paratuberculosis
ccggcgcccgucacg

SEQ ID NO: 862588 - RNA, 19 nt, Mycobacterium avium subsp. paratuberculosis
ccggcgcccgucacgcugg

SEQ ID NO: 862589 - RNA, 23 nt, Mycobacterium avium subsp. paratuberculosis
ccggcgcccgucacgcuggcgug

SEQ ID NO: 862590 - RNA, 16 nt, Mycobacterium avium subsp. paratuberculosis
ccggcgcccuucggcg

SEQ ID NO: 862591 - RNA, 21 nt, Mycobacterium avium subsp. paratuberculosis
ccggcgcccuucggcgcccgc

SEQ ID NO: 862592 - RNA, 23 nt, Mycobacterium avium subsp. paratuberculosis
ccggcgcccuucggcgcccgcuc

SEQ ID NO: 862593 - RNA, 12 nt, Mycobacterium avium subsp. paratuberculosis
ccggcgccgauc

SEQ ID NO: 862594 - RNA, 19 nt, Mycobacterium avium subsp. paratuberculosis
ccggcgccgauuccgucgg

SEQ ID NO: 862595 - RNA, 22 nt, Mycobacterium avium subsp. paratuberculosis
ccggcgccgcagcggcgccggg

SEQ ID NO: 862596 - RNA, 24 nt, Mycobacterium avium subsp. paratuberculosis
ccggcgcccugcacccagccgugc

SEQ ID NO: 862597 - RNA, 15 nt, Mycobacterium avium subsp. paratuberculosis
ccggcgcccugcgcg

SEQ ID NO: 862598 - RNA, 18 nt, Mycobacterium avium subsp. paratuberculosis
ccggcgcccggcgcgcca

SEQ ID NO: 862599 - RNA, 15 nt, Mycobacterium avium subsp. paratuberculosis
ccggcgcccggcucc

SEQ ID NO: 862600 - RNA, 19 nt, Mycobacterium avium subsp. paratuberculosis
ccggcgccgaagcccgcag

SEQ ID NO: 862601 - RNA, 24 nt, Mycobacterium avium subsp. paratuberculosis
ccggcgccgaagccgucgaccccg

SEQ ID NO: 862602 - RNA, 20 nt, Mycobacterium avium subsp. paratuberculosis
ccggcgccgaccaggcucgc

SEQ ID NO: 862603 - RNA, 13 nt, Mycobacterium avium subsp. paratuberculosis
ccggcgccgaccc

SEQ ID NO: 862604 - RNA, 16 nt, Mycobacterium avium subsp. paratuberculosis
ccggcgccgacccccg

SEQ ID NO: 862605 - RNA, 20 nt, Mycobacterium avium subsp. paratuberculosis
ccggcgccgacccccgccgc

SEQ ID NO: 862606 - RNA, 15 nt, Mycobacterium avium subsp. paratuberculosis
ccggcgccgaccgag

SEQ ID NO: 862607 - RNA, 22 nt, Mycobacterium avium subsp. paratuberculosis
ccggcgccgaccgagggcgcgg

SEQ ID NO: 862608 - RNA, 13 nt, Mycobacterium avium subsp. paratuberculosis
ccggcgcccggcc

SEQ ID NO: 862609 - RNA, 16 nt, Mycobacterium avium subsp. paratuberculosis
ccggcgcccggccggu

SEQ ID NO: 862610 - RNA, 17 nt, Mycobacterium avium subsp. paratuberculosis
ccggcgcccggccggug

SEQ ID NO: 862611 - RNA, 11 nt, Mycobacterium avium subsp. paratuberculosis
ccggcgcccga

SEQ ID NO: 862612 - RNA, 12 nt, Mycobacterium avium subsp. paratuberculosis
ccggcgcccgau

SEQ ID NO: 862613 - RNA, 21 nt, Mycobacterium avium subsp. paratuberculosis
ccggcgcccgaucggcacccg

SEQ ID NO: 862614 - RNA, 13 nt, Mycobacterium avium subsp. paratuberculosis
ccggcgcccgcag

SEQ ID NO: 862615 - RNA, 20 nt, Mycobacterium avium subsp. paratuberculosis
ccggcgcccgcaggccgcga

SEQ ID NO: 862616 - RNA, 17 nt, Mycobacterium avium subsp. paratuberculosis
ccggcgccagcccggug

SEQ ID NO: 862617 - RNA, 14 nt, Mycobacterium avium subsp. paratuberculosis
ccggcgccaggccg

SEQ ID NO: 862618 - RNA, 16 nt, Mycobacterium avium subsp. paratuberculosis
ccggcgccaggccggc

SEQ ID NO: 862619 - RNA, 17 nt, Mycobacterium avium subsp. paratuberculosis
ccggcgccaggccggcg

SEQ ID NO: 862620 - RNA, 20 nt, Mycobacterium avium subsp. paratuberculosis
ccggcgccaggccggcgacg

SEQ ID NO: 862621 - RNA, 22 nt, Mycobacterium avium subsp. paratuberculosis
ccggcgccaggccggcgacgcc

SEQ ID NO: 862622 - RNA, 15 nt, Mycobacterium avium subsp. paratuberculosis
ccggcgcccagcggc

SEQ ID NO: 862623 - RNA, 18 nt, Mycobacterium avium subsp. paratuberculosis
ccggcgcccagcggcgau

SEQ ID NO: 862624 - RNA, 20 nt, Mycobacterium avium subsp. paratuberculosis
ccggcgcccagcggcgaugc

SEQ ID NO: 862625 - RNA, 19 nt, Mycobacterium avium subsp. paratuberculosis
ccggcgcgggggcggccug

SEQ ID NO: 862626 - RNA, 14 nt, Mycobacterium avium subsp. paratuberculosis
ccggcgcggugauu

SEQ ID NO: 862627 - RNA, 16 nt, Mycobacterium avium subsp. paratuberculosis
ccggcgcggugcucgg

SEQ ID NO: 862628 - RNA, 12 nt, Mycobacterium avium subsp. paratuberculosis
ccggcgcggugg

SEQ ID NO: 862629 - RNA, 12 nt, Mycobacterium avium subsp. paratuberculosis
ccggcgcgggca

SEQ ID NO: 862630 - RNA, 14 nt, Mycobacterium avium subsp. paratuberculosis
ccggcgcggcggcg

SEQ ID NO: 862631 - RNA, 17 nt, Mycobacterium avium subsp. paratuberculosis
ccggcgcggcggcgacg

SEQ ID NO: 862632 - RNA, 22 nt, Mycobacterium avium subsp. paratuberculosis
ccggcgcggcggcgacgucgac

SEQ ID NO: 862633 - RNA, 15 nt, Mycobacterium avium subsp. paratuberculosis
ccggcgcggcggcgc

SEQ ID NO: 862634 - RNA, 18 nt, Mycobacterium avium subsp. paratuberculosis
ccggcgcggccgcccagc

SEQ ID NO: 862635 - RNA, 13 nt, Mycobacterium avium subsp. paratuberculosis
ccggcgcggccgc

SEQ ID NO: 862636 - RNA, 20 nt, Mycobacterium avium subsp. paratuberculosis
ccggcgcggaacgcgccggg

SEQ ID NO: 862637 - RNA, 24 nt, Mycobacterium avium subsp. paratuberculosis
ccggcgcggaacgcgccgggcaac

SEQ ID NO: 862638 - RNA, 18 nt, Mycobacterium avium subsp. paratuberculosis
ccggcgcgccugcgcggc

SEQ ID NO: 862639 - RNA, 18 nt, Mycobacterium avium subsp. paratuberculosis
ccggcgcgcugaagcgcg

SEQ ID NO: 862640 - RNA, 21 nt, Mycobacterium avium subsp. paratuberculosis
ccggcgcgcugaagcgcgacc

SEQ ID NO: 862641 - RNA, 16 nt, Mycobacterium avium subsp. paratuberculosis
ccggcgcggacagcgc

SEQ ID NO: 862642 - RNA, 18 nt, Mycobacterium avium subsp. paratuberculosis
ccggcgcggacagcgcgg

SEQ ID NO: 862643 - RNA, 20 nt, Mycobacterium avium subsp. paratuberculosis
ccggcgcggacagcgcggug

SEQ ID NO: 862644 - RNA, 13 nt, Mycobacterium avium subsp. paratuberculosis
ccggcgcggacgg

SEQ ID NO: 862645 - RNA, 19 nt, Mycobacterium avium subsp. paratuberculosis
ccggcgcgcgagcgucacg

SEQ ID NO: 862646 - RNA, 20 nt, Mycobacterium avium subsp. paratuberculosis
ccggcgcgcgagcgucacgc

SEQ ID NO: 862647 - RNA, 12 nt, Mycobacterium avium subsp. paratuberculosis
ccggcgcgccgu

SEQ ID NO: 862648 - RNA, 15 nt, Mycobacterium avium subsp. paratuberculosis
ccggcgcgccguccu

SEQ ID NO: 862649 - RNA, 16 nt, Mycobacterium avium subsp. paratuberculosis
ccggcgcgccguccuu

SEQ ID NO: 862650 - RNA, 19 nt, Mycobacterium avium subsp. paratuberculosis
ccggcgcgcccgagucacc

SEQ ID NO: 862651 - RNA, 21 nt, Mycobacterium avium subsp. paratuberculosis
ccggcgcgcccgagucacccg

SEQ ID NO: 862652 - RNA, 22 nt, Mycobacterium avium subsp. paratuberculosis
ccggcgcgcccgagucacccgg

SEQ ID NO: 862653 - RNA, 19 nt, Mycobacterium avium subsp. paratuberculosis
ccggcgcgcccggaaagcg

SEQ ID NO: 862654 - RNA, 16 nt, Mycobacterium avium subsp. paratuberculosis
ccggcgcgccacgacg

SEQ ID NO: 862655 - RNA, 17 nt, Mycobacterium avium subsp. paratuberculosis
ccggcgcgccacgacgu

SEQ ID NO: 862656 - RNA, 19 nt, Mycobacterium avium subsp. paratuberculosis
ccggcgcgcaccccggcau

SEQ ID NO: 862657 - RNA, 16 nt, Mycobacterium avium subsp. paratuberculosis
ccggcgcgcacggcag

SEQ ID NO: 862658 - RNA, 13 nt, Mycobacterium avium subsp. paratuberculosis
ccggcgcgcagcg

SEQ ID NO: 862659 - RNA, 14 nt, Mycobacterium avium subsp. paratuberculosis
ccggcgcgaccagc

SEQ ID NO: 862660 - RNA, 14 nt, Mycobacterium avium subsp. paratuberculosis
ccggcgcgacggca

SEQ ID NO: 862661 - RNA, 15 nt, Mycobacterium avium subsp. paratuberculosis
ccggcgcgacggcgg

SEQ ID NO: 862662 - RNA, 13 nt, Mycobacterium avium subsp. paratuberculosis
ccggcgcgaucgg

SEQ ID NO: 862663 - RNA, 14 nt, Mycobacterium avium subsp. paratuberculosis
ccggcgcgaucggc

SEQ ID NO: 862664 - RNA, 17 nt, Mycobacterium avium subsp. paratuberculosis
ccggcgcgaucggccgc

SEQ ID NO: 862665 - RNA, 13 nt, Mycobacterium avium subsp. paratuberculosis
ccggcgcgcagca

SEQ ID NO: 862666 - RNA, 17 nt, Mycobacterium avium subsp. paratuberculosis
ccggcgcgcagcaucuc

SEQ ID NO: 862667 - RNA, 14 nt, Mycobacterium avium subsp. paratuberculosis
ccggcgcgcagcca

SEQ ID NO: 862668 - RNA, 22 nt, Mycobacterium avium subsp. paratuberculosis
ccggcgcgcagccaaugccgga

SEQ ID NO: 862669 - RNA, 20 nt, Mycobacterium avium subsp. paratuberculosis
ccggcgcgcagccagucgcc

SEQ ID NO: 862670 - RNA, 23 nt, Mycobacterium avium subsp. paratuberculosis
ccggcgcgcagccagucgccggc

SEQ ID NO: 862671 - RNA, 17 nt, Mycobacterium avium subsp. paratuberculosis
ccggcgcgcagcccagc

SEQ ID NO: 862672 - RNA, 17 nt, Mycobacterium avium subsp. paratuberculosis
ccggcggccauggucgc

SEQ ID NO: 862673 - RNA, 20 nt, Mycobacterium avium subsp. paratuberculosis
ccggcggccauggucgcggc

SEQ ID NO: 862674 - RNA, 22 nt, Mycobacterium avium subsp. paratuberculosis
ccggcggccauggucgcggccg

SEQ ID NO: 862675 - RNA, 12 nt, Mycobacterium avium subsp. paratuberculosis
ccggcggccgac

SEQ ID NO: 862676 - RNA, 15 nt, Mycobacterium avium subsp. paratuberculosis
ccggcggccgacagg

SEQ ID NO: 862677 - RNA, 12 nt, Mycobacterium avium subsp. paratuberculosis
ccggcggccgcc

SEQ ID NO: 862678 - RNA, 13 nt, Mycobacterium avium subsp. paratuberculosis
ccggcggccacca

SEQ ID NO: 862679 - RNA, 20 nt, Mycobacterium avium subsp. paratuberculosis
ccggcggccaccaugggcgg

SEQ ID NO: 862680 - RNA, 13 nt, Mycobacterium avium subsp. paratuberculosis
ccggcggccacga

SEQ ID NO: 862681 - RNA, 15 nt, Mycobacterium avium subsp. paratuberculosis
ccggcggccacgcag

SEQ ID NO: 862682 - RNA, 22 nt, Mycobacterium avium subsp. paratuberculosis
ccggcggccacgcaggcgucca

SEQ ID NO: 862683 - RNA, 23 nt, Mycobacterium avium subsp. paratuberculosis
ccggcggcagauagaucagcagg

SEQ ID NO: 862684 - RNA, 12 nt, Mycobacterium avium subsp. paratuberculosis
ccggcggcaggu

SEQ ID NO: 862685 - RNA, 15 nt, Mycobacterium avium subsp. paratuberculosis
ccggcggcaggugaa

SEQ ID NO: 862686 - RNA, 14 nt, Mycobacterium avium subsp. paratuberculosis
ccggcggcaggugg

SEQ ID NO: 862687 - RNA, 19 nt, Mycobacterium avium subsp. paratuberculosis
ccggcggcagugcgccguc

SEQ ID NO: 862688 - RNA, 16 nt, Mycobacterium avium subsp. paratuberculosis
ccggcggcaccgcggc

SEQ ID NO: 862689 - RNA, 18 nt, Mycobacterium avium subsp. paratuberculosis
ccggcggcaccgcggcuc

SEQ ID NO: 862690 - RNA, 19 nt, Mycobacterium avium subsp. paratuberculosis
ccggcggcaccgcggcucg

SEQ ID NO: 862691 - RNA, 15 nt, Mycobacterium avium subsp. paratuberculosis
ccggcggcaccaccc

SEQ ID NO: 862692 - RNA, 24 nt, Mycobacterium avium subsp. paratuberculosis
ccggcggcaccacccgcggccggc

SEQ ID NO: 862693 - RNA, 14 nt, Mycobacterium avium subsp. paratuberculosis
ccggcggcaccgcc

SEQ ID NO: 862694 - RNA, 14 nt, Mycobacterium avium subsp. paratuberculosis
ccggcggauucucg

SEQ ID NO: 862695 - RNA, 20 nt, Mycobacterium avium subsp. paratuberculosis
ccggcggauccucaguccgc

SEQ ID NO: 862696 - RNA, 16 nt, Mycobacterium avium subsp. paratuberculosis
ccggcggaucgcgugc

SEQ ID NO: 862697 - RNA, 20 nt, Mycobacterium avium subsp. paratuberculosis
ccggcggaaguagcccggag

SEQ ID NO: 862698 - RNA, 22 nt, Mycobacterium avium subsp. paratuberculosis
ccggcggaaguagcccggagug

SEQ ID NO: 862699 - RNA, 13 nt, Mycobacterium avium subsp. paratuberculosis
ccggcggacagcc

SEQ ID NO: 862700 - RNA, 15 nt, Mycobacterium avium subsp. paratuberculosis
ccggcggacagcccc

SEQ ID NO: 862701 - RNA, 14 nt, Mycobacterium avium subsp. paratuberculosis
ccggcggacccagc

SEQ ID NO: 862702 - RNA, 21 nt, Mycobacterium avium subsp. paratuberculosis
ccggcggacccagcuccucgg

SEQ ID NO: 862703 - RNA, 14 nt, Mycobacterium avium subsp. paratuberculosis
ccggcgcuucugcg

SEQ ID NO: 862704 - RNA, 18 nt, Mycobacterium avium subsp. paratuberculosis
ccggcgcuggcgcgccgu

SEQ ID NO: 862705 - RNA, 15 nt, Mycobacterium avium subsp. paratuberculosis
ccggcgcuggcgugc

SEQ ID NO: 862706 - RNA, 13 nt, Mycobacterium avium subsp. paratuberculosis
ccggcgcugcgcc

SEQ ID NO: 862707 - RNA, 16 nt, Mycobacterium avium subsp. paratuberculosis
ccggcgcuggaacagg

SEQ ID NO: 862708 - RNA, 13 nt, Mycobacterium avium subsp. paratuberculosis
ccggcgcucgucg

SEQ ID NO: 862709 - RNA, 13 nt, Mycobacterium avium subsp. paratuberculosis
ccggcgcucaccg

SEQ ID NO: 862710 - RNA, 15 nt, Mycobacterium avium subsp. paratuberculosis
ccggcgcucaccgcg

SEQ ID NO: 862711 - RNA, 16 nt, Mycobacterium avium subsp. paratuberculosis
ccggcgcucaccgcga

SEQ ID NO: 862712 - RNA, 18 nt, Mycobacterium avium subsp. paratuberculosis
ccggcgcucaccgcgaug

SEQ ID NO: 862713 - RNA, 20 nt, Mycobacterium avium subsp. paratuberculosis
ccggcgcguuccaucagcgc

SEQ ID NO: 862714 - RNA, 21 nt, Mycobacterium avium subsp. paratuberculosis
ccggcgcguuccaucagcgcc

SEQ ID NO: 862715 - RNA, 17 nt, Mycobacterium avium subsp. paratuberculosis
ccggcgcguuggcccgu

SEQ ID NO: 862716 - RNA, 18 nt, Mycobacterium avium subsp. paratuberculosis
ccggcgcuaaagccgacc

SEQ ID NO: 862717 - RNA, 23 nt, Mycobacterium avium subsp. paratuberculosis
ccggcgcguccggaggugccggc

SEQ ID NO: 862718 - RNA, 15 nt, Mycobacterium avium subsp. paratuberculosis
ccggcgcgggcauga

SEQ ID NO: 862719 - RNA, 19 nt, Mycobacterium avium subsp. paratuberculosis
ccggcgcggugggcggcgg

SEQ ID NO: 862720 - RNA, 13 nt, Mycobacterium avium subsp. paratuberculosis
ccuagucgacgcc

SEQ ID NO: 862721 - RNA, 17 nt, Mycobacterium avium subsp. paratuberculosis
ccuagccuuggccgcag

SEQ ID NO: 862722 - RNA, 15 nt, Mycobacterium avium subsp. paratuberculosis
ccuaggacgccgccc

SEQ ID NO: 862723 - RNA, 14 nt, Mycobacterium avium subsp. paratuberculosis
ccuagcgugccguc

SEQ ID NO: 862724 - RNA, 14 nt, Mycobacterium avium subsp. paratuberculosis
ccuaggggagcagc

SEQ ID NO: 862725 - RNA, 12 nt, Mycobacterium avium subsp. paratuberculosis
ccuaugccgcgu

SEQ ID NO: 862726 - RNA, 15 nt, Mycobacterium avium subsp. paratuberculosis
ccucagggcgcgcug

SEQ ID NO: 862727 - RNA, 13 nt, Mycobacterium avium subsp. paratuberculosis
ccucacaccucgc

SEQ ID NO: 862728 - RNA, 16 nt, Mycobacterium avium subsp. paratuberculosis
ccucauagccggccgc

SEQ ID NO: 862729 - RNA, 17 nt, Mycobacterium avium subsp. paratuberculosis
ccucauagccggccgcg

SEQ ID NO: 862730 - RNA, 17 nt, Mycobacterium avium subsp. paratuberculosis
ccucauaggcguacacc

SEQ ID NO: 862731 - RNA, 16 nt, Mycobacterium avium subsp. paratuberculosis
ccucaucgcccagccg

SEQ ID NO: 862732 - RNA, 14 nt, Mycobacterium avium subsp. paratuberculosis
ccucaugccagacg

SEQ ID NO: 862733 - RNA, 17 nt, Mycobacterium avium subsp. paratuberculosis
ccucaugccagacgcgc

SEQ ID NO: 862734 - RNA, 20 nt, Mycobacterium avium subsp. paratuberculosis
ccucaucgucgacccggccg

SEQ ID NO: 862735 - RNA, 21 nt, Mycobacterium avium subsp. paratuberculosis
ccuccgagauggacagcaccu

SEQ ID NO: 862736 - RNA, 16 nt, Mycobacterium avium subsp. paratuberculosis
ccuccgcggcgccgua

SEQ ID NO: 862737 - RNA, 12 nt, Mycobacterium avium subsp. paratuberculosis
ccuccggcggca

SEQ ID NO: 862738 - RNA, 14 nt, Mycobacterium avium subsp. paratuberculosis
ccuccggcaggccg

SEQ ID NO: 862739 - RNA, 22 nt, Mycobacterium avium subsp. paratuberculosis
ccuccggcaguacgcgccggcc

SEQ ID NO: 862740 - RNA, 22 nt, Mycobacterium avium subsp. paratuberculosis
ccuccggauggcggucgcgcca

SEQ ID NO: 862741 - RNA, 23 nt, Mycobacterium avium subsp. paratuberculosis
ccuccggauggcggucgcgccag

SEQ ID NO: 862742 - RNA, 16 nt, Mycobacterium avium subsp. paratuberculosis
ccuccggagaucgccc

SEQ ID NO: 862743 - RNA, 18 nt, Mycobacterium avium subsp. paratuberculosis
ccuccggagugacgucgc

SEQ ID NO: 862744 - RNA, 18 nt, Mycobacterium avium subsp. paratuberculosis
ccuccgugcuggccgggu

SEQ ID NO: 862745 - RNA, 19 nt, Mycobacterium avium subsp. paratuberculosis
ccuccuccgguccgggcug

SEQ ID NO: 862746 - RNA, 19 nt, Mycobacterium avium subsp. paratuberculosis
ccuccgggaaggcggccgc

SEQ ID NO: 862747 - RNA, 21 nt, Mycobacterium avium subsp. paratuberculosis
ccuccgggaaggcggccgcga

SEQ ID NO: 862748 - RNA, 23 nt, Mycobacterium avium subsp. paratuberculosis
ccuccgggcggcaccgcugccgg

SEQ ID NO: 862749 - RNA, 14 nt, Mycobacterium avium subsp. paratuberculosis
ccuccgguccgggc

SEQ ID NO: 862750 - RNA, 16 nt, Mycobacterium avium subsp. paratuberculosis
ccuccgguccgggcug

SEQ ID NO: 862751 - RNA, 17 nt, Mycobacterium avium subsp. paratuberculosis
ccuccgguuugcgccgg

SEQ ID NO: 862752 - RNA, 18 nt, Mycobacterium avium subsp. paratuberculosis
ccuccgguuugcgccggc

SEQ ID NO: 862753 - RNA, 20 nt, Mycobacterium avium subsp. paratuberculosis
ccuccgguuugcgccggcuc

SEQ ID NO: 862754 - RNA, 13 nt, Mycobacterium avium subsp. paratuberculosis
ccuccgucagcgc

SEQ ID NO: 862755 - RNA, 16 nt, Mycobacterium avium subsp. paratuberculosis
ccucgaagccgaucgc

SEQ ID NO: 862756 - RNA, 15 nt, Mycobacterium avium subsp. paratuberculosis
ccucgaauccgcggg

SEQ ID NO: 862757 - RNA, 17 nt, Mycobacterium avium subsp. paratuberculosis
ccucgaauccgcgggcg

SEQ ID NO: 862758 - RNA, 14 nt, Mycobacterium avium subsp. paratuberculosis
ccucgacaccggug

SEQ ID NO: 862759 - RNA, 16 nt, Mycobacterium avium subsp. paratuberculosis
ccucgacacgggccgc

SEQ ID NO: 862760 - RNA, 18 nt, Mycobacterium avium subsp. paratuberculosis
ccucgacacgggccgcgc

SEQ ID NO: 862761 - RNA, 21 nt, Mycobacterium avium subsp. paratuberculosis
ccucgacacgggccgcgccga

SEQ ID NO: 862762 - RNA, 22 nt, Mycobacterium avium subsp. paratuberculosis
ccucgacacgggccgcgccgag

SEQ ID NO: 862763 - RNA, 18 nt, Mycobacterium avium subsp. paratuberculosis
ccucgaccacgcacacca

SEQ ID NO: 862764 - RNA, 21 nt, Mycobacterium avium subsp. paratuberculosis
ccucgaccacgcacaccaccg

SEQ ID NO: 862765 - RNA, 16 nt, Mycobacterium avium subsp. paratuberculosis
ccucgaccagcaccgc

SEQ ID NO: 862766 - RNA, 12 nt, Mycobacterium avium subsp. paratuberculosis
ccuccucggcgc

SEQ ID NO: 862767 - RNA, 15 nt, Mycobacterium avium subsp. paratuberculosis
ccuccucgcgccgcc

SEQ ID NO: 862768 - RNA, 15 nt, Mycobacterium avium subsp. paratuberculosis
ccuccucggccagcc

SEQ ID NO: 862769 - RNA, 18 nt, Mycobacterium avium subsp. paratuberculosis
ccuccucggccagcccca

SEQ ID NO: 862770 - RNA, 17 nt, Mycobacterium avium subsp. paratuberculosis
ccucgaagggcgccagc

SEQ ID NO: 862771 - RNA, 19 nt, Mycobacterium avium subsp. paratuberculosis
ccucgaagggcgccagccg

SEQ ID NO: 862772 - RNA, 20 nt, Mycobacterium avium subsp. paratuberculosis
ccucgaagggcgccagccgu

SEQ ID NO: 862773 - RNA, 19 nt, Mycobacterium avium subsp. paratuberculosis
ccucgaaguagagccgcug

SEQ ID NO: 862774 - RNA, 16 nt, Mycobacterium avium subsp. paratuberculosis
ccucgaagucgccggc

SEQ ID NO: 862775 - RNA, 19 nt, Mycobacterium avium subsp. paratuberculosis
ccucgaagucgccggccuc

SEQ ID NO: 862776 - RNA, 18 nt, Mycobacterium avium subsp. paratuberculosis
ccucgaaguucuccucgc

SEQ ID NO: 862777 - RNA, 13 nt, Mycobacterium avium subsp. paratuberculosis
ccucgcugacguc

SEQ ID NO: 862778 - RNA, 22 nt, Mycobacterium avium subsp. paratuberculosis
ccucgcucaacccgucgcgggu

SEQ ID NO: 862779 - RNA, 17 nt, Mycobacterium avium subsp. paratuberculosis
ccucgcuaaucgccgcg

SEQ ID NO: 862780 - RNA, 20 nt, Mycobacterium avium subsp. paratuberculosis
ccucgcuacgcgagcugcuu

SEQ ID NO: 862781 - RNA, 20 nt, Mycobacterium avium subsp. paratuberculosis
ccucgcggucuucgaacauc

SEQ ID NO: 862782 - RNA, 19 nt, Mycobacterium avium subsp. paratuberculosis
ccucgcgguugcggguggc

SEQ ID NO: 862783 - RNA, 21 nt, Mycobacterium avium subsp. paratuberculosis
ccucgcgguugcggguggcgg

SEQ ID NO: 862784 - RNA, 17 nt, Mycobacterium avium subsp. paratuberculosis
ccucgcuggaaaccucu

SEQ ID NO: 862785 - RNA, 12 nt, Mycobacterium avium subsp. paratuberculosis
ccucggaccggu

SEQ ID NO: 862786 - RNA, 11 nt, Mycobacterium avium subsp. paratuberculosis
ccucggcgauc

SEQ ID NO: 862787 - RNA, 14 nt, Mycobacterium avium subsp. paratuberculosis
ccucggcgacgucc

SEQ ID NO: 862788 - RNA, 19 nt, Mycobacterium avium subsp. paratuberculosis
ccucggcgagcgaggccau

SEQ ID NO: 862789 - RNA, 20 nt, Mycobacterium avium subsp. paratuberculosis
ccucggagaugauggccgcg

SEQ ID NO: 862790 - RNA, 15 nt, Mycobacterium avium subsp. paratuberculosis
ccucggcgaccacgu

SEQ ID NO: 862791 - RNA, 16 nt, Mycobacterium avium subsp. paratuberculosis
ccucggcgaccacguc

SEQ ID NO: 862792 - RNA, 18 nt, Mycobacterium avium subsp. paratuberculosis
ccucggcgaccagcgacg

SEQ ID NO: 862793 - RNA, 15 nt, Mycobacterium avium subsp. paratuberculosis
ccucggcgaccgccc

SEQ ID NO: 862794 - RNA, 17 nt, Mycobacterium avium subsp. paratuberculosis
ccucggcgaccgcccgg

SEQ ID NO: 862795 - RNA, 18 nt, Mycobacterium avium subsp. paratuberculosis
ccucggcgacgauggcca

SEQ ID NO: 862796 - RNA, 22 nt, Mycobacterium avium subsp. paratuberculosis
ccucggccuugaccacggugcg

SEQ ID NO: 862797 - RNA, 18 nt, Mycobacterium avium subsp. paratuberculosis
ccucggccuugccgcugu

SEQ ID NO: 862798 - RNA, 16 nt, Mycobacterium avium subsp. paratuberculosis
ccucggccggguccug

SEQ ID NO: 862799 - RNA, 18 nt, Mycobacterium avium subsp. paratuberculosis
ccucggccggguccugga

SEQ ID NO: 862800 - RNA, 15 nt, Mycobacterium avium subsp. paratuberculosis
ccucggccguaccgg

SEQ ID NO: 862801 - RNA, 18 nt, Mycobacterium avium subsp. paratuberculosis
ccucggccguaccggcgu

SEQ ID NO: 862802 - RNA, 18 nt, Mycobacterium avium subsp. paratuberculosis
ccucggccucgucgacgu

SEQ ID NO: 862803 - RNA, 21 nt, Mycobacterium avium subsp. paratuberculosis
ccucggccucgucgacgucgg

SEQ ID NO: 862804 - RNA, 14 nt, Mycobacterium avium subsp. paratuberculosis
ccucggucagcucg

SEQ ID NO: 862805 - RNA, 13 nt, Mycobacterium avium subsp. paratuberculosis
ccucggucacggu

SEQ ID NO: 862806 - RNA, 21 nt, Mycobacterium avium subsp. paratuberculosis
ccucggguguaggcccgauca

SEQ ID NO: 862807 - RNA, 19 nt, Mycobacterium avium subsp. paratuberculosis
ccucgggcacguccagccc

SEQ ID NO: 862808 - RNA, 21 nt, Mycobacterium avium subsp. paratuberculosis
ccucgggcacguccagcccgc

SEQ ID NO: 862809 - RNA, 14 nt, Mycobacterium avium subsp. paratuberculosis
ccucggucgccgaa

SEQ ID NO: 862810 - RNA, 15 nt, Mycobacterium avium subsp. paratuberculosis
ccucggucucgucca

SEQ ID NO: 862811 - RNA, 14 nt, Mycobacterium avium subsp. paratuberculosis
ccucggugaccucg

SEQ ID NO: 862812 - RNA, 14 nt, Mycobacterium avium subsp. paratuberculosis
ccucggugagcagc

SEQ ID NO: 862813 - RNA, 14 nt, Mycobacterium avium subsp. paratuberculosis
ccucggugaucuca

SEQ ID NO: 862814 - RNA, 22 nt, Mycobacterium avium subsp. paratuberculosis
ccucggggcguggcggaagcgc

SEQ ID NO: 862815 - RNA, 19 nt, Mycobacterium avium subsp. paratuberculosis
ccucgggguacucggcggc

SEQ ID NO: 862816 - RNA, 20 nt, Mycobacterium avium subsp. paratuberculosis
ccucgggguagccggcccgc

SEQ ID NO: 862817 - RNA, 23 nt, Mycobacterium avium subsp. paratuberculosis
ccucgggauccaggaacggcacc

SEQ ID NO: 862818 - RNA, 21 nt, Mycobacterium avium subsp. paratuberculosis
ccucgggcauuggcagcucgg

SEQ ID NO: 862819 - RNA, 14 nt, Mycobacterium avium subsp. paratuberculosis
ccucgggccggcag

SEQ ID NO: 862820 - RNA, 15 nt, Mycobacterium avium subsp. paratuberculosis
ccucgggccggcagc

SEQ ID NO: 862821 - RNA, 16 nt, Mycobacterium avium subsp. paratuberculosis
ccucggcgcgggcgau

SEQ ID NO: 862822 - RNA, 14 nt, Mycobacterium avium subsp. paratuberculosis
ccucggcgcgucgg

SEQ ID NO: 862823 - RNA, 13 nt, Mycobacterium avium subsp. paratuberculosis
ccucggcgccggu

SEQ ID NO: 862824 - RNA, 14 nt, Mycobacterium avium subsp. paratuberculosis
ccucggcgccucgg

SEQ ID NO: 862825 - RNA, 16 nt, Mycobacterium avium subsp. paratuberculosis
ccucggcgaucggccg

SEQ ID NO: 862826 - RNA, 17 nt, Mycobacterium avium subsp. paratuberculosis
ccucggcgaucggccgc

SEQ ID NO: 862827 - RNA, 17 nt, Mycobacterium avium subsp. paratuberculosis
ccucggcgaugccgagg

SEQ ID NO: 862828 - RNA, 12 nt, Mycobacterium avium subsp. paratuberculosis
ccucggcgaugu

SEQ ID NO: 862829 - RNA, 21 nt, Mycobacterium avium subsp. paratuberculosis
ccucgaucaccgacagcgcgu

SEQ ID NO: 862830 - RNA, 16 nt, Mycobacterium avium subsp. paratuberculosis
ccucgaucaccgggcg

SEQ ID NO: 862831 - RNA, 20 nt, Mycobacterium avium subsp. paratuberculosis
ccucgaucaccgggcggccg

SEQ ID NO: 862832 - RNA, 20 nt, Mycobacterium avium subsp. paratuberculosis
ccucgaucagagcgggccga

SEQ ID NO: 862833 - RNA, 21 nt, Mycobacterium avium subsp. paratuberculosis
ccucgaucagccacaccgccg

SEQ ID NO: 862834 - RNA, 16 nt, Mycobacterium avium subsp. paratuberculosis
ccucgaggccgacgug

SEQ ID NO: 862835 - RNA, 18 nt, Mycobacterium avium subsp. paratuberculosis
ccucgaggccgaggucgg

SEQ ID NO: 862836 - RNA, 20 nt, Mycobacterium avium subsp. paratuberculosis
ccucgagugccugcgcccac

SEQ ID NO: 862837 - RNA, 15 nt, Mycobacterium avium subsp. paratuberculosis
ccucgaucgcgacca

SEQ ID NO: 862838 - RNA, 14 nt, Mycobacterium avium subsp. paratuberculosis
ccucgaucagucgu

SEQ ID NO: 862839 - RNA, 18 nt, Mycobacterium avium subsp. paratuberculosis
ccucgaucgacaccucgg

SEQ ID NO: 862840 - RNA, 19 nt, Mycobacterium avium subsp. paratuberculosis
ccucgauaauggcggccgc

SEQ ID NO: 862841 - RNA, 21 nt, Mycobacterium avium subsp. paratuberculosis
ccucgauaauggcggccgccg

SEQ ID NO: 862842 - RNA, 13 nt, Mycobacterium avium subsp. paratuberculosis
ccucgaucagcgg

SEQ ID NO: 862843 - RNA, 13 nt, Mycobacterium avium subsp. paratuberculosis
ccucgaucaucgc

SEQ ID NO: 862844 - RNA, 18 nt, Mycobacterium avium subsp. paratuberculosis
ccucgaucaucgcgucgg

SEQ ID NO: 862845 - RNA, 21 nt, Mycobacterium avium subsp. paratuberculosis
ccucgaucaucgcgucggugu

SEQ ID NO: 862846 - RNA, 19 nt, Mycobacterium avium subsp. paratuberculosis
ccucgacccguuccggcga

SEQ ID NO: 862847 - RNA, 21 nt, Mycobacterium avium subsp. paratuberculosis
ccucgaccaggcuuggcccgc

SEQ ID NO: 862848 - RNA, 14 nt, Mycobacterium avium subsp. paratuberculosis
ccucgaccagccgg

SEQ ID NO: 862849 - RNA, 13 nt, Mycobacterium avium subsp. paratuberculosis
ccucgaccagcgc

SEQ ID NO: 862850 - RNA, 14 nt, Mycobacterium avium subsp. paratuberculosis
ccucgaccagcgcg

SEQ ID NO: 862851 - RNA, 17 nt, Mycobacterium avium subsp. paratuberculosis
ccucgaccagcgcgccg

SEQ ID NO: 862852 - RNA, 10 nt, Mycobacterium avium subsp. paratuberculosis
ccucgacgaa

SEQ ID NO: 862853 - RNA, 16 nt, Mycobacterium avium subsp. paratuberculosis
ccucgacgaacgcggc

SEQ ID NO: 862854 - RNA, 17 nt, Mycobacterium avium subsp. paratuberculosis
ccucgacgaacgcggcg

SEQ ID NO: 862855 - RNA, 22 nt, Mycobacterium avium subsp. paratuberculosis
ccucgagccauaaaccggccgg

SEQ ID NO: 862856 - RNA, 22 nt, Mycobacterium avium subsp. paratuberculosis
ccucgagccguuugaugccguc

SEQ ID NO: 862857 - RNA, 12 nt, Mycobacterium avium subsp. paratuberculosis
ccucgagcgccc

SEQ ID NO: 862858 - RNA, 13 nt, Mycobacterium avium subsp. paratuberculosis
ccucgagcgcguc

SEQ ID NO: 862859 - RNA, 15 nt, Mycobacterium avium subsp. paratuberculosis
ccucgagcgcgucga

SEQ ID NO: 862860 - RNA, 13 nt, Mycobacterium avium subsp. paratuberculosis
ccucgagcgucac

SEQ ID NO: 862861 - RNA, 18 nt, Mycobacterium avium subsp. paratuberculosis
ccucgagcgucacgcugg

SEQ ID NO: 862862 - RNA, 17 nt, Mycobacterium avium subsp. paratuberculosis
ccucgagcuugccgucg

SEQ ID NO: 862863 - RNA, 18 nt, Mycobacterium avium subsp. paratuberculosis
ccucgagcuugccgucgu

SEQ ID NO: 862864 - RNA, 18 nt, Mycobacterium avium subsp. paratuberculosis
ccucgaggaucgcggcca

SEQ ID NO: 862865 - RNA, 12 nt, Mycobacterium avium subsp. paratuberculosis
ccucgccgaccu

SEQ ID NO: 862866 - RNA, 15 nt, Mycobacterium avium subsp. paratuberculosis
ccucgccgaccuugg

SEQ ID NO: 862867 - RNA, 22 nt, Mycobacterium avium subsp. paratuberculosis
ccucgccgacgguguccgcggg

SEQ ID NO: 862868 - RNA, 14 nt, Mycobacterium avium subsp. paratuberculosis
ccucgccgagcagc

SEQ ID NO: 862869 - RNA, 23 nt, Mycobacterium avium subsp. paratuberculosis
ccucgccgaucucgaccagcgcc

SEQ ID NO: 862870 - RNA, 12 nt, Mycobacterium avium subsp. paratuberculosis
ccucgcccgccg

SEQ ID NO: 862871 - RNA, 14 nt, Mycobacterium avium subsp. paratuberculosis
ccucgcccgccgcg

SEQ ID NO: 862872 - RNA, 11 nt, Mycobacterium avium subsp. paratuberculosis
ccucgcccggc

SEQ ID NO: 862873 - RNA, 14 nt, Mycobacterium avium subsp. paratuberculosis
ccucgcccagcgcc

SEQ ID NO: 862874 - RNA, 15 nt, Mycobacterium avium subsp. paratuberculosis
ccucgcccagcgccg

SEQ ID NO: 862875 - RNA, 14 nt, Mycobacterium avium subsp. paratuberculosis
ccucgaucggggaa

SEQ ID NO: 862876 - RNA, 20 nt, Mycobacterium avium subsp. paratuberculosis
ccucgccggcgccgggcggg

SEQ ID NO: 862877 - RNA, 15 nt, Mycobacterium avium subsp. paratuberculosis
ccucgccggccgggc

SEQ ID NO: 862878 - RNA, 13 nt, Mycobacterium avium subsp. paratuberculosis
ccucgcggcggcg

SEQ ID NO: 862879 - RNA, 15 nt, Mycobacterium avium subsp. paratuberculosis
ccucgcggcggcguc

SEQ ID NO: 862880 - RNA, 17 nt, Mycobacterium avium subsp. paratuberculosis
ccucgcggcggcgucgg

SEQ ID NO: 862881 - RNA, 20 nt, Mycobacterium avium subsp. paratuberculosis
ccucgcggcggcgucggcgu

SEQ ID NO: 862882 - RNA, 13 nt, Mycobacterium avium subsp. paratuberculosis
ccucgcggcgguc

SEQ ID NO: 862883 - RNA, 20 nt, Mycobacterium avium subsp. paratuberculosis
ccucgcgggcgaucuccagc

SEQ ID NO: 862884 - RNA, 22 nt, Mycobacterium avium subsp. paratuberculosis
ccucgcgggcgaucuccagcgg

SEQ ID NO: 862885 - RNA, 16 nt, Mycobacterium avium subsp. paratuberculosis
ccucgccgccgccgau

SEQ ID NO: 862886 - RNA, 15 nt, Mycobacterium avium subsp. paratuberculosis
ccucgccgcuucgga

SEQ ID NO: 862887 - RNA, 14 nt, Mycobacterium avium subsp. paratuberculosis
ccuaacgugcccgg

SEQ ID NO: 862888 - RNA, 18 nt, Mycobacterium avium subsp. paratuberculosis
ccuaaucgccccaggcgg

SEQ ID NO: 862889 - RNA, 15 nt, Mycobacterium avium subsp. paratuberculosis
ccuacggcgggugcg

SEQ ID NO: 862890 - RNA, 18 nt, Mycobacterium avium subsp. paratuberculosis
ccuacccguccagcgcga

SEQ ID NO: 862891 - RNA, 17 nt, Mycobacterium avium subsp. paratuberculosis
ccuaccgccgagcguga

SEQ ID NO: 862892 - RNA, 18 nt, Mycobacterium avium subsp. paratuberculosis
ccuaccggcucggcccgg

SEQ ID NO: 862893 - RNA, 13 nt, Mycobacterium avium subsp. paratuberculosis
ccuaccggguggc

SEQ ID NO: 862894 - RNA, 22 nt, Mycobacterium avium subsp. paratuberculosis
ccuacuugcguugcgcggcggc

SEQ ID NO: 862895 - RNA, 17 nt, Mycobacterium avium subsp. paratuberculosis
ccuacuugcggccgcga

SEQ ID NO: 862896 - RNA, 22 nt, Mycobacterium avium subsp. paratuberculosis
ccuacuugcggccgcgacgcgc

SEQ ID NO: 862897 - RNA, 14 nt, Mycobacterium avium subsp. paratuberculosis
ccguuuucggcgcg

SEQ ID NO: 862898 - RNA, 16 nt, Mycobacterium avium subsp. paratuberculosis
ccguuuggcgccgccc

SEQ ID NO: 862899 - RNA, 17 nt, Mycobacterium avium subsp. paratuberculosis
ccguuguugucgugguc

SEQ ID NO: 862900 - RNA, 19 nt, Mycobacterium avium subsp. paratuberculosis
ccguuguugucguggucgc

SEQ ID NO: 862901 - RNA, 19 nt, Mycobacterium avium subsp. paratuberculosis
ccguuguugaggaugacga

SEQ ID NO: 862902 - RNA, 19 nt, Mycobacterium avium subsp. paratuberculosis
ccguugucucggcgccguc

SEQ ID NO: 862903 - RNA, 21 nt, Mycobacterium avium subsp. paratuberculosis
ccguugucucggcgccgucgc

SEQ ID NO: 862904 - RNA, 15 nt, Mycobacterium avium subsp. paratuberculosis
ccguuguggcggcca

SEQ ID NO: 862905 - RNA, 18 nt, Mycobacterium avium subsp. paratuberculosis
ccguugcgccgcaacggc

SEQ ID NO: 862906 - RNA, 15 nt, Mycobacterium avium subsp. paratuberculosis
ccguugcgccagcgg

SEQ ID NO: 862907 - RNA, 18 nt, Mycobacterium avium subsp. paratuberculosis
ccguugcgggugucgccg

SEQ ID NO: 862908 - RNA, 20 nt, Mycobacterium avium subsp. paratuberculosis
ccguugcgggugucgccggu

SEQ ID NO: 862909 - RNA, 19 nt, Mycobacterium avium subsp. paratuberculosis
ccguugcggugcucgucga

SEQ ID NO: 862910 - RNA, 21 nt, Mycobacterium avium subsp. paratuberculosis
ccguugcggugcucgucgagc

SEQ ID NO: 862911 - RNA, 14 nt, Mycobacterium avium subsp. paratuberculosis
ccguuggaggugau

SEQ ID NO: 862912 - RNA, 20 nt, Mycobacterium avium subsp. paratuberculosis
ccguugcgggacugggcgau

SEQ ID NO: 862913 - RNA, 19 nt, Mycobacterium avium subsp. paratuberculosis
ccguuggccugcgcgaccu

SEQ ID NO: 862914 - RNA, 21 nt, Mycobacterium avium subsp. paratuberculosis
ccguugcugcguucggcgauc

SEQ ID NO: 862915 - RNA, 13 nt, Mycobacterium avium subsp. paratuberculosis
ccguuggcgccgg

SEQ ID NO: 862916 - RNA, 14 nt, Mycobacterium avium subsp. paratuberculosis
ccguuggcgccggu

SEQ ID NO: 862917 - RNA, 21 nt, Mycobacterium avium subsp. paratuberculosis
ccguuggggaucgugucgauc

SEQ ID NO: 862918 - RNA, 18 nt, Mycobacterium avium subsp. paratuberculosis
ccguugggggcgccgcgg

SEQ ID NO: 862919 - RNA, 22 nt, Mycobacterium avium subsp. paratuberculosis
ccguugggguccucgauggcgg

SEQ ID NO: 862920 - RNA, 23 nt, Mycobacterium avium subsp. paratuberculosis
ccguugggucucaucccgccgac

SEQ ID NO: 862921 - RNA, 17 nt, Mycobacterium avium subsp. paratuberculosis
ccguuggucuguggucg

SEQ ID NO: 862922 - RNA, 19 nt, Mycobacterium avium subsp. paratuberculosis
ccguuggugacgcucaccc

SEQ ID NO: 862923 - RNA, 16 nt, Mycobacterium avium subsp. paratuberculosis
ccguuggugcgguguc

SEQ ID NO: 862924 - RNA, 16 nt, Mycobacterium avium subsp. paratuberculosis
ccguuguaggccgcgc

SEQ ID NO: 862925 - RNA, 13 nt, Mycobacterium avium subsp. paratuberculosis
ccguugucgagca

SEQ ID NO: 862926 - RNA, 13 nt, Mycobacterium avium subsp. paratuberculosis
ccguugucgaggu

SEQ ID NO: 862927 - RNA, 16 nt, Mycobacterium avium subsp. paratuberculosis
ccguugucgaggucgg

SEQ ID NO: 862928 - RNA, 18 nt, Mycobacterium avium subsp. paratuberculosis
ccguguugacguaacacc

SEQ ID NO: 862929 - RNA, 17 nt, Mycobacterium avium subsp. paratuberculosis
ccguuccagccggcccg

SEQ ID NO: 862930 - RNA, 20 nt, Mycobacterium avium subsp. paratuberculosis
ccguuccagccggcccgcau

SEQ ID NO: 862931 - RNA, 14 nt, Mycobacterium avium subsp. paratuberculosis
ccguuccccggccg

SEQ ID NO: 862932 - RNA, 15 nt, Mycobacterium avium subsp. paratuberculosis
ccguuccccggccga

SEQ ID NO: 862933 - RNA, 16 nt, Mycobacterium avium subsp. paratuberculosis
ccguuccccggccgac

SEQ ID NO: 862934 - RNA, 19 nt, Mycobacterium avium subsp. paratuberculosis
ccguuccccggccgacguc

SEQ ID NO: 862935 - RNA, 14 nt, Mycobacterium avium subsp. paratuberculosis
ccguucccgacagc

SEQ ID NO: 862936 - RNA, 12 nt, Mycobacterium avium subsp. paratuberculosis
ccgugcccgagg

SEQ ID NO: 862937 - RNA, 15 nt, Mycobacterium avium subsp. paratuberculosis
ccguggugugcccgc

SEQ ID NO: 862938 - RNA, 14 nt, Mycobacterium avium subsp. paratuberculosis
ccgugcccgcggga

SEQ ID NO: 862939 - RNA, 22 nt, Mycobacterium avium subsp. paratuberculosis
ccgugcccgcgggacacggcgg

SEQ ID NO: 862940 - RNA, 17 nt, Mycobacterium avium subsp. paratuberculosis
ccgugccgaugccggcc

SEQ ID NO: 862941 - RNA, 19 nt, Mycobacterium avium subsp. paratuberculosis
ccgugccgaugccggccug

SEQ ID NO: 862942 - RNA, 19 nt, Mycobacterium avium subsp. paratuberculosis
ccgugccgauggccaccgg

SEQ ID NO: 862943 - RNA, 17 nt, Mycobacterium avium subsp. paratuberculosis
ccguguagccgaccgac

SEQ ID NO: 862944 - RNA, 15 nt, Mycobacterium avium subsp. paratuberculosis
ccguguaggccgcgc

SEQ ID NO: 862945 - RNA, 17 nt, Mycobacterium avium subsp. paratuberculosis
ccgugucccggauggag

SEQ ID NO: 862946 - RNA, 18 nt, Mycobacterium avium subsp. paratuberculosis
ccgugucgcccguggccc

SEQ ID NO: 862947 - RNA, 15 nt, Mycobacterium avium subsp. paratuberculosis
ccgugucgcggccuc

SEQ ID NO: 862948 - RNA, 23 nt, Mycobacterium avium subsp. paratuberculosis
ccgugucgcggccuccgagcggc

SEQ ID NO: 862949 - RNA, 15 nt, Mycobacterium avium subsp. paratuberculosis
ccgugugccagcccg

SEQ ID NO: 862950 - RNA, 12 nt, Mycobacterium avium subsp. paratuberculosis
ccgugucgucgc

SEQ ID NO: 862951 - RNA, 17 nt, Mycobacterium avium subsp. paratuberculosis
ccguguucaccagcggg

SEQ ID NO: 862952 - RNA, 21 nt, Mycobacterium avium subsp. paratuberculosis
ccguugagcguggacaccgca

SEQ ID NO: 862953 - RNA, 16 nt, Mycobacterium avium subsp. paratuberculosis
ccguugaugcgcaccg

SEQ ID NO: 862954 - RNA, 17 nt, Mycobacterium avium subsp. paratuberculosis
ccguugaugcgcaccgc

SEQ ID NO: 862955 - RNA, 20 nt, Mycobacterium avium subsp. paratuberculosis
ccguugaugcgcaccgcggc

SEQ ID NO: 862956 - RNA, 21 nt, Mycobacterium avium subsp. paratuberculosis
ccguugaugcgcaccgcggcg

SEQ ID NO: 862957 - RNA, 17 nt, Mycobacterium avium subsp. paratuberculosis
ccguugaugaagaccug

SEQ ID NO: 862958 - RNA, 13 nt, Mycobacterium avium subsp. paratuberculosis
ccguugcagcaca

SEQ ID NO: 862959 - RNA, 19 nt, Mycobacterium avium subsp. paratuberculosis
ccguugauugcgcccgccg

SEQ ID NO: 862960 - RNA, 15 nt, Mycobacterium avium subsp. paratuberculosis
ccguugccaggccgc

SEQ ID NO: 862961 - RNA, 18 nt, Mycobacterium avium subsp. paratuberculosis
ccguugccaggccgcgag

SEQ ID NO: 862962 - RNA, 14 nt, Mycobacterium avium subsp. paratuberculosis
ccguugccgccgcg

SEQ ID NO: 862963 - RNA, 15 nt, Mycobacterium avium subsp. paratuberculosis
ccguugccgccgcgc

SEQ ID NO: 862964 - RNA, 16 nt, Mycobacterium avium subsp. paratuberculosis
ccguugccgccgcgcg

SEQ ID NO: 862965 - RNA, 17 nt, Mycobacterium avium subsp. paratuberculosis
ccguucgucgucgcgca

SEQ ID NO: 862966 - RNA, 22 nt, Mycobacterium avium subsp. paratuberculosis
ccguucguagggacugcgccgg

SEQ ID NO: 862967 - RNA, 14 nt, Mycobacterium avium subsp. paratuberculosis
ccguucuccgaggc

SEQ ID NO: 862968 - RNA, 15 nt, Mycobacterium avium subsp. paratuberculosis
ccguucucgcgcagg

SEQ ID NO: 862969 - RNA, 22 nt, Mycobacterium avium subsp. paratuberculosis
ccguucucgggaaaugcgucgc

SEQ ID NO: 862970 - RNA, 13 nt, Mycobacterium avium subsp. paratuberculosis
ccguucuugucga

SEQ ID NO: 862971 - RNA, 15 nt, Mycobacterium avium subsp. paratuberculosis
ccguugagcaccgcg

SEQ ID NO: 862972 - RNA, 16 nt, Mycobacterium avium subsp. paratuberculosis
ccguugagcaccgcga

SEQ ID NO: 862973 - RNA, 14 nt, Mycobacterium avium subsp. paratuberculosis
ccguugaccgacgc

SEQ ID NO: 862974 - RNA, 18 nt, Mycobacterium avium subsp. paratuberculosis
ccguugaccgacgccucc

SEQ ID NO: 862975 - RNA, 14 nt, Mycobacterium avium subsp. paratuberculosis
ccguugaccggccg

SEQ ID NO: 862976 - RNA, 15 nt, Mycobacterium avium subsp. paratuberculosis
ccguugaccggccgg

SEQ ID NO: 862977 - RNA, 17 nt, Mycobacterium avium subsp. paratuberculosis
ccguugaccggccgguc

SEQ ID NO: 862978 - RNA, 15 nt, Mycobacterium avium subsp. paratuberculosis
ccguucgcugcccuc

SEQ ID NO: 862979 - RNA, 15 nt, Mycobacterium avium subsp. paratuberculosis
ccguucgccgacagc

SEQ ID NO: 862980 - RNA, 19 nt, Mycobacterium avium subsp. paratuberculosis
ccguucgccgacagcagcu

SEQ ID NO: 862981 - RNA, 15 nt, Mycobacterium avium subsp. paratuberculosis
ccguucgccggccag

SEQ ID NO: 862982 - RNA, 15 nt, Mycobacterium avium subsp. paratuberculosis
ccguucgccggcgac

SEQ ID NO: 862983 - RNA, 16 nt, Mycobacterium avium subsp. paratuberculosis
ccguucgccggcgacg

SEQ ID NO: 862984 - RNA, 19 nt, Mycobacterium avium subsp. paratuberculosis
ccguucgcgcacggcgcgc

SEQ ID NO: 862985 - RNA, 13 nt, Mycobacterium avium subsp. paratuberculosis
ccguucgcgccga

SEQ ID NO: 862986 - RNA, 14 nt, Mycobacterium avium subsp. paratuberculosis
ccguucgcgccgag

SEQ ID NO: 862987 - RNA, 14 nt, Mycobacterium avium subsp. paratuberculosis
ccguucccaccggc

SEQ ID NO: 862988 - RNA, 14 nt, Mycobacterium avium subsp. paratuberculosis
ccguuccucgacgu

SEQ ID NO: 862989 - RNA, 18 nt, Mycobacterium avium subsp. paratuberculosis
ccguucauuaucccgcac

SEQ ID NO: 862990 - RNA, 22 nt, Mycobacterium avium subsp. paratuberculosis
ccgucggcguucagcggcaccg

SEQ ID NO: 862991 - RNA, 21 nt, Mycobacterium avium subsp. paratuberculosis
ccgucguccuugagcccccac

SEQ ID NO: 862992 - RNA, 15 nt, Mycobacterium avium subsp. paratuberculosis
ccgucgucgagcacc

SEQ ID NO: 862993 - RNA, 23 nt, Mycobacterium avium subsp. paratuberculosis
ccgucgucgagcaccacccgggu

SEQ ID NO: 862994 - RNA, 13 nt, Mycobacterium avium subsp. paratuberculosis
ccgucgucgaugc

SEQ ID NO: 862995 - RNA, 16 nt, Mycobacterium avium subsp. paratuberculosis
ccgucgucgcaccggc

SEQ ID NO: 862996 - RNA, 13 nt, Mycobacterium avium subsp. paratuberculosis
ccgucgucggaca

SEQ ID NO: 862997 - RNA, 16 nt, Mycobacterium avium subsp. paratuberculosis
ccgucgucggcgccgc

SEQ ID NO: 862998 - RNA, 18 nt, Mycobacterium avium subsp. paratuberculosis
ccgucgucggcgccgcgc

SEQ ID NO: 862999 - RNA, 15 nt, Mycobacterium avium subsp. paratuberculosis
ccgucgucggucagc

SEQ ID NO: 863000 - RNA, 22 nt, Mycobacterium avium subsp. paratuberculosis
ccgucgucggucucuucgaccc

SEQ ID NO: 863001 - RNA, 17 nt, Mycobacterium avium subsp. paratuberculosis
ccgugaaauaucccgau

SEQ ID NO: 863002 - RNA, 14 nt, Mycobacterium avium subsp. paratuberculosis
ccgucguccacgcc

SEQ ID NO: 863003 - RNA, 18 nt, Mycobacterium avium subsp. paratuberculosis
ccgucguccacgcccagc

SEQ ID NO: 863004 - RNA, 16 nt, Mycobacterium avium subsp. paratuberculosis
ccgucgucagccgggc

SEQ ID NO: 863005 - RNA, 18 nt, Mycobacterium avium subsp. paratuberculosis
ccgucgucagccgggcca

SEQ ID NO: 863006 - RNA, 19 nt, Mycobacterium avium subsp. paratuberculosis
ccgucgucagccgggccag

SEQ ID NO: 863007 - RNA, 17 nt, Mycobacterium avium subsp. paratuberculosis
ccgucguauucgacggc

SEQ ID NO: 863008 - RNA, 19 nt, Mycobacterium avium subsp. paratuberculosis
ccgucguauucgacggcga

SEQ ID NO: 863009 - RNA, 21 nt, Mycobacterium avium subsp. paratuberculosis
ccgucguauucgacggcgacc

SEQ ID NO: 863010 - RNA, 13 nt, Mycobacterium avium subsp. paratuberculosis
ccgucguagccgc

SEQ ID NO: 863011 - RNA, 19 nt, Mycobacterium avium subsp. paratuberculosis
ccgugagauccagcagcca

SEQ ID NO: 863012 - RNA, 19 nt, Mycobacterium avium subsp. paratuberculosis
ccgugcagcgcccagccga

SEQ ID NO: 863013 - RNA, 12 nt, Mycobacterium avium subsp. paratuberculosis
ccgugccagccg

SEQ ID NO: 863014 - RNA, 15 nt, Mycobacterium avium subsp. paratuberculosis
ccgugccagccggcc

SEQ ID NO: 863015 - RNA, 19 nt, Mycobacterium avium subsp. paratuberculosis
ccgugccagccggccgcug

SEQ ID NO: 863016 - RNA, 14 nt, Mycobacterium avium subsp. paratuberculosis
ccgugcccaccagc

SEQ ID NO: 863017 - RNA, 22 nt, Mycobacterium avium subsp. paratuberculosis
ccgugcccaccagccggccggc

SEQ ID NO: 863018 - RNA, 16 nt, Mycobacterium avium subsp. paratuberculosis
ccgugcaucgggcgcu

SEQ ID NO: 863019 - RNA, 21 nt, Mycobacterium avium subsp. paratuberculosis
ccgugcauguagguggcgacc

SEQ ID NO: 863020 - RNA, 22 nt, Mycobacterium avium subsp. paratuberculosis
ccgugcauguagguggcgacca

SEQ ID NO: 863021 - RNA, 20 nt, Mycobacterium avium subsp. paratuberculosis
ccgugacgccgauccgcugc

SEQ ID NO: 863022 - RNA, 21 nt, Mycobacterium avium subsp. paratuberculosis
ccgugcaggaugaccgcgucg

SEQ ID NO: 863023 - RNA, 13 nt, Mycobacterium avium subsp. paratuberculosis
ccgugaccggcga

SEQ ID NO: 863024 - RNA, 18 nt, Mycobacterium avium subsp. paratuberculosis
ccgugaacugugcggugc

SEQ ID NO: 863025 - RNA, 13 nt, Mycobacterium avium subsp. paratuberculosis
ccgugacccgccg

SEQ ID NO: 863026 - RNA, 20 nt, Mycobacterium avium subsp. paratuberculosis
ccgugacccgccgugaccgg

SEQ ID NO: 863027 - RNA, 21 nt, Mycobacterium avium subsp. paratuberculosis
ccgugacccgccgugaccggc

SEQ ID NO: 863028 - RNA, 14 nt, Mycobacterium avium subsp. paratuberculosis
ccgucgggacgcgg

SEQ ID NO: 863029 - RNA, 15 nt, Mycobacterium avium subsp. paratuberculosis
ccgucgggacgcggc

SEQ ID NO: 863030 - RNA, 23 nt, Mycobacterium avium subsp. paratuberculosis
ccgucgggacgcggcaggcgccc

SEQ ID NO: 863031 - RNA, 11 nt, Mycobacterium avium subsp. paratuberculosis
ccgucggcggc

SEQ ID NO: 863032 - RNA, 14 nt, Mycobacterium avium subsp. paratuberculosis
ccgucggcgucgac

SEQ ID NO: 863033 - RNA, 15 nt, Mycobacterium avium subsp. paratuberculosis
ccgucggcggccgac

SEQ ID NO: 863034 - RNA, 14 nt, Mycobacterium avium subsp. paratuberculosis
ccgucggcggccuu

SEQ ID NO: 863035 - RNA, 21 nt, Mycobacterium avium subsp. paratuberculosis
ccgucggcggccuugaacgcg

SEQ ID NO: 863036 - RNA, 14 nt, Mycobacterium avium subsp. paratuberculosis
ccgucggcgggaug

SEQ ID NO: 863037 - RNA, 13 nt, Mycobacterium avium subsp. paratuberculosis
ccgucggcgaucg

SEQ ID NO: 863038 - RNA, 16 nt, Mycobacterium avium subsp. paratuberculosis
ccgucggcgaucgccg

SEQ ID NO: 863039 - RNA, 12 nt, Mycobacterium avium subsp. paratuberculosis
ccgucggcgaug

SEQ ID NO: 863040 - RNA, 13 nt, Mycobacterium avium subsp. paratuberculosis
ccgucggcgcccg

SEQ ID NO: 863041 - RNA, 17 nt, Mycobacterium avium subsp. paratuberculosis
ccgucggcgcccggcac

SEQ ID NO: 863042 - RNA, 20 nt, Mycobacterium avium subsp. paratuberculosis
ccgucggcgcccggcaccgg

SEQ ID NO: 863043 - RNA, 13 nt, Mycobacterium avium subsp. paratuberculosis
ccgucggcgccgc

SEQ ID NO: 863044 - RNA, 14 nt, Mycobacterium avium subsp. paratuberculosis
ccgucggcgccgcc

SEQ ID NO: 863045 - RNA, 21 nt, Mycobacterium avium subsp. paratuberculosis
ccgucggcgccgccgagccgc

SEQ ID NO: 863046 - RNA, 19 nt, Mycobacterium avium subsp. paratuberculosis
ccgucggccuccagccggc

SEQ ID NO: 863047 - RNA, 16 nt, Mycobacterium avium subsp. paratuberculosis
ccgucggccucggcgg

SEQ ID NO: 863048 - RNA, 14 nt, Mycobacterium avium subsp. paratuberculosis
ccgucggccugcgc

SEQ ID NO: 863049 - RNA, 12 nt, Mycobacterium avium subsp. paratuberculosis
ccgucggccauc

SEQ ID NO: 863050 - RNA, 18 nt, Mycobacterium avium subsp. paratuberculosis
ccgucggccaucagccgc

SEQ ID NO: 863051 - RNA, 24 nt, Mycobacterium avium subsp. paratuberculosis
ccgucggccaucagccgccgucgc

SEQ ID NO: 863052 - RNA, 15 nt, Mycobacterium avium subsp. paratuberculosis
ccgucggccgccgac

SEQ ID NO: 863053 - RNA, 18 nt, Mycobacterium avium subsp. paratuberculosis
ccgucggccgccgacugu

SEQ ID NO: 863054 - RNA, 20 nt, Mycobacterium avium subsp. paratuberculosis
ccgucgcuguuggcgacggc

SEQ ID NO: 863055 - RNA, 22 nt, Mycobacterium avium subsp. paratuberculosis
ccgucgcuguuggcgacggcgc

SEQ ID NO: 863056 - RNA, 18 nt, Mycobacterium avium subsp. paratuberculosis
ccgucggcaacgccgggu

SEQ ID NO: 863057 - RNA, 12 nt, Mycobacterium avium subsp. paratuberculosis
ccgucggcaucc

SEQ ID NO: 863058 - RNA, 22 nt, Mycobacterium avium subsp. paratuberculosis
ccgucggccagcagcgcgucgc

SEQ ID NO: 863059 - RNA, 12 nt, Mycobacterium avium subsp. paratuberculosis
ccgucgagcagg

SEQ ID NO: 863060 - RNA, 20 nt, Mycobacterium avium subsp. paratuberculosis
ccgucgagcagggugacgcg

SEQ ID NO: 863061 - RNA, 11 nt, Mycobacterium avium subsp. paratuberculosis
ccgucgacgcg

SEQ ID NO: 863062 - RNA, 21 nt, Mycobacterium avium subsp. paratuberculosis
ccgucgacgcgugcgucaucg

SEQ ID NO: 863063 - RNA, 22 nt, Mycobacterium avium subsp. paratuberculosis
ccgucgacgcgugcgucaucgc

SEQ ID NO: 863064 - RNA, 14 nt, Mycobacterium avium subsp. paratuberculosis
ccgucgacgggcca

SEQ ID NO: 863065 - RNA, 15 nt, Mycobacterium avium subsp. paratuberculosis
ccgucgacgggccac

SEQ ID NO: 863066 - RNA, 21 nt, Mycobacterium avium subsp. paratuberculosis
ccgucgacgggccaccagcgc

SEQ ID NO: 863067 - RNA, 13 nt, Mycobacterium avium subsp. paratuberculosis
ccgucgacgguga

SEQ ID NO: 863068 - RNA, 20 nt, Mycobacterium avium subsp. paratuberculosis
ccgucgacucggcggugccg

SEQ ID NO: 863069 - RNA, 21 nt, Mycobacterium avium subsp. paratuberculosis
ccgucgagcggcuugccgccg

SEQ ID NO: 863070 - RNA, 15 nt, Mycobacterium avium subsp. paratuberculosis
ccgucgagcgucacg

SEQ ID NO: 863071 - RNA, 17 nt, Mycobacterium avium subsp. paratuberculosis
ccgucgagcgucacgcc

SEQ ID NO: 863072 - RNA, 22 nt, Mycobacterium avium subsp. paratuberculosis
ccgucgagcgucacgccgcgcc

SEQ ID NO: 863073 - RNA, 20 nt, Mycobacterium avium subsp. paratuberculosis
ccgucgagcgucacgcuggc

SEQ ID NO: 863074 - RNA, 18 nt, Mycobacterium avium subsp. paratuberculosis
ccgucgaggaauccgguc

SEQ ID NO: 863075 - RNA, 20 nt, Mycobacterium avium subsp. paratuberculosis
ccgucgacccguuccccggc

SEQ ID NO: 863076 - RNA, 18 nt, Mycobacterium avium subsp. paratuberculosis
ccgucgagucggccaccg

SEQ ID NO: 863077 - RNA, 12 nt, Mycobacterium avium subsp. paratuberculosis
ccgucgaucacc

SEQ ID NO: 863078 - RNA, 15 nt, Mycobacterium avium subsp. paratuberculosis
ccgucgaucgcccgc

SEQ ID NO: 863079 - RNA, 16 nt, Mycobacterium avium subsp. paratuberculosis
ccgucgaucgcccgcu

SEQ ID NO: 863080 - RNA, 20 nt, Mycobacterium avium subsp. paratuberculosis
ccgucgaucuugucguccag

SEQ ID NO: 863081 - RNA, 23 nt, Mycobacterium avium subsp. paratuberculosis
ccgucgaucuugucguccaguga

SEQ ID NO: 863082 - RNA, 17 nt, Mycobacterium avium subsp. paratuberculosis
ccgucgaugccggcgac

SEQ ID NO: 863083 - RNA, 22 nt, Mycobacterium avium subsp. paratuberculosis
ccgucgcgggagagcgcgggca

SEQ ID NO: 863084 - RNA, 12 nt, Mycobacterium avium subsp. paratuberculosis
ccgucgcgguca

SEQ ID NO: 863085 - RNA, 22 nt, Mycobacterium avium subsp. paratuberculosis
ccguccugagguauucgucgag

SEQ ID NO: 863086 - RNA, 19 nt, Mycobacterium avium subsp. paratuberculosis
ccgucgaacacguugcgca

SEQ ID NO: 863087 - RNA, 16 nt, Mycobacterium avium subsp. paratuberculosis
ccguccuuggccgcca

SEQ ID NO: 863088 - RNA, 20 nt, Mycobacterium avium subsp. paratuberculosis
ccguccuuggccgccagcac

SEQ ID NO: 863089 - RNA, 19 nt, Mycobacterium avium subsp. paratuberculosis
ccgucgaacugcagccggc

SEQ ID NO: 863090 - RNA, 20 nt, Mycobacterium avium subsp. paratuberculosis
ccgucgaacugcagccggcc

SEQ ID NO: 863091 - RNA, 23 nt, Mycobacterium avium subsp. paratuberculosis
ccgucgaagaugaccugaucgag

SEQ ID NO: 863092 - RNA, 14 nt, Mycobacterium avium subsp. paratuberculosis
ccgucgaacagcgg

SEQ ID NO: 863093 - RNA, 16 nt, Mycobacterium avium subsp. paratuberculosis
ccgucgaacagcgggc

SEQ ID NO: 863094 - RNA, 15 nt, Mycobacterium avium subsp. paratuberculosis
ccguccuuggugauu

SEQ ID NO: 863095 - RNA, 21 nt, Mycobacterium avium subsp. paratuberculosis
ccguccuugucgcgcaccgcg

SEQ ID NO: 863096 - RNA, 23 nt, Mycobacterium avium subsp. paratuberculosis
ccguccuugucgcgcaccgcggc

SEQ ID NO: 863097 - RNA, 22 nt, Mycobacterium avium subsp. paratuberculosis
ccgucgaaaccgucuccggcgc

SEQ ID NO: 863098 - RNA, 16 nt, Mycobacterium avium subsp. paratuberculosis
ccgucgaaacggcugc

SEQ ID NO: 863099 - RNA, 18 nt, Mycobacterium avium subsp. paratuberculosis
ccgucgaaacggcugcug

SEQ ID NO: 863100 - RNA, 18 nt, Mycobacterium avium subsp. paratuberculosis
ccguccugggccuggcgc

SEQ ID NO: 863101 - RNA, 15 nt, Mycobacterium avium subsp. paratuberculosis
ccguccuggucgucc

SEQ ID NO: 863102 - RNA, 15 nt, Mycobacterium avium subsp. paratuberculosis
ccgucgaccgggucc

SEQ ID NO: 863103 - RNA, 11 nt, Mycobacterium avium subsp. paratuberculosis
ccgucgacgac

SEQ ID NO: 863104 - RNA, 14 nt, Mycobacterium avium subsp. paratuberculosis
ccgucgacgacggu

SEQ ID NO: 863105 - RNA, 16 nt, Mycobacterium avium subsp. paratuberculosis
ccgucgaccccgccgg

SEQ ID NO: 863106 - RNA, 17 nt, Mycobacterium avium subsp. paratuberculosis
ccgucgaccccgccggc

SEQ ID NO: 863107 - RNA, 16 nt, Mycobacterium avium subsp. paratuberculosis
ccgucgaaggccgggc

SEQ ID NO: 863108 - RNA, 19 nt, Mycobacterium avium subsp. paratuberculosis
ccgucgaaggccgggcugg

SEQ ID NO: 863109 - RNA, 23 nt, Mycobacterium avium subsp. paratuberculosis
ccguccuucucgaaccggggcac

SEQ ID NO: 863110 - RNA, 15 nt, Mycobacterium avium subsp. paratuberculosis
ccgucgaccaacugc

SEQ ID NO: 863111 - RNA, 19 nt, Mycobacterium avium subsp. paratuberculosis
ccgucgaccaaugcgauca

SEQ ID NO: 863112 - RNA, 20 nt, Mycobacterium avium subsp. paratuberculosis
ccgucgaccaggacgucggc

SEQ ID NO: 863113 - RNA, 21 nt, Mycobacterium avium subsp. paratuberculosis
ccgucgaccaggacgucggcc

SEQ ID NO: 863114 - RNA, 22 nt, Mycobacterium avium subsp. paratuberculosis
ccgucgaccaggacgucggccg

SEQ ID NO: 863115 - RNA, 15 nt, Mycobacterium avium subsp. paratuberculosis
ccguccucgcgucgc

SEQ ID NO: 863116 - RNA, 20 nt, Mycobacterium avium subsp. paratuberculosis
ccguccucgcgucgcgcggu

SEQ ID NO: 863117 - RNA, 14 nt, Mycobacterium avium subsp. paratuberculosis
ccguccucggccgc

SEQ ID NO: 863118 - RNA, 18 nt, Mycobacterium avium subsp. paratuberculosis
ccguccccgcgcggcucg

SEQ ID NO: 863119 - RNA, 13 nt, Mycobacterium avium subsp. paratuberculosis
ccgucccgccgac

SEQ ID NO: 863120 - RNA, 15 nt, Mycobacterium avium subsp. paratuberculosis
ccgucccgccgacgg

SEQ ID NO: 863121 - RNA, 13 nt, Mycobacterium avium subsp. paratuberculosis
ccguccggggccg

SEQ ID NO: 863122 - RNA, 12 nt, Mycobacterium avium subsp. paratuberculosis
ccguccgggucc

SEQ ID NO: 863123 - RNA, 19 nt, Mycobacterium avium subsp. paratuberculosis
ccguccggguccggcuuca

SEQ ID NO: 863124 - RNA, 13 nt, Mycobacterium avium subsp. paratuberculosis
ccguccgggucgc

SEQ ID NO: 863125 - RNA, 14 nt, Mycobacterium avium subsp. paratuberculosis
ccguccggguucga

SEQ ID NO: 863126 - RNA, 22 nt, Mycobacterium avium subsp. paratuberculosis
ccguccggguucgacgccucgg

SEQ ID NO: 863127 - RNA, 17 nt, Mycobacterium avium subsp. paratuberculosis
ccguccgguucggcggc

SEQ ID NO: 863128 - RNA, 18 nt, Mycobacterium avium subsp. paratuberculosis
ccguccgguucggcggca

SEQ ID NO: 863129 - RNA, 12 nt, Mycobacterium avium subsp. paratuberculosis
ccgucccacacg

SEQ ID NO: 863130 - RNA, 22 nt, Mycobacterium avium subsp. paratuberculosis
ccguccagcagcagcgcgcggu

SEQ ID NO: 863131 - RNA, 14 nt, Mycobacterium avium subsp. paratuberculosis
ccguccaucgccgc

SEQ ID NO: 863132 - RNA, 18 nt, Mycobacterium avium subsp. paratuberculosis
ccguccaucgccgcgcac

SEQ ID NO: 863133 - RNA, 13 nt, Mycobacterium avium subsp. paratuberculosis
ccgucccaccggc

SEQ ID NO: 863134 - RNA, 14 nt, Mycobacterium avium subsp. paratuberculosis
ccguccccaccgau

SEQ ID NO: 863135 - RNA, 17 nt, Mycobacterium avium subsp. paratuberculosis
ccgucccccgagcgggc

SEQ ID NO: 863136 - RNA, 13 nt, Mycobacterium avium subsp. paratuberculosis
ccguccagcguca

SEQ ID NO: 863137 - RNA, 14 nt, Mycobacterium avium subsp. paratuberculosis
ccguccagcgucac

SEQ ID NO: 863138 - RNA, 13 nt, Mycobacterium avium subsp. paratuberculosis
ccguccagcgugu

SEQ ID NO: 863139 - RNA, 22 nt, Mycobacterium avium subsp. paratuberculosis
ccguccagcgugugcguggugg

SEQ ID NO: 863140 - RNA, 16 nt, Mycobacterium avium subsp. paratuberculosis
ccguccagcucagcgc

SEQ ID NO: 863141 - RNA, 20 nt, Mycobacterium avium subsp. paratuberculosis
ccguccagcucagcgcgcac

SEQ ID NO: 863142 - RNA, 18 nt, Mycobacterium avium subsp. paratuberculosis
ccguccagcuccgccgac

SEQ ID NO: 863143 - RNA, 15 nt, Mycobacterium avium subsp. paratuberculosis
ccguccaggcgccau

SEQ ID NO: 863144 - RNA, 14 nt, Mycobacterium avium subsp. paratuberculosis
ccguccagcgcgag

SEQ ID NO: 863145 - RNA, 14 nt, Mycobacterium avium subsp. paratuberculosis
ccgucaggccucga

SEQ ID NO: 863146 - RNA, 22 nt, Mycobacterium avium subsp. paratuberculosis
ccgucaggccugguaggccgcc

SEQ ID NO: 863147 - RNA, 21 nt, Mycobacterium avium subsp. paratuberculosis
ccguagagccguuuggcgccg

SEQ ID NO: 863148 - RNA, 19 nt, Mycobacterium avium subsp. paratuberculosis
ccguacuucucgaagaagg

SEQ ID NO: 863149 - RNA, 20 nt, Mycobacterium avium subsp. paratuberculosis
ccgucagcgucagcacguug

SEQ ID NO: 863150 - RNA, 15 nt, Mycobacterium avium subsp. paratuberculosis
ccgucaguucguaga

SEQ ID NO: 863151 - RNA, 23 nt, Mycobacterium avium subsp. paratuberculosis
ccgucagggugacguggcggccg

SEQ ID NO: 863152 - RNA, 15 nt, Mycobacterium avium subsp. paratuberculosis
ccgucaggguggugc

SEQ ID NO: 863153 - RNA, 21 nt, Mycobacterium avium subsp. paratuberculosis
ccgucaggguggugcccccgc

SEQ ID NO: 863154 - RNA, 21 nt, Mycobacterium avium subsp. paratuberculosis
ccgucagugcgcauucggcga

SEQ ID NO: 863155 - RNA, 22 nt, Mycobacterium avium subsp. paratuberculosis
ccgucagugcgcauucggcgac

SEQ ID NO: 863156 - RNA, 17 nt, Mycobacterium avium subsp. paratuberculosis
ccguccagcgcaugcca

SEQ ID NO: 863157 - RNA, 17 nt, Mycobacterium avium subsp. paratuberculosis
ccgucaucaccgccgag

SEQ ID NO: 863158 - RNA, 20 nt, Mycobacterium avium subsp. paratuberculosis
ccgucaucaccgccgagggc

SEQ ID NO: 863159 - RNA, 18 nt, Mycobacterium avium subsp. paratuberculosis
ccguccagcaacgccgac

SEQ ID NO: 863160 - RNA, 22 nt, Mycobacterium avium subsp. paratuberculosis
ccguacagcugguccggccggc

SEQ ID NO: 863161 - RNA, 18 nt, Mycobacterium avium subsp. paratuberculosis
ccguaccgaggaugaccg

SEQ ID NO: 863162 - RNA, 22 nt, Mycobacterium avium subsp. paratuberculosis
ccguaccgaggaugaccgcggc

SEQ ID NO: 863163 - RNA, 18 nt, Mycobacterium avium subsp. paratuberculosis
ccguaccgauccgcgggc

SEQ ID NO: 863164 - RNA, 20 nt, Mycobacterium avium subsp. paratuberculosis
ccguaccgauccgcgggccg

SEQ ID NO: 863165 - RNA, 16 nt, Mycobacterium avium subsp. paratuberculosis
ccguaccgcaacaccg

SEQ ID NO: 863166 - RNA, 18 nt, Mycobacterium avium subsp. paratuberculosis
ccguacacggcggcgaag

SEQ ID NO: 863167 - RNA, 22 nt, Mycobacterium avium subsp. paratuberculosis
ccguacggcccgaacaccguga

SEQ ID NO: 863168 - RNA, 22 nt, Mycobacterium avium subsp. paratuberculosis
ccguacggguugccgucgacga

SEQ ID NO: 863169 - RNA, 20 nt, Mycobacterium avium subsp. paratuberculosis
ccguacgcgccggccagccg

SEQ ID NO: 863170 - RNA, 15 nt, Mycobacterium avium subsp. paratuberculosis
ccguagaccaccucg

SEQ ID NO: 863171 - RNA, 16 nt, Mycobacterium avium subsp. paratuberculosis
ccguagaccaccucga

SEQ ID NO: 863172 - RNA, 15 nt, Mycobacterium avium subsp. paratuberculosis
ccguagaccagcauc

SEQ ID NO: 863173 - RNA, 16 nt, Mycobacterium avium subsp. paratuberculosis
ccggucggccgcgugc

SEQ ID NO: 863174 - RNA, 15 nt, Mycobacterium avium subsp. paratuberculosis
ccggucucgaccgcg

SEQ ID NO: 863175 - RNA, 18 nt, Mycobacterium avium subsp. paratuberculosis
ccggucucgaccgcggcg

SEQ ID NO: 863176 - RNA, 20 nt, Mycobacterium avium subsp. paratuberculosis
ccggucggcgcucgcgggug

SEQ ID NO: 863177 - RNA, 21 nt, Mycobacterium avium subsp. paratuberculosis
ccggucggcgcucgcgggugc

SEQ ID NO: 863178 - RNA, 13 nt, Mycobacterium avium subsp. paratuberculosis
ccggucgggccaa

SEQ ID NO: 863179 - RNA, 16 nt, Mycobacterium avium subsp. paratuberculosis
ccggucggucagucgc

SEQ ID NO: 863180 - RNA, 15 nt, Mycobacterium avium subsp. paratuberculosis
ccggucggucggccg

SEQ ID NO: 863181 - RNA, 16 nt, Mycobacterium avium subsp. paratuberculosis
ccggucggucggccgc

SEQ ID NO: 863182 - RNA, 13 nt, Mycobacterium avium subsp. paratuberculosis
ccggucggugagc

SEQ ID NO: 863183 - RNA, 23 nt, Mycobacterium avium subsp. paratuberculosis
ccggucggugcgaugguggucgc

SEQ ID NO: 863184 - RNA, 18 nt, Mycobacterium avium subsp. paratuberculosis
ccggucguagcgucgggg

SEQ ID NO: 863185 - RNA, 15 nt, Mycobacterium avium subsp. paratuberculosis
ccggucguagucggc

SEQ ID NO: 863186 - RNA, 22 nt, Mycobacterium avium subsp. paratuberculosis
ccggucguagucggcccgccgg

SEQ ID NO: 863187 - RNA, 17 nt, Mycobacterium avium subsp. paratuberculosis
ccggucgucgccggaug

SEQ ID NO: 863188 - RNA, 18 nt, Mycobacterium avium subsp. paratuberculosis
ccggucgucggggcaucg

SEQ ID NO: 863189 - RNA, 20 nt, Mycobacterium avium subsp. paratuberculosis
ccggucgcgucgugcggccg

SEQ ID NO: 863190 - RNA, 16 nt, Mycobacterium avium subsp. paratuberculosis
ccggucgcugcgauga

SEQ ID NO: 863191 - RNA, 15 nt, Mycobacterium avium subsp. paratuberculosis
ccggugaaaccggcg

SEQ ID NO: 863192 - RNA, 20 nt, Mycobacterium avium subsp. paratuberculosis
ccggugaaaccggcgccgaa

SEQ ID NO: 863193 - RNA, 16 nt, Mycobacterium avium subsp. paratuberculosis
ccggucuugccggcuu

SEQ ID NO: 863194 - RNA, 16 nt, Mycobacterium avium subsp. paratuberculosis
ccggucuugggcucgg

SEQ ID NO: 863195 - RNA, 19 nt, Mycobacterium avium subsp. paratuberculosis
ccggucuuguagucgacca

SEQ ID NO: 863196 - RNA, 15 nt, Mycobacterium avium subsp. paratuberculosis
ccggucugcggccgc

SEQ ID NO: 863197 - RNA, 17 nt, Mycobacterium avium subsp. paratuberculosis
ccggucugcggccgcga

SEQ ID NO: 863198 - RNA, 21 nt, Mycobacterium avium subsp. paratuberculosis
ccggucuucucggccaggcuc

SEQ ID NO: 863199 - RNA, 15 nt, Mycobacterium avium subsp. paratuberculosis
ccggugauggugauc

SEQ ID NO: 863200 - RNA, 23 nt, Mycobacterium avium subsp. paratuberculosis
ccggugauggugaucucgccgcg

SEQ ID NO: 863201 - RNA, 12 nt, Mycobacterium avium subsp. paratuberculosis
ccggugaccgcc

SEQ ID NO: 863202 - RNA, 23 nt, Mycobacterium avium subsp. paratuberculosis
ccggugaccgccucgucgaaggu

SEQ ID NO: 863203 - RNA, 16 nt, Mycobacterium avium subsp. paratuberculosis
ccggugaccgcgccgg

SEQ ID NO: 863204 - RNA, 18 nt, Mycobacterium avium subsp. paratuberculosis
ccggugaccucccggaca

SEQ ID NO: 863205 - RNA, 17 nt, Mycobacterium avium subsp. paratuberculosis
ccggugacgaccggcag

SEQ ID NO: 863206 - RNA, 19 nt, Mycobacterium avium subsp. paratuberculosis
ccggugaagaucagcgcgu

SEQ ID NO: 863207 - RNA, 20 nt, Mycobacterium avium subsp. paratuberculosis
ccggugaagaucgcccgccg

SEQ ID NO: 863208 - RNA, 20 nt, Mycobacterium avium subsp. paratuberculosis
ccggugaagcgggacagcaa

SEQ ID NO: 863209 - RNA, 15 nt, Mycobacterium avium subsp. paratuberculosis
ccggugaccacgcug

SEQ ID NO: 863210 - RNA, 17 nt, Mycobacterium avium subsp. paratuberculosis
ccgggguuuucgugguc

SEQ ID NO: 863211 - RNA, 19 nt, Mycobacterium avium subsp. paratuberculosis
ccgggguguaggcgucggc

SEQ ID NO: 863212 - RNA, 20 nt, Mycobacterium avium subsp. paratuberculosis
ccgggguguaggcgucggcg

SEQ ID NO: 863213 - RNA, 23 nt, Mycobacterium avium subsp. paratuberculosis
ccgggggaccagcgcaaccgcgg

SEQ ID NO: 863214 - RNA, 18 nt, Mycobacterium avium subsp. paratuberculosis
ccgggggagucggggugc

SEQ ID NO: 863215 - RNA, 18 nt, Mycobacterium avium subsp. paratuberculosis
ccgggggauagggcguga

SEQ ID NO: 863216 - RNA, 23 nt, Mycobacterium avium subsp. paratuberculosis
ccgggggaucaccucaucgccca

SEQ ID NO: 863217 - RNA, 18 nt, Mycobacterium avium subsp. paratuberculosis
ccggggugugcagcggga

SEQ ID NO: 863218 - RNA, 21 nt, Mycobacterium avium subsp. paratuberculosis
ccggggcucauacggcggcuc

SEQ ID NO: 863219 - RNA, 16 nt, Mycobacterium avium subsp. paratuberculosis
ccggggcucgacaggc

SEQ ID NO: 863220 - RNA, 18 nt, Mycobacterium avium subsp. paratuberculosis
ccggggcuucgaacgccc

SEQ ID NO: 863221 - RNA, 15 nt, Mycobacterium avium subsp. paratuberculosis
ccggguaggacaccg

SEQ ID NO: 863222 - RNA, 17 nt, Mycobacterium avium subsp. paratuberculosis
ccggguaggacaccguc

SEQ ID NO: 863223 - RNA, 21 nt, Mycobacterium avium subsp. paratuberculosis
ccggguaucgacagucccgcg

SEQ ID NO: 863224 - RNA, 14 nt, Mycobacterium avium subsp. paratuberculosis
ccggguagcgccgc

SEQ ID NO: 863225 - RNA, 16 nt, Mycobacterium avium subsp. paratuberculosis
ccggguagcgccgccg

SEQ ID NO: 863226 - RNA, 16 nt, Mycobacterium avium subsp. paratuberculosis
ccggguacaccgacuu

SEQ ID NO: 863227 - RNA, 17 nt, Mycobacterium avium subsp. paratuberculosis
ccggguacaccgacuuc

SEQ ID NO: 863228 - RNA, 16 nt, Mycobacterium avium subsp. paratuberculosis
ccggguacaccggcuc

SEQ ID NO: 863229 - RNA, 18 nt, Mycobacterium avium subsp. paratuberculosis
ccggguacaccggcucgc

SEQ ID NO: 863230 - RNA, 23 nt, Mycobacterium avium subsp. paratuberculosis
ccggucgcgcaucgccucggcgg

SEQ ID NO: 863231 - RNA, 13 nt, Mycobacterium avium subsp. paratuberculosis
ccggucgccggug

SEQ ID NO: 863232 - RNA, 15 nt, Mycobacterium avium subsp. paratuberculosis
ccggucgaugucggc

SEQ ID NO: 863233 - RNA, 17 nt, Mycobacterium avium subsp. paratuberculosis
ccggucgccgaugguga

SEQ ID NO: 863234 - RNA, 17 nt, Mycobacterium avium subsp. paratuberculosis
ccggucgccgggccggc

SEQ ID NO: 863235 - RNA, 12 nt, Mycobacterium avium subsp. paratuberculosis
ccggucgccggu

SEQ ID NO: 863236 - RNA, 22 nt, Mycobacterium avium subsp. paratuberculosis
ccggucgcccccucggccgguc

SEQ ID NO: 863237 - RNA, 16 nt, Mycobacterium avium subsp. paratuberculosis
ccggucgaugucggcg

SEQ ID NO: 863238 - RNA, 17 nt, Mycobacterium avium subsp. paratuberculosis
ccggucgaugucggcga

SEQ ID NO: 863239 - RNA, 13 nt, Mycobacterium avium subsp. paratuberculosis
ccggucgaucacc

SEQ ID NO: 863240 - RNA, 21 nt, Mycobacterium avium subsp. paratuberculosis
ccggucgacgauggcccgggc

SEQ ID NO: 863241 - RNA, 18 nt, Mycobacterium avium subsp. paratuberculosis
ccgguccggcggcaccac

SEQ ID NO: 863242 - RNA, 20 nt, Mycobacterium avium subsp. paratuberculosis
ccgguccugggccuccggcg

SEQ ID NO: 863243 - RNA, 21 nt, Mycobacterium avium subsp. paratuberculosis
ccgguccugggccuccggcgg

SEQ ID NO: 863244 - RNA, 22 nt, Mycobacterium avium subsp. paratuberculosis
ccgguccugggccuccggcggc

SEQ ID NO: 863245 - RNA, 17 nt, Mycobacterium avium subsp. paratuberculosis
ccggucgaaggaggcca

SEQ ID NO: 863246 - RNA, 21 nt, Mycobacterium avium subsp. paratuberculosis
ccggucgaaggaggccagcug

SEQ ID NO: 863247 - RNA, 13 nt, Mycobacterium avium subsp. paratuberculosis
ccgguccggccgu

SEQ ID NO: 863248 - RNA, 15 nt, Mycobacterium avium subsp. paratuberculosis
ccgguccggccgugc

SEQ ID NO: 863249 - RNA, 13 nt, Mycobacterium avium subsp. paratuberculosis
ccgguccggcugg

SEQ ID NO: 863250 - RNA, 17 nt, Mycobacterium avium subsp. paratuberculosis
ccgguccggcuggucgg

SEQ ID NO: 863251 - RNA, 19 nt, Mycobacterium avium subsp. paratuberculosis
ccgguccggcuggucggcc

SEQ ID NO: 863252 - RNA, 20 nt, Mycobacterium avium subsp. paratuberculosis
ccgguccggcuggucggccu

SEQ ID NO: 863253 - RNA, 21 nt, Mycobacterium avium subsp. paratuberculosis
ccgguccggcuggucggccug

SEQ ID NO: 863254 - RNA, 14 nt, Mycobacterium avium subsp. paratuberculosis
ccgguccggucacg

SEQ ID NO: 863255 - RNA, 16 nt, Mycobacterium avium subsp. paratuberculosis
ccgguccgugcacggc

SEQ ID NO: 863256 - RNA, 18 nt, Mycobacterium avium subsp. paratuberculosis
ccgguccgugcacggcca

SEQ ID NO: 863257 - RNA, 17 nt, Mycobacterium avium subsp. paratuberculosis
ccgguccgugccacggc

SEQ ID NO: 863258 - RNA, 19 nt, Mycobacterium avium subsp. paratuberculosis
ccgguggagauggccagca

SEQ ID NO: 863259 - RNA, 17 nt, Mycobacterium avium subsp. paratuberculosis
ccgguggaugggcucga

SEQ ID NO: 863260 - RNA, 18 nt, Mycobacterium avium subsp. paratuberculosis
ccgguggaugggcucgac

SEQ ID NO: 863261 - RNA, 19 nt, Mycobacterium avium subsp. paratuberculosis
ccgguggacuccagcacca

SEQ ID NO: 863262 - RNA, 19 nt, Mycobacterium avium subsp. paratuberculosis
ccgguggacgcgauggcgc

SEQ ID NO: 863263 - RNA, 21 nt, Mycobacterium avium subsp. paratuberculosis
ccgguggacgaggugaccggc

SEQ ID NO: 863264 - RNA, 14 nt, Mycobacterium avium subsp. paratuberculosis
ccggugccgacgau

SEQ ID NO: 863265 - RNA, 15 nt, Mycobacterium avium subsp. paratuberculosis
ccggugccgacgauc

SEQ ID NO: 863266 - RNA, 16 nt, Mycobacterium avium subsp. paratuberculosis
ccggugccgacgauga

SEQ ID NO: 863267 - RNA, 15 nt, Mycobacterium avium subsp. paratuberculosis
ccggugccgcagccg

SEQ ID NO: 863268 - RNA, 22 nt, Mycobacterium avium subsp. paratuberculosis
ccggugcuggucaugccgucga

SEQ ID NO: 863269 - RNA, 24 nt, Mycobacterium avium subsp. paratuberculosis
ccggugcuggucaugccgucgacg

SEQ ID NO: 863270 - RNA, 17 nt, Mycobacterium avium subsp. paratuberculosis
ccggugcuuggcguuga

SEQ ID NO: 863271 - RNA, 21 nt, Mycobacterium avium subsp. paratuberculosis
ccgguggaaugcaucgcgauc

SEQ ID NO: 863272 - RNA, 21 nt, Mycobacterium avium subsp. paratuberculosis
ccgguggaauucuggccgacc

SEQ ID NO: 863273 - RNA, 23 nt, Mycobacterium avium subsp. paratuberculosis
ccgguggaauucuggccgaccgc

SEQ ID NO: 863274 - RNA, 19 nt, Mycobacterium avium subsp. paratuberculosis
ccggugcagaucguccauc

SEQ ID NO: 863275 - RNA, 14 nt, Mycobacterium avium subsp. paratuberculosis
ccggugcaccgcgc

SEQ ID NO: 863276 - RNA, 15 nt, Mycobacterium avium subsp. paratuberculosis
ccggugcaccgcgcg

SEQ ID NO: 863277 - RNA, 19 nt, Mycobacterium avium subsp. paratuberculosis
ccggugccacggucaggcg

SEQ ID NO: 863278 - RNA, 21 nt, Mycobacterium avium subsp. paratuberculosis
ccgguggucccggucagcguc

SEQ ID NO: 863279 - RNA, 20 nt, Mycobacterium avium subsp. paratuberculosis
ccggugggguuagggcguca

SEQ ID NO: 863280 - RNA, 13 nt, Mycobacterium avium subsp. paratuberculosis
ccgguggcgucgg

SEQ ID NO: 863281 - RNA, 23 nt, Mycobacterium avium subsp. paratuberculosis
ccgguggcgucggugaugccgga

SEQ ID NO: 863282 - RNA, 20 nt, Mycobacterium avium subsp. paratuberculosis
ccggugggacugggcgccgc

SEQ ID NO: 863283 - RNA, 14 nt, Mycobacterium avium subsp. paratuberculosis
ccggugggcggcgc

SEQ ID NO: 863284 - RNA, 16 nt, Mycobacterium avium subsp. paratuberculosis
ccgguggcagcccggc

SEQ ID NO: 863285 - RNA, 23 nt, Mycobacterium avium subsp. paratuberculosis
ccgguggccgaggguuccagcca

SEQ ID NO: 863286 - RNA, 13 nt, Mycobacterium avium subsp. paratuberculosis
ccgguggccgccg

SEQ ID NO: 863287 - RNA, 15 nt, Mycobacterium avium subsp. paratuberculosis
ccgguggccgcgucg

SEQ ID NO: 863288 - RNA, 16 nt, Mycobacterium avium subsp. paratuberculosis
ccgguggccgcgucga

SEQ ID NO: 863289 - RNA, 17 nt, Mycobacterium avium subsp. paratuberculosis
ccgguggccgcgucgac

SEQ ID NO: 863290 - RNA, 13 nt, Mycobacterium avium subsp. paratuberculosis
ccgguggccggga

SEQ ID NO: 863291 - RNA, 15 nt, Mycobacterium avium subsp. paratuberculosis
ccgguggcggccacg

SEQ ID NO: 863292 - RNA, 20 nt, Mycobacterium avium subsp. paratuberculosis
ccgguggcggccaggccggc

SEQ ID NO: 863293 - RNA, 14 nt, Mycobacterium avium subsp. paratuberculosis
ccgguggcggcgag

SEQ ID NO: 863294 - RNA, 15 nt, Mycobacterium avium subsp. paratuberculosis
ccgguggcggcgagg

SEQ ID NO: 863295 - RNA, 16 nt, Mycobacterium avium subsp. paratuberculosis
ccgguggcggcgagga

SEQ ID NO: 863296 - RNA, 17 nt, Mycobacterium avium subsp. paratuberculosis
ccgguguugccgacggc

SEQ ID NO: 863297 - RNA, 19 nt, Mycobacterium avium subsp. paratuberculosis
ccgguguugccgacggcgc

SEQ ID NO: 863298 - RNA, 20 nt, Mycobacterium avium subsp. paratuberculosis
ccgguguugccgacggcgcc

SEQ ID NO: 863299 - RNA, 22 nt, Mycobacterium avium subsp. paratuberculosis
ccgguguugccgacggcgccgg

SEQ ID NO: 863300 - RNA, 13 nt, Mycobacterium avium subsp. paratuberculosis
ccgguguucggcg

SEQ ID NO: 863301 - RNA, 20 nt, Mycobacterium avium subsp. paratuberculosis
ccgguguucggcgccagccg

SEQ ID NO: 863302 - RNA, 18 nt, Mycobacterium avium subsp. paratuberculosis
ccgguucggacacggcgc

SEQ ID NO: 863303 - RNA, 15 nt, Mycobacterium avium subsp. paratuberculosis
ccgguuggugcgccg

SEQ ID NO: 863304 - RNA, 16 nt, Mycobacterium avium subsp. paratuberculosis
ccgguuggugcgccgu

SEQ ID NO: 863305 - RNA, 12 nt, Mycobacterium avium subsp. paratuberculosis
ccgguuccgggc

SEQ ID NO: 863306 - RNA, 17 nt, Mycobacterium avium subsp. paratuberculosis
ccgguuccucggcgugu

SEQ ID NO: 863307 - RNA, 14 nt, Mycobacterium avium subsp. paratuberculosis
ccgguuccgcgaca

SEQ ID NO: 863308 - RNA, 18 nt, Mycobacterium avium subsp. paratuberculosis
ccgguuccgcgacaucgg

SEQ ID NO: 863309 - RNA, 18 nt, Mycobacterium avium subsp. paratuberculosis
ccgguuccaccgggccgc

SEQ ID NO: 863310 - RNA, 15 nt, Mycobacterium avium subsp. paratuberculosis
ccgguucccggcacc

SEQ ID NO: 863311 - RNA, 16 nt, Mycobacterium avium subsp. paratuberculosis
ccguaacacgaucacc

SEQ ID NO: 863312 - RNA, 14 nt, Mycobacterium avium subsp. paratuberculosis
ccgguuugucggcg

SEQ ID NO: 863313 - RNA, 16 nt, Mycobacterium avium subsp. paratuberculosis
ccgguuugucggcgcc

SEQ ID NO: 863314 - RNA, 14 nt, Mycobacterium avium subsp. paratuberculosis
ccgguuugcgccgg

SEQ ID NO: 863315 - RNA, 23 nt, Mycobacterium avium subsp. paratuberculosis
ccgguuugcgccggcuccaccgc

SEQ ID NO: 863316 - RNA, 14 nt, Mycobacterium avium subsp. paratuberculosis
ccgccgggguccgc

SEQ ID NO: 863317 - RNA, 12 nt, Mycobacterium avium subsp. paratuberculosis
ccgccggggugc

SEQ ID NO: 863318 - RNA, 17 nt, Mycobacterium avium subsp. paratuberculosis
ccgccggggugcaccgu

SEQ ID NO: 863319 - RNA, 19 nt, Mycobacterium avium subsp. paratuberculosis
ccgccggggugcaccgugg

SEQ ID NO: 863320 - RNA, 16 nt, Mycobacterium avium subsp. paratuberculosis
ccgccggggcgccgcc

SEQ ID NO: 863321 - RNA, 18 nt, Mycobacterium avium subsp. paratuberculosis
ccgccggggcgccgccga

SEQ ID NO: 863322 - RNA, 19 nt, Mycobacterium avium subsp. paratuberculosis
ccgccggggcgccgccgaa

SEQ ID NO: 863323 - RNA, 21 nt, Mycobacterium avium subsp. paratuberculosis
ccgccggggcgccgccgaaca

SEQ ID NO: 863324 - RNA, 24 nt, Mycobacterium avium subsp. paratuberculosis
ccgccgggcugagcugugccgcgg

SEQ ID NO: 863325 - RNA, 14 nt, Mycobacterium avium subsp. paratuberculosis
ccgccggggcgcag

SEQ ID NO: 863326 - RNA, 15 nt, Mycobacterium avium subsp. paratuberculosis
ccgccggggccccaa

SEQ ID NO: 863327 - RNA, 12 nt, Mycobacterium avium subsp. paratuberculosis
ccgccggggccg

SEQ ID NO: 863328 - RNA, 14 nt, Mycobacterium avium subsp. paratuberculosis
ccgccggggccggc

SEQ ID NO: 863329 - RNA, 16 nt, Mycobacterium avium subsp. paratuberculosis
ccgccggggccggcga

SEQ ID NO: 863330 - RNA, 18 nt, Mycobacterium avium subsp. paratuberculosis
ccgccggggccggcgaug

SEQ ID NO: 863331 - RNA, 19 nt, Mycobacterium avium subsp. paratuberculosis
ccgccggggccggcgaugc

SEQ ID NO: 863332 - RNA, 21 nt, Mycobacterium avium subsp. paratuberculosis
ccgccggggacccgcaccgga

SEQ ID NO: 863333 - RNA, 22 nt, Mycobacterium avium subsp. paratuberculosis
ccgccggggacccgcaccggaa

SEQ ID NO: 863334 - RNA, 13 nt, Mycobacterium avium subsp. paratuberculosis
ccgccggccucgg

SEQ ID NO: 863335 - RNA, 19 nt, Mycobacterium avium subsp. paratuberculosis
ccgccggcgaacgacgucg

SEQ ID NO: 863336 - RNA, 23 nt, Mycobacterium avium subsp. paratuberculosis
ccgccggcgcaucaucucggcga

SEQ ID NO: 863337 - RNA, 16 nt, Mycobacterium avium subsp. paratuberculosis
ccgccggugucggcga

SEQ ID NO: 863338 - RNA, 13 nt, Mycobacterium avium subsp. paratuberculosis
ccgccgucgacgc

SEQ ID NO: 863339 - RNA, 19 nt, Mycobacterium avium subsp. paratuberculosis
ccgccgucgacgcgugcgu

SEQ ID NO: 863340 - RNA, 12 nt, Mycobacterium avium subsp. paratuberculosis
ccgccgucgagu

SEQ ID NO: 863341 - RNA, 18 nt, Mycobacterium avium subsp. paratuberculosis
ccgccgucgccaccaccg

SEQ ID NO: 863342 - RNA, 13 nt, Mycobacterium avium subsp. paratuberculosis
ccgccgguggcgg

SEQ ID NO: 863343 - RNA, 14 nt, Mycobacterium avium subsp. paratuberculosis
ccgccgguggcggc

SEQ ID NO: 863344 - RNA, 16 nt, Mycobacterium avium subsp. paratuberculosis
ccgccgguggcggcga

SEQ ID NO: 863345 - RNA, 19 nt, Mycobacterium avium subsp. paratuberculosis
ccgccgguggcggcgagga

SEQ ID NO: 863346 - RNA, 15 nt, Mycobacterium avium subsp. paratuberculosis
ccgccgguggcgucg

SEQ ID NO: 863347 - RNA, 17 nt, Mycobacterium avium subsp. paratuberculosis
ccgccgguggggugaug

SEQ ID NO: 863348 - RNA, 15 nt, Mycobacterium avium subsp. paratuberculosis
ccgccgucgcgccag

SEQ ID NO: 863349 - RNA, 23 nt, Mycobacterium avium subsp. paratuberculosis
ccgccgucgcgccaggaccagcg

SEQ ID NO: 863350 - RNA, 22 nt, Mycobacterium avium subsp. paratuberculosis
ccgccggucgcccccucggccg

SEQ ID NO: 863351 - RNA, 19 nt, Mycobacterium avium subsp. paratuberculosis
ccgccggugaccacgcuga

SEQ ID NO: 863352 - RNA, 19 nt, Mycobacterium avium subsp. paratuberculosis
ccgccggugccagcaacac

SEQ ID NO: 863353 - RNA, 19 nt, Mycobacterium avium subsp. paratuberculosis
ccgccgguccagugccggc

SEQ ID NO: 863354 - RNA, 20 nt, Mycobacterium avium subsp. paratuberculosis
ccgccgguccagugccggcg

SEQ ID NO: 863355 - RNA, 15 nt, Mycobacterium avium subsp. paratuberculosis
ccgccggugccgacg

SEQ ID NO: 863356 - RNA, 16 nt, Mycobacterium avium subsp. paratuberculosis
ccgccggugccgacga

SEQ ID NO: 863357 - RNA, 19 nt, Mycobacterium avium subsp. paratuberculosis
ccgccggugccgacgauga

SEQ ID NO: 863358 - RNA, 22 nt, Mycobacterium avium subsp. paratuberculosis
ccgccgguggagauggccagca

SEQ ID NO: 863359 - RNA, 15 nt, Mycobacterium avium subsp. paratuberculosis
ccgccgguggccgcg

SEQ ID NO: 863360 - RNA, 16 nt, Mycobacterium avium subsp. paratuberculosis
ccgccgguggccgcga

SEQ ID NO: 863361 - RNA, 19 nt, Mycobacterium avium subsp. paratuberculosis
ccgccgguggccgcgcugg

SEQ ID NO: 863362 - RNA, 13 nt, Mycobacterium avium subsp. paratuberculosis
ccgccuccgggcu

SEQ ID NO: 863363 - RNA, 14 nt, Mycobacterium avium subsp. paratuberculosis
ccgccuccgggcug

SEQ ID NO: 863364 - RNA, 23 nt, Mycobacterium avium subsp. paratuberculosis
ccgccuccgguuugcgccggcuc

SEQ ID NO: 863365 - RNA, 14 nt, Mycobacterium avium subsp. paratuberculosis
ccgccuccgacagc

SEQ ID NO: 863366 - RNA, 16 nt, Mycobacterium avium subsp. paratuberculosis
ccgccuccgacagccg

SEQ ID NO: 863367 - RNA, 23 nt, Mycobacterium avium subsp. paratuberculosis
ccgccuccgacagccgcaccggc

SEQ ID NO: 863368 - RNA, 16 nt, Mycobacterium avium subsp. paratuberculosis
ccgccuccgaccagcc

SEQ ID NO: 863369 - RNA, 13 nt, Mycobacterium avium subsp. paratuberculosis
ccgccguucucgc

SEQ ID NO: 863370 - RNA, 17 nt, Mycobacterium avium subsp. paratuberculosis
ccgccguucucgcgcag

SEQ ID NO: 863371 - RNA, 18 nt, Mycobacterium avium subsp. paratuberculosis
ccgccguucucgcgcagg

SEQ ID NO: 863372 - RNA, 16 nt, Mycobacterium avium subsp. paratuberculosis
ccgccguggcagggcc

SEQ ID NO: 863373 - RNA, 20 nt, Mycobacterium avium subsp. paratuberculosis
ccgccguggcagggccagca

SEQ ID NO: 863374 - RNA, 21 nt, Mycobacterium avium subsp. paratuberculosis
ccgccguguaggccgcgcugg

SEQ ID NO: 863375 - RNA, 21 nt, Mycobacterium avium subsp. paratuberculosis
ccgccguggcguuacacccgc

SEQ ID NO: 863376 - RNA, 22 nt, Mycobacterium avium subsp. paratuberculosis
ccgccguggcguuacacccgcg

SEQ ID NO: 863377 - RNA, 15 nt, Mycobacterium avium subsp. paratuberculosis
ccgccgugcgcggcg

SEQ ID NO: 863378 - RNA, 16 nt, Mycobacterium avium subsp. paratuberculosis
ccgccgugcgcggcga

SEQ ID NO: 863379 - RNA, 18 nt, Mycobacterium avium subsp. paratuberculosis
ccgccgugcgcggcgacc

SEQ ID NO: 863380 - RNA, 21 nt, Mycobacterium avium subsp. paratuberculosis
ccgccgugcgcggcgaccacc

SEQ ID NO: 863381 - RNA, 15 nt, Mycobacterium avium subsp. paratuberculosis
ccgccgucggcaucc

SEQ ID NO: 863382 - RNA, 12 nt, Mycobacterium avium subsp. paratuberculosis
ccgccgucgggg

SEQ ID NO: 863383 - RNA, 13 nt, Mycobacterium avium subsp. paratuberculosis
ccgccgucggggc

SEQ ID NO: 863384 - RNA, 14 nt, Mycobacterium avium subsp. paratuberculosis
ccgccgucggggug

SEQ ID NO: 863385 - RNA, 16 nt, Mycobacterium avium subsp. paratuberculosis
ccgccgucgguguagc

SEQ ID NO: 863386 - RNA, 20 nt, Mycobacterium avium subsp. paratuberculosis
ccgccgucguagccgcgggu

SEQ ID NO: 863387 - RNA, 21 nt, Mycobacterium avium subsp. paratuberculosis
ccgccgucguagccgcgggug

SEQ ID NO: 863388 - RNA, 15 nt, Mycobacterium avium subsp. paratuberculosis
ccgccgugaccggcg

SEQ ID NO: 863389 - RNA, 16 nt, Mycobacterium avium subsp. paratuberculosis
ccgccgugaccggcga

SEQ ID NO: 863390 - RNA, 19 nt, Mycobacterium avium subsp. paratuberculosis
ccgccggauuacucgccgg

SEQ ID NO: 863391 - RNA, 22 nt, Mycobacterium avium subsp. paratuberculosis
ccgccggauuacucgccggcgg

SEQ ID NO: 863392 - RNA, 14 nt, Mycobacterium avium subsp. paratuberculosis
ccgccggcaguccg

SEQ ID NO: 863393 - RNA, 14 nt, Mycobacterium avium subsp. paratuberculosis
ccgccggcaccguc

SEQ ID NO: 863394 - RNA, 14 nt, Mycobacterium avium subsp. paratuberculosis
ccgccggcagcggc

SEQ ID NO: 863395 - RNA, 14 nt, Mycobacterium avium subsp. paratuberculosis
ccgccggcccagcu

SEQ ID NO: 863396 - RNA, 15 nt, Mycobacterium avium subsp. paratuberculosis
ccgccggcccagcuc

SEQ ID NO: 863397 - RNA, 15 nt, Mycobacterium avium subsp. paratuberculosis
ccgccggccaggcga

SEQ ID NO: 863398 - RNA, 15 nt, Mycobacterium avium subsp. paratuberculosis
ccgccggccagcucc

SEQ ID NO: 863399 - RNA, 18 nt, Mycobacterium avium subsp. paratuberculosis
ccgccggccaccaggguc

SEQ ID NO: 863400 - RNA, 20 nt, Mycobacterium avium subsp. paratuberculosis
ccgccggcgaagcucgacga

SEQ ID NO: 863401 - RNA, 20 nt, Mycobacterium avium subsp. paratuberculosis
ccgccggccgcgcgugcgca

SEQ ID NO: 863402 - RNA, 13 nt, Mycobacterium avium subsp. paratuberculosis
ccgccggccgcgg

SEQ ID NO: 863403 - RNA, 16 nt, Mycobacterium avium subsp. paratuberculosis
ccgccggccgcggcgu

SEQ ID NO: 863404 - RNA, 12 nt, Mycobacterium avium subsp. paratuberculosis
ccgccggccgcu

SEQ ID NO: 863405 - RNA, 13 nt, Mycobacterium avium subsp. paratuberculosis
ccgccggccgcuc

SEQ ID NO: 863406 - RNA, 14 nt, Mycobacterium avium subsp. paratuberculosis
ccgccggccgcucg

SEQ ID NO: 863407 - RNA, 15 nt, Mycobacterium avium subsp. paratuberculosis
ccgccggcccggcgu

SEQ ID NO: 863408 - RNA, 14 nt, Mycobacterium avium subsp. paratuberculosis
ccgccggcccgguc

SEQ ID NO: 863409 - RNA, 17 nt, Mycobacterium avium subsp. paratuberculosis
ccgccggagaccagcag

SEQ ID NO: 863410 - RNA, 15 nt, Mycobacterium avium subsp. paratuberculosis
ccgccggagccgauc

SEQ ID NO: 863411 - RNA, 16 nt, Mycobacterium avium subsp. paratuberculosis
ccgccggagccgaucg

SEQ ID NO: 863412 - RNA, 16 nt, Mycobacterium avium subsp. paratuberculosis
ccgccggaucggcagc

SEQ ID NO: 863413 - RNA, 23 nt, Mycobacterium avium subsp. paratuberculosis
ccgccggaucggcagcgcguuga

SEQ ID NO: 863414 - RNA, 22 nt, Mycobacterium avium subsp. paratuberculosis
ccgccggaucgugucccggcgc

SEQ ID NO: 863415 - RNA, 23 nt, Mycobacterium avium subsp. paratuberculosis
ccgccggaucgugucccggcgcc

SEQ ID NO: 863416 - RNA, 14 nt, Mycobacterium avium subsp. paratuberculosis
ccgccggaacggga

SEQ ID NO: 863417 - RNA, 23 nt, Mycobacterium avium subsp. paratuberculosis
ccgccggaacgggaagaucgucg

SEQ ID NO: 863418 - RNA, 17 nt, Mycobacterium avium subsp. paratuberculosis
ccgccggaacucggccg

SEQ ID NO: 863419 - RNA, 19 nt, Mycobacterium avium subsp. paratuberculosis
ccgccggaacucggccggc

SEQ ID NO: 863420 - RNA, 16 nt, Mycobacterium avium subsp. paratuberculosis
ccgccggacaccaccg

SEQ ID NO: 863421 - RNA, 20 nt, Mycobacterium avium subsp. paratuberculosis
ccgccggacaccaccgcggu

SEQ ID NO: 863422 - RNA, 17 nt, Mycobacterium avium subsp. paratuberculosis
ccgccgcugacgcggcg

SEQ ID NO: 863423 - RNA, 22 nt, Mycobacterium avium subsp. paratuberculosis
ccgccgcugacgcggcgggcau

SEQ ID NO: 863424 - RNA, 12 nt, Mycobacterium avium subsp. paratuberculosis
ccgccgcugcag

SEQ ID NO: 863425 - RNA, 14 nt, Mycobacterium avium subsp. paratuberculosis
ccgccgcugcagcu

SEQ ID NO: 863426 - RNA, 13 nt, Mycobacterium avium subsp. paratuberculosis
ccgccgcugucga

SEQ ID NO: 863427 - RNA, 22 nt, Mycobacterium avium subsp. paratuberculosis
ccgccgcugcgcgcgcgaucgg

SEQ ID NO: 863428 - RNA, 17 nt, Mycobacterium avium subsp. paratuberculosis
ccgcccggacaccccgu

SEQ ID NO: 863429 - RNA, 17 nt, Mycobacterium avium subsp. paratuberculosis
ccgcccggaucagcuga

SEQ ID NO: 863430 - RNA, 18 nt, Mycobacterium avium subsp. paratuberculosis
ccgcccggaucagcugac

SEQ ID NO: 863431 - RNA, 14 nt, Mycobacterium avium subsp. paratuberculosis
ccgcccggaugccg

SEQ ID NO: 863432 - RNA, 18 nt, Mycobacterium avium subsp. paratuberculosis
ccgcccggaugccggcgc

SEQ ID NO: 863433 - RNA, 19 nt, Mycobacterium avium subsp. paratuberculosis
ccgcccggaugccggcgcc

SEQ ID NO: 863434 - RNA, 14 nt, Mycobacterium avium subsp. paratuberculosis
ccgcccgacccguc

SEQ ID NO: 863435 - RNA, 17 nt, Mycobacterium avium subsp. paratuberculosis
ccgcccgcucgacggcc

SEQ ID NO: 863436 - RNA, 19 nt, Mycobacterium avium subsp. paratuberculosis
ccgcccgcucgacggccgg

SEQ ID NO: 863437 - RNA, 14 nt, Mycobacterium avium subsp. paratuberculosis
ccgcccgcugaccg

SEQ ID NO: 863438 - RNA, 24 nt, Mycobacterium avium subsp. paratuberculosis
ccgcccgcugaccgccgcgcucgg

SEQ ID NO: 863439 - RNA, 22 nt, Mycobacterium avium subsp. paratuberculosis
ccgcccggauucgcggcggcgc

SEQ ID NO: 863440 - RNA, 13 nt, Mycobacterium avium subsp. paratuberculosis
ccgcccggcccgc

SEQ ID NO: 863441 - RNA, 15 nt, Mycobacterium avium subsp. paratuberculosis
ccgcccggcccggcg

SEQ ID NO: 863442 - RNA, 19 nt, Mycobacterium avium subsp. paratuberculosis
ccgcccggcccaagacccg

SEQ ID NO: 863443 - RNA, 21 nt, Mycobacterium avium subsp. paratuberculosis
ccgcccggcccaagacccgcg

SEQ ID NO: 863444 - RNA, 13 nt, Mycobacterium avium subsp. paratuberculosis
ccgcccggccggu

SEQ ID NO: 863445 - RNA, 17 nt, Mycobacterium avium subsp. paratuberculosis
ccgcccggccggucgcc

SEQ ID NO: 863446 - RNA, 13 nt, Mycobacterium avium subsp. paratuberculosis
ccgcccggcgaua

SEQ ID NO: 863447 - RNA, 13 nt, Mycobacterium avium subsp. paratuberculosis
ccgcccggcgauc

SEQ ID NO: 863448 - RNA, 12 nt, Mycobacterium avium subsp. paratuberculosis
ccgcccggcgcc

SEQ ID NO: 863449 - RNA, 12 nt, Mycobacterium avium subsp. paratuberculosis
ccgccgcggcca

SEQ ID NO: 863450 - RNA, 14 nt, Mycobacterium avium subsp. paratuberculosis
ccgccgcggccaca

SEQ ID NO: 863451 - RNA, 13 nt, Mycobacterium avium subsp. paratuberculosis
ccgccgcggccag

SEQ ID NO: 863452 - RNA, 11 nt, Mycobacterium avium subsp. paratuberculosis
ccgcccggcga

SEQ ID NO: 863453 - RNA, 13 nt, Mycobacterium avium subsp. paratuberculosis
ccgccgcggcacc

SEQ ID NO: 863454 - RNA, 16 nt, Mycobacterium avium subsp. paratuberculosis
ccgcccggcggcgcug

SEQ ID NO: 863455 - RNA, 16 nt, Mycobacterium avium subsp. paratuberculosis
ccgcccggcgccggcc

SEQ ID NO: 863456 - RNA, 20 nt, Mycobacterium avium subsp. paratuberculosis
ccgcccggcgccggccgaca

SEQ ID NO: 863457 - RNA, 17 nt, Mycobacterium avium subsp. paratuberculosis
ccgcccggcggccacca

SEQ ID NO: 863458 - RNA, 14 nt, Mycobacterium avium subsp. paratuberculosis
ccgcccggcggcgc

SEQ ID NO: 863459 - RNA, 12 nt, Mycobacterium avium subsp. paratuberculosis
ccgcccgggaag

SEQ ID NO: 863460 - RNA, 13 nt, Mycobacterium avium subsp. paratuberculosis
ccgcccgggaagc

SEQ ID NO: 863461 - RNA, 18 nt, Mycobacterium avium subsp. paratuberculosis
ccgcccgggcacgacggu

SEQ ID NO: 863462 - RNA, 16 nt, Mycobacterium avium subsp. paratuberculosis
ccgcccgggcccgggg

SEQ ID NO: 863463 - RNA, 19 nt, Mycobacterium avium subsp. paratuberculosis
ccgcccgggcccggggugg

SEQ ID NO: 863464 - RNA, 13 nt, Mycobacterium avium subsp. paratuberculosis
ccgcccgggccgc

SEQ ID NO: 863465 - RNA, 15 nt, Mycobacterium avium subsp. paratuberculosis
ccgcccgggccgcgc

SEQ ID NO: 863466 - RNA, 14 nt, Mycobacterium avium subsp. paratuberculosis
ccgcccgggcggcc

SEQ ID NO: 863467 - RNA, 18 nt, Mycobacterium avium subsp. paratuberculosis
ccgcccgggcggcccggg

SEQ ID NO: 863468 - RNA, 14 nt, Mycobacterium avium subsp. paratuberculosis
ccgccgcggaucgg

SEQ ID NO: 863469 - RNA, 10 nt, Mycobacterium avium subsp. paratuberculosis
ccgccgcggc

SEQ ID NO: 863470 - RNA, 18 nt, Mycobacterium avium subsp. paratuberculosis
ccgccgcgucgugccgag

SEQ ID NO: 863471 - RNA, 22 nt, Mycobacterium avium subsp. paratuberculosis
ccgccgcuagguuuggccagca

SEQ ID NO: 863472 - RNA, 15 nt, Mycobacterium avium subsp. paratuberculosis
ccgccgcucaccgcc

SEQ ID NO: 863473 - RNA, 18 nt, Mycobacterium avium subsp. paratuberculosis
ccgccgcguccggggugc

SEQ ID NO: 863474 - RNA, 15 nt, Mycobacterium avium subsp. paratuberculosis
ccgccgcgucgccgc

SEQ ID NO: 863475 - RNA, 14 nt, Mycobacterium avium subsp. paratuberculosis
ccgccgcgucgguc

SEQ ID NO: 863476 - RNA, 17 nt, Mycobacterium avium subsp. paratuberculosis
ccgccgcgucggucagc

SEQ ID NO: 863477 - RNA, 22 nt, Mycobacterium avium subsp. paratuberculosis
ccgccgcgucggucagcgccac

SEQ ID NO: 863478 - RNA, 13 nt, Mycobacterium avium subsp. paratuberculosis
ccgccgcgucguc

SEQ ID NO: 863479 - RNA, 18 nt, Mycobacterium avium subsp. paratuberculosis
ccgccgcgguggguccgc

SEQ ID NO: 863480 - RNA, 15 nt, Mycobacterium avium subsp. paratuberculosis
ccgccgcguacaccg

SEQ ID NO: 863481 - RNA, 17 nt, Mycobacterium avium subsp. paratuberculosis
ccgccgcguacaccggc

SEQ ID NO: 863482 - RNA, 16 nt, Mycobacterium avium subsp. paratuberculosis
ccgccgcguacagcag

SEQ ID NO: 863483 - RNA, 18 nt, Mycobacterium avium subsp. paratuberculosis
ccgccgcguaggccagga

SEQ ID NO: 863484 - RNA, 16 nt, Mycobacterium avium subsp. paratuberculosis
ccgccgcgucagcggc

SEQ ID NO: 863485 - RNA, 14 nt, Mycobacterium avium subsp. paratuberculosis
ccgccgcgggucgg

SEQ ID NO: 863486 - RNA, 17 nt, Mycobacterium avium subsp. paratuberculosis
ccgccgcgggucggcga

SEQ ID NO: 863487 - RNA, 18 nt, Mycobacterium avium subsp. paratuberculosis
ccgccgcgggucggcgac

SEQ ID NO: 863488 - RNA, 21 nt, Mycobacterium avium subsp. paratuberculosis
ccgccccgucggucgggcagu

SEQ ID NO: 863489 - RNA, 17 nt, Mycobacterium avium subsp. paratuberculosis
ccgccgcggccgcgaug

SEQ ID NO: 863490 - RNA, 20 nt, Mycobacterium avium subsp. paratuberculosis
ccgccgcggccgcggcgggc

SEQ ID NO: 863491 - RNA, 15 nt, Mycobacterium avium subsp. paratuberculosis
ccgccgcggccgcug

SEQ ID NO: 863492 - RNA, 22 nt, Mycobacterium avium subsp. paratuberculosis
ccgccgcggccgcuggcguuga

SEQ ID NO: 863493 - RNA, 13 nt, Mycobacterium avium subsp. paratuberculosis
ccgccgcggcgac

SEQ ID NO: 863494 - RNA, 14 nt, Mycobacterium avium subsp. paratuberculosis
ccgccgcggcgacc

SEQ ID NO: 863495 - RNA, 20 nt, Mycobacterium avium subsp. paratuberculosis
ccgccgcggcgaccggggcg

SEQ ID NO: 863496 - RNA, 16 nt, Mycobacterium avium subsp. paratuberculosis
ccgccgcggcgcccgg

SEQ ID NO: 863497 - RNA, 19 nt, Mycobacterium avium subsp. paratuberculosis
ccgccgcggcgcccggcgc

SEQ ID NO: 863498 - RNA, 14 nt, Mycobacterium avium subsp. paratuberculosis
ccgccgcggcggca

SEQ ID NO: 863499 - RNA, 14 nt, Mycobacterium avium subsp. paratuberculosis
ccgccgcggcggcc

SEQ ID NO: 863500 - RNA, 15 nt, Mycobacterium avium subsp. paratuberculosis
ccgccgcggcggccu

SEQ ID NO: 863501 - RNA, 15 nt, Mycobacterium avium subsp. paratuberculosis
ccgccgcggcuccag

SEQ ID NO: 863502 - RNA, 12 nt, Mycobacterium avium subsp. paratuberculosis
ccgccgcggccg

SEQ ID NO: 863503 - RNA, 13 nt, Mycobacterium avium subsp. paratuberculosis
ccgccgcggccgc

SEQ ID NO: 863504 - RNA, 14 nt, Mycobacterium avium subsp. paratuberculosis
ccgccgcggccgcc

SEQ ID NO: 863505 - RNA, 12 nt, Mycobacterium avium subsp. paratuberculosis
ccgcgcccgcuc

SEQ ID NO: 863506 - RNA, 16 nt, Mycobacterium avium subsp. paratuberculosis
ccgcgcccgccccguu

SEQ ID NO: 863507 - RNA, 20 nt, Mycobacterium avium subsp. paratuberculosis
ccgcgcccgccgcguacacc

SEQ ID NO: 863508 - RNA, 14 nt, Mycobacterium avium subsp. paratuberculosis
ccgcgcccgccggc

SEQ ID NO: 863509 - RNA, 13 nt, Mycobacterium avium subsp. paratuberculosis
ccgcgccccggcg

SEQ ID NO: 863510 - RNA, 14 nt, Mycobacterium avium subsp. paratuberculosis
ccgcgccccggcgg

SEQ ID NO: 863511 - RNA, 17 nt, Mycobacterium avium subsp. paratuberculosis
ccgcgcccagccccagc

SEQ ID NO: 863512 - RNA, 18 nt, Mycobacterium avium subsp. paratuberculosis
ccgcgcccaguguggggc

SEQ ID NO: 863513 - RNA, 14 nt, Mycobacterium avium subsp. paratuberculosis
ccgcgcccaucgcg

SEQ ID NO: 863514 - RNA, 16 nt, Mycobacterium avium subsp. paratuberculosis
ccgcgcccaucgcggc

SEQ ID NO: 863515 - RNA, 20 nt, Mycobacterium avium subsp. paratuberculosis
ccgcgcccaucgcggccgcc

SEQ ID NO: 863516 - RNA, 21 nt, Mycobacterium avium subsp. paratuberculosis
ccgcgcccaugaacgcgucgc

SEQ ID NO: 863517 - RNA, 12 nt, Mycobacterium avium subsp. paratuberculosis
ccgcgcccagca

SEQ ID NO: 863518 - RNA, 17 nt, Mycobacterium avium subsp. paratuberculosis
ccgcgcccagcacguca

SEQ ID NO: 863519 - RNA, 20 nt, Mycobacterium avium subsp. paratuberculosis
ccgcgcccagcacgucaccg

SEQ ID NO: 863520 - RNA, 13 nt, Mycobacterium avium subsp. paratuberculosis
ccgcgccaacgag

SEQ ID NO: 863521 - RNA, 12 nt, Mycobacterium avium subsp. paratuberculosis
ccgcgcccaccc

SEQ ID NO: 863522 - RNA, 22 nt, Mycobacterium avium subsp. paratuberculosis
ccgcgcccacccgaugaccggc

SEQ ID NO: 863523 - RNA, 20 nt, Mycobacterium avium subsp. paratuberculosis
ccgcgcccaccuggaggcca

SEQ ID NO: 863524 - RNA, 22 nt, Mycobacterium avium subsp. paratuberculosis
ccgcgcauguuggugaucagcc

SEQ ID NO: 863525 - RNA, 16 nt, Mycobacterium avium subsp. paratuberculosis
ccgcgcaucggucagc

SEQ ID NO: 863526 - RNA, 20 nt, Mycobacterium avium subsp. paratuberculosis
ccgcgcaucaucgcccagcg

SEQ ID NO: 863527 - RNA, 17 nt, Mycobacterium avium subsp. paratuberculosis
ccgcgcaucccgucgac

SEQ ID NO: 863528 - RNA, 19 nt, Mycobacterium avium subsp. paratuberculosis
ccgcgcaucccgucgacca

SEQ ID NO: 863529 - RNA, 16 nt, Mycobacterium avium subsp. paratuberculosis
ccgcgcauccgcaccg

SEQ ID NO: 863530 - RNA, 20 nt, Mycobacterium avium subsp. paratuberculosis
ccgcgcauccgcaccgagac

SEQ ID NO: 863531 - RNA, 21 nt, Mycobacterium avium subsp. paratuberculosis
ccgcgaucugcucggugucga

SEQ ID NO: 863532 - RNA, 12 nt, Mycobacterium avium subsp. paratuberculosis
ccgcgaugaggc

SEQ ID NO: 863533 - RNA, 15 nt, Mycobacterium avium subsp. paratuberculosis
ccgcgaugaucacac

SEQ ID NO: 863534 - RNA, 18 nt, Mycobacterium avium subsp. paratuberculosis
ccgcgaugauggcgucga

SEQ ID NO: 863535 - RNA, 22 nt, Mycobacterium avium subsp. paratuberculosis
ccgcgaugauggcgucgacgug

SEQ ID NO: 863536 - RNA, 23 nt, Mycobacterium avium subsp. paratuberculosis
ccgcgaugauggcgucgacgugc

SEQ ID NO: 863537 - RNA, 22 nt, Mycobacterium avium subsp. paratuberculosis
ccgcgaugcagaacagccgguc

SEQ ID NO: 863538 - RNA, 20 nt, Mycobacterium avium subsp. paratuberculosis
ccgcgauggccuccgacccg

SEQ ID NO: 863539 - RNA, 19 nt, Mycobacterium avium subsp. paratuberculosis
ccgcgauggcccgcgcgau

SEQ ID NO: 863540 - RNA, 15 nt, Mycobacterium avium subsp. paratuberculosis
ccgcgaugcccgccg

SEQ ID NO: 863541 - RNA, 16 nt, Mycobacterium avium subsp. paratuberculosis
ccgcgaugcccgccgg

SEQ ID NO: 863542 - RNA, 15 nt, Mycobacterium avium subsp. paratuberculosis
ccgcgaugcgacacc

SEQ ID NO: 863543 - RNA, 18 nt, Mycobacterium avium subsp. paratuberculosis
ccgcgaugcgacaccgcg

SEQ ID NO: 863544 - RNA, 16 nt, Mycobacterium avium subsp. paratuberculosis
ccgcgcagucggcguc

SEQ ID NO: 863545 - RNA, 18 nt, Mycobacterium avium subsp. paratuberculosis
ccgcgcagucggcgucgc

SEQ ID NO: 863546 - RNA, 20 nt, Mycobacterium avium subsp. paratuberculosis
ccgcgcagucggcgucgcgg

SEQ ID NO: 863547 - RNA, 22 nt, Mycobacterium avium subsp. paratuberculosis
ccgcgcagucggcgucgcggcg

SEQ ID NO: 863548 - RNA, 24 nt, Mycobacterium avium subsp. paratuberculosis
ccgcgcagucggcgucgcggcgca

SEQ ID NO: 863549 - RNA, 15 nt, Mycobacterium avium subsp. paratuberculosis
ccgcgcaggcggcga

SEQ ID NO: 863550 - RNA, 19 nt, Mycobacterium avium subsp. paratuberculosis
ccgcgcaggcggcgacggc

SEQ ID NO: 863551 - RNA, 16 nt, Mycobacterium avium subsp. paratuberculosis
ccgcgcaggccccggg

SEQ ID NO: 863552 - RNA, 17 nt, Mycobacterium avium subsp. paratuberculosis
ccgcgcaggccccgggg

SEQ ID NO: 863553 - RNA, 12 nt, Mycobacterium avium subsp. paratuberculosis
ccgcgcaggccg

SEQ ID NO: 863554 - RNA, 14 nt, Mycobacterium avium subsp. paratuberculosis
ccgcgcaggccgcc

SEQ ID NO: 863555 - RNA, 22 nt, Mycobacterium avium subsp. paratuberculosis
ccgcgcaggccguccagcagca

SEQ ID NO: 863556 - RNA, 13 nt, Mycobacterium avium subsp. paratuberculosis
ccgcgaugguggc

SEQ ID NO: 863557 - RNA, 20 nt, Mycobacterium avium subsp. paratuberculosis
ccgcgauguagcggacgggc

SEQ ID NO: 863558 - RNA, 23 nt, Mycobacterium avium subsp. paratuberculosis
ccgcgauguagcggacgggccgc

SEQ ID NO: 863559 - RNA, 21 nt, Mycobacterium avium subsp. paratuberculosis
ccgcgcagcgugucggggucg

SEQ ID NO: 863560 - RNA, 11 nt, Mycobacterium avium subsp. paratuberculosis
ccgcgcagcuc

SEQ ID NO: 863561 - RNA, 12 nt, Mycobacterium avium subsp. paratuberculosis
ccgcgcagcucg

SEQ ID NO: 863562 - RNA, 22 nt, Mycobacterium avium subsp. paratuberculosis
ccgcgcagcucgacgaccucgc

SEQ ID NO: 863563 - RNA, 18 nt, Mycobacterium avium subsp. paratuberculosis
ccgcgcagcucggggucg

SEQ ID NO: 863564 - RNA, 22 nt, Mycobacterium avium subsp. paratuberculosis
ccgcgcagcucggggucggcgu

SEQ ID NO: 863565 - RNA, 23 nt, Mycobacterium avium subsp. paratuberculosis
ccgcgcgccggccagcacggcgg

SEQ ID NO: 863566 - RNA, 14 nt, Mycobacterium avium subsp. paratuberculosis
ccgcgcgccgacag

SEQ ID NO: 863567 - RNA, 15 nt, Mycobacterium avium subsp. paratuberculosis
ccgcgcgccgacaga

SEQ ID NO: 863568 - RNA, 12 nt, Mycobacterium avium subsp. paratuberculosis
ccgcgcgccgag

SEQ ID NO: 863569 - RNA, 15 nt, Mycobacterium avium subsp. paratuberculosis
ccgcgcgccgagagc

SEQ ID NO: 863570 - RNA, 22 nt, Mycobacterium avium subsp. paratuberculosis
ccgcgcgccgagagcgcgucga

SEQ ID NO: 863571 - RNA, 12 nt, Mycobacterium avium subsp. paratuberculosis
ccgcgcgcccgc

SEQ ID NO: 863572 - RNA, 13 nt, Mycobacterium avium subsp. paratuberculosis
ccgcgcgcccguc

SEQ ID NO: 863573 - RNA, 18 nt, Mycobacterium avium subsp. paratuberculosis
ccgcgcgcccgucgucgg

SEQ ID NO: 863574 - RNA, 19 nt, Mycobacterium avium subsp. paratuberculosis
ccgcgcgcccgucgucggu

SEQ ID NO: 863575 - RNA, 13 nt, Mycobacterium avium subsp. paratuberculosis
ccgcgcgcaccac

SEQ ID NO: 863576 - RNA, 15 nt, Mycobacterium avium subsp. paratuberculosis
ccgcgcgccagcgcg

SEQ ID NO: 863577 - RNA, 16 nt, Mycobacterium avium subsp. paratuberculosis
ccgcgcgcaggcgcug

SEQ ID NO: 863578 - RNA, 17 nt, Mycobacterium avium subsp. paratuberculosis
ccgcgcgcaggcgcuga

SEQ ID NO: 863579 - RNA, 22 nt, Mycobacterium avium subsp. paratuberculosis
ccgcgcgaugcgggcgccgaac

SEQ ID NO: 863580 - RNA, 16 nt, Mycobacterium avium subsp. paratuberculosis
ccgcgcgaucggcgag

SEQ ID NO: 863581 - RNA, 18 nt, Mycobacterium avium subsp. paratuberculosis
ccgcgcgaucggcgagcc

SEQ ID NO: 863582 - RNA, 22 nt, Mycobacterium avium subsp. paratuberculosis
ccgcgcgaugcacaaccgcugc

SEQ ID NO: 863583 - RNA, 16 nt, Mycobacterium avium subsp. paratuberculosis
ccgcgcgcaacgaggc

SEQ ID NO: 863584 - RNA, 12 nt, Mycobacterium avium subsp. paratuberculosis
ccgcgccgucgu

SEQ ID NO: 863585 - RNA, 13 nt, Mycobacterium avium subsp. paratuberculosis
ccgcgccgucguc

SEQ ID NO: 863586 - RNA, 18 nt, Mycobacterium avium subsp. paratuberculosis
ccgcgccgucuuccgggc

SEQ ID NO: 863587 - RNA, 16 nt, Mycobacterium avium subsp. paratuberculosis
ccgcgccgugggcguc

SEQ ID NO: 863588 - RNA, 19 nt, Mycobacterium avium subsp. paratuberculosis
ccgcgccguugaccgcggc

SEQ ID NO: 863589 - RNA, 14 nt, Mycobacterium avium subsp. paratuberculosis
ccgcgccgggcgga

SEQ ID NO: 863590 - RNA, 13 nt, Mycobacterium avium subsp. paratuberculosis
ccgcgccggcgug

SEQ ID NO: 863591 - RNA, 14 nt, Mycobacterium avium subsp. paratuberculosis
ccgcgccgguccgg

SEQ ID NO: 863592 - RNA, 19 nt, Mycobacterium avium subsp. paratuberculosis
ccgcgccgguccggcccug

SEQ ID NO: 863593 - RNA, 13 nt, Mycobacterium avium subsp. paratuberculosis
ccgcgccggggug

SEQ ID NO: 863594 - RNA, 14 nt, Mycobacterium avium subsp. paratuberculosis
ccgcgccggggugg

SEQ ID NO: 863595 - RNA, 18 nt, Mycobacterium avium subsp. paratuberculosis
ccgcgccggggugggcca

SEQ ID NO: 863596 - RNA, 22 nt, Mycobacterium avium subsp. paratuberculosis
ccgcgccggggugggccaucgg

SEQ ID NO: 863597 - RNA, 14 nt, Mycobacterium avium subsp. paratuberculosis
ccgcgccggggugu

SEQ ID NO: 863598 - RNA, 22 nt, Mycobacterium avium subsp. paratuberculosis
ccgcgccgggguguccagcggg

SEQ ID NO: 863599 - RNA, 13 nt, Mycobacterium avium subsp. paratuberculosis
ccgcgccgggcaa

SEQ ID NO: 863600 - RNA, 17 nt, Mycobacterium avium subsp. paratuberculosis
ccgcgccgggcaccacc

SEQ ID NO: 863601 - RNA, 22 nt, Mycobacterium avium subsp. paratuberculosis
ccgcgccgggcgaagucgccgg

SEQ ID NO: 863602 - RNA, 23 nt, Mycobacterium avium subsp. paratuberculosis
ccgcgccgggcgaagucgccggc

SEQ ID NO: 863603 - RNA, 14 nt, Mycobacterium avium subsp. paratuberculosis
ccgcgccggcggcg

SEQ ID NO: 863604 - RNA, 19 nt, Mycobacterium avium subsp. paratuberculosis
ccgcgccggcggcggcggu

SEQ ID NO: 863605 - RNA, 16 nt, Mycobacterium avium subsp. paratuberculosis
ccgcgccggccggaca

SEQ ID NO: 863606 - RNA, 18 nt, Mycobacterium avium subsp. paratuberculosis
ccgcgccgcggccagcgc

SEQ ID NO: 863607 - RNA, 19 nt, Mycobacterium avium subsp. paratuberculosis
ccgcgccgcggccagcgcc

SEQ ID NO: 863608 - RNA, 16 nt, Mycobacterium avium subsp. paratuberculosis
ccgcgccgcgccgccu

SEQ ID NO: 863609 - RNA, 17 nt, Mycobacterium avium subsp. paratuberculosis
ccgcgccgcgccgccuu

SEQ ID NO: 863610 - RNA, 14 nt, Mycobacterium avium subsp. paratuberculosis
ccgcgccgcgucgu

SEQ ID NO: 863611 - RNA, 17 nt, Mycobacterium avium subsp. paratuberculosis
ccgcgccgcgucgucgu

SEQ ID NO: 863612 - RNA, 21 nt, Mycobacterium avium subsp. paratuberculosis
ccgcgccgcgucgucgucgac

SEQ ID NO: 863613 - RNA, 15 nt, Mycobacterium avium subsp. paratuberculosis
ccgcgccggaguuga

SEQ ID NO: 863614 - RNA, 19 nt, Mycobacterium avium subsp. paratuberculosis
ccgcgccggcacucgucgu

SEQ ID NO: 863615 - RNA, 17 nt, Mycobacterium avium subsp. paratuberculosis
ccgcgccgccggugacc

SEQ ID NO: 863616 - RNA, 16 nt, Mycobacterium avium subsp. paratuberculosis
ccgcgccgccgccagc

SEQ ID NO: 863617 - RNA, 17 nt, Mycobacterium avium subsp. paratuberculosis
ccgcgccgccgccagcc

SEQ ID NO: 863618 - RNA, 22 nt, Mycobacterium avium subsp. paratuberculosis
ccgcgccgccgccagccagccg

SEQ ID NO: 863619 - RNA, 13 nt, Mycobacterium avium subsp. paratuberculosis
ccgcgccgccuuc

SEQ ID NO: 863620 - RNA, 22 nt, Mycobacterium avium subsp. paratuberculosis
ccgcgccgccuucuugcgcggc

SEQ ID NO: 863621 - RNA, 21 nt, Mycobacterium avium subsp. paratuberculosis
ccgcgccgcgaugcaacaccg

SEQ ID NO: 863622 - RNA, 14 nt, Mycobacterium avium subsp. paratuberculosis
ccgcgccgcgccgc

SEQ ID NO: 863623 - RNA, 14 nt, Mycobacterium avium subsp. paratuberculosis
ccgcgccgcccgga

SEQ ID NO: 863624 - RNA, 16 nt, Mycobacterium avium subsp. paratuberculosis
ccgcgccgcccggagg

SEQ ID NO: 863625 - RNA, 16 nt, Mycobacterium avium subsp. paratuberculosis
ccgcgccgcccggcga

SEQ ID NO: 863626 - RNA, 18 nt, Mycobacterium avium subsp. paratuberculosis
ccgcgccgcccggcgauc

SEQ ID NO: 863627 - RNA, 22 nt, Mycobacterium avium subsp. paratuberculosis
ccgcgccgcccggcgaucucgg

SEQ ID NO: 863628 - RNA, 12 nt, Mycobacterium avium subsp. paratuberculosis
ccgcgccgccga

SEQ ID NO: 863629 - RNA, 17 nt, Mycobacterium avium subsp. paratuberculosis
ccgcgagcaccgcgauc

SEQ ID NO: 863630 - RNA, 13 nt, Mycobacterium avium subsp. paratuberculosis
ccgcgagcacgac

SEQ ID NO: 863631 - RNA, 17 nt, Mycobacterium avium subsp. paratuberculosis
ccgcgagcacgacgucg

SEQ ID NO: 863632 - RNA, 18 nt, Mycobacterium avium subsp. paratuberculosis
ccgcgagcacgacgucga

SEQ ID NO: 863633 - RNA, 19 nt, Mycobacterium avium subsp. paratuberculosis
ccgcgagcacgacgucgac

SEQ ID NO: 863634 - RNA, 21 nt, Mycobacterium avium subsp. paratuberculosis
ccgcgagcacgacgucgacgu

SEQ ID NO: 863635 - RNA, 14 nt, Mycobacterium avium subsp. paratuberculosis
ccgcgacgggcucg

SEQ ID NO: 863636 - RNA, 18 nt, Mycobacterium avium subsp. paratuberculosis
ccgcgacgggcucggcgu

SEQ ID NO: 863637 - RNA, 22 nt, Mycobacterium avium subsp. paratuberculosis
ccgcgacgggcugucccggccg

SEQ ID NO: 863638 - RNA, 15 nt, Mycobacterium avium subsp. paratuberculosis
ccgcgacugcacccg

SEQ ID NO: 863639 - RNA, 17 nt, Mycobacterium avium subsp. paratuberculosis
ccgcgacugucggcgcc

SEQ ID NO: 863640 - RNA, 20 nt, Mycobacterium avium subsp. paratuberculosis
ccgcgacugucggcgccccg

SEQ ID NO: 863641 - RNA, 18 nt, Mycobacterium avium subsp. paratuberculosis
ccgcgacugucggcucgc

SEQ ID NO: 863642 - RNA, 19 nt, Mycobacterium avium subsp. paratuberculosis
ccgcgacugucggcucgcc

SEQ ID NO: 863643 - RNA, 17 nt, Mycobacterium avium subsp. paratuberculosis
ccgcgagcccggcgacg

SEQ ID NO: 863644 - RNA, 18 nt, Mycobacterium avium subsp. paratuberculosis
ccgcgagcccggcgacgu

SEQ ID NO: 863645 - RNA, 15 nt, Mycobacterium avium subsp. paratuberculosis
ccgcgagccgcccag

SEQ ID NO: 863646 - RNA, 14 nt, Mycobacterium avium subsp. paratuberculosis
ccgcgagcgcagca

SEQ ID NO: 863647 - RNA, 22 nt, Mycobacterium avium subsp. paratuberculosis
ccgcgaucgucucgucgagaaa

SEQ ID NO: 863648 - RNA, 21 nt, Mycobacterium avium subsp. paratuberculosis
ccgcgaucucggcggacucgg

SEQ ID NO: 863649 - RNA, 20 nt, Mycobacterium avium subsp. paratuberculosis
ccgcgacgaugucgacccgc

SEQ ID NO: 863650 - RNA, 15 nt, Mycobacterium avium subsp. paratuberculosis
ccgcgacggaccagu

SEQ ID NO: 863651 - RNA, 16 nt, Mycobacterium avium subsp. paratuberculosis
ccgcgacgcugagcgc

SEQ ID NO: 863652 - RNA, 21 nt, Mycobacterium avium subsp. paratuberculosis
ccgcgacgcugccggggcgca

SEQ ID NO: 863653 - RNA, 16 nt, Mycobacterium avium subsp. paratuberculosis
ccgcgacgcugccggu

SEQ ID NO: 863654 - RNA, 14 nt, Mycobacterium avium subsp. paratuberculosis
ccgcgacggccgcc

SEQ ID NO: 863655 - RNA, 17 nt, Mycobacterium avium subsp. paratuberculosis
ccgcgacggccgccgau

SEQ ID NO: 863656 - RNA, 13 nt, Mycobacterium avium subsp. paratuberculosis
ccgcgacggugag

SEQ ID NO: 863657 - RNA, 16 nt, Mycobacterium avium subsp. paratuberculosis
ccgcgacguccaucgg

SEQ ID NO: 863658 - RNA, 22 nt, Mycobacterium avium subsp. paratuberculosis
ccgcgacgucgguguagucggc

SEQ ID NO: 863659 - RNA, 14 nt, Mycobacterium avium subsp. paratuberculosis
ccgcgacguggcgc

SEQ ID NO: 863660 - RNA, 22 nt, Mycobacterium avium subsp. paratuberculosis
ccgcgacggcgagccgggccgg

SEQ ID NO: 863661 - RNA, 14 nt, Mycobacterium avium subsp. paratuberculosis
ccgcgacggcgggu

SEQ ID NO: 863662 - RNA, 17 nt, Mycobacterium avium subsp. paratuberculosis
ccgcgacggcgggucga

SEQ ID NO: 863663 - RNA, 14 nt, Mycobacterium avium subsp. paratuberculosis
ccgcgacgccgccg

SEQ ID NO: 863664 - RNA, 19 nt, Mycobacterium avium subsp. paratuberculosis
ccgcgacgccgccgccgag

SEQ ID NO: 863665 - RNA, 13 nt, Mycobacterium avium subsp. paratuberculosis
ccgcgacgcgauc

SEQ ID NO: 863666 - RNA, 14 nt, Mycobacterium avium subsp. paratuberculosis
ccgcgacgcgcggu

SEQ ID NO: 863667 - RNA, 14 nt, Mycobacterium avium subsp. paratuberculosis
ccgcgacgccagca

SEQ ID NO: 863668 - RNA, 15 nt, Mycobacterium avium subsp. paratuberculosis
ccgcgacgccagcac

SEQ ID NO: 863669 - RNA, 17 nt, Mycobacterium avium subsp. paratuberculosis
ccgcgacgccagcaccu

SEQ ID NO: 863670 - RNA, 16 nt, Mycobacterium avium subsp. paratuberculosis
ccgcgacgcccaggug

SEQ ID NO: 863671 - RNA, 24 nt, Mycobacterium avium subsp. paratuberculosis
ccgcgacgcccaggugcacccgau

SEQ ID NO: 863672 - RNA, 16 nt, Mycobacterium avium subsp. paratuberculosis
ccgcgacgaugccggc

SEQ ID NO: 863673 - RNA, 22 nt, Mycobacterium avium subsp. paratuberculosis
ccgcgacgaugccggcgucguc

SEQ ID NO: 863674 - RNA, 23 nt, Mycobacterium avium subsp. paratuberculosis
ccgcgacgaugccggcgucgucg

SEQ ID NO: 863675 - RNA, 19 nt, Mycobacterium avium subsp. paratuberculosis
ccgcgacgaacugccguug

SEQ ID NO: 863676 - RNA, 20 nt, Mycobacterium avium subsp. paratuberculosis
ccgcgacgaacugccguuga

SEQ ID NO: 863677 - RNA, 17 nt, Mycobacterium avium subsp. paratuberculosis
ccgcgacgacaccaccg

SEQ ID NO: 863678 - RNA, 20 nt, Mycobacterium avium subsp. paratuberculosis
ccgcgacgacaccaccgugc

SEQ ID NO: 863679 - RNA, 14 nt, Mycobacterium avium subsp. paratuberculosis
ccgcgacgacaccg

SEQ ID NO: 863680 - RNA, 18 nt, Mycobacterium avium subsp. paratuberculosis
ccgcgacgacaccgugug

SEQ ID NO: 863681 - RNA, 20 nt, Mycobacterium avium subsp. paratuberculosis
ccgcgacgaccucgcccgcc

SEQ ID NO: 863682 - RNA, 23 nt, Mycobacterium avium subsp. paratuberculosis
ccgcgacgaccucgcccgccgcg

SEQ ID NO: 863683 - RNA, 14 nt, Mycobacterium avium subsp. paratuberculosis
ccgcgacgaucacg

SEQ ID NO: 863684 - RNA, 20 nt, Mycobacterium avium subsp. paratuberculosis
ccgcgacgaucacgguguug

SEQ ID NO: 863685 - RNA, 21 nt, Mycobacterium avium subsp. paratuberculosis
ccgcgacgaucacgguguugu

SEQ ID NO: 863686 - RNA, 15 nt, Mycobacterium avium subsp. paratuberculosis
ccgcgacgaucgcga

SEQ ID NO: 863687 - RNA, 19 nt, Mycobacterium avium subsp. paratuberculosis
ccgcgacgaucgcgacggc

SEQ ID NO: 863688 - RNA, 21 nt, Mycobacterium avium subsp. paratuberculosis
ccgcgacgaucgcgacggccg

SEQ ID NO: 863689 - RNA, 23 nt, Mycobacterium avium subsp. paratuberculosis
ccgcgacgaucgcgacggccggg

SEQ ID NO: 863690 - RNA, 17 nt, Mycobacterium avium subsp. paratuberculosis
ccgcgacccggccgagc

SEQ ID NO: 863691 - RNA, 22 nt, Mycobacterium avium subsp. paratuberculosis
ccgcgacccggccgagcgcgcc

SEQ ID NO: 863692 - RNA, 23 nt, Mycobacterium avium subsp. paratuberculosis
ccgcgacccggccgagcgcgccg

SEQ ID NO: 863693 - RNA, 16 nt, Mycobacterium avium subsp. paratuberculosis
ccgcgacccgggccgc

SEQ ID NO: 863694 - RNA, 17 nt, Mycobacterium avium subsp. paratuberculosis
ccgcgacccgggccgcc

SEQ ID NO: 863695 - RNA, 22 nt, Mycobacterium avium subsp. paratuberculosis
ccgcgacccgggccgccacggc

SEQ ID NO: 863696 - RNA, 12 nt, Mycobacterium avium subsp. paratuberculosis
ccgcgaccgcag

SEQ ID NO: 863697 - RNA, 12 nt, Mycobacterium avium subsp. paratuberculosis
ccgcgaccgccu

SEQ ID NO: 863698 - RNA, 22 nt, Mycobacterium avium subsp. paratuberculosis
ccgcgaccgguccgugccacgg

SEQ ID NO: 863699 - RNA, 20 nt, Mycobacterium avium subsp. paratuberculosis
ccgcgaccgucagcagggcc

SEQ ID NO: 863700 - RNA, 14 nt, Mycobacterium avium subsp. paratuberculosis
ccgcgaccgucauc

SEQ ID NO: 863701 - RNA, 15 nt, Mycobacterium avium subsp. paratuberculosis
ccgcgacccaggccg

SEQ ID NO: 863702 - RNA, 17 nt, Mycobacterium avium subsp. paratuberculosis
ccgcgacccaggccgcc

SEQ ID NO: 863703 - RNA, 18 nt, Mycobacterium avium subsp. paratuberculosis
ccgcgacccaggccgccg

SEQ ID NO: 863704 - RNA, 12 nt, Mycobacterium avium subsp. paratuberculosis
ccgcgacccaga

SEQ ID NO: 863705 - RNA, 14 nt, Mycobacterium avium subsp. paratuberculosis
ccgcgaccagcucg

SEQ ID NO: 863706 - RNA, 15 nt, Mycobacterium avium subsp. paratuberculosis
ccgcgaccagcucgg

SEQ ID NO: 863707 - RNA, 17 nt, Mycobacterium avium subsp. paratuberculosis
ccgcgaccagcucgggc

SEQ ID NO: 863708 - RNA, 13 nt, Mycobacterium avium subsp. paratuberculosis
ccgcgacaucggc

SEQ ID NO: 863709 - RNA, 17 nt, Mycobacterium avium subsp. paratuberculosis
ccgcgacaucggcgccg

SEQ ID NO: 863710 - RNA, 18 nt, Mycobacterium avium subsp. paratuberculosis
ccgcgacaucggcgccga

SEQ ID NO: 863711 - RNA, 21 nt, Mycobacterium avium subsp. paratuberculosis
ccgcgacaucggcgccgacgg

SEQ ID NO: 863712 - RNA, 18 nt, Mycobacterium avium subsp. paratuberculosis
ccgcgacaucggugaccg

SEQ ID NO: 863713 - RNA, 19 nt, Mycobacterium avium subsp. paratuberculosis
ccgcgacaucggugaccgu

SEQ ID NO: 863714 - RNA, 20 nt, Mycobacterium avium subsp. paratuberculosis
ccgcgaccacagcgccucgu

SEQ ID NO: 863715 - RNA, 14 nt, Mycobacterium avium subsp. paratuberculosis
ccgcgaccacgccg

SEQ ID NO: 863716 - RNA, 17 nt, Mycobacterium avium subsp. paratuberculosis
ccgcgaccacgccgcgg

SEQ ID NO: 863717 - RNA, 18 nt, Mycobacterium avium subsp. paratuberculosis
ccgcgaccacgccgcggu

SEQ ID NO: 863718 - RNA, 20 nt, Mycobacterium avium subsp. paratuberculosis
ccgcgaccacgccgcggucg

SEQ ID NO: 863719 - RNA, 21 nt, Mycobacterium avium subsp. paratuberculosis
ccgcgaccacgccgcggucgc

SEQ ID NO: 863720 - RNA, 17 nt, Mycobacterium avium subsp. paratuberculosis
ccgcgacacccgcgacg

SEQ ID NO: 863721 - RNA, 14 nt, Mycobacterium avium subsp. paratuberculosis
ccgcgacacgccgc

SEQ ID NO: 863722 - RNA, 19 nt, Mycobacterium avium subsp. paratuberculosis
ccgcgacacgccgcgcauc

SEQ ID NO: 863723 - RNA, 16 nt, Mycobacterium avium subsp. paratuberculosis
ccgcgacacgucgaca

SEQ ID NO: 863724 - RNA, 22 nt, Mycobacterium avium subsp. paratuberculosis
ccgcgacacgucgacacgccgg

SEQ ID NO: 863725 - RNA, 14 nt, Mycobacterium avium subsp. paratuberculosis
ccgcgacagccgcc

SEQ ID NO: 863726 - RNA, 22 nt, Mycobacterium avium subsp. paratuberculosis
ccgcgaauuugguugcggugua

SEQ ID NO: 863727 - RNA, 17 nt, Mycobacterium avium subsp. paratuberculosis
ccgcgacaaggucgacc

SEQ ID NO: 863728 - RNA, 18 nt, Mycobacterium avium subsp. paratuberculosis
ccgccugcgcgaucgccg

SEQ ID NO: 863729 - RNA, 13 nt, Mycobacterium avium subsp. paratuberculosis
ccgccugcgcgcc

SEQ ID NO: 863730 - RNA, 18 nt, Mycobacterium avium subsp. paratuberculosis
ccgccugcgcgccgucgg

SEQ ID NO: 863731 - RNA, 13 nt, Mycobacterium avium subsp. paratuberculosis
ccgccugcgcggg

SEQ ID NO: 863732 - RNA, 20 nt, Mycobacterium avium subsp. paratuberculosis
ccgcgaaucgauaacgcgcg

SEQ ID NO: 863733 - RNA, 15 nt, Mycobacterium avium subsp. paratuberculosis
ccgccugcgcgggcg

SEQ ID NO: 863734 - RNA, 17 nt, Mycobacterium avium subsp. paratuberculosis
ccgccugcgcgggcgcg

SEQ ID NO: 863735 - RNA, 18 nt, Mycobacterium avium subsp. paratuberculosis
ccgccugcgcgggcgcgg

SEQ ID NO: 863736 - RNA, 19 nt, Mycobacterium avium subsp. paratuberculosis
ccgccugcgcgggcgcgga

SEQ ID NO: 863737 - RNA, 14 nt, Mycobacterium avium subsp. paratuberculosis
ccgccugcccgggc

SEQ ID NO: 863738 - RNA, 16 nt, Mycobacterium avium subsp. paratuberculosis
ccgccugcccgggcgc

SEQ ID NO: 863739 - RNA, 17 nt, Mycobacterium avium subsp. paratuberculosis
ccgccugcccgggcgcc

SEQ ID NO: 863740 - RNA, 12 nt, Mycobacterium avium subsp. paratuberculosis
ccgccucgucga

SEQ ID NO: 863741 - RNA, 14 nt, Mycobacterium avium subsp. paratuberculosis
ccgccucgucggga

SEQ ID NO: 863742 - RNA, 15 nt, Mycobacterium avium subsp. paratuberculosis
ccgccucggcggccg

SEQ ID NO: 863743 - RNA, 16 nt, Mycobacterium avium subsp. paratuberculosis
ccgccucggcggccgc

SEQ ID NO: 863744 - RNA, 12 nt, Mycobacterium avium subsp. paratuberculosis
ccgccucggcgg

SEQ ID NO: 863745 - RNA, 20 nt, Mycobacterium avium subsp. paratuberculosis
ccgccucggcggagucguag

SEQ ID NO: 863746 - RNA, 19 nt, Mycobacterium avium subsp. paratuberculosis
ccgccucggauuccgcgga

SEQ ID NO: 863747 - RNA, 14 nt, Mycobacterium avium subsp. paratuberculosis
ccgccucggcgagg

SEQ ID NO: 863748 - RNA, 21 nt, Mycobacterium avium subsp. paratuberculosis
ccgccucggcgaggucgucga

SEQ ID NO: 863749 - RNA, 16 nt, Mycobacterium avium subsp. paratuberculosis
ccgccucgcagcgaca

SEQ ID NO: 863750 - RNA, 22 nt, Mycobacterium avium subsp. paratuberculosis
ccgccucgccagccccaccggc

SEQ ID NO: 863751 - RNA, 15 nt, Mycobacterium avium subsp. paratuberculosis
ccgccucgccgguca

SEQ ID NO: 863752 - RNA, 20 nt, Mycobacterium avium subsp. paratuberculosis
ccgccucgaagucgccggcc

SEQ ID NO: 863753 - RNA, 24 nt, Mycobacterium avium subsp. paratuberculosis
ccgccuccucgaugucgguggugg

SEQ ID NO: 863754 - RNA, 17 nt, Mycobacterium avium subsp. paratuberculosis
ccgcggacggccagccc

SEQ ID NO: 863755 - RNA, 18 nt, Mycobacterium avium subsp. paratuberculosis
ccgcggacggccagcccg

SEQ ID NO: 863756 - RNA, 13 nt, Mycobacterium avium subsp. paratuberculosis
ccgcggacggcga

SEQ ID NO: 863757 - RNA, 22 nt, Mycobacterium avium subsp. paratuberculosis
ccgcggacggguugggcgccag

SEQ ID NO: 863758 - RNA, 19 nt, Mycobacterium avium subsp. paratuberculosis
ccgcggacuggccaccgcg

SEQ ID NO: 863759 - RNA, 22 nt, Mycobacterium avium subsp. paratuberculosis
ccgcggacuggccaccgcgauc

SEQ ID NO: 863760 - RNA, 19 nt, Mycobacterium avium subsp. paratuberculosis
ccgcggaguaggcgccgcc

SEQ ID NO: 863761 - RNA, 23 nt, Mycobacterium avium subsp. paratuberculosis
ccgcggaguaggcgccgccgcgc

SEQ ID NO: 863762 - RNA, 12 nt, Mycobacterium avium subsp. paratuberculosis
ccgcggagcggc

SEQ ID NO: 863763 - RNA, 16 nt, Mycobacterium avium subsp. paratuberculosis
ccgcggagcggcgguc

SEQ ID NO: 863764 - RNA, 19 nt, Mycobacterium avium subsp. paratuberculosis
ccgcggagcggcggucacg

SEQ ID NO: 863765 - RNA, 21 nt, Mycobacterium avium subsp. paratuberculosis
ccgcggaggaauucgccgacg

SEQ ID NO: 863766 - RNA, 22 nt, Mycobacterium avium subsp. paratuberculosis
ccgcggaggaauucgccgacgc

SEQ ID NO: 863767 - RNA, 20 nt, Mycobacterium avium subsp. paratuberculosis
ccgcggaucagcaggaccgg

SEQ ID NO: 863768 - RNA, 13 nt, Mycobacterium avium subsp. paratuberculosis
ccgcggaucuucu

SEQ ID NO: 863769 - RNA, 15 nt, Mycobacterium avium subsp. paratuberculosis
ccgcggaugacgggu

SEQ ID NO: 863770 - RNA, 19 nt, Mycobacterium avium subsp. paratuberculosis
ccgcggaugacgggugcuc

SEQ ID NO: 863771 - RNA, 18 nt, Mycobacterium avium subsp. paratuberculosis
ccgcggcacgcugcgcca

SEQ ID NO: 863772 - RNA, 19 nt, Mycobacterium avium subsp. paratuberculosis
ccgcggcacgcugcgccag

SEQ ID NO: 863773 - RNA, 20 nt, Mycobacterium avium subsp. paratuberculosis
ccgcggcacgcugcgccagc

SEQ ID NO: 863774 - RNA, 15 nt, Mycobacterium avium subsp. paratuberculosis
ccgcggcagccagcc

SEQ ID NO: 863775 - RNA, 13 nt, Mycobacterium avium subsp. paratuberculosis
ccgcggcagccgg

SEQ ID NO: 863776 - RNA, 16 nt, Mycobacterium avium subsp. paratuberculosis
ccgcggcagccgggcg

SEQ ID NO: 863777 - RNA, 18 nt, Mycobacterium avium subsp. paratuberculosis
ccgcggcaaggcguucca

SEQ ID NO: 863778 - RNA, 19 nt, Mycobacterium avium subsp. paratuberculosis
ccgcggauggccucggcga

SEQ ID NO: 863779 - RNA, 15 nt, Mycobacterium avium subsp. paratuberculosis
ccgcggauggugacg

SEQ ID NO: 863780 - RNA, 19 nt, Mycobacterium avium subsp. paratuberculosis
ccgcggauggugacggccg

SEQ ID NO: 863781 - RNA, 21 nt, Mycobacterium avium subsp. paratuberculosis
ccgcggauggugacggccgug

SEQ ID NO: 863782 - RNA, 19 nt, Mycobacterium avium subsp. paratuberculosis
ccgcggauguggaggcgag

SEQ ID NO: 863783 - RNA, 15 nt, Mycobacterium avium subsp. paratuberculosis
ccgcggccagcgcgc

SEQ ID NO: 863784 - RNA, 13 nt, Mycobacterium avium subsp. paratuberculosis
ccgcggccagcuc

SEQ ID NO: 863785 - RNA, 22 nt, Mycobacterium avium subsp. paratuberculosis
ccgcggccagcucggucgcggu

SEQ ID NO: 863786 - RNA, 20 nt, Mycobacterium avium subsp. paratuberculosis
ccgcggccagcugcccgccg

SEQ ID NO: 863787 - RNA, 20 nt, Mycobacterium avium subsp. paratuberculosis
ccgcggccagcugcgacagc

SEQ ID NO: 863788 - RNA, 15 nt, Mycobacterium avium subsp. paratuberculosis
ccgcggccaggucga

SEQ ID NO: 863789 - RNA, 18 nt, Mycobacterium avium subsp. paratuberculosis
ccgcggccaggucgaggu

SEQ ID NO: 863790 - RNA, 15 nt, Mycobacterium avium subsp. paratuberculosis
ccgcggccaccggga

SEQ ID NO: 863791 - RNA, 22 nt, Mycobacterium avium subsp. paratuberculosis
ccgcggccaccgggaccgucgg

SEQ ID NO: 863792 - RNA, 12 nt, Mycobacterium avium subsp. paratuberculosis
ccgcggccaccu

SEQ ID NO: 863793 - RNA, 18 nt, Mycobacterium avium subsp. paratuberculosis
ccgcggccaccugggcgg

SEQ ID NO: 863794 - RNA, 21 nt, Mycobacterium avium subsp. paratuberculosis
ccgcggccacgcucgggccgg

SEQ ID NO: 863795 - RNA, 16 nt, Mycobacterium avium subsp. paratuberculosis
ccgcggccaccccgga

SEQ ID NO: 863796 - RNA, 19 nt, Mycobacterium avium subsp. paratuberculosis
ccgcggccaacccgggcgc

SEQ ID NO: 863797 - RNA, 21 nt, Mycobacterium avium subsp. paratuberculosis
ccgcggccaacccgggcgcca

SEQ ID NO: 863798 - RNA, 13 nt, Mycobacterium avium subsp. paratuberculosis
ccgcggccaccac

SEQ ID NO: 863799 - RNA, 18 nt, Mycobacterium avium subsp. paratuberculosis
ccgcggccaccaccgcca

SEQ ID NO: 863800 - RNA, 20 nt, Mycobacterium avium subsp. paratuberculosis
ccgcggccaccaccgccacg

SEQ ID NO: 863801 - RNA, 22 nt, Mycobacterium avium subsp. paratuberculosis
ccgcggccaccaccgccacggc

SEQ ID NO: 863802 - RNA, 18 nt, Mycobacterium avium subsp. paratuberculosis
ccgcggacauucugcacg

SEQ ID NO: 863803 - RNA, 18 nt, Mycobacterium avium subsp. paratuberculosis
ccgcggaccaccgcgugc

SEQ ID NO: 863804 - RNA, 15 nt, Mycobacterium avium subsp. paratuberculosis
ccgcggaacgcucac

SEQ ID NO: 863805 - RNA, 21 nt, Mycobacterium avium subsp. paratuberculosis
ccgcggaagccccaggcccgg

SEQ ID NO: 863806 - RNA, 16 nt, Mycobacterium avium subsp. paratuberculosis
ccgcggaaggccagcu

SEQ ID NO: 863807 - RNA, 17 nt, Mycobacterium avium subsp. paratuberculosis
ccgcggaaggccagcuc

SEQ ID NO: 863808 - RNA, 20 nt, Mycobacterium avium subsp. paratuberculosis
ccgcggaaggccagcuccuc

SEQ ID NO: 863809 - RNA, 21 nt, Mycobacterium avium subsp. paratuberculosis
ccgcggaacccguugcgcccu

SEQ ID NO: 863810 - RNA, 23 nt, Mycobacterium avium subsp. paratuberculosis
ccgcgcuuuggaccagggcggug

SEQ ID NO: 863811 - RNA, 17 nt, Mycobacterium avium subsp. paratuberculosis
ccgcgcuugacggccgg

SEQ ID NO: 863812 - RNA, 18 nt, Mycobacterium avium subsp. paratuberculosis
ccgcgcuugacggccggg

SEQ ID NO: 863813 - RNA, 22 nt, Mycobacterium avium subsp. paratuberculosis
ccgcgcuugccgcgacccgggc

SEQ ID NO: 863814 - RNA, 16 nt, Mycobacterium avium subsp. paratuberculosis
ccgcgcuugcgaccgc

SEQ ID NO: 863815 - RNA, 18 nt, Mycobacterium avium subsp. paratuberculosis
ccgcgcuugcgaccgccg

SEQ ID NO: 863816 - RNA, 21 nt, Mycobacterium avium subsp. paratuberculosis
ccgcgcuugcgaccgccgcua

SEQ ID NO: 863817 - RNA, 14 nt, Mycobacterium avium subsp. paratuberculosis
ccgcgcgcagcaca

SEQ ID NO: 863818 - RNA, 22 nt, Mycobacterium avium subsp. paratuberculosis
ccgcgcggcgcagggcggccgg

SEQ ID NO: 863819 - RNA, 16 nt, Mycobacterium avium subsp. paratuberculosis
ccgcgcgggcgaccug

SEQ ID NO: 863820 - RNA, 23 nt, Mycobacterium avium subsp. paratuberculosis
ccgcgcgggcgaccugcgggccc

SEQ ID NO: 863821 - RNA, 20 nt, Mycobacterium avium subsp. paratuberculosis
ccgcgcuugcgaucgccgcg

SEQ ID NO: 863822 - RNA, 21 nt, Mycobacterium avium subsp. paratuberculosis
ccgcgcuugcgaucgccgcgc

SEQ ID NO: 863823 - RNA, 14 nt, Mycobacterium avium subsp. paratuberculosis
ccgcgcggcggcca

SEQ ID NO: 863824 - RNA, 20 nt, Mycobacterium avium subsp. paratuberculosis
ccgcgcggcgguccagcgag

SEQ ID NO: 863825 - RNA, 13 nt, Mycobacterium avium subsp. paratuberculosis
ccgcgcggcggug

SEQ ID NO: 863826 - RNA, 16 nt, Mycobacterium avium subsp. paratuberculosis
ccgcgcggcggugucg

SEQ ID NO: 863827 - RNA, 13 nt, Mycobacterium avium subsp. paratuberculosis
ccgcgcggcgucg

SEQ ID NO: 863828 - RNA, 21 nt, Mycobacterium avium subsp. paratuberculosis
ccgcgcggcuaauucagcugc

SEQ ID NO: 863829 - RNA, 21 nt, Mycobacterium avium subsp. paratuberculosis
ccgcgcggcuaguuggccggc

SEQ ID NO: 863830 - RNA, 14 nt, Mycobacterium avium subsp. paratuberculosis
ccgcgcggcucaca

SEQ ID NO: 863831 - RNA, 16 nt, Mycobacterium avium subsp. paratuberculosis
ccgcgcggcucacagc

SEQ ID NO: 863832 - RNA, 18 nt, Mycobacterium avium subsp. paratuberculosis
ccgcgcggcucacagcgc

SEQ ID NO: 863833 - RNA, 21 nt, Mycobacterium avium subsp. paratuberculosis
ccgcgcggcucacagcgcggc

SEQ ID NO: 863834 - RNA, 23 nt, Mycobacterium avium subsp. paratuberculosis
ccgcgcggcucacagcgcggcgg

SEQ ID NO: 863835 - RNA, 24 nt, Mycobacterium avium subsp. paratuberculosis
ccgcgcggcucacagcgcggcggu

SEQ ID NO: 863836 - RNA, 13 nt, Mycobacterium avium subsp. paratuberculosis
ccgcgcggcgacg

SEQ ID NO: 863837 - RNA, 14 nt, Mycobacterium avium subsp. paratuberculosis
ccgcgcggccgggc

SEQ ID NO: 863838 - RNA, 13 nt, Mycobacterium avium subsp. paratuberculosis
ccgcgcggcgaug

SEQ ID NO: 863839 - RNA, 14 nt, Mycobacterium avium subsp. paratuberculosis
ccgcgcggcgaugg

SEQ ID NO: 863840 - RNA, 19 nt, Mycobacterium avium subsp. paratuberculosis
ccgcgcggcgauggccgac

SEQ ID NO: 863841 - RNA, 20 nt, Mycobacterium avium subsp. paratuberculosis
ccgcgcggcgauggccgaca

SEQ ID NO: 863842 - RNA, 13 nt, Mycobacterium avium subsp. paratuberculosis
ccgcgcggcgcca

SEQ ID NO: 863843 - RNA, 17 nt, Mycobacterium avium subsp. paratuberculosis
ccgcgcggcgccagcgg

SEQ ID NO: 863844 - RNA, 18 nt, Mycobacterium avium subsp. paratuberculosis
ccgcgcggcgccagcggc

SEQ ID NO: 863845 - RNA, 19 nt, Mycobacterium avium subsp. paratuberculosis
ccgcgcggccagcggcgcc

SEQ ID NO: 863846 - RNA, 20 nt, Mycobacterium avium subsp. paratuberculosis
ccgcgcggccagcggcgccg

SEQ ID NO: 863847 - RNA, 15 nt, Mycobacterium avium subsp. paratuberculosis
ccgcgcggcccgcga

SEQ ID NO: 863848 - RNA, 18 nt, Mycobacterium avium subsp. paratuberculosis
ccgcgcggcccgcgacgu

SEQ ID NO: 863849 - RNA, 13 nt, Mycobacterium avium subsp. paratuberculosis
ccgcgcggccgcc

SEQ ID NO: 863850 - RNA, 14 nt, Mycobacterium avium subsp. paratuberculosis
ccgcgcggccgcca

SEQ ID NO: 863851 - RNA, 16 nt, Mycobacterium avium subsp. paratuberculosis
ccgcgcggccgccucc

SEQ ID NO: 863852 - RNA, 13 nt, Mycobacterium avium subsp. paratuberculosis
ccgcgcggccggc

SEQ ID NO: 863853 - RNA, 12 nt, Mycobacterium avium subsp. paratuberculosis
ccgcgcggccac

SEQ ID NO: 863854 - RNA, 16 nt, Mycobacterium avium subsp. paratuberculosis
ccgcgcggccaccagc

SEQ ID NO: 863855 - RNA, 16 nt, Mycobacterium avium subsp. paratuberculosis
ccgcgggacacggcgg

SEQ ID NO: 863856 - RNA, 23 nt, Mycobacterium avium subsp. paratuberculosis
ccgcgggacacggcggcgcgggc

SEQ ID NO: 863857 - RNA, 16 nt, Mycobacterium avium subsp. paratuberculosis
ccgcgggaggcccagu

SEQ ID NO: 863858 - RNA, 16 nt, Mycobacterium avium subsp. paratuberculosis
ccgcgggaguccacgc

SEQ ID NO: 863859 - RNA, 17 nt, Mycobacterium avium subsp. paratuberculosis
ccgcgggaguccacgcc

SEQ ID NO: 863860 - RNA, 19 nt, Mycobacterium avium subsp. paratuberculosis
ccgcgggaguccacgccgu

SEQ ID NO: 863861 - RNA, 15 nt, Mycobacterium avium subsp. paratuberculosis
ccgcgggaucagcgu

SEQ ID NO: 863862 - RNA, 17 nt, Mycobacterium avium subsp. paratuberculosis
ccgcgggaucagcgugu

SEQ ID NO: 863863 - RNA, 22 nt, Mycobacterium avium subsp. paratuberculosis
ccgcgggaugcuuggucgcggc

SEQ ID NO: 863864 - RNA, 17 nt, Mycobacterium avium subsp. paratuberculosis
ccgcgggaauggccgcg

SEQ ID NO: 863865 - RNA, 18 nt, Mycobacterium avium subsp. paratuberculosis
ccgcgggaauggccgcgc

SEQ ID NO: 863866 - RNA, 21 nt, Mycobacterium avium subsp. paratuberculosis
ccgcgggaauggccgcgccgu

SEQ ID NO: 863867 - RNA, 13 nt, Mycobacterium avium subsp. paratuberculosis
ccgcgggcacggc

SEQ ID NO: 863868 - RNA, 18 nt, Mycobacterium avium subsp. paratuberculosis
ccgcgggcacggcgaugu

SEQ ID NO: 863869 - RNA, 15 nt, Mycobacterium avium subsp. paratuberculosis
ccgcgggccagcagc

SEQ ID NO: 863870 - RNA, 17 nt, Mycobacterium avium subsp. paratuberculosis
ccgcgggccagcagccg

SEQ ID NO: 863871 - RNA, 20 nt, Mycobacterium avium subsp. paratuberculosis
ccgcgggccagcagccgggu

SEQ ID NO: 863872 - RNA, 13 nt, Mycobacterium avium subsp. paratuberculosis
ccgcgggccaggc

SEQ ID NO: 863873 - RNA, 18 nt, Mycobacterium avium subsp. paratuberculosis
ccgcgggccaggcccacc

SEQ ID NO: 863874 - RNA, 16 nt, Mycobacterium avium subsp. paratuberculosis
ccgcgggcccaccgcc

SEQ ID NO: 863875 - RNA, 13 nt, Mycobacterium avium subsp. paratuberculosis
ccgcgggcagcga

SEQ ID NO: 863876 - RNA, 15 nt, Mycobacterium avium subsp. paratuberculosis
ccgcgggcagcgagc

SEQ ID NO: 863877 - RNA, 16 nt, Mycobacterium avium subsp. paratuberculosis
ccgcgggcaucgccgu

SEQ ID NO: 863878 - RNA, 17 nt, Mycobacterium avium subsp. paratuberculosis
ccgcgggcaucgccguc

SEQ ID NO: 863879 - RNA, 13 nt, Mycobacterium avium subsp. paratuberculosis
ccgcgggccagca

SEQ ID NO: 863880 - RNA, 15 nt, Mycobacterium avium subsp. paratuberculosis
ccgcgggucgucgac

SEQ ID NO: 863881 - RNA, 17 nt, Mycobacterium avium subsp. paratuberculosis
ccgcgggucgucgacgu

SEQ ID NO: 863882 - RNA, 21 nt, Mycobacterium avium subsp. paratuberculosis
ccgcgggucgucgggcggcag

SEQ ID NO: 863883 - RNA, 22 nt, Mycobacterium avium subsp. paratuberculosis
ccgcgggugaggggcgcgcgcc

SEQ ID NO: 863884 - RNA, 23 nt, Mycobacterium avium subsp. paratuberculosis
ccgcgggugaggggcgcgcgccg

SEQ ID NO: 863885 - RNA, 22 nt, Mycobacterium avium subsp. paratuberculosis
ccgcgggugaucugcgccguga

SEQ ID NO: 863886 - RNA, 19 nt, Mycobacterium avium subsp. paratuberculosis
ccgcgggugcagccggauc

SEQ ID NO: 863887 - RNA, 14 nt, Mycobacterium avium subsp. paratuberculosis
ccgcggcgucggga

SEQ ID NO: 863888 - RNA, 21 nt, Mycobacterium avium subsp. paratuberculosis
ccgcggcgucgggauggucga

SEQ ID NO: 863889 - RNA, 23 nt, Mycobacterium avium subsp. paratuberculosis
ccgcggcgucgggauggucgauc

SEQ ID NO: 863890 - RNA, 13 nt, Mycobacterium avium subsp. paratuberculosis
ccgcggcguggac

SEQ ID NO: 863891 - RNA, 21 nt, Mycobacterium avium subsp. paratuberculosis
ccgcggcgucaucccccgcag

SEQ ID NO: 863892 - RNA, 22 nt, Mycobacterium avium subsp. paratuberculosis
ccgcggcgucaucccccgcagc

SEQ ID NO: 863893 - RNA, 14 nt, Mycobacterium avium subsp. paratuberculosis
ccgcggcgucccgg

SEQ ID NO: 863894 - RNA, 13 nt, Mycobacterium avium subsp. paratuberculosis
ccgcggcggucgc

SEQ ID NO: 863895 - RNA, 15 nt, Mycobacterium avium subsp. paratuberculosis
ccgcggcggugccgg

SEQ ID NO: 863896 - RNA, 12 nt, Mycobacterium avium subsp. paratuberculosis
ccgcggcggugg

SEQ ID NO: 863897 - RNA, 16 nt, Mycobacterium avium subsp. paratuberculosis
ccgcggcgguggccug

SEQ ID NO: 863898 - RNA, 14 nt, Mycobacterium avium subsp. paratuberculosis
ccgcggcuccagca

SEQ ID NO: 863899 - RNA, 17 nt, Mycobacterium avium subsp. paratuberculosis
ccgcggcuccagcagcg

SEQ ID NO: 863900 - RNA, 16 nt, Mycobacterium avium subsp. paratuberculosis
ccgcggcuccggccgc

SEQ ID NO: 863901 - RNA, 18 nt, Mycobacterium avium subsp. paratuberculosis
ccgcggcuccggccgcgc

SEQ ID NO: 863902 - RNA, 22 nt, Mycobacterium avium subsp. paratuberculosis
ccgcggcuccggccgcgccggc

SEQ ID NO: 863903 - RNA, 12 nt, Mycobacterium avium subsp. paratuberculosis
ccgcggcucgau

SEQ ID NO: 863904 - RNA, 19 nt, Mycobacterium avium subsp. paratuberculosis
ccgcggcucgauggacgcc

SEQ ID NO: 863905 - RNA, 23 nt, Mycobacterium avium subsp. paratuberculosis
ccgcggcucgauggacgccagca

SEQ ID NO: 863906 - RNA, 18 nt, Mycobacterium avium subsp. paratuberculosis
ccgcggcucgcgacgcgg

SEQ ID NO: 863907 - RNA, 19 nt, Mycobacterium avium subsp. paratuberculosis
ccgcggcucgcgacgcggc

SEQ ID NO: 863908 - RNA, 15 nt, Mycobacterium avium subsp. paratuberculosis
ccgcggcucggucgc

SEQ ID NO: 863909 - RNA, 18 nt, Mycobacterium avium subsp. paratuberculosis
ccgcggcgcuugaccucg

SEQ ID NO: 863910 - RNA, 20 nt, Mycobacterium avium subsp. paratuberculosis
ccgcggcggauccagcaccg

SEQ ID NO: 863911 - RNA, 22 nt, Mycobacterium avium subsp. paratuberculosis
ccgcggcggauccagcaccgcc

SEQ ID NO: 863912 - RNA, 17 nt, Mycobacterium avium subsp. paratuberculosis
ccgcggcggcacccagg

SEQ ID NO: 863913 - RNA, 16 nt, Mycobacterium avium subsp. paratuberculosis
ccgcggcggcagcacc

SEQ ID NO: 863914 - RNA, 17 nt, Mycobacterium avium subsp. paratuberculosis
ccgcggcggcagcaccc

SEQ ID NO: 863915 - RNA, 21 nt, Mycobacterium avium subsp. paratuberculosis
ccgcggcggccaucucgugcc

SEQ ID NO: 863916 - RNA, 22 nt, Mycobacterium avium subsp. paratuberculosis
ccgcggcggcccggcgucacgc

SEQ ID NO: 863917 - RNA, 16 nt, Mycobacterium avium subsp. paratuberculosis
ccgcggcggccggcga

SEQ ID NO: 863918 - RNA, 20 nt, Mycobacterium avium subsp. paratuberculosis
ccgcggcggccugcuugacc

SEQ ID NO: 863919 - RNA, 13 nt, Mycobacterium avium subsp. paratuberculosis
ccgcggcggcggc

SEQ ID NO: 863920 - RNA, 16 nt, Mycobacterium avium subsp. paratuberculosis
ccgcggcggcggcccg

SEQ ID NO: 863921 - RNA, 17 nt, Mycobacterium avium subsp. paratuberculosis
ccgcggcggcggcccgu

SEQ ID NO: 863922 - RNA, 12 nt, Mycobacterium avium subsp. paratuberculosis
ccgcggcggcgu

SEQ ID NO: 863923 - RNA, 13 nt, Mycobacterium avium subsp. paratuberculosis
ccgcggcggcguc

SEQ ID NO: 863924 - RNA, 14 nt, Mycobacterium avium subsp. paratuberculosis
ccgcggcggcgucg

SEQ ID NO: 863925 - RNA, 19 nt, Mycobacterium avium subsp. paratuberculosis
ccgcggcggcgucgaccgc

SEQ ID NO: 863926 - RNA, 20 nt, Mycobacterium avium subsp. paratuberculosis
ccgcggcggcgucgaccgcc

SEQ ID NO: 863927 - RNA, 16 nt, Mycobacterium avium subsp. paratuberculosis
ccgcggcggcgucggc

SEQ ID NO: 863928 - RNA, 14 nt, Mycobacterium avium subsp. paratuberculosis
ccgcggcggcgugc

SEQ ID NO: 863929 - RNA, 12 nt, Mycobacterium avium subsp. paratuberculosis
ccgcggcggcgc

SEQ ID NO: 863930 - RNA, 13 nt, Mycobacterium avium subsp. paratuberculosis
ccgcggcggcgcc

SEQ ID NO: 863931 - RNA, 16 nt, Mycobacterium avium subsp. paratuberculosis
ccgcggcggcgccgac

SEQ ID NO: 863932 - RNA, 21 nt, Mycobacterium avium subsp. paratuberculosis
ccgcggcggcgccgacgggcc

SEQ ID NO: 863933 - RNA, 20 nt, Mycobacterium avium subsp. paratuberculosis
ccgcggcggcagcacccgca

SEQ ID NO: 863934 - RNA, 23 nt, Mycobacterium avium subsp. paratuberculosis
ccgcggcggcgugccgcccggac

SEQ ID NO: 863935 - RNA, 12 nt, Mycobacterium avium subsp. paratuberculosis
ccgcggcgggca

SEQ ID NO: 863936 - RNA, 23 nt, Mycobacterium avium subsp. paratuberculosis
ccgcggcgcgguugacguagauc

SEQ ID NO: 863937 - RNA, 14 nt, Mycobacterium avium subsp. paratuberculosis
ccgcggcgcgcggc

SEQ ID NO: 863938 - RNA, 17 nt, Mycobacterium avium subsp. paratuberculosis
ccgcggcgcgcggccgc

SEQ ID NO: 863939 - RNA, 12 nt, Mycobacterium avium subsp. paratuberculosis
ccgcggcgcggc

SEQ ID NO: 863940 - RNA, 22 nt, Mycobacterium avium subsp. paratuberculosis
ccgcggcgcggcccggcccgcu

SEQ ID NO: 863941 - RNA, 23 nt, Mycobacterium avium subsp. paratuberculosis
ccgcggcgcggcccggcccgcug

SEQ ID NO: 863942 - RNA, 14 nt, Mycobacterium avium subsp. paratuberculosis
ccgcggcgcgcagg

SEQ ID NO: 863943 - RNA, 18 nt, Mycobacterium avium subsp. paratuberculosis
ccgcggcgcgcaggucgu

SEQ ID NO: 863944 - RNA, 19 nt, Mycobacterium avium subsp. paratuberculosis
ccgcggcgcgcaucgccgu

SEQ ID NO: 863945 - RNA, 20 nt, Mycobacterium avium subsp. paratuberculosis
ccgcggcgcgcaucgccguc

SEQ ID NO: 863946 - RNA, 12 nt, Mycobacterium avium subsp. paratuberculosis
ccgcggcgccga

SEQ ID NO: 863947 - RNA, 13 nt, Mycobacterium avium subsp. paratuberculosis
ccgcggcgccgcc

SEQ ID NO: 863948 - RNA, 15 nt, Mycobacterium avium subsp. paratuberculosis
ccgcggcgccgccac

SEQ ID NO: 863949 - RNA, 22 nt, Mycobacterium avium subsp. paratuberculosis
ccgcggcgccgccacggcacgu

SEQ ID NO: 863950 - RNA, 14 nt, Mycobacterium avium subsp. paratuberculosis
ccgcggcgccgcgg

SEQ ID NO: 863951 - RNA, 17 nt, Mycobacterium avium subsp. paratuberculosis
ccgcggcgccgcggcgg

SEQ ID NO: 863952 - RNA, 20 nt, Mycobacterium avium subsp. paratuberculosis
ccgcggcgccgcggcggcac

SEQ ID NO: 863953 - RNA, 12 nt, Mycobacterium avium subsp. paratuberculosis
ccgcggcgccgg

SEQ ID NO: 863954 - RNA, 14 nt, Mycobacterium avium subsp. paratuberculosis
ccgcggcgccgggc

SEQ ID NO: 863955 - RNA, 20 nt, Mycobacterium avium subsp. paratuberculosis
ccgcggcgccgggcggcccg

SEQ ID NO: 863956 - RNA, 12 nt, Mycobacterium avium subsp. paratuberculosis
ccgcggcgccgu

SEQ ID NO: 863957 - RNA, 22 nt, Mycobacterium avium subsp. paratuberculosis
ccgcggcgccguagguggccau

SEQ ID NO: 863958 - RNA, 17 nt, Mycobacterium avium subsp. paratuberculosis
ccgcggcgccgucgaac

SEQ ID NO: 863959 - RNA, 15 nt, Mycobacterium avium subsp. paratuberculosis
ccgcggcgccguuga

SEQ ID NO: 863960 - RNA, 22 nt, Mycobacterium avium subsp. paratuberculosis
ccgcggcgccguugaccggccg

SEQ ID NO: 863961 - RNA, 13 nt, Mycobacterium avium subsp. paratuberculosis
ccgcggcgcccgg

SEQ ID NO: 863962 - RNA, 17 nt, Mycobacterium avium subsp. paratuberculosis
ccgcggcgcccggaaug

SEQ ID NO: 863963 - RNA, 12 nt, Mycobacterium avium subsp. paratuberculosis
ccgcggcgcccu

SEQ ID NO: 863964 - RNA, 15 nt, Mycobacterium avium subsp. paratuberculosis
ccgcggcgcccucgc

SEQ ID NO: 863965 - RNA, 18 nt, Mycobacterium avium subsp. paratuberculosis
ccgcggcgcccucgccgg

SEQ ID NO: 863966 - RNA, 15 nt, Mycobacterium avium subsp. paratuberculosis
ccgcggcgagccggc

SEQ ID NO: 863967 - RNA, 18 nt, Mycobacterium avium subsp. paratuberculosis
ccgcggcgagccggccgu

SEQ ID NO: 863968 - RNA, 15 nt, Mycobacterium avium subsp. paratuberculosis
ccgcggcgaucgccg

SEQ ID NO: 863969 - RNA, 16 nt, Mycobacterium avium subsp. paratuberculosis
ccgcggcgaucgccgu

SEQ ID NO: 863970 - RNA, 13 nt, Mycobacterium avium subsp. paratuberculosis
ccgcggcgaucgg

SEQ ID NO: 863971 - RNA, 16 nt, Mycobacterium avium subsp. paratuberculosis
ccgcggcgaucggcgg

SEQ ID NO: 863972 - RNA, 17 nt, Mycobacterium avium subsp. paratuberculosis
ccgcggcgaucggcggu

SEQ ID NO: 863973 - RNA, 21 nt, Mycobacterium avium subsp. paratuberculosis
ccgcggcgaucggcgguccgc

SEQ ID NO: 863974 - RNA, 12 nt, Mycobacterium avium subsp. paratuberculosis
ccgcggcgauga

SEQ ID NO: 863975 - RNA, 13 nt, Mycobacterium avium subsp. paratuberculosis
ccgcggcgaccgg

SEQ ID NO: 863976 - RNA, 14 nt, Mycobacterium avium subsp. paratuberculosis
ccgcggcgaccggg

SEQ ID NO: 863977 - RNA, 13 nt, Mycobacterium avium subsp. paratuberculosis
ccgcggcgcaccc

SEQ ID NO: 863978 - RNA, 13 nt, Mycobacterium avium subsp. paratuberculosis
ccgcggccggugc

SEQ ID NO: 863979 - RNA, 22 nt, Mycobacterium avium subsp. paratuberculosis
ccgcggccggugccacggucag

SEQ ID NO: 863980 - RNA, 19 nt, Mycobacterium avium subsp. paratuberculosis
ccgcggccgucgcggcgau

SEQ ID NO: 863981 - RNA, 20 nt, Mycobacterium avium subsp. paratuberculosis
ccgcggccgucgcggcgauc

SEQ ID NO: 863982 - RNA, 20 nt, Mycobacterium avium subsp. paratuberculosis
ccgcggccgucgucgugcac

SEQ ID NO: 863983 - RNA, 12 nt, Mycobacterium avium subsp. paratuberculosis
ccgcggccguug

SEQ ID NO: 863984 - RNA, 17 nt, Mycobacterium avium subsp. paratuberculosis
ccgcggccuccagccgc

SEQ ID NO: 863985 - RNA, 11 nt, Mycobacterium avium subsp. paratuberculosis
ccgcggccggc

SEQ ID NO: 863986 - RNA, 15 nt, Mycobacterium avium subsp. paratuberculosis
ccgcggccggcccag

SEQ ID NO: 863987 - RNA, 16 nt, Mycobacterium avium subsp. paratuberculosis
ccgcggccggcccagc

SEQ ID NO: 863988 - RNA, 13 nt, Mycobacterium avium subsp. paratuberculosis
ccgcggccucggc

SEQ ID NO: 863989 - RNA, 16 nt, Mycobacterium avium subsp. paratuberculosis
ccgcggccucggcguc

SEQ ID NO: 863990 - RNA, 17 nt, Mycobacterium avium subsp. paratuberculosis
ccgcggccucgucgagg

SEQ ID NO: 863991 - RNA, 19 nt, Mycobacterium avium subsp. paratuberculosis
ccgcggccuugcgagccgg

SEQ ID NO: 863992 - RNA, 20 nt, Mycobacterium avium subsp. paratuberculosis
ccgcggcgaauccgagcauc

SEQ ID NO: 863993 - RNA, 22 nt, Mycobacterium avium subsp. paratuberculosis
ccgcggcgaauccgagcaucgg

SEQ ID NO: 863994 - RNA, 20 nt, Mycobacterium avium subsp. paratuberculosis
ccgcggcgacacccagcggc

SEQ ID NO: 863995 - RNA, 20 nt, Mycobacterium avium subsp. paratuberculosis
ccgcggcgaccacgaacacc

SEQ ID NO: 863996 - RNA, 23 nt, Mycobacterium avium subsp. paratuberculosis
ccgcggcgaccacgaacaccggc

SEQ ID NO: 863997 - RNA, 14 nt, Mycobacterium avium subsp. paratuberculosis
ccgcggccgcggcg

SEQ ID NO: 863998 - RNA, 16 nt, Mycobacterium avium subsp. paratuberculosis
ccgcggccgcggcgcg

SEQ ID NO: 863999 - RNA, 17 nt, Mycobacterium avium subsp. paratuberculosis
ccgcggccgcggcgcgc

SEQ ID NO: 864000 - RNA, 15 nt, Mycobacterium avium subsp. paratuberculosis
ccgcggccgcguugu

SEQ ID NO: 864001 - RNA, 11 nt, Mycobacterium avium subsp. paratuberculosis
ccgcggccgcu

SEQ ID NO: 864002 - RNA, 23 nt, Mycobacterium avium subsp. paratuberculosis
ccgcggccgcugcgcccagcgcg

SEQ ID NO: 864003 - RNA, 17 nt, Mycobacterium avium subsp. paratuberculosis
ccgcggccgcgcgcccg

SEQ ID NO: 864004 - RNA, 14 nt, Mycobacterium avium subsp. paratuberculosis
ccgcggccgccgcc

SEQ ID NO: 864005 - RNA, 19 nt, Mycobacterium avium subsp. paratuberculosis
ccgcggccgccgccgcggc

SEQ ID NO: 864006 - RNA, 22 nt, Mycobacterium avium subsp. paratuberculosis
ccgcggccgccgccgcggccgc

SEQ ID NO: 864007 - RNA, 18 nt, Mycobacterium avium subsp. paratuberculosis
ccgcggccgccgcgacgg

SEQ ID NO: 864008 - RNA, 14 nt, Mycobacterium avium subsp. paratuberculosis
ccgcggccgccucc

SEQ ID NO: 864009 - RNA, 19 nt, Mycobacterium avium subsp. paratuberculosis
ccgcggccgccucccgcag

SEQ ID NO: 864010 - RNA, 20 nt, Mycobacterium avium subsp. paratuberculosis
ccgcggccgccucccgcagc

SEQ ID NO: 864011 - RNA, 23 nt, Mycobacterium avium subsp. paratuberculosis
ccgcggccgccuucacgaccggc

SEQ ID NO: 864012 - RNA, 12 nt, Mycobacterium avium subsp. paratuberculosis
ccgcggccgcga

SEQ ID NO: 864013 - RNA, 15 nt, Mycobacterium avium subsp. paratuberculosis
ccgcggccgcgacgg

SEQ ID NO: 864014 - RNA, 16 nt, Mycobacterium avium subsp. paratuberculosis
ccgcggccgcgacggu

SEQ ID NO: 864015 - RNA, 18 nt, Mycobacterium avium subsp. paratuberculosis
ccgcggccagccggucgu

SEQ ID NO: 864016 - RNA, 15 nt, Mycobacterium avium subsp. paratuberculosis
ccgcggccagcgagg

SEQ ID NO: 864017 - RNA, 17 nt, Mycobacterium avium subsp. paratuberculosis
ccgcggccagcgaggug

SEQ ID NO: 864018 - RNA, 13 nt, Mycobacterium avium subsp. paratuberculosis
ccgcggcccgcuu

SEQ ID NO: 864019 - RNA, 12 nt, Mycobacterium avium subsp. paratuberculosis
ccgcggcccggc

SEQ ID NO: 864020 - RNA, 15 nt, Mycobacterium avium subsp. paratuberculosis
ccgcggcccggccac

SEQ ID NO: 864021 - RNA, 17 nt, Mycobacterium avium subsp. paratuberculosis
ccgcggcccugcagcgc

SEQ ID NO: 864022 - RNA, 17 nt, Mycobacterium avium subsp. paratuberculosis
ccgcucguaacgccacg

SEQ ID NO: 864023 - RNA, 21 nt, Mycobacterium avium subsp. paratuberculosis
ccgcucguaacgccacggcgg

SEQ ID NO: 864024 - RNA, 13 nt, Mycobacterium avium subsp. paratuberculosis
ccgcucgucgagu

SEQ ID NO: 864025 - RNA, 16 nt, Mycobacterium avium subsp. paratuberculosis
ccgcucgucgggcaca

SEQ ID NO: 864026 - RNA, 17 nt, Mycobacterium avium subsp. paratuberculosis
ccgcucgggcgccucga

SEQ ID NO: 864027 - RNA, 13 nt, Mycobacterium avium subsp. paratuberculosis
ccgcucggcgugg

SEQ ID NO: 864028 - RNA, 13 nt, Mycobacterium avium subsp. paratuberculosis
ccgcucggcucga

SEQ ID NO: 864029 - RNA, 18 nt, Mycobacterium avium subsp. paratuberculosis
ccgcucgggcgugcgcgu

SEQ ID NO: 864030 - RNA, 19 nt, Mycobacterium avium subsp. paratuberculosis
ccgcucgggcgugcgcgug

SEQ ID NO: 864031 - RNA, 19 nt, Mycobacterium avium subsp. paratuberculosis
ccgcucgggugucgccgag

SEQ ID NO: 864032 - RNA, 14 nt, Mycobacterium avium subsp. paratuberculosis
ccgcucuucgacga

SEQ ID NO: 864033 - RNA, 15 nt, Mycobacterium avium subsp. paratuberculosis
ccgcucuucgacgac

SEQ ID NO: 864034 - RNA, 18 nt, Mycobacterium avium subsp. paratuberculosis
ccgcucuucgacgacccg

SEQ ID NO: 864035 - RNA, 23 nt, Mycobacterium avium subsp. paratuberculosis
ccgcugaaagcucgcgucgacgu

SEQ ID NO: 864036 - RNA, 17 nt, Mycobacterium avium subsp. paratuberculosis
ccgcugccggggugcag

SEQ ID NO: 864037 - RNA, 16 nt, Mycobacterium avium subsp. paratuberculosis
ccgcugccguccggcg

SEQ ID NO: 864038 - RNA, 16 nt, Mycobacterium avium subsp. paratuberculosis
ccgcugccguucgccg

SEQ ID NO: 864039 - RNA, 13 nt, Mycobacterium avium subsp. paratuberculosis
ccgcugccggccg

SEQ ID NO: 864040 - RNA, 16 nt, Mycobacterium avium subsp. paratuberculosis
ccgcugcgccggcgcg

SEQ ID NO: 864041 - RNA, 12 nt, Mycobacterium avium subsp. paratuberculosis
ccgcugcgccga

SEQ ID NO: 864042 - RNA, 13 nt, Mycobacterium avium subsp. paratuberculosis
ccgcugcgccgac

SEQ ID NO: 864043 - RNA, 17 nt, Mycobacterium avium subsp. paratuberculosis
ccgcugcgacaggucgg

SEQ ID NO: 864044 - RNA, 18 nt, Mycobacterium avium subsp. paratuberculosis
ccgcugcgacaggucggc

SEQ ID NO: 864045 - RNA, 19 nt, Mycobacterium avium subsp. paratuberculosis
ccgcugcggauccgacgaa

SEQ ID NO: 864046 - RNA, 16 nt, Mycobacterium avium subsp. paratuberculosis
ccgcugcgcgggucgg

SEQ ID NO: 864047 - RNA, 22 nt, Mycobacterium avium subsp. paratuberculosis
ccgcugcgcgggucggcgccgg

SEQ ID NO: 864048 - RNA, 14 nt, Mycobacterium avium subsp. paratuberculosis
ccgcugcgcggccg

SEQ ID NO: 864049 - RNA, 15 nt, Mycobacterium avium subsp. paratuberculosis
ccgcuggcguagauc

SEQ ID NO: 864050 - RNA, 18 nt, Mycobacterium avium subsp. paratuberculosis
ccgcuggcgucgaucgcg

SEQ ID NO: 864051 - RNA, 13 nt, Mycobacterium avium subsp. paratuberculosis
ccgcuggcccggc

SEQ ID NO: 864052 - RNA, 13 nt, Mycobacterium avium subsp. paratuberculosis
ccgcuggcgccgg

SEQ ID NO: 864053 - RNA, 14 nt, Mycobacterium avium subsp. paratuberculosis
ccgcuggccgaggc

SEQ ID NO: 864054 - RNA, 11 nt, Mycobacterium avium subsp. paratuberculosis
ccgcuggccgc

SEQ ID NO: 864055 - RNA, 19 nt, Mycobacterium avium subsp. paratuberculosis
ccgcuggccgccccgaaca

SEQ ID NO: 864056 - RNA, 21 nt, Mycobacterium avium subsp. paratuberculosis
ccgcuggccgccccgaacagc

SEQ ID NO: 864057 - RNA, 13 nt, Mycobacterium avium subsp. paratuberculosis
ccgcuggccgccg

SEQ ID NO: 864058 - RNA, 14 nt, Mycobacterium avium subsp. paratuberculosis
ccgcuggccgccgc

SEQ ID NO: 864059 - RNA, 18 nt, Mycobacterium avium subsp. paratuberculosis
ccgcuggccgcgccacag

SEQ ID NO: 864060 - RNA, 15 nt, Mycobacterium avium subsp. paratuberculosis
ccgcugucugcgugc

SEQ ID NO: 864061 - RNA, 14 nt, Mycobacterium avium subsp. paratuberculosis
ccgcugucgucgaa

SEQ ID NO: 864062 - RNA, 17 nt, Mycobacterium avium subsp. paratuberculosis
ccgcugugcggcccggc

SEQ ID NO: 864063 - RNA, 14 nt, Mycobacterium avium subsp. paratuberculosis
ccgcugucggugug

SEQ ID NO: 864064 - RNA, 11 nt, Mycobacterium avium subsp. paratuberculosis
ccgcugucguc

SEQ ID NO: 864065 - RNA, 14 nt, Mycobacterium avium subsp. paratuberculosis
ccgcuggucaaugc

SEQ ID NO: 864066 - RNA, 17 nt, Mycobacterium avium subsp. paratuberculosis
ccgcuggugcgcgccgg

SEQ ID NO: 864067 - RNA, 23 nt, Mycobacterium avium subsp. paratuberculosis
ccgcugguggugaucacccagcc

SEQ ID NO: 864068 - RNA, 18 nt, Mycobacterium avium subsp. paratuberculosis
ccgcugucaauccccgcg

SEQ ID NO: 864069 - RNA, 22 nt, Mycobacterium avium subsp. paratuberculosis
ccgcugucaauccccgcgguuc

SEQ ID NO: 864070 - RNA, 16 nt, Mycobacterium avium subsp. paratuberculosis
ccgcuggucaggccga

SEQ ID NO: 864071 - RNA, 22 nt, Mycobacterium avium subsp. paratuberculosis
ccgcuggucaggccgaaugacg

SEQ ID NO: 864072 - RNA, 16 nt, Mycobacterium avium subsp. paratuberculosis
ccgcugguaggcggcg

SEQ ID NO: 864073 - RNA, 19 nt, Mycobacterium avium subsp. paratuberculosis
ccgcuggugaacucgccga

SEQ ID NO: 864074 - RNA, 21 nt, Mycobacterium avium subsp. paratuberculosis
ccgcuggugaggucgcgcagg

SEQ ID NO: 864075 - RNA, 24 nt, Mycobacterium avium subsp. paratuberculosis
ccgcugggagcacgugaugagcga

SEQ ID NO: 864076 - RNA, 19 nt, Mycobacterium avium subsp. paratuberculosis
ccgcugggcggcgcggcgg

SEQ ID NO: 864077 - RNA, 13 nt, Mycobacterium avium subsp. paratuberculosis
ccgcugggcgugg

SEQ ID NO: 864078 - RNA, 16 nt, Mycobacterium avium subsp. paratuberculosis
ccgcugggcguggugc

SEQ ID NO: 864079 - RNA, 21 nt, Mycobacterium avium subsp. paratuberculosis
ccgcuggggcgcaccgccugu

SEQ ID NO: 864080 - RNA, 17 nt, Mycobacterium avium subsp. paratuberculosis
ccgcuucaggcagcgca

SEQ ID NO: 864081 - RNA, 22 nt, Mycobacterium avium subsp. paratuberculosis
ccgcuguucggguagacgauca

SEQ ID NO: 864082 - RNA, 23 nt, Mycobacterium avium subsp. paratuberculosis
ccgcuguggacaggucgaugaug

SEQ ID NO: 864083 - RNA, 17 nt, Mycobacterium avium subsp. paratuberculosis
ccgcugugguccucguc

SEQ ID NO: 864084 - RNA, 18 nt, Mycobacterium avium subsp. paratuberculosis
ccgcugugguccucguca

SEQ ID NO: 864085 - RNA, 21 nt, Mycobacterium avium subsp. paratuberculosis
ccgcugugguccucgucaccg

SEQ ID NO: 864086 - RNA, 16 nt, Mycobacterium avium subsp. paratuberculosis
ccgcuucgcccggcug

SEQ ID NO: 864087 - RNA, 13 nt, Mycobacterium avium subsp. paratuberculosis
ccgcuucggcucg

SEQ ID NO: 864088 - RNA, 14 nt, Mycobacterium avium subsp. paratuberculosis
ccgcuucggggugg

SEQ ID NO: 864089 - RNA, 15 nt, Mycobacterium avium subsp. paratuberculosis
ccgcuucgucgccgg

SEQ ID NO: 864090 - RNA, 18 nt, Mycobacterium avium subsp. paratuberculosis
ccgcuucgucgccggccg

SEQ ID NO: 864091 - RNA, 19 nt, Mycobacterium avium subsp. paratuberculosis
ccgcuucgucgccggccgc

SEQ ID NO: 864092 - RNA, 13 nt, Mycobacterium avium subsp. paratuberculosis
ccgcuucccaccc

SEQ ID NO: 864093 - RNA, 15 nt, Mycobacterium avium subsp. paratuberculosis
ccgcuucccacccgg

SEQ ID NO: 864094 - RNA, 14 nt, Mycobacterium avium subsp. paratuberculosis
ccgcuucgaggugc

SEQ ID NO: 864095 - RNA, 15 nt, Mycobacterium avium subsp. paratuberculosis
ccgcgucgccgacca

SEQ ID NO: 864096 - RNA, 19 nt, Mycobacterium avium subsp. paratuberculosis
ccgcgucgccgaccagcag

SEQ ID NO: 864097 - RNA, 13 nt, Mycobacterium avium subsp. paratuberculosis
ccgcgucgccgau

SEQ ID NO: 864098 - RNA, 14 nt, Mycobacterium avium subsp. paratuberculosis
ccgcgucgccgauc

SEQ ID NO: 864099 - RNA, 15 nt, Mycobacterium avium subsp. paratuberculosis
ccgcgucgccgaucg

SEQ ID NO: 864100 - RNA, 20 nt, Mycobacterium avium subsp. paratuberculosis
ccgcgucgccgaucgcccgg

SEQ ID NO: 864101 - RNA, 13 nt, Mycobacterium avium subsp. paratuberculosis
ccgcgucgccgcc

SEQ ID NO: 864102 - RNA, 14 nt, Mycobacterium avium subsp. paratuberculosis
ccgcgucgccgccg

SEQ ID NO: 864103 - RNA, 18 nt, Mycobacterium avium subsp. paratuberculosis
ccgcgucgccgccgggcg

SEQ ID NO: 864104 - RNA, 15 nt, Mycobacterium avium subsp. paratuberculosis
ccgcgucgcgcagca

SEQ ID NO: 864105 - RNA, 16 nt, Mycobacterium avium subsp. paratuberculosis
ccgcgucgcgccgccg

SEQ ID NO: 864106 - RNA, 14 nt, Mycobacterium avium subsp. paratuberculosis
ccgcgucggcgccg

SEQ ID NO: 864107 - RNA, 16 nt, Mycobacterium avium subsp. paratuberculosis
ccgcgucggcgccggc

SEQ ID NO: 864108 - RNA, 15 nt, Mycobacterium avium subsp. paratuberculosis
ccgcgucggcgccgu

SEQ ID NO: 864109 - RNA, 23 nt, Mycobacterium avium subsp. paratuberculosis
ccgcgucggcgcuggccagcgcg

SEQ ID NO: 864110 - RNA, 13 nt, Mycobacterium avium subsp. paratuberculosis
ccgcgucggcggc

SEQ ID NO: 864111 - RNA, 18 nt, Mycobacterium avium subsp. paratuberculosis
ccgcgucggaggccauga

SEQ ID NO: 864112 - RNA, 14 nt, Mycobacterium avium subsp. paratuberculosis
ccgcgucggcccag

SEQ ID NO: 864113 - RNA, 15 nt, Mycobacterium avium subsp. paratuberculosis
ccgcgucgcugccca

SEQ ID NO: 864114 - RNA, 19 nt, Mycobacterium avium subsp. paratuberculosis
ccgcgucggaccccgaugc

SEQ ID NO: 864115 - RNA, 18 nt, Mycobacterium avium subsp. paratuberculosis
ccgcgucgaugucgucgu

SEQ ID NO: 864116 - RNA, 19 nt, Mycobacterium avium subsp. paratuberculosis
ccgcgucgaugucgucguu

SEQ ID NO: 864117 - RNA, 22 nt, Mycobacterium avium subsp. paratuberculosis
ccgcgucgcagugccggugcag

SEQ ID NO: 864118 - RNA, 13 nt, Mycobacterium avium subsp. paratuberculosis
ccgcgucgacggc

SEQ ID NO: 864119 - RNA, 17 nt, Mycobacterium avium subsp. paratuberculosis
ccgcgucgacggcgugg

SEQ ID NO: 864120 - RNA, 16 nt, Mycobacterium avium subsp. paratuberculosis
ccgcgguagcggaccu

SEQ ID NO: 864121 - RNA, 17 nt, Mycobacterium avium subsp. paratuberculosis
ccgcgguagcggaccug

SEQ ID NO: 864122 - RNA, 16 nt, Mycobacterium avium subsp. paratuberculosis
ccgcggucaucgagcc

SEQ ID NO: 864123 - RNA, 21 nt, Mycobacterium avium subsp. paratuberculosis
ccgcggucaucgagccgguac

SEQ ID NO: 864124 - RNA, 14 nt, Mycobacterium avium subsp. paratuberculosis
ccgcggucaugcgc

SEQ ID NO: 864125 - RNA, 18 nt, Mycobacterium avium subsp. paratuberculosis
ccgcggucaugcgcgggc

SEQ ID NO: 864126 - RNA, 19 nt, Mycobacterium avium subsp. paratuberculosis
ccgcggucaugcgcgggca

SEQ ID NO: 864127 - RNA, 22 nt, Mycobacterium avium subsp. paratuberculosis
ccgcgucgaccagccgguaggc

SEQ ID NO: 864128 - RNA, 20 nt, Mycobacterium avium subsp. paratuberculosis
ccgcgggcgauucccggaug

SEQ ID NO: 864129 - RNA, 21 nt, Mycobacterium avium subsp. paratuberculosis
ccgcgggcgcauaccagcgcu

SEQ ID NO: 864130 - RNA, 13 nt, Mycobacterium avium subsp. paratuberculosis
ccgcggguggccu

SEQ ID NO: 864131 - RNA, 22 nt, Mycobacterium avium subsp. paratuberculosis
ccgcggguggccuucaucaccg

SEQ ID NO: 864132 - RNA, 13 nt, Mycobacterium avium subsp. paratuberculosis
ccgcggguggcgc

SEQ ID NO: 864133 - RNA, 18 nt, Mycobacterium avium subsp. paratuberculosis
ccgcggguggcgccacag

SEQ ID NO: 864134 - RNA, 16 nt, Mycobacterium avium subsp. paratuberculosis
ccgcgggcgcgccguc

SEQ ID NO: 864135 - RNA, 18 nt, Mycobacterium avium subsp. paratuberculosis
ccgcgguagaaccaacgc

SEQ ID NO: 864136 - RNA, 17 nt, Mycobacterium avium subsp. paratuberculosis
ccgcguggccucccggu

SEQ ID NO: 864137 - RNA, 17 nt, Mycobacterium avium subsp. paratuberculosis
ccgcguggccgaggaug

SEQ ID NO: 864138 - RNA, 18 nt, Mycobacterium avium subsp. paratuberculosis
ccgcgugcgagccgagca

SEQ ID NO: 864139 - RNA, 19 nt, Mycobacterium avium subsp. paratuberculosis
ccgcgugcgagccgagcac

SEQ ID NO: 864140 - RNA, 16 nt, Mycobacterium avium subsp. paratuberculosis
ccgcgucggcggcggc

SEQ ID NO: 864141 - RNA, 20 nt, Mycobacterium avium subsp. paratuberculosis
ccgcgucggcggcggcggcc

SEQ ID NO: 864142 - RNA, 20 nt, Mycobacterium avium subsp. paratuberculosis
ccgcgucggcggucgccagc

SEQ ID NO: 864143 - RNA, 22 nt, Mycobacterium avium subsp. paratuberculosis
ccgcgugacggccgcggcgcgg

SEQ ID NO: 864144 - RNA, 20 nt, Mycobacterium avium subsp. paratuberculosis
ccgcguucacccgcgcccgc

SEQ ID NO: 864145 - RNA, 16 nt, Mycobacterium avium subsp. paratuberculosis
ccgcguucucggcgga

SEQ ID NO: 864146 - RNA, 15 nt, Mycobacterium avium subsp. paratuberculosis
ccgcguuccccggcg

SEQ ID NO: 864147 - RNA, 16 nt, Mycobacterium avium subsp. paratuberculosis
ccgcguuccccggcgu

SEQ ID NO: 864148 - RNA, 18 nt, Mycobacterium avium subsp. paratuberculosis
ccgcguuccccggcgugg

SEQ ID NO: 864149 - RNA, 19 nt, Mycobacterium avium subsp. paratuberculosis
ccgcguucgaccuccacga

SEQ ID NO: 864150 - RNA, 22 nt, Mycobacterium avium subsp. paratuberculosis
ccgcguucgaccuccacgagcc

SEQ ID NO: 864151 - RNA, 14 nt, Mycobacterium avium subsp. paratuberculosis
ccgcgugucggcac

SEQ ID NO: 864152 - RNA, 23 nt, Mycobacterium avium subsp. paratuberculosis
ccgcucagagcugcaccggguac

SEQ ID NO: 864153 - RNA, 18 nt, Mycobacterium avium subsp. paratuberculosis
ccgcucaccugcggcccg

SEQ ID NO: 864154 - RNA, 19 nt, Mycobacterium avium subsp. paratuberculosis
ccgcucaccugcggcccgu

SEQ ID NO: 864155 - RNA, 20 nt, Mycobacterium avium subsp. paratuberculosis
ccgcucaccugcggcccguc

SEQ ID NO: 864156 - RNA, 13 nt, Mycobacterium avium subsp. paratuberculosis
ccgcucacacagc

SEQ ID NO: 864157 - RNA, 17 nt, Mycobacterium avium subsp. paratuberculosis
ccgcucaccgccgagcc

SEQ ID NO: 864158 - RNA, 16 nt, Mycobacterium avium subsp. paratuberculosis
ccgcucaggucggccg

SEQ ID NO: 864159 - RNA, 17 nt, Mycobacterium avium subsp. paratuberculosis
ccgcucaggucggccgc

SEQ ID NO: 864160 - RNA, 20 nt, Mycobacterium avium subsp. paratuberculosis
ccgcucaggucggccgcggc

SEQ ID NO: 864161 - RNA, 22 nt, Mycobacterium avium subsp. paratuberculosis
ccgcucaggucggccgcggccg

SEQ ID NO: 864162 - RNA, 19 nt, Mycobacterium avium subsp. paratuberculosis
ccgcucagcgauugcggcc

SEQ ID NO: 864163 - RNA, 21 nt, Mycobacterium avium subsp. paratuberculosis
ccgcucagcgauugcggccgc

SEQ ID NO: 864164 - RNA, 23 nt, Mycobacterium avium subsp. paratuberculosis
ccgcucagcgauugcggccgccg

SEQ ID NO: 864165 - RNA, 16 nt, Mycobacterium avium subsp. paratuberculosis
ccgcucagcgggcggc

SEQ ID NO: 864166 - RNA, 21 nt, Mycobacterium avium subsp. paratuberculosis
ccgcucagcgggcggccagcc

SEQ ID NO: 864167 - RNA, 22 nt, Mycobacterium avium subsp. paratuberculosis
ccgcucagcgggcggccagccg

SEQ ID NO: 864168 - RNA, 20 nt, Mycobacterium avium subsp. paratuberculosis
ccgcuccagcggccacaccg

SEQ ID NO: 864169 - RNA, 14 nt, Mycobacterium avium subsp. paratuberculosis
ccgcuccaccagcg

SEQ ID NO: 864170 - RNA, 15 nt, Mycobacterium avium subsp. paratuberculosis
ccgcuccaccagcgc

SEQ ID NO: 864171 - RNA, 22 nt, Mycobacterium avium subsp. paratuberculosis
ccgcuccaccagcgcggugaug

SEQ ID NO: 864172 - RNA, 14 nt, Mycobacterium avium subsp. paratuberculosis
ccgcuccaccgaaa

SEQ ID NO: 864173 - RNA, 17 nt, Mycobacterium avium subsp. paratuberculosis
ccgcuccaugaaccggu

SEQ ID NO: 864174 - RNA, 16 nt, Mycobacterium avium subsp. paratuberculosis
ccgcuccauggcggcg

SEQ ID NO: 864175 - RNA, 20 nt, Mycobacterium avium subsp. paratuberculosis
ccgcuccauggcggcgacca

SEQ ID NO: 864176 - RNA, 18 nt, Mycobacterium avium subsp. paratuberculosis
ccgcuccauguucggggc

SEQ ID NO: 864177 - RNA, 16 nt, Mycobacterium avium subsp. paratuberculosis
ccgcuccccgagcacg

SEQ ID NO: 864178 - RNA, 20 nt, Mycobacterium avium subsp. paratuberculosis
ccgcuccccgagcacgucga

SEQ ID NO: 864179 - RNA, 22 nt, Mycobacterium avium subsp. paratuberculosis
ccgcuccccgagcacgucgagc

SEQ ID NO: 864180 - RNA, 13 nt, Mycobacterium avium subsp. paratuberculosis
ccgcucggcgggu

SEQ ID NO: 864181 - RNA, 16 nt, Mycobacterium avium subsp. paratuberculosis
ccgcucggcgggucgu

SEQ ID NO: 864182 - RNA, 20 nt, Mycobacterium avium subsp. paratuberculosis
ccgcguuggccagcgccucc

SEQ ID NO: 864183 - RNA, 16 nt, Mycobacterium avium subsp. paratuberculosis
ccgcguuggccgccac

SEQ ID NO: 864184 - RNA, 17 nt, Mycobacterium avium subsp. paratuberculosis
ccgcguuggccgccacg

SEQ ID NO: 864185 - RNA, 19 nt, Mycobacterium avium subsp. paratuberculosis
ccgcguuggcgccgacguc

SEQ ID NO: 864186 - RNA, 16 nt, Mycobacterium avium subsp. paratuberculosis
ccgcguugucggcgac

SEQ ID NO: 864187 - RNA, 17 nt, Mycobacterium avium subsp. paratuberculosis
ccgcguugucggcgacg

SEQ ID NO: 864188 - RNA, 18 nt, Mycobacterium avium subsp. paratuberculosis
ccgcguugucggcgacgg

SEQ ID NO: 864189 - RNA, 20 nt, Mycobacterium avium subsp. paratuberculosis
ccgcguugucggcgacggcg

SEQ ID NO: 864190 - RNA, 22 nt, Mycobacterium avium subsp. paratuberculosis
ccgcguugucggcgacggcggg

SEQ ID NO: 864191 - RNA, 15 nt, Mycobacterium avium subsp. paratuberculosis
ccgcguugucggcgu

SEQ ID NO: 864192 - RNA, 16 nt, Mycobacterium avium subsp. paratuberculosis
ccgcguugucggcguc

SEQ ID NO: 864193 - RNA, 18 nt, Mycobacterium avium subsp. paratuberculosis
ccgcguugugcaccaaca

SEQ ID NO: 864194 - RNA, 16 nt, Mycobacterium avium subsp. paratuberculosis
ccgcguugcggcgcag

SEQ ID NO: 864195 - RNA, 17 nt, Mycobacterium avium subsp. paratuberculosis
ccgcguugcggcgcagc

SEQ ID NO: 864196 - RNA, 17 nt, Mycobacterium avium subsp. paratuberculosis
ccgcguugaucagcgcc

SEQ ID NO: 864197 - RNA, 22 nt, Mycobacterium avium subsp. paratuberculosis
ccgcucaacuugaucagcucgc

SEQ ID NO: 864198 - RNA, 23 nt, Mycobacterium avium subsp. paratuberculosis
ccgcuagaccgauggcggcggcc

SEQ ID NO: 864199 - RNA, 18 nt, Mycobacterium avium subsp. paratuberculosis
ccgcuagguuuggccagc

SEQ ID NO: 864200 - RNA, 16 nt, Mycobacterium avium subsp. paratuberculosis
ccgcuagucgcccagc

SEQ ID NO: 864201 - RNA, 21 nt, Mycobacterium avium subsp. paratuberculosis
ccgcuagucgcccagcagccc

SEQ ID NO: 864202 - RNA, 16 nt, Mycobacterium avium subsp. paratuberculosis
ccgcuaguuggugcug

SEQ ID NO: 864203 - RNA, 22 nt, Mycobacterium avium subsp. paratuberculosis
ccgcaccagaucgucgggcacc

SEQ ID NO: 864204 - RNA, 17 nt, Mycobacterium avium subsp. paratuberculosis
ccgcaccaccgcccgga

SEQ ID NO: 864205 - RNA, 23 nt, Mycobacterium avium subsp. paratuberculosis
ccgcaccagguagguggccgucg

SEQ ID NO: 864206 - RNA, 18 nt, Mycobacterium avium subsp. paratuberculosis
ccgcaccaccacguugca

SEQ ID NO: 864207 - RNA, 14 nt, Mycobacterium avium subsp. paratuberculosis
ccgcaccacccagc

SEQ ID NO: 864208 - RNA, 13 nt, Mycobacterium avium subsp. paratuberculosis
ccgcacccagcgg

SEQ ID NO: 864209 - RNA, 18 nt, Mycobacterium avium subsp. paratuberculosis
ccgcaccccacccgcgcg

SEQ ID NO: 864210 - RNA, 17 nt, Mycobacterium avium subsp. paratuberculosis
ccgcacccccagcucga

SEQ ID NO: 864211 - RNA, 17 nt, Mycobacterium avium subsp. paratuberculosis
ccgcaauugcgccagca

SEQ ID NO: 864212 - RNA, 18 nt, Mycobacterium avium subsp. paratuberculosis
ccgcaauugcgccagcag

SEQ ID NO: 864213 - RNA, 19 nt, Mycobacterium avium subsp. paratuberculosis
ccgcaauugcgccagcagc

SEQ ID NO: 864214 - RNA, 18 nt, Mycobacterium avium subsp. paratuberculosis
ccgcacaauccggucagc

SEQ ID NO: 864215 - RNA, 15 nt, Mycobacterium avium subsp. paratuberculosis
ccgcacaccaccacg

SEQ ID NO: 864216 - RNA, 13 nt, Mycobacterium avium subsp. paratuberculosis
ccgcacaccgcgc

SEQ ID NO: 864217 - RNA, 15 nt, Mycobacterium avium subsp. paratuberculosis
ccgcacaccgcgcag

SEQ ID NO: 864218 - RNA, 15 nt, Mycobacterium avium subsp. paratuberculosis
ccgcacaccgcggcg

SEQ ID NO: 864219 - RNA, 13 nt, Mycobacterium avium subsp. paratuberculosis
ccgcacaccgucu

SEQ ID NO: 864220 - RNA, 18 nt, Mycobacterium avium subsp. paratuberculosis
ccgcacaccugcaucacg

SEQ ID NO: 864221 - RNA, 16 nt, Mycobacterium avium subsp. paratuberculosis
ccgcaaucggcgccgg

SEQ ID NO: 864222 - RNA, 21 nt, Mycobacterium avium subsp. paratuberculosis
ccgcaauacggugcccgccgc

SEQ ID NO: 864223 - RNA, 22 nt, Mycobacterium avium subsp. paratuberculosis
ccgcaauacggugcccgccgcg

SEQ ID NO: 864224 - RNA, 21 nt, Mycobacterium avium subsp. paratuberculosis
ccgcaauccuguuccccggcg

SEQ ID NO: 864225 - RNA, 15 nt, Mycobacterium avium subsp. paratuberculosis
ccgcaauacaccgcg

SEQ ID NO: 864226 - RNA, 17 nt, Mycobacterium avium subsp. paratuberculosis
ccgcaauacaccgcgaa

SEQ ID NO: 864227 - RNA, 20 nt, Mycobacterium avium subsp. paratuberculosis
ccgcaaggugauucgcgcgg

SEQ ID NO: 864228 - RNA, 21 nt, Mycobacterium avium subsp. paratuberculosis
ccgcaaggugauucgcgcggc

SEQ ID NO: 864229 - RNA, 13 nt, Mycobacterium avium subsp. paratuberculosis
ccgcaaggccgcc

SEQ ID NO: 864230 - RNA, 16 nt, Mycobacterium avium subsp. paratuberculosis
ccgcaaggccgccagc

SEQ ID NO: 864231 - RNA, 16 nt, Mycobacterium avium subsp. paratuberculosis
ccgcaacuugcccgac

SEQ ID NO: 864232 - RNA, 19 nt, Mycobacterium avium subsp. paratuberculosis
ccgcaacuugcccgacggc

SEQ ID NO: 864233 - RNA, 21 nt, Mycobacterium avium subsp. paratuberculosis
ccgcaacuugcccgacggcgu

SEQ ID NO: 864234 - RNA, 23 nt, Mycobacterium avium subsp. paratuberculosis
ccgcaagaugugggcgucgucga

SEQ ID NO: 864235 - RNA, 17 nt, Mycobacterium avium subsp. paratuberculosis
ccgcaacgugcgccggc

SEQ ID NO: 864236 - RNA, 19 nt, Mycobacterium avium subsp. paratuberculosis
ccgcaacguuguuccacgu

SEQ ID NO: 864237 - RNA, 22 nt, Mycobacterium avium subsp. paratuberculosis
ccgcaacguuguuccacguguc

SEQ ID NO: 864238 - RNA, 20 nt, Mycobacterium avium subsp. paratuberculosis
ccgcaacuccacaaccagcg

SEQ ID NO: 864239 - RNA, 21 nt, Mycobacterium avium subsp. paratuberculosis
ccgcaacucgggcucgucguu

SEQ ID NO: 864240 - RNA, 15 nt, Mycobacterium avium subsp. paratuberculosis
ccgcaacgggccgca

SEQ ID NO: 864241 - RNA, 17 nt, Mycobacterium avium subsp. paratuberculosis
ccgcaacgggccgcagc

SEQ ID NO: 864242 - RNA, 21 nt, Mycobacterium avium subsp. paratuberculosis
ccgcaacgggccgcagccgcg

SEQ ID NO: 864243 - RNA, 17 nt, Mycobacterium avium subsp. paratuberculosis
ccgcaacuguucgcggc

SEQ ID NO: 864244 - RNA, 13 nt, Mycobacterium avium subsp. paratuberculosis
ccgcaacgcggcg

SEQ ID NO: 864245 - RNA, 15 nt, Mycobacterium avium subsp. paratuberculosis
ccgcaacgcggcggu

SEQ ID NO: 864246 - RNA, 16 nt, Mycobacterium avium subsp. paratuberculosis
ccgcaacgcggcggug

SEQ ID NO: 864247 - RNA, 14 nt, Mycobacterium avium subsp. paratuberculosis
ccgcaacgcugacc

SEQ ID NO: 864248 - RNA, 17 nt, Mycobacterium avium subsp. paratuberculosis
ccgcaacgcugaccgca

SEQ ID NO: 864249 - RNA, 20 nt, Mycobacterium avium subsp. paratuberculosis
ccgcaacgcugaccgcagga

SEQ ID NO: 864250 - RNA, 12 nt, Mycobacterium avium subsp. paratuberculosis
ccgcaacgccgg

SEQ ID NO: 864251 - RNA, 13 nt, Mycobacterium avium subsp. paratuberculosis
ccgcaaccgccgg

SEQ ID NO: 864252 - RNA, 22 nt, Mycobacterium avium subsp. paratuberculosis
ccgcaaccgccggcagcggcug

SEQ ID NO: 864253 - RNA, 13 nt, Mycobacterium avium subsp. paratuberculosis
ccgcaacaccacg

SEQ ID NO: 864254 - RNA, 22 nt, Mycobacterium avium subsp. paratuberculosis
ccgcaacaccacgucggugccg

SEQ ID NO: 864255 - RNA, 14 nt, Mycobacterium avium subsp. paratuberculosis
ccgcaacaccagca

SEQ ID NO: 864256 - RNA, 16 nt, Mycobacterium avium subsp. paratuberculosis
ccgcaacaccagcacg

SEQ ID NO: 864257 - RNA, 23 nt, Mycobacterium avium subsp. paratuberculosis
ccgcaacaccgaaagccgacacc

SEQ ID NO: 864258 - RNA, 17 nt, Mycobacterium avium subsp. paratuberculosis
ccgcaacacggccucga

SEQ ID NO: 864259 - RNA, 17 nt, Mycobacterium avium subsp. paratuberculosis
ccgauuucggccagccg

SEQ ID NO: 864260 - RNA, 13 nt, Mycobacterium avium subsp. paratuberculosis
ccgauugcccgac

SEQ ID NO: 864261 - RNA, 15 nt, Mycobacterium avium subsp. paratuberculosis
ccgauugcccgacuc

SEQ ID NO: 864262 - RNA, 15 nt, Mycobacterium avium subsp. paratuberculosis
ccgauucggcgccgc

SEQ ID NO: 864263 - RNA, 18 nt, Mycobacterium avium subsp. paratuberculosis
ccgauucggcgccgcgac

SEQ ID NO: 864264 - RNA, 19 nt, Mycobacterium avium subsp. paratuberculosis
ccgauucggcgccgcgacc

SEQ ID NO: 864265 - RNA, 14 nt, Mycobacterium avium subsp. paratuberculosis
ccgauuccccggcg

SEQ ID NO: 864266 - RNA, 14 nt, Mycobacterium avium subsp. paratuberculosis
ccgauuccggccgg

SEQ ID NO: 864267 - RNA, 18 nt, Mycobacterium avium subsp. paratuberculosis
ccgauuccggccggccgc

SEQ ID NO: 864268 - RNA, 19 nt, Mycobacterium avium subsp. paratuberculosis
ccgauuccggccggccgcc

SEQ ID NO: 864269 - RNA, 16 nt, Mycobacterium avium subsp. paratuberculosis
ccgcaaacacgagcag

SEQ ID NO: 864270 - RNA, 17 nt, Mycobacterium avium subsp. paratuberculosis
ccgcaaacacgagcaga

SEQ ID NO: 864271 - RNA, 16 nt, Mycobacterium avium subsp. paratuberculosis
ccgcaaagcaccgcga

SEQ ID NO: 864272 - RNA, 21 nt, Mycobacterium avium subsp. paratuberculosis
ccgcaaagcaccgcgaacagc

SEQ ID NO: 864273 - RNA, 17 nt, Mycobacterium avium subsp. paratuberculosis
ccgcaaaucagccgagc

SEQ ID NO: 864274 - RNA, 18 nt, Mycobacterium avium subsp. paratuberculosis
ccgcaaaucagccgagcc

SEQ ID NO: 864275 - RNA, 23 nt, Mycobacterium avium subsp. paratuberculosis
ccgcacuggucgugcuggagcgg

SEQ ID NO: 864276 - RNA, 22 nt, Mycobacterium avium subsp. paratuberculosis
ccgcacuccgucgcgaucacac

SEQ ID NO: 864277 - RNA, 17 nt, Mycobacterium avium subsp. paratuberculosis
ccgcacugaacgggaug

SEQ ID NO: 864278 - RNA, 18 nt, Mycobacterium avium subsp. paratuberculosis
ccgcacugaacgggauga

SEQ ID NO: 864279 - RNA, 16 nt, Mycobacterium avium subsp. paratuberculosis
ccgcacugcaucucga

SEQ ID NO: 864280 - RNA, 21 nt, Mycobacterium avium subsp. paratuberculosis
ccgcacugcaucucgaccugg

SEQ ID NO: 864281 - RNA, 23 nt, Mycobacterium avium subsp. paratuberculosis
ccgcacugcaucucgaccugggu

SEQ ID NO: 864282 - RNA, 15 nt, Mycobacterium avium subsp. paratuberculosis
ccgcacuuggccucg

SEQ ID NO: 864283 - RNA, 20 nt, Mycobacterium avium subsp. paratuberculosis
ccgcacguauccgcggucga

SEQ ID NO: 864284 - RNA, 22 nt, Mycobacterium avium subsp. paratuberculosis
ccgcacguauccgcggucgacc

SEQ ID NO: 864285 - RNA, 23 nt, Mycobacterium avium subsp. paratuberculosis
ccgcacguauccgcggucgacca

SEQ ID NO: 864286 - RNA, 21 nt, Mycobacterium avium subsp. paratuberculosis
ccgcacgucccgcccggcgcc

SEQ ID NO: 864287 - RNA, 16 nt, Mycobacterium avium subsp. paratuberculosis
ccgcacgugcgcgccg

SEQ ID NO: 864288 - RNA, 18 nt, Mycobacterium avium subsp. paratuberculosis
ccgcacgugcgcgccgac

SEQ ID NO: 864289 - RNA, 21 nt, Mycobacterium avium subsp. paratuberculosis
ccgcacgugcgcgccgaccgc

SEQ ID NO: 864290 - RNA, 22 nt, Mycobacterium avium subsp. paratuberculosis
ccgcacguguucucacggcgaa

SEQ ID NO: 864291 - RNA, 13 nt, Mycobacterium avium subsp. paratuberculosis
ccgcacggugcag

SEQ ID NO: 864292 - RNA, 20 nt, Mycobacterium avium subsp. paratuberculosis
ccgcacggugcagcagcgcc

SEQ ID NO: 864293 - RNA, 22 nt, Mycobacterium avium subsp. paratuberculosis
ccgcagauacaucucgguggug

SEQ ID NO: 864294 - RNA, 18 nt, Mycobacterium avium subsp. paratuberculosis
ccgcagauagaucgacgc

SEQ ID NO: 864295 - RNA, 16 nt, Mycobacterium avium subsp. paratuberculosis
ccgcagaucagggcga

SEQ ID NO: 864296 - RNA, 16 nt, Mycobacterium avium subsp. paratuberculosis
ccgcagcaccaggguc

SEQ ID NO: 864297 - RNA, 23 nt, Mycobacterium avium subsp. paratuberculosis
ccgcagcccaggcccagcagcac

SEQ ID NO: 864298 - RNA, 16 nt, Mycobacterium avium subsp. paratuberculosis
ccgcagcccgaccuuc

SEQ ID NO: 864299 - RNA, 15 nt, Mycobacterium avium subsp. paratuberculosis
ccgcagcccgccagg

SEQ ID NO: 864300 - RNA, 20 nt, Mycobacterium avium subsp. paratuberculosis
ccgcagcagcgaggccucgc

SEQ ID NO: 864301 - RNA, 13 nt, Mycobacterium avium subsp. paratuberculosis
ccgcagcacgccc

SEQ ID NO: 864302 - RNA, 15 nt, Mycobacterium avium subsp. paratuberculosis
ccgcagcacgcugaa

SEQ ID NO: 864303 - RNA, 20 nt, Mycobacterium avium subsp. paratuberculosis
ccgcagcacgcugaagccca

SEQ ID NO: 864304 - RNA, 21 nt, Mycobacterium avium subsp. paratuberculosis
ccgcagcacgcugaagcccac

SEQ ID NO: 864305 - RNA, 21 nt, Mycobacterium avium subsp. paratuberculosis
ccgcagcaggugcaucgccac

SEQ ID NO: 864306 - RNA, 19 nt, Mycobacterium avium subsp. paratuberculosis
ccgcagcaucuuggccacg

SEQ ID NO: 864307 - RNA, 20 nt, Mycobacterium avium subsp. paratuberculosis
ccgcacccccuccacacggc

SEQ ID NO: 864308 - RNA, 21 nt, Mycobacterium avium subsp. paratuberculosis
ccgcaccccgugguagacgcc

SEQ ID NO: 864309 - RNA, 23 nt, Mycobacterium avium subsp. paratuberculosis
ccgcaccccgugguagacgccgg

SEQ ID NO: 864310 - RNA, 18 nt, Mycobacterium avium subsp. paratuberculosis
ccgcacccgauccacggc

SEQ ID NO: 864311 - RNA, 21 nt, Mycobacterium avium subsp. paratuberculosis
ccgcacccgauccacggcgac

SEQ ID NO: 864312 - RNA, 23 nt, Mycobacterium avium subsp. paratuberculosis
ccgcaccgagaccaugccgccga

SEQ ID NO: 864313 - RNA, 12 nt, Mycobacterium avium subsp. paratuberculosis
ccgcaccgagcc

SEQ ID NO: 864314 - RNA, 15 nt, Mycobacterium avium subsp. paratuberculosis
ccgcacccguucggc

SEQ ID NO: 864315 - RNA, 19 nt, Mycobacterium avium subsp. paratuberculosis
ccgcacccguucggcgucg

SEQ ID NO: 864316 - RNA, 20 nt, Mycobacterium avium subsp. paratuberculosis
ccgcacccguucggcgucga

SEQ ID NO: 864317 - RNA, 14 nt, Mycobacterium avium subsp. paratuberculosis
ccgcaccgaccagc

SEQ ID NO: 864318 - RNA, 15 nt, Mycobacterium avium subsp. paratuberculosis
ccgcaccgaccagcg

SEQ ID NO: 864319 - RNA, 23 nt, Mycobacterium avium subsp. paratuberculosis
ccgcaccgacgaaaucgucgggc

SEQ ID NO: 864320 - RNA, 12 nt, Mycobacterium avium subsp. paratuberculosis
ccgcaccgccuc

SEQ ID NO: 864321 - RNA, 13 nt, Mycobacterium avium subsp. paratuberculosis
ccgcaccgcgacc

SEQ ID NO: 864322 - RNA, 14 nt, Mycobacterium avium subsp. paratuberculosis
ccgcaccggucucc

SEQ ID NO: 864323 - RNA, 14 nt, Mycobacterium avium subsp. paratuberculosis
ccgcaccgggcagc

SEQ ID NO: 864324 - RNA, 14 nt, Mycobacterium avium subsp. paratuberculosis
ccgcaccggccggc

SEQ ID NO: 864325 - RNA, 12 nt, Mycobacterium avium subsp. paratuberculosis
ccgcaccggccg

SEQ ID NO: 864326 - RNA, 12 nt, Mycobacterium avium subsp. paratuberculosis
ccgcaccggcgc

SEQ ID NO: 864327 - RNA, 13 nt, Mycobacterium avium subsp. paratuberculosis
ccgcaccggcgcc

SEQ ID NO: 864328 - RNA, 14 nt, Mycobacterium avium subsp. paratuberculosis
ccgcaccggcgccg

SEQ ID NO: 864329 - RNA, 17 nt, Mycobacterium avium subsp. paratuberculosis
ccgcaccggcgccgcca

SEQ ID NO: 864330 - RNA, 17 nt, Mycobacterium avium subsp. paratuberculosis
ccgcacgcugucggggu

SEQ ID NO: 864331 - RNA, 19 nt, Mycobacterium avium subsp. paratuberculosis
ccgcacgcugucggggucg

SEQ ID NO: 864332 - RNA, 16 nt, Mycobacterium avium subsp. paratuberculosis
ccgcacggcccaucac

SEQ ID NO: 864333 - RNA, 23 nt, Mycobacterium avium subsp. paratuberculosis
ccgcacgccggguugggcggcgg

SEQ ID NO: 864334 - RNA, 17 nt, Mycobacterium avium subsp. paratuberculosis
ccgcacgcgaacaccag

SEQ ID NO: 864335 - RNA, 16 nt, Mycobacterium avium subsp. paratuberculosis
ccgcacgcgaccgcgu

SEQ ID NO: 864336 - RNA, 19 nt, Mycobacterium avium subsp. paratuberculosis
ccgcacgcgaccgcgucga

SEQ ID NO: 864337 - RNA, 21 nt, Mycobacterium avium subsp. paratuberculosis
ccgcacgcgaccgcgucgacg

SEQ ID NO: 864338 - RNA, 23 nt, Mycobacterium avium subsp. paratuberculosis
ccgcacgcgaccgcgucgacggc

SEQ ID NO: 864339 - RNA, 17 nt, Mycobacterium avium subsp. paratuberculosis
ccgcacgcccgggcaug

SEQ ID NO: 864340 - RNA, 22 nt, Mycobacterium avium subsp. paratuberculosis
ccgcacgcccgggcaugcccgu

SEQ ID NO: 864341 - RNA, 20 nt, Mycobacterium avium subsp. paratuberculosis
ccgcacgaugccgcgcucga

SEQ ID NO: 864342 - RNA, 24 nt, Mycobacterium avium subsp. paratuberculosis
ccgcacgaauugccgguggugcgg

SEQ ID NO: 864343 - RNA, 12 nt, Mycobacterium avium subsp. paratuberculosis
ccgcacgaccug

SEQ ID NO: 864344 - RNA, 21 nt, Mycobacterium avium subsp. paratuberculosis
ccgcaccuggcagcauccgcc

SEQ ID NO: 864345 - RNA, 13 nt, Mycobacterium avium subsp. paratuberculosis
ccgcaccucgccc

SEQ ID NO: 864346 - RNA, 20 nt, Mycobacterium avium subsp. paratuberculosis
ccgcaccucgcccggcucga

SEQ ID NO: 864347 - RNA, 18 nt, Mycobacterium avium subsp. paratuberculosis
ccgcaccucgccggccgc

SEQ ID NO: 864348 - RNA, 14 nt, Mycobacterium avium subsp. paratuberculosis
ccgcaccucgcugg

SEQ ID NO: 864349 - RNA, 22 nt, Mycobacterium avium subsp. paratuberculosis
ccgcaccucgcuggcggcgcgg

SEQ ID NO: 864350 - RNA, 20 nt, Mycobacterium avium subsp. paratuberculosis
ccgcaccgucgugccagcgc

SEQ ID NO: 864351 - RNA, 18 nt, Mycobacterium avium subsp. paratuberculosis
ccgcaccguguagccgac

SEQ ID NO: 864352 - RNA, 20 nt, Mycobacterium avium subsp. paratuberculosis
ccgcaccguguagccgaccg

SEQ ID NO: 864353 - RNA, 23 nt, Mycobacterium avium subsp. paratuberculosis
ccgccccugagggugucggcgau

SEQ ID NO: 864354 - RNA, 13 nt, Mycobacterium avium subsp. paratuberculosis
ccgccccugcugg

SEQ ID NO: 864355 - RNA, 13 nt, Mycobacterium avium subsp. paratuberculosis
ccgccccuguggu

SEQ ID NO: 864356 - RNA, 14 nt, Mycobacterium avium subsp. paratuberculosis
ccgccccgaugcgc

SEQ ID NO: 864357 - RNA, 14 nt, Mycobacterium avium subsp. paratuberculosis
ccgccccgcugccg

SEQ ID NO: 864358 - RNA, 15 nt, Mycobacterium avium subsp. paratuberculosis
ccgcccccgccgcga

SEQ ID NO: 864359 - RNA, 14 nt, Mycobacterium avium subsp. paratuberculosis
ccgcccccgcggcg

SEQ ID NO: 864360 - RNA, 19 nt, Mycobacterium avium subsp. paratuberculosis
ccgcccccgcggcggccau

SEQ ID NO: 864361 - RNA, 17 nt, Mycobacterium avium subsp. paratuberculosis
ccgcccccgcggcgucc

SEQ ID NO: 864362 - RNA, 14 nt, Mycobacterium avium subsp. paratuberculosis
ccgccccgacgauc

SEQ ID NO: 864363 - RNA, 17 nt, Mycobacterium avium subsp. paratuberculosis
ccgccccgacgaucgcg

SEQ ID NO: 864364 - RNA, 20 nt, Mycobacterium avium subsp. paratuberculosis
ccgccccgacgugcagcgcc

SEQ ID NO: 864365 - RNA, 14 nt, Mycobacterium avium subsp. paratuberculosis
ccgcccaucagcag

SEQ ID NO: 864366 - RNA, 14 nt, Mycobacterium avium subsp. paratuberculosis
ccgcccaucgaccg

SEQ ID NO: 864367 - RNA, 14 nt, Mycobacterium avium subsp. paratuberculosis
ccgcccaucggcag

SEQ ID NO: 864368 - RNA, 15 nt, Mycobacterium avium subsp. paratuberculosis
ccgcccaucggcagc

SEQ ID NO: 864369 - RNA, 16 nt, Mycobacterium avium subsp. paratuberculosis
ccgcccaucggcagcc

SEQ ID NO: 864370 - RNA, 22 nt, Mycobacterium avium subsp. paratuberculosis
ccgcccaucggcagcccggagg

SEQ ID NO: 864371 - RNA, 15 nt, Mycobacterium avium subsp. paratuberculosis
ccgcccaugcccaug

SEQ ID NO: 864372 - RNA, 17 nt, Mycobacterium avium subsp. paratuberculosis
ccgccccagcccggcug

SEQ ID NO: 864373 - RNA, 16 nt, Mycobacterium avium subsp. paratuberculosis
ccgccccagccgacca

SEQ ID NO: 864374 - RNA, 19 nt, Mycobacterium avium subsp. paratuberculosis
ccgcccagucgccgccgcg

SEQ ID NO: 864375 - RNA, 19 nt, Mycobacterium avium subsp. paratuberculosis
ccgcccaguugcacggugu

SEQ ID NO: 864376 - RNA, 21 nt, Mycobacterium avium subsp. paratuberculosis
ccgcccaguugcacgguguag

SEQ ID NO: 864377 - RNA, 17 nt, Mycobacterium avium subsp. paratuberculosis
ccgcccaggacccguac

SEQ ID NO: 864378 - RNA, 22 nt, Mycobacterium avium subsp. paratuberculosis
ccgcccaucaccccgaagcuca

SEQ ID NO: 864379 - RNA, 22 nt, Mycobacterium avium subsp. paratuberculosis
ccgcccagcgacucggccagga

SEQ ID NO: 864380 - RNA, 16 nt, Mycobacterium avium subsp. paratuberculosis
ccgcccagcgccacgg

SEQ ID NO: 864381 - RNA, 19 nt, Mycobacterium avium subsp. paratuberculosis
ccgcccagcggccccggcu

SEQ ID NO: 864382 - RNA, 18 nt, Mycobacterium avium subsp. paratuberculosis
ccgcccaggccccggccg

SEQ ID NO: 864383 - RNA, 19 nt, Mycobacterium avium subsp. paratuberculosis
ccgcccaggccccggccga

SEQ ID NO: 864384 - RNA, 22 nt, Mycobacterium avium subsp. paratuberculosis
ccgcccaggccccggccgagcg

SEQ ID NO: 864385 - RNA, 23 nt, Mycobacterium avium subsp. paratuberculosis
ccgcccaggccccggccgagcgc

SEQ ID NO: 864386 - RNA, 14 nt, Mycobacterium avium subsp. paratuberculosis
ccgcccaggccgcc

SEQ ID NO: 864387 - RNA, 15 nt, Mycobacterium avium subsp. paratuberculosis
ccgcccaggccgcca

SEQ ID NO: 864388 - RNA, 16 nt, Mycobacterium avium subsp. paratuberculosis
ccgcccaggcgggcca

SEQ ID NO: 864389 - RNA, 15 nt, Mycobacterium avium subsp. paratuberculosis
ccgcccagcccgcgc

SEQ ID NO: 864390 - RNA, 19 nt, Mycobacterium avium subsp. paratuberculosis
ccgcccacuggucguugca

SEQ ID NO: 864391 - RNA, 22 nt, Mycobacterium avium subsp. paratuberculosis
ccgcccacuucgacggugaugu

SEQ ID NO: 864392 - RNA, 23 nt, Mycobacterium avium subsp. paratuberculosis
ccgcccaccuucccaaccccggg

SEQ ID NO: 864393 - RNA, 15 nt, Mycobacterium avium subsp. paratuberculosis
ccgcccagacgcggg

SEQ ID NO: 864394 - RNA, 19 nt, Mycobacterium avium subsp. paratuberculosis
ccgcccagacgcgggcgcc

SEQ ID NO: 864395 - RNA, 19 nt, Mycobacterium avium subsp. paratuberculosis
ccgcccacgggucgccgau

SEQ ID NO: 864396 - RNA, 14 nt, Mycobacterium avium subsp. paratuberculosis
ccgcccacgccgug

SEQ ID NO: 864397 - RNA, 16 nt, Mycobacterium avium subsp. paratuberculosis
ccgcccacgccgugca

SEQ ID NO: 864398 - RNA, 16 nt, Mycobacterium avium subsp. paratuberculosis
ccgcccacgccgccca

SEQ ID NO: 864399 - RNA, 15 nt, Mycobacterium avium subsp. paratuberculosis
ccgcccaccaccggc

SEQ ID NO: 864400 - RNA, 21 nt, Mycobacterium avium subsp. paratuberculosis
ccgcccaacgacgucggcguc

SEQ ID NO: 864401 - RNA, 20 nt, Mycobacterium avium subsp. paratuberculosis
ccgcccacaccgacaccggc

SEQ ID NO: 864402 - RNA, 22 nt, Mycobacterium avium subsp. paratuberculosis
ccgcccacaccgacaccggccg

SEQ ID NO: 864403 - RNA, 19 nt, Mycobacterium avium subsp. paratuberculosis
ccgcccacauacaccggga

SEQ ID NO: 864404 - RNA, 12 nt, Mycobacterium avium subsp. paratuberculosis
ccgccagcucgu

SEQ ID NO: 864405 - RNA, 15 nt, Mycobacterium avium subsp. paratuberculosis
ccgccagcucgucca

SEQ ID NO: 864406 - RNA, 16 nt, Mycobacterium avium subsp. paratuberculosis
ccgccagcucguccag

SEQ ID NO: 864407 - RNA, 21 nt, Mycobacterium avium subsp. paratuberculosis
ccgccagcucguccagcgugc

SEQ ID NO: 864408 - RNA, 21 nt, Mycobacterium avium subsp. paratuberculosis
ccgccagcgucccguccuggg

SEQ ID NO: 864409 - RNA, 14 nt, Mycobacterium avium subsp. paratuberculosis
ccgccagccgcagc

SEQ ID NO: 864410 - RNA, 17 nt, Mycobacterium avium subsp. paratuberculosis
ccgccagccgcagcagg

SEQ ID NO: 864411 - RNA, 12 nt, Mycobacterium avium subsp. paratuberculosis
ccgccagccgca

SEQ ID NO: 864412 - RNA, 14 nt, Mycobacterium avium subsp. paratuberculosis
ccgccagccaccac

SEQ ID NO: 864413 - RNA, 16 nt, Mycobacterium avium subsp. paratuberculosis
ccgccauggcggcauc

SEQ ID NO: 864414 - RNA, 17 nt, Mycobacterium avium subsp. paratuberculosis
ccgccauggcggcaucc

SEQ ID NO: 864415 - RNA, 18 nt, Mycobacterium avium subsp. paratuberculosis
ccgccaucuccuccgggc

SEQ ID NO: 864416 - RNA, 19 nt, Mycobacterium avium subsp. paratuberculosis
ccgccaucuccuccgggcu

SEQ ID NO: 864417 - RNA, 16 nt, Mycobacterium avium subsp. paratuberculosis
ccgccaucucgggagu

SEQ ID NO: 864418 - RNA, 15 nt, Mycobacterium avium subsp. paratuberculosis
ccgccaucgccucgu

SEQ ID NO: 864419 - RNA, 19 nt, Mycobacterium avium subsp. paratuberculosis
ccgccaucgcggcguugug

SEQ ID NO: 864420 - RNA, 19 nt, Mycobacterium avium subsp. paratuberculosis
ccgccaggaugucguccuc

SEQ ID NO: 864421 - RNA, 13 nt, Mycobacterium avium subsp. paratuberculosis
ccgccacgugcgg

SEQ ID NO: 864422 - RNA, 16 nt, Mycobacterium avium subsp. paratuberculosis
ccgccacgugcggcug

SEQ ID NO: 864423 - RNA, 17 nt, Mycobacterium avium subsp. paratuberculosis
ccgccacgugcggcugc

SEQ ID NO: 864424 - RNA, 12 nt, Mycobacterium avium subsp. paratuberculosis
ccgccacggcgg

SEQ ID NO: 864425 - RNA, 13 nt, Mycobacterium avium subsp. paratuberculosis
ccgccacggcggg

SEQ ID NO: 864426 - RNA, 17 nt, Mycobacterium avium subsp. paratuberculosis
ccgccacggccagcacc

SEQ ID NO: 864427 - RNA, 13 nt, Mycobacterium avium subsp. paratuberculosis
ccgccacggcgcc

SEQ ID NO: 864428 - RNA, 18 nt, Mycobacterium avium subsp. paratuberculosis
ccgccacggggcccgcga

SEQ ID NO: 864429 - RNA, 13 nt, Mycobacterium avium subsp. paratuberculosis
ccgccacgcggcg

SEQ ID NO: 864430 - RNA, 17 nt, Mycobacterium avium subsp. paratuberculosis
ccgccacgcggcgcgca

SEQ ID NO: 864431 - RNA, 17 nt, Mycobacterium avium subsp. paratuberculosis
ccgccacgccguugggc

SEQ ID NO: 864432 - RNA, 14 nt, Mycobacterium avium subsp. paratuberculosis
ccgccagcagcgca

SEQ ID NO: 864433 - RNA, 22 nt, Mycobacterium avium subsp. paratuberculosis
ccgccacgucgaacccgacccc

SEQ ID NO: 864434 - RNA, 22 nt, Mycobacterium avium subsp. paratuberculosis
ccgccagcaccucgcggcagcc

SEQ ID NO: 864435 - RNA, 18 nt, Mycobacterium avium subsp. paratuberculosis
ccgccagcagcacggcaa

SEQ ID NO: 864436 - RNA, 14 nt, Mycobacterium avium subsp. paratuberculosis
ccgccagcagcagc

SEQ ID NO: 864437 - RNA, 16 nt, Mycobacterium avium subsp. paratuberculosis
ccgccagcagcagcgc

SEQ ID NO: 864438 - RNA, 12 nt, Mycobacterium avium subsp. paratuberculosis
ccgccagcagcg

SEQ ID NO: 864439 - RNA, 23 nt, Mycobacterium avium subsp. paratuberculosis
ccgccacaccucggcgaccucgg

SEQ ID NO: 864440 - RNA, 12 nt, Mycobacterium avium subsp. paratuberculosis
ccgccacagcgc

SEQ ID NO: 864441 - RNA, 15 nt, Mycobacterium avium subsp. paratuberculosis
ccgccacagcgccuc

SEQ ID NO: 864442 - RNA, 22 nt, Mycobacterium avium subsp. paratuberculosis
ccgccaccggcccggccggcgc

SEQ ID NO: 864443 - RNA, 15 nt, Mycobacterium avium subsp. paratuberculosis
ccgccaccggccggu

SEQ ID NO: 864444 - RNA, 12 nt, Mycobacterium avium subsp. paratuberculosis
ccgccaccgucg

SEQ ID NO: 864445 - RNA, 17 nt, Mycobacterium avium subsp. paratuberculosis
ccgccaccgucgccggc

SEQ ID NO: 864446 - RNA, 19 nt, Mycobacterium avium subsp. paratuberculosis
ccgccaccgucgccggcug

SEQ ID NO: 864447 - RNA, 16 nt, Mycobacterium avium subsp. paratuberculosis
ccgccacgacgcggcg

SEQ ID NO: 864448 - RNA, 17 nt, Mycobacterium avium subsp. paratuberculosis
ccgccaagugcggugug

SEQ ID NO: 864449 - RNA, 17 nt, Mycobacterium avium subsp. paratuberculosis
ccgccaaucaccgcggu

SEQ ID NO: 864450 - RNA, 18 nt, Mycobacterium avium subsp. paratuberculosis
ccgccaaucaccgcggug

SEQ ID NO: 864451 - RNA, 19 nt, Mycobacterium avium subsp. paratuberculosis
ccgccaaggggaacaacgc

SEQ ID NO: 864452 - RNA, 15 nt, Mycobacterium avium subsp. paratuberculosis
ccgcagcgugggcac

SEQ ID NO: 864453 - RNA, 23 nt, Mycobacterium avium subsp. paratuberculosis
ccgcagcgugggcaccggcaccg

SEQ ID NO: 864454 - RNA, 23 nt, Mycobacterium avium subsp. paratuberculosis
ccgcagcggggcgcuguccuggu

SEQ ID NO: 864455 - RNA, 19 nt, Mycobacterium avium subsp. paratuberculosis
ccgcagcucccccggcgug

SEQ ID NO: 864456 - RNA, 19 nt, Mycobacterium avium subsp. paratuberculosis
ccgcaugaugcggccauga

SEQ ID NO: 864457 - RNA, 21 nt, Mycobacterium avium subsp. paratuberculosis
ccgcaugcaccggugcaccgc

SEQ ID NO: 864458 - RNA, 20 nt, Mycobacterium avium subsp. paratuberculosis
ccgcaucguugguccaggcg

SEQ ID NO: 864459 - RNA, 14 nt, Mycobacterium avium subsp. paratuberculosis
ccgcagcgcggcga

SEQ ID NO: 864460 - RNA, 15 nt, Mycobacterium avium subsp. paratuberculosis
ccgcagcggcgccgc

SEQ ID NO: 864461 - RNA, 18 nt, Mycobacterium avium subsp. paratuberculosis
ccgcagcggcgccgcagc

SEQ ID NO: 864462 - RNA, 13 nt, Mycobacterium avium subsp. paratuberculosis
ccgcagcggcggc

SEQ ID NO: 864463 - RNA, 20 nt, Mycobacterium avium subsp. paratuberculosis
ccgcagcggcggcacgguug

SEQ ID NO: 864464 - RNA, 21 nt, Mycobacterium avium subsp. paratuberculosis
ccgcagcggcggcacgguugg

SEQ ID NO: 864465 - RNA, 15 nt, Mycobacterium avium subsp. paratuberculosis
ccgcagcggcggcuc

SEQ ID NO: 864466 - RNA, 18 nt, Mycobacterium avium subsp. paratuberculosis
ccgcagcggcggcucguc

SEQ ID NO: 864467 - RNA, 16 nt, Mycobacterium avium subsp. paratuberculosis
ccgcagcggcuugacc

SEQ ID NO: 864468 - RNA, 22 nt, Mycobacterium avium subsp. paratuberculosis
ccgcagcggcuugaccggcucg

SEQ ID NO: 864469 - RNA, 24 nt, Mycobacterium avium subsp. paratuberculosis
ccgcagcggcuugaccggcucgcc

SEQ ID NO: 864470 - RNA, 20 nt, Mycobacterium avium subsp. paratuberculosis
ccgcagcgggauuggcgcca

SEQ ID NO: 864471 - RNA, 13 nt, Mycobacterium avium subsp. paratuberculosis
ccgcagcgcccgg

SEQ ID NO: 864472 - RNA, 16 nt, Mycobacterium avium subsp. paratuberculosis
ccgcagcgcccggcag

SEQ ID NO: 864473 - RNA, 17 nt, Mycobacterium avium subsp. paratuberculosis
ccgcagcgcccggcagc

SEQ ID NO: 864474 - RNA, 14 nt, Mycobacterium avium subsp. paratuberculosis
ccgcagcgccucgg

SEQ ID NO: 864475 - RNA, 18 nt, Mycobacterium avium subsp. paratuberculosis
ccgcagcgccucggcgug

SEQ ID NO: 864476 - RNA, 12 nt, Mycobacterium avium subsp. paratuberculosis
ccgcagcgcgac

SEQ ID NO: 864477 - RNA, 16 nt, Mycobacterium avium subsp. paratuberculosis
ccgcagcgcgacgaac

SEQ ID NO: 864478 - RNA, 14 nt, Mycobacterium avium subsp. paratuberculosis
ccgcagcgcgcgac

SEQ ID NO: 864479 - RNA, 17 nt, Mycobacterium avium subsp. paratuberculosis
ccgcagcgcgcgaccgc

SEQ ID NO: 864480 - RNA, 18 nt, Mycobacterium avium subsp. paratuberculosis
ccgcagcgcgcgaccgcg

SEQ ID NO: 864481 - RNA, 21 nt, Mycobacterium avium subsp. paratuberculosis
ccgcagcgcgcgaccgcgaug

SEQ ID NO: 864482 - RNA, 16 nt, Mycobacterium avium subsp. paratuberculosis
ccgcagcgcgcgggug

SEQ ID NO: 864483 - RNA, 15 nt, Mycobacterium avium subsp. paratuberculosis
ccgcaugcccgggcg

SEQ ID NO: 864484 - RNA, 16 nt, Mycobacterium avium subsp. paratuberculosis
ccgcaugcccgggcga

SEQ ID NO: 864485 - RNA, 17 nt, Mycobacterium avium subsp. paratuberculosis
ccgcaugcccgggcgac

SEQ ID NO: 864486 - RNA, 15 nt, Mycobacterium avium subsp. paratuberculosis
ccgcauggccggcga

SEQ ID NO: 864487 - RNA, 17 nt, Mycobacterium avium subsp. paratuberculosis
ccgcauggccggcgaac

SEQ ID NO: 864488 - RNA, 21 nt, Mycobacterium avium subsp. paratuberculosis
ccgcaugcccuugucgcuggc

SEQ ID NO: 864489 - RNA, 21 nt, Mycobacterium avium subsp. paratuberculosis
ccgcauguccggggugagcag

SEQ ID NO: 864490 - RNA, 15 nt, Mycobacterium avium subsp. paratuberculosis
ccgcaugucgaagaa

SEQ ID NO: 864491 - RNA, 18 nt, Mycobacterium avium subsp. paratuberculosis
ccgcaugucgaccucggc

SEQ ID NO: 864492 - RNA, 22 nt, Mycobacterium avium subsp. paratuberculosis
ccgcaugucgaccucggccacc

SEQ ID NO: 864493 - RNA, 17 nt, Mycobacterium avium subsp. paratuberculosis
ccgcauguucucgagcc

SEQ ID NO: 864494 - RNA, 23 nt, Mycobacterium avium subsp. paratuberculosis
ccgcauguugugcccgacggcgc

SEQ ID NO: 864495 - RNA, 22 nt, Mycobacterium avium subsp. paratuberculosis
ccgcauuccgucuuggccaggc

SEQ ID NO: 864496 - RNA, 17 nt, Mycobacterium avium subsp. paratuberculosis
ccgcauuccucggccag

SEQ ID NO: 864497 - RNA, 15 nt, Mycobacterium avium subsp. paratuberculosis
ccgccaaccaggucg

SEQ ID NO: 864498 - RNA, 24 nt, Mycobacterium avium subsp. paratuberculosis
ccgccaaccaggucgcggcgcugc

SEQ ID NO: 864499 - RNA, 20 nt, Mycobacterium avium subsp. paratuberculosis
ccgcauuugccgacaugcug

SEQ ID NO: 864500 - RNA, 23 nt, Mycobacterium avium subsp. paratuberculosis
ccgcauuugccgacaugcugggc

SEQ ID NO: 864501 - RNA, 12 nt, Mycobacterium avium subsp. paratuberculosis
ccgccaaaacgg

SEQ ID NO: 864502 - RNA, 22 nt, Mycobacterium avium subsp. paratuberculosis
ccgccaaaacgggguggaauag

SEQ ID NO: 864503 - RNA, 19 nt, Mycobacterium avium subsp. paratuberculosis
ccgcauucggccgccaccg

SEQ ID NO: 864504 - RNA, 20 nt, Mycobacterium avium subsp. paratuberculosis
ccgauagcuugagccccgcc

SEQ ID NO: 864505 - RNA, 14 nt, Mycobacterium avium subsp. paratuberculosis
ccgaucaacaccgc

SEQ ID NO: 864506 - RNA, 16 nt, Mycobacterium avium subsp. paratuberculosis
ccgaucaacaccgcca

SEQ ID NO: 864507 - RNA, 18 nt, Mycobacterium avium subsp. paratuberculosis
ccgaucaacaccgccagc

SEQ ID NO: 864508 - RNA, 18 nt, Mycobacterium avium subsp. paratuberculosis
ccgauauaggugagaaaa

SEQ ID NO: 864509 - RNA, 16 nt, Mycobacterium avium subsp. paratuberculosis
ccgaucaggaucggcg

SEQ ID NO: 864510 - RNA, 21 nt, Mycobacterium avium subsp. paratuberculosis
ccgaucaggaucggcgggcgc

SEQ ID NO: 864511 - RNA, 19 nt, Mycobacterium avium subsp. paratuberculosis
ccgaucagcggcgggccca

SEQ ID NO: 864512 - RNA, 23 nt, Mycobacterium avium subsp. paratuberculosis
ccgaucagcggcgggcccagcag

SEQ ID NO: 864513 - RNA, 21 nt, Mycobacterium avium subsp. paratuberculosis
ccgaucagcgucagcaccgcg

SEQ ID NO: 864514 - RNA, 22 nt, Mycobacterium avium subsp. paratuberculosis
ccgaucagcgucagcaccgcga

SEQ ID NO: 864515 - RNA, 21 nt, Mycobacterium avium subsp. paratuberculosis
ccgaucaggcuggacaccacg

SEQ ID NO: 864516 - RNA, 13 nt, Mycobacterium avium subsp. paratuberculosis
ccgaucagcggcg

SEQ ID NO: 864517 - RNA, 16 nt, Mycobacterium avium subsp. paratuberculosis
ccgaucaacggcagcg

SEQ ID NO: 864518 - RNA, 23 nt, Mycobacterium avium subsp. paratuberculosis
ccgaucaccaggcccaggccgac

SEQ ID NO: 864519 - RNA, 15 nt, Mycobacterium avium subsp. paratuberculosis
ccgaucaccucgaac

SEQ ID NO: 864520 - RNA, 20 nt, Mycobacterium avium subsp. paratuberculosis
ccgaucaccucgauggccgg

SEQ ID NO: 864521 - RNA, 13 nt, Mycobacterium avium subsp. paratuberculosis
ccgaucaccucgc

SEQ ID NO: 864522 - RNA, 17 nt, Mycobacterium avium subsp. paratuberculosis
ccgaucaccucgccggc

SEQ ID NO: 864523 - RNA, 12 nt, Mycobacterium avium subsp. paratuberculosis
ccgaucaccgcg

SEQ ID NO: 864524 - RNA, 15 nt, Mycobacterium avium subsp. paratuberculosis
ccgaucaccggcacg

SEQ ID NO: 864525 - RNA, 15 nt, Mycobacterium avium subsp. paratuberculosis
ccgaucaccggcagc

SEQ ID NO: 864526 - RNA, 13 nt, Mycobacterium avium subsp. paratuberculosis
ccgaucacgguga

SEQ ID NO: 864527 - RNA, 22 nt, Mycobacterium avium subsp. paratuberculosis
ccgaucagcaccagguugucgc

SEQ ID NO: 864528 - RNA, 14 nt, Mycobacterium avium subsp. paratuberculosis
ccgauccggcgccg

SEQ ID NO: 864529 - RNA, 16 nt, Mycobacterium avium subsp. paratuberculosis
ccgauccgcaccggac

SEQ ID NO: 864530 - RNA, 13 nt, Mycobacterium avium subsp. paratuberculosis
ccgauccgcagcc

SEQ ID NO: 864531 - RNA, 14 nt, Mycobacterium avium subsp. paratuberculosis
ccgauccgcagccg

SEQ ID NO: 864532 - RNA, 17 nt, Mycobacterium avium subsp. paratuberculosis
ccgauccgcagccgcug

SEQ ID NO: 864533 - RNA, 13 nt, Mycobacterium avium subsp. paratuberculosis
ccgauccgccggc

SEQ ID NO: 864534 - RNA, 15 nt, Mycobacterium avium subsp. paratuberculosis
ccgauccgccggcga

SEQ ID NO: 864535 - RNA, 17 nt, Mycobacterium avium subsp. paratuberculosis
ccgauccgccggcgaag

SEQ ID NO: 864536 - RNA, 13 nt, Mycobacterium avium subsp. paratuberculosis
ccgauccgccguu

SEQ ID NO: 864537 - RNA, 21 nt, Mycobacterium avium subsp. paratuberculosis
ccgauccgccguugcggccca

SEQ ID NO: 864538 - RNA, 14 nt, Mycobacterium avium subsp. paratuberculosis
ccgauccgcgccgc

SEQ ID NO: 864539 - RNA, 16 nt, Mycobacterium avium subsp. paratuberculosis
ccgauccgcgccgccg

SEQ ID NO: 864540 - RNA, 16 nt, Mycobacterium avium subsp. paratuberculosis
ccgauccucgccuguc

SEQ ID NO: 864541 - RNA, 18 nt, Mycobacterium avium subsp. paratuberculosis
ccgaucgaggacaccgcg

SEQ ID NO: 864542 - RNA, 15 nt, Mycobacterium avium subsp. paratuberculosis
ccgaucccgggccgu

SEQ ID NO: 864543 - RNA, 15 nt, Mycobacterium avium subsp. paratuberculosis
ccgauccagggcccg

SEQ ID NO: 864544 - RNA, 14 nt, Mycobacterium avium subsp. paratuberculosis
ccgaucccggccac

SEQ ID NO: 864545 - RNA, 16 nt, Mycobacterium avium subsp. paratuberculosis
ccgaucccggccacgu

SEQ ID NO: 864546 - RNA, 19 nt, Mycobacterium avium subsp. paratuberculosis
ccgaucccggccacgucga

SEQ ID NO: 864547 - RNA, 23 nt, Mycobacterium avium subsp. paratuberculosis
ccgaucccggccacgucgaugcc

SEQ ID NO: 864548 - RNA, 16 nt, Mycobacterium avium subsp. paratuberculosis
ccgauccagccgucgu

SEQ ID NO: 864549 - RNA, 19 nt, Mycobacterium avium subsp. paratuberculosis
ccgauccagccgucguugc

SEQ ID NO: 864550 - RNA, 15 nt, Mycobacterium avium subsp. paratuberculosis
ccgauccacggcgac

SEQ ID NO: 864551 - RNA, 16 nt, Mycobacterium avium subsp. paratuberculosis
ccgauccacggcgacc

SEQ ID NO: 864552 - RNA, 17 nt, Mycobacterium avium subsp. paratuberculosis
ccgaucaucucaccgac

SEQ ID NO: 864553 - RNA, 18 nt, Mycobacterium avium subsp. paratuberculosis
ccgaucauggucggcgac

SEQ ID NO: 864554 - RNA, 20 nt, Mycobacterium avium subsp. paratuberculosis
ccgaucauggucggcgacgc

SEQ ID NO: 864555 - RNA, 22 nt, Mycobacterium avium subsp. paratuberculosis
ccgaucgaucagccgcgacagc

SEQ ID NO: 864556 - RNA, 20 nt, Mycobacterium avium subsp. paratuberculosis
ccgaucgaucaucgccucgg

SEQ ID NO: 864557 - RNA, 22 nt, Mycobacterium avium subsp. paratuberculosis
ccgaucgcccgguaggccgccg

SEQ ID NO: 864558 - RNA, 17 nt, Mycobacterium avium subsp. paratuberculosis
ccgaucgccgagucgau

SEQ ID NO: 864559 - RNA, 15 nt, Mycobacterium avium subsp. paratuberculosis
ccgaucgccgcggcg

SEQ ID NO: 864560 - RNA, 21 nt, Mycobacterium avium subsp. paratuberculosis
ccgaucgccgcggcgaucucg

SEQ ID NO: 864561 - RNA, 15 nt, Mycobacterium avium subsp. paratuberculosis
ccgaucgcgcgcagg

SEQ ID NO: 864562 - RNA, 16 nt, Mycobacterium avium subsp. paratuberculosis
ccgaucgcgcgcagga

SEQ ID NO: 864563 - RNA, 13 nt, Mycobacterium avium subsp. paratuberculosis
ccgaucgcggccc

SEQ ID NO: 864564 - RNA, 17 nt, Mycobacterium avium subsp. paratuberculosis
ccgaucgcggcgaucag

SEQ ID NO: 864565 - RNA, 23 nt, Mycobacterium avium subsp. paratuberculosis
ccgaucgcggcgaucagcccggc

SEQ ID NO: 864566 - RNA, 19 nt, Mycobacterium avium subsp. paratuberculosis
ccgaucgcgagggccguug

SEQ ID NO: 864567 - RNA, 16 nt, Mycobacterium avium subsp. paratuberculosis
ccgaucgcgaucaccg

SEQ ID NO: 864568 - RNA, 18 nt, Mycobacterium avium subsp. paratuberculosis
ccgaucgcgaucaccgcg

SEQ ID NO: 864569 - RNA, 20 nt, Mycobacterium avium subsp. paratuberculosis
ccgaucgcgaucaccgcggc

SEQ ID NO: 864570 - RNA, 16 nt, Mycobacterium avium subsp. paratuberculosis
ccgaucgcgucgacga

SEQ ID NO: 864571 - RNA, 20 nt, Mycobacterium avium subsp. paratuberculosis
ccgaucgcgucgacgauggc

SEQ ID NO: 864572 - RNA, 22 nt, Mycobacterium avium subsp. paratuberculosis
ccgaucgcgucgacgauggcgu

SEQ ID NO: 864573 - RNA, 14 nt, Mycobacterium avium subsp. paratuberculosis
ccgaucggcacccg

SEQ ID NO: 864574 - RNA, 22 nt, Mycobacterium avium subsp. paratuberculosis
ccgaucggcacccgcaacacca

SEQ ID NO: 864575 - RNA, 23 nt, Mycobacterium avium subsp. paratuberculosis
ccgaucggcacccgcaacaccac

SEQ ID NO: 864576 - RNA, 18 nt, Mycobacterium avium subsp. paratuberculosis
ccgaucgggaccgucacc

SEQ ID NO: 864577 - RNA, 20 nt, Mycobacterium avium subsp. paratuberculosis
ccgaucgggaccgucaccgu

SEQ ID NO: 864578 - RNA, 21 nt, Mycobacterium avium subsp. paratuberculosis
ccgaucgggaccgucaccgug

SEQ ID NO: 864579 - RNA, 23 nt, Mycobacterium avium subsp. paratuberculosis
ccgaucgggaccgucaccguggc

SEQ ID NO: 864580 - RNA, 18 nt, Mycobacterium avium subsp. paratuberculosis
ccgaucggggccaggaug

SEQ ID NO: 864581 - RNA, 19 nt, Mycobacterium avium subsp. paratuberculosis
ccgaucggggcgcagcccg

SEQ ID NO: 864582 - RNA, 12 nt, Mycobacterium avium subsp. paratuberculosis
ccgaucggcacg

SEQ ID NO: 864583 - RNA, 15 nt, Mycobacterium avium subsp. paratuberculosis
ccgaucggcacgucg

SEQ ID NO: 864584 - RNA, 19 nt, Mycobacterium avium subsp. paratuberculosis
ccgaucggcacgucgagca

SEQ ID NO: 864585 - RNA, 18 nt, Mycobacterium avium subsp. paratuberculosis
ccgauucaaccccgcgcg

SEQ ID NO: 864586 - RNA, 20 nt, Mycobacterium avium subsp. paratuberculosis
ccgauucagccggcgggcgc

SEQ ID NO: 864587 - RNA, 21 nt, Mycobacterium avium subsp. paratuberculosis
ccgauucagccggcgggcgcu

SEQ ID NO: 864588 - RNA, 23 nt, Mycobacterium avium subsp. paratuberculosis
ccgauuccagcaacugcucgacc

SEQ ID NO: 864589 - RNA, 13 nt, Mycobacterium avium subsp. paratuberculosis
ccgaugucggacu

SEQ ID NO: 864590 - RNA, 15 nt, Mycobacterium avium subsp. paratuberculosis
ccgaugucggccggu

SEQ ID NO: 864591 - RNA, 13 nt, Mycobacterium avium subsp. paratuberculosis
ccgaugucgucga

SEQ ID NO: 864592 - RNA, 15 nt, Mycobacterium avium subsp. paratuberculosis
ccgaugucgucgaac

SEQ ID NO: 864593 - RNA, 17 nt, Mycobacterium avium subsp. paratuberculosis
ccgaugucgucgaacgc

SEQ ID NO: 864594 - RNA, 16 nt, Mycobacterium avium subsp. paratuberculosis
ccgaugucugaucgcg

SEQ ID NO: 864595 - RNA, 19 nt, Mycobacterium avium subsp. paratuberculosis
ccgaugugaucggcggcca

SEQ ID NO: 864596 - RNA, 17 nt, Mycobacterium avium subsp. paratuberculosis
ccgauguggcgggcguc

SEQ ID NO: 864597 - RNA, 12 nt, Mycobacterium avium subsp. paratuberculosis
ccgauggucagc

SEQ ID NO: 864598 - RNA, 15 nt, Mycobacterium avium subsp. paratuberculosis
ccgauguaggacagg

SEQ ID NO: 864599 - RNA, 22 nt, Mycobacterium avium subsp. paratuberculosis
ccgauguaggacaggucgcggu

SEQ ID NO: 864600 - RNA, 17 nt, Mycobacterium avium subsp. paratuberculosis
ccgauggugguaccgac

SEQ ID NO: 864601 - RNA, 19 nt, Mycobacterium avium subsp. paratuberculosis
ccgauggugguaccgaccu

SEQ ID NO: 864602 - RNA, 23 nt, Mycobacterium avium subsp. paratuberculosis
ccgaugguguggaucgcuucggc

SEQ ID NO: 864603 - RNA, 16 nt, Mycobacterium avium subsp. paratuberculosis
ccgauggucagcugcc

SEQ ID NO: 864604 - RNA, 19 nt, Mycobacterium avium subsp. paratuberculosis
ccgauggucagcugccgca

SEQ ID NO: 864605 - RNA, 17 nt, Mycobacterium avium subsp. paratuberculosis
ccgauggugaagccgug

SEQ ID NO: 864606 - RNA, 22 nt, Mycobacterium avium subsp. paratuberculosis
ccgauggugaagccgugcacgc

SEQ ID NO: 864607 - RNA, 15 nt, Mycobacterium avium subsp. paratuberculosis
ccgauggugaccucg

SEQ ID NO: 864608 - RNA, 13 nt, Mycobacterium avium subsp. paratuberculosis
ccgauggugacgg

SEQ ID NO: 864609 - RNA, 14 nt, Mycobacterium avium subsp. paratuberculosis
ccgauggugacggu

SEQ ID NO: 864610 - RNA, 16 nt, Mycobacterium avium subsp. paratuberculosis
ccgauggugacggugc

SEQ ID NO: 864611 - RNA, 21 nt, Mycobacterium avium subsp. paratuberculosis
ccgauggcguucaucguccac

SEQ ID NO: 864612 - RNA, 16 nt, Mycobacterium avium subsp. paratuberculosis
ccgauggcgcccagcg

SEQ ID NO: 864613 - RNA, 19 nt, Mycobacterium avium subsp. paratuberculosis
ccgauggcggccugcagga

SEQ ID NO: 864614 - RNA, 14 nt, Mycobacterium avium subsp. paratuberculosis
ccgauggcggcggc

SEQ ID NO: 864615 - RNA, 22 nt, Mycobacterium avium subsp. paratuberculosis
ccgauggcggcggcccgccgcg

SEQ ID NO: 864616 - RNA, 23 nt, Mycobacterium avium subsp. paratuberculosis
ccgauggcggcggcccgccgcgc

SEQ ID NO: 864617 - RNA, 14 nt, Mycobacterium avium subsp. paratuberculosis
ccgauggcggucca

SEQ ID NO: 864618 - RNA, 17 nt, Mycobacterium avium subsp. paratuberculosis
ccgauggccaccgggcg

SEQ ID NO: 864619 - RNA, 17 nt, Mycobacterium avium subsp. paratuberculosis
ccgauggccugguggcc

SEQ ID NO: 864620 - RNA, 18 nt, Mycobacterium avium subsp. paratuberculosis
ccgauggccugguggccc

SEQ ID NO: 864621 - RNA, 13 nt, Mycobacterium avium subsp. paratuberculosis
ccgauggaggugc

SEQ ID NO: 864622 - RNA, 17 nt, Mycobacterium avium subsp. paratuberculosis
ccgauggaggugccgcg

SEQ ID NO: 864623 - RNA, 18 nt, Mycobacterium avium subsp. paratuberculosis
ccgaugcuggccaucgcc

SEQ ID NO: 864624 - RNA, 20 nt, Mycobacterium avium subsp. paratuberculosis
ccgaugcgguugaucaacgg

SEQ ID NO: 864625 - RNA, 19 nt, Mycobacterium avium subsp. paratuberculosis
ccgaugcggugccgggcca

SEQ ID NO: 864626 - RNA, 12 nt, Mycobacterium avium subsp. paratuberculosis
ccgaugcgcccg

SEQ ID NO: 864627 - RNA, 13 nt, Mycobacterium avium subsp. paratuberculosis
ccgaugcgcccgc

SEQ ID NO: 864628 - RNA, 21 nt, Mycobacterium avium subsp. paratuberculosis
ccgaugcgcccgcugcggcgc

SEQ ID NO: 864629 - RNA, 12 nt, Mycobacterium avium subsp. paratuberculosis
ccgaugcgccgc

SEQ ID NO: 864630 - RNA, 19 nt, Mycobacterium avium subsp. paratuberculosis
ccgaugcgccgcaccaguu

SEQ ID NO: 864631 - RNA, 16 nt, Mycobacterium avium subsp. paratuberculosis
ccgaugcccaucacgc

SEQ ID NO: 864632 - RNA, 12 nt, Mycobacterium avium subsp. paratuberculosis
ccgaugcccgac

SEQ ID NO: 864633 - RNA, 14 nt, Mycobacterium avium subsp. paratuberculosis
ccgaugcccgacac

SEQ ID NO: 864634 - RNA, 19 nt, Mycobacterium avium subsp. paratuberculosis
ccgaugcccgacaccgccc

SEQ ID NO: 864635 - RNA, 19 nt, Mycobacterium avium subsp. paratuberculosis
ccgaugccgaacuccgccg

SEQ ID NO: 864636 - RNA, 14 nt, Mycobacterium avium subsp. paratuberculosis
ccgaugccgcgcug

SEQ ID NO: 864637 - RNA, 19 nt, Mycobacterium avium subsp. paratuberculosis
ccgaugccgccgagggcca

SEQ ID NO: 864638 - RNA, 13 nt, Mycobacterium avium subsp. paratuberculosis
ccgaugcccagca

SEQ ID NO: 864639 - RNA, 13 nt, Mycobacterium avium subsp. paratuberculosis
ccgaugcagggcc

SEQ ID NO: 864640 - RNA, 19 nt, Mycobacterium avium subsp. paratuberculosis
ccgaugcagggccgaaaaa

SEQ ID NO: 864641 - RNA, 16 nt, Mycobacterium avium subsp. paratuberculosis
ccgaugaugaugccgc

SEQ ID NO: 864642 - RNA, 19 nt, Mycobacterium avium subsp. paratuberculosis
ccgaugaugguggcggcca

SEQ ID NO: 864643 - RNA, 15 nt, Mycobacterium avium subsp. paratuberculosis
ccgaugaucgagcac

SEQ ID NO: 864644 - RNA, 17 nt, Mycobacterium avium subsp. paratuberculosis
ccgaugacguugcgcgc

SEQ ID NO: 864645 - RNA, 18 nt, Mycobacterium avium subsp. paratuberculosis
ccgaugagccucagcgcg

SEQ ID NO: 864646 - RNA, 19 nt, Mycobacterium avium subsp. paratuberculosis
ccgaugagccucagcgcgc

SEQ ID NO: 864647 - RNA, 15 nt, Mycobacterium avium subsp. paratuberculosis
ccgaugaccggcccg

SEQ ID NO: 864648 - RNA, 17 nt, Mycobacterium avium subsp. paratuberculosis
ccgaugaagaacacccc

SEQ ID NO: 864649 - RNA, 20 nt, Mycobacterium avium subsp. paratuberculosis
ccgaugaagaacaccccgac

SEQ ID NO: 864650 - RNA, 19 nt, Mycobacterium avium subsp. paratuberculosis
ccgaugacgagcagcgugc

SEQ ID NO: 864651 - RNA, 14 nt, Mycobacterium avium subsp. paratuberculosis
ccgaugaccgcggc

SEQ ID NO: 864652 - RNA, 15 nt, Mycobacterium avium subsp. paratuberculosis
ccgaugaccgcggcg

SEQ ID NO: 864653 - RNA, 23 nt, Mycobacterium avium subsp. paratuberculosis
ccgaucuuggcgagcugaccggc

SEQ ID NO: 864654 - RNA, 13 nt, Mycobacterium avium subsp. paratuberculosis
ccgaucuugucga

SEQ ID NO: 864655 - RNA, 22 nt, Mycobacterium avium subsp. paratuberculosis
ccgaucugcucgaugcggcccu

SEQ ID NO: 864656 - RNA, 20 nt, Mycobacterium avium subsp. paratuberculosis
ccgaucuggcgaucgaugcc

SEQ ID NO: 864657 - RNA, 20 nt, Mycobacterium avium subsp. paratuberculosis
ccgaucugggaucggugcgc

SEQ ID NO: 864658 - RNA, 16 nt, Mycobacterium avium subsp. paratuberculosis
ccgaucucgcgcgggu

SEQ ID NO: 864659 - RNA, 14 nt, Mycobacterium avium subsp. paratuberculosis
ccgaucucgcgguc

SEQ ID NO: 864660 - RNA, 17 nt, Mycobacterium avium subsp. paratuberculosis
ccgaucucguagcccac

SEQ ID NO: 864661 - RNA, 14 nt, Mycobacterium avium subsp. paratuberculosis
ccgaucucgucggu

SEQ ID NO: 864662 - RNA, 18 nt, Mycobacterium avium subsp. paratuberculosis
ccgaucuccaccgagugc

SEQ ID NO: 864663 - RNA, 15 nt, Mycobacterium avium subsp. paratuberculosis
ccgaucucgaccagc

SEQ ID NO: 864664 - RNA, 17 nt, Mycobacterium avium subsp. paratuberculosis
ccgaucucgaccagcgc

SEQ ID NO: 864665 - RNA, 13 nt, Mycobacterium avium subsp. paratuberculosis
ccgaucgacgaau

SEQ ID NO: 864666 - RNA, 15 nt, Mycobacterium avium subsp. paratuberculosis
ccgaucguccggcgc

SEQ ID NO: 864667 - RNA, 15 nt, Mycobacterium avium subsp. paratuberculosis
ccgaucgugacgccg

SEQ ID NO: 864668 - RNA, 23 nt, Mycobacterium avium subsp. paratuberculosis
ccgaucgugacgccguccgacgu

SEQ ID NO: 864669 - RNA, 15 nt, Mycobacterium avium subsp. paratuberculosis
ccgaacaccacgccg

SEQ ID NO: 864670 - RNA, 15 nt, Mycobacterium avium subsp. paratuberculosis
ccgaacaccggcagc

SEQ ID NO: 864671 - RNA, 17 nt, Mycobacterium avium subsp. paratuberculosis
ccgaacaccggcagcgc

SEQ ID NO: 864672 - RNA, 12 nt, Mycobacterium avium subsp. paratuberculosis
ccgaacaccguc

SEQ ID NO: 864673 - RNA, 13 nt, Mycobacterium avium subsp. paratuberculosis
ccgaacaccguca

SEQ ID NO: 864674 - RNA, 14 nt, Mycobacterium avium subsp. paratuberculosis
ccgaacacggccgc

SEQ ID NO: 864675 - RNA, 15 nt, Mycobacterium avium subsp. paratuberculosis
ccgaacacgggcggc

SEQ ID NO: 864676 - RNA, 16 nt, Mycobacterium avium subsp. paratuberculosis
ccgaacacgggcggca

SEQ ID NO: 864677 - RNA, 14 nt, Mycobacterium avium subsp. paratuberculosis
ccgaacagccgggc

SEQ ID NO: 864678 - RNA, 20 nt, Mycobacterium avium subsp. paratuberculosis
ccgaacagccgggccagcag

SEQ ID NO: 864679 - RNA, 19 nt, Mycobacterium avium subsp. paratuberculosis
ccgaacagccgggcggccg

SEQ ID NO: 864680 - RNA, 16 nt, Mycobacterium avium subsp. paratuberculosis
ccgaacagcagcgcgc

SEQ ID NO: 864681 - RNA, 23 nt, Mycobacterium avium subsp. paratuberculosis
ccgaacaccugcggcggcagucg

SEQ ID NO: 864682 - RNA, 18 nt, Mycobacterium avium subsp. paratuberculosis
ccgaaaguccccgggugg

SEQ ID NO: 864683 - RNA, 18 nt, Mycobacterium avium subsp. paratuberculosis
ccgaaagcccccagcucu

SEQ ID NO: 864684 - RNA, 13 nt, Mycobacterium avium subsp. paratuberculosis
ccgaaagccgaca

SEQ ID NO: 864685 - RNA, 16 nt, Mycobacterium avium subsp. paratuberculosis
ccgaaagccguaccgc

SEQ ID NO: 864686 - RNA, 19 nt, Mycobacterium avium subsp. paratuberculosis
ccgaaaugcaucagcguga

SEQ ID NO: 864687 - RNA, 15 nt, Mycobacterium avium subsp. paratuberculosis
ccgaacaacagggcc

SEQ ID NO: 864688 - RNA, 18 nt, Mycobacterium avium subsp. paratuberculosis
ccgaacaacagggccgcg

SEQ ID NO: 864689 - RNA, 19 nt, Mycobacterium avium subsp. paratuberculosis
ccgaacaacagggccgcgc

SEQ ID NO: 864690 - RNA, 23 nt, Mycobacterium avium subsp. paratuberculosis
ccgaacaacagggccgcgcgggc

SEQ ID NO: 864691 - RNA, 17 nt, Mycobacterium avium subsp. paratuberculosis
ccgaacaacggcggacc

SEQ ID NO: 864692 - RNA, 23 nt, Mycobacterium avium subsp. paratuberculosis
ccgaacaacugaccgauggccgc

SEQ ID NO: 864693 - RNA, 14 nt, Mycobacterium avium subsp. paratuberculosis
ccgagccggcggcg

SEQ ID NO: 864694 - RNA, 18 nt, Mycobacterium avium subsp. paratuberculosis
ccgagccggcgucgccgc

SEQ ID NO: 864695 - RNA, 19 nt, Mycobacterium avium subsp. paratuberculosis
ccgagccggcacggccggc

SEQ ID NO: 864696 - RNA, 21 nt, Mycobacterium avium subsp. paratuberculosis
ccgagccgcuugguggcgccg

SEQ ID NO: 864697 - RNA, 22 nt, Mycobacterium avium subsp. paratuberculosis
ccgagccgcuugguggcgccgg

SEQ ID NO: 864698 - RNA, 11 nt, Mycobacterium avium subsp. paratuberculosis
ccgagccgggc

SEQ ID NO: 864699 - RNA, 14 nt, Mycobacterium avium subsp. paratuberculosis
ccgagccgggcagc

SEQ ID NO: 864700 - RNA, 18 nt, Mycobacterium avium subsp. paratuberculosis
ccgagccgggcagcgcga

SEQ ID NO: 864701 - RNA, 13 nt, Mycobacterium avium subsp. paratuberculosis
ccgagccgggcca

SEQ ID NO: 864702 - RNA, 17 nt, Mycobacterium avium subsp. paratuberculosis
ccgagccgggcggccag

SEQ ID NO: 864703 - RNA, 18 nt, Mycobacterium avium subsp. paratuberculosis
ccgagccgggcggccagc

SEQ ID NO: 864704 - RNA, 11 nt, Mycobacterium avium subsp. paratuberculosis
ccgagccgccc

SEQ ID NO: 864705 - RNA, 13 nt, Mycobacterium avium subsp. paratuberculosis
ccgagccgcgcca

SEQ ID NO: 864706 - RNA, 16 nt, Mycobacterium avium subsp. paratuberculosis
ccgagccgcgcgccga

SEQ ID NO: 864707 - RNA, 21 nt, Mycobacterium avium subsp. paratuberculosis
ccgagccgcggauggccucgg

SEQ ID NO: 864708 - RNA, 12 nt, Mycobacterium avium subsp. paratuberculosis
ccgagccgcggg

SEQ ID NO: 864709 - RNA, 13 nt, Mycobacterium avium subsp. paratuberculosis
ccgagccgcgggu

SEQ ID NO: 864710 - RNA, 21 nt, Mycobacterium avium subsp. paratuberculosis
ccgagcccuuugcgcugcccg

SEQ ID NO: 864711 - RNA, 23 nt, Mycobacterium avium subsp. paratuberculosis
ccgagcccuuugcgcugcccgau

SEQ ID NO: 864712 - RNA, 14 nt, Mycobacterium avium subsp. paratuberculosis
ccgagcccgacggc

SEQ ID NO: 864713 - RNA, 17 nt, Mycobacterium avium subsp. paratuberculosis
ccgagcccgacggcagc

SEQ ID NO: 864714 - RNA, 15 nt, Mycobacterium avium subsp. paratuberculosis
ccgagcccgccggcg

SEQ ID NO: 864715 - RNA, 16 nt, Mycobacterium avium subsp. paratuberculosis
ccgagcccgccggcgg

SEQ ID NO: 864716 - RNA, 19 nt, Mycobacterium avium subsp. paratuberculosis
ccgagcccgccggcggcga

SEQ ID NO: 864717 - RNA, 17 nt, Mycobacterium avium subsp. paratuberculosis
ccgagcauuucgcgcac

SEQ ID NO: 864718 - RNA, 22 nt, Mycobacterium avium subsp. paratuberculosis
ccgagcauuucgcgcacgucga

SEQ ID NO: 864719 - RNA, 13 nt, Mycobacterium avium subsp. paratuberculosis
ccgagcggcgcug

SEQ ID NO: 864720 - RNA, 14 nt, Mycobacterium avium subsp. paratuberculosis
ccgagcggcgcugc

SEQ ID NO: 864721 - RNA, 20 nt, Mycobacterium avium subsp. paratuberculosis
ccgagcggcgcugcagcagc

SEQ ID NO: 864722 - RNA, 16 nt, Mycobacterium avium subsp. paratuberculosis
ccgagcugaucgcggc

SEQ ID NO: 864723 - RNA, 19 nt, Mycobacterium avium subsp. paratuberculosis
ccgagcugaucgcggccgg

SEQ ID NO: 864724 - RNA, 17 nt, Mycobacterium avium subsp. paratuberculosis
ccgagcugggccggcgc

SEQ ID NO: 864725 - RNA, 19 nt, Mycobacterium avium subsp. paratuberculosis
ccgagcugggccggcgccg

SEQ ID NO: 864726 - RNA, 17 nt, Mycobacterium avium subsp. paratuberculosis
ccgagcuugggccggug

SEQ ID NO: 864727 - RNA, 12 nt, Mycobacterium avium subsp. paratuberculosis
ccgagcucggcc

SEQ ID NO: 864728 - RNA, 15 nt, Mycobacterium avium subsp. paratuberculosis
ccgagcucgggcgcg

SEQ ID NO: 864729 - RNA, 21 nt, Mycobacterium avium subsp. paratuberculosis
ccgagcucgggcgcgaacagc

SEQ ID NO: 864730 - RNA, 12 nt, Mycobacterium avium subsp. paratuberculosis
ccgagcgucacg

SEQ ID NO: 864731 - RNA, 14 nt, Mycobacterium avium subsp. paratuberculosis
ccgagcgucacgcc

SEQ ID NO: 864732 - RNA, 20 nt, Mycobacterium avium subsp. paratuberculosis
ccgagcgucacgccagcgug

SEQ ID NO: 864733 - RNA, 21 nt, Mycobacterium avium subsp. paratuberculosis
ccgagcgucacgccagcguga

SEQ ID NO: 864734 - RNA, 20 nt, Mycobacterium avium subsp. paratuberculosis
ccgagcgucacgcuagcgug

SEQ ID NO: 864735 - RNA, 21 nt, Mycobacterium avium subsp. paratuberculosis
ccgagcgucacgcuagcguga

SEQ ID NO: 864736 - RNA, 17 nt, Mycobacterium avium subsp. paratuberculosis
ccgagcgucacgcuggc

SEQ ID NO: 864737 - RNA, 20 nt, Mycobacterium avium subsp. paratuberculosis
ccgagcgucacgcuggcgug

SEQ ID NO: 864738 - RNA, 19 nt, Mycobacterium avium subsp. paratuberculosis
ccgagcgucauuccgccgc

SEQ ID NO: 864739 - RNA, 20 nt, Mycobacterium avium subsp. paratuberculosis
ccgagcgucauuccgccgcg

SEQ ID NO: 864740 - RNA, 21 nt, Mycobacterium avium subsp. paratuberculosis
ccgagcgugcauucagugcga

SEQ ID NO: 864741 - RNA, 12 nt, Mycobacterium avium subsp. paratuberculosis
ccgagcgggccg

SEQ ID NO: 864742 - RNA, 23 nt, Mycobacterium avium subsp. paratuberculosis
ccgagcgggccguggcaccgggu

SEQ ID NO: 864743 - RNA, 12 nt, Mycobacterium avium subsp. paratuberculosis
ccgagcgggccu

SEQ ID NO: 864744 - RNA, 13 nt, Mycobacterium avium subsp. paratuberculosis
ccgagcggggugu

SEQ ID NO: 864745 - RNA, 20 nt, Mycobacterium avium subsp. paratuberculosis
ccgagcgggguguggcuguc

SEQ ID NO: 864746 - RNA, 18 nt, Mycobacterium avium subsp. paratuberculosis
ccgagcggcaucaguucg

SEQ ID NO: 864747 - RNA, 14 nt, Mycobacterium avium subsp. paratuberculosis
ccgagcggaugccg

SEQ ID NO: 864748 - RNA, 20 nt, Mycobacterium avium subsp. paratuberculosis
ccgagcggaugccguagcgc

SEQ ID NO: 864749 - RNA, 13 nt, Mycobacterium avium subsp. paratuberculosis
ccgagcggccguc

SEQ ID NO: 864750 - RNA, 15 nt, Mycobacterium avium subsp. paratuberculosis
ccgagcggcgcaggc

SEQ ID NO: 864751 - RNA, 18 nt, Mycobacterium avium subsp. paratuberculosis
ccgagcgcugguugucga

SEQ ID NO: 864752 - RNA, 17 nt, Mycobacterium avium subsp. paratuberculosis
ccgagcgcgccgccgcc

SEQ ID NO: 864753 - RNA, 12 nt, Mycobacterium avium subsp. paratuberculosis
ccgagcgcgcga

SEQ ID NO: 864754 - RNA, 14 nt, Mycobacterium avium subsp. paratuberculosis
ccgagcgcgccgcc

SEQ ID NO: 864755 - RNA, 21 nt, Mycobacterium avium subsp. paratuberculosis
ccgagcgccgcguucacccgc

SEQ ID NO: 864756 - RNA, 14 nt, Mycobacterium avium subsp. paratuberculosis
ccgagcgcaccgcg

SEQ ID NO: 864757 - RNA, 15 nt, Mycobacterium avium subsp. paratuberculosis
ccgagcgcaccgcgg

SEQ ID NO: 864758 - RNA, 23 nt, Mycobacterium avium subsp. paratuberculosis
ccgagccugggauugccgggcac

SEQ ID NO: 864759 - RNA, 19 nt, Mycobacterium avium subsp. paratuberculosis
ccgagccgguccgaccagc

SEQ ID NO: 864760 - RNA, 21 nt, Mycobacterium avium subsp. paratuberculosis
ccgagccggugaugacgucgc

SEQ ID NO: 864761 - RNA, 20 nt, Mycobacterium avium subsp. paratuberculosis
ccgagcccugcgccagcagc

SEQ ID NO: 864762 - RNA, 14 nt, Mycobacterium avium subsp. paratuberculosis
ccgaggaggccgcg

SEQ ID NO: 864763 - RNA, 21 nt, Mycobacterium avium subsp. paratuberculosis
ccgaggauggggucgcgggcg

SEQ ID NO: 864764 - RNA, 22 nt, Mycobacterium avium subsp. paratuberculosis
ccgaggauuucgcgaucgagga

SEQ ID NO: 864765 - RNA, 22 nt, Mycobacterium avium subsp. paratuberculosis
ccgaggcaaucgagcgggcggg

SEQ ID NO: 864766 - RNA, 16 nt, Mycobacterium avium subsp. paratuberculosis
ccgaggaugaccgcgg

SEQ ID NO: 864767 - RNA, 18 nt, Mycobacterium avium subsp. paratuberculosis
ccgaggaugaccgcggcg

SEQ ID NO: 864768 - RNA, 19 nt, Mycobacterium avium subsp. paratuberculosis
ccgaggaugccgcccacca

SEQ ID NO: 864769 - RNA, 20 nt, Mycobacterium avium subsp. paratuberculosis
ccgaggaugccgcccaccac

SEQ ID NO: 864770 - RNA, 22 nt, Mycobacterium avium subsp. paratuberculosis
ccgaggaugccgcccaccaccg

SEQ ID NO: 864771 - RNA, 12 nt, Mycobacterium avium subsp. paratuberculosis
ccgaggaaccgg

SEQ ID NO: 864772 - RNA, 16 nt, Mycobacterium avium subsp. paratuberculosis
ccgaggaaccggcagc

SEQ ID NO: 864773 - RNA, 19 nt, Mycobacterium avium subsp. paratuberculosis
ccgaggaaccggcagccgg

SEQ ID NO: 864774 - RNA, 18 nt, Mycobacterium avium subsp. paratuberculosis
ccgaggaacugcagcgac

SEQ ID NO: 864775 - RNA, 21 nt, Mycobacterium avium subsp. paratuberculosis
ccgaggagguuuugcgugguc

SEQ ID NO: 864776 - RNA, 16 nt, Mycobacterium avium subsp. paratuberculosis
ccgaggccagcacgcc

SEQ ID NO: 864777 - RNA, 16 nt, Mycobacterium avium subsp. paratuberculosis
ccgaggccgauggcgc

SEQ ID NO: 864778 - RNA, 21 nt, Mycobacterium avium subsp. paratuberculosis
ccgaggccgauggcgcccagc

SEQ ID NO: 864779 - RNA, 21 nt, Mycobacterium avium subsp. paratuberculosis
ccgaggcgaagguggcgucgg

SEQ ID NO: 864780 - RNA, 14 nt, Mycobacterium avium subsp. paratuberculosis
ccgaggcgagugag

SEQ ID NO: 864781 - RNA, 14 nt, Mycobacterium avium subsp. paratuberculosis
ccgaggcgcucgca

SEQ ID NO: 864782 - RNA, 14 nt, Mycobacterium avium subsp. paratuberculosis
ccgagggccagcag

SEQ ID NO: 864783 - RNA, 15 nt, Mycobacterium avium subsp. paratuberculosis
ccgagggccagcagc

SEQ ID NO: 864784 - RNA, 19 nt, Mycobacterium avium subsp. paratuberculosis
ccgagggcccgggcaggca

SEQ ID NO: 864785 - RNA, 15 nt, Mycobacterium avium subsp. paratuberculosis
ccgagggcggcggcu

SEQ ID NO: 864786 - RNA, 14 nt, Mycobacterium avium subsp. paratuberculosis
ccgaggcgaucgcg

SEQ ID NO: 864787 - RNA, 17 nt, Mycobacterium avium subsp. paratuberculosis
ccgaggcgaucgcggcc

SEQ ID NO: 864788 - RNA, 16 nt, Mycobacterium avium subsp. paratuberculosis
ccgaggcgcaacaccg

SEQ ID NO: 864789 - RNA, 21 nt, Mycobacterium avium subsp. paratuberculosis
ccgaggcgucagggguuggcg

SEQ ID NO: 864790 - RNA, 13 nt, Mycobacterium avium subsp. paratuberculosis
ccgaggucgccga

SEQ ID NO: 864791 - RNA, 18 nt, Mycobacterium avium subsp. paratuberculosis
ccgaggucgccgacgccg

SEQ ID NO: 864792 - RNA, 21 nt, Mycobacterium avium subsp. paratuberculosis
ccgaggguucgguggccccgg

SEQ ID NO: 864793 - RNA, 15 nt, Mycobacterium avium subsp. paratuberculosis
ccgagguagccgcgc

SEQ ID NO: 864794 - RNA, 17 nt, Mycobacterium avium subsp. paratuberculosis
ccgagguagccgcgcac

SEQ ID NO: 864795 - RNA, 17 nt, Mycobacterium avium subsp. paratuberculosis
ccgagguagggccgggu

SEQ ID NO: 864796 - RNA, 17 nt, Mycobacterium avium subsp. paratuberculosis
ccgagguagucggccuc

SEQ ID NO: 864797 - RNA, 14 nt, Mycobacterium avium subsp. paratuberculosis
ccgagggcgcggga

SEQ ID NO: 864798 - RNA, 21 nt, Mycobacterium avium subsp. paratuberculosis
ccgagggggaagucgaccggg

SEQ ID NO: 864799 - RNA, 18 nt, Mycobacterium avium subsp. paratuberculosis
ccgagggguccggggcac

SEQ ID NO: 864800 - RNA, 14 nt, Mycobacterium avium subsp. paratuberculosis
ccgagggugccggc

SEQ ID NO: 864801 - RNA, 20 nt, Mycobacterium avium subsp. paratuberculosis
ccgagggugccggccaccgg

SEQ ID NO: 864802 - RNA, 22 nt, Mycobacterium avium subsp. paratuberculosis
ccgagggugccggccaccggcg

SEQ ID NO: 864803 - RNA, 17 nt, Mycobacterium avium subsp. paratuberculosis
ccgaguauccgcgcagc

SEQ ID NO: 864804 - RNA, 20 nt, Mycobacterium avium subsp. paratuberculosis
ccgaguauccgcgcagcguc

SEQ ID NO: 864805 - RNA, 21 nt, Mycobacterium avium subsp. paratuberculosis
ccgagucacccggcuggccgc

SEQ ID NO: 864806 - RNA, 14 nt, Mycobacterium avium subsp. paratuberculosis
ccgaguccacgacg

SEQ ID NO: 864807 - RNA, 22 nt, Mycobacterium avium subsp. paratuberculosis
ccgaguccacgacguccucgac

SEQ ID NO: 864808 - RNA, 18 nt, Mycobacterium avium subsp. paratuberculosis
ccgaggugcugucgucgc

SEQ ID NO: 864809 - RNA, 18 nt, Mycobacterium avium subsp. paratuberculosis
ccgagguggcccagccgc

SEQ ID NO: 864810 - RNA, 14 nt, Mycobacterium avium subsp. paratuberculosis
ccgagguggccgcc

SEQ ID NO: 864811 - RNA, 16 nt, Mycobacterium avium subsp. paratuberculosis
ccgagguggccgccag

SEQ ID NO: 864812 - RNA, 13 nt, Mycobacterium avium subsp. paratuberculosis
ccgaggugccgcg

SEQ ID NO: 864813 - RNA, 22 nt, Mycobacterium avium subsp. paratuberculosis
ccgaggucuuucaucgccccgg

SEQ ID NO: 864814 - RNA, 23 nt, Mycobacterium avium subsp. paratuberculosis
ccgaggugaauaccacugcgcgc

SEQ ID NO: 864815 - RNA, 17 nt, Mycobacterium avium subsp. paratuberculosis
ccgaggugacgaggccc

SEQ ID NO: 864816 - RNA, 19 nt, Mycobacterium avium subsp. paratuberculosis
ccgaggugacgucgcgccg

SEQ ID NO: 864817 - RNA, 13 nt, Mycobacterium avium subsp. paratuberculosis
ccgaggugaucgc

SEQ ID NO: 864818 - RNA, 17 nt, Mycobacterium avium subsp. paratuberculosis
ccgaggugcaacacucg

SEQ ID NO: 864819 - RNA, 18 nt, Mycobacterium avium subsp. paratuberculosis
ccgaggugcaacacucga

SEQ ID NO: 864820 - RNA, 17 nt, Mycobacterium avium subsp. paratuberculosis
ccgaggucaccgcgacc

SEQ ID NO: 864821 - RNA, 17 nt, Mycobacterium avium subsp. paratuberculosis
ccgaggucaccgcggga

SEQ ID NO: 864822 - RNA, 18 nt, Mycobacterium avium subsp. paratuberculosis
ccgaggucauaucgacgg

SEQ ID NO: 864823 - RNA, 19 nt, Mycobacterium avium subsp. paratuberculosis
ccgaggucauaucgacggc

SEQ ID NO: 864824 - RNA, 22 nt, Mycobacterium avium subsp. paratuberculosis
ccgaggucauaucgacggcccc

SEQ ID NO: 864825 - RNA, 14 nt, Mycobacterium avium subsp. paratuberculosis
ccgagucggcgucg

SEQ ID NO: 864826 - RNA, 12 nt, Mycobacterium avium subsp. paratuberculosis
ccgagucgucgc

SEQ ID NO: 864827 - RNA, 14 nt, Mycobacterium avium subsp. paratuberculosis
ccgagucgucgcgc

SEQ ID NO: 864828 - RNA, 17 nt, Mycobacterium avium subsp. paratuberculosis
ccgagucgucgcgcacc

SEQ ID NO: 864829 - RNA, 17 nt, Mycobacterium avium subsp. paratuberculosis
ccgagugcggcgcggug

SEQ ID NO: 864830 - RNA, 15 nt, Mycobacterium avium subsp. paratuberculosis
ccgaguccgggccgc

SEQ ID NO: 864831 - RNA, 12 nt, Mycobacterium avium subsp. paratuberculosis
ccgagucgacgu

SEQ ID NO: 864832 - RNA, 18 nt, Mycobacterium avium subsp. paratuberculosis
ccgagucgacgugcucgg

SEQ ID NO: 864833 - RNA, 20 nt, Mycobacterium avium subsp. paratuberculosis
ccgagucgacgugcucggcg

SEQ ID NO: 864834 - RNA, 15 nt, Mycobacterium avium subsp. paratuberculosis
ccgagucgaucgcca

SEQ ID NO: 864835 - RNA, 16 nt, Mycobacterium avium subsp. paratuberculosis
ccgagucgaucgccag

SEQ ID NO: 864836 - RNA, 17 nt, Mycobacterium avium subsp. paratuberculosis
ccgagucgaucgccagc

SEQ ID NO: 864837 - RNA, 21 nt, Mycobacterium avium subsp. paratuberculosis
ccgagucgaucgccagcgcgc

SEQ ID NO: 864838 - RNA, 14 nt, Mycobacterium avium subsp. paratuberculosis
ccgagucgcgcgac

SEQ ID NO: 864839 - RNA, 15 nt, Mycobacterium avium subsp. paratuberculosis
ccgagucgcgcgacc

SEQ ID NO: 864840 - RNA, 22 nt, Mycobacterium avium subsp. paratuberculosis
ccgagucgcgcgaccaguaccg

SEQ ID NO: 864841 - RNA, 12 nt, Mycobacterium avium subsp. paratuberculosis
ccgagucgcugc

SEQ ID NO: 864842 - RNA, 16 nt, Mycobacterium avium subsp. paratuberculosis
ccgaguuuggcgucga

SEQ ID NO: 864843 - RNA, 19 nt, Mycobacterium avium subsp. paratuberculosis
ccgaguugauaggucacgc

SEQ ID NO: 864844 - RNA, 23 nt, Mycobacterium avium subsp. paratuberculosis
ccgaguugauaggucacgccggg

SEQ ID NO: 864845 - RNA, 14 nt, Mycobacterium avium subsp. paratuberculosis
ccgaguuggccggc

SEQ ID NO: 864846 - RNA, 19 nt, Mycobacterium avium subsp. paratuberculosis
ccgaguuggccggcacucg

SEQ ID NO: 864847 - RNA, 13 nt, Mycobacterium avium subsp. paratuberculosis
ccgaguggcgccg

SEQ ID NO: 864848 - RNA, 19 nt, Mycobacterium avium subsp. paratuberculosis
ccgagugggaccgucggca

SEQ ID NO: 864849 - RNA, 18 nt, Mycobacterium avium subsp. paratuberculosis
ccgaguuccugcgaccgc

SEQ ID NO: 864850 - RNA, 20 nt, Mycobacterium avium subsp. paratuberculosis
ccgaguuccugcgaccgccg

SEQ ID NO: 864851 - RNA, 18 nt, Mycobacterium avium subsp. paratuberculosis
ccgaguucgaccucggug

SEQ ID NO: 864852 - RNA, 13 nt, Mycobacterium avium subsp. paratuberculosis
ccgaguucggcca

SEQ ID NO: 864853 - RNA, 14 nt, Mycobacterium avium subsp. paratuberculosis
ccaucauggcgcug

SEQ ID NO: 864854 - RNA, 23 nt, Mycobacterium avium subsp. paratuberculosis
ccaucauggcgcugcgcgacacc

SEQ ID NO: 864855 - RNA, 21 nt, Mycobacterium avium subsp. paratuberculosis
ccauccccgcguuggccagcg

SEQ ID NO: 864856 - RNA, 20 nt, Mycobacterium avium subsp. paratuberculosis
ccaucccggggacaccgggc

SEQ ID NO: 864857 - RNA, 20 nt, Mycobacterium avium subsp. paratuberculosis
ccaucccgccgccgaacagc

SEQ ID NO: 864858 - RNA, 14 nt, Mycobacterium avium subsp. paratuberculosis
ccauccgcgccgaa

SEQ ID NO: 864859 - RNA, 18 nt, Mycobacterium avium subsp. paratuberculosis
ccauccgcagcccgucga

SEQ ID NO: 864860 - RNA, 14 nt, Mycobacterium avium subsp. paratuberculosis
ccauccgccacccg

SEQ ID NO: 864861 - RNA, 14 nt, Mycobacterium avium subsp. paratuberculosis
ccauccgcggccac

SEQ ID NO: 864862 - RNA, 16 nt, Mycobacterium avium subsp. paratuberculosis
ccauccgcggccaccg

SEQ ID NO: 864863 - RNA, 12 nt, Mycobacterium avium subsp. paratuberculosis
ccauccggccgg

SEQ ID NO: 864864 - RNA, 12 nt, Mycobacterium avium subsp. paratuberculosis
ccauccggcgcc

SEQ ID NO: 864865 - RNA, 13 nt, Mycobacterium avium subsp. paratuberculosis
ccauccggcgccg

SEQ ID NO: 864866 - RNA, 14 nt, Mycobacterium avium subsp. paratuberculosis
ccauccggcgccgc

SEQ ID NO: 864867 - RNA, 15 nt, Mycobacterium avium subsp. paratuberculosis
ccauccggcgccgcg

SEQ ID NO: 864868 - RNA, 15 nt, Mycobacterium avium subsp. paratuberculosis
ccauccgccgucgac

SEQ ID NO: 864869 - RNA, 13 nt, Mycobacterium avium subsp. paratuberculosis
ccauccgggagac

SEQ ID NO: 864870 - RNA, 11 nt, Mycobacterium avium subsp. paratuberculosis
ccauccgggcg

SEQ ID NO: 864871 - RNA, 13 nt, Mycobacterium avium subsp. paratuberculosis
ccauccgggcggc

SEQ ID NO: 864872 - RNA, 16 nt, Mycobacterium avium subsp. paratuberculosis
ccauccgggcggcauc

SEQ ID NO: 864873 - RNA, 20 nt, Mycobacterium avium subsp. paratuberculosis
ccauccgggcggcaucgcgc

SEQ ID NO: 864874 - RNA, 24 nt, Mycobacterium avium subsp. paratuberculosis
ccauccgggcggcaucgcgcgcgg

SEQ ID NO: 864875 - RNA, 14 nt, Mycobacterium avium subsp. paratuberculosis
ccauccgggcggcc

SEQ ID NO: 864876 - RNA, 19 nt, Mycobacterium avium subsp. paratuberculosis
ccauccgggcggccagccg

SEQ ID NO: 864877 - RNA, 22 nt, Mycobacterium avium subsp. paratuberculosis
ccauccgggcggccagccgcgc

SEQ ID NO: 864878 - RNA, 13 nt, Mycobacterium avium subsp. paratuberculosis
ccauccguucggc

SEQ ID NO: 864879 - RNA, 16 nt, Mycobacterium avium subsp. paratuberculosis
ccaucgacuccagcac

SEQ ID NO: 864880 - RNA, 18 nt, Mycobacterium avium subsp. paratuberculosis
ccaucgacuccagcaccg

SEQ ID NO: 864881 - RNA, 23 nt, Mycobacterium avium subsp. paratuberculosis
ccaucgacuccagcaccggcgcc

SEQ ID NO: 864882 - RNA, 23 nt, Mycobacterium avium subsp. paratuberculosis
ccaucgaccggaugaugccggug

SEQ ID NO: 864883 - RNA, 16 nt, Mycobacterium avium subsp. paratuberculosis
ccaucgaggcgaucau

SEQ ID NO: 864884 - RNA, 12 nt, Mycobacterium avium subsp. paratuberculosis
ccaucgacgcug

SEQ ID NO: 864885 - RNA, 13 nt, Mycobacterium avium subsp. paratuberculosis
ccaucgacgcuga

SEQ ID NO: 864886 - RNA, 19 nt, Mycobacterium avium subsp. paratuberculosis
ccaucgacggaucgcccug

SEQ ID NO: 864887 - RNA, 19 nt, Mycobacterium avium subsp. paratuberculosis
ccaucguccucgcgccgug

SEQ ID NO: 864888 - RNA, 14 nt, Mycobacterium avium subsp. paratuberculosis
ccaucggggcuaca

SEQ ID NO: 864889 - RNA, 15 nt, Mycobacterium avium subsp. paratuberculosis
ccaucgggaccgcgg

SEQ ID NO: 864890 - RNA, 15 nt, Mycobacterium avium subsp. paratuberculosis
ccaucgggcccagca

SEQ ID NO: 864891 - RNA, 17 nt, Mycobacterium avium subsp. paratuberculosis
ccaucgggcccagcagc

SEQ ID NO: 864892 - RNA, 18 nt, Mycobacterium avium subsp. paratuberculosis
ccaucgggcccagcagcc

SEQ ID NO: 864893 - RNA, 23 nt, Mycobacterium avium subsp. paratuberculosis
ccaucgggcccagcagccugccc

SEQ ID NO: 864894 - RNA, 15 nt, Mycobacterium avium subsp. paratuberculosis
ccaucgggucgucgg

SEQ ID NO: 864895 - RNA, 13 nt, Mycobacterium avium subsp. paratuberculosis
ccaucgcgucguc

SEQ ID NO: 864896 - RNA, 15 nt, Mycobacterium avium subsp. paratuberculosis
ccaucggcaucgcgc

SEQ ID NO: 864897 - RNA, 19 nt, Mycobacterium avium subsp. paratuberculosis
ccaucggcaucgcgcgcgg

SEQ ID NO: 864898 - RNA, 20 nt, Mycobacterium avium subsp. paratuberculosis
ccaucggcagacccagcagc

SEQ ID NO: 864899 - RNA, 13 nt, Mycobacterium avium subsp. paratuberculosis
ccaucgcggucag

SEQ ID NO: 864900 - RNA, 15 nt, Mycobacterium avium subsp. paratuberculosis
ccaucgccucggcca

SEQ ID NO: 864901 - RNA, 20 nt, Mycobacterium avium subsp. paratuberculosis
ccaucgccgcgguggcgccg

SEQ ID NO: 864902 - RNA, 12 nt, Mycobacterium avium subsp. paratuberculosis
ccaucgcggccc

SEQ ID NO: 864903 - RNA, 13 nt, Mycobacterium avium subsp. paratuberculosis
ccaucgcggcccc

SEQ ID NO: 864904 - RNA, 14 nt, Mycobacterium avium subsp. paratuberculosis
ccaucgcggccgcc

SEQ ID NO: 864905 - RNA, 15 nt, Mycobacterium avium subsp. paratuberculosis
ccaucgcggccgccc

SEQ ID NO: 864906 - RNA, 17 nt, Mycobacterium avium subsp. paratuberculosis
ccaucgcggccgcccgg

SEQ ID NO: 864907 - RNA, 18 nt, Mycobacterium avium subsp. paratuberculosis
ccaucgcggccgcccggu

SEQ ID NO: 864908 - RNA, 16 nt, Mycobacterium avium subsp. paratuberculosis
ccaucgauggcggugu

SEQ ID NO: 864909 - RNA, 17 nt, Mycobacterium avium subsp. paratuberculosis
ccaucgauggcggugug

SEQ ID NO: 864910 - RNA, 18 nt, Mycobacterium avium subsp. paratuberculosis
ccaucgauggcggugugg

SEQ ID NO: 864911 - RNA, 21 nt, Mycobacterium avium subsp. paratuberculosis
ccaucgccgccaucgccgccg

SEQ ID NO: 864912 - RNA, 15 nt, Mycobacterium avium subsp. paratuberculosis
ccaucgccgccgcca

SEQ ID NO: 864913 - RNA, 17 nt, Mycobacterium avium subsp. paratuberculosis
ccaucgccgccgccauc

SEQ ID NO: 864914 - RNA, 20 nt, Mycobacterium avium subsp. paratuberculosis
ccaucgccaggaaccacacc

SEQ ID NO: 864915 - RNA, 15 nt, Mycobacterium avium subsp. paratuberculosis
ccaucgcccggugcg

SEQ ID NO: 864916 - RNA, 20 nt, Mycobacterium avium subsp. paratuberculosis
ccaucgcccggugcgccagc

SEQ ID NO: 864917 - RNA, 23 nt, Mycobacterium avium subsp. paratuberculosis
ccaucgcccggugcgccagcgug

SEQ ID NO: 864918 - RNA, 17 nt, Mycobacterium avium subsp. paratuberculosis
ccaugccgaugcccauc

SEQ ID NO: 864919 - RNA, 15 nt, Mycobacterium avium subsp. paratuberculosis
ccaugccgcgggcca

SEQ ID NO: 864920 - RNA, 16 nt, Mycobacterium avium subsp. paratuberculosis
ccaugccgcgggccag

SEQ ID NO: 864921 - RNA, 20 nt, Mycobacterium avium subsp. paratuberculosis
ccaugccgcgggccagcagc

SEQ ID NO: 864922 - RNA, 23 nt, Mycobacterium avium subsp. paratuberculosis
ccaugcccgcccacgggucgccg

SEQ ID NO: 864923 - RNA, 14 nt, Mycobacterium avium subsp. paratuberculosis
ccaugcccucgauc

SEQ ID NO: 864924 - RNA, 17 nt, Mycobacterium avium subsp. paratuberculosis
ccaugcccaugucgauc

SEQ ID NO: 864925 - RNA, 23 nt, Mycobacterium avium subsp. paratuberculosis
ccaugcccagcaguccggcgguc

SEQ ID NO: 864926 - RNA, 17 nt, Mycobacterium avium subsp. paratuberculosis
ccauggaaaccggcggg

SEQ ID NO: 864927 - RNA, 17 nt, Mycobacterium avium subsp. paratuberculosis
ccaugcuggugccgccg

SEQ ID NO: 864928 - RNA, 18 nt, Mycobacterium avium subsp. paratuberculosis
ccaugcuggugccgccga

SEQ ID NO: 864929 - RNA, 20 nt, Mycobacterium avium subsp. paratuberculosis
ccaugcuggugccgccgaug

SEQ ID NO: 864930 - RNA, 18 nt, Mycobacterium avium subsp. paratuberculosis
ccaugccucuucggcgcg

SEQ ID NO: 864931 - RNA, 21 nt, Mycobacterium avium subsp. paratuberculosis
ccaugccucuucggcgcgccg

SEQ ID NO: 864932 - RNA, 18 nt, Mycobacterium avium subsp. paratuberculosis
ccaugccgucgcgcaccg

SEQ ID NO: 864933 - RNA, 18 nt, Mycobacterium avium subsp. paratuberculosis
ccaugccgccgaccgccg

SEQ ID NO: 864934 - RNA, 20 nt, Mycobacterium avium subsp. paratuberculosis
ccauggaguugucggugaag

SEQ ID NO: 864935 - RNA, 13 nt, Mycobacterium avium subsp. paratuberculosis
ccauggcgcaccg

SEQ ID NO: 864936 - RNA, 17 nt, Mycobacterium avium subsp. paratuberculosis
ccauggcgcaccgcggc

SEQ ID NO: 864937 - RNA, 20 nt, Mycobacterium avium subsp. paratuberculosis
ccauggcgcaccgcggccuc

SEQ ID NO: 864938 - RNA, 13 nt, Mycobacterium avium subsp. paratuberculosis
ccauggcggcccg

SEQ ID NO: 864939 - RNA, 18 nt, Mycobacterium avium subsp. paratuberculosis
ccauggcggcccgcgccg

SEQ ID NO: 864940 - RNA, 14 nt, Mycobacterium avium subsp. paratuberculosis
ccauggcgcggcgg

SEQ ID NO: 864941 - RNA, 16 nt, Mycobacterium avium subsp. paratuberculosis
ccauggcgcggcggcc

SEQ ID NO: 864942 - RNA, 21 nt, Mycobacterium avium subsp. paratuberculosis
ccauggccaggaacggcgcca

SEQ ID NO: 864943 - RNA, 14 nt, Mycobacterium avium subsp. paratuberculosis
ccauggcccacgac

SEQ ID NO: 864944 - RNA, 18 nt, Mycobacterium avium subsp. paratuberculosis
ccaucuucaguucggccg

SEQ ID NO: 864945 - RNA, 23 nt, Mycobacterium avium subsp. paratuberculosis
ccaucuggccgcgggugcggccc

SEQ ID NO: 864946 - RNA, 23 nt, Mycobacterium avium subsp. paratuberculosis
ccaucuucacgugcgcggcgucc

SEQ ID NO: 864947 - RNA, 11 nt, Mycobacterium avium subsp. paratuberculosis
ccaucuggccg

SEQ ID NO: 864948 - RNA, 14 nt, Mycobacterium avium subsp. paratuberculosis
ccaucuggccgcgg

SEQ ID NO: 864949 - RNA, 20 nt, Mycobacterium avium subsp. paratuberculosis
ccaugaacucguccaccgac

SEQ ID NO: 864950 - RNA, 20 nt, Mycobacterium avium subsp. paratuberculosis
ccaugaacugguuccacacc

SEQ ID NO: 864951 - RNA, 17 nt, Mycobacterium avium subsp. paratuberculosis
ccaucuccugcacgcgc

SEQ ID NO: 864952 - RNA, 14 nt, Mycobacterium avium subsp. paratuberculosis
ccaucuccagcucc

SEQ ID NO: 864953 - RNA, 14 nt, Mycobacterium avium subsp. paratuberculosis
ccaucguggccgcg

SEQ ID NO: 864954 - RNA, 22 nt, Mycobacterium avium subsp. paratuberculosis
ccaucgugggcgccgucgccgc

SEQ ID NO: 864955 - RNA, 19 nt, Mycobacterium avium subsp. paratuberculosis
ccaucucgggagugcggcc

SEQ ID NO: 864956 - RNA, 16 nt, Mycobacterium avium subsp. paratuberculosis
ccaucucgugcccggg

SEQ ID NO: 864957 - RNA, 20 nt, Mycobacterium avium subsp. paratuberculosis
ccaucucgugcccgggcccg

SEQ ID NO: 864958 - RNA, 20 nt, Mycobacterium avium subsp. paratuberculosis
ccaugaagccguugccgccg

SEQ ID NO: 864959 - RNA, 21 nt, Mycobacterium avium subsp. paratuberculosis
ccaugaucacaccgcugucgg

SEQ ID NO: 864960 - RNA, 19 nt, Mycobacterium avium subsp. paratuberculosis
ccaugaucagcgccguggc

SEQ ID NO: 864961 - RNA, 21 nt, Mycobacterium avium subsp. paratuberculosis
ccaugaucagcgccguggccc

SEQ ID NO: 864962 - RNA, 20 nt, Mycobacterium avium subsp. paratuberculosis
ccaugaucgccaguccggcg

SEQ ID NO: 864963 - RNA, 16 nt, Mycobacterium avium subsp. paratuberculosis
ccaugcagaccagccc

SEQ ID NO: 864964 - RNA, 16 nt, Mycobacterium avium subsp. paratuberculosis
ccauggucgagccgca

SEQ ID NO: 864965 - RNA, 17 nt, Mycobacterium avium subsp. paratuberculosis
ccauggucgagccgcag

SEQ ID NO: 864966 - RNA, 16 nt, Mycobacterium avium subsp. paratuberculosis
ccaugggucucggcga

SEQ ID NO: 864967 - RNA, 15 nt, Mycobacterium avium subsp. paratuberculosis
ccauggucgcggccg

SEQ ID NO: 864968 - RNA, 17 nt, Mycobacterium avium subsp. paratuberculosis
ccauggucgcggccgug

SEQ ID NO: 864969 - RNA, 13 nt, Mycobacterium avium subsp. paratuberculosis
aaaucgucgggcc

SEQ ID NO: 864970 - RNA, 14 nt, Mycobacterium avium subsp. paratuberculosis
ccaugugccgcauc

SEQ ID NO: 864971 - RNA, 21 nt, Mycobacterium avium subsp. paratuberculosis
ccaugugccggcgcucgucgu

SEQ ID NO: 864972 - RNA, 12 nt, Mycobacterium avium subsp. paratuberculosis
ccaugucgucga

SEQ ID NO: 864973 - RNA, 16 nt, Mycobacterium avium subsp. paratuberculosis
ccaugucgucggcgga

SEQ ID NO: 864974 - RNA, 17 nt, Mycobacterium avium subsp. paratuberculosis
ccaugucguugacgcug

SEQ ID NO: 864975 - RNA, 23 nt, Mycobacterium avium subsp. paratuberculosis
ccauguccggcaggcucagcagc

SEQ ID NO: 864976 - RNA, 13 nt, Mycobacterium avium subsp. paratuberculosis
ccaugucgacgcu

SEQ ID NO: 864977 - RNA, 17 nt, Mycobacterium avium subsp. paratuberculosis
ccaugucgacgcugagc

SEQ ID NO: 864978 - RNA, 17 nt, Mycobacterium avium subsp. paratuberculosis
ccaugucggcgacccgc

SEQ ID NO: 864979 - RNA, 17 nt, Mycobacterium avium subsp. paratuberculosis
ccaugucgaucggcucg

SEQ ID NO: 864980 - RNA, 22 nt, Mycobacterium avium subsp. paratuberculosis
ccaugucgaucggcucggcgcc

SEQ ID NO: 864981 - RNA, 15 nt, Mycobacterium avium subsp. paratuberculosis
ccaugucgcaacggu

SEQ ID NO: 864982 - RNA, 22 nt, Mycobacterium avium subsp. paratuberculosis
cccaaugaucugggccgccaac

SEQ ID NO: 864983 - RNA, 16 nt, Mycobacterium avium subsp. paratuberculosis
cccaauccucgccgag

SEQ ID NO: 864984 - RNA, 17 nt, Mycobacterium avium subsp. paratuberculosis
cccaauugccgggccag

SEQ ID NO: 864985 - RNA, 15 nt, Mycobacterium avium subsp. paratuberculosis
ccauguuccagaacc

SEQ ID NO: 864986 - RNA, 16 nt, Mycobacterium avium subsp. paratuberculosis
cccaauacgaucagca

SEQ ID NO: 864987 - RNA, 21 nt, Mycobacterium avium subsp. paratuberculosis
cccacugcccguagucggcgg

SEQ ID NO: 864988 - RNA, 16 nt, Mycobacterium avium subsp. paratuberculosis
cccacucgucgaucga

SEQ ID NO: 864989 - RNA, 16 nt, Mycobacterium avium subsp. paratuberculosis
cccacuggcggccggc

SEQ ID NO: 864990 - RNA, 18 nt, Mycobacterium avium subsp. paratuberculosis
cccacuggcggccggccg

SEQ ID NO: 864991 - RNA, 21 nt, Mycobacterium avium subsp. paratuberculosis
cccacuggcggccggccgcgc

SEQ ID NO: 864992 - RNA, 21 nt, Mycobacterium avium subsp. paratuberculosis
cccacgccgcccaggccccgg

SEQ ID NO: 864993 - RNA, 20 nt, Mycobacterium avium subsp. paratuberculosis
cccacgccaugugccggcgc

SEQ ID NO: 864994 - RNA, 16 nt, Mycobacterium avium subsp. paratuberculosis
cccacucccagccgcc

SEQ ID NO: 864995 - RNA, 18 nt, Mycobacterium avium subsp. paratuberculosis
cccacucccagccgccgg

SEQ ID NO: 864996 - RNA, 15 nt, Mycobacterium avium subsp. paratuberculosis
cccacgcagcggugc

SEQ ID NO: 864997 - RNA, 16 nt, Mycobacterium avium subsp. paratuberculosis
cccacgccagccgggu

SEQ ID NO: 864998 - RNA, 19 nt, Mycobacterium avium subsp. paratuberculosis
cccacgccagccggguggc

SEQ ID NO: 864999 - RNA, 12 nt, Mycobacterium avium subsp. paratuberculosis
cccacgaucacg

SEQ ID NO: 865000 - RNA, 14 nt, Mycobacterium avium subsp. paratuberculosis
cccacgacgacugg

SEQ ID NO: 865001 - RNA, 15 nt, Mycobacterium avium subsp. paratuberculosis
cccacaccaccaccg

SEQ ID NO: 865002 - RNA, 15 nt, Mycobacterium avium subsp. paratuberculosis
cccacagcggggucg

SEQ ID NO: 865003 - RNA, 16 nt, Mycobacterium avium subsp. paratuberculosis
cccacagcggggucgg

SEQ ID NO: 865004 - RNA, 16 nt, Mycobacterium avium subsp. paratuberculosis
cccacaccgacaccgg

SEQ ID NO: 865005 - RNA, 17 nt, Mycobacterium avium subsp. paratuberculosis
cccacaccgacaccggc

SEQ ID NO: 865006 - RNA, 20 nt, Mycobacterium avium subsp. paratuberculosis
cccacaccuucgcggucggc

SEQ ID NO: 865007 - RNA, 20 nt, Mycobacterium avium subsp. paratuberculosis
cccacagcugacgggccggc

SEQ ID NO: 865008 - RNA, 23 nt, Mycobacterium avium subsp. paratuberculosis
cccacagcugacgggccggcggg

SEQ ID NO: 865009 - RNA, 15 nt, Mycobacterium avium subsp. paratuberculosis
cccacagcugccggc

SEQ ID NO: 865010 - RNA, 17 nt, Mycobacterium avium subsp. paratuberculosis
cccacagcugccggccg

SEQ ID NO: 865011 - RNA, 23 nt, Mycobacterium avium subsp. paratuberculosis
cccacaggacguugaggcggcgg

SEQ ID NO: 865012 - RNA, 16 nt, Mycobacterium avium subsp. paratuberculosis
cccaccugaucgcggc

SEQ ID NO: 865013 - RNA, 17 nt, Mycobacterium avium subsp. paratuberculosis
cccaccugaucgcggcg

SEQ ID NO: 865014 - RNA, 17 nt, Mycobacterium avium subsp. paratuberculosis
cccaccgguggccggga

SEQ ID NO: 865015 - RNA, 22 nt, Mycobacterium avium subsp. paratuberculosis
cccacgaaccgguugcgggccg

SEQ ID NO: 865016 - RNA, 14 nt, Mycobacterium avium subsp. paratuberculosis
cccacagucgcugg

SEQ ID NO: 865017 - RNA, 13 nt, Mycobacterium avium subsp. paratuberculosis
cccaccgucgcca

SEQ ID NO: 865018 - RNA, 18 nt, Mycobacterium avium subsp. paratuberculosis
cccaccgucgccacgauc

SEQ ID NO: 865019 - RNA, 21 nt, Mycobacterium avium subsp. paratuberculosis
cccaccgucgccacgaucacc

SEQ ID NO: 865020 - RNA, 16 nt, Mycobacterium avium subsp. paratuberculosis
cccagaucgcccgggc

SEQ ID NO: 865021 - RNA, 19 nt, Mycobacterium avium subsp. paratuberculosis
cccagaucgcccgggcggc

SEQ ID NO: 865022 - RNA, 22 nt, Mycobacterium avium subsp. paratuberculosis
cccagaucgcgguccaccagaa

SEQ ID NO: 865023 - RNA, 14 nt, Mycobacterium avium subsp. paratuberculosis
cccagaucggccag

SEQ ID NO: 865024 - RNA, 12 nt, Mycobacterium avium subsp. paratuberculosis
cccagaucgacg

SEQ ID NO: 865025 - RNA, 14 nt, Mycobacterium avium subsp. paratuberculosis
cccagaucgacgcc

SEQ ID NO: 865026 - RNA, 13 nt, Mycobacterium avium subsp. paratuberculosis
cccagaaccgcuc

SEQ ID NO: 865027 - RNA, 20 nt, Mycobacterium avium subsp. paratuberculosis
cccagaaccgcucggcggcg

SEQ ID NO: 865028 - RNA, 23 nt, Mycobacterium avium subsp. paratuberculosis
cccagaaccgcucggcggcgccg

SEQ ID NO: 865029 - RNA, 20 nt, Mycobacterium avium subsp. paratuberculosis
cccagaacgacgcgcucagc

SEQ ID NO: 865030 - RNA, 16 nt, Mycobacterium avium subsp. paratuberculosis
cccagcaaacccagca

SEQ ID NO: 865031 - RNA, 20 nt, Mycobacterium avium subsp. paratuberculosis
cccagcaaacccagcaccaa

SEQ ID NO: 865032 - RNA, 18 nt, Mycobacterium avium subsp. paratuberculosis
cccagaucguagggcucg

SEQ ID NO: 865033 - RNA, 23 nt, Mycobacterium avium subsp. paratuberculosis
cccagaucguagggcucggcguc

SEQ ID NO: 865034 - RNA, 14 nt, Mycobacterium avium subsp. paratuberculosis
cccagaugcccagc

SEQ ID NO: 865035 - RNA, 19 nt, Mycobacterium avium subsp. paratuberculosis
cccagaugccgccgccagc

SEQ ID NO: 865036 - RNA, 16 nt, Mycobacterium avium subsp. paratuberculosis
cccagaugcgcgacgg

SEQ ID NO: 865037 - RNA, 18 nt, Mycobacterium avium subsp. paratuberculosis
cccagaugcgcgacggcc

SEQ ID NO: 865038 - RNA, 21 nt, Mycobacterium avium subsp. paratuberculosis
cccagaugcgcgacggccucg

SEQ ID NO: 865039 - RNA, 22 nt, Mycobacterium avium subsp. paratuberculosis
cccagaugcgcgacggccucgc

SEQ ID NO: 865040 - RNA, 20 nt, Mycobacterium avium subsp. paratuberculosis
cccagcaccaccacguugcg

SEQ ID NO: 865041 - RNA, 14 nt, Mycobacterium avium subsp. paratuberculosis
cccagccagccggu

SEQ ID NO: 865042 - RNA, 22 nt, Mycobacterium avium subsp. paratuberculosis
cccagccaggccgccgggccgc

SEQ ID NO: 865043 - RNA, 15 nt, Mycobacterium avium subsp. paratuberculosis
cccagcaccgccggc

SEQ ID NO: 865044 - RNA, 16 nt, Mycobacterium avium subsp. paratuberculosis
cccagcaccgccggcg

SEQ ID NO: 865045 - RNA, 13 nt, Mycobacterium avium subsp. paratuberculosis
cccagcaccgcga

SEQ ID NO: 865046 - RNA, 13 nt, Mycobacterium avium subsp. paratuberculosis
cccagcaccacuu

SEQ ID NO: 865047 - RNA, 23 nt, Mycobacterium avium subsp. paratuberculosis
cccagcaccacuuccagcaccgg

SEQ ID NO: 865048 - RNA, 14 nt, Mycobacterium avium subsp. paratuberculosis
cccagcacccgcuc

SEQ ID NO: 865049 - RNA, 22 nt, Mycobacterium avium subsp. paratuberculosis
cccagcaccaacagcggcccga

SEQ ID NO: 865050 - RNA, 18 nt, Mycobacterium avium subsp. paratuberculosis
cccagcacaacgccuccg

SEQ ID NO: 865051 - RNA, 17 nt, Mycobacterium avium subsp. paratuberculosis
cccagcacagccgucgc

SEQ ID NO: 865052 - RNA, 18 nt, Mycobacterium avium subsp. paratuberculosis
cccagcacagccgucgca

SEQ ID NO: 865053 - RNA, 17 nt, Mycobacterium avium subsp. paratuberculosis
cccagcacagcgaggcg

SEQ ID NO: 865054 - RNA, 16 nt, Mycobacterium avium subsp. paratuberculosis
cccagccgagccgggc

SEQ ID NO: 865055 - RNA, 17 nt, Mycobacterium avium subsp. paratuberculosis
cccagccgagccgggcc

SEQ ID NO: 865056 - RNA, 21 nt, Mycobacterium avium subsp. paratuberculosis
cccagccgccgcgacacccgc

SEQ ID NO: 865057 - RNA, 13 nt, Mycobacterium avium subsp. paratuberculosis
cccagccgccggc

SEQ ID NO: 865058 - RNA, 14 nt, Mycobacterium avium subsp. paratuberculosis
cccagccgccggcc

SEQ ID NO: 865059 - RNA, 17 nt, Mycobacterium avium subsp. paratuberculosis
cccagccgccggccacc

SEQ ID NO: 865060 - RNA, 15 nt, Mycobacterium avium subsp. paratuberculosis
cccagcccgccgcgu

SEQ ID NO: 865061 - RNA, 16 nt, Mycobacterium avium subsp. paratuberculosis
cccagcccgccgggcu

SEQ ID NO: 865062 - RNA, 15 nt, Mycobacterium avium subsp. paratuberculosis
cccagcccgcgccga

SEQ ID NO: 865063 - RNA, 17 nt, Mycobacterium avium subsp. paratuberculosis
cccagcccgcgcgagcg

SEQ ID NO: 865064 - RNA, 17 nt, Mycobacterium avium subsp. paratuberculosis
cccagcccgcgggcggc

SEQ ID NO: 865065 - RNA, 12 nt, Mycobacterium avium subsp. paratuberculosis
cccagcccggcc

SEQ ID NO: 865066 - RNA, 14 nt, Mycobacterium avium subsp. paratuberculosis
cccagcccggccag

SEQ ID NO: 865067 - RNA, 22 nt, Mycobacterium avium subsp. paratuberculosis
cccagcccggccccaccgccgc

SEQ ID NO: 865068 - RNA, 21 nt, Mycobacterium avium subsp. paratuberculosis
cccagcccggcuggcaggucg

SEQ ID NO: 865069 - RNA, 15 nt, Mycobacterium avium subsp. paratuberculosis
cccagccccagcacg

SEQ ID NO: 865070 - RNA, 16 nt, Mycobacterium avium subsp. paratuberculosis
cccagccccagcacga

SEQ ID NO: 865071 - RNA, 18 nt, Mycobacterium avium subsp. paratuberculosis
cccagccccagcacgaug

SEQ ID NO: 865072 - RNA, 12 nt, Mycobacterium avium subsp. paratuberculosis
cccagccgugcc

SEQ ID NO: 865073 - RNA, 13 nt, Mycobacterium avium subsp. paratuberculosis
cccagccggcggu

SEQ ID NO: 865074 - RNA, 14 nt, Mycobacterium avium subsp. paratuberculosis
cccagccggcggug

SEQ ID NO: 865075 - RNA, 19 nt, Mycobacterium avium subsp. paratuberculosis
cccagccggucgccgggcc

SEQ ID NO: 865076 - RNA, 20 nt, Mycobacterium avium subsp. paratuberculosis
cccagccggugcgagccgcu

SEQ ID NO: 865077 - RNA, 16 nt, Mycobacterium avium subsp. paratuberculosis
cccagccgucgcaccg

SEQ ID NO: 865078 - RNA, 19 nt, Mycobacterium avium subsp. paratuberculosis
cccagccggccgacgcggc

SEQ ID NO: 865079 - RNA, 14 nt, Mycobacterium avium subsp. paratuberculosis
cccagccggccgag

SEQ ID NO: 865080 - RNA, 14 nt, Mycobacterium avium subsp. paratuberculosis
cccagccggcggau

SEQ ID NO: 865081 - RNA, 14 nt, Mycobacterium avium subsp. paratuberculosis
cccagccgcugaac

SEQ ID NO: 865082 - RNA, 20 nt, Mycobacterium avium subsp. paratuberculosis
cccagccgcugaacgcgauc

SEQ ID NO: 865083 - RNA, 16 nt, Mycobacterium avium subsp. paratuberculosis
cccagccgcugcgaca

SEQ ID NO: 865084 - RNA, 15 nt, Mycobacterium avium subsp. paratuberculosis
cccagccggacagcg

SEQ ID NO: 865085 - RNA, 14 nt, Mycobacterium avium subsp. paratuberculosis
cccagcgacucggc

SEQ ID NO: 865086 - RNA, 17 nt, Mycobacterium avium subsp. paratuberculosis
cccagcgacucggccag

SEQ ID NO: 865087 - RNA, 15 nt, Mycobacterium avium subsp. paratuberculosis
cccagcgagaccgcu

SEQ ID NO: 865088 - RNA, 13 nt, Mycobacterium avium subsp. paratuberculosis
cccagcgagcagg

SEQ ID NO: 865089 - RNA, 15 nt, Mycobacterium avium subsp. paratuberculosis
cccagcgagcagguc

SEQ ID NO: 865090 - RNA, 19 nt, Mycobacterium avium subsp. paratuberculosis
cccagcgaggcggccagcg

SEQ ID NO: 865091 - RNA, 21 nt, Mycobacterium avium subsp. paratuberculosis
cccagcgaggugaagccguug

SEQ ID NO: 865092 - RNA, 13 nt, Mycobacterium avium subsp. paratuberculosis
cccagcgagcugc

SEQ ID NO: 865093 - RNA, 17 nt, Mycobacterium avium subsp. paratuberculosis
cccagcgagcugccggc

SEQ ID NO: 865094 - RNA, 18 nt, Mycobacterium avium subsp. paratuberculosis
cccagcgcaacggcgucg

SEQ ID NO: 865095 - RNA, 21 nt, Mycobacterium avium subsp. paratuberculosis
cccagcgcaacggcgucgaca

SEQ ID NO: 865096 - RNA, 15 nt, Mycobacterium avium subsp. paratuberculosis
cccagcgcagcaucg

SEQ ID NO: 865097 - RNA, 14 nt, Mycobacterium avium subsp. paratuberculosis
cccagcgcagcgcc

SEQ ID NO: 865098 - RNA, 16 nt, Mycobacterium avium subsp. paratuberculosis
cccagcgcagcgccuc

SEQ ID NO: 865099 - RNA, 22 nt, Mycobacterium avium subsp. paratuberculosis
cccagcgcagcgccucggcggc

SEQ ID NO: 865100 - RNA, 20 nt, Mycobacterium avium subsp. paratuberculosis
cccaggaacacgggauagcg

SEQ ID NO: 865101 - RNA, 17 nt, Mycobacterium avium subsp. paratuberculosis
cccaggaacgcgccggc

SEQ ID NO: 865102 - RNA, 18 nt, Mycobacterium avium subsp. paratuberculosis
cccaggaacgcgccggcg

SEQ ID NO: 865103 - RNA, 19 nt, Mycobacterium avium subsp. paratuberculosis
cccaggaacgcgccggcgc

SEQ ID NO: 865104 - RNA, 22 nt, Mycobacterium avium subsp. paratuberculosis
cccaggaacuggucgaacagcg

SEQ ID NO: 865105 - RNA, 17 nt, Mycobacterium avium subsp. paratuberculosis
cccagcgccucgagcac

SEQ ID NO: 865106 - RNA, 18 nt, Mycobacterium avium subsp. paratuberculosis
cccagcgccucgagcacc

SEQ ID NO: 865107 - RNA, 21 nt, Mycobacterium avium subsp. paratuberculosis
cccagcgcgacgucgaccgcg

SEQ ID NO: 865108 - RNA, 20 nt, Mycobacterium avium subsp. paratuberculosis
cccagcgcgaggucgacgga

SEQ ID NO: 865109 - RNA, 15 nt, Mycobacterium avium subsp. paratuberculosis
cccagcgccgcggcg

SEQ ID NO: 865110 - RNA, 22 nt, Mycobacterium avium subsp. paratuberculosis
cccagcgcauccaccagggcgg

SEQ ID NO: 865111 - RNA, 21 nt, Mycobacterium avium subsp. paratuberculosis
cccaggaaguagccggccagc

SEQ ID NO: 865112 - RNA, 14 nt, Mycobacterium avium subsp. paratuberculosis
cccaggacggcgcg

SEQ ID NO: 865113 - RNA, 15 nt, Mycobacterium avium subsp. paratuberculosis
cccaggacggcgcgg

SEQ ID NO: 865114 - RNA, 19 nt, Mycobacterium avium subsp. paratuberculosis
cccaggauucccgaccccg

SEQ ID NO: 865115 - RNA, 20 nt, Mycobacterium avium subsp. paratuberculosis
cccaggauuccgucggcggc

SEQ ID NO: 865116 - RNA, 22 nt, Mycobacterium avium subsp. paratuberculosis
cccaggauuccgucggcggccg

SEQ ID NO: 865117 - RNA, 19 nt, Mycobacterium avium subsp. paratuberculosis
cccaggauucucagcagcg

SEQ ID NO: 865118 - RNA, 17 nt, Mycobacterium avium subsp. paratuberculosis
cccaggccaacagcagc

SEQ ID NO: 865119 - RNA, 15 nt, Mycobacterium avium subsp. paratuberculosis
cccaggccgcggcca

SEQ ID NO: 865120 - RNA, 17 nt, Mycobacterium avium subsp. paratuberculosis
cccaggccgcggccaag

SEQ ID NO: 865121 - RNA, 20 nt, Mycobacterium avium subsp. paratuberculosis
cccaggccgcggucgccccg

SEQ ID NO: 865122 - RNA, 15 nt, Mycobacterium avium subsp. paratuberculosis
cccaggccgccagcu

SEQ ID NO: 865123 - RNA, 15 nt, Mycobacterium avium subsp. paratuberculosis
cccaggccacccggg

SEQ ID NO: 865124 - RNA, 15 nt, Mycobacterium avium subsp. paratuberculosis
cccaggccgccgcca

SEQ ID NO: 865125 - RNA, 20 nt, Mycobacterium avium subsp. paratuberculosis
cccaggcccgggagaaccuc

SEQ ID NO: 865126 - RNA, 17 nt, Mycobacterium avium subsp. paratuberculosis
cccaggccgacgccggc

SEQ ID NO: 865127 - RNA, 14 nt, Mycobacterium avium subsp. paratuberculosis
cccaggccgagcgc

SEQ ID NO: 865128 - RNA, 23 nt, Mycobacterium avium subsp. paratuberculosis
cccaggccgaguauccgcgcagc

SEQ ID NO: 865129 - RNA, 20 nt, Mycobacterium avium subsp. paratuberculosis
cccaggcccagcagcaccgc

SEQ ID NO: 865130 - RNA, 19 nt, Mycobacterium avium subsp. paratuberculosis
cccaggcccaucgcgguca

SEQ ID NO: 865131 - RNA, 14 nt, Mycobacterium avium subsp. paratuberculosis
cccaggccccggcc

SEQ ID NO: 865132 - RNA, 23 nt, Mycobacterium avium subsp. paratuberculosis
cccaggccccggccgagcgcagc

SEQ ID NO: 865133 - RNA, 14 nt, Mycobacterium avium subsp. paratuberculosis
cccaggcccggcac

SEQ ID NO: 865134 - RNA, 22 nt, Mycobacterium avium subsp. paratuberculosis
ccaguaggucacccgguccccg

SEQ ID NO: 865135 - RNA, 22 nt, Mycobacterium avium subsp. paratuberculosis
ccagguuugcugcgagaucggc

SEQ ID NO: 865136 - RNA, 18 nt, Mycobacterium avium subsp. paratuberculosis
ccagguuggcggcggccc

SEQ ID NO: 865137 - RNA, 17 nt, Mycobacterium avium subsp. paratuberculosis
ccagguuuugcagcgga

SEQ ID NO: 865138 - RNA, 21 nt, Mycobacterium avium subsp. paratuberculosis
ccagguuggucagcagcagcg

SEQ ID NO: 865139 - RNA, 20 nt, Mycobacterium avium subsp. paratuberculosis
ccagguuguaggugcccgau

SEQ ID NO: 865140 - RNA, 19 nt, Mycobacterium avium subsp. paratuberculosis
ccagguugucgccgcgcca

SEQ ID NO: 865141 - RNA, 20 nt, Mycobacterium avium subsp. paratuberculosis
ccagguugucgccgcgccag

SEQ ID NO: 865142 - RNA, 21 nt, Mycobacterium avium subsp. paratuberculosis
ccagguugaccaccagcgugc

SEQ ID NO: 865143 - RNA, 19 nt, Mycobacterium avium subsp. paratuberculosis
ccagguugcgccguccggc

SEQ ID NO: 865144 - RNA, 21 nt, Mycobacterium avium subsp. paratuberculosis
ccagguugcgccguccggcca

SEQ ID NO: 865145 - RNA, 22 nt, Mycobacterium avium subsp. paratuberculosis
ccagguugcgccguccggccac

SEQ ID NO: 865146 - RNA, 16 nt, Mycobacterium avium subsp. paratuberculosis
ccaggucguugccggu

SEQ ID NO: 865147 - RNA, 20 nt, Mycobacterium avium subsp. paratuberculosis
ccaggucguugccggugccg

SEQ ID NO: 865148 - RNA, 19 nt, Mycobacterium avium subsp. paratuberculosis
ccagguccgguucgaccgg

SEQ ID NO: 865149 - RNA, 14 nt, Mycobacterium avium subsp. paratuberculosis
ccaggucgcacacc

SEQ ID NO: 865150 - RNA, 20 nt, Mycobacterium avium subsp. paratuberculosis
ccaggucgcacaccagcacg

SEQ ID NO: 865151 - RNA, 23 nt, Mycobacterium avium subsp. paratuberculosis
ccaggucgcacaccagcacggcg

SEQ ID NO: 865152 - RNA, 16 nt, Mycobacterium avium subsp. paratuberculosis
ccaggucgacgggguc

SEQ ID NO: 865153 - RNA, 19 nt, Mycobacterium avium subsp. paratuberculosis
ccaggucgacggggucgga

SEQ ID NO: 865154 - RNA, 12 nt, Mycobacterium avium subsp. paratuberculosis
ccaggucgaggu

SEQ ID NO: 865155 - RNA, 20 nt, Mycobacterium avium subsp. paratuberculosis
ccaggucgagguccucggcg

SEQ ID NO: 865156 - RNA, 22 nt, Mycobacterium avium subsp. paratuberculosis
ccaggucgaguucaugaucucg

SEQ ID NO: 865157 - RNA, 15 nt, Mycobacterium avium subsp. paratuberculosis
ccaggugaacagcag

SEQ ID NO: 865158 - RNA, 16 nt, Mycobacterium avium subsp. paratuberculosis
ccaggugaacagcagc

SEQ ID NO: 865159 - RNA, 19 nt, Mycobacterium avium subsp. paratuberculosis
ccaggugaacagcagccac

SEQ ID NO: 865160 - RNA, 13 nt, Mycobacterium avium subsp. paratuberculosis
ccaggugacgccg

SEQ ID NO: 865161 - RNA, 17 nt, Mycobacterium avium subsp. paratuberculosis
ccaggugacgccgcacg

SEQ ID NO: 865162 - RNA, 18 nt, Mycobacterium avium subsp. paratuberculosis
ccaggucuccgucggcgc

SEQ ID NO: 865163 - RNA, 23 nt, Mycobacterium avium subsp. paratuberculosis
ccaggucuucucguccgcgcugg

SEQ ID NO: 865164 - RNA, 16 nt, Mycobacterium avium subsp. paratuberculosis
ccaggugcgccgccgc

SEQ ID NO: 865165 - RNA, 22 nt, Mycobacterium avium subsp. paratuberculosis
ccaggugcgccgccgcgucgcc

SEQ ID NO: 865166 - RNA, 20 nt, Mycobacterium avium subsp. paratuberculosis
ccaggugcacccgaugcucg

SEQ ID NO: 865167 - RNA, 21 nt, Mycobacterium avium subsp. paratuberculosis
ccaggugcacccgcggcgcga

SEQ ID NO: 865168 - RNA, 21 nt, Mycobacterium avium subsp. paratuberculosis
ccaggugcacgccgagcagca

SEQ ID NO: 865169 - RNA, 14 nt, Mycobacterium avium subsp. paratuberculosis
ccaggugcagaccg

SEQ ID NO: 865170 - RNA, 14 nt, Mycobacterium avium subsp. paratuberculosis
ccaggucccaggcg

SEQ ID NO: 865171 - RNA, 22 nt, Mycobacterium avium subsp. paratuberculosis
ccaggucccaggcguggucggc

SEQ ID NO: 865172 - RNA, 19 nt, Mycobacterium avium subsp. paratuberculosis
ccaggguuggucggagccg

SEQ ID NO: 865173 - RNA, 19 nt, Mycobacterium avium subsp. paratuberculosis
ccaggguuucaugcacggc

SEQ ID NO: 865174 - RNA, 21 nt, Mycobacterium avium subsp. paratuberculosis
ccaggguuugggcgugcggcc

SEQ ID NO: 865175 - RNA, 22 nt, Mycobacterium avium subsp. paratuberculosis
ccaggucaugguggcggcgccg

SEQ ID NO: 865176 - RNA, 14 nt, Mycobacterium avium subsp. paratuberculosis
ccagggugguggug

SEQ ID NO: 865177 - RNA, 16 nt, Mycobacterium avium subsp. paratuberculosis
ccagguccaccccgcc

SEQ ID NO: 865178 - RNA, 23 nt, Mycobacterium avium subsp. paratuberculosis
ccagguccaccguugucucggcg

SEQ ID NO: 865179 - RNA, 15 nt, Mycobacterium avium subsp. paratuberculosis
ccagggugucgauga

SEQ ID NO: 865180 - RNA, 13 nt, Mycobacterium avium subsp. paratuberculosis
ccagggugucguc

SEQ ID NO: 865181 - RNA, 22 nt, Mycobacterium avium subsp. paratuberculosis
ccagggugucgucgucgguuuc

SEQ ID NO: 865182 - RNA, 20 nt, Mycobacterium avium subsp. paratuberculosis
ccagggugucccagcgccac

SEQ ID NO: 865183 - RNA, 20 nt, Mycobacterium avium subsp. paratuberculosis
ccagggucucgcgcagcacg

SEQ ID NO: 865184 - RNA, 19 nt, Mycobacterium avium subsp. paratuberculosis
ccagggucucgggcagcag

SEQ ID NO: 865185 - RNA, 15 nt, Mycobacterium avium subsp. paratuberculosis
ccaggguggucagcg

SEQ ID NO: 865186 - RNA, 18 nt, Mycobacterium avium subsp. paratuberculosis
ccaggguggucagcgucu

SEQ ID NO: 865187 - RNA, 12 nt, Mycobacterium avium subsp. paratuberculosis
ccagggugccga

SEQ ID NO: 865188 - RNA, 17 nt, Mycobacterium avium subsp. paratuberculosis
ccagggugccgacgacc

SEQ ID NO: 865189 - RNA, 15 nt, Mycobacterium avium subsp. paratuberculosis
ccagggugccgccgg

SEQ ID NO: 865190 - RNA, 17 nt, Mycobacterium avium subsp. paratuberculosis
ccagggugccgccgggc

SEQ ID NO: 865191 - RNA, 21 nt, Mycobacterium avium subsp. paratuberculosis
ccagggugccgcugcccgccg

SEQ ID NO: 865192 - RNA, 16 nt, Mycobacterium avium subsp. paratuberculosis
ccagggugcgcacgau

SEQ ID NO: 865193 - RNA, 15 nt, Mycobacterium avium subsp. paratuberculosis
ccagggugcgccgcu

SEQ ID NO: 865194 - RNA, 17 nt, Mycobacterium avium subsp. paratuberculosis
ccagggugcgccgcucg

SEQ ID NO: 865195 - RNA, 17 nt, Mycobacterium avium subsp. paratuberculosis
ccaggguggccagcacg

SEQ ID NO: 865196 - RNA, 20 nt, Mycobacterium avium subsp. paratuberculosis
ccaggguggccagcacgcug

SEQ ID NO: 865197 - RNA, 19 nt, Mycobacterium avium subsp. paratuberculosis
ccaggguggccccagcccg

SEQ ID NO: 865198 - RNA, 21 nt, Mycobacterium avium subsp. paratuberculosis
ccaggguggccccagcccggg

SEQ ID NO: 865199 - RNA, 13 nt, Mycobacterium avium subsp. paratuberculosis
ccaggguggccgc

SEQ ID NO: 865200 - RNA, 15 nt, Mycobacterium avium subsp. paratuberculosis
ccaggguggccgcca

SEQ ID NO: 865201 - RNA, 17 nt, Mycobacterium avium subsp. paratuberculosis
ccaggguagaggcggcg

SEQ ID NO: 865202 - RNA, 18 nt, Mycobacterium avium subsp. paratuberculosis
ccaggguagaggcggcga

SEQ ID NO: 865203 - RNA, 14 nt, Mycobacterium avium subsp. paratuberculosis
ccaggggcagcuga

SEQ ID NO: 865204 - RNA, 14 nt, Mycobacterium avium subsp. paratuberculosis
ccaggggagcggcg

SEQ ID NO: 865205 - RNA, 20 nt, Mycobacterium avium subsp. paratuberculosis
ccagggacaugccgagcagc

SEQ ID NO: 865206 - RNA, 21 nt, Mycobacterium avium subsp. paratuberculosis
ccagcgcguugaagcugacga

SEQ ID NO: 865207 - RNA, 17 nt, Mycobacterium avium subsp. paratuberculosis
ccagcgcguugcggccg

SEQ ID NO: 865208 - RNA, 15 nt, Mycobacterium avium subsp. paratuberculosis
ccagcgcuggccggc

SEQ ID NO: 865209 - RNA, 24 nt, Mycobacterium avium subsp. paratuberculosis
ccagcgcuggccggccaccagcgg

SEQ ID NO: 865210 - RNA, 15 nt, Mycobacterium avium subsp. paratuberculosis
ccaggccacccgggc

SEQ ID NO: 865211 - RNA, 19 nt, Mycobacterium avium subsp. paratuberculosis
ccaggccacccgggcgccg

SEQ ID NO: 865212 - RNA, 12 nt, Mycobacterium avium subsp. paratuberculosis
ccaggccaccgc

SEQ ID NO: 865213 - RNA, 15 nt, Mycobacterium avium subsp. paratuberculosis
ccaggccaacagcag

SEQ ID NO: 865214 - RNA, 17 nt, Mycobacterium avium subsp. paratuberculosis
ccagcgcucgacgaggc

SEQ ID NO: 865215 - RNA, 18 nt, Mycobacterium avium subsp. paratuberculosis
ccaggcccagcagcaccg

SEQ ID NO: 865216 - RNA, 22 nt, Mycobacterium avium subsp. paratuberculosis
ccaggcccagcagcaccgcgac

SEQ ID NO: 865217 - RNA, 13 nt, Mycobacterium avium subsp. paratuberculosis
ccaggcccagccc

SEQ ID NO: 865218 - RNA, 15 nt, Mycobacterium avium subsp. paratuberculosis
ccaggcccagcccac

SEQ ID NO: 865219 - RNA, 14 nt, Mycobacterium avium subsp. paratuberculosis
ccaggcccagcccg

SEQ ID NO: 865220 - RNA, 14 nt, Mycobacterium avium subsp. paratuberculosis
ccaggcccaccguc

SEQ ID NO: 865221 - RNA, 15 nt, Mycobacterium avium subsp. paratuberculosis
ccaggccauggcgca

SEQ ID NO: 865222 - RNA, 18 nt, Mycobacterium avium subsp. paratuberculosis
ccaggccauggcgcaccg

SEQ ID NO: 865223 - RNA, 21 nt, Mycobacterium avium subsp. paratuberculosis
ccaggccauggcgcaccgcgg

SEQ ID NO: 865224 - RNA, 18 nt, Mycobacterium avium subsp. paratuberculosis
ccaggccgaagacgauga

SEQ ID NO: 865225 - RNA, 15 nt, Mycobacterium avium subsp. paratuberculosis
ccaggccgacgccgg

SEQ ID NO: 865226 - RNA, 17 nt, Mycobacterium avium subsp. paratuberculosis
ccaggccgacgccggcc

SEQ ID NO: 865227 - RNA, 18 nt, Mycobacterium avium subsp. paratuberculosis
ccaggccgacgcuggccg

SEQ ID NO: 865228 - RNA, 20 nt, Mycobacterium avium subsp. paratuberculosis
ccaggcccucgccgcgguca

SEQ ID NO: 865229 - RNA, 17 nt, Mycobacterium avium subsp. paratuberculosis
ccaggcccggcaccggu

SEQ ID NO: 865230 - RNA, 14 nt, Mycobacterium avium subsp. paratuberculosis
ccaggccccggccg

SEQ ID NO: 865231 - RNA, 17 nt, Mycobacterium avium subsp. paratuberculosis
ccaggccccggccgagc

SEQ ID NO: 865232 - RNA, 13 nt, Mycobacterium avium subsp. paratuberculosis
ccaggcccagcgg

SEQ ID NO: 865233 - RNA, 15 nt, Mycobacterium avium subsp. paratuberculosis
ccaggcuggccaggc

SEQ ID NO: 865234 - RNA, 20 nt, Mycobacterium avium subsp. paratuberculosis
ccaggcuuggcccgccgccg

SEQ ID NO: 865235 - RNA, 22 nt, Mycobacterium avium subsp. paratuberculosis
ccaggcuuggcccgccgccggc

SEQ ID NO: 865236 - RNA, 16 nt, Mycobacterium avium subsp. paratuberculosis
ccaggcguggucggcg

SEQ ID NO: 865237 - RNA, 23 nt, Mycobacterium avium subsp. paratuberculosis
ccaggcguggucggcgcggucca

SEQ ID NO: 865238 - RNA, 22 nt, Mycobacterium avium subsp. paratuberculosis
ccaggcgggccaccacaguggc

SEQ ID NO: 865239 - RNA, 22 nt, Mycobacterium avium subsp. paratuberculosis
ccaggcggcgacgaacgccggc

SEQ ID NO: 865240 - RNA, 17 nt, Mycobacterium avium subsp. paratuberculosis
ccaggcgcccugcacga

SEQ ID NO: 865241 - RNA, 12 nt, Mycobacterium avium subsp. paratuberculosis
ccaggcgcaccg

SEQ ID NO: 865242 - RNA, 17 nt, Mycobacterium avium subsp. paratuberculosis
ccaggcgcaccgccacc

SEQ ID NO: 865243 - RNA, 19 nt, Mycobacterium avium subsp. paratuberculosis
ccaggcgcaccgccaccgc

SEQ ID NO: 865244 - RNA, 20 nt, Mycobacterium avium subsp. paratuberculosis
ccaggcgcaccgccaccgcg

SEQ ID NO: 865245 - RNA, 14 nt, Mycobacterium avium subsp. paratuberculosis
ccaggcgccacagc

SEQ ID NO: 865246 - RNA, 20 nt, Mycobacterium avium subsp. paratuberculosis
ccaggcgccacagcagcacc

SEQ ID NO: 865247 - RNA, 21 nt, Mycobacterium avium subsp. paratuberculosis
ccaggcgccacagcagcacca

SEQ ID NO: 865248 - RNA, 15 nt, Mycobacterium avium subsp. paratuberculosis
ccaggcgcccagcac

SEQ ID NO: 865249 - RNA, 19 nt, Mycobacterium avium subsp. paratuberculosis
ccaggcgaugaagccggcg

SEQ ID NO: 865250 - RNA, 21 nt, Mycobacterium avium subsp. paratuberculosis
ccauaccccccacgcucggcg

SEQ ID NO: 865251 - RNA, 15 nt, Mycobacterium avium subsp. paratuberculosis
ccauacacgggccgu

SEQ ID NO: 865252 - RNA, 18 nt, Mycobacterium avium subsp. paratuberculosis
ccauacacgggccgucca

SEQ ID NO: 865253 - RNA, 20 nt, Mycobacterium avium subsp. paratuberculosis
ccaguuguuuccccagcccg

SEQ ID NO: 865254 - RNA, 23 nt, Mycobacterium avium subsp. paratuberculosis
ccaguuguuuccccagcccggau

SEQ ID NO: 865255 - RNA, 15 nt, Mycobacterium avium subsp. paratuberculosis
ccaguuggcgucguc

SEQ ID NO: 865256 - RNA, 13 nt, Mycobacterium avium subsp. paratuberculosis
ccaguugucgauc

SEQ ID NO: 865257 - RNA, 18 nt, Mycobacterium avium subsp. paratuberculosis
ccaguuucacgucggcga

SEQ ID NO: 865258 - RNA, 19 nt, Mycobacterium avium subsp. paratuberculosis
ccaguuucacgucggcgau

SEQ ID NO: 865259 - RNA, 20 nt, Mycobacterium avium subsp. paratuberculosis
ccauaaaccggccggcgcgc

SEQ ID NO: 865260 - RNA, 21 nt, Mycobacterium avium subsp. paratuberculosis
ccauaucgagguaggccaccg

SEQ ID NO: 865261 - RNA, 23 nt, Mycobacterium avium subsp. paratuberculosis
ccaucaacccgagcaccgggccg

SEQ ID NO: 865262 - RNA, 14 nt, Mycobacterium avium subsp. paratuberculosis
ccaucaccagcgcg

SEQ ID NO: 865263 - RNA, 15 nt, Mycobacterium avium subsp. paratuberculosis
ccaucaccccgaagc

SEQ ID NO: 865264 - RNA, 16 nt, Mycobacterium avium subsp. paratuberculosis
ccaucaccgcaccgac

SEQ ID NO: 865265 - RNA, 19 nt, Mycobacterium avium subsp. paratuberculosis
ccaucaccggaccggccag

SEQ ID NO: 865266 - RNA, 20 nt, Mycobacterium avium subsp. paratuberculosis
ccaucaccggaccggccagc

SEQ ID NO: 865267 - RNA, 21 nt, Mycobacterium avium subsp. paratuberculosis
ccaucaccggaccggccagca

SEQ ID NO: 865268 - RNA, 21 nt, Mycobacterium avium subsp. paratuberculosis
ccaucacgcagaacucgucgc

SEQ ID NO: 865269 - RNA, 21 nt, Mycobacterium avium subsp. paratuberculosis
ccaucagcagcgccucgccgg

SEQ ID NO: 865270 - RNA, 15 nt, Mycobacterium avium subsp. paratuberculosis
ccaucagcccgguga

SEQ ID NO: 865271 - RNA, 15 nt, Mycobacterium avium subsp. paratuberculosis
ccaucagccgccguc

SEQ ID NO: 865272 - RNA, 17 nt, Mycobacterium avium subsp. paratuberculosis
ccaucagccgccgucgc

SEQ ID NO: 865273 - RNA, 18 nt, Mycobacterium avium subsp. paratuberculosis
ccaucagccgccgucgcg

SEQ ID NO: 865274 - RNA, 17 nt, Mycobacterium avium subsp. paratuberculosis
ccaucagcaccacguug

SEQ ID NO: 865275 - RNA, 17 nt, Mycobacterium avium subsp. paratuberculosis
ccaucagccugcgguga

SEQ ID NO: 865276 - RNA, 14 nt, Mycobacterium avium subsp. paratuberculosis
ccaucagcaccgaa

SEQ ID NO: 865277 - RNA, 15 nt, Mycobacterium avium subsp. paratuberculosis
ccaucagcggcucgc

SEQ ID NO: 865278 - RNA, 18 nt, Mycobacterium avium subsp. paratuberculosis
ccaucagcgcccgggugg

SEQ ID NO: 865279 - RNA, 22 nt, Mycobacterium avium subsp. paratuberculosis
ccaguccagcgaaucgaccggg

SEQ ID NO: 865280 - RNA, 14 nt, Mycobacterium avium subsp. paratuberculosis
ccagucccagcaca

SEQ ID NO: 865281 - RNA, 15 nt, Mycobacterium avium subsp. paratuberculosis
ccagucccagcacag

SEQ ID NO: 865282 - RNA, 13 nt, Mycobacterium avium subsp. paratuberculosis
ccaguccgccgcc

SEQ ID NO: 865283 - RNA, 17 nt, Mycobacterium avium subsp. paratuberculosis
ccagucgcgcagcguca

SEQ ID NO: 865284 - RNA, 18 nt, Mycobacterium avium subsp. paratuberculosis
ccagucgcgcagcgucau

SEQ ID NO: 865285 - RNA, 19 nt, Mycobacterium avium subsp. paratuberculosis
ccagucgcgcagcgucauc

SEQ ID NO: 865286 - RNA, 13 nt, Mycobacterium avium subsp. paratuberculosis
ccagucgcgccga

SEQ ID NO: 865287 - RNA, 14 nt, Mycobacterium avium subsp. paratuberculosis
ccagucgcgccgag

SEQ ID NO: 865288 - RNA, 22 nt, Mycobacterium avium subsp. paratuberculosis
ccagucgcgccgagguggccgc

SEQ ID NO: 865289 - RNA, 20 nt, Mycobacterium avium subsp. paratuberculosis
ccagucggccaucagcaccg

SEQ ID NO: 865290 - RNA, 13 nt, Mycobacterium avium subsp. paratuberculosis
ccagucggcgccg

SEQ ID NO: 865291 - RNA, 15 nt, Mycobacterium avium subsp. paratuberculosis
ccagucggcgccgau

SEQ ID NO: 865292 - RNA, 16 nt, Mycobacterium avium subsp. paratuberculosis
ccagucggcgccgaug

SEQ ID NO: 865293 - RNA, 19 nt, Mycobacterium avium subsp. paratuberculosis
ccagucggcgccgaugcag

SEQ ID NO: 865294 - RNA, 20 nt, Mycobacterium avium subsp. paratuberculosis
ccagucggcgccgaugcagc

SEQ ID NO: 865295 - RNA, 13 nt, Mycobacterium avium subsp. paratuberculosis
ccagucggcgucu

SEQ ID NO: 865296 - RNA, 15 nt, Mycobacterium avium subsp. paratuberculosis
ccagucggcgucuuc

SEQ ID NO: 865297 - RNA, 17 nt, Mycobacterium avium subsp. paratuberculosis
ccagucguuggugcgca

SEQ ID NO: 865298 - RNA, 22 nt, Mycobacterium avium subsp. paratuberculosis
ccagucguuggugcgcaccagc

SEQ ID NO: 865299 - RNA, 17 nt, Mycobacterium avium subsp. paratuberculosis
ccagugccaguaccagc

SEQ ID NO: 865300 - RNA, 20 nt, Mycobacterium avium subsp. paratuberculosis
ccagugccaguaccagcggc

SEQ ID NO: 865301 - RNA, 15 nt, Mycobacterium avium subsp. paratuberculosis
ccagugcaugccggc

SEQ ID NO: 865302 - RNA, 19 nt, Mycobacterium avium subsp. paratuberculosis
ccagugcacgcucggcggg

SEQ ID NO: 865303 - RNA, 17 nt, Mycobacterium avium subsp. paratuberculosis
ccagucugagcccgggc

SEQ ID NO: 865304 - RNA, 18 nt, Mycobacterium avium subsp. paratuberculosis
ccagucugagcccgggca

SEQ ID NO: 865305 - RNA, 19 nt, Mycobacterium avium subsp. paratuberculosis
ccagucugagcccgggcag

SEQ ID NO: 865306 - RNA, 14 nt, Mycobacterium avium subsp. paratuberculosis
ccagugcccgagca

SEQ ID NO: 865307 - RNA, 21 nt, Mycobacterium avium subsp. paratuberculosis
ccagugccgcagguggugggc

SEQ ID NO: 865308 - RNA, 13 nt, Mycobacterium avium subsp. paratuberculosis
ccagugccggcga

SEQ ID NO: 865309 - RNA, 21 nt, Mycobacterium avium subsp. paratuberculosis
ccagugccgggccagcugcuc

SEQ ID NO: 865310 - RNA, 14 nt, Mycobacterium avium subsp. paratuberculosis
ccagugcccggcca

SEQ ID NO: 865311 - RNA, 15 nt, Mycobacterium avium subsp. paratuberculosis
ccagugcgcgccgug

SEQ ID NO: 865312 - RNA, 18 nt, Mycobacterium avium subsp. paratuberculosis
ccaguguggccgcggcgg

SEQ ID NO: 865313 - RNA, 20 nt, Mycobacterium avium subsp. paratuberculosis
ccaguguggccgcggcggcc

SEQ ID NO: 865314 - RNA, 14 nt, Mycobacterium avium subsp. paratuberculosis
ccaguucaccgcgc

SEQ ID NO: 865315 - RNA, 17 nt, Mycobacterium avium subsp. paratuberculosis
ccaguggaucggcccga

SEQ ID NO: 865316 - RNA, 17 nt, Mycobacterium avium subsp. paratuberculosis
ccaguguccgggcgccc

SEQ ID NO: 865317 - RNA, 18 nt, Mycobacterium avium subsp. paratuberculosis
ccaguguccgggcgccca

SEQ ID NO: 865318 - RNA, 14 nt, Mycobacterium avium subsp. paratuberculosis
ccagugguggccga

SEQ ID NO: 865319 - RNA, 18 nt, Mycobacterium avium subsp. paratuberculosis
ccaguggcugucgggugc

SEQ ID NO: 865320 - RNA, 20 nt, Mycobacterium avium subsp. paratuberculosis
ccaguugaaguccggcgguc

SEQ ID NO: 865321 - RNA, 14 nt, Mycobacterium avium subsp. paratuberculosis
ccaguugacggcgc

SEQ ID NO: 865322 - RNA, 15 nt, Mycobacterium avium subsp. paratuberculosis
ccaguugacggcgca

SEQ ID NO: 865323 - RNA, 16 nt, Mycobacterium avium subsp. paratuberculosis
ccaguugacguugauc

SEQ ID NO: 865324 - RNA, 18 nt, Mycobacterium avium subsp. paratuberculosis
ccaguugacguugaucgc

SEQ ID NO: 865325 - RNA, 23 nt, Mycobacterium avium subsp. paratuberculosis
ccaguugacguugaucgcgccga

SEQ ID NO: 865326 - RNA, 18 nt, Mycobacterium avium subsp. paratuberculosis
ccaguucggccaccgcgu

SEQ ID NO: 865327 - RNA, 18 nt, Mycobacterium avium subsp. paratuberculosis
ccaguucggccagcgcgg

SEQ ID NO: 865328 - RNA, 19 nt, Mycobacterium avium subsp. paratuberculosis
ccaguucuucgaugacggc

SEQ ID NO: 865329 - RNA, 13 nt, Mycobacterium avium subsp. paratuberculosis
ccaguugcggcac

SEQ ID NO: 865330 - RNA, 17 nt, Mycobacterium avium subsp. paratuberculosis
ccaguugcgaccccgcc

SEQ ID NO: 865331 - RNA, 21 nt, Mycobacterium avium subsp. paratuberculosis
ccaguugcgaccccgccgucg

SEQ ID NO: 865332 - RNA, 16 nt, Mycobacterium avium subsp. paratuberculosis
ccaguugcaccggcac

SEQ ID NO: 865333 - RNA, 17 nt, Mycobacterium avium subsp. paratuberculosis
ccaguugcaccggcacc

SEQ ID NO: 865334 - RNA, 19 nt, Mycobacterium avium subsp. paratuberculosis
ccaguucgcguacccgcgc

SEQ ID NO: 865335 - RNA, 21 nt, Mycobacterium avium subsp. paratuberculosis
ccaguucgcguacccgcgcgg

SEQ ID NO: 865336 - RNA, 15 nt, Mycobacterium avium subsp. paratuberculosis
ccaguucgagcgccg

SEQ ID NO: 865337 - RNA, 16 nt, Mycobacterium avium subsp. paratuberculosis
ccaguucgagcgccgc

SEQ ID NO: 865338 - RNA, 14 nt, Mycobacterium avium subsp. paratuberculosis
ccaguucgccacca

SEQ ID NO: 865339 - RNA, 24 nt, Mycobacterium avium subsp. paratuberculosis
cccgaagcucaucaccggcgcgcc

SEQ ID NO: 865340 - RNA, 15 nt, Mycobacterium avium subsp. paratuberculosis
cccgaaggugguggc

SEQ ID NO: 865341 - RNA, 16 nt, Mycobacterium avium subsp. paratuberculosis
cccgaccuucugcugc

SEQ ID NO: 865342 - RNA, 20 nt, Mycobacterium avium subsp. paratuberculosis
cccgaccuuuugcccggcga

SEQ ID NO: 865343 - RNA, 18 nt, Mycobacterium avium subsp. paratuberculosis
cccgacgaagccgccgcc

SEQ ID NO: 865344 - RNA, 13 nt, Mycobacterium avium subsp. paratuberculosis
cccgaccgcgccg

SEQ ID NO: 865345 - RNA, 14 nt, Mycobacterium avium subsp. paratuberculosis
cccgaccgcgccga

SEQ ID NO: 865346 - RNA, 15 nt, Mycobacterium avium subsp. paratuberculosis
cccgaccgcgccgaa

SEQ ID NO: 865347 - RNA, 16 nt, Mycobacterium avium subsp. paratuberculosis
cccgacgaucgcgccg

SEQ ID NO: 865348 - RNA, 21 nt, Mycobacterium avium subsp. paratuberculosis
cccgacgaucgcgccggccgc

SEQ ID NO: 865349 - RNA, 20 nt, Mycobacterium avium subsp. paratuberculosis
cccgaccugaucuucgagac

SEQ ID NO: 865350 - RNA, 16 nt, Mycobacterium avium subsp. paratuberculosis
cccgacgacgacgucg

SEQ ID NO: 865351 - RNA, 21 nt, Mycobacterium avium subsp. paratuberculosis
cccgacgacgacgucgacgac

SEQ ID NO: 865352 - RNA, 12 nt, Mycobacterium avium subsp. paratuberculosis
cccgacgacgcc

SEQ ID NO: 865353 - RNA, 12 nt, Mycobacterium avium subsp. paratuberculosis
cccgacgccgac

SEQ ID NO: 865354 - RNA, 14 nt, Mycobacterium avium subsp. paratuberculosis
cccgacgccgacac

SEQ ID NO: 865355 - RNA, 20 nt, Mycobacterium avium subsp. paratuberculosis
cccgacgccgacaccagcgc

SEQ ID NO: 865356 - RNA, 13 nt, Mycobacterium avium subsp. paratuberculosis
cccgacgccgacg

SEQ ID NO: 865357 - RNA, 14 nt, Mycobacterium avium subsp. paratuberculosis
cccgacgccgacgg

SEQ ID NO: 865358 - RNA, 15 nt, Mycobacterium avium subsp. paratuberculosis
cccgacgccgacggc

SEQ ID NO: 865359 - RNA, 13 nt, Mycobacterium avium subsp. paratuberculosis
cccgacgccggac

SEQ ID NO: 865360 - RNA, 14 nt, Mycobacterium avium subsp. paratuberculosis
cccgacgccggacc

SEQ ID NO: 865361 - RNA, 17 nt, Mycobacterium avium subsp. paratuberculosis
cccgacgccggacccca

SEQ ID NO: 865362 - RNA, 23 nt, Mycobacterium avium subsp. paratuberculosis
cccgacgccggaccccacagcgc

SEQ ID NO: 865363 - RNA, 16 nt, Mycobacterium avium subsp. paratuberculosis
cccgaucaacaccgcc

SEQ ID NO: 865364 - RNA, 21 nt, Mycobacterium avium subsp. paratuberculosis
cccgaucaacaccgccagcac

SEQ ID NO: 865365 - RNA, 13 nt, Mycobacterium avium subsp. paratuberculosis
cccgaucaccagg

SEQ ID NO: 865366 - RNA, 23 nt, Mycobacterium avium subsp. paratuberculosis
cccgaucaccaggcccaggccga

SEQ ID NO: 865367 - RNA, 12 nt, Mycobacterium avium subsp. paratuberculosis
cccgaucagcgu

SEQ ID NO: 865368 - RNA, 16 nt, Mycobacterium avium subsp. paratuberculosis
cccgauccacggcgac

SEQ ID NO: 865369 - RNA, 17 nt, Mycobacterium avium subsp. paratuberculosis
cccgauccagggcccgc

SEQ ID NO: 865370 - RNA, 14 nt, Mycobacterium avium subsp. paratuberculosis
cccgacggcgcgcc

SEQ ID NO: 865371 - RNA, 12 nt, Mycobacterium avium subsp. paratuberculosis
cccgacuucggc

SEQ ID NO: 865372 - RNA, 16 nt, Mycobacterium avium subsp. paratuberculosis
cccgacuucggcucgg

SEQ ID NO: 865373 - RNA, 20 nt, Mycobacterium avium subsp. paratuberculosis
cccgacuucggcucggcgac

SEQ ID NO: 865374 - RNA, 22 nt, Mycobacterium avium subsp. paratuberculosis
cccgacuucggcucggcgacaa

SEQ ID NO: 865375 - RNA, 15 nt, Mycobacterium avium subsp. paratuberculosis
cccgauagccccgcc

SEQ ID NO: 865376 - RNA, 20 nt, Mycobacterium avium subsp. paratuberculosis
cccgauagccccgccaggcg

SEQ ID NO: 865377 - RNA, 14 nt, Mycobacterium avium subsp. paratuberculosis
cccgauaggccgac

SEQ ID NO: 865378 - RNA, 16 nt, Mycobacterium avium subsp. paratuberculosis
cccgauaggccgacug

SEQ ID NO: 865379 - RNA, 13 nt, Mycobacterium avium subsp. paratuberculosis
cccgacggcgcgc

SEQ ID NO: 865380 - RNA, 17 nt, Mycobacterium avium subsp. paratuberculosis
cccgacggcgccgcggc

SEQ ID NO: 865381 - RNA, 19 nt, Mycobacterium avium subsp. paratuberculosis
cccgacggcgccgcggccg

SEQ ID NO: 865382 - RNA, 13 nt, Mycobacterium avium subsp. paratuberculosis
cccgacggcagca

SEQ ID NO: 865383 - RNA, 16 nt, Mycobacterium avium subsp. paratuberculosis
cccgacggcagcaccg

SEQ ID NO: 865384 - RNA, 13 nt, Mycobacterium avium subsp. paratuberculosis
cccgacgcggcgc

SEQ ID NO: 865385 - RNA, 15 nt, Mycobacterium avium subsp. paratuberculosis
cccgacgcggcgcga

SEQ ID NO: 865386 - RNA, 23 nt, Mycobacterium avium subsp. paratuberculosis
cccgacgcggcgcgacaccgcgg

SEQ ID NO: 865387 - RNA, 22 nt, Mycobacterium avium subsp. paratuberculosis
cccgacgcugacgaugcggccg

SEQ ID NO: 865388 - RNA, 21 nt, Mycobacterium avium subsp. paratuberculosis
cccgacgggaacucggccagc

SEQ ID NO: 865389 - RNA, 20 nt, Mycobacterium avium subsp. paratuberculosis
cccgacggguucgcgcagcc

SEQ ID NO: 865390 - RNA, 21 nt, Mycobacterium avium subsp. paratuberculosis
cccgacggguucgcgcagcca

SEQ ID NO: 865391 - RNA, 13 nt, Mycobacterium avium subsp. paratuberculosis
cccgacggucgcc

SEQ ID NO: 865392 - RNA, 15 nt, Mycobacterium avium subsp. paratuberculosis
cccgacggucgccac

SEQ ID NO: 865393 - RNA, 17 nt, Mycobacterium avium subsp. paratuberculosis
cccgacggucgccacca

SEQ ID NO: 865394 - RNA, 19 nt, Mycobacterium avium subsp. paratuberculosis
cccgacgucgacgcgggcg

SEQ ID NO: 865395 - RNA, 17 nt, Mycobacterium avium subsp. paratuberculosis
cccgacgugcagcgcca

SEQ ID NO: 865396 - RNA, 16 nt, Mycobacterium avium subsp. paratuberculosis
cccgacguugccgcug

SEQ ID NO: 865397 - RNA, 23 nt, Mycobacterium avium subsp. paratuberculosis
cccgacguugccgcuggucaggc

SEQ ID NO: 865398 - RNA, 14 nt, Mycobacterium avium subsp. paratuberculosis
cccgacuccucaca

SEQ ID NO: 865399 - RNA, 20 nt, Mycobacterium avium subsp. paratuberculosis
cccgacuccucacaccucgc

SEQ ID NO: 865400 - RNA, 13 nt, Mycobacterium avium subsp. paratuberculosis
ccccucggccggu

SEQ ID NO: 865401 - RNA, 20 nt, Mycobacterium avium subsp. paratuberculosis
ccccucgaccaccucuucgc

SEQ ID NO: 865402 - RNA, 14 nt, Mycobacterium avium subsp. paratuberculosis
ccccucgacccgaa

SEQ ID NO: 865403 - RNA, 20 nt, Mycobacterium avium subsp. paratuberculosis
ccccucgacgaacgcggcgg

SEQ ID NO: 865404 - RNA, 19 nt, Mycobacterium avium subsp. paratuberculosis
ccccgcgcugcccagcgcg

SEQ ID NO: 865405 - RNA, 12 nt, Mycobacterium avium subsp. paratuberculosis
ccccuccagccg

SEQ ID NO: 865406 - RNA, 14 nt, Mycobacterium avium subsp. paratuberculosis
ccccuccagccgcc

SEQ ID NO: 865407 - RNA, 21 nt, Mycobacterium avium subsp. paratuberculosis
ccccucccaccacggccgaug

SEQ ID NO: 865408 - RNA, 20 nt, Mycobacterium avium subsp. paratuberculosis
cccgaacuucagcgcgucgu

SEQ ID NO: 865409 - RNA, 16 nt, Mycobacterium avium subsp. paratuberculosis
cccgaacgcgcgucgg

SEQ ID NO: 865410 - RNA, 17 nt, Mycobacterium avium subsp. paratuberculosis
cccgaacgcgcgucggu

SEQ ID NO: 865411 - RNA, 15 nt, Mycobacterium avium subsp. paratuberculosis
cccgaacgcgucguc

SEQ ID NO: 865412 - RNA, 14 nt, Mycobacterium avium subsp. paratuberculosis
cccgaacggaccgg

SEQ ID NO: 865413 - RNA, 15 nt, Mycobacterium avium subsp. paratuberculosis
cccgaacggaccggg

SEQ ID NO: 865414 - RNA, 16 nt, Mycobacterium avium subsp. paratuberculosis
cccgaacggaccgggc

SEQ ID NO: 865415 - RNA, 19 nt, Mycobacterium avium subsp. paratuberculosis
cccgaaccaguucgccacc

SEQ ID NO: 865416 - RNA, 22 nt, Mycobacterium avium subsp. paratuberculosis
cccgaaccaguucgccaccacg

SEQ ID NO: 865417 - RNA, 15 nt, Mycobacterium avium subsp. paratuberculosis
cccgaacagccgggc

SEQ ID NO: 865418 - RNA, 16 nt, Mycobacterium avium subsp. paratuberculosis
cccgaacagccgggcg

SEQ ID NO: 865419 - RNA, 18 nt, Mycobacterium avium subsp. paratuberculosis
cccgaacagccgggcggc

SEQ ID NO: 865420 - RNA, 20 nt, Mycobacterium avium subsp. paratuberculosis
cccgaacagggcgacggcgg

SEQ ID NO: 865421 - RNA, 21 nt, Mycobacterium avium subsp. paratuberculosis
cccgaacagggcgacggcggc

SEQ ID NO: 865422 - RNA, 23 nt, Mycobacterium avium subsp. paratuberculosis
cccgaacaucgccucggccgcgg

SEQ ID NO: 865423 - RNA, 13 nt, Mycobacterium avium subsp. paratuberculosis
ccccguugccgcc

SEQ ID NO: 865424 - RNA, 15 nt, Mycobacterium avium subsp. paratuberculosis
ccccguugccgccgg

SEQ ID NO: 865425 - RNA, 19 nt, Mycobacterium avium subsp. paratuberculosis
ccccguugccgccggcgcc

SEQ ID NO: 865426 - RNA, 22 nt, Mycobacterium avium subsp. paratuberculosis
ccccguugaucuugaccgucgc

SEQ ID NO: 865427 - RNA, 24 nt, Mycobacterium avium subsp. paratuberculosis
ccccguugcacaggcacacgaaca

SEQ ID NO: 865428 - RNA, 15 nt, Mycobacterium avium subsp. paratuberculosis
ccccggcgcgacggc

SEQ ID NO: 865429 - RNA, 21 nt, Mycobacterium avium subsp. paratuberculosis
ccccggcgcggaacgcgccgg

SEQ ID NO: 865430 - RNA, 22 nt, Mycobacterium avium subsp. paratuberculosis
ccccggcgcggaacgcgccggg

SEQ ID NO: 865431 - RNA, 23 nt, Mycobacterium avium subsp. paratuberculosis
ccccggcgcggaacgcgccgggc

SEQ ID NO: 865432 - RNA, 13 nt, Mycobacterium avium subsp. paratuberculosis
ccccggcggcacc

SEQ ID NO: 865433 - RNA, 15 nt, Mycobacterium avium subsp. paratuberculosis
ccccggcggccacgc

SEQ ID NO: 865434 - RNA, 13 nt, Mycobacterium avium subsp. paratuberculosis
ccccggcggccgc

SEQ ID NO: 865435 - RNA, 15 nt, Mycobacterium avium subsp. paratuberculosis
ccccggcggccgcgu

SEQ ID NO: 865436 - RNA, 14 nt, Mycobacterium avium subsp. paratuberculosis
ccccggcggccggc

SEQ ID NO: 865437 - RNA, 14 nt, Mycobacterium avium subsp. paratuberculosis
ccccggccccggcc

SEQ ID NO: 865438 - RNA, 15 nt, Mycobacterium avium subsp. paratuberculosis
ccccggccccggccg

SEQ ID NO: 865439 - RNA, 16 nt, Mycobacterium avium subsp. paratuberculosis
ccccggccccggccgg

SEQ ID NO: 865440 - RNA, 18 nt, Mycobacterium avium subsp. paratuberculosis
ccccggccccggccggcg

SEQ ID NO: 865441 - RNA, 20 nt, Mycobacterium avium subsp. paratuberculosis
ccccgcgggucgucgacguc

SEQ ID NO: 865442 - RNA, 20 nt, Mycobacterium avium subsp. paratuberculosis
ccccggccagggugccgacg

SEQ ID NO: 865443 - RNA, 22 nt, Mycobacterium avium subsp. paratuberculosis
ccccggccagggugccgacgac

SEQ ID NO: 865444 - RNA, 14 nt, Mycobacterium avium subsp. paratuberculosis
ccccggcgaugacc

SEQ ID NO: 865445 - RNA, 21 nt, Mycobacterium avium subsp. paratuberculosis
ccccggcgacggcggugggcu

SEQ ID NO: 865446 - RNA, 15 nt, Mycobacterium avium subsp. paratuberculosis
ccccggcgacgucgc

SEQ ID NO: 865447 - RNA, 18 nt, Mycobacterium avium subsp. paratuberculosis
ccccggcgacgucgccgg

SEQ ID NO: 865448 - RNA, 23 nt, Mycobacterium avium subsp. paratuberculosis
ccccggcgacgucgccggccugc

SEQ ID NO: 865449 - RNA, 13 nt, Mycobacterium avium subsp. paratuberculosis
ccccggccgagcg

SEQ ID NO: 865450 - RNA, 12 nt, Mycobacterium avium subsp. paratuberculosis
ccccggcccguc

SEQ ID NO: 865451 - RNA, 15 nt, Mycobacterium avium subsp. paratuberculosis
ccccggcccguccag

SEQ ID NO: 865452 - RNA, 15 nt, Mycobacterium avium subsp. paratuberculosis
ccccggccgcgguga

SEQ ID NO: 865453 - RNA, 19 nt, Mycobacterium avium subsp. paratuberculosis
ccccggccggcccgcccgg

SEQ ID NO: 865454 - RNA, 22 nt, Mycobacterium avium subsp. paratuberculosis
ccccggccggcccgcccggcgg

SEQ ID NO: 865455 - RNA, 13 nt, Mycobacterium avium subsp. paratuberculosis
ccccggccggcgg

SEQ ID NO: 865456 - RNA, 14 nt, Mycobacterium avium subsp. paratuberculosis
ccccggccgggcga

SEQ ID NO: 865457 - RNA, 16 nt, Mycobacterium avium subsp. paratuberculosis
ccccagaaccgcucgg

SEQ ID NO: 865458 - RNA, 20 nt, Mycobacterium avium subsp. paratuberculosis
ccccagaaccgcucggcggc

SEQ ID NO: 865459 - RNA, 20 nt, Mycobacterium avium subsp. paratuberculosis
ccccacgcgcucagcgcggc

SEQ ID NO: 865460 - RNA, 22 nt, Mycobacterium avium subsp. paratuberculosis
ccccacgcgcucagcgcggcca

SEQ ID NO: 865461 - RNA, 12 nt, Mycobacterium avium subsp. paratuberculosis
ccccacgcucgg

SEQ ID NO: 865462 - RNA, 12 nt, Mycobacterium avium subsp. paratuberculosis
ccccacggccgc

SEQ ID NO: 865463 - RNA, 22 nt, Mycobacterium avium subsp. paratuberculosis
ccccacgggccauguccccgac

SEQ ID NO: 865464 - RNA, 22 nt, Mycobacterium avium subsp. paratuberculosis
ccccacgaguaaccggugcgcu

SEQ ID NO: 865465 - RNA, 13 nt, Mycobacterium avium subsp. paratuberculosis
ccccaccgugacg

SEQ ID NO: 865466 - RNA, 14 nt, Mycobacterium avium subsp. paratuberculosis
ccccaccgccgcug

SEQ ID NO: 865467 - RNA, 16 nt, Mycobacterium avium subsp. paratuberculosis
ccccaccgccgcugcg

SEQ ID NO: 865468 - RNA, 17 nt, Mycobacterium avium subsp. paratuberculosis
ccccaccgcgacacguc

SEQ ID NO: 865469 - RNA, 12 nt, Mycobacterium avium subsp. paratuberculosis
ccccaccgcgcc

SEQ ID NO: 865470 - RNA, 22 nt, Mycobacterium avium subsp. paratuberculosis
cccaggcgucgucgucgagccg

SEQ ID NO: 865471 - RNA, 23 nt, Mycobacterium avium subsp. paratuberculosis
cccaggcgaacauggcggccagc

SEQ ID NO: 865472 - RNA, 20 nt, Mycobacterium avium subsp. paratuberculosis
cccaggcgaugccgccgacg

SEQ ID NO: 865473 - RNA, 22 nt, Mycobacterium avium subsp. paratuberculosis
ccccagugcaggcugacgcgac

SEQ ID NO: 865474 - RNA, 18 nt, Mycobacterium avium subsp. paratuberculosis
ccccagggccucggcgac

SEQ ID NO: 865475 - RNA, 13 nt, Mycobacterium avium subsp. paratuberculosis
ccccaggucgggg

SEQ ID NO: 865476 - RNA, 14 nt, Mycobacterium avium subsp. paratuberculosis
ccccaggucggggu

SEQ ID NO: 865477 - RNA, 19 nt, Mycobacterium avium subsp. paratuberculosis
ccccaguuucccgucgggg

SEQ ID NO: 865478 - RNA, 22 nt, Mycobacterium avium subsp. paratuberculosis
ccccaguuucccgucggggugg

SEQ ID NO: 865479 - RNA, 22 nt, Mycobacterium avium subsp. paratuberculosis
ccccaguuggcgucgucggcgg

SEQ ID NO: 865480 - RNA, 20 nt, Mycobacterium avium subsp. paratuberculosis
ccccaggcgaacauggcggc

SEQ ID NO: 865481 - RNA, 14 nt, Mycobacterium avium subsp. paratuberculosis
ccccagcacgguga

SEQ ID NO: 865482 - RNA, 19 nt, Mycobacterium avium subsp. paratuberculosis
ccccagcaaaaccccgccg

SEQ ID NO: 865483 - RNA, 17 nt, Mycobacterium avium subsp. paratuberculosis
ccccgacaggcccaccc

SEQ ID NO: 865484 - RNA, 16 nt, Mycobacterium avium subsp. paratuberculosis
ccccgacaucgccauc

SEQ ID NO: 865485 - RNA, 20 nt, Mycobacterium avium subsp. paratuberculosis
ccccgaagcucaucaccggc

SEQ ID NO: 865486 - RNA, 23 nt, Mycobacterium avium subsp. paratuberculosis
ccccgaagcucaucaccggcgcg

SEQ ID NO: 865487 - RNA, 14 nt, Mycobacterium avium subsp. paratuberculosis
ccccgacaccgcca

SEQ ID NO: 865488 - RNA, 22 nt, Mycobacterium avium subsp. paratuberculosis
ccccgacaccgccagcagcgcc

SEQ ID NO: 865489 - RNA, 12 nt, Mycobacterium avium subsp. paratuberculosis
ccccgacccgaa

SEQ ID NO: 865490 - RNA, 13 nt, Mycobacterium avium subsp. paratuberculosis
ccccgaccgacgc

SEQ ID NO: 865491 - RNA, 15 nt, Mycobacterium avium subsp. paratuberculosis
ccccgaccgacgcgg

SEQ ID NO: 865492 - RNA, 20 nt, Mycobacterium avium subsp. paratuberculosis
ccccgacgaucgcgccggcc

SEQ ID NO: 865493 - RNA, 22 nt, Mycobacterium avium subsp. paratuberculosis
ccccgacgaucgcgccggccgc

SEQ ID NO: 865494 - RNA, 16 nt, Mycobacterium avium subsp. paratuberculosis
ccccgacgccgacggc

SEQ ID NO: 865495 - RNA, 19 nt, Mycobacterium avium subsp. paratuberculosis
ccccgacggcgccgcggcc

SEQ ID NO: 865496 - RNA, 20 nt, Mycobacterium avium subsp. paratuberculosis
ccccgacggcgccgcggccg

SEQ ID NO: 865497 - RNA, 17 nt, Mycobacterium avium subsp. paratuberculosis
ccccgaacccggccagc

SEQ ID NO: 865498 - RNA, 18 nt, Mycobacterium avium subsp. paratuberculosis
ccccgaacccggccagcg

SEQ ID NO: 865499 - RNA, 19 nt, Mycobacterium avium subsp. paratuberculosis
ccccgaacccggccagcgu

SEQ ID NO: 865500 - RNA, 20 nt, Mycobacterium avium subsp. paratuberculosis
ccccgaacagcgccagggug

SEQ ID NO: 865501 - RNA, 14 nt, Mycobacterium avium subsp. paratuberculosis
cccccggcgcgacg

SEQ ID NO: 865502 - RNA, 12 nt, Mycobacterium avium subsp. paratuberculosis
cccccgcggcgg

SEQ ID NO: 865503 - RNA, 13 nt, Mycobacterium avium subsp. paratuberculosis
cccccgcggcggc

SEQ ID NO: 865504 - RNA, 14 nt, Mycobacterium avium subsp. paratuberculosis
cccccgcggcggcc

SEQ ID NO: 865505 - RNA, 13 nt, Mycobacterium avium subsp. paratuberculosis
cccccgcggcguc

SEQ ID NO: 865506 - RNA, 21 nt, Mycobacterium avium subsp. paratuberculosis
cccccgcgggucgucgacguc

SEQ ID NO: 865507 - RNA, 16 nt, Mycobacterium avium subsp. paratuberculosis
cccccggaccugccgg

SEQ ID NO: 865508 - RNA, 12 nt, Mycobacterium avium subsp. paratuberculosis
cccccgcgccgc

SEQ ID NO: 865509 - RNA, 12 nt, Mycobacterium avium subsp. paratuberculosis
cccccgcagccc

SEQ ID NO: 865510 - RNA, 13 nt, Mycobacterium avium subsp. paratuberculosis
cccccgccgaccg

SEQ ID NO: 865511 - RNA, 15 nt, Mycobacterium avium subsp. paratuberculosis
cccccgacgccgaca

SEQ ID NO: 865512 - RNA, 21 nt, Mycobacterium avium subsp. paratuberculosis
cccccauacacgggccgucca

SEQ ID NO: 865513 - RNA, 12 nt, Mycobacterium avium subsp. paratuberculosis
ccccccgggcac

SEQ ID NO: 865514 - RNA, 20 nt, Mycobacterium avium subsp. paratuberculosis
ccccgaguuccagcuccguc

SEQ ID NO: 865515 - RNA, 18 nt, Mycobacterium avium subsp. paratuberculosis
ccccgaguucggccagau

SEQ ID NO: 865516 - RNA, 16 nt, Mycobacterium avium subsp. paratuberculosis
ccccgauagccccgcc

SEQ ID NO: 865517 - RNA, 19 nt, Mycobacterium avium subsp. paratuberculosis
ccccgaucaacaccgccag

SEQ ID NO: 865518 - RNA, 13 nt, Mycobacterium avium subsp. paratuberculosis
ccccgagccgacg

SEQ ID NO: 865519 - RNA, 14 nt, Mycobacterium avium subsp. paratuberculosis
ccccgccgccgugc

SEQ ID NO: 865520 - RNA, 13 nt, Mycobacterium avium subsp. paratuberculosis
ccccgccgcgccg

SEQ ID NO: 865521 - RNA, 14 nt, Mycobacterium avium subsp. paratuberculosis
ccccgccgcggcca

SEQ ID NO: 865522 - RNA, 14 nt, Mycobacterium avium subsp. paratuberculosis
ccccgccgcgucgg

SEQ ID NO: 865523 - RNA, 19 nt, Mycobacterium avium subsp. paratuberculosis
ccccgccggcccggucgac

SEQ ID NO: 865524 - RNA, 16 nt, Mycobacterium avium subsp. paratuberculosis
ccccgacgugcagcgc

SEQ ID NO: 865525 - RNA, 16 nt, Mycobacterium avium subsp. paratuberculosis
ccccgagaucgcgggc

SEQ ID NO: 865526 - RNA, 22 nt, Mycobacterium avium subsp. paratuberculosis
ccccgagcaggcggaucggccc

SEQ ID NO: 865527 - RNA, 13 nt, Mycobacterium avium subsp. paratuberculosis
ccccgagcgggcc

SEQ ID NO: 865528 - RNA, 14 nt, Mycobacterium avium subsp. paratuberculosis
ccccgagcucgggc

SEQ ID NO: 865529 - RNA, 18 nt, Mycobacterium avium subsp. paratuberculosis
ccccgagcucgggcgcga

SEQ ID NO: 865530 - RNA, 20 nt, Mycobacterium avium subsp. paratuberculosis
ccccgaggagacgucggccg

SEQ ID NO: 865531 - RNA, 16 nt, Mycobacterium avium subsp. paratuberculosis
ccccgcgcccgccgcg

SEQ ID NO: 865532 - RNA, 13 nt, Mycobacterium avium subsp. paratuberculosis
ccccgcgacgucc

SEQ ID NO: 865533 - RNA, 13 nt, Mycobacterium avium subsp. paratuberculosis
ccccgcgccgggc

SEQ ID NO: 865534 - RNA, 22 nt, Mycobacterium avium subsp. paratuberculosis
ccccgcgccgggcguugcccgc

SEQ ID NO: 865535 - RNA, 15 nt, Mycobacterium avium subsp. paratuberculosis
ccccgcgcggcucgc

SEQ ID NO: 865536 - RNA, 19 nt, Mycobacterium avium subsp. paratuberculosis
ccccgcgcggcucgcgggc

SEQ ID NO: 865537 - RNA, 16 nt, Mycobacterium avium subsp. paratuberculosis
ccccgcgccacgccgc

SEQ ID NO: 865538 - RNA, 15 nt, Mycobacterium avium subsp. paratuberculosis
ccccgcgcgcgggcc

SEQ ID NO: 865539 - RNA, 13 nt, Mycobacterium avium subsp. paratuberculosis
ccccgccgggauc

SEQ ID NO: 865540 - RNA, 18 nt, Mycobacterium avium subsp. paratuberculosis
ccccgccgggaucggcgg

SEQ ID NO: 865541 - RNA, 19 nt, Mycobacterium avium subsp. paratuberculosis
ccccgccgggaucggcggg

SEQ ID NO: 865542 - RNA, 13 nt, Mycobacterium avium subsp. paratuberculosis
ccccgccggggcc

SEQ ID NO: 865543 - RNA, 12 nt, Mycobacterium avium subsp. paratuberculosis
ccccgccggugu

SEQ ID NO: 865544 - RNA, 14 nt, Mycobacterium avium subsp. paratuberculosis
ccccgccggugucg

SEQ ID NO: 865545 - RNA, 16 nt, Mycobacterium avium subsp. paratuberculosis
ccccgccggugucggc

SEQ ID NO: 865546 - RNA, 18 nt, Mycobacterium avium subsp. paratuberculosis
ccccgccggugucggcga

SEQ ID NO: 865547 - RNA, 12 nt, Mycobacterium avium subsp. paratuberculosis
ccccgccgucga

SEQ ID NO: 865548 - RNA, 11 nt, Mycobacterium avium subsp. paratuberculosis
ccccgccucgg

SEQ ID NO: 865549 - RNA, 14 nt, Mycobacterium avium subsp. paratuberculosis
cccgcucccauccg

SEQ ID NO: 865550 - RNA, 16 nt, Mycobacterium avium subsp. paratuberculosis
cccgcuccuccucgcg

SEQ ID NO: 865551 - RNA, 21 nt, Mycobacterium avium subsp. paratuberculosis
cccgcuccuccucgcgccgcc

SEQ ID NO: 865552 - RNA, 17 nt, Mycobacterium avium subsp. paratuberculosis
cccgcuccugcaggccg

SEQ ID NO: 865553 - RNA, 19 nt, Mycobacterium avium subsp. paratuberculosis
cccgcuccugcaggccgag

SEQ ID NO: 865554 - RNA, 14 nt, Mycobacterium avium subsp. paratuberculosis
cccgcucgacgcgc

SEQ ID NO: 865555 - RNA, 15 nt, Mycobacterium avium subsp. paratuberculosis
cccgcuccgcgggca

SEQ ID NO: 865556 - RNA, 15 nt, Mycobacterium avium subsp. paratuberculosis
cccgcuccgcggugc

SEQ ID NO: 865557 - RNA, 17 nt, Mycobacterium avium subsp. paratuberculosis
cccgcuccgcggugcug

SEQ ID NO: 865558 - RNA, 13 nt, Mycobacterium avium subsp. paratuberculosis
cccgcuccggcgg

SEQ ID NO: 865559 - RNA, 14 nt, Mycobacterium avium subsp. paratuberculosis
cccgcuccggcgga

SEQ ID NO: 865560 - RNA, 14 nt, Mycobacterium avium subsp. paratuberculosis
cccgcuggcgccgg

SEQ ID NO: 865561 - RNA, 15 nt, Mycobacterium avium subsp. paratuberculosis
cccgcugcggcgcag

SEQ ID NO: 865562 - RNA, 18 nt, Mycobacterium avium subsp. paratuberculosis
cccgcuggaacagcgggc

SEQ ID NO: 865563 - RNA, 20 nt, Mycobacterium avium subsp. paratuberculosis
cccgcuggaacagcgggccg

SEQ ID NO: 865564 - RNA, 16 nt, Mycobacterium avium subsp. paratuberculosis
cccgcuggaacgccga

SEQ ID NO: 865565 - RNA, 19 nt, Mycobacterium avium subsp. paratuberculosis
cccgcuggaucccggugag

SEQ ID NO: 865566 - RNA, 13 nt, Mycobacterium avium subsp. paratuberculosis
cccgcuccagcgg

SEQ ID NO: 865567 - RNA, 15 nt, Mycobacterium avium subsp. paratuberculosis
cccgcuccagcggcc

SEQ ID NO: 865568 - RNA, 17 nt, Mycobacterium avium subsp. paratuberculosis
cccgcuccagcggccac

SEQ ID NO: 865569 - RNA, 18 nt, Mycobacterium avium subsp. paratuberculosis
cccgcuccauggcggcga

SEQ ID NO: 865570 - RNA, 20 nt, Mycobacterium avium subsp. paratuberculosis
cccgcuccauggcggcgacc

SEQ ID NO: 865571 - RNA, 18 nt, Mycobacterium avium subsp. paratuberculosis
cccgcucaggucggccgc

SEQ ID NO: 865572 - RNA, 21 nt, Mycobacterium avium subsp. paratuberculosis
cccgcucaggucggccgcggc

SEQ ID NO: 865573 - RNA, 23 nt, Mycobacterium avium subsp. paratuberculosis
cccgcucaggucggccgcggccg

SEQ ID NO: 865574 - RNA, 19 nt, Mycobacterium avium subsp. paratuberculosis
cccgcucaguccagcuccc

SEQ ID NO: 865575 - RNA, 22 nt, Mycobacterium avium subsp. paratuberculosis
cccgcucagagcugcaccgggu

SEQ ID NO: 865576 - RNA, 15 nt, Mycobacterium avium subsp. paratuberculosis
cccggagaugguggc

SEQ ID NO: 865577 - RNA, 15 nt, Mycobacterium avium subsp. paratuberculosis
cccggagccgucggc

SEQ ID NO: 865578 - RNA, 16 nt, Mycobacterium avium subsp. paratuberculosis
cccggacgugaucgcg

SEQ ID NO: 865579 - RNA, 20 nt, Mycobacterium avium subsp. paratuberculosis
cccggacgugaucgcggugg

SEQ ID NO: 865580 - RNA, 21 nt, Mycobacterium avium subsp. paratuberculosis
cccggacuccucgguggccuc

SEQ ID NO: 865581 - RNA, 22 nt, Mycobacterium avium subsp. paratuberculosis
cccggagaacaucagccccuug

SEQ ID NO: 865582 - RNA, 17 nt, Mycobacterium avium subsp. paratuberculosis
cccggacccgcucgccg

SEQ ID NO: 865583 - RNA, 16 nt, Mycobacterium avium subsp. paratuberculosis
cccggaccgcggucgg

SEQ ID NO: 865584 - RNA, 14 nt, Mycobacterium avium subsp. paratuberculosis
cccggaccggccgu

SEQ ID NO: 865585 - RNA, 15 nt, Mycobacterium avium subsp. paratuberculosis
cccggaccggccgug

SEQ ID NO: 865586 - RNA, 13 nt, Mycobacterium avium subsp. paratuberculosis
cccggacgaugac

SEQ ID NO: 865587 - RNA, 21 nt, Mycobacterium avium subsp. paratuberculosis
cccggacgaugacccagccca

SEQ ID NO: 865588 - RNA, 16 nt, Mycobacterium avium subsp. paratuberculosis
cccggacgaugccgcg

SEQ ID NO: 865589 - RNA, 14 nt, Mycobacterium avium subsp. paratuberculosis
cccggacgaugcgc

SEQ ID NO: 865590 - RNA, 17 nt, Mycobacterium avium subsp. paratuberculosis
cccggacgcgcacacgg

SEQ ID NO: 865591 - RNA, 23 nt, Mycobacterium avium subsp. paratuberculosis
cccggacgcgcacacggccucgc

SEQ ID NO: 865592 - RNA, 13 nt, Mycobacterium avium subsp. paratuberculosis
cccggacggccga

SEQ ID NO: 865593 - RNA, 17 nt, Mycobacterium avium subsp. paratuberculosis
cccggaccugccggcga

SEQ ID NO: 865594 - RNA, 18 nt, Mycobacterium avium subsp. paratuberculosis
cccgcuucgcccggcugc

SEQ ID NO: 865595 - RNA, 19 nt, Mycobacterium avium subsp. paratuberculosis
cccgcuucgcccggcugcg

SEQ ID NO: 865596 - RNA, 14 nt, Mycobacterium avium subsp. paratuberculosis
cccgcuggccgccg

SEQ ID NO: 865597 - RNA, 17 nt, Mycobacterium avium subsp. paratuberculosis
cccgcuggggcgcaccg

SEQ ID NO: 865598 - RNA, 21 nt, Mycobacterium avium subsp. paratuberculosis
cccgcugucaauccccgcggu

SEQ ID NO: 865599 - RNA, 16 nt, Mycobacterium avium subsp. paratuberculosis
cccgcuuggcggucug

SEQ ID NO: 865600 - RNA, 18 nt, Mycobacterium avium subsp. paratuberculosis
cccgcuucuggcgggcga

SEQ ID NO: 865601 - RNA, 15 nt, Mycobacterium avium subsp. paratuberculosis
cccgcuucggcucgg

SEQ ID NO: 865602 - RNA, 20 nt, Mycobacterium avium subsp. paratuberculosis
cccgcuugauggcggcgcgg

SEQ ID NO: 865603 - RNA, 22 nt, Mycobacterium avium subsp. paratuberculosis
cccgcuugauggcggcgcggau

SEQ ID NO: 865604 - RNA, 16 nt, Mycobacterium avium subsp. paratuberculosis
cccgcuugccgacgug

SEQ ID NO: 865605 - RNA, 18 nt, Mycobacterium avium subsp. paratuberculosis
cccgcgucaucgggcccg

SEQ ID NO: 865606 - RNA, 16 nt, Mycobacterium avium subsp. paratuberculosis
cccgcguccagcagca

SEQ ID NO: 865607 - RNA, 17 nt, Mycobacterium avium subsp. paratuberculosis
cccgcgcgagcgcagcg

SEQ ID NO: 865608 - RNA, 15 nt, Mycobacterium avium subsp. paratuberculosis
cccgcgcgaucggcg

SEQ ID NO: 865609 - RNA, 13 nt, Mycobacterium avium subsp. paratuberculosis
cccgcgccgcggc

SEQ ID NO: 865610 - RNA, 14 nt, Mycobacterium avium subsp. paratuberculosis
cccgcgccgcggcc

SEQ ID NO: 865611 - RNA, 14 nt, Mycobacterium avium subsp. paratuberculosis
cccgcgccgcgucg

SEQ ID NO: 865612 - RNA, 18 nt, Mycobacterium avium subsp. paratuberculosis
cccgcgccgcgucgucgu

SEQ ID NO: 865613 - RNA, 21 nt, Mycobacterium avium subsp. paratuberculosis
cccgcgccgcgucgucgucga

SEQ ID NO: 865614 - RNA, 13 nt, Mycobacterium avium subsp. paratuberculosis
cccgcgccgggca

SEQ ID NO: 865615 - RNA, 13 nt, Mycobacterium avium subsp. paratuberculosis
cccgcgccgggcg

SEQ ID NO: 865616 - RNA, 12 nt, Mycobacterium avium subsp. paratuberculosis
cccgcgccgccc

SEQ ID NO: 865617 - RNA, 17 nt, Mycobacterium avium subsp. paratuberculosis
cccgcgugacggccgcg

SEQ ID NO: 865618 - RNA, 23 nt, Mycobacterium avium subsp. paratuberculosis
cccgcgugacggccgcggcgcgg

SEQ ID NO: 865619 - RNA, 15 nt, Mycobacterium avium subsp. paratuberculosis
cccgcgugcacaccc

SEQ ID NO: 865620 - RNA, 15 nt, Mycobacterium avium subsp. paratuberculosis
cccgcguuggccagc

SEQ ID NO: 865621 - RNA, 20 nt, Mycobacterium avium subsp. paratuberculosis
cccgcguuggccagcgccuc

SEQ ID NO: 865622 - RNA, 20 nt, Mycobacterium avium subsp. paratuberculosis
cccgcguggcaggucgggcu

SEQ ID NO: 865623 - RNA, 21 nt, Mycobacterium avium subsp. paratuberculosis
cccgcguauugcacggcggcg

SEQ ID NO: 865624 - RNA, 22 nt, Mycobacterium avium subsp. paratuberculosis
cccgcguauugcacggcggcga

SEQ ID NO: 865625 - RNA, 19 nt, Mycobacterium avium subsp. paratuberculosis
cccgcguccugcagcgccg

SEQ ID NO: 865626 - RNA, 20 nt, Mycobacterium avium subsp. paratuberculosis
cccgcguccugcagcgccgu

SEQ ID NO: 865627 - RNA, 14 nt, Mycobacterium avium subsp. paratuberculosis
cccgcgucgcgcag

SEQ ID NO: 865628 - RNA, 14 nt, Mycobacterium avium subsp. paratuberculosis
cccgcgucguggcc

SEQ ID NO: 865629 - RNA, 20 nt, Mycobacterium avium subsp. paratuberculosis
cccgccuggccaccucgacg

SEQ ID NO: 865630 - RNA, 15 nt, Mycobacterium avium subsp. paratuberculosis
cccgccucggugagc

SEQ ID NO: 865631 - RNA, 22 nt, Mycobacterium avium subsp. paratuberculosis
cccgccucggugagcagcucgg

SEQ ID NO: 865632 - RNA, 21 nt, Mycobacterium avium subsp. paratuberculosis
cccgccuacuugaccagcgug

SEQ ID NO: 865633 - RNA, 13 nt, Mycobacterium avium subsp. paratuberculosis
cccgccucacagc

SEQ ID NO: 865634 - RNA, 17 nt, Mycobacterium avium subsp. paratuberculosis
cccgccucacagcgaca

SEQ ID NO: 865635 - RNA, 14 nt, Mycobacterium avium subsp. paratuberculosis
cccgccucgcagcg

SEQ ID NO: 865636 - RNA, 14 nt, Mycobacterium avium subsp. paratuberculosis
cccgccucggcggc

SEQ ID NO: 865637 - RNA, 11 nt, Mycobacterium avium subsp. paratuberculosis
cccgcgccgac

SEQ ID NO: 865638 - RNA, 14 nt, Mycobacterium avium subsp. paratuberculosis
cccgcgccgacggc

SEQ ID NO: 865639 - RNA, 21 nt, Mycobacterium avium subsp. paratuberculosis
cccgcgccgacggccgcgccg

SEQ ID NO: 865640 - RNA, 20 nt, Mycobacterium avium subsp. paratuberculosis
cccgcgcccaugaacgcguc

SEQ ID NO: 865641 - RNA, 13 nt, Mycobacterium avium subsp. paratuberculosis
cccgcgccccggc

SEQ ID NO: 865642 - RNA, 14 nt, Mycobacterium avium subsp. paratuberculosis
cccgcgccccggcc

SEQ ID NO: 865643 - RNA, 16 nt, Mycobacterium avium subsp. paratuberculosis
cccgcgccccggcggc

SEQ ID NO: 865644 - RNA, 18 nt, Mycobacterium avium subsp. paratuberculosis
cccgcgccccggcggcca

SEQ ID NO: 865645 - RNA, 13 nt, Mycobacterium avium subsp. paratuberculosis
cccgcgcccgcau

SEQ ID NO: 865646 - RNA, 15 nt, Mycobacterium avium subsp. paratuberculosis
cccgcgcccgccgcg

SEQ ID NO: 865647 - RNA, 13 nt, Mycobacterium avium subsp. paratuberculosis
cccgcgcccgcga

SEQ ID NO: 865648 - RNA, 17 nt, Mycobacterium avium subsp. paratuberculosis
cccgcgccagcucggcg

SEQ ID NO: 865649 - RNA, 19 nt, Mycobacterium avium subsp. paratuberculosis
cccgcgccagcucggcggc

SEQ ID NO: 865650 - RNA, 15 nt, Mycobacterium avium subsp. paratuberculosis
cccgcgaacacgcga

SEQ ID NO: 865651 - RNA, 17 nt, Mycobacterium avium subsp. paratuberculosis
cccgcgaacacgcgaug

SEQ ID NO: 865652 - RNA, 14 nt, Mycobacterium avium subsp. paratuberculosis
cccgcgaacgccuc

SEQ ID NO: 865653 - RNA, 13 nt, Mycobacterium avium subsp. paratuberculosis
cccgccagcaccg

SEQ ID NO: 865654 - RNA, 17 nt, Mycobacterium avium subsp. paratuberculosis
cccgccagcaccgacag

SEQ ID NO: 865655 - RNA, 16 nt, Mycobacterium avium subsp. paratuberculosis
cccgccagcagaugcc

SEQ ID NO: 865656 - RNA, 15 nt, Mycobacterium avium subsp. paratuberculosis
cccgccagcccgcgu

SEQ ID NO: 865657 - RNA, 13 nt, Mycobacterium avium subsp. paratuberculosis
cccgccaucgccc

SEQ ID NO: 865658 - RNA, 16 nt, Mycobacterium avium subsp. paratuberculosis
cccgccaucgcccggu

SEQ ID NO: 865659 - RNA, 19 nt, Mycobacterium avium subsp. paratuberculosis
cccgccagggcgacgccgc

SEQ ID NO: 865660 - RNA, 15 nt, Mycobacterium avium subsp. paratuberculosis
cccgccaggcggcga

SEQ ID NO: 865661 - RNA, 23 nt, Mycobacterium avium subsp. paratuberculosis
cccgccgagauccaccgcgcggc

SEQ ID NO: 865662 - RNA, 17 nt, Mycobacterium avium subsp. paratuberculosis
cccgccgaucgaucagc

SEQ ID NO: 865663 - RNA, 22 nt, Mycobacterium avium subsp. paratuberculosis
cccgccgaucgaucagccgcga

SEQ ID NO: 865664 - RNA, 19 nt, Mycobacterium avium subsp. paratuberculosis
cccgccgacgccugcgcga

SEQ ID NO: 865665 - RNA, 11 nt, Mycobacterium avium subsp. paratuberculosis
cccgccgacgg

SEQ ID NO: 865666 - RNA, 21 nt, Mycobacterium avium subsp. paratuberculosis
cccgccgacggagacgaccag

SEQ ID NO: 865667 - RNA, 14 nt, Mycobacterium avium subsp. paratuberculosis
cccgcccagcacca

SEQ ID NO: 865668 - RNA, 23 nt, Mycobacterium avium subsp. paratuberculosis
cccgccgaccaccuugcgcagca

SEQ ID NO: 865669 - RNA, 13 nt, Mycobacterium avium subsp. paratuberculosis
cccgccgaccggu

SEQ ID NO: 865670 - RNA, 22 nt, Mycobacterium avium subsp. paratuberculosis
cccgccgaccgguccgccgccg

SEQ ID NO: 865671 - RNA, 14 nt, Mycobacterium avium subsp. paratuberculosis
cccgccgucggcau

SEQ ID NO: 865672 - RNA, 20 nt, Mycobacterium avium subsp. paratuberculosis
cccgccguagcgccggcaac

SEQ ID NO: 865673 - RNA, 23 nt, Mycobacterium avium subsp. paratuberculosis
cccgccggugaucucccgugcgg

SEQ ID NO: 865674 - RNA, 16 nt, Mycobacterium avium subsp. paratuberculosis
cccgccgguggccgcg

SEQ ID NO: 865675 - RNA, 13 nt, Mycobacterium avium subsp. paratuberculosis
cccgccgucgacc

SEQ ID NO: 865676 - RNA, 15 nt, Mycobacterium avium subsp. paratuberculosis
cccgccgucgaccac

SEQ ID NO: 865677 - RNA, 20 nt, Mycobacterium avium subsp. paratuberculosis
cccgccguuucagcagcgcg

SEQ ID NO: 865678 - RNA, 18 nt, Mycobacterium avium subsp. paratuberculosis
cccgccgugcgccccgcc

SEQ ID NO: 865679 - RNA, 16 nt, Mycobacterium avium subsp. paratuberculosis
cccgccgugaccggcg

SEQ ID NO: 865680 - RNA, 16 nt, Mycobacterium avium subsp. paratuberculosis
cccgccgggccggauc

SEQ ID NO: 865681 - RNA, 22 nt, Mycobacterium avium subsp. paratuberculosis
cccgccgggccggaucgcgcag

SEQ ID NO: 865682 - RNA, 22 nt, Mycobacterium avium subsp. paratuberculosis
cccgccgggcgccacgcuggcg

SEQ ID NO: 865683 - RNA, 18 nt, Mycobacterium avium subsp. paratuberculosis
cccgccggggccggcgau

SEQ ID NO: 865684 - RNA, 20 nt, Mycobacterium avium subsp. paratuberculosis
cccgccgggaucggcggggc

SEQ ID NO: 865685 - RNA, 12 nt, Mycobacterium avium subsp. paratuberculosis
cccgccgggaug

SEQ ID NO: 865686 - RNA, 19 nt, Mycobacterium avium subsp. paratuberculosis
cccgccggguggccgccac

SEQ ID NO: 865687 - RNA, 16 nt, Mycobacterium avium subsp. paratuberculosis
cccgccgccgcgggug

SEQ ID NO: 865688 - RNA, 14 nt, Mycobacterium avium subsp. paratuberculosis
cccgccgcgagccg

SEQ ID NO: 865689 - RNA, 12 nt, Mycobacterium avium subsp. paratuberculosis
cccgccgcgacc

SEQ ID NO: 865690 - RNA, 19 nt, Mycobacterium avium subsp. paratuberculosis
cccgccgccggcgcuggcg

SEQ ID NO: 865691 - RNA, 15 nt, Mycobacterium avium subsp. paratuberculosis
cccgccgccggcggc

SEQ ID NO: 865692 - RNA, 15 nt, Mycobacterium avium subsp. paratuberculosis
cccgccgccgugcau

SEQ ID NO: 865693 - RNA, 16 nt, Mycobacterium avium subsp. paratuberculosis
cccgccgauggacacg

SEQ ID NO: 865694 - RNA, 13 nt, Mycobacterium avium subsp. paratuberculosis
cccgccgcagccc

SEQ ID NO: 865695 - RNA, 13 nt, Mycobacterium avium subsp. paratuberculosis
cccgccgccacca

SEQ ID NO: 865696 - RNA, 17 nt, Mycobacterium avium subsp. paratuberculosis
cccgccgccaccacggc

SEQ ID NO: 865697 - RNA, 22 nt, Mycobacterium avium subsp. paratuberculosis
cccgauucagccggcgggcgcu

SEQ ID NO: 865698 - RNA, 15 nt, Mycobacterium avium subsp. paratuberculosis
cccgaugucggcgaa

SEQ ID NO: 865699 - RNA, 13 nt, Mycobacterium avium subsp. paratuberculosis
cccgaucgccgag

SEQ ID NO: 865700 - RNA, 16 nt, Mycobacterium avium subsp. paratuberculosis
cccgaucgccgagucg

SEQ ID NO: 865701 - RNA, 23 nt, Mycobacterium avium subsp. paratuberculosis
cccgaucgccgagucgaucgcca

SEQ ID NO: 865702 - RNA, 15 nt, Mycobacterium avium subsp. paratuberculosis
cccgaucgcgaucac

SEQ ID NO: 865703 - RNA, 20 nt, Mycobacterium avium subsp. paratuberculosis
cccgaucgcgaucaccgcgg

SEQ ID NO: 865704 - RNA, 22 nt, Mycobacterium avium subsp. paratuberculosis
cccgaucgcgaucaccgcggcc

SEQ ID NO: 865705 - RNA, 13 nt, Mycobacterium avium subsp. paratuberculosis
cccgaucgaggac

SEQ ID NO: 865706 - RNA, 22 nt, Mycobacterium avium subsp. paratuberculosis
cccgaucgaucaucgccucggu

SEQ ID NO: 865707 - RNA, 14 nt, Mycobacterium avium subsp. paratuberculosis
cccgauccggcuga

SEQ ID NO: 865708 - RNA, 13 nt, Mycobacterium avium subsp. paratuberculosis
cccgauccgccgu

SEQ ID NO: 865709 - RNA, 23 nt, Mycobacterium avium subsp. paratuberculosis
cccgauccgccguugcggcccac

SEQ ID NO: 865710 - RNA, 13 nt, Mycobacterium avium subsp. paratuberculosis
cccgauccgcgcc

SEQ ID NO: 865711 - RNA, 14 nt, Mycobacterium avium subsp. paratuberculosis
cccgauccgcgccg

SEQ ID NO: 865712 - RNA, 21 nt, Mycobacterium avium subsp. paratuberculosis
cccgauccgcgccgccgccag

SEQ ID NO: 865713 - RNA, 20 nt, Mycobacterium avium subsp. paratuberculosis
cccgcaacgcgcgcgacggc

SEQ ID NO: 865714 - RNA, 19 nt, Mycobacterium avium subsp. paratuberculosis
cccgcaacgcugaccgcag

SEQ ID NO: 865715 - RNA, 19 nt, Mycobacterium avium subsp. paratuberculosis
cccgcaaaucagccgagcc

SEQ ID NO: 865716 - RNA, 17 nt, Mycobacterium avium subsp. paratuberculosis
cccgcaaacacgagcag

SEQ ID NO: 865717 - RNA, 21 nt, Mycobacterium avium subsp. paratuberculosis
cccgcaaacacgagcagaccc

SEQ ID NO: 865718 - RNA, 13 nt, Mycobacterium avium subsp. paratuberculosis
cccgauguuggcc

SEQ ID NO: 865719 - RNA, 18 nt, Mycobacterium avium subsp. paratuberculosis
cccgcaucaacugcacca

SEQ ID NO: 865720 - RNA, 20 nt, Mycobacterium avium subsp. paratuberculosis
cccgcaucaacugcaccagc

SEQ ID NO: 865721 - RNA, 22 nt, Mycobacterium avium subsp. paratuberculosis
cccgcaucaacugcaccagcgg

SEQ ID NO: 865722 - RNA, 16 nt, Mycobacterium avium subsp. paratuberculosis
cccgcaguucggccgc

SEQ ID NO: 865723 - RNA, 18 nt, Mycobacterium avium subsp. paratuberculosis
cccgcaguucggccgccg

SEQ ID NO: 865724 - RNA, 12 nt, Mycobacterium avium subsp. paratuberculosis
cccgcagggcgc

SEQ ID NO: 865725 - RNA, 20 nt, Mycobacterium avium subsp. paratuberculosis
cccgcagggcgccggugaag

SEQ ID NO: 865726 - RNA, 21 nt, Mycobacterium avium subsp. paratuberculosis
cccgccacgugcggcugcgcg

SEQ ID NO: 865727 - RNA, 12 nt, Mycobacterium avium subsp. paratuberculosis
cccgccagaucg

SEQ ID NO: 865728 - RNA, 17 nt, Mycobacterium avium subsp. paratuberculosis
cccgccagaucgccauc

SEQ ID NO: 865729 - RNA, 17 nt, Mycobacterium avium subsp. paratuberculosis
cccgcauccgccgggcg

SEQ ID NO: 865730 - RNA, 19 nt, Mycobacterium avium subsp. paratuberculosis
cccgcauccgccgggcggc

SEQ ID NO: 865731 - RNA, 21 nt, Mycobacterium avium subsp. paratuberculosis
cccgcauccgccgggcggcgu

SEQ ID NO: 865732 - RNA, 22 nt, Mycobacterium avium subsp. paratuberculosis
cccgcaucgccgaaccgggcgc

SEQ ID NO: 865733 - RNA, 15 nt, Mycobacterium avium subsp. paratuberculosis
cccgcagccgcgacg

SEQ ID NO: 865734 - RNA, 17 nt, Mycobacterium avium subsp. paratuberculosis
cccgcagccgcgagucg

SEQ ID NO: 865735 - RNA, 20 nt, Mycobacterium avium subsp. paratuberculosis
cccgcagccgcuggccgcgc

SEQ ID NO: 865736 - RNA, 21 nt, Mycobacterium avium subsp. paratuberculosis
cccgcagccgcuggccgcgcc

SEQ ID NO: 865737 - RNA, 22 nt, Mycobacterium avium subsp. paratuberculosis
cccgcaaggccgccagccgcgu

SEQ ID NO: 865738 - RNA, 18 nt, Mycobacterium avium subsp. paratuberculosis
cccgcaauugcgccagca

SEQ ID NO: 865739 - RNA, 15 nt, Mycobacterium avium subsp. paratuberculosis
cccgcagcgaccgcg

SEQ ID NO: 865740 - RNA, 18 nt, Mycobacterium avium subsp. paratuberculosis
cccgcagcgccagcgcgc

SEQ ID NO: 865741 - RNA, 13 nt, Mycobacterium avium subsp. paratuberculosis
cccgcagcgcggc

SEQ ID NO: 865742 - RNA, 17 nt, Mycobacterium avium subsp. paratuberculosis
cccgcagcgcggcggag

SEQ ID NO: 865743 - RNA, 14 nt, Mycobacterium avium subsp. paratuberculosis
cccgcagcggggcg

SEQ ID NO: 865744 - RNA, 17 nt, Mycobacterium avium subsp. paratuberculosis
cccgcagcuccagcgag

SEQ ID NO: 865745 - RNA, 22 nt, Mycobacterium avium subsp. paratuberculosis
cccgcagcucccccggcgugag

SEQ ID NO: 865746 - RNA, 13 nt, Mycobacterium avium subsp. paratuberculosis
cccgcagcucgga

SEQ ID NO: 865747 - RNA, 17 nt, Mycobacterium avium subsp. paratuberculosis
cccgcaggaucgagccg

SEQ ID NO: 865748 - RNA, 16 nt, Mycobacterium avium subsp. paratuberculosis
cccgcaggccaugauc

SEQ ID NO: 865749 - RNA, 13 nt, Mycobacterium avium subsp. paratuberculosis
cccuuaccggccg

SEQ ID NO: 865750 - RNA, 16 nt, Mycobacterium avium subsp. paratuberculosis
cccuguucgccgucgc

SEQ ID NO: 865751 - RNA, 21 nt, Mycobacterium avium subsp. paratuberculosis
cccugugaggcguuggcccgc

SEQ ID NO: 865752 - RNA, 14 nt, Mycobacterium avium subsp. paratuberculosis
cccuuccagcaccc

SEQ ID NO: 865753 - RNA, 16 nt, Mycobacterium avium subsp. paratuberculosis
cccuguuugcaggcga

SEQ ID NO: 865754 - RNA, 16 nt, Mycobacterium avium subsp. paratuberculosis
ccgaaaaacgcgucgc

SEQ ID NO: 865755 - RNA, 21 nt, Mycobacterium avium subsp. paratuberculosis
ccgaaaaacgcgucgcguggc

SEQ ID NO: 865756 - RNA, 18 nt, Mycobacterium avium subsp. paratuberculosis
ccgaaaagcccgccgccu

SEQ ID NO: 865757 - RNA, 15 nt, Mycobacterium avium subsp. paratuberculosis
ccgaaaccgucgacc

SEQ ID NO: 865758 - RNA, 13 nt, Mycobacterium avium subsp. paratuberculosis
cccugggggucgg

SEQ ID NO: 865759 - RNA, 15 nt, Mycobacterium avium subsp. paratuberculosis
cccugggcggcgaca

SEQ ID NO: 865760 - RNA, 18 nt, Mycobacterium avium subsp. paratuberculosis
cccuggcgggcggcccgc

SEQ ID NO: 865761 - RNA, 12 nt, Mycobacterium avium subsp. paratuberculosis
cccuggcgggua

SEQ ID NO: 865762 - RNA, 19 nt, Mycobacterium avium subsp. paratuberculosis
cccugguacgcgccgucgu

SEQ ID NO: 865763 - RNA, 20 nt, Mycobacterium avium subsp. paratuberculosis
cccugguacgcgccgucguc

SEQ ID NO: 865764 - RNA, 21 nt, Mycobacterium avium subsp. paratuberculosis
cccugguccuuaaucgggacg

SEQ ID NO: 865765 - RNA, 18 nt, Mycobacterium avium subsp. paratuberculosis
cccugcaggucgcggugg

SEQ ID NO: 865766 - RNA, 17 nt, Mycobacterium avium subsp. paratuberculosis
cccugcagccggguggc

SEQ ID NO: 865767 - RNA, 21 nt, Mycobacterium avium subsp. paratuberculosis
cccugcagccggguggcccgc

SEQ ID NO: 865768 - RNA, 22 nt, Mycobacterium avium subsp. paratuberculosis
cccugcagcgccuugaccgcgu

SEQ ID NO: 865769 - RNA, 17 nt, Mycobacterium avium subsp. paratuberculosis
cccugcggccagugccg

SEQ ID NO: 865770 - RNA, 16 nt, Mycobacterium avium subsp. paratuberculosis
cccugcguccggcccg

SEQ ID NO: 865771 - RNA, 17 nt, Mycobacterium avium subsp. paratuberculosis
cccugcguccggcccgg

SEQ ID NO: 865772 - RNA, 23 nt, Mycobacterium avium subsp. paratuberculosis
cccugcguccggcccggcguccg

SEQ ID NO: 865773 - RNA, 19 nt, Mycobacterium avium subsp. paratuberculosis
cccugcgggaacagcggga

SEQ ID NO: 865774 - RNA, 21 nt, Mycobacterium avium subsp. paratuberculosis
cccugcucggccagcggguga

SEQ ID NO: 865775 - RNA, 22 nt, Mycobacterium avium subsp. paratuberculosis
cccugcucggccagcgggugau

SEQ ID NO: 865776 - RNA, 14 nt, Mycobacterium avium subsp. paratuberculosis
cccugcucggugau

SEQ ID NO: 865777 - RNA, 20 nt, Mycobacterium avium subsp. paratuberculosis
cccugcucuucgcgcgcggc

SEQ ID NO: 865778 - RNA, 16 nt, Mycobacterium avium subsp. paratuberculosis
cccugcugcagcgcga

SEQ ID NO: 865779 - RNA, 21 nt, Mycobacterium avium subsp. paratuberculosis
cccugaacgucuugggcgcga

SEQ ID NO: 865780 - RNA, 22 nt, Mycobacterium avium subsp. paratuberculosis
cccugacacagcaccggcgucg

SEQ ID NO: 865781 - RNA, 18 nt, Mycobacterium avium subsp. paratuberculosis
cccugacacgaccgccug

SEQ ID NO: 865782 - RNA, 22 nt, Mycobacterium avium subsp. paratuberculosis
cccugagcugguuucgggucga

SEQ ID NO: 865783 - RNA, 20 nt, Mycobacterium avium subsp. paratuberculosis
cccugaccgugcuuggcggc

SEQ ID NO: 865784 - RNA, 16 nt, Mycobacterium avium subsp. paratuberculosis
cccugagggugucggc

SEQ ID NO: 865785 - RNA, 14 nt, Mycobacterium avium subsp. paratuberculosis
cccugaucggccgc

SEQ ID NO: 865786 - RNA, 15 nt, Mycobacterium avium subsp. paratuberculosis
cccugcacccagccg

SEQ ID NO: 865787 - RNA, 19 nt, Mycobacterium avium subsp. paratuberculosis
cccggucuuguugugcugc

SEQ ID NO: 865788 - RNA, 15 nt, Mycobacterium avium subsp. paratuberculosis
cccgguucugggcgg

SEQ ID NO: 865789 - RNA, 14 nt, Mycobacterium avium subsp. paratuberculosis
cccggugacgaaca

SEQ ID NO: 865790 - RNA, 20 nt, Mycobacterium avium subsp. paratuberculosis
cccggugacgaacaucgacg

SEQ ID NO: 865791 - RNA, 22 nt, Mycobacterium avium subsp. paratuberculosis
cccggugacgaacaucgacgac

SEQ ID NO: 865792 - RNA, 23 nt, Mycobacterium avium subsp. paratuberculosis
cccggugacgaacaucgacgacg

SEQ ID NO: 865793 - RNA, 15 nt, Mycobacterium avium subsp. paratuberculosis
cccggucugaucgcc

SEQ ID NO: 865794 - RNA, 16 nt, Mycobacterium avium subsp. paratuberculosis
cccggucugcggccgc

SEQ ID NO: 865795 - RNA, 20 nt, Mycobacterium avium subsp. paratuberculosis
cccgguuccaaccaccgugg

SEQ ID NO: 865796 - RNA, 18 nt, Mycobacterium avium subsp. paratuberculosis
cccgguuccaccgggccg

SEQ ID NO: 865797 - RNA, 23 nt, Mycobacterium avium subsp. paratuberculosis
cccgguuccaccgggccgccauc

SEQ ID NO: 865798 - RNA, 19 nt, Mycobacterium avium subsp. paratuberculosis
cccgguuccagcggcaccg

SEQ ID NO: 865799 - RNA, 18 nt, Mycobacterium avium subsp. paratuberculosis
cccgguuccgcgacaucg

SEQ ID NO: 865800 - RNA, 20 nt, Mycobacterium avium subsp. paratuberculosis
cccgguuccgcgacaucggu

SEQ ID NO: 865801 - RNA, 21 nt, Mycobacterium avium subsp. paratuberculosis
cccgguuuccaguccggcgcc

SEQ ID NO: 865802 - RNA, 23 nt, Mycobacterium avium subsp. paratuberculosis
cccgguuuccaguccggcgcccg

SEQ ID NO: 865803 - RNA, 13 nt, Mycobacterium avium subsp. paratuberculosis
cccgguugagcac

SEQ ID NO: 865804 - RNA, 15 nt, Mycobacterium avium subsp. paratuberculosis
cccgguugagcaccg

SEQ ID NO: 865805 - RNA, 20 nt, Mycobacterium avium subsp. paratuberculosis
cccgguugauccggaucggg

SEQ ID NO: 865806 - RNA, 20 nt, Mycobacterium avium subsp. paratuberculosis
cccgguuucguuguccacca

SEQ ID NO: 865807 - RNA, 16 nt, Mycobacterium avium subsp. paratuberculosis
cccguaccagcgcucg

SEQ ID NO: 865808 - RNA, 11 nt, Mycobacterium avium subsp. paratuberculosis
cccgucgccgg

SEQ ID NO: 865809 - RNA, 14 nt, Mycobacterium avium subsp. paratuberculosis
cccgucgccggcgc

SEQ ID NO: 865810 - RNA, 15 nt, Mycobacterium avium subsp. paratuberculosis
cccgucgccggcgcg

SEQ ID NO: 865811 - RNA, 16 nt, Mycobacterium avium subsp. paratuberculosis
cccgucgccggcgcgc

SEQ ID NO: 865812 - RNA, 17 nt, Mycobacterium avium subsp. paratuberculosis
cccgucgccggcgcgca

SEQ ID NO: 865813 - RNA, 23 nt, Mycobacterium avium subsp. paratuberculosis
cccgucgccuccugcuggcgcug

SEQ ID NO: 865814 - RNA, 12 nt, Mycobacterium avium subsp. paratuberculosis
cccgucgcgacg

SEQ ID NO: 865815 - RNA, 15 nt, Mycobacterium avium subsp. paratuberculosis
cccgugaucgccacg

SEQ ID NO: 865816 - RNA, 17 nt, Mycobacterium avium subsp. paratuberculosis
cccgugcaggaucggcu

SEQ ID NO: 865817 - RNA, 19 nt, Mycobacterium avium subsp. paratuberculosis
cccgugccgaugccggccu

SEQ ID NO: 865818 - RNA, 22 nt, Mycobacterium avium subsp. paratuberculosis
cccgugccgaugccggccuggc

SEQ ID NO: 865819 - RNA, 12 nt, Mycobacterium avium subsp. paratuberculosis
cccgugccgcac

SEQ ID NO: 865820 - RNA, 11 nt, Mycobacterium avium subsp. paratuberculosis
cccgugcuggc

SEQ ID NO: 865821 - RNA, 23 nt, Mycobacterium avium subsp. paratuberculosis
cccgugcggggccucgucgccgc

SEQ ID NO: 865822 - RNA, 13 nt, Mycobacterium avium subsp. paratuberculosis
cccgugcgacggc

SEQ ID NO: 865823 - RNA, 15 nt, Mycobacterium avium subsp. paratuberculosis
cccgugcgacggcuc

SEQ ID NO: 865824 - RNA, 18 nt, Mycobacterium avium subsp. paratuberculosis
cccgucggccuccagccg

SEQ ID NO: 865825 - RNA, 14 nt, Mycobacterium avium subsp. paratuberculosis
cccgucgcggguca

SEQ ID NO: 865826 - RNA, 15 nt, Mycobacterium avium subsp. paratuberculosis
cccgucgcggacccu

SEQ ID NO: 865827 - RNA, 13 nt, Mycobacterium avium subsp. paratuberculosis
cccgucggcguga

SEQ ID NO: 865828 - RNA, 20 nt, Mycobacterium avium subsp. paratuberculosis
cccgucgggcgcggcggcaa

SEQ ID NO: 865829 - RNA, 17 nt, Mycobacterium avium subsp. paratuberculosis
cccgucgggcggggugg

SEQ ID NO: 865830 - RNA, 15 nt, Mycobacterium avium subsp. paratuberculosis
cccgucggggcccgg

SEQ ID NO: 865831 - RNA, 13 nt, Mycobacterium avium subsp. paratuberculosis
cccgucggggugc

SEQ ID NO: 865832 - RNA, 16 nt, Mycobacterium avium subsp. paratuberculosis
cccgucggucccgacg

SEQ ID NO: 865833 - RNA, 19 nt, Mycobacterium avium subsp. paratuberculosis
cccgucggucccgacgcgg

SEQ ID NO: 865834 - RNA, 20 nt, Mycobacterium avium subsp. paratuberculosis
cccgucggucccgacgcggc

SEQ ID NO: 865835 - RNA, 22 nt, Mycobacterium avium subsp. paratuberculosis
cccgucggucccgacgcggcgc

SEQ ID NO: 865836 - RNA, 13 nt, Mycobacterium avium subsp. paratuberculosis
cccgucggugaag

SEQ ID NO: 865837 - RNA, 15 nt, Mycobacterium avium subsp. paratuberculosis
cccgucggccucggc

SEQ ID NO: 865838 - RNA, 12 nt, Mycobacterium avium subsp. paratuberculosis
cccgucggcgcg

SEQ ID NO: 865839 - RNA, 13 nt, Mycobacterium avium subsp. paratuberculosis
cccgucggcgcga

SEQ ID NO: 865840 - RNA, 23 nt, Mycobacterium avium subsp. paratuberculosis
cccgucguccuugagcccccacc

SEQ ID NO: 865841 - RNA, 20 nt, Mycobacterium avium subsp. paratuberculosis
cccgucgucgaugcgcagca

SEQ ID NO: 865842 - RNA, 16 nt, Mycobacterium avium subsp. paratuberculosis
cccgucgucggcgccg

SEQ ID NO: 865843 - RNA, 21 nt, Mycobacterium avium subsp. paratuberculosis
cccgucggccaucagccgccg

SEQ ID NO: 865844 - RNA, 14 nt, Mycobacterium avium subsp. paratuberculosis
cccgucucggcgug

SEQ ID NO: 865845 - RNA, 19 nt, Mycobacterium avium subsp. paratuberculosis
cccgucucggcgugcucgg

SEQ ID NO: 865846 - RNA, 20 nt, Mycobacterium avium subsp. paratuberculosis
cccgucucggcgugcucggc

SEQ ID NO: 865847 - RNA, 23 nt, Mycobacterium avium subsp. paratuberculosis
cccgucucggcgugcucggccac

SEQ ID NO: 865848 - RNA, 14 nt, Mycobacterium avium subsp. paratuberculosis
cccucucacggcgg

SEQ ID NO: 865849 - RNA, 20 nt, Mycobacterium avium subsp. paratuberculosis
cccucgugguggacggucag

SEQ ID NO: 865850 - RNA, 14 nt, Mycobacterium avium subsp. paratuberculosis
cccucguagcggcc

SEQ ID NO: 865851 - RNA, 12 nt, Mycobacterium avium subsp. paratuberculosis
cccucguccagg

SEQ ID NO: 865852 - RNA, 22 nt, Mycobacterium avium subsp. paratuberculosis
cccucgucgaagccgaucaccg

SEQ ID NO: 865853 - RNA, 17 nt, Mycobacterium avium subsp. paratuberculosis
cccucgucuuggugcga

SEQ ID NO: 865854 - RNA, 18 nt, Mycobacterium avium subsp. paratuberculosis
cccucgugcguagcggcc

SEQ ID NO: 865855 - RNA, 17 nt, Mycobacterium avium subsp. paratuberculosis
cccucggggcucaccac

SEQ ID NO: 865856 - RNA, 18 nt, Mycobacterium avium subsp. paratuberculosis
cccucggggcucaccaca

SEQ ID NO: 865857 - RNA, 22 nt, Mycobacterium avium subsp. paratuberculosis
cccucggggcugcgcggcuugc

SEQ ID NO: 865858 - RNA, 20 nt, Mycobacterium avium subsp. paratuberculosis
cccucgggguacucggcggc

SEQ ID NO: 865859 - RNA, 21 nt, Mycobacterium avium subsp. paratuberculosis
cccucgggguacucggcggcg

SEQ ID NO: 865860 - RNA, 22 nt, Mycobacterium avium subsp. paratuberculosis
cccucgggguagccggcccgca

SEQ ID NO: 865861 - RNA, 13 nt, Mycobacterium avium subsp. paratuberculosis
cccucggcgccgg

SEQ ID NO: 865862 - RNA, 19 nt, Mycobacterium avium subsp. paratuberculosis
cccucggcgccgguggugu

SEQ ID NO: 865863 - RNA, 22 nt, Mycobacterium avium subsp. paratuberculosis
cccucggcgccgguggugucga

SEQ ID NO: 865864 - RNA, 16 nt, Mycobacterium avium subsp. paratuberculosis
cccucggcggccgucg

SEQ ID NO: 865865 - RNA, 18 nt, Mycobacterium avium subsp. paratuberculosis
cccucggcggccgucgga

SEQ ID NO: 865866 - RNA, 22 nt, Mycobacterium avium subsp. paratuberculosis
cccucggcgggaucggaccgca

SEQ ID NO: 865867 - RNA, 24 nt, Mycobacterium avium subsp. paratuberculosis
cccucggcuuccgagccggugaug

SEQ ID NO: 865868 - RNA, 17 nt, Mycobacterium avium subsp. paratuberculosis
cccuccaacggccgcac

SEQ ID NO: 865869 - RNA, 20 nt, Mycobacterium avium subsp. paratuberculosis
cccuccacacggcaggcggc

SEQ ID NO: 865870 - RNA, 15 nt, Mycobacterium avium subsp. paratuberculosis
cccuccagccgccgg

SEQ ID NO: 865871 - RNA, 21 nt, Mycobacterium avium subsp. paratuberculosis
cccuccaggaagaacccggcg

SEQ ID NO: 865872 - RNA, 11 nt, Mycobacterium avium subsp. paratuberculosis
cccucggccag

SEQ ID NO: 865873 - RNA, 19 nt, Mycobacterium avium subsp. paratuberculosis
cccucggccgguccgaucg

SEQ ID NO: 865874 - RNA, 14 nt, Mycobacterium avium subsp. paratuberculosis
cccucggcgagcga

SEQ ID NO: 865875 - RNA, 12 nt, Mycobacterium avium subsp. paratuberculosis
cccucaccccgc

SEQ ID NO: 865876 - RNA, 22 nt, Mycobacterium avium subsp. paratuberculosis
cccucagaccauggcgcggcgg

SEQ ID NO: 865877 - RNA, 11 nt, Mycobacterium avium subsp. paratuberculosis
cccucagcagg

SEQ ID NO: 865878 - RNA, 15 nt, Mycobacterium avium subsp. paratuberculosis
cccuccacgucgucg

SEQ ID NO: 865879 - RNA, 14 nt, Mycobacterium avium subsp. paratuberculosis
cccucaggcgucca

SEQ ID NO: 865880 - RNA, 19 nt, Mycobacterium avium subsp. paratuberculosis
cccgugguagacgccggac

SEQ ID NO: 865881 - RNA, 16 nt, Mycobacterium avium subsp. paratuberculosis
cccguggaucaucccg

SEQ ID NO: 865882 - RNA, 18 nt, Mycobacterium avium subsp. paratuberculosis
cccguggcccacgggaug

SEQ ID NO: 865883 - RNA, 16 nt, Mycobacterium avium subsp. paratuberculosis
cccggcguuccagcgc

SEQ ID NO: 865884 - RNA, 19 nt, Mycobacterium avium subsp. paratuberculosis
cccggcguuccagcgcaca

SEQ ID NO: 865885 - RNA, 19 nt, Mycobacterium avium subsp. paratuberculosis
cccggcggccacgcaggcg

SEQ ID NO: 865886 - RNA, 15 nt, Mycobacterium avium subsp. paratuberculosis
cccggcggccccggu

SEQ ID NO: 865887 - RNA, 17 nt, Mycobacterium avium subsp. paratuberculosis
cccggcgugucgcgugc

SEQ ID NO: 865888 - RNA, 18 nt, Mycobacterium avium subsp. paratuberculosis
cccggcgugggccgcagc

SEQ ID NO: 865889 - RNA, 22 nt, Mycobacterium avium subsp. paratuberculosis
cccggcgugggccgcagcgcgg

SEQ ID NO: 865890 - RNA, 15 nt, Mycobacterium avium subsp. paratuberculosis
cccggcgcgcagccc

SEQ ID NO: 865891 - RNA, 16 nt, Mycobacterium avium subsp. paratuberculosis
cccggcggcaccgccg

SEQ ID NO: 865892 - RNA, 15 nt, Mycobacterium avium subsp. paratuberculosis
cccggcggacccgga

SEQ ID NO: 865893 - RNA, 12 nt, Mycobacterium avium subsp. paratuberculosis
cccggcggacgg

SEQ ID NO: 865894 - RNA, 20 nt, Mycobacterium avium subsp. paratuberculosis
cccggcggacggucccgacg

SEQ ID NO: 865895 - RNA, 20 nt, Mycobacterium avium subsp. paratuberculosis
cccggcgcuaaagccgaccg

SEQ ID NO: 865896 - RNA, 17 nt, Mycobacterium avium subsp. paratuberculosis
cccggcgcucaccgcga

SEQ ID NO: 865897 - RNA, 22 nt, Mycobacterium avium subsp. paratuberculosis
cccggcgcugaagugcagcgca

SEQ ID NO: 865898 - RNA, 19 nt, Mycobacterium avium subsp. paratuberculosis
cccggcuaauucgggccgc

SEQ ID NO: 865899 - RNA, 23 nt, Mycobacterium avium subsp. paratuberculosis
cccggcuacucggacgccggcag

SEQ ID NO: 865900 - RNA, 20 nt, Mycobacterium avium subsp. paratuberculosis
cccggcucgaaguggcagcg

SEQ ID NO: 865901 - RNA, 11 nt, Mycobacterium avium subsp. paratuberculosis
cccggcucgau

SEQ ID NO: 865902 - RNA, 18 nt, Mycobacterium avium subsp. paratuberculosis
cccggcucgaucgcgguc

SEQ ID NO: 865903 - RNA, 20 nt, Mycobacterium avium subsp. paratuberculosis
cccggcucggaaccguugga

SEQ ID NO: 865904 - RNA, 21 nt, Mycobacterium avium subsp. paratuberculosis
cccggcuccccgaccacaccg

SEQ ID NO: 865905 - RNA, 16 nt, Mycobacterium avium subsp. paratuberculosis
cccggcucgccgggcu

SEQ ID NO: 865906 - RNA, 20 nt, Mycobacterium avium subsp. paratuberculosis
cccggcucagcgcgacgugc

SEQ ID NO: 865907 - RNA, 13 nt, Mycobacterium avium subsp. paratuberculosis
cccggcgcggccg

SEQ ID NO: 865908 - RNA, 18 nt, Mycobacterium avium subsp. paratuberculosis
cccggcgcggcggcgccg

SEQ ID NO: 865909 - RNA, 13 nt, Mycobacterium avium subsp. paratuberculosis
cccggcgcggcgg

SEQ ID NO: 865910 - RNA, 12 nt, Mycobacterium avium subsp. paratuberculosis
cccggcgcgccg

SEQ ID NO: 865911 - RNA, 14 nt, Mycobacterium avium subsp. paratuberculosis
cccggcgcggccgc

SEQ ID NO: 865912 - RNA, 23 nt, Mycobacterium avium subsp. paratuberculosis
cccggcgcgcguauuccagcgcc

SEQ ID NO: 865913 - RNA, 22 nt, Mycobacterium avium subsp. paratuberculosis
cccggcgcggaacgcgccgggc

SEQ ID NO: 865914 - RNA, 16 nt, Mycobacterium avium subsp. paratuberculosis
cccggcgcggacagcg

SEQ ID NO: 865915 - RNA, 24 nt, Mycobacterium avium subsp. paratuberculosis
cccggcgcggacagcgcggugaug

SEQ ID NO: 865916 - RNA, 16 nt, Mycobacterium avium subsp. paratuberculosis
cccggcgcccggcgcg

SEQ ID NO: 865917 - RNA, 17 nt, Mycobacterium avium subsp. paratuberculosis
cccggcgcccggcgcgc

SEQ ID NO: 865918 - RNA, 21 nt, Mycobacterium avium subsp. paratuberculosis
cccggcgcccuucggcgcccg

SEQ ID NO: 865919 - RNA, 13 nt, Mycobacterium avium subsp. paratuberculosis
cccggcgccgccg

SEQ ID NO: 865920 - RNA, 14 nt, Mycobacterium avium subsp. paratuberculosis
cccggcgcgacggc

SEQ ID NO: 865921 - RNA, 22 nt, Mycobacterium avium subsp. paratuberculosis
cccggcgccacgcacaccgcgc

SEQ ID NO: 865922 - RNA, 18 nt, Mycobacterium avium subsp. paratuberculosis
cccggcgccacgccgcga

SEQ ID NO: 865923 - RNA, 12 nt, Mycobacterium avium subsp. paratuberculosis
cccggcgcccgg

SEQ ID NO: 865924 - RNA, 15 nt, Mycobacterium avium subsp. paratuberculosis
cccggcgcccggccg

SEQ ID NO: 865925 - RNA, 20 nt, Mycobacterium avium subsp. paratuberculosis
cccggcgcccggccggugcu

SEQ ID NO: 865926 - RNA, 15 nt, Mycobacterium avium subsp. paratuberculosis
cccggcgcccggcgc

SEQ ID NO: 865927 - RNA, 12 nt, Mycobacterium avium subsp. paratuberculosis
cccggcgccggc

SEQ ID NO: 865928 - RNA, 18 nt, Mycobacterium avium subsp. paratuberculosis
cccggcgccggcggccac

SEQ ID NO: 865929 - RNA, 13 nt, Mycobacterium avium subsp. paratuberculosis
cccggcgccgucg

SEQ ID NO: 865930 - RNA, 12 nt, Mycobacterium avium subsp. paratuberculosis
cccggcgcagca

SEQ ID NO: 865931 - RNA, 16 nt, Mycobacterium avium subsp. paratuberculosis
cccggcgcagcaacuc

SEQ ID NO: 865932 - RNA, 15 nt, Mycobacterium avium subsp. paratuberculosis
cccggcgcagcgccg

SEQ ID NO: 865933 - RNA, 20 nt, Mycobacterium avium subsp. paratuberculosis
cccggcgcaccaggcgccac

SEQ ID NO: 865934 - RNA, 15 nt, Mycobacterium avium subsp. paratuberculosis
cccggcgaugaucag

SEQ ID NO: 865935 - RNA, 14 nt, Mycobacterium avium subsp. paratuberculosis
cccggcgaugccga

SEQ ID NO: 865936 - RNA, 15 nt, Mycobacterium avium subsp. paratuberculosis
cccggcgaugccgag

SEQ ID NO: 865937 - RNA, 17 nt, Mycobacterium avium subsp. paratuberculosis
cccggcgaugucgggca

SEQ ID NO: 865938 - RNA, 21 nt, Mycobacterium avium subsp. paratuberculosis
cccggcgaugucgggcaccug

SEQ ID NO: 865939 - RNA, 12 nt, Mycobacterium avium subsp. paratuberculosis
cccggucgccgg

SEQ ID NO: 865940 - RNA, 23 nt, Mycobacterium avium subsp. paratuberculosis
cccggucgccggugugaucgagc

SEQ ID NO: 865941 - RNA, 14 nt, Mycobacterium avium subsp. paratuberculosis
cccggucgcggccg

SEQ ID NO: 865942 - RNA, 21 nt, Mycobacterium avium subsp. paratuberculosis
cccggucgcggccguagccgu

SEQ ID NO: 865943 - RNA, 21 nt, Mycobacterium avium subsp. paratuberculosis
cccggucggaguccagcacgc

SEQ ID NO: 865944 - RNA, 19 nt, Mycobacterium avium subsp. paratuberculosis
cccggucgaggucggccag

SEQ ID NO: 865945 - RNA, 14 nt, Mycobacterium avium subsp. paratuberculosis
cccggucgaugauc

SEQ ID NO: 865946 - RNA, 14 nt, Mycobacterium avium subsp. paratuberculosis
cccggucguagucg

SEQ ID NO: 865947 - RNA, 19 nt, Mycobacterium avium subsp. paratuberculosis
cccggucguagucggcccg

SEQ ID NO: 865948 - RNA, 20 nt, Mycobacterium avium subsp. paratuberculosis
cccggucguagucggcccgc

SEQ ID NO: 865949 - RNA, 23 nt, Mycobacterium avium subsp. paratuberculosis
cccggucguagucggcccgccgg

SEQ ID NO: 865950 - RNA, 16 nt, Mycobacterium avium subsp. paratuberculosis
cccggucgucgagcac

SEQ ID NO: 865951 - RNA, 20 nt, Mycobacterium avium subsp. paratuberculosis
cccggucgucgagcaccggc

SEQ ID NO: 865952 - RNA, 22 nt, Mycobacterium avium subsp. paratuberculosis
cccggucgucgagcaccggcug

SEQ ID NO: 865953 - RNA, 17 nt, Mycobacterium avium subsp. paratuberculosis
cccggucgucgccggau

SEQ ID NO: 865954 - RNA, 23 nt, Mycobacterium avium subsp. paratuberculosis
cccggguugucgacguggugcac

SEQ ID NO: 865955 - RNA, 13 nt, Mycobacterium avium subsp. paratuberculosis
cccgguacagcgc

SEQ ID NO: 865956 - RNA, 22 nt, Mycobacterium avium subsp. paratuberculosis
cccgguacggcucaacggccgg

SEQ ID NO: 865957 - RNA, 23 nt, Mycobacterium avium subsp. paratuberculosis
cccgguacggcucaacggccggc

SEQ ID NO: 865958 - RNA, 22 nt, Mycobacterium avium subsp. paratuberculosis
cccgguagagcggcaccagguu

SEQ ID NO: 865959 - RNA, 22 nt, Mycobacterium avium subsp. paratuberculosis
cccgguagauauggcccuccac

SEQ ID NO: 865960 - RNA, 23 nt, Mycobacterium avium subsp. paratuberculosis
cccgguagauauggcccuccacg

SEQ ID NO: 865961 - RNA, 15 nt, Mycobacterium avium subsp. paratuberculosis
cccgguagaucgccg

SEQ ID NO: 865962 - RNA, 16 nt, Mycobacterium avium subsp. paratuberculosis
cccgguagccagcacc

SEQ ID NO: 865963 - RNA, 22 nt, Mycobacterium avium subsp. paratuberculosis
cccgguagccagcaccgccccg

SEQ ID NO: 865964 - RNA, 18 nt, Mycobacterium avium subsp. paratuberculosis
cccgguacagcgccgcgg

SEQ ID NO: 865965 - RNA, 23 nt, Mycobacterium avium subsp. paratuberculosis
cccgguacagcgccgcggccagc

SEQ ID NO: 865966 - RNA, 15 nt, Mycobacterium avium subsp. paratuberculosis
cccgguagcgcagca

SEQ ID NO: 865967 - RNA, 15 nt, Mycobacterium avium subsp. paratuberculosis
cccgguaggccgccg

SEQ ID NO: 865968 - RNA, 15 nt, Mycobacterium avium subsp. paratuberculosis
cccgggcaccccggu

SEQ ID NO: 865969 - RNA, 19 nt, Mycobacterium avium subsp. paratuberculosis
cccgggcacgacggucagc

SEQ ID NO: 865970 - RNA, 22 nt, Mycobacterium avium subsp. paratuberculosis
cccgggcacgcgagacgagccg

SEQ ID NO: 865971 - RNA, 14 nt, Mycobacterium avium subsp. paratuberculosis
cccgggaugccgag

SEQ ID NO: 865972 - RNA, 23 nt, Mycobacterium avium subsp. paratuberculosis
cccgggaugccugcccgcgcagg

SEQ ID NO: 865973 - RNA, 15 nt, Mycobacterium avium subsp. paratuberculosis
cccgggcaccagcgc

SEQ ID NO: 865974 - RNA, 20 nt, Mycobacterium avium subsp. paratuberculosis
cccgggcaccagcgcgacgg

SEQ ID NO: 865975 - RNA, 14 nt, Mycobacterium avium subsp. paratuberculosis
cccggcucuccauc

SEQ ID NO: 865976 - RNA, 18 nt, Mycobacterium avium subsp. paratuberculosis
cccggcucuccaucuucg

SEQ ID NO: 865977 - RNA, 14 nt, Mycobacterium avium subsp. paratuberculosis
cccggcucggugcg

SEQ ID NO: 865978 - RNA, 18 nt, Mycobacterium avium subsp. paratuberculosis
cccgggaaguucacgucc

SEQ ID NO: 865979 - RNA, 14 nt, Mycobacterium avium subsp. paratuberculosis
cccgggacccggaa

SEQ ID NO: 865980 - RNA, 15 nt, Mycobacterium avium subsp. paratuberculosis
cccggguggcgucca

SEQ ID NO: 865981 - RNA, 24 nt, Mycobacterium avium subsp. paratuberculosis
cccggguggcguccagaugccguu

SEQ ID NO: 865982 - RNA, 14 nt, Mycobacterium avium subsp. paratuberculosis
cccgggugggcagc

SEQ ID NO: 865983 - RNA, 21 nt, Mycobacterium avium subsp. paratuberculosis
cccgggugggcgggacguggc

SEQ ID NO: 865984 - RNA, 22 nt, Mycobacterium avium subsp. paratuberculosis
cccgggugggcgggacguggcu

SEQ ID NO: 865985 - RNA, 23 nt, Mycobacterium avium subsp. paratuberculosis
cccgggugggugcucaccccggc

SEQ ID NO: 865986 - RNA, 23 nt, Mycobacterium avium subsp. paratuberculosis
cccgggugugggcgccgucaaug

SEQ ID NO: 865987 - RNA, 15 nt, Mycobacterium avium subsp. paratuberculosis
cccgggcccgcugca

SEQ ID NO: 865988 - RNA, 16 nt, Mycobacterium avium subsp. paratuberculosis
cccgggcccgcugcag

SEQ ID NO: 865989 - RNA, 15 nt, Mycobacterium avium subsp. paratuberculosis
cccggguggcccgca

SEQ ID NO: 865990 - RNA, 20 nt, Mycobacterium avium subsp. paratuberculosis
cccggguugagcaggucagc

SEQ ID NO: 865991 - RNA, 19 nt, Mycobacterium avium subsp. paratuberculosis
cccggguugcgugcagccg

SEQ ID NO: 865992 - RNA, 13 nt, Mycobacterium avium subsp. paratuberculosis
cccgggcaggcau

SEQ ID NO: 865993 - RNA, 17 nt, Mycobacterium avium subsp. paratuberculosis
cccgggcaggcggcgcg

SEQ ID NO: 865994 - RNA, 21 nt, Mycobacterium avium subsp. paratuberculosis
cccgggcaggcggcgcgccag

SEQ ID NO: 865995 - RNA, 13 nt, Mycobacterium avium subsp. paratuberculosis
cccgggccaggac

SEQ ID NO: 865996 - RNA, 14 nt, Mycobacterium avium subsp. paratuberculosis
cccgggcccagcac

SEQ ID NO: 865997 - RNA, 15 nt, Mycobacterium avium subsp. paratuberculosis
cccgggcccagcacc

SEQ ID NO: 865998 - RNA, 17 nt, Mycobacterium avium subsp. paratuberculosis
cccgggcccagcaccac

SEQ ID NO: 865999 - RNA, 16 nt, Mycobacterium avium subsp. paratuberculosis
cccgggccgcagcucg

SEQ ID NO: 866000 - RNA, 15 nt, Mycobacterium avium subsp. paratuberculosis
cccgggccgccacgg

SEQ ID NO: 866001 - RNA, 16 nt, Mycobacterium avium subsp. paratuberculosis
cccgggccgccacggc

SEQ ID NO: 866002 - RNA, 22 nt, Mycobacterium avium subsp. paratuberculosis
cccggcagccgcuccggcccga

SEQ ID NO: 866003 - RNA, 14 nt, Mycobacterium avium subsp. paratuberculosis
cccggcagccgggg

SEQ ID NO: 866004 - RNA, 15 nt, Mycobacterium avium subsp. paratuberculosis
cccggcagccggggu

SEQ ID NO: 866005 - RNA, 23 nt, Mycobacterium avium subsp. paratuberculosis
cccggcagccggggugcccgggc

SEQ ID NO: 866006 - RNA, 19 nt, Mycobacterium avium subsp. paratuberculosis
cccggcagaacgacgccag

SEQ ID NO: 866007 - RNA, 16 nt, Mycobacterium avium subsp. paratuberculosis
cccggcagaucgcggc

SEQ ID NO: 866008 - RNA, 15 nt, Mycobacterium avium subsp. paratuberculosis
cccggaguccggcuc

SEQ ID NO: 866009 - RNA, 22 nt, Mycobacterium avium subsp. paratuberculosis
cccggaguccggcucggugccg

SEQ ID NO: 866010 - RNA, 14 nt, Mycobacterium avium subsp. paratuberculosis
cccggaggcggcgg

SEQ ID NO: 866011 - RNA, 16 nt, Mycobacterium avium subsp. paratuberculosis
cccggauacacggugg

SEQ ID NO: 866012 - RNA, 20 nt, Mycobacterium avium subsp. paratuberculosis
cccggcaccaccacccccga

SEQ ID NO: 866013 - RNA, 16 nt, Mycobacterium avium subsp. paratuberculosis
cccggcaccgcggcgg

SEQ ID NO: 866014 - RNA, 15 nt, Mycobacterium avium subsp. paratuberculosis
cccggcaccgggacc

SEQ ID NO: 866015 - RNA, 15 nt, Mycobacterium avium subsp. paratuberculosis
cccggcaccggugcg

SEQ ID NO: 866016 - RNA, 14 nt, Mycobacterium avium subsp. paratuberculosis
cccggccagguucc

SEQ ID NO: 866017 - RNA, 21 nt, Mycobacterium avium subsp. paratuberculosis
cccggccagguuccaccgggc

SEQ ID NO: 866018 - RNA, 22 nt, Mycobacterium avium subsp. paratuberculosis
cccggccagguuccaccgggcg

SEQ ID NO: 866019 - RNA, 23 nt, Mycobacterium avium subsp. paratuberculosis
cccggccaguccggcagcagcga

SEQ ID NO: 866020 - RNA, 12 nt, Mycobacterium avium subsp. paratuberculosis
cccggccagccg

SEQ ID NO: 866021 - RNA, 17 nt, Mycobacterium avium subsp. paratuberculosis
cccggccagccggccgc

SEQ ID NO: 866022 - RNA, 14 nt, Mycobacterium avium subsp. paratuberculosis
cccggccagccggu

SEQ ID NO: 866023 - RNA, 16 nt, Mycobacterium avium subsp. paratuberculosis
cccggccagccgguau

SEQ ID NO: 866024 - RNA, 16 nt, Mycobacterium avium subsp. paratuberculosis
cccggccagcggcagc

SEQ ID NO: 866025 - RNA, 20 nt, Mycobacterium avium subsp. paratuberculosis
cccggccacucgccgcgaac

SEQ ID NO: 866026 - RNA, 13 nt, Mycobacterium avium subsp. paratuberculosis
cccggccagcacc

SEQ ID NO: 866027 - RNA, 14 nt, Mycobacterium avium subsp. paratuberculosis
cccggccagcaccc

SEQ ID NO: 866028 - RNA, 17 nt, Mycobacterium avium subsp. paratuberculosis
cccggccagcacccgcu

SEQ ID NO: 866029 - RNA, 13 nt, Mycobacterium avium subsp. paratuberculosis
cccggccacgucg

SEQ ID NO: 866030 - RNA, 17 nt, Mycobacterium avium subsp. paratuberculosis
cccggccacgucgaugc

SEQ ID NO: 866031 - RNA, 17 nt, Mycobacterium avium subsp. paratuberculosis
cccggccaccagggaca

SEQ ID NO: 866032 - RNA, 17 nt, Mycobacterium avium subsp. paratuberculosis
cccggccaccagggcga

SEQ ID NO: 866033 - RNA, 14 nt, Mycobacterium avium subsp. paratuberculosis
cccggccaccccgc

SEQ ID NO: 866034 - RNA, 15 nt, Mycobacterium avium subsp. paratuberculosis
cccggccaccccgca

SEQ ID NO: 866035 - RNA, 13 nt, Mycobacterium avium subsp. paratuberculosis
cccggccaccgcc

SEQ ID NO: 866036 - RNA, 14 nt, Mycobacterium avium subsp. paratuberculosis
cccggccaccgccg

SEQ ID NO: 866037 - RNA, 18 nt, Mycobacterium avium subsp. paratuberculosis
cccggccaccgccgccag

SEQ ID NO: 866038 - RNA, 18 nt, Mycobacterium avium subsp. paratuberculosis
cccggccaccuggccggu

SEQ ID NO: 866039 - RNA, 23 nt, Mycobacterium avium subsp. paratuberculosis
cccggcgaguggaagucagcgcg

SEQ ID NO: 866040 - RNA, 19 nt, Mycobacterium avium subsp. paratuberculosis
cccggcgaucucgagcauc

SEQ ID NO: 866041 - RNA, 11 nt, Mycobacterium avium subsp. paratuberculosis
cccggcgauga

SEQ ID NO: 866042 - RNA, 17 nt, Mycobacterium avium subsp. paratuberculosis
cccggcgaugaccggga

SEQ ID NO: 866043 - RNA, 13 nt, Mycobacterium avium subsp. paratuberculosis
cccggcgacggcg

SEQ ID NO: 866044 - RNA, 14 nt, Mycobacterium avium subsp. paratuberculosis
cccggcgacggcgc

SEQ ID NO: 866045 - RNA, 14 nt, Mycobacterium avium subsp. paratuberculosis
cccggcgacgucgc

SEQ ID NO: 866046 - RNA, 20 nt, Mycobacterium avium subsp. paratuberculosis
cccggcgacgucgccggccu

SEQ ID NO: 866047 - RNA, 19 nt, Mycobacterium avium subsp. paratuberculosis
cccggcgagcacgccgccg

SEQ ID NO: 866048 - RNA, 20 nt, Mycobacterium avium subsp. paratuberculosis
cccggcgagcacgccgccgg

SEQ ID NO: 866049 - RNA, 14 nt, Mycobacterium avium subsp. paratuberculosis
cccggcgagcgcgu

SEQ ID NO: 866050 - RNA, 13 nt, Mycobacterium avium subsp. paratuberculosis
cccggcgagcggc

SEQ ID NO: 866051 - RNA, 13 nt, Mycobacterium avium subsp. paratuberculosis
cccggcgaccacc

SEQ ID NO: 866052 - RNA, 13 nt, Mycobacterium avium subsp. paratuberculosis
cccggcgaaccgg

SEQ ID NO: 866053 - RNA, 18 nt, Mycobacterium avium subsp. paratuberculosis
cccggcgaacgccucggu

SEQ ID NO: 866054 - RNA, 18 nt, Mycobacterium avium subsp. paratuberculosis
cccggcgaaucagcagcu

SEQ ID NO: 866055 - RNA, 17 nt, Mycobacterium avium subsp. paratuberculosis
cccggcgacgaagcagc

SEQ ID NO: 866056 - RNA, 21 nt, Mycobacterium avium subsp. paratuberculosis
cccggccggcgaaacacagca

SEQ ID NO: 866057 - RNA, 20 nt, Mycobacterium avium subsp. paratuberculosis
cccggccguugggccagcgg

SEQ ID NO: 866058 - RNA, 14 nt, Mycobacterium avium subsp. paratuberculosis
cccggccggcgcga

SEQ ID NO: 866059 - RNA, 22 nt, Mycobacterium avium subsp. paratuberculosis
cccggccggcgcgaccagcggc

SEQ ID NO: 866060 - RNA, 13 nt, Mycobacterium avium subsp. paratuberculosis
cccggccggcggg

SEQ ID NO: 866061 - RNA, 17 nt, Mycobacterium avium subsp. paratuberculosis
cccggccggucgccgau

SEQ ID NO: 866062 - RNA, 17 nt, Mycobacterium avium subsp. paratuberculosis
cccggccggucgccugc

SEQ ID NO: 866063 - RNA, 12 nt, Mycobacterium avium subsp. paratuberculosis
cccggccgugga

SEQ ID NO: 866064 - RNA, 17 nt, Mycobacterium avium subsp. paratuberculosis
cccggccguggacccgc

SEQ ID NO: 866065 - RNA, 22 nt, Mycobacterium avium subsp. paratuberculosis
cccggccguucuugcgggugau

SEQ ID NO: 866066 - RNA, 12 nt, Mycobacterium avium subsp. paratuberculosis
cccggccgccgg

SEQ ID NO: 866067 - RNA, 13 nt, Mycobacterium avium subsp. paratuberculosis
cccggccgccggg

SEQ ID NO: 866068 - RNA, 15 nt, Mycobacterium avium subsp. paratuberculosis
cccggccgccgggac

SEQ ID NO: 866069 - RNA, 15 nt, Mycobacterium avium subsp. paratuberculosis
cccggccgcgacagc

SEQ ID NO: 866070 - RNA, 16 nt, Mycobacterium avium subsp. paratuberculosis
cccggccgcgacagcc

SEQ ID NO: 866071 - RNA, 17 nt, Mycobacterium avium subsp. paratuberculosis
cccggccgcgacagccg

SEQ ID NO: 866072 - RNA, 12 nt, Mycobacterium avium subsp. paratuberculosis
cccggccgacga

SEQ ID NO: 866073 - RNA, 12 nt, Mycobacterium avium subsp. paratuberculosis
cccggccgacgg

SEQ ID NO: 866074 - RNA, 15 nt, Mycobacterium avium subsp. paratuberculosis
cccggccgacgggcg

SEQ ID NO: 866075 - RNA, 19 nt, Mycobacterium avium subsp. paratuberculosis
cccggccgagccggcguac

SEQ ID NO: 866076 - RNA, 12 nt, Mycobacterium avium subsp. paratuberculosis
cccggccgagcg

SEQ ID NO: 866077 - RNA, 17 nt, Mycobacterium avium subsp. paratuberculosis
cccggcccguccagauc

SEQ ID NO: 866078 - RNA, 21 nt, Mycobacterium avium subsp. paratuberculosis
cccggcccuauggcaucgcca

SEQ ID NO: 866079 - RNA, 19 nt, Mycobacterium avium subsp. paratuberculosis
cccggcccaagacccgcgu

SEQ ID NO: 866080 - RNA, 16 nt, Mycobacterium avium subsp. paratuberculosis
cccggcccgccgcugc

SEQ ID NO: 866081 - RNA, 15 nt, Mycobacterium avium subsp. paratuberculosis
cccggcccggcgaug

SEQ ID NO: 866082 - RNA, 14 nt, Mycobacterium avium subsp. paratuberculosis
cccggcccggcgcg

SEQ ID NO: 866083 - RNA, 16 nt, Mycobacterium avium subsp. paratuberculosis
cccggcccggcgcggc

SEQ ID NO: 866084 - RNA, 18 nt, Mycobacterium avium subsp. paratuberculosis
cccggcccggcgcggccg

SEQ ID NO: 866085 - RNA, 17 nt, Mycobacterium avium subsp. paratuberculosis
cccggcccaucaccgga

SEQ ID NO: 866086 - RNA, 21 nt, Mycobacterium avium subsp. paratuberculosis
cccggcccaucaccggaccgg

SEQ ID NO: 866087 - RNA, 16 nt, Mycobacterium avium subsp. paratuberculosis
cccggccccaccgccg

SEQ ID NO: 866088 - RNA, 14 nt, Mycobacterium avium subsp. paratuberculosis
cccggccccggccg

SEQ ID NO: 866089 - RNA, 16 nt, Mycobacterium avium subsp. paratuberculosis
cccggccccggccggc

SEQ ID NO: 866090 - RNA, 15 nt, Mycobacterium avium subsp. paratuberculosis
cccggcccaccaccg

SEQ ID NO: 866091 - RNA, 17 nt, Mycobacterium avium subsp. paratuberculosis
cccggcccaccggcccg

SEQ ID NO: 866092 - RNA, 17 nt, Mycobacterium avium subsp. paratuberculosis
cccggcccacgccgucg

SEQ ID NO: 866093 - RNA, 12 nt, Mycobacterium avium subsp. paratuberculosis
cccggcccagcc

SEQ ID NO: 866094 - RNA, 17 nt, Mycobacterium avium subsp. paratuberculosis
cccggcccagccggucg

SEQ ID NO: 866095 - RNA, 22 nt, Mycobacterium avium subsp. paratuberculosis
cccggcccagccggucgccggg

SEQ ID NO: 866096 - RNA, 18 nt, Mycobacterium avium subsp. paratuberculosis
ccagcagauacuccucgc

SEQ ID NO: 866097 - RNA, 16 nt, Mycobacterium avium subsp. paratuberculosis
ccagcagaugccgccc

SEQ ID NO: 866098 - RNA, 12 nt, Mycobacterium avium subsp. paratuberculosis
ccagcagcacca

SEQ ID NO: 866099 - RNA, 14 nt, Mycobacterium avium subsp. paratuberculosis
ccagcagcaacgcg

SEQ ID NO: 866100 - RNA, 21 nt, Mycobacterium avium subsp. paratuberculosis
ccagcagcagcaggucgucga

SEQ ID NO: 866101 - RNA, 18 nt, Mycobacterium avium subsp. paratuberculosis
ccagcagcagcccgccga

SEQ ID NO: 866102 - RNA, 14 nt, Mycobacterium avium subsp. paratuberculosis
ccagcagcaccaga

SEQ ID NO: 866103 - RNA, 22 nt, Mycobacterium avium subsp. paratuberculosis
ccagcagcaccagaugcaccuc

SEQ ID NO: 866104 - RNA, 14 nt, Mycobacterium avium subsp. paratuberculosis
ccagcagcaccagg

SEQ ID NO: 866105 - RNA, 14 nt, Mycobacterium avium subsp. paratuberculosis
ccagcagcaccgcg

SEQ ID NO: 866106 - RNA, 12 nt, Mycobacterium avium subsp. paratuberculosis
ccagcagcaccu

SEQ ID NO: 866107 - RNA, 13 nt, Mycobacterium avium subsp. paratuberculosis
ccagcagcaggua

SEQ ID NO: 866108 - RNA, 23 nt, Mycobacterium avium subsp. paratuberculosis
ccagcagcagguagcggcugacc

SEQ ID NO: 866109 - RNA, 15 nt, Mycobacterium avium subsp. paratuberculosis
ccagcagccagccca

SEQ ID NO: 866110 - RNA, 17 nt, Mycobacterium avium subsp. paratuberculosis
ccagcagccagcccagc

SEQ ID NO: 866111 - RNA, 15 nt, Mycobacterium avium subsp. paratuberculosis
ccagcagccaggauc

SEQ ID NO: 866112 - RNA, 20 nt, Mycobacterium avium subsp. paratuberculosis
ccagcagccaggauccgaug

SEQ ID NO: 866113 - RNA, 14 nt, Mycobacterium avium subsp. paratuberculosis
ccagcagcagcgcg

SEQ ID NO: 866114 - RNA, 16 nt, Mycobacterium avium subsp. paratuberculosis
ccagcagcagcgcggc

SEQ ID NO: 866115 - RNA, 18 nt, Mycobacterium avium subsp. paratuberculosis
ccagcagcagcgcggcau

SEQ ID NO: 866116 - RNA, 17 nt, Mycobacterium avium subsp. paratuberculosis
ccagcagcagcgccgcc

SEQ ID NO: 866117 - RNA, 20 nt, Mycobacterium avium subsp. paratuberculosis
ccagcagcagcgccgccacc

SEQ ID NO: 866118 - RNA, 21 nt, Mycobacterium avium subsp. paratuberculosis
ccagcagcagcgccgccaccg

SEQ ID NO: 866119 - RNA, 14 nt, Mycobacterium avium subsp. paratuberculosis
ccagcagcacggca

SEQ ID NO: 866120 - RNA, 17 nt, Mycobacterium avium subsp. paratuberculosis
ccagcagcagccgcgcc

SEQ ID NO: 866121 - RNA, 18 nt, Mycobacterium avium subsp. paratuberculosis
ccagcagcagccgcgccg

SEQ ID NO: 866122 - RNA, 21 nt, Mycobacterium avium subsp. paratuberculosis
ccagcagcagccgcgccgccg

SEQ ID NO: 866123 - RNA, 14 nt, Mycobacterium avium subsp. paratuberculosis
ccagcaccgcgacg

SEQ ID NO: 866124 - RNA, 17 nt, Mycobacterium avium subsp. paratuberculosis
ccagcacgcugcggaug

SEQ ID NO: 866125 - RNA, 13 nt, Mycobacterium avium subsp. paratuberculosis
ccagcacggccgc

SEQ ID NO: 866126 - RNA, 14 nt, Mycobacterium avium subsp. paratuberculosis
ccagcacggccgcc

SEQ ID NO: 866127 - RNA, 19 nt, Mycobacterium avium subsp. paratuberculosis
ccagcacggccaccagcag

SEQ ID NO: 866128 - RNA, 20 nt, Mycobacterium avium subsp. paratuberculosis
ccagcacgccguccuuggcc

SEQ ID NO: 866129 - RNA, 23 nt, Mycobacterium avium subsp. paratuberculosis
ccagcacgccguccuuggccgcc

SEQ ID NO: 866130 - RNA, 15 nt, Mycobacterium avium subsp. paratuberculosis
ccagcacgccguuga

SEQ ID NO: 866131 - RNA, 14 nt, Mycobacterium avium subsp. paratuberculosis
ccagcaccggcugg

SEQ ID NO: 866132 - RNA, 17 nt, Mycobacterium avium subsp. paratuberculosis
ccagcaccgggcccagc

SEQ ID NO: 866133 - RNA, 17 nt, Mycobacterium avium subsp. paratuberculosis
ccagcacgcaggcgugg

SEQ ID NO: 866134 - RNA, 16 nt, Mycobacterium avium subsp. paratuberculosis
ccagcacgcccagauc

SEQ ID NO: 866135 - RNA, 13 nt, Mycobacterium avium subsp. paratuberculosis
ccagcacgucacc

SEQ ID NO: 866136 - RNA, 18 nt, Mycobacterium avium subsp. paratuberculosis
ccagcacgucaccgcuga

SEQ ID NO: 866137 - RNA, 16 nt, Mycobacterium avium subsp. paratuberculosis
ccagcacgucggggug

SEQ ID NO: 866138 - RNA, 23 nt, Mycobacterium avium subsp. paratuberculosis
ccagcacgugcccagcccgcgcg

SEQ ID NO: 866139 - RNA, 15 nt, Mycobacterium avium subsp. paratuberculosis
ccagcacguggccgg

SEQ ID NO: 866140 - RNA, 19 nt, Mycobacterium avium subsp. paratuberculosis
ccagcacguggccgggcuc

SEQ ID NO: 866141 - RNA, 17 nt, Mycobacterium avium subsp. paratuberculosis
ccagcacggucagcggc

SEQ ID NO: 866142 - RNA, 20 nt, Mycobacterium avium subsp. paratuberculosis
ccagcacggucagcggccag

SEQ ID NO: 866143 - RNA, 14 nt, Mycobacterium avium subsp. paratuberculosis
ccagcacggugaug

SEQ ID NO: 866144 - RNA, 13 nt, Mycobacterium avium subsp. paratuberculosis
ccagcacggugcg

SEQ ID NO: 866145 - RNA, 22 nt, Mycobacterium avium subsp. paratuberculosis
ccagcacggugcguucgcguuc

SEQ ID NO: 866146 - RNA, 14 nt, Mycobacterium avium subsp. paratuberculosis
ccagcacggcgaag

SEQ ID NO: 866147 - RNA, 14 nt, Mycobacterium avium subsp. paratuberculosis
ccagcacggcgacc

SEQ ID NO: 866148 - RNA, 14 nt, Mycobacterium avium subsp. paratuberculosis
ccagcacggcggcg

SEQ ID NO: 866149 - RNA, 15 nt, Mycobacterium avium subsp. paratuberculosis
ccagcacggcggcgc

SEQ ID NO: 866150 - RNA, 17 nt, Mycobacterium avium subsp. paratuberculosis
ccagcacggcggcgcug

SEQ ID NO: 866151 - RNA, 19 nt, Mycobacterium avium subsp. paratuberculosis
ccagcacggcggcgcugau

SEQ ID NO: 866152 - RNA, 16 nt, Mycobacterium avium subsp. paratuberculosis
ccagcacggcggcgug

SEQ ID NO: 866153 - RNA, 14 nt, Mycobacterium avium subsp. paratuberculosis
ccagcaccaccguc

SEQ ID NO: 866154 - RNA, 22 nt, Mycobacterium avium subsp. paratuberculosis
ccagcaccaccgucaccgccgc

SEQ ID NO: 866155 - RNA, 23 nt, Mycobacterium avium subsp. paratuberculosis
ccagcaccaccguggcgaugggc

SEQ ID NO: 866156 - RNA, 13 nt, Mycobacterium avium subsp. paratuberculosis
ccagcaccacccg

SEQ ID NO: 866157 - RNA, 13 nt, Mycobacterium avium subsp. paratuberculosis
ccagcaccaccgc

SEQ ID NO: 866158 - RNA, 15 nt, Mycobacterium avium subsp. paratuberculosis
ccagcaccaccgcga

SEQ ID NO: 866159 - RNA, 19 nt, Mycobacterium avium subsp. paratuberculosis
ccagcaccgacagucccac

SEQ ID NO: 866160 - RNA, 15 nt, Mycobacterium avium subsp. paratuberculosis
ccagcaccgacgcgc

SEQ ID NO: 866161 - RNA, 11 nt, Mycobacterium avium subsp. paratuberculosis
ccagcaccgcc

SEQ ID NO: 866162 - RNA, 12 nt, Mycobacterium avium subsp. paratuberculosis
ccagcaccgcca

SEQ ID NO: 866163 - RNA, 14 nt, Mycobacterium avium subsp. paratuberculosis
ccagcaccgcggcc

SEQ ID NO: 866164 - RNA, 18 nt, Mycobacterium avium subsp. paratuberculosis
ccagcaccgcggccgucg

SEQ ID NO: 866165 - RNA, 19 nt, Mycobacterium avium subsp. paratuberculosis
ccagcaccgcggccgucgc

SEQ ID NO: 866166 - RNA, 15 nt, Mycobacterium avium subsp. paratuberculosis
ccagcaccgcggcga

SEQ ID NO: 866167 - RNA, 22 nt, Mycobacterium avium subsp. paratuberculosis
ccagcaccgcggcgaucgccgu

SEQ ID NO: 866168 - RNA, 16 nt, Mycobacterium avium subsp. paratuberculosis
ccagcaccgcgucgau

SEQ ID NO: 866169 - RNA, 17 nt, Mycobacterium avium subsp. paratuberculosis
ccagcaccgcgucgaug

SEQ ID NO: 866170 - RNA, 14 nt, Mycobacterium avium subsp. paratuberculosis
ccagcaccggcgcc

SEQ ID NO: 866171 - RNA, 15 nt, Mycobacterium avium subsp. paratuberculosis
ccagcaccggcgcca

SEQ ID NO: 866172 - RNA, 16 nt, Mycobacterium avium subsp. paratuberculosis
ccagcaccggcgcgcc

SEQ ID NO: 866173 - RNA, 13 nt, Mycobacterium avium subsp. paratuberculosis
ccagcaccgccgc

SEQ ID NO: 866174 - RNA, 20 nt, Mycobacterium avium subsp. paratuberculosis
ccagcaccgccccggucacc

SEQ ID NO: 866175 - RNA, 12 nt, Mycobacterium avium subsp. paratuberculosis
ccagcaccgccg

SEQ ID NO: 866176 - RNA, 14 nt, Mycobacterium avium subsp. paratuberculosis
ccagcaccgccgcg

SEQ ID NO: 866177 - RNA, 20 nt, Mycobacterium avium subsp. paratuberculosis
ccagcaccgccacgucgaac

SEQ ID NO: 866178 - RNA, 13 nt, Mycobacterium avium subsp. paratuberculosis
ccagcaccgccag

SEQ ID NO: 866179 - RNA, 23 nt, Mycobacterium avium subsp. paratuberculosis
ccagcaccgccagcgccggcagc

SEQ ID NO: 866180 - RNA, 14 nt, Mycobacterium avium subsp. paratuberculosis
ccagcaccgccacc

SEQ ID NO: 866181 - RNA, 15 nt, Mycobacterium avium subsp. paratuberculosis
ccagcaccgccaccg

SEQ ID NO: 866182 - RNA, 17 nt, Mycobacterium avium subsp. paratuberculosis
ccagcaccgccaccggc

SEQ ID NO: 866183 - RNA, 14 nt, Mycobacterium avium subsp. paratuberculosis
ccagcagcccgggc

SEQ ID NO: 866184 - RNA, 18 nt, Mycobacterium avium subsp. paratuberculosis
ccagcagcccgggcugca

SEQ ID NO: 866185 - RNA, 13 nt, Mycobacterium avium subsp. paratuberculosis
ccagcagccgcag

SEQ ID NO: 866186 - RNA, 14 nt, Mycobacterium avium subsp. paratuberculosis
ccagcagccgcagc

SEQ ID NO: 866187 - RNA, 17 nt, Mycobacterium avium subsp. paratuberculosis
ccagcagccgcagcgcg

SEQ ID NO: 866188 - RNA, 12 nt, Mycobacterium avium subsp. paratuberculosis
ccagcagccgcg

SEQ ID NO: 866189 - RNA, 22 nt, Mycobacterium avium subsp. paratuberculosis
ccagcagcgagaaccggcgcag

SEQ ID NO: 866190 - RNA, 19 nt, Mycobacterium avium subsp. paratuberculosis
ccagcagcgagaccggcac

SEQ ID NO: 866191 - RNA, 15 nt, Mycobacterium avium subsp. paratuberculosis
ccagcagcccggcca

SEQ ID NO: 866192 - RNA, 19 nt, Mycobacterium avium subsp. paratuberculosis
ccagcagcccggccagccg

SEQ ID NO: 866193 - RNA, 22 nt, Mycobacterium avium subsp. paratuberculosis
ccagcagcccggccagccgggc

SEQ ID NO: 866194 - RNA, 13 nt, Mycobacterium avium subsp. paratuberculosis
ccagcagccgcgc

SEQ ID NO: 866195 - RNA, 17 nt, Mycobacterium avium subsp. paratuberculosis
ccagcagccgcgccgac

SEQ ID NO: 866196 - RNA, 20 nt, Mycobacterium avium subsp. paratuberculosis
ccagcagccgcgccgacgcc

SEQ ID NO: 866197 - RNA, 23 nt, Mycobacterium avium subsp. paratuberculosis
ccagcagccgcgcgagcaucacc

SEQ ID NO: 866198 - RNA, 13 nt, Mycobacterium avium subsp. paratuberculosis
ccagcagccgggu

SEQ ID NO: 866199 - RNA, 21 nt, Mycobacterium avium subsp. paratuberculosis
ccagcagccggucgaggucgc

SEQ ID NO: 866200 - RNA, 13 nt, Mycobacterium avium subsp. paratuberculosis
ccagcagcggcac

SEQ ID NO: 866201 - RNA, 16 nt, Mycobacterium avium subsp. paratuberculosis
ccagcagcggcacccg

SEQ ID NO: 866202 - RNA, 22 nt, Mycobacterium avium subsp. paratuberculosis
ccagcagcgccucggcgaucgg

SEQ ID NO: 866203 - RNA, 12 nt, Mycobacterium avium subsp. paratuberculosis
ccagcagcggca

SEQ ID NO: 866204 - RNA, 19 nt, Mycobacterium avium subsp. paratuberculosis
ccagcagcgcgacgccgac

SEQ ID NO: 866205 - RNA, 22 nt, Mycobacterium avium subsp. paratuberculosis
ccagcagcgcgacgccgacgcc

SEQ ID NO: 866206 - RNA, 23 nt, Mycobacterium avium subsp. paratuberculosis
ccagcagcgcgacgccgacgccc

SEQ ID NO: 866207 - RNA, 13 nt, Mycobacterium avium subsp. paratuberculosis
ccagcagcgcggc

SEQ ID NO: 866208 - RNA, 17 nt, Mycobacterium avium subsp. paratuberculosis
ccagcagcgcggcgauc

SEQ ID NO: 866209 - RNA, 14 nt, Mycobacterium avium subsp. paratuberculosis
ccagcagcgccgcu

SEQ ID NO: 866210 - RNA, 16 nt, Mycobacterium avium subsp. paratuberculosis
ccagcagcgccgcuuc

SEQ ID NO: 866211 - RNA, 15 nt, Mycobacterium avium subsp. paratuberculosis
ccagcagcgccggca

SEQ ID NO: 866212 - RNA, 13 nt, Mycobacterium avium subsp. paratuberculosis
ccagcagcgccuc

SEQ ID NO: 866213 - RNA, 13 nt, Mycobacterium avium subsp. paratuberculosis
ccagcagcgccac

SEQ ID NO: 866214 - RNA, 16 nt, Mycobacterium avium subsp. paratuberculosis
ccagcagcgccagcac

SEQ ID NO: 866215 - RNA, 17 nt, Mycobacterium avium subsp. paratuberculosis
ccagcagcgccagcacc

SEQ ID NO: 866216 - RNA, 19 nt, Mycobacterium avium subsp. paratuberculosis
ccagcagcgccagcaccgc

SEQ ID NO: 866217 - RNA, 15 nt, Mycobacterium avium subsp. paratuberculosis
ccagcagcgcaccgg

SEQ ID NO: 866218 - RNA, 16 nt, Mycobacterium avium subsp. paratuberculosis
ccagcagcgcaccggc

SEQ ID NO: 866219 - RNA, 17 nt, Mycobacterium avium subsp. paratuberculosis
ccagcagcgcaccggcg

SEQ ID NO: 866220 - RNA, 21 nt, Mycobacterium avium subsp. paratuberculosis
ccagcagcgcaccggcgaugc

SEQ ID NO: 866221 - RNA, 22 nt, Mycobacterium avium subsp. paratuberculosis
ccagcagcuguugcggcgucag

SEQ ID NO: 866222 - RNA, 22 nt, Mycobacterium avium subsp. paratuberculosis
ccagcagcuugacgucggucag

SEQ ID NO: 866223 - RNA, 23 nt, Mycobacterium avium subsp. paratuberculosis
ccagcagcuugacgucggucagc

SEQ ID NO: 866224 - RNA, 19 nt, Mycobacterium avium subsp. paratuberculosis
ccagcagcgucacgucgac

SEQ ID NO: 866225 - RNA, 20 nt, Mycobacterium avium subsp. paratuberculosis
ccagcagcgucacgucgacg

SEQ ID NO: 866226 - RNA, 14 nt, Mycobacterium avium subsp. paratuberculosis
ccagcagcgucguc

SEQ ID NO: 866227 - RNA, 22 nt, Mycobacterium avium subsp. paratuberculosis
ccagcagcgucgucaggccgug

SEQ ID NO: 866228 - RNA, 14 nt, Mycobacterium avium subsp. paratuberculosis
ccagcagcggggcg

SEQ ID NO: 866229 - RNA, 14 nt, Mycobacterium avium subsp. paratuberculosis
ccagcagcggggug

SEQ ID NO: 866230 - RNA, 15 nt, Mycobacterium avium subsp. paratuberculosis
ccagcagcggggugu

SEQ ID NO: 866231 - RNA, 14 nt, Mycobacterium avium subsp. paratuberculosis
ccagcagcggccgg

SEQ ID NO: 866232 - RNA, 20 nt, Mycobacterium avium subsp. paratuberculosis
ccagcagcggcuuggucacc

SEQ ID NO: 866233 - RNA, 16 nt, Mycobacterium avium subsp. paratuberculosis
ccagcagcgggcccgg

SEQ ID NO: 866234 - RNA, 21 nt, Mycobacterium avium subsp. paratuberculosis
ccagcagcugcgggaccagcg

SEQ ID NO: 866235 - RNA, 23 nt, Mycobacterium avium subsp. paratuberculosis
ccagcagcugcgggaccagcgcc

SEQ ID NO: 866236 - RNA, 22 nt, Mycobacterium avium subsp. paratuberculosis
ccagcaggacgcgcccggcgac

SEQ ID NO: 866237 - RNA, 23 nt, Mycobacterium avium subsp. paratuberculosis
ccagcaggacgcgcccggcgacg

SEQ ID NO: 866238 - RNA, 16 nt, Mycobacterium avium subsp. paratuberculosis
ccagcaggaugaugac

SEQ ID NO: 866239 - RNA, 20 nt, Mycobacterium avium subsp. paratuberculosis
ccagccagaacacgccccgg

SEQ ID NO: 866240 - RNA, 22 nt, Mycobacterium avium subsp. paratuberculosis
ccagccagaacacgccccggcg

SEQ ID NO: 866241 - RNA, 16 nt, Mycobacterium avium subsp. paratuberculosis
ccagccagaacgaaca

SEQ ID NO: 866242 - RNA, 22 nt, Mycobacterium avium subsp. paratuberculosis
ccagcauggcgaucaccccggc

SEQ ID NO: 866243 - RNA, 16 nt, Mycobacterium avium subsp. paratuberculosis
ccagccagccggugcg

SEQ ID NO: 866244 - RNA, 18 nt, Mycobacterium avium subsp. paratuberculosis
ccagccagccggugcggu

SEQ ID NO: 866245 - RNA, 13 nt, Mycobacterium avium subsp. paratuberculosis
ccagccagccgcg

SEQ ID NO: 866246 - RNA, 17 nt, Mycobacterium avium subsp. paratuberculosis
ccagcaugaucaccgcc

SEQ ID NO: 866247 - RNA, 23 nt, Mycobacterium avium subsp. paratuberculosis
ccagcaugaucaccgccagcgcg

SEQ ID NO: 866248 - RNA, 22 nt, Mycobacterium avium subsp. paratuberculosis
ccagcaugcccacgccgucgac

SEQ ID NO: 866249 - RNA, 13 nt, Mycobacterium avium subsp. paratuberculosis
ccagcagggucag

SEQ ID NO: 866250 - RNA, 23 nt, Mycobacterium avium subsp. paratuberculosis
ccagcagguagaagccgcgacgg

SEQ ID NO: 866251 - RNA, 16 nt, Mycobacterium avium subsp. paratuberculosis
ccagcaucucggcgaa

SEQ ID NO: 866252 - RNA, 17 nt, Mycobacterium avium subsp. paratuberculosis
ccagcaucucggcgaag

SEQ ID NO: 866253 - RNA, 18 nt, Mycobacterium avium subsp. paratuberculosis
ccagcaggcgcgccgagc

SEQ ID NO: 866254 - RNA, 14 nt, Mycobacterium avium subsp. paratuberculosis
ccagcagggcgccg

SEQ ID NO: 866255 - RNA, 16 nt, Mycobacterium avium subsp. paratuberculosis
ccagcagggcgccgac

SEQ ID NO: 866256 - RNA, 17 nt, Mycobacterium avium subsp. paratuberculosis
ccagcagggcgccgacg

SEQ ID NO: 866257 - RNA, 20 nt, Mycobacterium avium subsp. paratuberculosis
ccagcagggcgccgacgauc

SEQ ID NO: 866258 - RNA, 15 nt, Mycobacterium avium subsp. paratuberculosis
ccagcagggcggcga

SEQ ID NO: 866259 - RNA, 16 nt, Mycobacterium avium subsp. paratuberculosis
ccagcagggcggcgau

SEQ ID NO: 866260 - RNA, 16 nt, Mycobacterium avium subsp. paratuberculosis
ccagcaggcuggcguu

SEQ ID NO: 866261 - RNA, 16 nt, Mycobacterium avium subsp. paratuberculosis
ccagcagggacauccg

SEQ ID NO: 866262 - RNA, 22 nt, Mycobacterium avium subsp. paratuberculosis
ccagcgccgucaucaccgccga

SEQ ID NO: 866263 - RNA, 16 nt, Mycobacterium avium subsp. paratuberculosis
ccagcgccucggccuc

SEQ ID NO: 866264 - RNA, 23 nt, Mycobacterium avium subsp. paratuberculosis
ccagcgccucggccugcgcccgg

SEQ ID NO: 866265 - RNA, 19 nt, Mycobacterium avium subsp. paratuberculosis
ccagcgccucggcgucacc

SEQ ID NO: 866266 - RNA, 22 nt, Mycobacterium avium subsp. paratuberculosis
ccagcgccucggcgucaccgcg

SEQ ID NO: 866267 - RNA, 14 nt, Mycobacterium avium subsp. paratuberculosis
ccagcgcgacgcgc

SEQ ID NO: 866268 - RNA, 15 nt, Mycobacterium avium subsp. paratuberculosis
ccagcgcgacgcgca

SEQ ID NO: 866269 - RNA, 21 nt, Mycobacterium avium subsp. paratuberculosis
ccagcgcgacggccucgugga

SEQ ID NO: 866270 - RNA, 14 nt, Mycobacterium avium subsp. paratuberculosis
ccagcgcgacggug

SEQ ID NO: 866271 - RNA, 17 nt, Mycobacterium avium subsp. paratuberculosis
ccagcgcgacgguguag

SEQ ID NO: 866272 - RNA, 22 nt, Mycobacterium avium subsp. paratuberculosis
ccagcgcgacgucgaccgcgac

SEQ ID NO: 866273 - RNA, 18 nt, Mycobacterium avium subsp. paratuberculosis
ccagcgcgaacagcgcgg

SEQ ID NO: 866274 - RNA, 19 nt, Mycobacterium avium subsp. paratuberculosis
ccagcgcgaacagcgcggc

SEQ ID NO: 866275 - RNA, 21 nt, Mycobacterium avium subsp. paratuberculosis
ccagcgcgaacagcgcggcca

SEQ ID NO: 866276 - RNA, 20 nt, Mycobacterium avium subsp. paratuberculosis
ccagcgccuucggcgccagc

SEQ ID NO: 866277 - RNA, 14 nt, Mycobacterium avium subsp. paratuberculosis
ccagcgccuucucc

SEQ ID NO: 866278 - RNA, 21 nt, Mycobacterium avium subsp. paratuberculosis
ccagcgccucgagcaccacgg

SEQ ID NO: 866279 - RNA, 21 nt, Mycobacterium avium subsp. paratuberculosis
ccagcgcgcgggcgcgcgccg

SEQ ID NO: 866280 - RNA, 13 nt, Mycobacterium avium subsp. paratuberculosis
ccagcgcgcggug

SEQ ID NO: 866281 - RNA, 14 nt, Mycobacterium avium subsp. paratuberculosis
ccagcgcgcggugc

SEQ ID NO: 866282 - RNA, 13 nt, Mycobacterium avium subsp. paratuberculosis
ccagcgcgaucaa

SEQ ID NO: 866283 - RNA, 14 nt, Mycobacterium avium subsp. paratuberculosis
ccagcgcgcgcagc

SEQ ID NO: 866284 - RNA, 12 nt, Mycobacterium avium subsp. paratuberculosis
ccagcgcgcggc

SEQ ID NO: 866285 - RNA, 15 nt, Mycobacterium avium subsp. paratuberculosis
ccagcgcgcggccca

SEQ ID NO: 866286 - RNA, 16 nt, Mycobacterium avium subsp. paratuberculosis
ccagcgcgcggcccag

SEQ ID NO: 866287 - RNA, 17 nt, Mycobacterium avium subsp. paratuberculosis
ccagcgcggacaccagg

SEQ ID NO: 866288 - RNA, 17 nt, Mycobacterium avium subsp. paratuberculosis
ccagcgcggccaccacc

SEQ ID NO: 866289 - RNA, 14 nt, Mycobacterium avium subsp. paratuberculosis
ccagcgcgucggcc

SEQ ID NO: 866290 - RNA, 20 nt, Mycobacterium avium subsp. paratuberculosis
ccagcgcgucggccagcacc

SEQ ID NO: 866291 - RNA, 17 nt, Mycobacterium avium subsp. paratuberculosis
ccagcgcgucgcugccg

SEQ ID NO: 866292 - RNA, 13 nt, Mycobacterium avium subsp. paratuberculosis
ccagcgcgucggc

SEQ ID NO: 866293 - RNA, 16 nt, Mycobacterium avium subsp. paratuberculosis
ccagcgcgugaucggu

SEQ ID NO: 866294 - RNA, 21 nt, Mycobacterium avium subsp. paratuberculosis
ccagcgcgugaucggugcccg

SEQ ID NO: 866295 - RNA, 22 nt, Mycobacterium avium subsp. paratuberculosis
ccagcgcgugaucggugcccgc

SEQ ID NO: 866296 - RNA, 13 nt, Mycobacterium avium subsp. paratuberculosis
ccagcgcggccgg

SEQ ID NO: 866297 - RNA, 16 nt, Mycobacterium avium subsp. paratuberculosis
ccagcgcggccgggcg

SEQ ID NO: 866298 - RNA, 21 nt, Mycobacterium avium subsp. paratuberculosis
ccagcgcggccgggcgccccg

SEQ ID NO: 866299 - RNA, 18 nt, Mycobacterium avium subsp. paratuberculosis
ccagcgcggcgaacccga

SEQ ID NO: 866300 - RNA, 19 nt, Mycobacterium avium subsp. paratuberculosis
ccagcgcggcgaacccgag

SEQ ID NO: 866301 - RNA, 23 nt, Mycobacterium avium subsp. paratuberculosis
ccagcgcggcgaacccgagcacc

SEQ ID NO: 866302 - RNA, 13 nt, Mycobacterium avium subsp. paratuberculosis
ccagcgcggcgau

SEQ ID NO: 866303 - RNA, 14 nt, Mycobacterium avium subsp. paratuberculosis
ccagcgcggcgauc

SEQ ID NO: 866304 - RNA, 20 nt, Mycobacterium avium subsp. paratuberculosis
ccagcgcggcgaucagcagc

SEQ ID NO: 866305 - RNA, 12 nt, Mycobacterium avium subsp. paratuberculosis
ccagcgcgucgc

SEQ ID NO: 866306 - RNA, 21 nt, Mycobacterium avium subsp. paratuberculosis
ccagcgcgucgcacagcgccg

SEQ ID NO: 866307 - RNA, 20 nt, Mycobacterium avium subsp. paratuberculosis
ccagcgccgucaucaccgcc

SEQ ID NO: 866308 - RNA, 13 nt, Mycobacterium avium subsp. paratuberculosis
ccagcgccggcac

SEQ ID NO: 866309 - RNA, 14 nt, Mycobacterium avium subsp. paratuberculosis
ccagcgccggcacc

SEQ ID NO: 866310 - RNA, 16 nt, Mycobacterium avium subsp. paratuberculosis
ccagcgccggcaccag

SEQ ID NO: 866311 - RNA, 17 nt, Mycobacterium avium subsp. paratuberculosis
ccagcgccggcaccagc

SEQ ID NO: 866312 - RNA, 16 nt, Mycobacterium avium subsp. paratuberculosis
ccagcgccggcagcaa

SEQ ID NO: 866313 - RNA, 16 nt, Mycobacterium avium subsp. paratuberculosis
ccagcgccgcggcgaa

SEQ ID NO: 866314 - RNA, 18 nt, Mycobacterium avium subsp. paratuberculosis
ccagcgccgcgcgcgcgg

SEQ ID NO: 866315 - RNA, 21 nt, Mycobacterium avium subsp. paratuberculosis
ccagcgccgcgcgcgcggccu

SEQ ID NO: 866316 - RNA, 16 nt, Mycobacterium avium subsp. paratuberculosis
ccagcgccgcgaugau

SEQ ID NO: 866317 - RNA, 22 nt, Mycobacterium avium subsp. paratuberculosis
ccagcgccacuggcuggucacc

SEQ ID NO: 866318 - RNA, 24 nt, Mycobacterium avium subsp. paratuberculosis
ccagcgcaugccacuugcgcacgu

SEQ ID NO: 866319 - RNA, 14 nt, Mycobacterium avium subsp. paratuberculosis
ccagcgccgcccgg

SEQ ID NO: 866320 - RNA, 17 nt, Mycobacterium avium subsp. paratuberculosis
ccagcgccgcccgggcg

SEQ ID NO: 866321 - RNA, 19 nt, Mycobacterium avium subsp. paratuberculosis
ccagcgccgcccgggcggc

SEQ ID NO: 866322 - RNA, 12 nt, Mycobacterium avium subsp. paratuberculosis
ccagcgccagga

SEQ ID NO: 866323 - RNA, 20 nt, Mycobacterium avium subsp. paratuberculosis
ccagcgccaggacgaaaacc

SEQ ID NO: 866324 - RNA, 12 nt, Mycobacterium avium subsp. paratuberculosis
ccagcgccacgg

SEQ ID NO: 866325 - RNA, 15 nt, Mycobacterium avium subsp. paratuberculosis
ccagcgccagcgugg

SEQ ID NO: 866326 - RNA, 13 nt, Mycobacterium avium subsp. paratuberculosis
ccagcgccagcga

SEQ ID NO: 866327 - RNA, 14 nt, Mycobacterium avium subsp. paratuberculosis
ccagcgccagcgcc

SEQ ID NO: 866328 - RNA, 17 nt, Mycobacterium avium subsp. paratuberculosis
ccagcgccagcgccagc

SEQ ID NO: 866329 - RNA, 22 nt, Mycobacterium avium subsp. paratuberculosis
ccagccgaaguauccggucagc

SEQ ID NO: 866330 - RNA, 21 nt, Mycobacterium avium subsp. paratuberculosis
ccagccgaaguuggcgucggg

SEQ ID NO: 866331 - RNA, 21 nt, Mycobacterium avium subsp. paratuberculosis
ccagcccugcucggccagcgg

SEQ ID NO: 866332 - RNA, 14 nt, Mycobacterium avium subsp. paratuberculosis
ccagcccguggcca

SEQ ID NO: 866333 - RNA, 18 nt, Mycobacterium avium subsp. paratuberculosis
ccagcccguggccagcgc

SEQ ID NO: 866334 - RNA, 20 nt, Mycobacterium avium subsp. paratuberculosis
ccagcccguggccagcgcca

SEQ ID NO: 866335 - RNA, 21 nt, Mycobacterium avium subsp. paratuberculosis
ccagcccguggccagcgccag

SEQ ID NO: 866336 - RNA, 21 nt, Mycobacterium avium subsp. paratuberculosis
ccagcccguugucgagcaccg

SEQ ID NO: 866337 - RNA, 21 nt, Mycobacterium avium subsp. paratuberculosis
ccagcccguuguggcggccag

SEQ ID NO: 866338 - RNA, 22 nt, Mycobacterium avium subsp. paratuberculosis
ccagcccuacccguccagcgcg

SEQ ID NO: 866339 - RNA, 23 nt, Mycobacterium avium subsp. paratuberculosis
ccagcccuacccguccagcgcga

SEQ ID NO: 866340 - RNA, 14 nt, Mycobacterium avium subsp. paratuberculosis
ccagcccucgucga

SEQ ID NO: 866341 - RNA, 16 nt, Mycobacterium avium subsp. paratuberculosis
ccagcccucgucgaug

SEQ ID NO: 866342 - RNA, 22 nt, Mycobacterium avium subsp. paratuberculosis
ccagcccucgucgaugacgucc

SEQ ID NO: 866343 - RNA, 14 nt, Mycobacterium avium subsp. paratuberculosis
ccagcccggucacc

SEQ ID NO: 866344 - RNA, 20 nt, Mycobacterium avium subsp. paratuberculosis
ccagccagguguaggcggcc

SEQ ID NO: 866345 - RNA, 13 nt, Mycobacterium avium subsp. paratuberculosis
ccagcccgggggu

SEQ ID NO: 866346 - RNA, 14 nt, Mycobacterium avium subsp. paratuberculosis
ccagcccgggggug

SEQ ID NO: 866347 - RNA, 20 nt, Mycobacterium avium subsp. paratuberculosis
ccagcccggggguggcgguc

SEQ ID NO: 866348 - RNA, 14 nt, Mycobacterium avium subsp. paratuberculosis
ccagccaggccgcc

SEQ ID NO: 866349 - RNA, 17 nt, Mycobacterium avium subsp. paratuberculosis
ccagccaggccgccggg

SEQ ID NO: 866350 - RNA, 18 nt, Mycobacterium avium subsp. paratuberculosis
ccagccaggccgccgggc

SEQ ID NO: 866351 - RNA, 17 nt, Mycobacterium avium subsp. paratuberculosis
ccagccaggccgucggc

SEQ ID NO: 866352 - RNA, 13 nt, Mycobacterium avium subsp. paratuberculosis
ccagccagcgcgc

SEQ ID NO: 866353 - RNA, 20 nt, Mycobacterium avium subsp. paratuberculosis
ccagccagcgcgcgaucagc

SEQ ID NO: 866354 - RNA, 16 nt, Mycobacterium avium subsp. paratuberculosis
ccagccagcguuuggc

SEQ ID NO: 866355 - RNA, 14 nt, Mycobacterium avium subsp. paratuberculosis
ccagccgcugcgac

SEQ ID NO: 866356 - RNA, 20 nt, Mycobacterium avium subsp. paratuberculosis
ccagccggucgccgggccgg

SEQ ID NO: 866357 - RNA, 15 nt, Mycobacterium avium subsp. paratuberculosis
ccagccggucgucgg

SEQ ID NO: 866358 - RNA, 13 nt, Mycobacterium avium subsp. paratuberculosis
ccagccggugcac

SEQ ID NO: 866359 - RNA, 14 nt, Mycobacterium avium subsp. paratuberculosis
ccagccgcgccgcg

SEQ ID NO: 866360 - RNA, 15 nt, Mycobacterium avium subsp. paratuberculosis
ccagccgcgccgcgc

SEQ ID NO: 866361 - RNA, 18 nt, Mycobacterium avium subsp. paratuberculosis
ccagccgagccgggccag

SEQ ID NO: 866362 - RNA, 13 nt, Mycobacterium avium subsp. paratuberculosis
ccagccgcgcggc

SEQ ID NO: 866363 - RNA, 19 nt, Mycobacterium avium subsp. paratuberculosis
ccagccgcgcggccgccuc

SEQ ID NO: 866364 - RNA, 16 nt, Mycobacterium avium subsp. paratuberculosis
ccagccgcgcggcguc

SEQ ID NO: 866365 - RNA, 22 nt, Mycobacterium avium subsp. paratuberculosis
ccagccgcgcggcgucggccgg

SEQ ID NO: 866366 - RNA, 16 nt, Mycobacterium avium subsp. paratuberculosis
ccagccgcggacggcc

SEQ ID NO: 866367 - RNA, 18 nt, Mycobacterium avium subsp. paratuberculosis
ccagccgcucccggcgca

SEQ ID NO: 866368 - RNA, 19 nt, Mycobacterium avium subsp. paratuberculosis
ccagccgcucccggcgcag

SEQ ID NO: 866369 - RNA, 21 nt, Mycobacterium avium subsp. paratuberculosis
ccagccgcucccggcgcagca

SEQ ID NO: 866370 - RNA, 20 nt, Mycobacterium avium subsp. paratuberculosis
ccagccgcuccgcggcgggc

SEQ ID NO: 866371 - RNA, 23 nt, Mycobacterium avium subsp. paratuberculosis
ccagccgcuccgcggcgggcgug

SEQ ID NO: 866372 - RNA, 20 nt, Mycobacterium avium subsp. paratuberculosis
ccagccgcuccucguugauc

SEQ ID NO: 866373 - RNA, 23 nt, Mycobacterium avium subsp. paratuberculosis
ccagccguugggcagcucggcgg

SEQ ID NO: 866374 - RNA, 14 nt, Mycobacterium avium subsp. paratuberculosis
ccagccgcugacga

SEQ ID NO: 866375 - RNA, 13 nt, Mycobacterium avium subsp. paratuberculosis
ccagccuggcggc

SEQ ID NO: 866376 - RNA, 15 nt, Mycobacterium avium subsp. paratuberculosis
ccagccuggcggcga

SEQ ID NO: 866377 - RNA, 14 nt, Mycobacterium avium subsp. paratuberculosis
ccagccguucccgg

SEQ ID NO: 866378 - RNA, 17 nt, Mycobacterium avium subsp. paratuberculosis
ccagccguucccggcag

SEQ ID NO: 866379 - RNA, 18 nt, Mycobacterium avium subsp. paratuberculosis
ccagccgugcggcacgcc

SEQ ID NO: 866380 - RNA, 15 nt, Mycobacterium avium subsp. paratuberculosis
ccagccgugcggcgg

SEQ ID NO: 866381 - RNA, 17 nt, Mycobacterium avium subsp. paratuberculosis
ccagccgugcggcggcg

SEQ ID NO: 866382 - RNA, 22 nt, Mycobacterium avium subsp. paratuberculosis
ccagccgugcggcggcggcggu

SEQ ID NO: 866383 - RNA, 15 nt, Mycobacterium avium subsp. paratuberculosis
ccagccgugcugggc

SEQ ID NO: 866384 - RNA, 15 nt, Mycobacterium avium subsp. paratuberculosis
ccagccgucccgccg

SEQ ID NO: 866385 - RNA, 16 nt, Mycobacterium avium subsp. paratuberculosis
ccagccgucgccgcgc

SEQ ID NO: 866386 - RNA, 17 nt, Mycobacterium avium subsp. paratuberculosis
ccagccgucgccgcgcc

SEQ ID NO: 866387 - RNA, 22 nt, Mycobacterium avium subsp. paratuberculosis
ccagccgucgccgcgcccgccg

SEQ ID NO: 866388 - RNA, 19 nt, Mycobacterium avium subsp. paratuberculosis
ccagccgucguugcgggcg

SEQ ID NO: 866389 - RNA, 23 nt, Mycobacterium avium subsp. paratuberculosis
ccagccgucguugcgggcggcgc

SEQ ID NO: 866390 - RNA, 18 nt, Mycobacterium avium subsp. paratuberculosis
ccagccgugccccagguc

SEQ ID NO: 866391 - RNA, 18 nt, Mycobacterium avium subsp. paratuberculosis
ccagccggugcggucggc

SEQ ID NO: 866392 - RNA, 19 nt, Mycobacterium avium subsp. paratuberculosis
ccagccggugcugacccgg

SEQ ID NO: 866393 - RNA, 20 nt, Mycobacterium avium subsp. paratuberculosis
ccagccggugcugacccggu

SEQ ID NO: 866394 - RNA, 23 nt, Mycobacterium avium subsp. paratuberculosis
ccagccggugcugacccggucgc

SEQ ID NO: 866395 - RNA, 17 nt, Mycobacterium avium subsp. paratuberculosis
ccagccgguggcggcca

SEQ ID NO: 866396 - RNA, 18 nt, Mycobacterium avium subsp. paratuberculosis
ccagccgguggcggccac

SEQ ID NO: 866397 - RNA, 21 nt, Mycobacterium avium subsp. paratuberculosis
ccagccgguugcgguggccga

SEQ ID NO: 866398 - RNA, 22 nt, Mycobacterium avium subsp. paratuberculosis
ccagccgguugcgguggccgau

SEQ ID NO: 866399 - RNA, 16 nt, Mycobacterium avium subsp. paratuberculosis
ccagcgauucccgccg

SEQ ID NO: 866400 - RNA, 17 nt, Mycobacterium avium subsp. paratuberculosis
ccagcgauucccgccgg

SEQ ID NO: 866401 - RNA, 15 nt, Mycobacterium avium subsp. paratuberculosis
ccagcgauccggcgc

SEQ ID NO: 866402 - RNA, 16 nt, Mycobacterium avium subsp. paratuberculosis
ccagcgauccggcgcg

SEQ ID NO: 866403 - RNA, 13 nt, Mycobacterium avium subsp. paratuberculosis
ccagcgaggucuc

SEQ ID NO: 866404 - RNA, 16 nt, Mycobacterium avium subsp. paratuberculosis
ccagcgaguccagcca

SEQ ID NO: 866405 - RNA, 23 nt, Mycobacterium avium subsp. paratuberculosis
ccagcgaguccagccagccgcgc

SEQ ID NO: 866406 - RNA, 15 nt, Mycobacterium avium subsp. paratuberculosis
ccagcgagucgagaa

SEQ ID NO: 866407 - RNA, 22 nt, Mycobacterium avium subsp. paratuberculosis
ccagcgagucgagaaacgcgcg

SEQ ID NO: 866408 - RNA, 18 nt, Mycobacterium avium subsp. paratuberculosis
ccagcgaguuggccaucg

SEQ ID NO: 866409 - RNA, 19 nt, Mycobacterium avium subsp. paratuberculosis
ccagcgaggcggccagcgg

SEQ ID NO: 866410 - RNA, 16 nt, Mycobacterium avium subsp. paratuberculosis
ccagcgagcugccggc

SEQ ID NO: 866411 - RNA, 19 nt, Mycobacterium avium subsp. paratuberculosis
ccagcgagcugccggcggc

SEQ ID NO: 866412 - RNA, 21 nt, Mycobacterium avium subsp. paratuberculosis
ccagcgagcugccggcggccg

SEQ ID NO: 866413 - RNA, 22 nt, Mycobacterium avium subsp. paratuberculosis
ccagcgagcugccggcggccgc

SEQ ID NO: 866414 - RNA, 14 nt, Mycobacterium avium subsp. paratuberculosis
ccagccuucgccgc

SEQ ID NO: 866415 - RNA, 18 nt, Mycobacterium avium subsp. paratuberculosis
ccagccuucgccgcacgu

SEQ ID NO: 866416 - RNA, 13 nt, Mycobacterium avium subsp. paratuberculosis
ccagcgagcaggu

SEQ ID NO: 866417 - RNA, 15 nt, Mycobacterium avium subsp. paratuberculosis
ccagcgagcagguca

SEQ ID NO: 866418 - RNA, 16 nt, Mycobacterium avium subsp. paratuberculosis
ccagcgagcaggucac

SEQ ID NO: 866419 - RNA, 17 nt, Mycobacterium avium subsp. paratuberculosis
ccagccuugcagccgcu

SEQ ID NO: 866420 - RNA, 20 nt, Mycobacterium avium subsp. paratuberculosis
ccagccuugcagccgcugcc

SEQ ID NO: 866421 - RNA, 21 nt, Mycobacterium avium subsp. paratuberculosis
ccagcgagcccuucgcggugu

SEQ ID NO: 866422 - RNA, 13 nt, Mycobacterium avium subsp. paratuberculosis
ccagcgagccgau

SEQ ID NO: 866423 - RNA, 15 nt, Mycobacterium avium subsp. paratuberculosis
ccagcgagcccagcu

SEQ ID NO: 866424 - RNA, 14 nt, Mycobacterium avium subsp. paratuberculosis
ccagcgagccgaug

SEQ ID NO: 866425 - RNA, 22 nt, Mycobacterium avium subsp. paratuberculosis
ccacuugcccagauugcggccc

SEQ ID NO: 866426 - RNA, 19 nt, Mycobacterium avium subsp. paratuberculosis
ccagaaacgacaucacgaa

SEQ ID NO: 866427 - RNA, 17 nt, Mycobacterium avium subsp. paratuberculosis
ccacugcccguagucgg

SEQ ID NO: 866428 - RNA, 23 nt, Mycobacterium avium subsp. paratuberculosis
ccacugcccguagucggcggcga

SEQ ID NO: 866429 - RNA, 14 nt, Mycobacterium avium subsp. paratuberculosis
ccacugccgccgcc

SEQ ID NO: 866430 - RNA, 21 nt, Mycobacterium avium subsp. paratuberculosis
ccacugccgccgcccaggccg

SEQ ID NO: 866431 - RNA, 15 nt, Mycobacterium avium subsp. paratuberculosis
ccacuuccagcaccg

SEQ ID NO: 866432 - RNA, 21 nt, Mycobacterium avium subsp. paratuberculosis
ccacuucgacggcagcggcac

SEQ ID NO: 866433 - RNA, 15 nt, Mycobacterium avium subsp. paratuberculosis
ccacucgucgacguu

SEQ ID NO: 866434 - RNA, 17 nt, Mycobacterium avium subsp. paratuberculosis
ccacucgucgaucgacg

SEQ ID NO: 866435 - RNA, 20 nt, Mycobacterium avium subsp. paratuberculosis
ccacucgucgaucgacgccg

SEQ ID NO: 866436 - RNA, 21 nt, Mycobacterium avium subsp. paratuberculosis
ccacucgucgaucgacgccga

SEQ ID NO: 866437 - RNA, 17 nt, Mycobacterium avium subsp. paratuberculosis
ccacucgucgaugucga

SEQ ID NO: 866438 - RNA, 20 nt, Mycobacterium avium subsp. paratuberculosis
ccacuccaauacggcccggc

SEQ ID NO: 866439 - RNA, 22 nt, Mycobacterium avium subsp. paratuberculosis
ccacuccaauacggcccggcga

SEQ ID NO: 866440 - RNA, 14 nt, Mycobacterium avium subsp. paratuberculosis
ccacuccaccaccg

SEQ ID NO: 866441 - RNA, 13 nt, Mycobacterium avium subsp. paratuberculosis
ccacuccagcacc

SEQ ID NO: 866442 - RNA, 16 nt, Mycobacterium avium subsp. paratuberculosis
ccacucgggcggccgc

SEQ ID NO: 866443 - RNA, 16 nt, Mycobacterium avium subsp. paratuberculosis
ccacugauccgucauc

SEQ ID NO: 866444 - RNA, 22 nt, Mycobacterium avium subsp. paratuberculosis
ccacugauccgucaucucguca

SEQ ID NO: 866445 - RNA, 17 nt, Mycobacterium avium subsp. paratuberculosis
ccacugagcgcaggccg

SEQ ID NO: 866446 - RNA, 21 nt, Mycobacterium avium subsp. paratuberculosis
ccacugccaagacguccgcgu

SEQ ID NO: 866447 - RNA, 15 nt, Mycobacterium avium subsp. paratuberculosis
ccacguugccgggua

SEQ ID NO: 866448 - RNA, 15 nt, Mycobacterium avium subsp. paratuberculosis
ccacguugcgcccgg

SEQ ID NO: 866449 - RNA, 17 nt, Mycobacterium avium subsp. paratuberculosis
ccacguugaugccgccc

SEQ ID NO: 866450 - RNA, 18 nt, Mycobacterium avium subsp. paratuberculosis
ccacguugcgcggccgca

SEQ ID NO: 866451 - RNA, 17 nt, Mycobacterium avium subsp. paratuberculosis
ccacguugagcacgccc

SEQ ID NO: 866452 - RNA, 16 nt, Mycobacterium avium subsp. paratuberculosis
ccacgucgcccagcgu

SEQ ID NO: 866453 - RNA, 17 nt, Mycobacterium avium subsp. paratuberculosis
ccacgucgcccagcgug

SEQ ID NO: 866454 - RNA, 18 nt, Mycobacterium avium subsp. paratuberculosis
ccacgucgcccagcgugu

SEQ ID NO: 866455 - RNA, 23 nt, Mycobacterium avium subsp. paratuberculosis
ccacguaguccgacgauccgggc

SEQ ID NO: 866456 - RNA, 12 nt, Mycobacterium avium subsp. paratuberculosis
ccacgucaccga

SEQ ID NO: 866457 - RNA, 16 nt, Mycobacterium avium subsp. paratuberculosis
ccacgucaccgacgca

SEQ ID NO: 866458 - RNA, 14 nt, Mycobacterium avium subsp. paratuberculosis
ccacguccaccagc

SEQ ID NO: 866459 - RNA, 15 nt, Mycobacterium avium subsp. paratuberculosis
ccacguccaccagca

SEQ ID NO: 866460 - RNA, 18 nt, Mycobacterium avium subsp. paratuberculosis
ccacguccaccagcacca

SEQ ID NO: 866461 - RNA, 20 nt, Mycobacterium avium subsp. paratuberculosis
ccacguccaccagcaccagg

SEQ ID NO: 866462 - RNA, 14 nt, Mycobacterium avium subsp. paratuberculosis
ccacguccagcugg

SEQ ID NO: 866463 - RNA, 13 nt, Mycobacterium avium subsp. paratuberculosis
ccacguccccggg

SEQ ID NO: 866464 - RNA, 20 nt, Mycobacterium avium subsp. paratuberculosis
ccacguccccgggcgugccg

SEQ ID NO: 866465 - RNA, 13 nt, Mycobacterium avium subsp. paratuberculosis
ccacgucgaugcc

SEQ ID NO: 866466 - RNA, 18 nt, Mycobacterium avium subsp. paratuberculosis
ccacgucgaacccgaccc

SEQ ID NO: 866467 - RNA, 21 nt, Mycobacterium avium subsp. paratuberculosis
ccacgucgaacccgaccccgg

SEQ ID NO: 866468 - RNA, 23 nt, Mycobacterium avium subsp. paratuberculosis
ccacgucgaacccgaccccggcg

SEQ ID NO: 866469 - RNA, 17 nt, Mycobacterium avium subsp. paratuberculosis
ccacgucgaagcccggg

SEQ ID NO: 866470 - RNA, 15 nt, Mycobacterium avium subsp. paratuberculosis
ccacguccgcgguga

SEQ ID NO: 866471 - RNA, 17 nt, Mycobacterium avium subsp. paratuberculosis
ccacguccggaugcggc

SEQ ID NO: 866472 - RNA, 19 nt, Mycobacterium avium subsp. paratuberculosis
ccacguccggaugcggcgc

SEQ ID NO: 866473 - RNA, 20 nt, Mycobacterium avium subsp. paratuberculosis
ccacguccggaugcggcgcc

SEQ ID NO: 866474 - RNA, 14 nt, Mycobacterium avium subsp. paratuberculosis
ccacgggaugcggc

SEQ ID NO: 866475 - RNA, 17 nt, Mycobacterium avium subsp. paratuberculosis
ccacgggaugcggcacg

SEQ ID NO: 866476 - RNA, 18 nt, Mycobacterium avium subsp. paratuberculosis
ccacgggaugcggcacgc

SEQ ID NO: 866477 - RNA, 20 nt, Mycobacterium avium subsp. paratuberculosis
ccacgggaugcggcacgcgu

SEQ ID NO: 866478 - RNA, 21 nt, Mycobacterium avium subsp. paratuberculosis
ccacggugcgcaccgacauca

SEQ ID NO: 866479 - RNA, 14 nt, Mycobacterium avium subsp. paratuberculosis
ccacggugcgcucg

SEQ ID NO: 866480 - RNA, 13 nt, Mycobacterium avium subsp. paratuberculosis
ccacgguggccgc

SEQ ID NO: 866481 - RNA, 14 nt, Mycobacterium avium subsp. paratuberculosis
ccacgguggcgccg

SEQ ID NO: 866482 - RNA, 15 nt, Mycobacterium avium subsp. paratuberculosis
ccacgguggcgccga

SEQ ID NO: 866483 - RNA, 15 nt, Mycobacterium avium subsp. paratuberculosis
ccacgguggcgccgc

SEQ ID NO: 866484 - RNA, 20 nt, Mycobacterium avium subsp. paratuberculosis
ccacgguggcgccgcgcagc

SEQ ID NO: 866485 - RNA, 20 nt, Mycobacterium avium subsp. paratuberculosis
ccacgguggcgccggcaucg

SEQ ID NO: 866486 - RNA, 16 nt, Mycobacterium avium subsp. paratuberculosis
ccacgguggcggucag

SEQ ID NO: 866487 - RNA, 16 nt, Mycobacterium avium subsp. paratuberculosis
ccacgguggcguccag

SEQ ID NO: 866488 - RNA, 17 nt, Mycobacterium avium subsp. paratuberculosis
ccacgguggcguccagc

SEQ ID NO: 866489 - RNA, 17 nt, Mycobacterium avium subsp. paratuberculosis
ccacgguguagcggcgg

SEQ ID NO: 866490 - RNA, 19 nt, Mycobacterium avium subsp. paratuberculosis
ccacgguguagcggcggcu

SEQ ID NO: 866491 - RNA, 17 nt, Mycobacterium avium subsp. paratuberculosis
ccacgguuucgccguac

SEQ ID NO: 866492 - RNA, 18 nt, Mycobacterium avium subsp. paratuberculosis
ccacguacaccgggaucg

SEQ ID NO: 866493 - RNA, 18 nt, Mycobacterium avium subsp. paratuberculosis
ccacguacuccugcgcga

SEQ ID NO: 866494 - RNA, 18 nt, Mycobacterium avium subsp. paratuberculosis
ccacguagcagcagaccg

SEQ ID NO: 866495 - RNA, 21 nt, Mycobacterium avium subsp. paratuberculosis
ccacguagcagcagaccgcga

SEQ ID NO: 866496 - RNA, 20 nt, Mycobacterium avium subsp. paratuberculosis
ccacguaggcgaucagcgcg

SEQ ID NO: 866497 - RNA, 19 nt, Mycobacterium avium subsp. paratuberculosis
ccacguaggcgaugucgac

SEQ ID NO: 866498 - RNA, 21 nt, Mycobacterium avium subsp. paratuberculosis
ccacguaggcgaugucgacgu

SEQ ID NO: 866499 - RNA, 23 nt, Mycobacterium avium subsp. paratuberculosis
ccacguaggcgaugucgacgugg

SEQ ID NO: 866500 - RNA, 17 nt, Mycobacterium avium subsp. paratuberculosis
ccacguaggggcccggg

SEQ ID NO: 866501 - RNA, 22 nt, Mycobacterium avium subsp. paratuberculosis
ccagcaaccggaauggcagcag

SEQ ID NO: 866502 - RNA, 18 nt, Mycobacterium avium subsp. paratuberculosis
ccagcaacgacccggcca

SEQ ID NO: 866503 - RNA, 22 nt, Mycobacterium avium subsp. paratuberculosis
ccagcaacgacccggccaccgc

SEQ ID NO: 866504 - RNA, 23 nt, Mycobacterium avium subsp. paratuberculosis
ccagcaacgacccggccaccgcc

SEQ ID NO: 866505 - RNA, 11 nt, Mycobacterium avium subsp. paratuberculosis
ccagcaacgcc

SEQ ID NO: 866506 - RNA, 14 nt, Mycobacterium avium subsp. paratuberculosis
ccagcaacgccgac

SEQ ID NO: 866507 - RNA, 17 nt, Mycobacterium avium subsp. paratuberculosis
ccagcaacgccgacauc

SEQ ID NO: 866508 - RNA, 17 nt, Mycobacterium avium subsp. paratuberculosis
ccagauaggccagcgcg

SEQ ID NO: 866509 - RNA, 19 nt, Mycobacterium avium subsp. paratuberculosis
ccagauacgccgcgacgau

SEQ ID NO: 866510 - RNA, 20 nt, Mycobacterium avium subsp. paratuberculosis
ccagcaacugcucgaccagc

SEQ ID NO: 866511 - RNA, 20 nt, Mycobacterium avium subsp. paratuberculosis
ccagcaccaacagcggcccg

SEQ ID NO: 866512 - RNA, 14 nt, Mycobacterium avium subsp. paratuberculosis
ccagcaccaccaac

SEQ ID NO: 866513 - RNA, 14 nt, Mycobacterium avium subsp. paratuberculosis
ccagcaccaccacg

SEQ ID NO: 866514 - RNA, 15 nt, Mycobacterium avium subsp. paratuberculosis
ccagcacagccgucg

SEQ ID NO: 866515 - RNA, 18 nt, Mycobacterium avium subsp. paratuberculosis
ccagcacagcgaggcgac

SEQ ID NO: 866516 - RNA, 21 nt, Mycobacterium avium subsp. paratuberculosis
ccagcacauagcgcagcucua

SEQ ID NO: 866517 - RNA, 22 nt, Mycobacterium avium subsp. paratuberculosis
ccagcacacccucgacccguuc

SEQ ID NO: 866518 - RNA, 17 nt, Mycobacterium avium subsp. paratuberculosis
ccagcacaccggaucgg

SEQ ID NO: 866519 - RNA, 21 nt, Mycobacterium avium subsp. paratuberculosis
ccagaauucgccggggcacca

SEQ ID NO: 866520 - RNA, 16 nt, Mycobacterium avium subsp. paratuberculosis
ccagacaggccggccg

SEQ ID NO: 866521 - RNA, 17 nt, Mycobacterium avium subsp. paratuberculosis
ccagacaggccggccgc

SEQ ID NO: 866522 - RNA, 20 nt, Mycobacterium avium subsp. paratuberculosis
ccagaccacaagggccaccg

SEQ ID NO: 866523 - RNA, 23 nt, Mycobacterium avium subsp. paratuberculosis
ccagaccacaagggccaccgggc

SEQ ID NO: 866524 - RNA, 14 nt, Mycobacterium avium subsp. paratuberculosis
ccagacugcgcacc

SEQ ID NO: 866525 - RNA, 18 nt, Mycobacterium avium subsp. paratuberculosis
ccagacugcgcaccgcca

SEQ ID NO: 866526 - RNA, 19 nt, Mycobacterium avium subsp. paratuberculosis
ccagaccguucuccgaggc

SEQ ID NO: 866527 - RNA, 22 nt, Mycobacterium avium subsp. paratuberculosis
ccagaccgcacaauccggucag

SEQ ID NO: 866528 - RNA, 15 nt, Mycobacterium avium subsp. paratuberculosis
ccagaccggccgggg

SEQ ID NO: 866529 - RNA, 22 nt, Mycobacterium avium subsp. paratuberculosis
ccagaccggccggggcgggcac

SEQ ID NO: 866530 - RNA, 23 nt, Mycobacterium avium subsp. paratuberculosis
ccagaccggccggggcgggcacg

SEQ ID NO: 866531 - RNA, 12 nt, Mycobacterium avium subsp. paratuberculosis
ccagaccggcga

SEQ ID NO: 866532 - RNA, 20 nt, Mycobacterium avium subsp. paratuberculosis
aaagugcuacugccgacgca

SEQ ID NO: 866533 - RNA, 17 nt, Mycobacterium avium subsp. paratuberculosis
ccacgacguccucgacg

SEQ ID NO: 866534 - RNA, 22 nt, Mycobacterium avium subsp. paratuberculosis
ccacgacguacccccgcacgcc

SEQ ID NO: 866535 - RNA, 20 nt, Mycobacterium avium subsp. paratuberculosis
ccacgacgucugggccgccg

SEQ ID NO: 866536 - RNA, 22 nt, Mycobacterium avium subsp. paratuberculosis
ccacgacgucugggccgccgag

SEQ ID NO: 866537 - RNA, 19 nt, Mycobacterium avium subsp. paratuberculosis
ccacgaccuccgugccgau

SEQ ID NO: 866538 - RNA, 15 nt, Mycobacterium avium subsp. paratuberculosis
ccacgaccucggggu

SEQ ID NO: 866539 - RNA, 18 nt, Mycobacterium avium subsp. paratuberculosis
ccacgaccuggcgggcca

SEQ ID NO: 866540 - RNA, 15 nt, Mycobacterium avium subsp. paratuberculosis
ccacgacgacguggu

SEQ ID NO: 866541 - RNA, 14 nt, Mycobacterium avium subsp. paratuberculosis
ccacgacgccgggc

SEQ ID NO: 866542 - RNA, 13 nt, Mycobacterium avium subsp. paratuberculosis
ccacgacgcgcca

SEQ ID NO: 866543 - RNA, 16 nt, Mycobacterium avium subsp. paratuberculosis
ccacgacgcgccacgc

SEQ ID NO: 866544 - RNA, 21 nt, Mycobacterium avium subsp. paratuberculosis
ccacgacgcgccacgccccgg

SEQ ID NO: 866545 - RNA, 13 nt, Mycobacterium avium subsp. paratuberculosis
ccacgacgcggcg

SEQ ID NO: 866546 - RNA, 19 nt, Mycobacterium avium subsp. paratuberculosis
ccacgacgcggcgcgcgau

SEQ ID NO: 866547 - RNA, 12 nt, Mycobacterium avium subsp. paratuberculosis
ccacgacggcgc

SEQ ID NO: 866548 - RNA, 15 nt, Mycobacterium avium subsp. paratuberculosis
ccacgacggcgcugg

SEQ ID NO: 866549 - RNA, 21 nt, Mycobacterium avium subsp. paratuberculosis
ccacgacggcgcuggccgcgg

SEQ ID NO: 866550 - RNA, 22 nt, Mycobacterium avium subsp. paratuberculosis
ccacgacggcgcuggccgcggc

SEQ ID NO: 866551 - RNA, 23 nt, Mycobacterium avium subsp. paratuberculosis
ccacgacggggaacucggugaug

SEQ ID NO: 866552 - RNA, 16 nt, Mycobacterium avium subsp. paratuberculosis
ccacgaccagcggcag

SEQ ID NO: 866553 - RNA, 20 nt, Mycobacterium avium subsp. paratuberculosis
ccacgaccagcggcagcacg

SEQ ID NO: 866554 - RNA, 19 nt, Mycobacterium avium subsp. paratuberculosis
ccacgaccagugcccggcc

SEQ ID NO: 866555 - RNA, 15 nt, Mycobacterium avium subsp. paratuberculosis
ccacgaccccggcgg

SEQ ID NO: 866556 - RNA, 18 nt, Mycobacterium avium subsp. paratuberculosis
ccacgaccccggcggcac

SEQ ID NO: 866557 - RNA, 15 nt, Mycobacterium avium subsp. paratuberculosis
ccaccuugcgcagca

SEQ ID NO: 866558 - RNA, 22 nt, Mycobacterium avium subsp. paratuberculosis
ccaccuugcgcgggucgccggg

SEQ ID NO: 866559 - RNA, 23 nt, Mycobacterium avium subsp. paratuberculosis
ccaccuugcgcgggucgccgggc

SEQ ID NO: 866560 - RNA, 17 nt, Mycobacterium avium subsp. paratuberculosis
ccaccuuggccggugcg

SEQ ID NO: 866561 - RNA, 20 nt, Mycobacterium avium subsp. paratuberculosis
ccaccuuggccggugcgccg

SEQ ID NO: 866562 - RNA, 20 nt, Mycobacterium avium subsp. paratuberculosis
ccaccuccuccgguccgggc

SEQ ID NO: 866563 - RNA, 17 nt, Mycobacterium avium subsp. paratuberculosis
ccaccuccccgcggugc

SEQ ID NO: 866564 - RNA, 19 nt, Mycobacterium avium subsp. paratuberculosis
ccaccuccccgcggugccg

SEQ ID NO: 866565 - RNA, 21 nt, Mycobacterium avium subsp. paratuberculosis
ccaccguguugaucucgucga

SEQ ID NO: 866566 - RNA, 15 nt, Mycobacterium avium subsp. paratuberculosis
ccaccguucgggugc

SEQ ID NO: 866567 - RNA, 16 nt, Mycobacterium avium subsp. paratuberculosis
ccaccguucgggugcg

SEQ ID NO: 866568 - RNA, 19 nt, Mycobacterium avium subsp. paratuberculosis
ccaccguugucucggcgcc

SEQ ID NO: 866569 - RNA, 22 nt, Mycobacterium avium subsp. paratuberculosis
ccaccuggaggccaacgagcgc

SEQ ID NO: 866570 - RNA, 14 nt, Mycobacterium avium subsp. paratuberculosis
ccaccucgacggcg

SEQ ID NO: 866571 - RNA, 14 nt, Mycobacterium avium subsp. paratuberculosis
ccaccucgagcacg

SEQ ID NO: 866572 - RNA, 19 nt, Mycobacterium avium subsp. paratuberculosis
ccaccucgagcucaccgac

SEQ ID NO: 866573 - RNA, 19 nt, Mycobacterium avium subsp. paratuberculosis
ccaccucgaucagcggcau

SEQ ID NO: 866574 - RNA, 13 nt, Mycobacterium avium subsp. paratuberculosis
ccaccucgacggc

SEQ ID NO: 866575 - RNA, 18 nt, Mycobacterium avium subsp. paratuberculosis
ccaccugguccugccccg

SEQ ID NO: 866576 - RNA, 14 nt, Mycobacterium avium subsp. paratuberculosis
ccaccuucaccgcg

SEQ ID NO: 866577 - RNA, 17 nt, Mycobacterium avium subsp. paratuberculosis
ccaccuucaccgcgccg

SEQ ID NO: 866578 - RNA, 21 nt, Mycobacterium avium subsp. paratuberculosis
ccaccuucaucgccgucgcca

SEQ ID NO: 866579 - RNA, 12 nt, Mycobacterium avium subsp. paratuberculosis
ccaccuggccgg

SEQ ID NO: 866580 - RNA, 14 nt, Mycobacterium avium subsp. paratuberculosis
ccaccuggccggcc

SEQ ID NO: 866581 - RNA, 15 nt, Mycobacterium avium subsp. paratuberculosis
ccaccugggcgucgu

SEQ ID NO: 866582 - RNA, 22 nt, Mycobacterium avium subsp. paratuberculosis
ccaccugggcgucgucggccgg

SEQ ID NO: 866583 - RNA, 21 nt, Mycobacterium avium subsp. paratuberculosis
ccaccugguucucccgucgcg

SEQ ID NO: 866584 - RNA, 20 nt, Mycobacterium avium subsp. paratuberculosis
ccaccugguuggcccgcacc

SEQ ID NO: 866585 - RNA, 14 nt, Mycobacterium avium subsp. paratuberculosis
ccaccgacaggucg

SEQ ID NO: 866586 - RNA, 15 nt, Mycobacterium avium subsp. paratuberculosis
ccaccgacaggucga

SEQ ID NO: 866587 - RNA, 13 nt, Mycobacterium avium subsp. paratuberculosis
ccaccgacaccac

SEQ ID NO: 866588 - RNA, 19 nt, Mycobacterium avium subsp. paratuberculosis
ccaccgacaccaccggccg

SEQ ID NO: 866589 - RNA, 21 nt, Mycobacterium avium subsp. paratuberculosis
ccaccgacaccaccggccgcc

SEQ ID NO: 866590 - RNA, 16 nt, Mycobacterium avium subsp. paratuberculosis
ccaccgacaccccgau

SEQ ID NO: 866591 - RNA, 15 nt, Mycobacterium avium subsp. paratuberculosis
ccaccgacagcaccc

SEQ ID NO: 866592 - RNA, 12 nt, Mycobacterium avium subsp. paratuberculosis
ccaccgacagcc

SEQ ID NO: 866593 - RNA, 15 nt, Mycobacterium avium subsp. paratuberculosis
ccacccugccgaccu

SEQ ID NO: 866594 - RNA, 20 nt, Mycobacterium avium subsp. paratuberculosis
ccaccgaagccgacgucgac

SEQ ID NO: 866595 - RNA, 14 nt, Mycobacterium avium subsp. paratuberculosis
ccacccgcagcgcg

SEQ ID NO: 866596 - RNA, 17 nt, Mycobacterium avium subsp. paratuberculosis
ccacccgcagcgcggcg

SEQ ID NO: 866597 - RNA, 21 nt, Mycobacterium avium subsp. paratuberculosis
ccacccucgccgccgccgauc

SEQ ID NO: 866598 - RNA, 19 nt, Mycobacterium avium subsp. paratuberculosis
ccacccgcaccucgcccgg

SEQ ID NO: 866599 - RNA, 17 nt, Mycobacterium avium subsp. paratuberculosis
ccacccgcacgcccggg

SEQ ID NO: 866600 - RNA, 13 nt, Mycobacterium avium subsp. paratuberculosis
ccacccgaggccg

SEQ ID NO: 866601 - RNA, 20 nt, Mycobacterium avium subsp. paratuberculosis
ccacccgaugaccggcccgg

SEQ ID NO: 866602 - RNA, 22 nt, Mycobacterium avium subsp. paratuberculosis
ccacccgcaacgcugaccgcag

SEQ ID NO: 866603 - RNA, 15 nt, Mycobacterium avium subsp. paratuberculosis
ccaccccggacggcc

SEQ ID NO: 866604 - RNA, 13 nt, Mycobacterium avium subsp. paratuberculosis
ccaccccggcggu

SEQ ID NO: 866605 - RNA, 14 nt, Mycobacterium avium subsp. paratuberculosis
ccaccccggcgguc

SEQ ID NO: 866606 - RNA, 20 nt, Mycobacterium avium subsp. paratuberculosis
ccaccccggcguccacgccg

SEQ ID NO: 866607 - RNA, 15 nt, Mycobacterium avium subsp. paratuberculosis
ccaccgguggccggg

SEQ ID NO: 866608 - RNA, 13 nt, Mycobacterium avium subsp. paratuberculosis
ccaccggucggaa

SEQ ID NO: 866609 - RNA, 15 nt, Mycobacterium avium subsp. paratuberculosis
ccaccguggccccac

SEQ ID NO: 866610 - RNA, 22 nt, Mycobacterium avium subsp. paratuberculosis
ccaccguggccccacgggccau

SEQ ID NO: 866611 - RNA, 21 nt, Mycobacterium avium subsp. paratuberculosis
ccaccgugcuggccaccacgg

SEQ ID NO: 866612 - RNA, 15 nt, Mycobacterium avium subsp. paratuberculosis
ccaccguggcgaugg

SEQ ID NO: 866613 - RNA, 15 nt, Mycobacterium avium subsp. paratuberculosis
ccaccguggucggca

SEQ ID NO: 866614 - RNA, 22 nt, Mycobacterium avium subsp. paratuberculosis
ccaccguggucggcagcaccgg

SEQ ID NO: 866615 - RNA, 14 nt, Mycobacterium avium subsp. paratuberculosis
ccaccgggccgcca

SEQ ID NO: 866616 - RNA, 15 nt, Mycobacterium avium subsp. paratuberculosis
ccaccgggccgccau

SEQ ID NO: 866617 - RNA, 14 nt, Mycobacterium avium subsp. paratuberculosis
ccaccgggcagccg

SEQ ID NO: 866618 - RNA, 17 nt, Mycobacterium avium subsp. paratuberculosis
ccaccgggcagccgcac

SEQ ID NO: 866619 - RNA, 20 nt, Mycobacterium avium subsp. paratuberculosis
ccaccgggcaguagaacggc

SEQ ID NO: 866620 - RNA, 15 nt, Mycobacterium avium subsp. paratuberculosis
ccaccgggcgucggc

SEQ ID NO: 866621 - RNA, 17 nt, Mycobacterium avium subsp. paratuberculosis
ccaccgggcgucggcgg

SEQ ID NO: 866622 - RNA, 21 nt, Mycobacterium avium subsp. paratuberculosis
ccaccggggucaccuuggccg

SEQ ID NO: 866623 - RNA, 15 nt, Mycobacterium avium subsp. paratuberculosis
ccaccgggucgucgc

SEQ ID NO: 866624 - RNA, 18 nt, Mycobacterium avium subsp. paratuberculosis
ccaccgggucgucgcgga

SEQ ID NO: 866625 - RNA, 19 nt, Mycobacterium avium subsp. paratuberculosis
ccaccggcuccuugcgccg

SEQ ID NO: 866626 - RNA, 20 nt, Mycobacterium avium subsp. paratuberculosis
ccaccgacgccacgucguuc

SEQ ID NO: 866627 - RNA, 13 nt, Mycobacterium avium subsp. paratuberculosis
ccaccgacgcggc

SEQ ID NO: 866628 - RNA, 17 nt, Mycobacterium avium subsp. paratuberculosis
ccaccgacgcggcggcc

SEQ ID NO: 866629 - RNA, 23 nt, Mycobacterium avium subsp. paratuberculosis
ccaccgacgcggcggccgacagc

SEQ ID NO: 866630 - RNA, 15 nt, Mycobacterium avium subsp. paratuberculosis
ccaccgacgcgucgc

SEQ ID NO: 866631 - RNA, 14 nt, Mycobacterium avium subsp. paratuberculosis
ccacggccagcacc

SEQ ID NO: 866632 - RNA, 23 nt, Mycobacterium avium subsp. paratuberculosis
ccacggccagcaccgccagcgcc

SEQ ID NO: 866633 - RNA, 20 nt, Mycobacterium avium subsp. paratuberculosis
ccacggccaccacggcaccg

SEQ ID NO: 866634 - RNA, 18 nt, Mycobacterium avium subsp. paratuberculosis
ccacggcggugucggcgg

SEQ ID NO: 866635 - RNA, 19 nt, Mycobacterium avium subsp. paratuberculosis
ccacggcggugucggcggc

SEQ ID NO: 866636 - RNA, 12 nt, Mycobacterium avium subsp. paratuberculosis
ccacggcggugu

SEQ ID NO: 866637 - RNA, 22 nt, Mycobacterium avium subsp. paratuberculosis
ccacggcggggucaagcggcag

SEQ ID NO: 866638 - RNA, 12 nt, Mycobacterium avium subsp. paratuberculosis
ccacggcggccg

SEQ ID NO: 866639 - RNA, 16 nt, Mycobacterium avium subsp. paratuberculosis
ccacggcggccgaauc

SEQ ID NO: 866640 - RNA, 22 nt, Mycobacterium avium subsp. paratuberculosis
ccacggcggccgaauccggccg

SEQ ID NO: 866641 - RNA, 15 nt, Mycobacterium avium subsp. paratuberculosis
ccacgcuagcgugac

SEQ ID NO: 866642 - RNA, 17 nt, Mycobacterium avium subsp. paratuberculosis
ccacgcuagcgugacgc

SEQ ID NO: 866643 - RNA, 13 nt, Mycobacterium avium subsp. paratuberculosis
ccacgcggugauc

SEQ ID NO: 866644 - RNA, 15 nt, Mycobacterium avium subsp. paratuberculosis
ccacgcguagccgac

SEQ ID NO: 866645 - RNA, 16 nt, Mycobacterium avium subsp. paratuberculosis
ccacgcguagccgacc

SEQ ID NO: 866646 - RNA, 13 nt, Mycobacterium avium subsp. paratuberculosis
ccacgcgcaacca

SEQ ID NO: 866647 - RNA, 24 nt, Mycobacterium avium subsp. paratuberculosis
ccacgaggcugugggccagcagcg

SEQ ID NO: 866648 - RNA, 18 nt, Mycobacterium avium subsp. paratuberculosis
ccacgaguaaccggugcg

SEQ ID NO: 866649 - RNA, 14 nt, Mycobacterium avium subsp. paratuberculosis
ccacgagcccagcc

SEQ ID NO: 866650 - RNA, 15 nt, Mycobacterium avium subsp. paratuberculosis
ccacgagcccagccg

SEQ ID NO: 866651 - RNA, 19 nt, Mycobacterium avium subsp. paratuberculosis
ccacgagcccagccgucgc

SEQ ID NO: 866652 - RNA, 14 nt, Mycobacterium avium subsp. paratuberculosis
ccacgaucagcgcg

SEQ ID NO: 866653 - RNA, 16 nt, Mycobacterium avium subsp. paratuberculosis
ccacgaucagcgcguc

SEQ ID NO: 866654 - RNA, 20 nt, Mycobacterium avium subsp. paratuberculosis
ccacgauccaaccgagucgc

SEQ ID NO: 866655 - RNA, 19 nt, Mycobacterium avium subsp. paratuberculosis
ccacgauccgcgcggccac

SEQ ID NO: 866656 - RNA, 15 nt, Mycobacterium avium subsp. paratuberculosis
ccacgcccggacccg

SEQ ID NO: 866657 - RNA, 14 nt, Mycobacterium avium subsp. paratuberculosis
ccacgccgacgaac

SEQ ID NO: 866658 - RNA, 18 nt, Mycobacterium avium subsp. paratuberculosis
ccacgccgagggcggcgg

SEQ ID NO: 866659 - RNA, 17 nt, Mycobacterium avium subsp. paratuberculosis
ccacgccgagggugccg

SEQ ID NO: 866660 - RNA, 19 nt, Mycobacterium avium subsp. paratuberculosis
ccacgccgagggugccggc

SEQ ID NO: 866661 - RNA, 20 nt, Mycobacterium avium subsp. paratuberculosis
ccacgccgagggugccggcc

SEQ ID NO: 866662 - RNA, 18 nt, Mycobacterium avium subsp. paratuberculosis
ccacgcccuggccgccgg

SEQ ID NO: 866663 - RNA, 21 nt, Mycobacterium avium subsp. paratuberculosis
ccacgcccuggccgccggccg

SEQ ID NO: 866664 - RNA, 22 nt, Mycobacterium avium subsp. paratuberculosis
ccacgcccuagcgggccaggau

SEQ ID NO: 866665 - RNA, 19 nt, Mycobacterium avium subsp. paratuberculosis
ccacgaucaauucgaagcc

SEQ ID NO: 866666 - RNA, 18 nt, Mycobacterium avium subsp. paratuberculosis
ccacgaucaccaccaccg

SEQ ID NO: 866667 - RNA, 20 nt, Mycobacterium avium subsp. paratuberculosis
ccacgaucaccaccaccgcc

SEQ ID NO: 866668 - RNA, 14 nt, Mycobacterium avium subsp. paratuberculosis
ccacgaucgcgauc

SEQ ID NO: 866669 - RNA, 18 nt, Mycobacterium avium subsp. paratuberculosis
ccacgaucgcgaucgccg

SEQ ID NO: 866670 - RNA, 12 nt, Mycobacterium avium subsp. paratuberculosis
ccacgaucgcgg

SEQ ID NO: 866671 - RNA, 15 nt, Mycobacterium avium subsp. paratuberculosis
ccacgaucgcggcca

SEQ ID NO: 866672 - RNA, 19 nt, Mycobacterium avium subsp. paratuberculosis
ccacgaucgcggccagcgu

SEQ ID NO: 866673 - RNA, 15 nt, Mycobacterium avium subsp. paratuberculosis
ccacgaucgcgucgg

SEQ ID NO: 866674 - RNA, 16 nt, Mycobacterium avium subsp. paratuberculosis
ccacgcgaucaggucc

SEQ ID NO: 866675 - RNA, 13 nt, Mycobacterium avium subsp. paratuberculosis
ccacgccgcgauc

SEQ ID NO: 866676 - RNA, 12 nt, Mycobacterium avium subsp. paratuberculosis
ccacgccgucga

SEQ ID NO: 866677 - RNA, 15 nt, Mycobacterium avium subsp. paratuberculosis
ccacgccgucgacga

SEQ ID NO: 866678 - RNA, 13 nt, Mycobacterium avium subsp. paratuberculosis
ccacgccgucguc

SEQ ID NO: 866679 - RNA, 13 nt, Mycobacterium avium subsp. paratuberculosis
ccacgccgugcag

SEQ ID NO: 866680 - RNA, 17 nt, Mycobacterium avium subsp. paratuberculosis
ccacgccgugcagaaca

SEQ ID NO: 866681 - RNA, 22 nt, Mycobacterium avium subsp. paratuberculosis
ccacgccgugcagaacagcacg

SEQ ID NO: 866682 - RNA, 15 nt, Mycobacterium avium subsp. paratuberculosis
ccacgccgugcccgg

SEQ ID NO: 866683 - RNA, 18 nt, Mycobacterium avium subsp. paratuberculosis
ccacgccguacaccgugc

SEQ ID NO: 866684 - RNA, 15 nt, Mycobacterium avium subsp. paratuberculosis
ccacgccggcgaucu

SEQ ID NO: 866685 - RNA, 12 nt, Mycobacterium avium subsp. paratuberculosis
ccacgccggcac

SEQ ID NO: 866686 - RNA, 19 nt, Mycobacterium avium subsp. paratuberculosis
ccacgccgcccccgccgcg

SEQ ID NO: 866687 - RNA, 17 nt, Mycobacterium avium subsp. paratuberculosis
ccacgccgcggucgcug

SEQ ID NO: 866688 - RNA, 18 nt, Mycobacterium avium subsp. paratuberculosis
ccaaggagaaggccgcgc

SEQ ID NO: 866689 - RNA, 18 nt, Mycobacterium avium subsp. paratuberculosis
ccaaggcaaucaggcggu

SEQ ID NO: 866690 - RNA, 13 nt, Mycobacterium avium subsp. paratuberculosis
ccaagugcggugu

SEQ ID NO: 866691 - RNA, 15 nt, Mycobacterium avium subsp. paratuberculosis
ccaagugcggugugg

SEQ ID NO: 866692 - RNA, 16 nt, Mycobacterium avium subsp. paratuberculosis
ccaaugcgccggcggc

SEQ ID NO: 866693 - RNA, 15 nt, Mycobacterium avium subsp. paratuberculosis
ccaauggcggccacg

SEQ ID NO: 866694 - RNA, 17 nt, Mycobacterium avium subsp. paratuberculosis
ccaauucuucggcgugu

SEQ ID NO: 866695 - RNA, 22 nt, Mycobacterium avium subsp. paratuberculosis
ccaauucgcgcugccagggccg

SEQ ID NO: 866696 - RNA, 21 nt, Mycobacterium avium subsp. paratuberculosis
ccacaauggauccgaucagca

SEQ ID NO: 866697 - RNA, 16 nt, Mycobacterium avium subsp. paratuberculosis
ccacaguccgcccagc

SEQ ID NO: 866698 - RNA, 23 nt, Mycobacterium avium subsp. paratuberculosis
ccacauacaccgggaucggcggc

SEQ ID NO: 866699 - RNA, 16 nt, Mycobacterium avium subsp. paratuberculosis
ccacauacgcggcggc

SEQ ID NO: 866700 - RNA, 19 nt, Mycobacterium avium subsp. paratuberculosis
ccacauacgcggcggccug

SEQ ID NO: 866701 - RNA, 17 nt, Mycobacterium avium subsp. paratuberculosis
ccacaggucgaaacccg

SEQ ID NO: 866702 - RNA, 22 nt, Mycobacterium avium subsp. paratuberculosis
ccacagcuugccggagcccagc

SEQ ID NO: 866703 - RNA, 20 nt, Mycobacterium avium subsp. paratuberculosis
ccacagcgccucgucgagcc

SEQ ID NO: 866704 - RNA, 17 nt, Mycobacterium avium subsp. paratuberculosis
ccacagcugacgggccg

SEQ ID NO: 866705 - RNA, 22 nt, Mycobacterium avium subsp. paratuberculosis
ccacagcugacgggccggcggg

SEQ ID NO: 866706 - RNA, 13 nt, Mycobacterium avium subsp. paratuberculosis
ccacagcggaucg

SEQ ID NO: 866707 - RNA, 20 nt, Mycobacterium avium subsp. paratuberculosis
ccacagcggcgacagcggcc

SEQ ID NO: 866708 - RNA, 21 nt, Mycobacterium avium subsp. paratuberculosis
ccacagcggcgcaugaccgau

SEQ ID NO: 866709 - RNA, 19 nt, Mycobacterium avium subsp. paratuberculosis
ccacagcugccggccguug

SEQ ID NO: 866710 - RNA, 18 nt, Mycobacterium avium subsp. paratuberculosis
ccacagcugcuggcugcg

SEQ ID NO: 866711 - RNA, 21 nt, Mycobacterium avium subsp. paratuberculosis
ccacagcugcuggcugcggcc

SEQ ID NO: 866712 - RNA, 14 nt, Mycobacterium avium subsp. paratuberculosis
ccacaggccgaaca

SEQ ID NO: 866713 - RNA, 20 nt, Mycobacterium avium subsp. paratuberculosis
ccacaggccgaacagcagcg

SEQ ID NO: 866714 - RNA, 22 nt, Mycobacterium avium subsp. paratuberculosis
ccacagcaguuccgacaucagu

SEQ ID NO: 866715 - RNA, 12 nt, Mycobacterium avium subsp. paratuberculosis
ccacaccggcgc

SEQ ID NO: 866716 - RNA, 19 nt, Mycobacterium avium subsp. paratuberculosis
ccacagcagcaccagcgcg

SEQ ID NO: 866717 - RNA, 22 nt, Mycobacterium avium subsp. paratuberculosis
ccacagccaggugugcggcacg

SEQ ID NO: 866718 - RNA, 17 nt, Mycobacterium avium subsp. paratuberculosis
ccacagccggcggcugu

SEQ ID NO: 866719 - RNA, 12 nt, Mycobacterium avium subsp. paratuberculosis
ccacagccgggg

SEQ ID NO: 866720 - RNA, 19 nt, Mycobacterium avium subsp. paratuberculosis
ccacagccggggaucgcgc

SEQ ID NO: 866721 - RNA, 22 nt, Mycobacterium avium subsp. paratuberculosis
ccacagccggucauaggccgcg

SEQ ID NO: 866722 - RNA, 13 nt, Mycobacterium avium subsp. paratuberculosis
ccacagccggcgg

SEQ ID NO: 866723 - RNA, 14 nt, Mycobacterium avium subsp. paratuberculosis
ccacagccggcggc

SEQ ID NO: 866724 - RNA, 13 nt, Mycobacterium avium subsp. paratuberculosis
ccacagcgccagc

SEQ ID NO: 866725 - RNA, 16 nt, Mycobacterium avium subsp. paratuberculosis
ccacagcgccagcacg

SEQ ID NO: 866726 - RNA, 14 nt, Mycobacterium avium subsp. paratuberculosis
ccacagcgguucgg

SEQ ID NO: 866727 - RNA, 15 nt, Mycobacterium avium subsp. paratuberculosis
ccacagcgguucggc

SEQ ID NO: 866728 - RNA, 18 nt, Mycobacterium avium subsp. paratuberculosis
ccacagcgguucggcgac

SEQ ID NO: 866729 - RNA, 12 nt, Mycobacterium avium subsp. paratuberculosis
ccacagcgucaa

SEQ ID NO: 866730 - RNA, 16 nt, Mycobacterium avium subsp. paratuberculosis
ccacagcgucucgacc

SEQ ID NO: 866731 - RNA, 23 nt, Mycobacterium avium subsp. paratuberculosis
ccacagcgucucgaccgcggugg

SEQ ID NO: 866732 - RNA, 13 nt, Mycobacterium avium subsp. paratuberculosis
ccacacccgcggc

SEQ ID NO: 866733 - RNA, 15 nt, Mycobacterium avium subsp. paratuberculosis
ccacacccgcggccg

SEQ ID NO: 866734 - RNA, 13 nt, Mycobacterium avium subsp. paratuberculosis
ccacacccgucga

SEQ ID NO: 866735 - RNA, 13 nt, Mycobacterium avium subsp. paratuberculosis
ccacaccgacacc

SEQ ID NO: 866736 - RNA, 18 nt, Mycobacterium avium subsp. paratuberculosis
ccacaccgacaccggccg

SEQ ID NO: 866737 - RNA, 22 nt, Mycobacterium avium subsp. paratuberculosis
ccacaccgacaccggccgggac

SEQ ID NO: 866738 - RNA, 13 nt, Mycobacterium avium subsp. paratuberculosis
ccacaccgccgcg

SEQ ID NO: 866739 - RNA, 15 nt, Mycobacterium avium subsp. paratuberculosis
ccacaccgccgcggc

SEQ ID NO: 866740 - RNA, 13 nt, Mycobacterium avium subsp. paratuberculosis
ccacaccgccggc

SEQ ID NO: 866741 - RNA, 15 nt, Mycobacterium avium subsp. paratuberculosis
ccacaccgccggcgc

SEQ ID NO: 866742 - RNA, 18 nt, Mycobacterium avium subsp. paratuberculosis
ccacaccgccggcgcgga

SEQ ID NO: 866743 - RNA, 16 nt, Mycobacterium avium subsp. paratuberculosis
ccacaugggccacggc

SEQ ID NO: 866744 - RNA, 19 nt, Mycobacterium avium subsp. paratuberculosis
ccacaugggccacggcgcg

SEQ ID NO: 866745 - RNA, 15 nt, Mycobacterium avium subsp. paratuberculosis
ccaccaccacacccg

SEQ ID NO: 866746 - RNA, 15 nt, Mycobacterium avium subsp. paratuberculosis
ccaccaccacggccg

SEQ ID NO: 866747 - RNA, 22 nt, Mycobacterium avium subsp. paratuberculosis
ccacaucuccuuggggcugacc

SEQ ID NO: 866748 - RNA, 16 nt, Mycobacterium avium subsp. paratuberculosis
ccacaucugccggcag

SEQ ID NO: 866749 - RNA, 17 nt, Mycobacterium avium subsp. paratuberculosis
ccacaucugccggcaga

SEQ ID NO: 866750 - RNA, 16 nt, Mycobacterium avium subsp. paratuberculosis
ccacaucggucucgac

SEQ ID NO: 866751 - RNA, 22 nt, Mycobacterium avium subsp. paratuberculosis
ccacaucgguugcuccggcguc

SEQ ID NO: 866752 - RNA, 23 nt, Mycobacterium avium subsp. paratuberculosis
ccacaucgguugcuccggcgucg

SEQ ID NO: 866753 - RNA, 14 nt, Mycobacterium avium subsp. paratuberculosis
ccacaucagcucgg

SEQ ID NO: 866754 - RNA, 15 nt, Mycobacterium avium subsp. paratuberculosis
ccaccaccuggccgg

SEQ ID NO: 866755 - RNA, 19 nt, Mycobacterium avium subsp. paratuberculosis
ccaccagaaguggucgauc

SEQ ID NO: 866756 - RNA, 12 nt, Mycobacterium avium subsp. paratuberculosis
ccaccagcaccg

SEQ ID NO: 866757 - RNA, 20 nt, Mycobacterium avium subsp. paratuberculosis
ccaccagcacaccggaucgg

SEQ ID NO: 866758 - RNA, 21 nt, Mycobacterium avium subsp. paratuberculosis
ccaccagaucgccccgcugga

SEQ ID NO: 866759 - RNA, 22 nt, Mycobacterium avium subsp. paratuberculosis
ccaccagaucguguccgcgccg

SEQ ID NO: 866760 - RNA, 23 nt, Mycobacterium avium subsp. paratuberculosis
ccaccagaucguguccgcgccgg

SEQ ID NO: 866761 - RNA, 17 nt, Mycobacterium avium subsp. paratuberculosis
ccaccagaugccgggcu

SEQ ID NO: 866762 - RNA, 12 nt, Mycobacterium avium subsp. paratuberculosis
ccaccaccgccu

SEQ ID NO: 866763 - RNA, 19 nt, Mycobacterium avium subsp. paratuberculosis
ccaccaccgccucgacggu

SEQ ID NO: 866764 - RNA, 18 nt, Mycobacterium avium subsp. paratuberculosis
ccaccaccucgcgggcga

SEQ ID NO: 866765 - RNA, 13 nt, Mycobacterium avium subsp. paratuberculosis
ccaccaccggccg

SEQ ID NO: 866766 - RNA, 16 nt, Mycobacterium avium subsp. paratuberculosis
ccaccaccggccgcgc

SEQ ID NO: 866767 - RNA, 20 nt, Mycobacterium avium subsp. paratuberculosis
ccaccaccggcuuggccacg

SEQ ID NO: 866768 - RNA, 15 nt, Mycobacterium avium subsp. paratuberculosis
ccaccaccgaggugg

SEQ ID NO: 866769 - RNA, 22 nt, Mycobacterium avium subsp. paratuberculosis
ccaccaccgagguggcccagcc

SEQ ID NO: 866770 - RNA, 20 nt, Mycobacterium avium subsp. paratuberculosis
ccaccaccgccaccagcgca

SEQ ID NO: 866771 - RNA, 13 nt, Mycobacterium avium subsp. paratuberculosis
ccaccaccgccgg

SEQ ID NO: 866772 - RNA, 12 nt, Mycobacterium avium subsp. paratuberculosis
ccaccacccgga

SEQ ID NO: 866773 - RNA, 19 nt, Mycobacterium avium subsp. paratuberculosis
ccaccaccgagccggcguc

SEQ ID NO: 866774 - RNA, 12 nt, Mycobacterium avium subsp. paratuberculosis
ccaccaccgcgg

SEQ ID NO: 866775 - RNA, 13 nt, Mycobacterium avium subsp. paratuberculosis
ccaccaccgcggc

SEQ ID NO: 866776 - RNA, 14 nt, Mycobacterium avium subsp. paratuberculosis
ccaccaccgcggcg

SEQ ID NO: 866777 - RNA, 15 nt, Mycobacterium avium subsp. paratuberculosis
ccaccaccgcggcgc

SEQ ID NO: 866778 - RNA, 21 nt, Mycobacterium avium subsp. paratuberculosis
ccaccaccgcggcgccgucga

SEQ ID NO: 866779 - RNA, 17 nt, Mycobacterium avium subsp. paratuberculosis
ccaccagcaccgggaag

SEQ ID NO: 866780 - RNA, 15 nt, Mycobacterium avium subsp. paratuberculosis
ccaccagaccggcga

SEQ ID NO: 866781 - RNA, 17 nt, Mycobacterium avium subsp. paratuberculosis
ccaccagcagcagguug

SEQ ID NO: 866782 - RNA, 14 nt, Mycobacterium avium subsp. paratuberculosis
ccaccagcaggucg

SEQ ID NO: 866783 - RNA, 20 nt, Mycobacterium avium subsp. paratuberculosis
ccaccagcgggcugugccgg

SEQ ID NO: 866784 - RNA, 22 nt, Mycobacterium avium subsp. paratuberculosis
ccaccagcgggcugugccggcg

SEQ ID NO: 866785 - RNA, 21 nt, Mycobacterium avium subsp. paratuberculosis
ccaccagcgguaaccacccgu

SEQ ID NO: 866786 - RNA, 12 nt, Mycobacterium avium subsp. paratuberculosis
ccaccagcucga

SEQ ID NO: 866787 - RNA, 16 nt, Mycobacterium avium subsp. paratuberculosis
ccaccagcucgaugcc

SEQ ID NO: 866788 - RNA, 22 nt, Mycobacterium avium subsp. paratuberculosis
ccaccagcucgaugccguucgc

SEQ ID NO: 866789 - RNA, 18 nt, Mycobacterium avium subsp. paratuberculosis
ccaccagcucgucgccga

SEQ ID NO: 866790 - RNA, 19 nt, Mycobacterium avium subsp. paratuberculosis
ccaccagcucgucgccgac

SEQ ID NO: 866791 - RNA, 19 nt, Mycobacterium avium subsp. paratuberculosis
ccaccaggaaggucccggu

SEQ ID NO: 866792 - RNA, 20 nt, Mycobacterium avium subsp. paratuberculosis
ccaccaggagcaccugcgcg

SEQ ID NO: 866793 - RNA, 19 nt, Mycobacterium avium subsp. paratuberculosis
ccaccagggucucgcgcag

SEQ ID NO: 866794 - RNA, 12 nt, Mycobacterium avium subsp. paratuberculosis
ccaccagggugg

SEQ ID NO: 866795 - RNA, 14 nt, Mycobacterium avium subsp. paratuberculosis
ccaccaggcgccgu

SEQ ID NO: 866796 - RNA, 15 nt, Mycobacterium avium subsp. paratuberculosis
ccaccaggcgccguc

SEQ ID NO: 866797 - RNA, 14 nt, Mycobacterium avium subsp. paratuberculosis
ccaccaggcgcggg

SEQ ID NO: 866798 - RNA, 15 nt, Mycobacterium avium subsp. paratuberculosis
ccaccaggcugaacg

SEQ ID NO: 866799 - RNA, 12 nt, Mycobacterium avium subsp. paratuberculosis
ccacccaccggc

SEQ ID NO: 866800 - RNA, 21 nt, Mycobacterium avium subsp. paratuberculosis
ccaccaugucggcgucgccga

SEQ ID NO: 866801 - RNA, 22 nt, Mycobacterium avium subsp. paratuberculosis
ccaccaugucggcgucgccgag

SEQ ID NO: 866802 - RNA, 23 nt, Mycobacterium avium subsp. paratuberculosis
ccaccaugucggcgucgccgagc

SEQ ID NO: 866803 - RNA, 20 nt, Mycobacterium avium subsp. paratuberculosis
ccaccaugucguugacgcug

SEQ ID NO: 866804 - RNA, 20 nt, Mycobacterium avium subsp. paratuberculosis
ccaccagggcgaccgccgcg

SEQ ID NO: 866805 - RNA, 22 nt, Mycobacterium avium subsp. paratuberculosis
ccaccauguuccagaaccggca

SEQ ID NO: 866806 - RNA, 14 nt, Mycobacterium avium subsp. paratuberculosis
ccaccaugauguag

SEQ ID NO: 866807 - RNA, 20 nt, Mycobacterium avium subsp. paratuberculosis
ccaccaugauguagcggcgg

SEQ ID NO: 866808 - RNA, 21 nt, Mycobacterium avium subsp. paratuberculosis
ccaccaugauguagcggcggu

SEQ ID NO: 866809 - RNA, 15 nt, Mycobacterium avium subsp. paratuberculosis
ccaccaugccggcgu

SEQ ID NO: 866810 - RNA, 16 nt, Mycobacterium avium subsp. paratuberculosis
ccaccaugccggcguc

SEQ ID NO: 866811 - RNA, 18 nt, Mycobacterium avium subsp. paratuberculosis
ccaccauggcuuccgccg

SEQ ID NO: 866812 - RNA, 20 nt, Mycobacterium avium subsp. paratuberculosis
ccaccauggcuuccgccgag

SEQ ID NO: 866813 - RNA, 23 nt, Mycobacterium avium subsp. paratuberculosis
ccaccauggcuuccgccgagacg

SEQ ID NO: 866814 - RNA, 14 nt, Mycobacterium avium subsp. paratuberculosis
ccaccccgagcucg

SEQ ID NO: 866815 - RNA, 21 nt, Mycobacterium avium subsp. paratuberculosis
ccaccccgcagaacaccagcg

SEQ ID NO: 866816 - RNA, 14 nt, Mycobacterium avium subsp. paratuberculosis
ccacccccagcccg

SEQ ID NO: 866817 - RNA, 17 nt, Mycobacterium avium subsp. paratuberculosis
ccacccccagcccgccg

SEQ ID NO: 866818 - RNA, 16 nt, Mycobacterium avium subsp. paratuberculosis
ccacccccgacccgaa

SEQ ID NO: 866819 - RNA, 13 nt, Mycobacterium avium subsp. paratuberculosis
ccacccccgcggu

SEQ ID NO: 866820 - RNA, 15 nt, Mycobacterium avium subsp. paratuberculosis
ccacccccgcgguga

SEQ ID NO: 866821 - RNA, 15 nt, Mycobacterium avium subsp. paratuberculosis
ccacccacucccagc

SEQ ID NO: 866822 - RNA, 19 nt, Mycobacterium avium subsp. paratuberculosis
ccacccacucccagccgcc

SEQ ID NO: 866823 - RNA, 22 nt, Mycobacterium avium subsp. paratuberculosis
ccaaaacgugauagcggccgcg

SEQ ID NO: 866824 - RNA, 15 nt, Mycobacterium avium subsp. paratuberculosis
ccaaaaccguugggc

SEQ ID NO: 866825 - RNA, 15 nt, Mycobacterium avium subsp. paratuberculosis
ccaacaacucgacgc

SEQ ID NO: 866826 - RNA, 20 nt, Mycobacterium avium subsp. paratuberculosis
ccaacaacucgacgcucggc

SEQ ID NO: 866827 - RNA, 20 nt, Mycobacterium avium subsp. paratuberculosis
ccaacaacucgacguucggc

SEQ ID NO: 866828 - RNA, 18 nt, Mycobacterium avium subsp. paratuberculosis
ccaacacggcggcgcgca

SEQ ID NO: 866829 - RNA, 18 nt, Mycobacterium avium subsp. paratuberculosis
ccaagcgguuccagaccg

SEQ ID NO: 866830 - RNA, 17 nt, Mycobacterium avium subsp. paratuberculosis
ccaagcguauccggcca

SEQ ID NO: 866831 - RNA, 22 nt, Mycobacterium avium subsp. paratuberculosis
ccaacugcauuucggacggcga

SEQ ID NO: 866832 - RNA, 18 nt, Mycobacterium avium subsp. paratuberculosis
ccaacucgaccugcccgg

SEQ ID NO: 866833 - RNA, 23 nt, Mycobacterium avium subsp. paratuberculosis
ccaacugaauuccuggccggugc

SEQ ID NO: 866834 - RNA, 22 nt, Mycobacterium avium subsp. paratuberculosis
ccaacugggugggugcggugcg

SEQ ID NO: 866835 - RNA, 15 nt, Mycobacterium avium subsp. paratuberculosis
ccaaccccgggcggc

SEQ ID NO: 866836 - RNA, 20 nt, Mycobacterium avium subsp. paratuberculosis
ccaacccgaaggugguggcg

SEQ ID NO: 866837 - RNA, 22 nt, Mycobacterium avium subsp. paratuberculosis
ccaacccgaaggugguggcguu

SEQ ID NO: 866838 - RNA, 14 nt, Mycobacterium avium subsp. paratuberculosis
ccaacccgggcgcc

SEQ ID NO: 866839 - RNA, 20 nt, Mycobacterium avium subsp. paratuberculosis
ccaaccgcauucggccgcca

SEQ ID NO: 866840 - RNA, 16 nt, Mycobacterium avium subsp. paratuberculosis
ccaaccgcccggcgcc

SEQ ID NO: 866841 - RNA, 18 nt, Mycobacterium avium subsp. paratuberculosis
ccaaccgcccggcgccga

SEQ ID NO: 866842 - RNA, 20 nt, Mycobacterium avium subsp. paratuberculosis
ccaaccgcccggcgccgauc

SEQ ID NO: 866843 - RNA, 16 nt, Mycobacterium avium subsp. paratuberculosis
ccaaccgcucggcgau

SEQ ID NO: 866844 - RNA, 18 nt, Mycobacterium avium subsp. paratuberculosis
ccaaccgcucggcgaucu

SEQ ID NO: 866845 - RNA, 19 nt, Mycobacterium avium subsp. paratuberculosis
ccaacuccaccgcccggau

SEQ ID NO: 866846 - RNA, 18 nt, Mycobacterium avium subsp. paratuberculosis
ccaacgugaugagcgcgu

SEQ ID NO: 866847 - RNA, 15 nt, Mycobacterium avium subsp. paratuberculosis
ccaacucaugggccc

SEQ ID NO: 866848 - RNA, 14 nt, Mycobacterium avium subsp. paratuberculosis
ccaacuccggcggc

SEQ ID NO: 866849 - RNA, 14 nt, Mycobacterium avium subsp. paratuberculosis
ccaaccggccccga

SEQ ID NO: 866850 - RNA, 16 nt, Mycobacterium avium subsp. paratuberculosis
ccaaccggccccgagc

SEQ ID NO: 866851 - RNA, 14 nt, Mycobacterium avium subsp. paratuberculosis
cauuucggcguccu

SEQ ID NO: 866852 - RNA, 23 nt, Mycobacterium avium subsp. paratuberculosis
cauuucggacggcgacggcagcg

SEQ ID NO: 866853 - RNA, 16 nt, Mycobacterium avium subsp. paratuberculosis
cauuuccgagcgacga

SEQ ID NO: 866854 - RNA, 19 nt, Mycobacterium avium subsp. paratuberculosis
cauuuccguugugccaccg

SEQ ID NO: 866855 - RNA, 15 nt, Mycobacterium avium subsp. paratuberculosis
cauuucagcagcgcg

SEQ ID NO: 866856 - RNA, 12 nt, Mycobacterium avium subsp. paratuberculosis
cauuggccgcgc

SEQ ID NO: 866857 - RNA, 15 nt, Mycobacterium avium subsp. paratuberculosis
cauuggccgcgcgca

SEQ ID NO: 866858 - RNA, 21 nt, Mycobacterium avium subsp. paratuberculosis
cauuggcgaccgcggccgcga

SEQ ID NO: 866859 - RNA, 14 nt, Mycobacterium avium subsp. paratuberculosis
cauugcgccggucg

SEQ ID NO: 866860 - RNA, 18 nt, Mycobacterium avium subsp. paratuberculosis
cauugcgacuugcgcgcc

SEQ ID NO: 866861 - RNA, 22 nt, Mycobacterium avium subsp. paratuberculosis
cauucugaauucggccaccgac

SEQ ID NO: 866862 - RNA, 14 nt, Mycobacterium avium subsp. paratuberculosis
cauucgucggcggu

SEQ ID NO: 866863 - RNA, 19 nt, Mycobacterium avium subsp. paratuberculosis
cauucgugguugccccagc

SEQ ID NO: 866864 - RNA, 19 nt, Mycobacterium avium subsp. paratuberculosis
cauucguguggcgcacgcu

SEQ ID NO: 866865 - RNA, 21 nt, Mycobacterium avium subsp. paratuberculosis
cauugagccgcucgccgggga

SEQ ID NO: 866866 - RNA, 16 nt, Mycobacterium avium subsp. paratuberculosis
cauugaucuccgcggc

SEQ ID NO: 866867 - RNA, 17 nt, Mycobacterium avium subsp. paratuberculosis
cauugaucuccgcggcg

SEQ ID NO: 866868 - RNA, 14 nt, Mycobacterium avium subsp. paratuberculosis
cauugcaccgcaac

SEQ ID NO: 866869 - RNA, 20 nt, Mycobacterium avium subsp. paratuberculosis
cauugcaccgcaacguuguu

SEQ ID NO: 866870 - RNA, 17 nt, Mycobacterium avium subsp. paratuberculosis
cauuccgccgaaacccg

SEQ ID NO: 866871 - RNA, 19 nt, Mycobacterium avium subsp. paratuberculosis
cauuccgccgcgcccgucg

SEQ ID NO: 866872 - RNA, 22 nt, Mycobacterium avium subsp. paratuberculosis
cauuccgccgcgcccgucgagc

SEQ ID NO: 866873 - RNA, 17 nt, Mycobacterium avium subsp. paratuberculosis
cauucgcgugugcccag

SEQ ID NO: 866874 - RNA, 17 nt, Mycobacterium avium subsp. paratuberculosis
cauucgggccagcgccg

SEQ ID NO: 866875 - RNA, 20 nt, Mycobacterium avium subsp. paratuberculosis
cauucgggccagcgccgagc

SEQ ID NO: 866876 - RNA, 21 nt, Mycobacterium avium subsp. paratuberculosis
cauucgggccagcgccgagcc

SEQ ID NO: 866877 - RNA, 15 nt, Mycobacterium avium subsp. paratuberculosis
cauucggggccacca

SEQ ID NO: 866878 - RNA, 19 nt, Mycobacterium avium subsp. paratuberculosis
cauucggucucgccccggc

SEQ ID NO: 866879 - RNA, 18 nt, Mycobacterium avium subsp. paratuberculosis
cauucaucgcgcaccagg

SEQ ID NO: 866880 - RNA, 14 nt, Mycobacterium avium subsp. paratuberculosis
cauucacgaggccg

SEQ ID NO: 866881 - RNA, 22 nt, Mycobacterium avium subsp. paratuberculosis
caugucguacgggcgcagcgcc

SEQ ID NO: 866882 - RNA, 24 nt, Mycobacterium avium subsp. paratuberculosis
caugucguacgggcgcagcgccgu

SEQ ID NO: 866883 - RNA, 15 nt, Mycobacterium avium subsp. paratuberculosis
caugucguaguagcg

SEQ ID NO: 866884 - RNA, 20 nt, Mycobacterium avium subsp. paratuberculosis
caugucguccucccggccga

SEQ ID NO: 866885 - RNA, 13 nt, Mycobacterium avium subsp. paratuberculosis
caugucggccagg

SEQ ID NO: 866886 - RNA, 20 nt, Mycobacterium avium subsp. paratuberculosis
caugucgaucggcucggcgc

SEQ ID NO: 866887 - RNA, 17 nt, Mycobacterium avium subsp. paratuberculosis
caugucgaugccgagcc

SEQ ID NO: 866888 - RNA, 21 nt, Mycobacterium avium subsp. paratuberculosis
caugucgaugccgagccggcc

SEQ ID NO: 866889 - RNA, 16 nt, Mycobacterium avium subsp. paratuberculosis
caugucgccgaacgcc

SEQ ID NO: 866890 - RNA, 18 nt, Mycobacterium avium subsp. paratuberculosis
caugucgccggugcuggu

SEQ ID NO: 866891 - RNA, 18 nt, Mycobacterium avium subsp. paratuberculosis
cauguggaagccgcgauc

SEQ ID NO: 866892 - RNA, 23 nt, Mycobacterium avium subsp. paratuberculosis
caugugccggcgcucgucgucgc

SEQ ID NO: 866893 - RNA, 16 nt, Mycobacterium avium subsp. paratuberculosis
caugucguugaugccg

SEQ ID NO: 866894 - RNA, 16 nt, Mycobacterium avium subsp. paratuberculosis
caugugaccggggucg

SEQ ID NO: 866895 - RNA, 17 nt, Mycobacterium avium subsp. paratuberculosis
cauguggccgucgccga

SEQ ID NO: 866896 - RNA, 13 nt, Mycobacterium avium subsp. paratuberculosis
cauguacagaccc

SEQ ID NO: 866897 - RNA, 23 nt, Mycobacterium avium subsp. paratuberculosis
cauguacaggaucaacucgucgg

SEQ ID NO: 866898 - RNA, 16 nt, Mycobacterium avium subsp. paratuberculosis
cauguaccaggcgacg

SEQ ID NO: 866899 - RNA, 14 nt, Mycobacterium avium subsp. paratuberculosis
cauguagcagcgcg

SEQ ID NO: 866900 - RNA, 19 nt, Mycobacterium avium subsp. paratuberculosis
cauguagguggcgaccacc

SEQ ID NO: 866901 - RNA, 16 nt, Mycobacterium avium subsp. paratuberculosis
cauguaguucagcagc

SEQ ID NO: 866902 - RNA, 17 nt, Mycobacterium avium subsp. paratuberculosis
cauguaguucagcagcc

SEQ ID NO: 866903 - RNA, 21 nt, Mycobacterium avium subsp. paratuberculosis
caugucgaagaagcggccgac

SEQ ID NO: 866904 - RNA, 21 nt, Mycobacterium avium subsp. paratuberculosis
caugucgaccucggccaccac

SEQ ID NO: 866905 - RNA, 22 nt, Mycobacterium avium subsp. paratuberculosis
cauguccgccgucaucggcgga

SEQ ID NO: 866906 - RNA, 23 nt, Mycobacterium avium subsp. paratuberculosis
cauguccggagcgaaggugccgc

SEQ ID NO: 866907 - RNA, 14 nt, Mycobacterium avium subsp. paratuberculosis
cauguccggcaggc

SEQ ID NO: 866908 - RNA, 22 nt, Mycobacterium avium subsp. paratuberculosis
cauguccggggugagcagggcc

SEQ ID NO: 866909 - RNA, 18 nt, Mycobacterium avium subsp. paratuberculosis
cauguccagguacgcgac

SEQ ID NO: 866910 - RNA, 22 nt, Mycobacterium avium subsp. paratuberculosis
cauguccccgccgguggcggcg

SEQ ID NO: 866911 - RNA, 16 nt, Mycobacterium avium subsp. paratuberculosis
caugucccgggcacgc

SEQ ID NO: 866912 - RNA, 14 nt, Mycobacterium avium subsp. paratuberculosis
cauguugugcaggc

SEQ ID NO: 866913 - RNA, 20 nt, Mycobacterium avium subsp. paratuberculosis
cauguugugcaggcagccgu

SEQ ID NO: 866914 - RNA, 22 nt, Mycobacterium avium subsp. paratuberculosis
cauguugugcccgacggcgcgc

SEQ ID NO: 866915 - RNA, 20 nt, Mycobacterium avium subsp. paratuberculosis
cauguucuccucgucgcggg

SEQ ID NO: 866916 - RNA, 16 nt, Mycobacterium avium subsp. paratuberculosis
caugcgaccacgaccg

SEQ ID NO: 866917 - RNA, 17 nt, Mycobacterium avium subsp. paratuberculosis
caugcgaccacgaccgg

SEQ ID NO: 866918 - RNA, 22 nt, Mycobacterium avium subsp. paratuberculosis
caugccuuucagcucgauggug

SEQ ID NO: 866919 - RNA, 16 nt, Mycobacterium avium subsp. paratuberculosis
caugccucuucggcgc

SEQ ID NO: 866920 - RNA, 18 nt, Mycobacterium avium subsp. paratuberculosis
caugccucuucggcgcgc

SEQ ID NO: 866921 - RNA, 17 nt, Mycobacterium avium subsp. paratuberculosis
caucgccgaaccgggcg

SEQ ID NO: 866922 - RNA, 20 nt, Mycobacterium avium subsp. paratuberculosis
caucgccgacggugagcacc

SEQ ID NO: 866923 - RNA, 12 nt, Mycobacterium avium subsp. paratuberculosis
caucgccgagcc

SEQ ID NO: 866924 - RNA, 20 nt, Mycobacterium avium subsp. paratuberculosis
caugccguugccaggccgcg

SEQ ID NO: 866925 - RNA, 14 nt, Mycobacterium avium subsp. paratuberculosis
caucgccgcgaccc

SEQ ID NO: 866926 - RNA, 21 nt, Mycobacterium avium subsp. paratuberculosis
caucgccgcgcacccggccac

SEQ ID NO: 866927 - RNA, 20 nt, Mycobacterium avium subsp. paratuberculosis
caugcgcgagucgagcaccg

SEQ ID NO: 866928 - RNA, 22 nt, Mycobacterium avium subsp. paratuberculosis
caugcgcgagucgagcaccgcg

SEQ ID NO: 866929 - RNA, 18 nt, Mycobacterium avium subsp. paratuberculosis
caugcgcagcgcccaggc

SEQ ID NO: 866930 - RNA, 19 nt, Mycobacterium avium subsp. paratuberculosis
caugcgcgucauggccguc

SEQ ID NO: 866931 - RNA, 20 nt, Mycobacterium avium subsp. paratuberculosis
caugcgcgucauggccgucg

SEQ ID NO: 866932 - RNA, 21 nt, Mycobacterium avium subsp. paratuberculosis
caugcuuucgaucaucgagca

SEQ ID NO: 866933 - RNA, 15 nt, Mycobacterium avium subsp. paratuberculosis
caugcuuccgaucaa

SEQ ID NO: 866934 - RNA, 21 nt, Mycobacterium avium subsp. paratuberculosis
cauggacgcggccucaccgcg

SEQ ID NO: 866935 - RNA, 17 nt, Mycobacterium avium subsp. paratuberculosis
caugcuggugccgccga

SEQ ID NO: 866936 - RNA, 20 nt, Mycobacterium avium subsp. paratuberculosis
caugcuggugccgccgauga

SEQ ID NO: 866937 - RNA, 16 nt, Mycobacterium avium subsp. paratuberculosis
caugcugccgccggcg

SEQ ID NO: 866938 - RNA, 17 nt, Mycobacterium avium subsp. paratuberculosis
caugcgguggucgaaau

SEQ ID NO: 866939 - RNA, 21 nt, Mycobacterium avium subsp. paratuberculosis
cauggugcggguguccgagcg

SEQ ID NO: 866940 - RNA, 24 nt, Mycobacterium avium subsp. paratuberculosis
cauggugcggguguccgagcgggc

SEQ ID NO: 866941 - RNA, 18 nt, Mycobacterium avium subsp. paratuberculosis
cauggugggguagacggc

SEQ ID NO: 866942 - RNA, 23 nt, Mycobacterium avium subsp. paratuberculosis
cauggugucaggaucgccggucg

SEQ ID NO: 866943 - RNA, 20 nt, Mycobacterium avium subsp. paratuberculosis
caugguguuccaccagcggc

SEQ ID NO: 866944 - RNA, 22 nt, Mycobacterium avium subsp. paratuberculosis
cauggucaggguguaggccgcg

SEQ ID NO: 866945 - RNA, 18 nt, Mycobacterium avium subsp. paratuberculosis
caugguccugcaccgagu

SEQ ID NO: 866946 - RNA, 18 nt, Mycobacterium avium subsp. paratuberculosis
cauggucgcccacaccgg

SEQ ID NO: 866947 - RNA, 22 nt, Mycobacterium avium subsp. paratuberculosis
cauggucgcggccguguacagc

SEQ ID NO: 866948 - RNA, 16 nt, Mycobacterium avium subsp. paratuberculosis
cauggugaugaucccg

SEQ ID NO: 866949 - RNA, 20 nt, Mycobacterium avium subsp. paratuberculosis
cauggugaugaucccgguga

SEQ ID NO: 866950 - RNA, 20 nt, Mycobacterium avium subsp. paratuberculosis
cauggucggcgacgccgucg

SEQ ID NO: 866951 - RNA, 17 nt, Mycobacterium avium subsp. paratuberculosis
cauggugaagcccagcg

SEQ ID NO: 866952 - RNA, 19 nt, Mycobacterium avium subsp. paratuberculosis
cauggugaagcccagcgcg

SEQ ID NO: 866953 - RNA, 23 nt, Mycobacterium avium subsp. paratuberculosis
cauggugaaggcgaacaccagcc

SEQ ID NO: 866954 - RNA, 17 nt, Mycobacterium avium subsp. paratuberculosis
cauggugaccagcguga

SEQ ID NO: 866955 - RNA, 16 nt, Mycobacterium avium subsp. paratuberculosis
caugggcgugccggcc

SEQ ID NO: 866956 - RNA, 21 nt, Mycobacterium avium subsp. paratuberculosis
caugggcgugccggcccggcg

SEQ ID NO: 866957 - RNA, 18 nt, Mycobacterium avium subsp. paratuberculosis
caugggcccggcccguca

SEQ ID NO: 866958 - RNA, 20 nt, Mycobacterium avium subsp. paratuberculosis
caugggccacggcgcgagga

SEQ ID NO: 866959 - RNA, 15 nt, Mycobacterium avium subsp. paratuberculosis
cauggcggccagccg

SEQ ID NO: 866960 - RNA, 19 nt, Mycobacterium avium subsp. paratuberculosis
cauggcggcccgcgccggc

SEQ ID NO: 866961 - RNA, 20 nt, Mycobacterium avium subsp. paratuberculosis
cauggcggcccgcgccggcg

SEQ ID NO: 866962 - RNA, 17 nt, Mycobacterium avium subsp. paratuberculosis
cauggcgcugcgcgaca

SEQ ID NO: 866963 - RNA, 19 nt, Mycobacterium avium subsp. paratuberculosis
cauggcgcugcgcgacacc

SEQ ID NO: 866964 - RNA, 18 nt, Mycobacterium avium subsp. paratuberculosis
cauggcgcggcggccggc

SEQ ID NO: 866965 - RNA, 13 nt, Mycobacterium avium subsp. paratuberculosis
cauggcgcagaac

SEQ ID NO: 866966 - RNA, 17 nt, Mycobacterium avium subsp. paratuberculosis
cauggcgcccgcguaca

SEQ ID NO: 866967 - RNA, 17 nt, Mycobacterium avium subsp. paratuberculosis
cauggcgaucaccccgg

SEQ ID NO: 866968 - RNA, 18 nt, Mycobacterium avium subsp. paratuberculosis
cauggcgaucaccccggc

SEQ ID NO: 866969 - RNA, 19 nt, Mycobacterium avium subsp. paratuberculosis
cauggcgaucaccccggcg

SEQ ID NO: 866970 - RNA, 23 nt, Mycobacterium avium subsp. paratuberculosis
cauggcgcaccgcggccucggcg

SEQ ID NO: 866971 - RNA, 16 nt, Mycobacterium avium subsp. paratuberculosis
cauggccuugaacucg

SEQ ID NO: 866972 - RNA, 20 nt, Mycobacterium avium subsp. paratuberculosis
cauggccuugaacucggcca

SEQ ID NO: 866973 - RNA, 24 nt, Mycobacterium avium subsp. paratuberculosis
cauggcgaacacgucggccagcgc

SEQ ID NO: 866974 - RNA, 19 nt, Mycobacterium avium subsp. paratuberculosis
cauggcgaaguagucggcg

SEQ ID NO: 866975 - RNA, 20 nt, Mycobacterium avium subsp. paratuberculosis
cauggcgaaguagucggcgu

SEQ ID NO: 866976 - RNA, 12 nt, Mycobacterium avium subsp. paratuberculosis
cauggccgucgg

SEQ ID NO: 866977 - RNA, 17 nt, Mycobacterium avium subsp. paratuberculosis
cauggccgucgggucgg

SEQ ID NO: 866978 - RNA, 19 nt, Mycobacterium avium subsp. paratuberculosis
cauggccgucgggucggcg

SEQ ID NO: 866979 - RNA, 16 nt, Mycobacterium avium subsp. paratuberculosis
cauggccagcucgucg

SEQ ID NO: 866980 - RNA, 17 nt, Mycobacterium avium subsp. paratuberculosis
caguuccugcaugccgg

SEQ ID NO: 866981 - RNA, 17 nt, Mycobacterium avium subsp. paratuberculosis
caguuccggagcgcggu

SEQ ID NO: 866982 - RNA, 22 nt, Mycobacterium avium subsp. paratuberculosis
caguuccgacaucagugcgggc

SEQ ID NO: 866983 - RNA, 11 nt, Mycobacterium avium subsp. paratuberculosis
caguucccggc

SEQ ID NO: 866984 - RNA, 18 nt, Mycobacterium avium subsp. paratuberculosis
caguucccggccagcgca

SEQ ID NO: 866985 - RNA, 14 nt, Mycobacterium avium subsp. paratuberculosis
caguucccggcggg

SEQ ID NO: 866986 - RNA, 20 nt, Mycobacterium avium subsp. paratuberculosis
caguggguggugugcucggu

SEQ ID NO: 866987 - RNA, 23 nt, Mycobacterium avium subsp. paratuberculosis
cagugguugagcagcagaccgcc

SEQ ID NO: 866988 - RNA, 22 nt, Mycobacterium avium subsp. paratuberculosis
caguggcugcacgucacgggcc

SEQ ID NO: 866989 - RNA, 20 nt, Mycobacterium avium subsp. paratuberculosis
caguggcugucgggugccgc

SEQ ID NO: 866990 - RNA, 15 nt, Mycobacterium avium subsp. paratuberculosis
caguggaucggcccg

SEQ ID NO: 866991 - RNA, 18 nt, Mycobacterium avium subsp. paratuberculosis
caguugacguugaucgcg

SEQ ID NO: 866992 - RNA, 19 nt, Mycobacterium avium subsp. paratuberculosis
caguugacguugaucgcgc

SEQ ID NO: 866993 - RNA, 20 nt, Mycobacterium avium subsp. paratuberculosis
caguucuucgaugacggccg

SEQ ID NO: 866994 - RNA, 16 nt, Mycobacterium avium subsp. paratuberculosis
caguucguucauccgg

SEQ ID NO: 866995 - RNA, 13 nt, Mycobacterium avium subsp. paratuberculosis
caguucggugcac

SEQ ID NO: 866996 - RNA, 17 nt, Mycobacterium avium subsp. paratuberculosis
caguucggugcacggcg

SEQ ID NO: 866997 - RNA, 17 nt, Mycobacterium avium subsp. paratuberculosis
caguucgguggggccgc

SEQ ID NO: 866998 - RNA, 19 nt, Mycobacterium avium subsp. paratuberculosis
caguucgguggggccgccg

SEQ ID NO: 866999 - RNA, 20 nt, Mycobacterium avium subsp. paratuberculosis
caguucgguggggccgccgu

SEQ ID NO: 867000 - RNA, 16 nt, Mycobacterium avium subsp. paratuberculosis
caguucguccagcccg

SEQ ID NO: 867001 - RNA, 20 nt, Mycobacterium avium subsp. paratuberculosis
caguucguagaucacggcgu

SEQ ID NO: 867002 - RNA, 20 nt, Mycobacterium avium subsp. paratuberculosis
caguucgggaucgucgccgg

SEQ ID NO: 867003 - RNA, 17 nt, Mycobacterium avium subsp. paratuberculosis
caguucggguccgcggu

SEQ ID NO: 867004 - RNA, 15 nt, Mycobacterium avium subsp. paratuberculosis
caguucggccggcuu

SEQ ID NO: 867005 - RNA, 14 nt, Mycobacterium avium subsp. paratuberculosis
caguucggcgcgca

SEQ ID NO: 867006 - RNA, 16 nt, Mycobacterium avium subsp. paratuberculosis
caguucgcaccccacc

SEQ ID NO: 867007 - RNA, 23 nt, Mycobacterium avium subsp. paratuberculosis
caguucgcaccccaccgacagcc

SEQ ID NO: 867008 - RNA, 15 nt, Mycobacterium avium subsp. paratuberculosis
caguucgcccuggcc

SEQ ID NO: 867009 - RNA, 14 nt, Mycobacterium avium subsp. paratuberculosis
caguuccucggcga

SEQ ID NO: 867010 - RNA, 20 nt, Mycobacterium avium subsp. paratuberculosis
caguucgacguagcccgccg

SEQ ID NO: 867011 - RNA, 17 nt, Mycobacterium avium subsp. paratuberculosis
caguucgaucagcagcu

SEQ ID NO: 867012 - RNA, 19 nt, Mycobacterium avium subsp. paratuberculosis
caguucgaucagcagcucg

SEQ ID NO: 867013 - RNA, 13 nt, Mycobacterium avium subsp. paratuberculosis
caguucgaugccg

SEQ ID NO: 867014 - RNA, 22 nt, Mycobacterium avium subsp. paratuberculosis
caguucgaugcgcucggcgacc

SEQ ID NO: 867015 - RNA, 19 nt, Mycobacterium avium subsp. paratuberculosis
caguuccuugauccggccg

SEQ ID NO: 867016 - RNA, 20 nt, Mycobacterium avium subsp. paratuberculosis
caguuccuugauccggccgc

SEQ ID NO: 867017 - RNA, 23 nt, Mycobacterium avium subsp. paratuberculosis
caguuccuugauccggccgcgga

SEQ ID NO: 867018 - RNA, 17 nt, Mycobacterium avium subsp. paratuberculosis
caguucgaccggcacca

SEQ ID NO: 867019 - RNA, 21 nt, Mycobacterium avium subsp. paratuberculosis
caguucgaccggcaccagcag

SEQ ID NO: 867020 - RNA, 23 nt, Mycobacterium avium subsp. paratuberculosis
caguucgaccggcaccagcagcc

SEQ ID NO: 867021 - RNA, 15 nt, Mycobacterium avium subsp. paratuberculosis
cagguuuugcagcgg

SEQ ID NO: 867022 - RNA, 16 nt, Mycobacterium avium subsp. paratuberculosis
cagguuuugcagcgga

SEQ ID NO: 867023 - RNA, 15 nt, Mycobacterium avium subsp. paratuberculosis
caguaccagcggccg

SEQ ID NO: 867024 - RNA, 15 nt, Mycobacterium avium subsp. paratuberculosis
caguccgacgcgacg

SEQ ID NO: 867025 - RNA, 14 nt, Mycobacterium avium subsp. paratuberculosis
caguccggcgguca

SEQ ID NO: 867026 - RNA, 20 nt, Mycobacterium avium subsp. paratuberculosis
caguccggcggucagcaccg

SEQ ID NO: 867027 - RNA, 23 nt, Mycobacterium avium subsp. paratuberculosis
caguccggcggucagcaccguca

SEQ ID NO: 867028 - RNA, 14 nt, Mycobacterium avium subsp. paratuberculosis
caguccgcccagcg

SEQ ID NO: 867029 - RNA, 17 nt, Mycobacterium avium subsp. paratuberculosis
caguccgccccgaugcg

SEQ ID NO: 867030 - RNA, 14 nt, Mycobacterium avium subsp. paratuberculosis
caguccgccgccgu

SEQ ID NO: 867031 - RNA, 21 nt, Mycobacterium avium subsp. paratuberculosis
caguccgccggagaccagcag

SEQ ID NO: 867032 - RNA, 14 nt, Mycobacterium avium subsp. paratuberculosis
caguccgcgccggu

SEQ ID NO: 867033 - RNA, 18 nt, Mycobacterium avium subsp. paratuberculosis
caguccgcgugacaagcc

SEQ ID NO: 867034 - RNA, 21 nt, Mycobacterium avium subsp. paratuberculosis
caguccggcgaguacccgccg

SEQ ID NO: 867035 - RNA, 15 nt, Mycobacterium avium subsp. paratuberculosis
caguccggcgccgac

SEQ ID NO: 867036 - RNA, 19 nt, Mycobacterium avium subsp. paratuberculosis
cagugccgcgcggacgcgg

SEQ ID NO: 867037 - RNA, 14 nt, Mycobacterium avium subsp. paratuberculosis
cagugccggcgcac

SEQ ID NO: 867038 - RNA, 16 nt, Mycobacterium avium subsp. paratuberculosis
cagugccggcgcaccg

SEQ ID NO: 867039 - RNA, 17 nt, Mycobacterium avium subsp. paratuberculosis
cagugccggcgcaccgc

SEQ ID NO: 867040 - RNA, 18 nt, Mycobacterium avium subsp. paratuberculosis
cagugccggcgcaccgcg

SEQ ID NO: 867041 - RNA, 21 nt, Mycobacterium avium subsp. paratuberculosis
cagugccggcgcaccgcgucg

SEQ ID NO: 867042 - RNA, 14 nt, Mycobacterium avium subsp. paratuberculosis
cagugccgggccag

SEQ ID NO: 867043 - RNA, 17 nt, Mycobacterium avium subsp. paratuberculosis
cagugccgggccagcug

SEQ ID NO: 867044 - RNA, 15 nt, Mycobacterium avium subsp. paratuberculosis
cagugccgcaccagc

SEQ ID NO: 867045 - RNA, 17 nt, Mycobacterium avium subsp. paratuberculosis
cagugccgcaccagcac

SEQ ID NO: 867046 - RNA, 18 nt, Mycobacterium avium subsp. paratuberculosis
cagugccccguccggcgc

SEQ ID NO: 867047 - RNA, 20 nt, Mycobacterium avium subsp. paratuberculosis
cagugccccguccggcgcca

SEQ ID NO: 867048 - RNA, 16 nt, Mycobacterium avium subsp. paratuberculosis
cagugaggccagcacc

SEQ ID NO: 867049 - RNA, 19 nt, Mycobacterium avium subsp. paratuberculosis
cagugagggaacgccgauc

SEQ ID NO: 867050 - RNA, 20 nt, Mycobacterium avium subsp. paratuberculosis
cagugagggaacgccgauca

SEQ ID NO: 867051 - RNA, 22 nt, Mycobacterium avium subsp. paratuberculosis
cagucggccugcagcucggugc

SEQ ID NO: 867052 - RNA, 13 nt, Mycobacterium avium subsp. paratuberculosis
cagucggccauca

SEQ ID NO: 867053 - RNA, 19 nt, Mycobacterium avium subsp. paratuberculosis
cagucggccaucagcaccg

SEQ ID NO: 867054 - RNA, 14 nt, Mycobacterium avium subsp. paratuberculosis
cagucggccggcgu

SEQ ID NO: 867055 - RNA, 15 nt, Mycobacterium avium subsp. paratuberculosis
cagucggccaccgcg

SEQ ID NO: 867056 - RNA, 16 nt, Mycobacterium avium subsp. paratuberculosis
cagucggccaccgcga

SEQ ID NO: 867057 - RNA, 13 nt, Mycobacterium avium subsp. paratuberculosis
cagucgcgcagcg

SEQ ID NO: 867058 - RNA, 15 nt, Mycobacterium avium subsp. paratuberculosis
cagucgcgcagcguc

SEQ ID NO: 867059 - RNA, 21 nt, Mycobacterium avium subsp. paratuberculosis
cagucgcgcagcgucaucgcg

SEQ ID NO: 867060 - RNA, 17 nt, Mycobacterium avium subsp. paratuberculosis
caguccugggccggggc

SEQ ID NO: 867061 - RNA, 15 nt, Mycobacterium avium subsp. paratuberculosis
cagucgcggcgaacc

SEQ ID NO: 867062 - RNA, 20 nt, Mycobacterium avium subsp. paratuberculosis
cagucgcggcgaaccagcau

SEQ ID NO: 867063 - RNA, 14 nt, Mycobacterium avium subsp. paratuberculosis
cagucgcgggcagc

SEQ ID NO: 867064 - RNA, 21 nt, Mycobacterium avium subsp. paratuberculosis
cagucgcgggcagccggcgcc

SEQ ID NO: 867065 - RNA, 16 nt, Mycobacterium avium subsp. paratuberculosis
cagucgcgggcgagcc

SEQ ID NO: 867066 - RNA, 19 nt, Mycobacterium avium subsp. paratuberculosis
cagucggcgucgcggcgca

SEQ ID NO: 867067 - RNA, 16 nt, Mycobacterium avium subsp. paratuberculosis
cagucggcgccgaugc

SEQ ID NO: 867068 - RNA, 12 nt, Mycobacterium avium subsp. paratuberculosis
cagucggcgcgu

SEQ ID NO: 867069 - RNA, 16 nt, Mycobacterium avium subsp. paratuberculosis
cagucggcgcguuggc

SEQ ID NO: 867070 - RNA, 15 nt, Mycobacterium avium subsp. paratuberculosis
cagguuucgcucguc

SEQ ID NO: 867071 - RNA, 19 nt, Mycobacterium avium subsp. paratuberculosis
cagguuucgcucgucggcg

SEQ ID NO: 867072 - RNA, 21 nt, Mycobacterium avium subsp. paratuberculosis
cagguuugagcgugccgccgg

SEQ ID NO: 867073 - RNA, 14 nt, Mycobacterium avium subsp. paratuberculosis
cagguucacgucgg

SEQ ID NO: 867074 - RNA, 17 nt, Mycobacterium avium subsp. paratuberculosis
cagguguccagcccuac

SEQ ID NO: 867075 - RNA, 19 nt, Mycobacterium avium subsp. paratuberculosis
cagguguccagcccuaccc

SEQ ID NO: 867076 - RNA, 13 nt, Mycobacterium avium subsp. paratuberculosis
cagguguccggcc

SEQ ID NO: 867077 - RNA, 15 nt, Mycobacterium avium subsp. paratuberculosis
caggugugcccgccc

SEQ ID NO: 867078 - RNA, 21 nt, Mycobacterium avium subsp. paratuberculosis
caggugugccgcugguaggcg

SEQ ID NO: 867079 - RNA, 13 nt, Mycobacterium avium subsp. paratuberculosis
caggugugcggca

SEQ ID NO: 867080 - RNA, 17 nt, Mycobacterium avium subsp. paratuberculosis
caggugugcggcaagcg

SEQ ID NO: 867081 - RNA, 23 nt, Mycobacterium avium subsp. paratuberculosis
caggugugggcguacgggcgggc

SEQ ID NO: 867082 - RNA, 15 nt, Mycobacterium avium subsp. paratuberculosis
caggugcucgccggc

SEQ ID NO: 867083 - RNA, 15 nt, Mycobacterium avium subsp. paratuberculosis
cagguggucggcgaa

SEQ ID NO: 867084 - RNA, 13 nt, Mycobacterium avium subsp. paratuberculosis
caggugaugcggc

SEQ ID NO: 867085 - RNA, 15 nt, Mycobacterium avium subsp. paratuberculosis
caggugaugcggccc

SEQ ID NO: 867086 - RNA, 16 nt, Mycobacterium avium subsp. paratuberculosis
caggugacgacgcucu

SEQ ID NO: 867087 - RNA, 13 nt, Mycobacterium avium subsp. paratuberculosis
caggugcacccga

SEQ ID NO: 867088 - RNA, 13 nt, Mycobacterium avium subsp. paratuberculosis
caggugcacccgc

SEQ ID NO: 867089 - RNA, 20 nt, Mycobacterium avium subsp. paratuberculosis
caggugcacccgcggcgcga

SEQ ID NO: 867090 - RNA, 17 nt, Mycobacterium avium subsp. paratuberculosis
caggugcacgccgagca

SEQ ID NO: 867091 - RNA, 20 nt, Mycobacterium avium subsp. paratuberculosis
caggugcacgccgagcagca

SEQ ID NO: 867092 - RNA, 22 nt, Mycobacterium avium subsp. paratuberculosis
caggugcacgccgagcagcacc

SEQ ID NO: 867093 - RNA, 23 nt, Mycobacterium avium subsp. paratuberculosis
caggugcacgccgagcagcaccg

SEQ ID NO: 867094 - RNA, 17 nt, Mycobacterium avium subsp. paratuberculosis
caggugcagaccggaca

SEQ ID NO: 867095 - RNA, 18 nt, Mycobacterium avium subsp. paratuberculosis
caggugcauccagucggc

SEQ ID NO: 867096 - RNA, 19 nt, Mycobacterium avium subsp. paratuberculosis
caggugcauccagucggcg

SEQ ID NO: 867097 - RNA, 22 nt, Mycobacterium avium subsp. paratuberculosis
caggugcauccagucggcgccg

SEQ ID NO: 867098 - RNA, 23 nt, Mycobacterium avium subsp. paratuberculosis
caggugcauccagucggcgccga

SEQ ID NO: 867099 - RNA, 18 nt, Mycobacterium avium subsp. paratuberculosis
caggugcaucgaccggcg

SEQ ID NO: 867100 - RNA, 15 nt, Mycobacterium avium subsp. paratuberculosis
caggugccggcggcg

SEQ ID NO: 867101 - RNA, 17 nt, Mycobacterium avium subsp. paratuberculosis
caggugccggcggcgcg

SEQ ID NO: 867102 - RNA, 15 nt, Mycobacterium avium subsp. paratuberculosis
caggugccggugacg

SEQ ID NO: 867103 - RNA, 16 nt, Mycobacterium avium subsp. paratuberculosis
caggugccggugacgg

SEQ ID NO: 867104 - RNA, 22 nt, Mycobacterium avium subsp. paratuberculosis
caggugcggggacagugcgggc

SEQ ID NO: 867105 - RNA, 23 nt, Mycobacterium avium subsp. paratuberculosis
caggugcgcggucagcgcgucca

SEQ ID NO: 867106 - RNA, 22 nt, Mycobacterium avium subsp. paratuberculosis
caggugcgccgccgcgucgccg

SEQ ID NO: 867107 - RNA, 23 nt, Mycobacterium avium subsp. paratuberculosis
caggugcgccgccgcgucgccgc

SEQ ID NO: 867108 - RNA, 22 nt, Mycobacterium avium subsp. paratuberculosis
caggugcgccgcucgucggcca

SEQ ID NO: 867109 - RNA, 13 nt, Mycobacterium avium subsp. paratuberculosis
cagguccaccccg

SEQ ID NO: 867110 - RNA, 23 nt, Mycobacterium avium subsp. paratuberculosis
caggucgcacaccagcacggcgg

SEQ ID NO: 867111 - RNA, 15 nt, Mycobacterium avium subsp. paratuberculosis
caggucgcccggcuc

SEQ ID NO: 867112 - RNA, 22 nt, Mycobacterium avium subsp. paratuberculosis
caggucgcccggcucgccgggc

SEQ ID NO: 867113 - RNA, 15 nt, Mycobacterium avium subsp. paratuberculosis
caggucgccgcgcag

SEQ ID NO: 867114 - RNA, 16 nt, Mycobacterium avium subsp. paratuberculosis
caggucgccgcgcagc

SEQ ID NO: 867115 - RNA, 17 nt, Mycobacterium avium subsp. paratuberculosis
caggucgccggcggccg

SEQ ID NO: 867116 - RNA, 13 nt, Mycobacterium avium subsp. paratuberculosis
cagguccacaccg

SEQ ID NO: 867117 - RNA, 16 nt, Mycobacterium avium subsp. paratuberculosis
cagguccacaccgugg

SEQ ID NO: 867118 - RNA, 15 nt, Mycobacterium avium subsp. paratuberculosis
caggucgggccggcc

SEQ ID NO: 867119 - RNA, 17 nt, Mycobacterium avium subsp. paratuberculosis
caggucgggccggccga

SEQ ID NO: 867120 - RNA, 18 nt, Mycobacterium avium subsp. paratuberculosis
caggucggggcccguccc

SEQ ID NO: 867121 - RNA, 22 nt, Mycobacterium avium subsp. paratuberculosis
caggucggggugggcgacgucg

SEQ ID NO: 867122 - RNA, 20 nt, Mycobacterium avium subsp. paratuberculosis
caggucggugccgcggcgca

SEQ ID NO: 867123 - RNA, 22 nt, Mycobacterium avium subsp. paratuberculosis
caggucgcugcccggcguguag

SEQ ID NO: 867124 - RNA, 20 nt, Mycobacterium avium subsp. paratuberculosis
caggucgcggcgcugcgccg

SEQ ID NO: 867125 - RNA, 11 nt, Mycobacterium avium subsp. paratuberculosis
caggucgcggu

SEQ ID NO: 867126 - RNA, 13 nt, Mycobacterium avium subsp. paratuberculosis
caggucgcgguag

SEQ ID NO: 867127 - RNA, 20 nt, Mycobacterium avium subsp. paratuberculosis
caggucgcugcgcucgccgu

SEQ ID NO: 867128 - RNA, 17 nt, Mycobacterium avium subsp. paratuberculosis
caggucgcggugggcgc

SEQ ID NO: 867129 - RNA, 21 nt, Mycobacterium avium subsp. paratuberculosis
caggucgcggugggcgcgggc

SEQ ID NO: 867130 - RNA, 15 nt, Mycobacterium avium subsp. paratuberculosis
caggugaccggccug

SEQ ID NO: 867131 - RNA, 13 nt, Mycobacterium avium subsp. paratuberculosis
caggugacgccgc

SEQ ID NO: 867132 - RNA, 15 nt, Mycobacterium avium subsp. paratuberculosis
caggugacgccgcac

SEQ ID NO: 867133 - RNA, 17 nt, Mycobacterium avium subsp. paratuberculosis
caggugacgccgcacga

SEQ ID NO: 867134 - RNA, 23 nt, Mycobacterium avium subsp. paratuberculosis
caggugacggauguggucggcca

SEQ ID NO: 867135 - RNA, 20 nt, Mycobacterium avium subsp. paratuberculosis
caggugagccgggugcccgc

SEQ ID NO: 867136 - RNA, 20 nt, Mycobacterium avium subsp. paratuberculosis
caggugaucuugcccagcca

SEQ ID NO: 867137 - RNA, 15 nt, Mycobacterium avium subsp. paratuberculosis
caggucuucggucgc

SEQ ID NO: 867138 - RNA, 20 nt, Mycobacterium avium subsp. paratuberculosis
caggucguucauucagcacc

SEQ ID NO: 867139 - RNA, 17 nt, Mycobacterium avium subsp. paratuberculosis
caggucguugccggugc

SEQ ID NO: 867140 - RNA, 14 nt, Mycobacterium avium subsp. paratuberculosis
caggucgucgauca

SEQ ID NO: 867141 - RNA, 17 nt, Mycobacterium avium subsp. paratuberculosis
caggucgucgucgccgc

SEQ ID NO: 867142 - RNA, 17 nt, Mycobacterium avium subsp. paratuberculosis
caggucguaguaggcgc

SEQ ID NO: 867143 - RNA, 19 nt, Mycobacterium avium subsp. paratuberculosis
caggucguaguaggcgccg

SEQ ID NO: 867144 - RNA, 20 nt, Mycobacterium avium subsp. paratuberculosis
caggucguaguaggcgccga

SEQ ID NO: 867145 - RNA, 22 nt, Mycobacterium avium subsp. paratuberculosis
caggucguaguaggcgccgaac

SEQ ID NO: 867146 - RNA, 13 nt, Mycobacterium avium subsp. paratuberculosis
caggucgucgacg

SEQ ID NO: 867147 - RNA, 15 nt, Mycobacterium avium subsp. paratuberculosis
caggucgucgacguc

SEQ ID NO: 867148 - RNA, 16 nt, Mycobacterium avium subsp. paratuberculosis
caggucgucgacgucc

SEQ ID NO: 867149 - RNA, 17 nt, Mycobacterium avium subsp. paratuberculosis
caggucgucgacgucgc

SEQ ID NO: 867150 - RNA, 15 nt, Mycobacterium avium subsp. paratuberculosis
cagguacacguagcg

SEQ ID NO: 867151 - RNA, 17 nt, Mycobacterium avium subsp. paratuberculosis
cagguaaaccagcagcg

SEQ ID NO: 867152 - RNA, 19 nt, Mycobacterium avium subsp. paratuberculosis
cagguaaaccagcagcgcc

SEQ ID NO: 867153 - RNA, 19 nt, Mycobacterium avium subsp. paratuberculosis
caggguuugggcgugcggc

SEQ ID NO: 867154 - RNA, 18 nt, Mycobacterium avium subsp. paratuberculosis
caggguuuucacgucgag

SEQ ID NO: 867155 - RNA, 22 nt, Mycobacterium avium subsp. paratuberculosis
caggguuuucacgucgagcggc

SEQ ID NO: 867156 - RNA, 22 nt, Mycobacterium avium subsp. paratuberculosis
cagguaggcgaccaugcccagc

SEQ ID NO: 867157 - RNA, 13 nt, Mycobacterium avium subsp. paratuberculosis
cagguaggcgucg

SEQ ID NO: 867158 - RNA, 19 nt, Mycobacterium avium subsp. paratuberculosis
cagguagggcacaccggug

SEQ ID NO: 867159 - RNA, 20 nt, Mycobacterium avium subsp. paratuberculosis
cagguagguggccagccggg

SEQ ID NO: 867160 - RNA, 15 nt, Mycobacterium avium subsp. paratuberculosis
cagguagguggccgu

SEQ ID NO: 867161 - RNA, 16 nt, Mycobacterium avium subsp. paratuberculosis
cagguagguggccguc

SEQ ID NO: 867162 - RNA, 16 nt, Mycobacterium avium subsp. paratuberculosis
cagguacaccaccagg

SEQ ID NO: 867163 - RNA, 18 nt, Mycobacterium avium subsp. paratuberculosis
cagguacagggucaucgc

SEQ ID NO: 867164 - RNA, 17 nt, Mycobacterium avium subsp. paratuberculosis
cagguagcggcugaccg

SEQ ID NO: 867165 - RNA, 20 nt, Mycobacterium avium subsp. paratuberculosis
cagguagcggcugaccgagc

SEQ ID NO: 867166 - RNA, 17 nt, Mycobacterium avium subsp. paratuberculosis
cagguagcggugcucga

SEQ ID NO: 867167 - RNA, 13 nt, Mycobacterium avium subsp. paratuberculosis
cagguaggcggcg

SEQ ID NO: 867168 - RNA, 18 nt, Mycobacterium avium subsp. paratuberculosis
cagguaggcggcgccguc

SEQ ID NO: 867169 - RNA, 23 nt, Mycobacterium avium subsp. paratuberculosis
cagguaguacaggugcagcagca

SEQ ID NO: 867170 - RNA, 19 nt, Mycobacterium avium subsp. paratuberculosis
cagguaguagcgccacauc

SEQ ID NO: 867171 - RNA, 17 nt, Mycobacterium avium subsp. paratuberculosis
cagguaguagcgcgccg

SEQ ID NO: 867172 - RNA, 14 nt, Mycobacterium avium subsp. paratuberculosis
caggucacccuccu

SEQ ID NO: 867173 - RNA, 14 nt, Mycobacterium avium subsp. paratuberculosis
caggucaccgagcg

SEQ ID NO: 867174 - RNA, 12 nt, Mycobacterium avium subsp. paratuberculosis
caggucaccgcg

SEQ ID NO: 867175 - RNA, 13 nt, Mycobacterium avium subsp. paratuberculosis
caggucaccgcgc

SEQ ID NO: 867176 - RNA, 20 nt, Mycobacterium avium subsp. paratuberculosis
caggucaccgcgcgaagucc

SEQ ID NO: 867177 - RNA, 15 nt, Mycobacterium avium subsp. paratuberculosis
caggucaugguggcg

SEQ ID NO: 867178 - RNA, 17 nt, Mycobacterium avium subsp. paratuberculosis
caggucaugguggcggc

SEQ ID NO: 867179 - RNA, 19 nt, Mycobacterium avium subsp. paratuberculosis
caggucaugguggcggcgc

SEQ ID NO: 867180 - RNA, 19 nt, Mycobacterium avium subsp. paratuberculosis
cagguauucaucgcggccg

SEQ ID NO: 867181 - RNA, 14 nt, Mycobacterium avium subsp. paratuberculosis
caggucagccaggu

SEQ ID NO: 867182 - RNA, 23 nt, Mycobacterium avium subsp. paratuberculosis
caggguggccagcaccgcgucga

SEQ ID NO: 867183 - RNA, 18 nt, Mycobacterium avium subsp. paratuberculosis
caggguucucgcggcggc

SEQ ID NO: 867184 - RNA, 21 nt, Mycobacterium avium subsp. paratuberculosis
caggguucucgcggcggccga

SEQ ID NO: 867185 - RNA, 24 nt, Mycobacterium avium subsp. paratuberculosis
caggguucucgcggcggccgacgc

SEQ ID NO: 867186 - RNA, 16 nt, Mycobacterium avium subsp. paratuberculosis
caggguugccgcacga

SEQ ID NO: 867187 - RNA, 19 nt, Mycobacterium avium subsp. paratuberculosis
cagggugcguuccaggucc

SEQ ID NO: 867188 - RNA, 16 nt, Mycobacterium avium subsp. paratuberculosis
cagggugccgacgacc

SEQ ID NO: 867189 - RNA, 11 nt, Mycobacterium avium subsp. paratuberculosis
cagggugccgc

SEQ ID NO: 867190 - RNA, 19 nt, Mycobacterium avium subsp. paratuberculosis
cagggugcgcagcgcgucg

SEQ ID NO: 867191 - RNA, 14 nt, Mycobacterium avium subsp. paratuberculosis
cagggugccgccgc

SEQ ID NO: 867192 - RNA, 15 nt, Mycobacterium avium subsp. paratuberculosis
cagggugccgccggg

SEQ ID NO: 867193 - RNA, 16 nt, Mycobacterium avium subsp. paratuberculosis
cagggugccgccgggc

SEQ ID NO: 867194 - RNA, 14 nt, Mycobacterium avium subsp. paratuberculosis
cagggugccgcugc

SEQ ID NO: 867195 - RNA, 22 nt, Mycobacterium avium subsp. paratuberculosis
cagggugccgcugcccgccgcg

SEQ ID NO: 867196 - RNA, 18 nt, Mycobacterium avium subsp. paratuberculosis
cagggugccgaacagcga

SEQ ID NO: 867197 - RNA, 20 nt, Mycobacterium avium subsp. paratuberculosis
cagggugccgaacagcgacg

SEQ ID NO: 867198 - RNA, 23 nt, Mycobacterium avium subsp. paratuberculosis
cagggugacgauccacagcgcga

SEQ ID NO: 867199 - RNA, 23 nt, Mycobacterium avium subsp. paratuberculosis
cagggugacgcgaaugucgacca

SEQ ID NO: 867200 - RNA, 16 nt, Mycobacterium avium subsp. paratuberculosis
cagggugacguggcgg

SEQ ID NO: 867201 - RNA, 19 nt, Mycobacterium avium subsp. paratuberculosis
cagggugacguggcggccg

SEQ ID NO: 867202 - RNA, 17 nt, Mycobacterium avium subsp. paratuberculosis
cagggccagcgccucgg

SEQ ID NO: 867203 - RNA, 17 nt, Mycobacterium avium subsp. paratuberculosis
cagggcccacagcagcc

SEQ ID NO: 867204 - RNA, 18 nt, Mycobacterium avium subsp. paratuberculosis
cagggcccacagcagccg

SEQ ID NO: 867205 - RNA, 21 nt, Mycobacterium avium subsp. paratuberculosis
cagggugccaaggucgccggu

SEQ ID NO: 867206 - RNA, 12 nt, Mycobacterium avium subsp. paratuberculosis
cagggugccccg

SEQ ID NO: 867207 - RNA, 20 nt, Mycobacterium avium subsp. paratuberculosis
cagggugccccgcaccgcca

SEQ ID NO: 867208 - RNA, 21 nt, Mycobacterium avium subsp. paratuberculosis
cagggugccccgcaccgccag

SEQ ID NO: 867209 - RNA, 19 nt, Mycobacterium avium subsp. paratuberculosis
cagggugccccgcgaccgc

SEQ ID NO: 867210 - RNA, 14 nt, Mycobacterium avium subsp. paratuberculosis
cagggagccgacga

SEQ ID NO: 867211 - RNA, 17 nt, Mycobacterium avium subsp. paratuberculosis
cagggaggacagcaccg

SEQ ID NO: 867212 - RNA, 14 nt, Mycobacterium avium subsp. paratuberculosis
cagggacuccgggg

SEQ ID NO: 867213 - RNA, 14 nt, Mycobacterium avium subsp. paratuberculosis
cagggacaugccga

SEQ ID NO: 867214 - RNA, 18 nt, Mycobacterium avium subsp. paratuberculosis
cagggacaugccgagcag

SEQ ID NO: 867215 - RNA, 23 nt, Mycobacterium avium subsp. paratuberculosis
cagggacaugccgagcagcaccg

SEQ ID NO: 867216 - RNA, 20 nt, Mycobacterium avium subsp. paratuberculosis
cagggccaggccgugaucgg

SEQ ID NO: 867217 - RNA, 14 nt, Mycobacterium avium subsp. paratuberculosis
cagggccagcacca

SEQ ID NO: 867218 - RNA, 14 nt, Mycobacterium avium subsp. paratuberculosis
cagggccagcagcc

SEQ ID NO: 867219 - RNA, 16 nt, Mycobacterium avium subsp. paratuberculosis
cagggccagcagcccg

SEQ ID NO: 867220 - RNA, 14 nt, Mycobacterium avium subsp. paratuberculosis
cagggccagcaaca

SEQ ID NO: 867221 - RNA, 13 nt, Mycobacterium avium subsp. paratuberculosis
cagggccagcggc

SEQ ID NO: 867222 - RNA, 14 nt, Mycobacterium avium subsp. paratuberculosis
cagggccagcggca

SEQ ID NO: 867223 - RNA, 14 nt, Mycobacterium avium subsp. paratuberculosis
cauaucgacggccc

SEQ ID NO: 867224 - RNA, 21 nt, Mycobacterium avium subsp. paratuberculosis
cauaucgacggccccccgggc

SEQ ID NO: 867225 - RNA, 20 nt, Mycobacterium avium subsp. paratuberculosis
cauaucgagguaggccaccg

SEQ ID NO: 867226 - RNA, 15 nt, Mycobacterium avium subsp. paratuberculosis
cauaugcgugggccc

SEQ ID NO: 867227 - RNA, 19 nt, Mycobacterium avium subsp. paratuberculosis
caucaagugcaagggcgac

SEQ ID NO: 867228 - RNA, 19 nt, Mycobacterium avium subsp. paratuberculosis
caucaccagcgcguagagc

SEQ ID NO: 867229 - RNA, 13 nt, Mycobacterium avium subsp. paratuberculosis
caucaccagcggc

SEQ ID NO: 867230 - RNA, 20 nt, Mycobacterium avium subsp. paratuberculosis
caucaaccgauuucggccag

SEQ ID NO: 867231 - RNA, 14 nt, Mycobacterium avium subsp. paratuberculosis
cauagucggcccga

SEQ ID NO: 867232 - RNA, 16 nt, Mycobacterium avium subsp. paratuberculosis
cauaguccagcucgcg

SEQ ID NO: 867233 - RNA, 20 nt, Mycobacterium avium subsp. paratuberculosis
cauaccccccacgcucggcg

SEQ ID NO: 867234 - RNA, 16 nt, Mycobacterium avium subsp. paratuberculosis
cauagcgccgcucggc

SEQ ID NO: 867235 - RNA, 17 nt, Mycobacterium avium subsp. paratuberculosis
cauagcgccgcucggcc

SEQ ID NO: 867236 - RNA, 18 nt, Mycobacterium avium subsp. paratuberculosis
cauagcgccgcucggccg

SEQ ID NO: 867237 - RNA, 15 nt, Mycobacterium avium subsp. paratuberculosis
cauaggccgcgcaga

SEQ ID NO: 867238 - RNA, 16 nt, Mycobacterium avium subsp. paratuberculosis
cauaggccagcaccag

SEQ ID NO: 867239 - RNA, 18 nt, Mycobacterium avium subsp. paratuberculosis
cauaggccagcaccagcg

SEQ ID NO: 867240 - RNA, 18 nt, Mycobacterium avium subsp. paratuberculosis
caguugcgcguugcgcgg

SEQ ID NO: 867241 - RNA, 20 nt, Mycobacterium avium subsp. paratuberculosis
caguugcggccgcuucccac

SEQ ID NO: 867242 - RNA, 17 nt, Mycobacterium avium subsp. paratuberculosis
caguugggggccagcgc

SEQ ID NO: 867243 - RNA, 20 nt, Mycobacterium avium subsp. paratuberculosis
caguugggggccagcgccga

SEQ ID NO: 867244 - RNA, 14 nt, Mycobacterium avium subsp. paratuberculosis
caguugcaccggca

SEQ ID NO: 867245 - RNA, 14 nt, Mycobacterium avium subsp. paratuberculosis
caguugcacggugu

SEQ ID NO: 867246 - RNA, 13 nt, Mycobacterium avium subsp. paratuberculosis
caguugccggcca

SEQ ID NO: 867247 - RNA, 16 nt, Mycobacterium avium subsp. paratuberculosis
caguugcgcggcgggc

SEQ ID NO: 867248 - RNA, 21 nt, Mycobacterium avium subsp. paratuberculosis
caguugcgcggcgggcgagcc

SEQ ID NO: 867249 - RNA, 19 nt, Mycobacterium avium subsp. paratuberculosis
caguugcgaccccgccguc

SEQ ID NO: 867250 - RNA, 21 nt, Mycobacterium avium subsp. paratuberculosis
caguugcgaccccgccgucga

SEQ ID NO: 867251 - RNA, 22 nt, Mycobacterium avium subsp. paratuberculosis
caguugcgaccccgccgucgac

SEQ ID NO: 867252 - RNA, 16 nt, Mycobacterium avium subsp. paratuberculosis
caguuguuggccgggc

SEQ ID NO: 867253 - RNA, 13 nt, Mycobacterium avium subsp. paratuberculosis
caucgaaccgccg

SEQ ID NO: 867254 - RNA, 22 nt, Mycobacterium avium subsp. paratuberculosis
caucgaaccgccgcgcucgcac

SEQ ID NO: 867255 - RNA, 17 nt, Mycobacterium avium subsp. paratuberculosis
cauccugucauccgucg

SEQ ID NO: 867256 - RNA, 14 nt, Mycobacterium avium subsp. paratuberculosis
caucgacaugcccg

SEQ ID NO: 867257 - RNA, 17 nt, Mycobacterium avium subsp. paratuberculosis
caucgacaugcccggcg

SEQ ID NO: 867258 - RNA, 18 nt, Mycobacterium avium subsp. paratuberculosis
caucgacaugcccggcga

SEQ ID NO: 867259 - RNA, 16 nt, Mycobacterium avium subsp. paratuberculosis
caucgaaugcagcggc

SEQ ID NO: 867260 - RNA, 14 nt, Mycobacterium avium subsp. paratuberculosis
cauccucggcgcgu

SEQ ID NO: 867261 - RNA, 15 nt, Mycobacterium avium subsp. paratuberculosis
cauccugggcgucga

SEQ ID NO: 867262 - RNA, 17 nt, Mycobacterium avium subsp. paratuberculosis
cauccugggcgucgagu

SEQ ID NO: 867263 - RNA, 15 nt, Mycobacterium avium subsp. paratuberculosis
cauccgcggccaccg

SEQ ID NO: 867264 - RNA, 16 nt, Mycobacterium avium subsp. paratuberculosis
cauccgcggccaccgg

SEQ ID NO: 867265 - RNA, 17 nt, Mycobacterium avium subsp. paratuberculosis
cauccgcucgccgcggg

SEQ ID NO: 867266 - RNA, 17 nt, Mycobacterium avium subsp. paratuberculosis
cauccgcuggugcgcgc

SEQ ID NO: 867267 - RNA, 18 nt, Mycobacterium avium subsp. paratuberculosis
cauccgcuggugcgcgcc

SEQ ID NO: 867268 - RNA, 18 nt, Mycobacterium avium subsp. paratuberculosis
cauccggaacacgugauc

SEQ ID NO: 867269 - RNA, 18 nt, Mycobacterium avium subsp. paratuberculosis
cauccggaaccgggcacc

SEQ ID NO: 867270 - RNA, 17 nt, Mycobacterium avium subsp. paratuberculosis
cauccgcgagccgagcc

SEQ ID NO: 867271 - RNA, 13 nt, Mycobacterium avium subsp. paratuberculosis
cauccgcgcgagc

SEQ ID NO: 867272 - RNA, 16 nt, Mycobacterium avium subsp. paratuberculosis
cauccgcgcgagcgcg

SEQ ID NO: 867273 - RNA, 20 nt, Mycobacterium avium subsp. paratuberculosis
cauccgcgacgacaccaccg

SEQ ID NO: 867274 - RNA, 14 nt, Mycobacterium avium subsp. paratuberculosis
cauccgcgacgcca

SEQ ID NO: 867275 - RNA, 17 nt, Mycobacterium avium subsp. paratuberculosis
cauccgccgggcggcgu

SEQ ID NO: 867276 - RNA, 14 nt, Mycobacterium avium subsp. paratuberculosis
cauccgccgucgac

SEQ ID NO: 867277 - RNA, 19 nt, Mycobacterium avium subsp. paratuberculosis
cauccgccgucgaccacga

SEQ ID NO: 867278 - RNA, 14 nt, Mycobacterium avium subsp. paratuberculosis
caucgccccggaga

SEQ ID NO: 867279 - RNA, 15 nt, Mycobacterium avium subsp. paratuberculosis
caucgccccggcgac

SEQ ID NO: 867280 - RNA, 16 nt, Mycobacterium avium subsp. paratuberculosis
caucgccccggcgacg

SEQ ID NO: 867281 - RNA, 14 nt, Mycobacterium avium subsp. paratuberculosis
caucgcccagccgg

SEQ ID NO: 867282 - RNA, 16 nt, Mycobacterium avium subsp. paratuberculosis
caucgcccagccggcg

SEQ ID NO: 867283 - RNA, 18 nt, Mycobacterium avium subsp. paratuberculosis
caucgcccagccggcgga

SEQ ID NO: 867284 - RNA, 17 nt, Mycobacterium avium subsp. paratuberculosis
caucgcccagcgcagcg

SEQ ID NO: 867285 - RNA, 16 nt, Mycobacterium avium subsp. paratuberculosis
caucgccaaggcgcug

SEQ ID NO: 867286 - RNA, 13 nt, Mycobacterium avium subsp. paratuberculosis
caucgcaccgcga

SEQ ID NO: 867287 - RNA, 17 nt, Mycobacterium avium subsp. paratuberculosis
caucgcagcgcgcggcg

SEQ ID NO: 867288 - RNA, 16 nt, Mycobacterium avium subsp. paratuberculosis
caucgauggcggugug

SEQ ID NO: 867289 - RNA, 16 nt, Mycobacterium avium subsp. paratuberculosis
caucgaguaggcccag

SEQ ID NO: 867290 - RNA, 15 nt, Mycobacterium avium subsp. paratuberculosis
caucgaggaccggcg

SEQ ID NO: 867291 - RNA, 20 nt, Mycobacterium avium subsp. paratuberculosis
caucgaggaccggcgccggc

SEQ ID NO: 867292 - RNA, 14 nt, Mycobacterium avium subsp. paratuberculosis
caucgaggcgauca

SEQ ID NO: 867293 - RNA, 23 nt, Mycobacterium avium subsp. paratuberculosis
caucgagcugcaacgcgucggcg

SEQ ID NO: 867294 - RNA, 20 nt, Mycobacterium avium subsp. paratuberculosis
caucgaccggcggaaguagc

SEQ ID NO: 867295 - RNA, 22 nt, Mycobacterium avium subsp. paratuberculosis
caucaugcguuugccgucgagg

SEQ ID NO: 867296 - RNA, 22 nt, Mycobacterium avium subsp. paratuberculosis
caucaucgcuacaccccaccgg

SEQ ID NO: 867297 - RNA, 16 nt, Mycobacterium avium subsp. paratuberculosis
caucaucucggcgaag

SEQ ID NO: 867298 - RNA, 16 nt, Mycobacterium avium subsp. paratuberculosis
caucaccgcaccgacg

SEQ ID NO: 867299 - RNA, 17 nt, Mycobacterium avium subsp. paratuberculosis
caucaccgcaccgacga

SEQ ID NO: 867300 - RNA, 15 nt, Mycobacterium avium subsp. paratuberculosis
caucacccggcgcgc

SEQ ID NO: 867301 - RNA, 16 nt, Mycobacterium avium subsp. paratuberculosis
caucacccggcgcgcg

SEQ ID NO: 867302 - RNA, 17 nt, Mycobacterium avium subsp. paratuberculosis
caucacccggcgcgcgg

SEQ ID NO: 867303 - RNA, 13 nt, Mycobacterium avium subsp. paratuberculosis
caucacccggcgg

SEQ ID NO: 867304 - RNA, 20 nt, Mycobacterium avium subsp. paratuberculosis
caucaccagcggcugcagca

SEQ ID NO: 867305 - RNA, 20 nt, Mycobacterium avium subsp. paratuberculosis
caucagugcggcccgccggg

SEQ ID NO: 867306 - RNA, 20 nt, Mycobacterium avium subsp. paratuberculosis
caucaccgcgggcgcgccgu

SEQ ID NO: 867307 - RNA, 13 nt, Mycobacterium avium subsp. paratuberculosis
caucaccgccgag

SEQ ID NO: 867308 - RNA, 14 nt, Mycobacterium avium subsp. paratuberculosis
caucaccggaccgg

SEQ ID NO: 867309 - RNA, 20 nt, Mycobacterium avium subsp. paratuberculosis
caucaccgaggucaccgcga

SEQ ID NO: 867310 - RNA, 13 nt, Mycobacterium avium subsp. paratuberculosis
cauccacucgggc

SEQ ID NO: 867311 - RNA, 18 nt, Mycobacterium avium subsp. paratuberculosis
cauccagaugcccagcag

SEQ ID NO: 867312 - RNA, 17 nt, Mycobacterium avium subsp. paratuberculosis
cauccccagcacgguga

SEQ ID NO: 867313 - RNA, 17 nt, Mycobacterium avium subsp. paratuberculosis
cauccccgcggccaccc

SEQ ID NO: 867314 - RNA, 16 nt, Mycobacterium avium subsp. paratuberculosis
cauccccgcguuggcc

SEQ ID NO: 867315 - RNA, 18 nt, Mycobacterium avium subsp. paratuberculosis
cauccccaggauggccgc

SEQ ID NO: 867316 - RNA, 19 nt, Mycobacterium avium subsp. paratuberculosis
cauccccaggauggccgcu

SEQ ID NO: 867317 - RNA, 22 nt, Mycobacterium avium subsp. paratuberculosis
cauccagccgugggugucggcg

SEQ ID NO: 867318 - RNA, 17 nt, Mycobacterium avium subsp. paratuberculosis
cauccagcgccgcagcg

SEQ ID NO: 867319 - RNA, 15 nt, Mycobacterium avium subsp. paratuberculosis
cauccagcgccgcca

SEQ ID NO: 867320 - RNA, 17 nt, Mycobacterium avium subsp. paratuberculosis
cauccagcgccgccaac

SEQ ID NO: 867321 - RNA, 20 nt, Mycobacterium avium subsp. paratuberculosis
caucccgcaauugcgccagc

SEQ ID NO: 867322 - RNA, 12 nt, Mycobacterium avium subsp. paratuberculosis
caucccgccgac

SEQ ID NO: 867323 - RNA, 15 nt, Mycobacterium avium subsp. paratuberculosis
caucccgccgaccca

SEQ ID NO: 867324 - RNA, 13 nt, Mycobacterium avium subsp. paratuberculosis
caucccgccgccg

SEQ ID NO: 867325 - RNA, 20 nt, Mycobacterium avium subsp. paratuberculosis
caucccgccgggcaucucgu

SEQ ID NO: 867326 - RNA, 19 nt, Mycobacterium avium subsp. paratuberculosis
caucccgcuucuggcgggc

SEQ ID NO: 867327 - RNA, 21 nt, Mycobacterium avium subsp. paratuberculosis
caucccgcuucuggcgggcga

SEQ ID NO: 867328 - RNA, 19 nt, Mycobacterium avium subsp. paratuberculosis
cauccccuuggugcggucg

SEQ ID NO: 867329 - RNA, 12 nt, Mycobacterium avium subsp. paratuberculosis
caucccgauccg

SEQ ID NO: 867330 - RNA, 22 nt, Mycobacterium avium subsp. paratuberculosis
caucccgaucgacgucagcucc

SEQ ID NO: 867331 - RNA, 16 nt, Mycobacterium avium subsp. paratuberculosis
caucccgaugucggcg

SEQ ID NO: 867332 - RNA, 23 nt, Mycobacterium avium subsp. paratuberculosis
caucccggagaacaucagccccu

SEQ ID NO: 867333 - RNA, 13 nt, Mycobacterium avium subsp. paratuberculosis
caucccggccacc

SEQ ID NO: 867334 - RNA, 16 nt, Mycobacterium avium subsp. paratuberculosis
caucccggccaccccg

SEQ ID NO: 867335 - RNA, 12 nt, Mycobacterium avium subsp. paratuberculosis
cauccgccgacg

SEQ ID NO: 867336 - RNA, 13 nt, Mycobacterium avium subsp. paratuberculosis
cauccgccgacga

SEQ ID NO: 867337 - RNA, 19 nt, Mycobacterium avium subsp. paratuberculosis
caggccaggugcagcugca

SEQ ID NO: 867338 - RNA, 16 nt, Mycobacterium avium subsp. paratuberculosis
caggccagcaccuggc

SEQ ID NO: 867339 - RNA, 17 nt, Mycobacterium avium subsp. paratuberculosis
caggcccucaucgucga

SEQ ID NO: 867340 - RNA, 18 nt, Mycobacterium avium subsp. paratuberculosis
caggcccucaucgucgac

SEQ ID NO: 867341 - RNA, 19 nt, Mycobacterium avium subsp. paratuberculosis
caggcccucaucgucgacc

SEQ ID NO: 867342 - RNA, 16 nt, Mycobacterium avium subsp. paratuberculosis
caggcccgggcggcga

SEQ ID NO: 867343 - RNA, 13 nt, Mycobacterium avium subsp. paratuberculosis
caggcccggguag

SEQ ID NO: 867344 - RNA, 23 nt, Mycobacterium avium subsp. paratuberculosis
caggcccgguugagugcgccgug

SEQ ID NO: 867345 - RNA, 18 nt, Mycobacterium avium subsp. paratuberculosis
caggcccagcgaggcggc

SEQ ID NO: 867346 - RNA, 23 nt, Mycobacterium avium subsp. paratuberculosis
caggcccagcgaggcggccagcg

SEQ ID NO: 867347 - RNA, 16 nt, Mycobacterium avium subsp. paratuberculosis
caggcccuugccccac

SEQ ID NO: 867348 - RNA, 21 nt, Mycobacterium avium subsp. paratuberculosis
caggcccuugccccaccaccg

SEQ ID NO: 867349 - RNA, 16 nt, Mycobacterium avium subsp. paratuberculosis
caggcccugccagcgc

SEQ ID NO: 867350 - RNA, 17 nt, Mycobacterium avium subsp. paratuberculosis
caggcccugccagcgcc

SEQ ID NO: 867351 - RNA, 20 nt, Mycobacterium avium subsp. paratuberculosis
caggcccugccagcgcccgc

SEQ ID NO: 867352 - RNA, 13 nt, Mycobacterium avium subsp. paratuberculosis
caggcccucggcc

SEQ ID NO: 867353 - RNA, 14 nt, Mycobacterium avium subsp. paratuberculosis
caggcccucggcca

SEQ ID NO: 867354 - RNA, 14 nt, Mycobacterium avium subsp. paratuberculosis
caggcccucgacgu

SEQ ID NO: 867355 - RNA, 17 nt, Mycobacterium avium subsp. paratuberculosis
caggcccucgccgcggu

SEQ ID NO: 867356 - RNA, 19 nt, Mycobacterium avium subsp. paratuberculosis
caggcccucgucggcgagc

SEQ ID NO: 867357 - RNA, 19 nt, Mycobacterium avium subsp. paratuberculosis
caggaugagcugggcggcg

SEQ ID NO: 867358 - RNA, 22 nt, Mycobacterium avium subsp. paratuberculosis
caggaugagcugggcggcgcgc

SEQ ID NO: 867359 - RNA, 17 nt, Mycobacterium avium subsp. paratuberculosis
caggaucuugucggcgg

SEQ ID NO: 867360 - RNA, 22 nt, Mycobacterium avium subsp. paratuberculosis
caggaugaucuucuccagguug

SEQ ID NO: 867361 - RNA, 19 nt, Mycobacterium avium subsp. paratuberculosis
caggaucuggacgaucggc

SEQ ID NO: 867362 - RNA, 16 nt, Mycobacterium avium subsp. paratuberculosis
caggaugaugaccgac

SEQ ID NO: 867363 - RNA, 13 nt, Mycobacterium avium subsp. paratuberculosis
caggaugcccggg

SEQ ID NO: 867364 - RNA, 13 nt, Mycobacterium avium subsp. paratuberculosis
caggcacagcgaa

SEQ ID NO: 867365 - RNA, 17 nt, Mycobacterium avium subsp. paratuberculosis
caggcacacgaacaccg

SEQ ID NO: 867366 - RNA, 18 nt, Mycobacterium avium subsp. paratuberculosis
caggcaugggaucagcag

SEQ ID NO: 867367 - RNA, 20 nt, Mycobacterium avium subsp. paratuberculosis
caggcaugggaucagcagca

SEQ ID NO: 867368 - RNA, 13 nt, Mycobacterium avium subsp. paratuberculosis
caggccacccggg

SEQ ID NO: 867369 - RNA, 19 nt, Mycobacterium avium subsp. paratuberculosis
caggccacaugggccacgg

SEQ ID NO: 867370 - RNA, 21 nt, Mycobacterium avium subsp. paratuberculosis
caggccacaugggccacggcg

SEQ ID NO: 867371 - RNA, 22 nt, Mycobacterium avium subsp. paratuberculosis
caggccacaugggccacggcgc

SEQ ID NO: 867372 - RNA, 16 nt, Mycobacterium avium subsp. paratuberculosis
caggccacgcaggucc

SEQ ID NO: 867373 - RNA, 21 nt, Mycobacterium avium subsp. paratuberculosis
caggaauaacgccggccccgg

SEQ ID NO: 867374 - RNA, 14 nt, Mycobacterium avium subsp. paratuberculosis
caggaaguagcccu

SEQ ID NO: 867375 - RNA, 17 nt, Mycobacterium avium subsp. paratuberculosis
caggaaguagccggcca

SEQ ID NO: 867376 - RNA, 20 nt, Mycobacterium avium subsp. paratuberculosis
caggaaguaguccagggugu

SEQ ID NO: 867377 - RNA, 18 nt, Mycobacterium avium subsp. paratuberculosis
caggaaguacaccaccgc

SEQ ID NO: 867378 - RNA, 22 nt, Mycobacterium avium subsp. paratuberculosis
caggacaucaagugcaagggcg

SEQ ID NO: 867379 - RNA, 19 nt, Mycobacterium avium subsp. paratuberculosis
caggacccggugcccaccg

SEQ ID NO: 867380 - RNA, 22 nt, Mycobacterium avium subsp. paratuberculosis
caggacccggugcccaccgucu

SEQ ID NO: 867381 - RNA, 15 nt, Mycobacterium avium subsp. paratuberculosis
caggaccgagccgcg

SEQ ID NO: 867382 - RNA, 20 nt, Mycobacterium avium subsp. paratuberculosis
caggaccgagccgcgcgccg

SEQ ID NO: 867383 - RNA, 21 nt, Mycobacterium avium subsp. paratuberculosis
caggaccgagccgcgcgccga

SEQ ID NO: 867384 - RNA, 18 nt, Mycobacterium avium subsp. paratuberculosis
caggacgggggccggugc

SEQ ID NO: 867385 - RNA, 16 nt, Mycobacterium avium subsp. paratuberculosis
caggacgggcaccagu

SEQ ID NO: 867386 - RNA, 12 nt, Mycobacterium avium subsp. paratuberculosis
caggaccaggcc

SEQ ID NO: 867387 - RNA, 18 nt, Mycobacterium avium subsp. paratuberculosis
caggacgucggccggcug

SEQ ID NO: 867388 - RNA, 19 nt, Mycobacterium avium subsp. paratuberculosis
caggacgucggccggcugc

SEQ ID NO: 867389 - RNA, 14 nt, Mycobacterium avium subsp. paratuberculosis
caggaucgcgguga

SEQ ID NO: 867390 - RNA, 16 nt, Mycobacterium avium subsp. paratuberculosis
caggaucgcggugacc

SEQ ID NO: 867391 - RNA, 22 nt, Mycobacterium avium subsp. paratuberculosis
caggaucgcggugaccgccgcc

SEQ ID NO: 867392 - RNA, 14 nt, Mycobacterium avium subsp. paratuberculosis
caggaucggcgggc

SEQ ID NO: 867393 - RNA, 14 nt, Mycobacterium avium subsp. paratuberculosis
caggaugaccgccc

SEQ ID NO: 867394 - RNA, 15 nt, Mycobacterium avium subsp. paratuberculosis
caggaugaccgcguc

SEQ ID NO: 867395 - RNA, 22 nt, Mycobacterium avium subsp. paratuberculosis
caggaugaccgcgucggcgccg

SEQ ID NO: 867396 - RNA, 13 nt, Mycobacterium avium subsp. paratuberculosis
caggaugacgccg

SEQ ID NO: 867397 - RNA, 14 nt, Mycobacterium avium subsp. paratuberculosis
caggaugacgccgc

SEQ ID NO: 867398 - RNA, 16 nt, Mycobacterium avium subsp. paratuberculosis
caggaugacgccgcgg

SEQ ID NO: 867399 - RNA, 21 nt, Mycobacterium avium subsp. paratuberculosis
caggaucucgcgggcccgcgc

SEQ ID NO: 867400 - RNA, 23 nt, Mycobacterium avium subsp. paratuberculosis
caggaucucgcgggcccgcgcgg

SEQ ID NO: 867401 - RNA, 16 nt, Mycobacterium avium subsp. paratuberculosis
caggaucugcagcacg

SEQ ID NO: 867402 - RNA, 14 nt, Mycobacterium avium subsp. paratuberculosis
caggaucugcgcaa

SEQ ID NO: 867403 - RNA, 22 nt, Mycobacterium avium subsp. paratuberculosis
caggaucugcucggcgucgcac

SEQ ID NO: 867404 - RNA, 14 nt, Mycobacterium avium subsp. paratuberculosis
caggagcaccugcg

SEQ ID NO: 867405 - RNA, 19 nt, Mycobacterium avium subsp. paratuberculosis
caggagcaccugcgcgacg

SEQ ID NO: 867406 - RNA, 24 nt, Mycobacterium avium subsp. paratuberculosis
caggagaucggcgcggagcgucgc

SEQ ID NO: 867407 - RNA, 20 nt, Mycobacterium avium subsp. paratuberculosis
caggacgguuucugccggcc

SEQ ID NO: 867408 - RNA, 19 nt, Mycobacterium avium subsp. paratuberculosis
caggacucgggguugaccc

SEQ ID NO: 867409 - RNA, 23 nt, Mycobacterium avium subsp. paratuberculosis
caggacuggaccgugccggaauu

SEQ ID NO: 867410 - RNA, 23 nt, Mycobacterium avium subsp. paratuberculosis
caggaacuggucgaacagcgcgc

SEQ ID NO: 867411 - RNA, 20 nt, Mycobacterium avium subsp. paratuberculosis
caggaagacguaggcggcca

SEQ ID NO: 867412 - RNA, 17 nt, Mycobacterium avium subsp. paratuberculosis
caggaacgggccggcgu

SEQ ID NO: 867413 - RNA, 19 nt, Mycobacterium avium subsp. paratuberculosis
caggaacgggccggcgucc

SEQ ID NO: 867414 - RNA, 23 nt, Mycobacterium avium subsp. paratuberculosis
caggaacggcacccgcagcucca

SEQ ID NO: 867415 - RNA, 14 nt, Mycobacterium avium subsp. paratuberculosis
caggaacggcgcca

SEQ ID NO: 867416 - RNA, 19 nt, Mycobacterium avium subsp. paratuberculosis
caggaacgcgacgguggcg

SEQ ID NO: 867417 - RNA, 18 nt, Mycobacterium avium subsp. paratuberculosis
caggaacgcgcccggcgg

SEQ ID NO: 867418 - RNA, 16 nt, Mycobacterium avium subsp. paratuberculosis
caggaacgcgccggcg

SEQ ID NO: 867419 - RNA, 18 nt, Mycobacterium avium subsp. paratuberculosis
caggaacgcgccggcgca

SEQ ID NO: 867420 - RNA, 15 nt, Mycobacterium avium subsp. paratuberculosis
caggaaaaccagcga

SEQ ID NO: 867421 - RNA, 18 nt, Mycobacterium avium subsp. paratuberculosis
caggaaaaccagcgacgc

SEQ ID NO: 867422 - RNA, 23 nt, Mycobacterium avium subsp. paratuberculosis
cagcuuucgggcggccugccggc

SEQ ID NO: 867423 - RNA, 18 nt, Mycobacterium avium subsp. paratuberculosis
caggaacacggcucgggg

SEQ ID NO: 867424 - RNA, 17 nt, Mycobacterium avium subsp. paratuberculosis
caggaacaaccgcagcg

SEQ ID NO: 867425 - RNA, 18 nt, Mycobacterium avium subsp. paratuberculosis
cagcuugggggccgacgc

SEQ ID NO: 867426 - RNA, 21 nt, Mycobacterium avium subsp. paratuberculosis
cagcuugggggccgacgcuuc

SEQ ID NO: 867427 - RNA, 22 nt, Mycobacterium avium subsp. paratuberculosis
cagcuugggggccgacgcuucg

SEQ ID NO: 867428 - RNA, 23 nt, Mycobacterium avium subsp. paratuberculosis
caggcguucgaccccaacccgaa

SEQ ID NO: 867429 - RNA, 20 nt, Mycobacterium avium subsp. paratuberculosis
caggcguggguuccgccguc

SEQ ID NO: 867430 - RNA, 21 nt, Mycobacterium avium subsp. paratuberculosis
caggcguggguuccgccgucg

SEQ ID NO: 867431 - RNA, 22 nt, Mycobacterium avium subsp. paratuberculosis
caggcguggguuccgccgucga

SEQ ID NO: 867432 - RNA, 16 nt, Mycobacterium avium subsp. paratuberculosis
caggcguggucggcgc

SEQ ID NO: 867433 - RNA, 17 nt, Mycobacterium avium subsp. paratuberculosis
caggcguggucggcgcg

SEQ ID NO: 867434 - RNA, 21 nt, Mycobacterium avium subsp. paratuberculosis
caggcguggucggcgcggucc

SEQ ID NO: 867435 - RNA, 14 nt, Mycobacterium avium subsp. paratuberculosis
caggcgugcacccg

SEQ ID NO: 867436 - RNA, 15 nt, Mycobacterium avium subsp. paratuberculosis
caggcgcugggugcg

SEQ ID NO: 867437 - RNA, 18 nt, Mycobacterium avium subsp. paratuberculosis
caggcgucgucgucgagc

SEQ ID NO: 867438 - RNA, 21 nt, Mycobacterium avium subsp. paratuberculosis
caggcgcucgucgaugcgcgg

SEQ ID NO: 867439 - RNA, 18 nt, Mycobacterium avium subsp. paratuberculosis
caggcgcgcggccagccc

SEQ ID NO: 867440 - RNA, 14 nt, Mycobacterium avium subsp. paratuberculosis
caggcgcgcggcca

SEQ ID NO: 867441 - RNA, 15 nt, Mycobacterium avium subsp. paratuberculosis
caggcgaucucgccg

SEQ ID NO: 867442 - RNA, 22 nt, Mycobacterium avium subsp. paratuberculosis
caggcgcgcacguuggcggcca

SEQ ID NO: 867443 - RNA, 13 nt, Mycobacterium avium subsp. paratuberculosis
caggcgcgcagca

SEQ ID NO: 867444 - RNA, 18 nt, Mycobacterium avium subsp. paratuberculosis
caggcucaggaucagcag

SEQ ID NO: 867445 - RNA, 20 nt, Mycobacterium avium subsp. paratuberculosis
caggcucaggaucagcagcc

SEQ ID NO: 867446 - RNA, 22 nt, Mycobacterium avium subsp. paratuberculosis
caggcucacguagucgaccggg

SEQ ID NO: 867447 - RNA, 18 nt, Mycobacterium avium subsp. paratuberculosis
caggcucgcucccgcgcg

SEQ ID NO: 867448 - RNA, 19 nt, Mycobacterium avium subsp. paratuberculosis
caggcucgcucccgcgcgg

SEQ ID NO: 867449 - RNA, 21 nt, Mycobacterium avium subsp. paratuberculosis
caggcucgcucccgcgcgggc

SEQ ID NO: 867450 - RNA, 22 nt, Mycobacterium avium subsp. paratuberculosis
caggcucgcucccgcgcgggca

SEQ ID NO: 867451 - RNA, 17 nt, Mycobacterium avium subsp. paratuberculosis
caggcugaacaccacca

SEQ ID NO: 867452 - RNA, 14 nt, Mycobacterium avium subsp. paratuberculosis
caggcuggcaucgu

SEQ ID NO: 867453 - RNA, 20 nt, Mycobacterium avium subsp. paratuberculosis
caggcuggcaucgucggcgc

SEQ ID NO: 867454 - RNA, 23 nt, Mycobacterium avium subsp. paratuberculosis
caggcuggcaucgucggcgccgg

SEQ ID NO: 867455 - RNA, 15 nt, Mycobacterium avium subsp. paratuberculosis
caggcuggccagcuc

SEQ ID NO: 867456 - RNA, 20 nt, Mycobacterium avium subsp. paratuberculosis
caggcuggccagcucggcgu

SEQ ID NO: 867457 - RNA, 22 nt, Mycobacterium avium subsp. paratuberculosis
caggcuggccagcucggcgugg

SEQ ID NO: 867458 - RNA, 22 nt, Mycobacterium avium subsp. paratuberculosis
caggcuggccaggcuggcgucg

SEQ ID NO: 867459 - RNA, 16 nt, Mycobacterium avium subsp. paratuberculosis
caggcugcucggcggg

SEQ ID NO: 867460 - RNA, 19 nt, Mycobacterium avium subsp. paratuberculosis
caggcugcucggcgggcuc

SEQ ID NO: 867461 - RNA, 14 nt, Mycobacterium avium subsp. paratuberculosis
caggcuggcggcga

SEQ ID NO: 867462 - RNA, 17 nt, Mycobacterium avium subsp. paratuberculosis
caggcuggcggcgauca

SEQ ID NO: 867463 - RNA, 20 nt, Mycobacterium avium subsp. paratuberculosis
caggcuggcggcgaucaccg

SEQ ID NO: 867464 - RNA, 22 nt, Mycobacterium avium subsp. paratuberculosis
caggcuggcggcgaucaccgcc

SEQ ID NO: 867465 - RNA, 18 nt, Mycobacterium avium subsp. paratuberculosis
caggcuuggcccgccgcc

SEQ ID NO: 867466 - RNA, 19 nt, Mycobacterium avium subsp. paratuberculosis
caggcuuggcccgccgccg

SEQ ID NO: 867467 - RNA, 21 nt, Mycobacterium avium subsp. paratuberculosis
caggcuuggcccgccgccggc

SEQ ID NO: 867468 - RNA, 22 nt, Mycobacterium avium subsp. paratuberculosis
caggcuuggcccgccgccggcg

SEQ ID NO: 867469 - RNA, 23 nt, Mycobacterium avium subsp. paratuberculosis
caggcuuggcccgccgccggcgc

SEQ ID NO: 867470 - RNA, 24 nt, Mycobacterium avium subsp. paratuberculosis
caggcuggcguugggcgggaucgc

SEQ ID NO: 867471 - RNA, 15 nt, Mycobacterium avium subsp. paratuberculosis
caggcuugccccgua

SEQ ID NO: 867472 - RNA, 19 nt, Mycobacterium avium subsp. paratuberculosis
caggcgaacaccucgguga

SEQ ID NO: 867473 - RNA, 19 nt, Mycobacterium avium subsp. paratuberculosis
caggcgaacauggcggcca

SEQ ID NO: 867474 - RNA, 19 nt, Mycobacterium avium subsp. paratuberculosis
caggccuuguacgccccgg

SEQ ID NO: 867475 - RNA, 22 nt, Mycobacterium avium subsp. paratuberculosis
caggccgggauagagcaccgcg

SEQ ID NO: 867476 - RNA, 15 nt, Mycobacterium avium subsp. paratuberculosis
caggccgucggcgcg

SEQ ID NO: 867477 - RNA, 16 nt, Mycobacterium avium subsp. paratuberculosis
caggccgucgaggcgc

SEQ ID NO: 867478 - RNA, 20 nt, Mycobacterium avium subsp. paratuberculosis
caggccguccaccagaucgc

SEQ ID NO: 867479 - RNA, 22 nt, Mycobacterium avium subsp. paratuberculosis
caggccguccaccagaucgccc

SEQ ID NO: 867480 - RNA, 15 nt, Mycobacterium avium subsp. paratuberculosis
caggccguccagcag

SEQ ID NO: 867481 - RNA, 15 nt, Mycobacterium avium subsp. paratuberculosis
caggccgucgccggu

SEQ ID NO: 867482 - RNA, 16 nt, Mycobacterium avium subsp. paratuberculosis
caggccgucgccgguc

SEQ ID NO: 867483 - RNA, 15 nt, Mycobacterium avium subsp. paratuberculosis
caggcgagccgacag

SEQ ID NO: 867484 - RNA, 23 nt, Mycobacterium avium subsp. paratuberculosis
caggcgaguuaugccgucaccca

SEQ ID NO: 867485 - RNA, 15 nt, Mycobacterium avium subsp. paratuberculosis
caggcgacccgcacc

SEQ ID NO: 867486 - RNA, 22 nt, Mycobacterium avium subsp. paratuberculosis
caggcgaccggccccaacggcg

SEQ ID NO: 867487 - RNA, 20 nt, Mycobacterium avium subsp. paratuberculosis
caggcgaaggugggcagcgc

SEQ ID NO: 867488 - RNA, 22 nt, Mycobacterium avium subsp. paratuberculosis
caggcgaaggugggcagcgcca

SEQ ID NO: 867489 - RNA, 23 nt, Mycobacterium avium subsp. paratuberculosis
caggcgaaggugggcagcgccac

SEQ ID NO: 867490 - RNA, 23 nt, Mycobacterium avium subsp. paratuberculosis
caggcgaaguuggucaccaccaa

SEQ ID NO: 867491 - RNA, 17 nt, Mycobacterium avium subsp. paratuberculosis
caggcgaaucggcgcac

SEQ ID NO: 867492 - RNA, 14 nt, Mycobacterium avium subsp. paratuberculosis
caggcgcgccgagc

SEQ ID NO: 867493 - RNA, 12 nt, Mycobacterium avium subsp. paratuberculosis
caggcgaugccg

SEQ ID NO: 867494 - RNA, 16 nt, Mycobacterium avium subsp. paratuberculosis
caggcgaugccgccga

SEQ ID NO: 867495 - RNA, 18 nt, Mycobacterium avium subsp. paratuberculosis
caggcgaugccgccgacg

SEQ ID NO: 867496 - RNA, 17 nt, Mycobacterium avium subsp. paratuberculosis
caggcgaugaagccggc

SEQ ID NO: 867497 - RNA, 20 nt, Mycobacterium avium subsp. paratuberculosis
caggcgaugaagccggcgaa

SEQ ID NO: 867498 - RNA, 14 nt, Mycobacterium avium subsp. paratuberculosis
caggcgagcacccg

SEQ ID NO: 867499 - RNA, 16 nt, Mycobacterium avium subsp. paratuberculosis
caggccgagccgccgg

SEQ ID NO: 867500 - RNA, 14 nt, Mycobacterium avium subsp. paratuberculosis
caggccgagcgcgc

SEQ ID NO: 867501 - RNA, 20 nt, Mycobacterium avium subsp. paratuberculosis
caggccgaugaugaugccgc

SEQ ID NO: 867502 - RNA, 23 nt, Mycobacterium avium subsp. paratuberculosis
caggccgaugaugaugccgccca

SEQ ID NO: 867503 - RNA, 21 nt, Mycobacterium avium subsp. paratuberculosis
caggccggccugccaccgcga

SEQ ID NO: 867504 - RNA, 23 nt, Mycobacterium avium subsp. paratuberculosis
caggccggccugccggaugccgc

SEQ ID NO: 867505 - RNA, 13 nt, Mycobacterium avium subsp. paratuberculosis
caggccggcgacg

SEQ ID NO: 867506 - RNA, 14 nt, Mycobacterium avium subsp. paratuberculosis
caggccggcgacga

SEQ ID NO: 867507 - RNA, 16 nt, Mycobacterium avium subsp. paratuberculosis
caggccggcgagcucg

SEQ ID NO: 867508 - RNA, 21 nt, Mycobacterium avium subsp. paratuberculosis
caggccggccuugcucgccgc

SEQ ID NO: 867509 - RNA, 22 nt, Mycobacterium avium subsp. paratuberculosis
caggccggccuugcucgccgcg

SEQ ID NO: 867510 - RNA, 20 nt, Mycobacterium avium subsp. paratuberculosis
caggccggccgcuacccggc

SEQ ID NO: 867511 - RNA, 23 nt, Mycobacterium avium subsp. paratuberculosis
caggccgaggcugacgaucgucg

SEQ ID NO: 867512 - RNA, 15 nt, Mycobacterium avium subsp. paratuberculosis
caggccgaguauccg

SEQ ID NO: 867513 - RNA, 14 nt, Mycobacterium avium subsp. paratuberculosis
caggccgguggcga

SEQ ID NO: 867514 - RNA, 23 nt, Mycobacterium avium subsp. paratuberculosis
caggccgguggcgacaacaggcg

SEQ ID NO: 867515 - RNA, 18 nt, Mycobacterium avium subsp. paratuberculosis
caggccguagcggcucgc

SEQ ID NO: 867516 - RNA, 20 nt, Mycobacterium avium subsp. paratuberculosis
caggccgggaaugucgcgca

SEQ ID NO: 867517 - RNA, 18 nt, Mycobacterium avium subsp. paratuberculosis
caggccggucacccaggc

SEQ ID NO: 867518 - RNA, 18 nt, Mycobacterium avium subsp. paratuberculosis
caggccggucagcgacga

SEQ ID NO: 867519 - RNA, 14 nt, Mycobacterium avium subsp. paratuberculosis
caggccggcggugg

SEQ ID NO: 867520 - RNA, 20 nt, Mycobacterium avium subsp. paratuberculosis
caggccggcgguggugccgc

SEQ ID NO: 867521 - RNA, 23 nt, Mycobacterium avium subsp. paratuberculosis
caggccggcgguggugccgccgu

SEQ ID NO: 867522 - RNA, 16 nt, Mycobacterium avium subsp. paratuberculosis
caggccggcgccgcgg

SEQ ID NO: 867523 - RNA, 14 nt, Mycobacterium avium subsp. paratuberculosis
caggccggcgccgg

SEQ ID NO: 867524 - RNA, 15 nt, Mycobacterium avium subsp. paratuberculosis
caggccggcgccggg

SEQ ID NO: 867525 - RNA, 22 nt, Mycobacterium avium subsp. paratuberculosis
cagcuucugcagcucgcugagc

SEQ ID NO: 867526 - RNA, 15 nt, Mycobacterium avium subsp. paratuberculosis
cagcuucucggcguc

SEQ ID NO: 867527 - RNA, 16 nt, Mycobacterium avium subsp. paratuberculosis
cagcuucucggcgucc

SEQ ID NO: 867528 - RNA, 17 nt, Mycobacterium avium subsp. paratuberculosis
cagcuucucggcguccc

SEQ ID NO: 867529 - RNA, 14 nt, Mycobacterium avium subsp. paratuberculosis
cagcuugaccaccc

SEQ ID NO: 867530 - RNA, 16 nt, Mycobacterium avium subsp. paratuberculosis
cagcuugaccgugacg

SEQ ID NO: 867531 - RNA, 18 nt, Mycobacterium avium subsp. paratuberculosis
cagcuugaagcccucguc

SEQ ID NO: 867532 - RNA, 20 nt, Mycobacterium avium subsp. paratuberculosis
cagcuugaagcccucgucga

SEQ ID NO: 867533 - RNA, 15 nt, Mycobacterium avium subsp. paratuberculosis
cagcuugccggagcc

SEQ ID NO: 867534 - RNA, 23 nt, Mycobacterium avium subsp. paratuberculosis
cagcuugccggagcccagcuugg

SEQ ID NO: 867535 - RNA, 14 nt, Mycobacterium avium subsp. paratuberculosis
cagcuugaucgccg

SEQ ID NO: 867536 - RNA, 15 nt, Mycobacterium avium subsp. paratuberculosis
cagcuucggcgccga

SEQ ID NO: 867537 - RNA, 19 nt, Mycobacterium avium subsp. paratuberculosis
cagcuuccgccucggcgag

SEQ ID NO: 867538 - RNA, 15 nt, Mycobacterium avium subsp. paratuberculosis
cagcuguugacgggc

SEQ ID NO: 867539 - RNA, 16 nt, Mycobacterium avium subsp. paratuberculosis
cagcuguugacgggcc

SEQ ID NO: 867540 - RNA, 18 nt, Mycobacterium avium subsp. paratuberculosis
cagcuguugacgggccgc

SEQ ID NO: 867541 - RNA, 19 nt, Mycobacterium avium subsp. paratuberculosis
cagcuguugacgggccgcg

SEQ ID NO: 867542 - RNA, 23 nt, Mycobacterium avium subsp. paratuberculosis
cagcuguugacgggccgcggcca

SEQ ID NO: 867543 - RNA, 23 nt, Mycobacterium avium subsp. paratuberculosis
cagcuguugcggcgucagguccg

SEQ ID NO: 867544 - RNA, 14 nt, Mycobacterium avium subsp. paratuberculosis
cagcugcucggcca

SEQ ID NO: 867545 - RNA, 14 nt, Mycobacterium avium subsp. paratuberculosis
cagcugcuccgggg

SEQ ID NO: 867546 - RNA, 23 nt, Mycobacterium avium subsp. paratuberculosis
cagcugcuccgggggcaccgcca

SEQ ID NO: 867547 - RNA, 16 nt, Mycobacterium avium subsp. paratuberculosis
cagcugcgucggcacc

SEQ ID NO: 867548 - RNA, 17 nt, Mycobacterium avium subsp. paratuberculosis
cagcugcgggaccagcg

SEQ ID NO: 867549 - RNA, 23 nt, Mycobacterium avium subsp. paratuberculosis
cagcugcggguugcgggccaggc

SEQ ID NO: 867550 - RNA, 15 nt, Mycobacterium avium subsp. paratuberculosis
cagcugcugcggccg

SEQ ID NO: 867551 - RNA, 17 nt, Mycobacterium avium subsp. paratuberculosis
cagcuggaacaccacgg

SEQ ID NO: 867552 - RNA, 20 nt, Mycobacterium avium subsp. paratuberculosis
cagcuggaacaccacggccg

SEQ ID NO: 867553 - RNA, 22 nt, Mycobacterium avium subsp. paratuberculosis
cagcuggaacaccacggccggc

SEQ ID NO: 867554 - RNA, 15 nt, Mycobacterium avium subsp. paratuberculosis
cagcugcugcgcggc

SEQ ID NO: 867555 - RNA, 15 nt, Mycobacterium avium subsp. paratuberculosis
cagcugcuggcguga

SEQ ID NO: 867556 - RNA, 22 nt, Mycobacterium avium subsp. paratuberculosis
cagcugcuggcugcggccccgg

SEQ ID NO: 867557 - RNA, 23 nt, Mycobacterium avium subsp. paratuberculosis
cagcugcuggcugcggccccggu

SEQ ID NO: 867558 - RNA, 19 nt, Mycobacterium avium subsp. paratuberculosis
cagcugcugggacgggucg

SEQ ID NO: 867559 - RNA, 14 nt, Mycobacterium avium subsp. paratuberculosis
cagcugcgcgucga

SEQ ID NO: 867560 - RNA, 17 nt, Mycobacterium avium subsp. paratuberculosis
cagcugcgcgucggccg

SEQ ID NO: 867561 - RNA, 20 nt, Mycobacterium avium subsp. paratuberculosis
cagcugcgcgggcgcggcca

SEQ ID NO: 867562 - RNA, 13 nt, Mycobacterium avium subsp. paratuberculosis
cagcugcgcgucg

SEQ ID NO: 867563 - RNA, 21 nt, Mycobacterium avium subsp. paratuberculosis
cagcugcggaaaugcccgcgc

SEQ ID NO: 867564 - RNA, 15 nt, Mycobacterium avium subsp. paratuberculosis
cagcugcgcgccggc

SEQ ID NO: 867565 - RNA, 16 nt, Mycobacterium avium subsp. paratuberculosis
cagcugcgcgccggcg

SEQ ID NO: 867566 - RNA, 21 nt, Mycobacterium avium subsp. paratuberculosis
cagcugcgcgccggcggccgc

SEQ ID NO: 867567 - RNA, 14 nt, Mycobacterium avium subsp. paratuberculosis
cagcugcgccgcgu

SEQ ID NO: 867568 - RNA, 17 nt, Mycobacterium avium subsp. paratuberculosis
cagcugcgccgcgucga

SEQ ID NO: 867569 - RNA, 18 nt, Mycobacterium avium subsp. paratuberculosis
cagcugcgccgcgucgac

SEQ ID NO: 867570 - RNA, 19 nt, Mycobacterium avium subsp. paratuberculosis
cagcugcgccgcgucgacg

SEQ ID NO: 867571 - RNA, 14 nt, Mycobacterium avium subsp. paratuberculosis
cagcuggauggcgc

SEQ ID NO: 867572 - RNA, 20 nt, Mycobacterium avium subsp. paratuberculosis
cagcuggauggcgcccagcc

SEQ ID NO: 867573 - RNA, 23 nt, Mycobacterium avium subsp. paratuberculosis
cagcuggagaggcccggcagccg

SEQ ID NO: 867574 - RNA, 20 nt, Mycobacterium avium subsp. paratuberculosis
cagcuggccgugcaccgucg

SEQ ID NO: 867575 - RNA, 16 nt, Mycobacterium avium subsp. paratuberculosis
cagcuggucccacagc

SEQ ID NO: 867576 - RNA, 17 nt, Mycobacterium avium subsp. paratuberculosis
cagcugguccggccggc

SEQ ID NO: 867577 - RNA, 16 nt, Mycobacterium avium subsp. paratuberculosis
cagcuggugaagcugc

SEQ ID NO: 867578 - RNA, 22 nt, Mycobacterium avium subsp. paratuberculosis
cagcuggugaagcugccgacca

SEQ ID NO: 867579 - RNA, 14 nt, Mycobacterium avium subsp. paratuberculosis
cagcuggugcagau

SEQ ID NO: 867580 - RNA, 20 nt, Mycobacterium avium subsp. paratuberculosis
cagcugggcguacugcucgg

SEQ ID NO: 867581 - RNA, 22 nt, Mycobacterium avium subsp. paratuberculosis
cagcugggcguacugcucggcg

SEQ ID NO: 867582 - RNA, 23 nt, Mycobacterium avium subsp. paratuberculosis
cagcugggcguacugcucggcgc

SEQ ID NO: 867583 - RNA, 16 nt, Mycobacterium avium subsp. paratuberculosis
cagcugggccagcgcg

SEQ ID NO: 867584 - RNA, 19 nt, Mycobacterium avium subsp. paratuberculosis
cagcugggcagccagaucu

SEQ ID NO: 867585 - RNA, 15 nt, Mycobacterium avium subsp. paratuberculosis
cagcucgucgccgac

SEQ ID NO: 867586 - RNA, 14 nt, Mycobacterium avium subsp. paratuberculosis
cagcugaacggugc

SEQ ID NO: 867587 - RNA, 15 nt, Mycobacterium avium subsp. paratuberculosis
cagcugaacggugcc

SEQ ID NO: 867588 - RNA, 20 nt, Mycobacterium avium subsp. paratuberculosis
cagcugaacggugcccgccg

SEQ ID NO: 867589 - RNA, 22 nt, Mycobacterium avium subsp. paratuberculosis
cagcugaacggugcccgccgau

SEQ ID NO: 867590 - RNA, 23 nt, Mycobacterium avium subsp. paratuberculosis
cagcugaacggugcccgccgauc

SEQ ID NO: 867591 - RNA, 23 nt, Mycobacterium avium subsp. paratuberculosis
cagcugaagguuguucugcucga

SEQ ID NO: 867592 - RNA, 22 nt, Mycobacterium avium subsp. paratuberculosis
cagcugaagugcacucggcgau

SEQ ID NO: 867593 - RNA, 13 nt, Mycobacterium avium subsp. paratuberculosis
cagcucguggcgg

SEQ ID NO: 867594 - RNA, 21 nt, Mycobacterium avium subsp. paratuberculosis
cagcucguggcgggcccgggc

SEQ ID NO: 867595 - RNA, 18 nt, Mycobacterium avium subsp. paratuberculosis
cagcucguugccggcggc

SEQ ID NO: 867596 - RNA, 20 nt, Mycobacterium avium subsp. paratuberculosis
cagcucguugccggcggcca

SEQ ID NO: 867597 - RNA, 23 nt, Mycobacterium avium subsp. paratuberculosis
cagcucguugccggcggccagca

SEQ ID NO: 867598 - RNA, 22 nt, Mycobacterium avium subsp. paratuberculosis
cagcucguugugaauccagccg

SEQ ID NO: 867599 - RNA, 12 nt, Mycobacterium avium subsp. paratuberculosis
cagcucgucgcg

SEQ ID NO: 867600 - RNA, 15 nt, Mycobacterium avium subsp. paratuberculosis
cagcucgucgcggaa

SEQ ID NO: 867601 - RNA, 21 nt, Mycobacterium avium subsp. paratuberculosis
cagcucgucgcggaacagccg

SEQ ID NO: 867602 - RNA, 23 nt, Mycobacterium avium subsp. paratuberculosis
cagcucgucgcggaacagccggc

SEQ ID NO: 867603 - RNA, 15 nt, Mycobacterium avium subsp. paratuberculosis
cagcucgucgacguc

SEQ ID NO: 867604 - RNA, 13 nt, Mycobacterium avium subsp. paratuberculosis
cagcucgucggcg

SEQ ID NO: 867605 - RNA, 16 nt, Mycobacterium avium subsp. paratuberculosis
cagcucgucggcgcgc

SEQ ID NO: 867606 - RNA, 18 nt, Mycobacterium avium subsp. paratuberculosis
cagcucgucggcgcgcca

SEQ ID NO: 867607 - RNA, 21 nt, Mycobacterium avium subsp. paratuberculosis
cagcucgucggcgcgccaccc

SEQ ID NO: 867608 - RNA, 14 nt, Mycobacterium avium subsp. paratuberculosis
cagcucgucguacu

SEQ ID NO: 867609 - RNA, 16 nt, Mycobacterium avium subsp. paratuberculosis
cagcucgucagcgcgg

SEQ ID NO: 867610 - RNA, 17 nt, Mycobacterium avium subsp. paratuberculosis
cagcucguccagcgugc

SEQ ID NO: 867611 - RNA, 16 nt, Mycobacterium avium subsp. paratuberculosis
cagcucgucgacgucc

SEQ ID NO: 867612 - RNA, 23 nt, Mycobacterium avium subsp. paratuberculosis
cagcucgucgacguccucgcccg

SEQ ID NO: 867613 - RNA, 12 nt, Mycobacterium avium subsp. paratuberculosis
cagcucgucgag

SEQ ID NO: 867614 - RNA, 14 nt, Mycobacterium avium subsp. paratuberculosis
cagcucgucgagcc

SEQ ID NO: 867615 - RNA, 16 nt, Mycobacterium avium subsp. paratuberculosis
cagcucgucgagccgg

SEQ ID NO: 867616 - RNA, 19 nt, Mycobacterium avium subsp. paratuberculosis
cagcucgucgagccggccg

SEQ ID NO: 867617 - RNA, 19 nt, Mycobacterium avium subsp. paratuberculosis
cagcugagcagcccgacca

SEQ ID NO: 867618 - RNA, 19 nt, Mycobacterium avium subsp. paratuberculosis
cagcugacgggccggcggg

SEQ ID NO: 867619 - RNA, 20 nt, Mycobacterium avium subsp. paratuberculosis
cagcugacgggccggcgggg

SEQ ID NO: 867620 - RNA, 23 nt, Mycobacterium avium subsp. paratuberculosis
cagcugacgauucuugaccaccu

SEQ ID NO: 867621 - RNA, 14 nt, Mycobacterium avium subsp. paratuberculosis
cagcugaccggcga

SEQ ID NO: 867622 - RNA, 17 nt, Mycobacterium avium subsp. paratuberculosis
cagcugaccggcgaucg

SEQ ID NO: 867623 - RNA, 19 nt, Mycobacterium avium subsp. paratuberculosis
cagcugaccggcgaucguc

SEQ ID NO: 867624 - RNA, 17 nt, Mycobacterium avium subsp. paratuberculosis
cagcugauagcccgccg

SEQ ID NO: 867625 - RNA, 15 nt, Mycobacterium avium subsp. paratuberculosis
cagcugaucggggcc

SEQ ID NO: 867626 - RNA, 20 nt, Mycobacterium avium subsp. paratuberculosis
cagcugaucggggcccaccc

SEQ ID NO: 867627 - RNA, 22 nt, Mycobacterium avium subsp. paratuberculosis
cagcugaucggggcccaccccg

SEQ ID NO: 867628 - RNA, 20 nt, Mycobacterium avium subsp. paratuberculosis
cagcugauuguugacgguga

SEQ ID NO: 867629 - RNA, 14 nt, Mycobacterium avium subsp. paratuberculosis
cagcugcgacagca

SEQ ID NO: 867630 - RNA, 16 nt, Mycobacterium avium subsp. paratuberculosis
cagcugcgacagcacg

SEQ ID NO: 867631 - RNA, 21 nt, Mycobacterium avium subsp. paratuberculosis
cagcugcgacagcacgggcgg

SEQ ID NO: 867632 - RNA, 16 nt, Mycobacterium avium subsp. paratuberculosis
cagcugcccaccagca

SEQ ID NO: 867633 - RNA, 18 nt, Mycobacterium avium subsp. paratuberculosis
cagcugcccaccagcagg

SEQ ID NO: 867634 - RNA, 16 nt, Mycobacterium avium subsp. paratuberculosis
cagcugcccgccgacg

SEQ ID NO: 867635 - RNA, 13 nt, Mycobacterium avium subsp. paratuberculosis
cagcugcccggag

SEQ ID NO: 867636 - RNA, 14 nt, Mycobacterium avium subsp. paratuberculosis
cagcugcccggagu

SEQ ID NO: 867637 - RNA, 17 nt, Mycobacterium avium subsp. paratuberculosis
cagcugcccggaguccg

SEQ ID NO: 867638 - RNA, 13 nt, Mycobacterium avium subsp. paratuberculosis
cagcugcccgucg

SEQ ID NO: 867639 - RNA, 14 nt, Mycobacterium avium subsp. paratuberculosis
cagcugccgcaccg

SEQ ID NO: 867640 - RNA, 14 nt, Mycobacterium avium subsp. paratuberculosis
cagcugccggccgu

SEQ ID NO: 867641 - RNA, 17 nt, Mycobacterium avium subsp. paratuberculosis
cagcugccggccguugc

SEQ ID NO: 867642 - RNA, 19 nt, Mycobacterium avium subsp. paratuberculosis
cagcugccguccggguccg

SEQ ID NO: 867643 - RNA, 18 nt, Mycobacterium avium subsp. paratuberculosis
cagcugcacccaccggcc

SEQ ID NO: 867644 - RNA, 22 nt, Mycobacterium avium subsp. paratuberculosis
cagcugcacccgcuccaccgaa

SEQ ID NO: 867645 - RNA, 13 nt, Mycobacterium avium subsp. paratuberculosis
cagcugcaccggg

SEQ ID NO: 867646 - RNA, 16 nt, Mycobacterium avium subsp. paratuberculosis
cagcugcaccggggcc

SEQ ID NO: 867647 - RNA, 14 nt, Mycobacterium avium subsp. paratuberculosis
cagcugcagccggc

SEQ ID NO: 867648 - RNA, 17 nt, Mycobacterium avium subsp. paratuberculosis
cagcugcagccggccgg

SEQ ID NO: 867649 - RNA, 22 nt, Mycobacterium avium subsp. paratuberculosis
cagcugcagcuccucggcggcc

SEQ ID NO: 867650 - RNA, 21 nt, Mycobacterium avium subsp. paratuberculosis
cagcugcaucuccguggacgg

SEQ ID NO: 867651 - RNA, 18 nt, Mycobacterium avium subsp. paratuberculosis
cagcugcauggacagcga

SEQ ID NO: 867652 - RNA, 16 nt, Mycobacterium avium subsp. paratuberculosis
cagcucgcgcagcugg

SEQ ID NO: 867653 - RNA, 19 nt, Mycobacterium avium subsp. paratuberculosis
cagcucgaggccgcgggcg

SEQ ID NO: 867654 - RNA, 17 nt, Mycobacterium avium subsp. paratuberculosis
cagcucgcgcaucagcg

SEQ ID NO: 867655 - RNA, 23 nt, Mycobacterium avium subsp. paratuberculosis
cagcucgcgggccugcucgucgg

SEQ ID NO: 867656 - RNA, 18 nt, Mycobacterium avium subsp. paratuberculosis
cagcucgcugaucagcuc

SEQ ID NO: 867657 - RNA, 23 nt, Mycobacterium avium subsp. paratuberculosis
cagcucgcugaucagcucuucga

SEQ ID NO: 867658 - RNA, 16 nt, Mycobacterium avium subsp. paratuberculosis
cagcucgagcaucacg

SEQ ID NO: 867659 - RNA, 17 nt, Mycobacterium avium subsp. paratuberculosis
cagcucgagcaucacga

SEQ ID NO: 867660 - RNA, 15 nt, Mycobacterium avium subsp. paratuberculosis
cagcucgaucgccgc

SEQ ID NO: 867661 - RNA, 21 nt, Mycobacterium avium subsp. paratuberculosis
cagcucgacgaccucgccgac

SEQ ID NO: 867662 - RNA, 16 nt, Mycobacterium avium subsp. paratuberculosis
cagcucgacgacuucg

SEQ ID NO: 867663 - RNA, 22 nt, Mycobacterium avium subsp. paratuberculosis
cagcucgacgacuucggccucg

SEQ ID NO: 867664 - RNA, 20 nt, Mycobacterium avium subsp. paratuberculosis
cagcucgauggugccgucgg

SEQ ID NO: 867665 - RNA, 22 nt, Mycobacterium avium subsp. paratuberculosis
cagcucgauggugccgucggcg

SEQ ID NO: 867666 - RNA, 12 nt, Mycobacterium avium subsp. paratuberculosis
cagcucgccgau

SEQ ID NO: 867667 - RNA, 23 nt, Mycobacterium avium subsp. paratuberculosis
cagcucgccgaugucggccgguc

SEQ ID NO: 867668 - RNA, 16 nt, Mycobacterium avium subsp. paratuberculosis
cagcucgccgccgacg

SEQ ID NO: 867669 - RNA, 14 nt, Mycobacterium avium subsp. paratuberculosis
cagcucgcccagca

SEQ ID NO: 867670 - RNA, 17 nt, Mycobacterium avium subsp. paratuberculosis
cagcucgcccagcaccg

SEQ ID NO: 867671 - RNA, 12 nt, Mycobacterium avium subsp. paratuberculosis
cagcucgccggc

SEQ ID NO: 867672 - RNA, 19 nt, Mycobacterium avium subsp. paratuberculosis
cagcucgccggccgcgggc

SEQ ID NO: 867673 - RNA, 16 nt, Mycobacterium avium subsp. paratuberculosis
cagcucgccggcgcgc

SEQ ID NO: 867674 - RNA, 14 nt, Mycobacterium avium subsp. paratuberculosis
cagcucgccggugg

SEQ ID NO: 867675 - RNA, 17 nt, Mycobacterium avium subsp. paratuberculosis
cagcucgccgguggcgg

SEQ ID NO: 867676 - RNA, 12 nt, Mycobacterium avium subsp. paratuberculosis
cagcucgccguc

SEQ ID NO: 867677 - RNA, 20 nt, Mycobacterium avium subsp. paratuberculosis
cagcucgccguccgggaaca

SEQ ID NO: 867678 - RNA, 17 nt, Mycobacterium avium subsp. paratuberculosis
cagcucgcgaagcgcga

SEQ ID NO: 867679 - RNA, 19 nt, Mycobacterium avium subsp. paratuberculosis
cagcucgcgaagcgcgaug

SEQ ID NO: 867680 - RNA, 21 nt, Mycobacterium avium subsp. paratuberculosis
cagcucgcgaagcgcgaugcg

SEQ ID NO: 867681 - RNA, 20 nt, Mycobacterium avium subsp. paratuberculosis
cagcucggugcagaccccgg

SEQ ID NO: 867682 - RNA, 16 nt, Mycobacterium avium subsp. paratuberculosis
cagcucggugcgcaug

SEQ ID NO: 867683 - RNA, 22 nt, Mycobacterium avium subsp. paratuberculosis
cagcucggugcgcauggcgugc

SEQ ID NO: 867684 - RNA, 15 nt, Mycobacterium avium subsp. paratuberculosis
cagcucgguggccgg

SEQ ID NO: 867685 - RNA, 17 nt, Mycobacterium avium subsp. paratuberculosis
cagcucgguggcgucgg

SEQ ID NO: 867686 - RNA, 20 nt, Mycobacterium avium subsp. paratuberculosis
cagcucgguggcgucggcgg

SEQ ID NO: 867687 - RNA, 15 nt, Mycobacterium avium subsp. paratuberculosis
cagcucggucgcggu

SEQ ID NO: 867688 - RNA, 17 nt, Mycobacterium avium subsp. paratuberculosis
cagcucggucgcggucg

SEQ ID NO: 867689 - RNA, 21 nt, Mycobacterium avium subsp. paratuberculosis
cagcucggucgcggucggcgc

SEQ ID NO: 867690 - RNA, 22 nt, Mycobacterium avium subsp. paratuberculosis
cagcucggucgcggucggcgcc

SEQ ID NO: 867691 - RNA, 20 nt, Mycobacterium avium subsp. paratuberculosis
cagcucggugaucaccauga

SEQ ID NO: 867692 - RNA, 23 nt, Mycobacterium avium subsp. paratuberculosis
cagcucggugaucugcaccagcg

SEQ ID NO: 867693 - RNA, 13 nt, Mycobacterium avium subsp. paratuberculosis
cagcucggcgugg

SEQ ID NO: 867694 - RNA, 21 nt, Mycobacterium avium subsp. paratuberculosis
cagcucgggguaguucagcgc

SEQ ID NO: 867695 - RNA, 17 nt, Mycobacterium avium subsp. paratuberculosis
cagcucggggucggcgu

SEQ ID NO: 867696 - RNA, 13 nt, Mycobacterium avium subsp. paratuberculosis
cagcucggucacc

SEQ ID NO: 867697 - RNA, 18 nt, Mycobacterium avium subsp. paratuberculosis
cagcucggucaccagcgg

SEQ ID NO: 867698 - RNA, 20 nt, Mycobacterium avium subsp. paratuberculosis
cagcucggucaccagcggcc

SEQ ID NO: 867699 - RNA, 22 nt, Mycobacterium avium subsp. paratuberculosis
cagcucggucaccagcggcccg

SEQ ID NO: 867700 - RNA, 19 nt, Mycobacterium avium subsp. paratuberculosis
cagcucggucagccgggcg

SEQ ID NO: 867701 - RNA, 15 nt, Mycobacterium avium subsp. paratuberculosis
cagcucggcggccgg

SEQ ID NO: 867702 - RNA, 14 nt, Mycobacterium avium subsp. paratuberculosis
cagcucggcggccu

SEQ ID NO: 867703 - RNA, 12 nt, Mycobacterium avium subsp. paratuberculosis
cagcucggcggc

SEQ ID NO: 867704 - RNA, 14 nt, Mycobacterium avium subsp. paratuberculosis
cagcucggcggcca

SEQ ID NO: 867705 - RNA, 19 nt, Mycobacterium avium subsp. paratuberculosis
cagcucggcggcccgccgg

SEQ ID NO: 867706 - RNA, 17 nt, Mycobacterium avium subsp. paratuberculosis
cagcucggcgaucaccg

SEQ ID NO: 867707 - RNA, 20 nt, Mycobacterium avium subsp. paratuberculosis
cagcucggcgaucaccgcgu

SEQ ID NO: 867708 - RNA, 17 nt, Mycobacterium avium subsp. paratuberculosis
cagcucggccauccccg

SEQ ID NO: 867709 - RNA, 16 nt, Mycobacterium avium subsp. paratuberculosis
cagcucauacagcggc

SEQ ID NO: 867710 - RNA, 23 nt, Mycobacterium avium subsp. paratuberculosis
cagcucaccggccagggccgccg

SEQ ID NO: 867711 - RNA, 13 nt, Mycobacterium avium subsp. paratuberculosis
cagcucaccggga

SEQ ID NO: 867712 - RNA, 17 nt, Mycobacterium avium subsp. paratuberculosis
cagcucaggaacggccg

SEQ ID NO: 867713 - RNA, 18 nt, Mycobacterium avium subsp. paratuberculosis
cagcucaggaacggccgg

SEQ ID NO: 867714 - RNA, 17 nt, Mycobacterium avium subsp. paratuberculosis
cagcucccccgacaccg

SEQ ID NO: 867715 - RNA, 22 nt, Mycobacterium avium subsp. paratuberculosis
cagcucccccgacaccgccagc

SEQ ID NO: 867716 - RNA, 15 nt, Mycobacterium avium subsp. paratuberculosis
cagcucccccggcgu

SEQ ID NO: 867717 - RNA, 17 nt, Mycobacterium avium subsp. paratuberculosis
cagcucccccggcguga

SEQ ID NO: 867718 - RNA, 13 nt, Mycobacterium avium subsp. paratuberculosis
cagcucccccguc

SEQ ID NO: 867719 - RNA, 13 nt, Mycobacterium avium subsp. paratuberculosis
cagcuccaccugc

SEQ ID NO: 867720 - RNA, 19 nt, Mycobacterium avium subsp. paratuberculosis
cagcuccaccugcggcacc

SEQ ID NO: 867721 - RNA, 23 nt, Mycobacterium avium subsp. paratuberculosis
cagcuccaccugcggcaccucgg

SEQ ID NO: 867722 - RNA, 20 nt, Mycobacterium avium subsp. paratuberculosis
cagcucauguggggggucgg

SEQ ID NO: 867723 - RNA, 21 nt, Mycobacterium avium subsp. paratuberculosis
cagcuccggucggcgcucgcg

SEQ ID NO: 867724 - RNA, 17 nt, Mycobacterium avium subsp. paratuberculosis
cagcuccguccaccggc

SEQ ID NO: 867725 - RNA, 20 nt, Mycobacterium avium subsp. paratuberculosis
cagcuccguccaccggcacg

SEQ ID NO: 867726 - RNA, 23 nt, Mycobacterium avium subsp. paratuberculosis
cagcuccguccaccggcacggca

SEQ ID NO: 867727 - RNA, 19 nt, Mycobacterium avium subsp. paratuberculosis
cagcucccgagcaucgccg

SEQ ID NO: 867728 - RNA, 17 nt, Mycobacterium avium subsp. paratuberculosis
cagcucccgggcggcgc

SEQ ID NO: 867729 - RNA, 18 nt, Mycobacterium avium subsp. paratuberculosis
cagcucccgggcggcgcc

SEQ ID NO: 867730 - RNA, 20 nt, Mycobacterium avium subsp. paratuberculosis
cagcucccgggcggcgccga

SEQ ID NO: 867731 - RNA, 19 nt, Mycobacterium avium subsp. paratuberculosis
cagcuccgccacccugcgc

SEQ ID NO: 867732 - RNA, 20 nt, Mycobacterium avium subsp. paratuberculosis
cagcuccgccacccugcgca

SEQ ID NO: 867733 - RNA, 16 nt, Mycobacterium avium subsp. paratuberculosis
cagcuccgccgacacc

SEQ ID NO: 867734 - RNA, 17 nt, Mycobacterium avium subsp. paratuberculosis
cagcuccgccgacacca

SEQ ID NO: 867735 - RNA, 17 nt, Mycobacterium avium subsp. paratuberculosis
cagcuccgcggccagcu

SEQ ID NO: 867736 - RNA, 24 nt, Mycobacterium avium subsp. paratuberculosis
cagcuccgcggccagcucggucgc

SEQ ID NO: 867737 - RNA, 19 nt, Mycobacterium avium subsp. paratuberculosis
cagcuccggcaacgaggcc

SEQ ID NO: 867738 - RNA, 24 nt, Mycobacterium avium subsp. paratuberculosis
cagcuccggcaacgaggccagggc

SEQ ID NO: 867739 - RNA, 17 nt, Mycobacterium avium subsp. paratuberculosis
cagcucgaccagccggg

SEQ ID NO: 867740 - RNA, 20 nt, Mycobacterium avium subsp. paratuberculosis
cagcucgaccagccgggucc

SEQ ID NO: 867741 - RNA, 15 nt, Mycobacterium avium subsp. paratuberculosis
cagcucgaccgcggc

SEQ ID NO: 867742 - RNA, 17 nt, Mycobacterium avium subsp. paratuberculosis
cagcucgaccgcggcga

SEQ ID NO: 867743 - RNA, 14 nt, Mycobacterium avium subsp. paratuberculosis
cagcucgaaggugc

SEQ ID NO: 867744 - RNA, 19 nt, Mycobacterium avium subsp. paratuberculosis
cagcucgaaggugcccgca

SEQ ID NO: 867745 - RNA, 22 nt, Mycobacterium avium subsp. paratuberculosis
cagcucgaaggugcccgcaucg

SEQ ID NO: 867746 - RNA, 13 nt, Mycobacterium avium subsp. paratuberculosis
cagcuccucggcc

SEQ ID NO: 867747 - RNA, 16 nt, Mycobacterium avium subsp. paratuberculosis
cagcuccucggcccca

SEQ ID NO: 867748 - RNA, 14 nt, Mycobacterium avium subsp. paratuberculosis
cagcuccucggcgg

SEQ ID NO: 867749 - RNA, 15 nt, Mycobacterium avium subsp. paratuberculosis
cagcuccucggcggc

SEQ ID NO: 867750 - RNA, 22 nt, Mycobacterium avium subsp. paratuberculosis
cagcuccucggggaugacgguc

SEQ ID NO: 867751 - RNA, 20 nt, Mycobacterium avium subsp. paratuberculosis
cagcuccuugagccgccgcg

SEQ ID NO: 867752 - RNA, 18 nt, Mycobacterium avium subsp. paratuberculosis
cagcucgaacaccgucga

SEQ ID NO: 867753 - RNA, 16 nt, Mycobacterium avium subsp. paratuberculosis
cagcguuuccagcgcc

SEQ ID NO: 867754 - RNA, 19 nt, Mycobacterium avium subsp. paratuberculosis
cagcguuuccagcgccggc

SEQ ID NO: 867755 - RNA, 20 nt, Mycobacterium avium subsp. paratuberculosis
cagcguuuccagcgccggca

SEQ ID NO: 867756 - RNA, 22 nt, Mycobacterium avium subsp. paratuberculosis
cagcguuuccuggugcaccagg

SEQ ID NO: 867757 - RNA, 14 nt, Mycobacterium avium subsp. paratuberculosis
cagcguucgucgcc

SEQ ID NO: 867758 - RNA, 17 nt, Mycobacterium avium subsp. paratuberculosis
cagcguucgucgccggu

SEQ ID NO: 867759 - RNA, 18 nt, Mycobacterium avium subsp. paratuberculosis
cagcuaggaagccagccg

SEQ ID NO: 867760 - RNA, 19 nt, Mycobacterium avium subsp. paratuberculosis
cagcuaggaagccagccgu

SEQ ID NO: 867761 - RNA, 20 nt, Mycobacterium avium subsp. paratuberculosis
cagcuaggaagccagccguc

SEQ ID NO: 867762 - RNA, 21 nt, Mycobacterium avium subsp. paratuberculosis
cagcuaggaagccagccgucc

SEQ ID NO: 867763 - RNA, 15 nt, Mycobacterium avium subsp. paratuberculosis
cagcuaggccagcag

SEQ ID NO: 867764 - RNA, 21 nt, Mycobacterium avium subsp. paratuberculosis
cagcuaggccagcagcgcggc

SEQ ID NO: 867765 - RNA, 19 nt, Mycobacterium avium subsp. paratuberculosis
cagcgucucgccggggaac

SEQ ID NO: 867766 - RNA, 21 nt, Mycobacterium avium subsp. paratuberculosis
cagcgucuucuucucgccguc

SEQ ID NO: 867767 - RNA, 19 nt, Mycobacterium avium subsp. paratuberculosis
cagcgucuugcccagcggg

SEQ ID NO: 867768 - RNA, 20 nt, Mycobacterium avium subsp. paratuberculosis
cagcgucuuggacgcccggu

SEQ ID NO: 867769 - RNA, 17 nt, Mycobacterium avium subsp. paratuberculosis
cagcgugaacaccgcgu

SEQ ID NO: 867770 - RNA, 18 nt, Mycobacterium avium subsp. paratuberculosis
cagcgugaacagcgcccg

SEQ ID NO: 867771 - RNA, 15 nt, Mycobacterium avium subsp. paratuberculosis
cagcguuccagcacc

SEQ ID NO: 867772 - RNA, 17 nt, Mycobacterium avium subsp. paratuberculosis
cagcguuccagcacccg

SEQ ID NO: 867773 - RNA, 20 nt, Mycobacterium avium subsp. paratuberculosis
cagcguuccagcacccggcc

SEQ ID NO: 867774 - RNA, 16 nt, Mycobacterium avium subsp. paratuberculosis
cagcgugacccugccg

SEQ ID NO: 867775 - RNA, 19 nt, Mycobacterium avium subsp. paratuberculosis
cagcgugacccugccguca

SEQ ID NO: 867776 - RNA, 22 nt, Mycobacterium avium subsp. paratuberculosis
cagcgugacccugccgucaccg

SEQ ID NO: 867777 - RNA, 15 nt, Mycobacterium avium subsp. paratuberculosis
cagcguuccggcggc

SEQ ID NO: 867778 - RNA, 16 nt, Mycobacterium avium subsp. paratuberculosis
cagcguuccggcggcc

SEQ ID NO: 867779 - RNA, 19 nt, Mycobacterium avium subsp. paratuberculosis
cagcguuccggcggccggc

SEQ ID NO: 867780 - RNA, 16 nt, Mycobacterium avium subsp. paratuberculosis
cagcgucucggcgauc

SEQ ID NO: 867781 - RNA, 14 nt, Mycobacterium avium subsp. paratuberculosis
cagcgucucggcgg

SEQ ID NO: 867782 - RNA, 18 nt, Mycobacterium avium subsp. paratuberculosis
cagcgucucggcggccga

SEQ ID NO: 867783 - RNA, 17 nt, Mycobacterium avium subsp. paratuberculosis
cagcgucugcgccagcu

SEQ ID NO: 867784 - RNA, 18 nt, Mycobacterium avium subsp. paratuberculosis
cagcgucugcgccagcug

SEQ ID NO: 867785 - RNA, 19 nt, Mycobacterium avium subsp. paratuberculosis
cagcgucugcgccagcugg

SEQ ID NO: 867786 - RNA, 17 nt, Mycobacterium avium subsp. paratuberculosis
cagcgucugcgccccgg

SEQ ID NO: 867787 - RNA, 18 nt, Mycobacterium avium subsp. paratuberculosis
cagcgucugcgccccggc

SEQ ID NO: 867788 - RNA, 20 nt, Mycobacterium avium subsp. paratuberculosis
cagcgucugcgccccggcgu

SEQ ID NO: 867789 - RNA, 22 nt, Mycobacterium avium subsp. paratuberculosis
cagcgucugcgccccggcgucg

SEQ ID NO: 867790 - RNA, 17 nt, Mycobacterium avium subsp. paratuberculosis
cagcgucugcugcgcca

SEQ ID NO: 867791 - RNA, 20 nt, Mycobacterium avium subsp. paratuberculosis
cagcgucuggcagccggccg

SEQ ID NO: 867792 - RNA, 21 nt, Mycobacterium avium subsp. paratuberculosis
cagcgucgacugcaccgacuc

SEQ ID NO: 867793 - RNA, 22 nt, Mycobacterium avium subsp. paratuberculosis
cagcgucgaugugggccgcagc

SEQ ID NO: 867794 - RNA, 20 nt, Mycobacterium avium subsp. paratuberculosis
cagcgucgccaauccggcgg

SEQ ID NO: 867795 - RNA, 22 nt, Mycobacterium avium subsp. paratuberculosis
cagcgucgccaauccggcgggc

SEQ ID NO: 867796 - RNA, 15 nt, Mycobacterium avium subsp. paratuberculosis
cagcgucgccagccg

SEQ ID NO: 867797 - RNA, 20 nt, Mycobacterium avium subsp. paratuberculosis
cagcgucucgaucgacgacg

SEQ ID NO: 867798 - RNA, 14 nt, Mycobacterium avium subsp. paratuberculosis
cagcgccggcacca

SEQ ID NO: 867799 - RNA, 16 nt, Mycobacterium avium subsp. paratuberculosis
cagcgccggcaccagc

SEQ ID NO: 867800 - RNA, 18 nt, Mycobacterium avium subsp. paratuberculosis
cagcgccggcaccagcag

SEQ ID NO: 867801 - RNA, 12 nt, Mycobacterium avium subsp. paratuberculosis
cagcgccggcag

SEQ ID NO: 867802 - RNA, 15 nt, Mycobacterium avium subsp. paratuberculosis
cagcgccggcagcaa

SEQ ID NO: 867803 - RNA, 13 nt, Mycobacterium avium subsp. paratuberculosis
cagcgccggaccg

SEQ ID NO: 867804 - RNA, 21 nt, Mycobacterium avium subsp. paratuberculosis
cagcgccgcuucgucgccggc

SEQ ID NO: 867805 - RNA, 20 nt, Mycobacterium avium subsp. paratuberculosis
cagcgccgcguugucggcgu

SEQ ID NO: 867806 - RNA, 16 nt, Mycobacterium avium subsp. paratuberculosis
cagcgccgcggccggu

SEQ ID NO: 867807 - RNA, 20 nt, Mycobacterium avium subsp. paratuberculosis
cagcgccgcggccggugcca

SEQ ID NO: 867808 - RNA, 14 nt, Mycobacterium avium subsp. paratuberculosis
cagcgccgcggccg

SEQ ID NO: 867809 - RNA, 15 nt, Mycobacterium avium subsp. paratuberculosis
cagcgccgcggccgg

SEQ ID NO: 867810 - RNA, 14 nt, Mycobacterium avium subsp. paratuberculosis
cagcgccgcggcgc

SEQ ID NO: 867811 - RNA, 15 nt, Mycobacterium avium subsp. paratuberculosis
cagcgccgcggcgcc

SEQ ID NO: 867812 - RNA, 16 nt, Mycobacterium avium subsp. paratuberculosis
cagcgccggcagcgcc

SEQ ID NO: 867813 - RNA, 22 nt, Mycobacterium avium subsp. paratuberculosis
cagcgccguccgcaccgcgacg

SEQ ID NO: 867814 - RNA, 22 nt, Mycobacterium avium subsp. paratuberculosis
cagcgccgucuccucgaccagc

SEQ ID NO: 867815 - RNA, 19 nt, Mycobacterium avium subsp. paratuberculosis
cagcgccgucucgacccgg

SEQ ID NO: 867816 - RNA, 16 nt, Mycobacterium avium subsp. paratuberculosis
cagcgccguggcccgg

SEQ ID NO: 867817 - RNA, 17 nt, Mycobacterium avium subsp. paratuberculosis
cagcgccguggcccggu

SEQ ID NO: 867818 - RNA, 13 nt, Mycobacterium avium subsp. paratuberculosis
cagcgccgucauc

SEQ ID NO: 867819 - RNA, 16 nt, Mycobacterium avium subsp. paratuberculosis
cagcgccgucaucacc

SEQ ID NO: 867820 - RNA, 20 nt, Mycobacterium avium subsp. paratuberculosis
cagcgccgucaucaccgccg

SEQ ID NO: 867821 - RNA, 21 nt, Mycobacterium avium subsp. paratuberculosis
cagcgccgucaucaccgccga

SEQ ID NO: 867822 - RNA, 20 nt, Mycobacterium avium subsp. paratuberculosis
cagcgccuccagccgcuccu

SEQ ID NO: 867823 - RNA, 15 nt, Mycobacterium avium subsp. paratuberculosis
cagcgccucccggac

SEQ ID NO: 867824 - RNA, 16 nt, Mycobacterium avium subsp. paratuberculosis
cagcgccucgagcacc

SEQ ID NO: 867825 - RNA, 18 nt, Mycobacterium avium subsp. paratuberculosis
cagcgccucgagcaccac

SEQ ID NO: 867826 - RNA, 20 nt, Mycobacterium avium subsp. paratuberculosis
cagcgccucgagcaccacgg

SEQ ID NO: 867827 - RNA, 13 nt, Mycobacterium avium subsp. paratuberculosis
cagcggcgggccc

SEQ ID NO: 867828 - RNA, 17 nt, Mycobacterium avium subsp. paratuberculosis
cagcggcgggcccagca

SEQ ID NO: 867829 - RNA, 12 nt, Mycobacterium avium subsp. paratuberculosis
cagcggcucggc

SEQ ID NO: 867830 - RNA, 23 nt, Mycobacterium avium subsp. paratuberculosis
cagcggcucggccuucggggugg

SEQ ID NO: 867831 - RNA, 16 nt, Mycobacterium avium subsp. paratuberculosis
cagcggcuccgagcgg

SEQ ID NO: 867832 - RNA, 22 nt, Mycobacterium avium subsp. paratuberculosis
cagcggcuccgagcggaugccg

SEQ ID NO: 867833 - RNA, 22 nt, Mycobacterium avium subsp. paratuberculosis
cagcggcgugcugcgcagcagc

SEQ ID NO: 867834 - RNA, 23 nt, Mycobacterium avium subsp. paratuberculosis
cagcggcgugcugcgcagcagcg

SEQ ID NO: 867835 - RNA, 20 nt, Mycobacterium avium subsp. paratuberculosis
cagcggcgucgucgucgaga

SEQ ID NO: 867836 - RNA, 17 nt, Mycobacterium avium subsp. paratuberculosis
cagcggcgucacgcccu

SEQ ID NO: 867837 - RNA, 16 nt, Mycobacterium avium subsp. paratuberculosis
cagcgggucgauggcg

SEQ ID NO: 867838 - RNA, 22 nt, Mycobacterium avium subsp. paratuberculosis
cagcgggucgauggcgacgggg

SEQ ID NO: 867839 - RNA, 19 nt, Mycobacterium avium subsp. paratuberculosis
cagcgggucgucgggccgg

SEQ ID NO: 867840 - RNA, 20 nt, Mycobacterium avium subsp. paratuberculosis
cagcgggucgugcaucggcg

SEQ ID NO: 867841 - RNA, 20 nt, Mycobacterium avium subsp. paratuberculosis
cagcgggucguuggcggcgg

SEQ ID NO: 867842 - RNA, 23 nt, Mycobacterium avium subsp. paratuberculosis
cagcgggucguuggcggcggugg

SEQ ID NO: 867843 - RNA, 20 nt, Mycobacterium avium subsp. paratuberculosis
cagcguagaacauccacggc

SEQ ID NO: 867844 - RNA, 15 nt, Mycobacterium avium subsp. paratuberculosis
cagcgggcuggcgua

SEQ ID NO: 867845 - RNA, 21 nt, Mycobacterium avium subsp. paratuberculosis
cagcgggcuguccgcguggcc

SEQ ID NO: 867846 - RNA, 19 nt, Mycobacterium avium subsp. paratuberculosis
cagcggggugagcaccgcg

SEQ ID NO: 867847 - RNA, 15 nt, Mycobacterium avium subsp. paratuberculosis
cagcggggugcccac

SEQ ID NO: 867848 - RNA, 16 nt, Mycobacterium avium subsp. paratuberculosis
cagcggggucgggauc

SEQ ID NO: 867849 - RNA, 20 nt, Mycobacterium avium subsp. paratuberculosis
cagcggggugugcucggcgg

SEQ ID NO: 867850 - RNA, 18 nt, Mycobacterium avium subsp. paratuberculosis
cagcggguccagccgccg

SEQ ID NO: 867851 - RNA, 13 nt, Mycobacterium avium subsp. paratuberculosis
cagcggggaggcc

SEQ ID NO: 867852 - RNA, 19 nt, Mycobacterium avium subsp. paratuberculosis
cagcggggcaagcagcggc

SEQ ID NO: 867853 - RNA, 20 nt, Mycobacterium avium subsp. paratuberculosis
cagcggggcaagcagcggca

SEQ ID NO: 867854 - RNA, 18 nt, Mycobacterium avium subsp. paratuberculosis
cagcggggcgaacccggc

SEQ ID NO: 867855 - RNA, 20 nt, Mycobacterium avium subsp. paratuberculosis
cagcggggcgagcuggccgc

SEQ ID NO: 867856 - RNA, 23 nt, Mycobacterium avium subsp. paratuberculosis
cagcggggcgagcuggccgccca

SEQ ID NO: 867857 - RNA, 13 nt, Mycobacterium avium subsp. paratuberculosis
cagcggggcgcgc

SEQ ID NO: 867858 - RNA, 15 nt, Mycobacterium avium subsp. paratuberculosis
cagcggggcguccag

SEQ ID NO: 867859 - RNA, 22 nt, Mycobacterium avium subsp. paratuberculosis
cagcggggcguccagcgagggg

SEQ ID NO: 867860 - RNA, 14 nt, Mycobacterium avium subsp. paratuberculosis
cagcggcugcagca

SEQ ID NO: 867861 - RNA, 11 nt, Mycobacterium avium subsp. paratuberculosis
cagcgggcugg

SEQ ID NO: 867862 - RNA, 14 nt, Mycobacterium avium subsp. paratuberculosis
cagcggcucggugu

SEQ ID NO: 867863 - RNA, 19 nt, Mycobacterium avium subsp. paratuberculosis
cagcguccaguccggcgug

SEQ ID NO: 867864 - RNA, 20 nt, Mycobacterium avium subsp. paratuberculosis
cagcguccaguccggcgugc

SEQ ID NO: 867865 - RNA, 23 nt, Mycobacterium avium subsp. paratuberculosis
cagcgucccguccugggccuggc

SEQ ID NO: 867866 - RNA, 18 nt, Mycobacterium avium subsp. paratuberculosis
cagcgucccgucggccag

SEQ ID NO: 867867 - RNA, 13 nt, Mycobacterium avium subsp. paratuberculosis
cagcgucgacgcg

SEQ ID NO: 867868 - RNA, 13 nt, Mycobacterium avium subsp. paratuberculosis
cagcguccgggcg

SEQ ID NO: 867869 - RNA, 14 nt, Mycobacterium avium subsp. paratuberculosis
cagcguccgggcgu

SEQ ID NO: 867870 - RNA, 23 nt, Mycobacterium avium subsp. paratuberculosis
cagcguccgggcguagugcagcu

SEQ ID NO: 867871 - RNA, 19 nt, Mycobacterium avium subsp. paratuberculosis
cagcgucagcaucgccguc

SEQ ID NO: 867872 - RNA, 20 nt, Mycobacterium avium subsp. paratuberculosis
cagcgucagcaucgccgucg

SEQ ID NO: 867873 - RNA, 17 nt, Mycobacterium avium subsp. paratuberculosis
cagcgucagccccgagu

SEQ ID NO: 867874 - RNA, 20 nt, Mycobacterium avium subsp. paratuberculosis
cagcgucaucacgugcuggc

SEQ ID NO: 867875 - RNA, 19 nt, Mycobacterium avium subsp. paratuberculosis
cagcgucaggucaccgagc

SEQ ID NO: 867876 - RNA, 13 nt, Mycobacterium avium subsp. paratuberculosis
cagcgucaccuuc

SEQ ID NO: 867877 - RNA, 14 nt, Mycobacterium avium subsp. paratuberculosis
cagcgucagcaccg

SEQ ID NO: 867878 - RNA, 17 nt, Mycobacterium avium subsp. paratuberculosis
cagcgucagcaccgcga

SEQ ID NO: 867879 - RNA, 14 nt, Mycobacterium avium subsp. paratuberculosis
cagcacaccggauc

SEQ ID NO: 867880 - RNA, 13 nt, Mycobacterium avium subsp. paratuberculosis
cagcacaccggca

SEQ ID NO: 867881 - RNA, 14 nt, Mycobacterium avium subsp. paratuberculosis
cagcacaccggcau

SEQ ID NO: 867882 - RNA, 23 nt, Mycobacterium avium subsp. paratuberculosis
cagcacaccggcauucguguggc

SEQ ID NO: 867883 - RNA, 12 nt, Mycobacterium avium subsp. paratuberculosis
cagcacacccuc

SEQ ID NO: 867884 - RNA, 15 nt, Mycobacterium avium subsp. paratuberculosis
cagcacagccgucgc

SEQ ID NO: 867885 - RNA, 16 nt, Mycobacterium avium subsp. paratuberculosis
cagcacagcgaggcga

SEQ ID NO: 867886 - RNA, 17 nt, Mycobacterium avium subsp. paratuberculosis
cagcacagcgaggcgac

SEQ ID NO: 867887 - RNA, 18 nt, Mycobacterium avium subsp. paratuberculosis
cagcacagcgaggcgacg

SEQ ID NO: 867888 - RNA, 22 nt, Mycobacterium avium subsp. paratuberculosis
cagcacagcgaggcgacgucga

SEQ ID NO: 867889 - RNA, 21 nt, Mycobacterium avium subsp. paratuberculosis
cagcacaccuuccaccaccgc

SEQ ID NO: 867890 - RNA, 15 nt, Mycobacterium avium subsp. paratuberculosis
cagcaacggcggcgg

SEQ ID NO: 867891 - RNA, 19 nt, Mycobacterium avium subsp. paratuberculosis
cagcaacggcggcggcacc

SEQ ID NO: 867892 - RNA, 21 nt, Mycobacterium avium subsp. paratuberculosis
cagcaacggcggcggcaccga

SEQ ID NO: 867893 - RNA, 15 nt, Mycobacterium avium subsp. paratuberculosis
cagcaacgccgacau

SEQ ID NO: 867894 - RNA, 20 nt, Mycobacterium avium subsp. paratuberculosis
cagcaaccggaauggcagca

SEQ ID NO: 867895 - RNA, 18 nt, Mycobacterium avium subsp. paratuberculosis
cagcaaccggcggcuggg

SEQ ID NO: 867896 - RNA, 13 nt, Mycobacterium avium subsp. paratuberculosis
cagcaaccggguc

SEQ ID NO: 867897 - RNA, 18 nt, Mycobacterium avium subsp. paratuberculosis
cagcaacgaaucucgcgu

SEQ ID NO: 867898 - RNA, 13 nt, Mycobacterium avium subsp. paratuberculosis
cagauacgccgcg

SEQ ID NO: 867899 - RNA, 22 nt, Mycobacterium avium subsp. paratuberculosis
cagauagaugagccgcagccgg

SEQ ID NO: 867900 - RNA, 22 nt, Mycobacterium avium subsp. paratuberculosis
cagauagcccagccagccggug

SEQ ID NO: 867901 - RNA, 23 nt, Mycobacterium avium subsp. paratuberculosis
cagauagcccagccagccggugg

SEQ ID NO: 867902 - RNA, 18 nt, Mycobacterium avium subsp. paratuberculosis
cagauacuccucgcgguc

SEQ ID NO: 867903 - RNA, 21 nt, Mycobacterium avium subsp. paratuberculosis
cagcaacaugauuccgccggg

SEQ ID NO: 867904 - RNA, 22 nt, Mycobacterium avium subsp. paratuberculosis
cagcaacaugauuccgccgggc

SEQ ID NO: 867905 - RNA, 20 nt, Mycobacterium avium subsp. paratuberculosis
cagauagccguacacggcgg

SEQ ID NO: 867906 - RNA, 22 nt, Mycobacterium avium subsp. paratuberculosis
cagauagccguacacggcggcg

SEQ ID NO: 867907 - RNA, 23 nt, Mycobacterium avium subsp. paratuberculosis
cagauagccguacacggcggcga

SEQ ID NO: 867908 - RNA, 22 nt, Mycobacterium avium subsp. paratuberculosis
cagcaacccgaaagcccccagc

SEQ ID NO: 867909 - RNA, 13 nt, Mycobacterium avium subsp. paratuberculosis
cagcaaccgccgu

SEQ ID NO: 867910 - RNA, 16 nt, Mycobacterium avium subsp. paratuberculosis
cagcaaccgccguggc

SEQ ID NO: 867911 - RNA, 23 nt, Mycobacterium avium subsp. paratuberculosis
cagcaaccgcgaaaacagcgacc

SEQ ID NO: 867912 - RNA, 16 nt, Mycobacterium avium subsp. paratuberculosis
cagcaccaacagcggc

SEQ ID NO: 867913 - RNA, 22 nt, Mycobacterium avium subsp. paratuberculosis
cagcaccaacagcggcccgauc

SEQ ID NO: 867914 - RNA, 14 nt, Mycobacterium avium subsp. paratuberculosis
cagcaccacgguga

SEQ ID NO: 867915 - RNA, 13 nt, Mycobacterium avium subsp. paratuberculosis
cagcaccagcacc

SEQ ID NO: 867916 - RNA, 18 nt, Mycobacterium avium subsp. paratuberculosis
cagcaccagcacggcgac

SEQ ID NO: 867917 - RNA, 19 nt, Mycobacterium avium subsp. paratuberculosis
cagcaccagcacggcgacc

SEQ ID NO: 867918 - RNA, 15 nt, Mycobacterium avium subsp. paratuberculosis
cagcaccagcagccg

SEQ ID NO: 867919 - RNA, 16 nt, Mycobacterium avium subsp. paratuberculosis
cagcaccagcagccgg

SEQ ID NO: 867920 - RNA, 19 nt, Mycobacterium avium subsp. paratuberculosis
cagcaccagcagccggucg

SEQ ID NO: 867921 - RNA, 20 nt, Mycobacterium avium subsp. paratuberculosis
cagcaccagcagccggucga

SEQ ID NO: 867922 - RNA, 12 nt, Mycobacterium avium subsp. paratuberculosis
cagcaccagccc

SEQ ID NO: 867923 - RNA, 14 nt, Mycobacterium avium subsp. paratuberculosis
cagcaccagcccga

SEQ ID NO: 867924 - RNA, 15 nt, Mycobacterium avium subsp. paratuberculosis
cagcaccagcccgau

SEQ ID NO: 867925 - RNA, 17 nt, Mycobacterium avium subsp. paratuberculosis
cagcaccagcgccgcga

SEQ ID NO: 867926 - RNA, 20 nt, Mycobacterium avium subsp. paratuberculosis
cagcaccaccaacagcagcg

SEQ ID NO: 867927 - RNA, 24 nt, Mycobacterium avium subsp. paratuberculosis
cagcaccaccaacagcagcgaggc

SEQ ID NO: 867928 - RNA, 22 nt, Mycobacterium avium subsp. paratuberculosis
cagcaccaccaacggcucgccg

SEQ ID NO: 867929 - RNA, 14 nt, Mycobacterium avium subsp. paratuberculosis
cagcaccaccacgc

SEQ ID NO: 867930 - RNA, 14 nt, Mycobacterium avium subsp. paratuberculosis
cagcaccaccacgu

SEQ ID NO: 867931 - RNA, 12 nt, Mycobacterium avium subsp. paratuberculosis
cagcaccaccgc

SEQ ID NO: 867932 - RNA, 14 nt, Mycobacterium avium subsp. paratuberculosis
cagcaccaccgcga

SEQ ID NO: 867933 - RNA, 16 nt, Mycobacterium avium subsp. paratuberculosis
cagcaccaccgcgagc

SEQ ID NO: 867934 - RNA, 17 nt, Mycobacterium avium subsp. paratuberculosis
cagcaccaccgcgagcg

SEQ ID NO: 867935 - RNA, 16 nt, Mycobacterium avium subsp. paratuberculosis
cagcaccaccgucacc

SEQ ID NO: 867936 - RNA, 13 nt, Mycobacterium avium subsp. paratuberculosis
cagcaccaccgug

SEQ ID NO: 867937 - RNA, 13 nt, Mycobacterium avium subsp. paratuberculosis
cagcaccaccucg

SEQ ID NO: 867938 - RNA, 16 nt, Mycobacterium avium subsp. paratuberculosis
cagcaccaccucgcgc

SEQ ID NO: 867939 - RNA, 17 nt, Mycobacterium avium subsp. paratuberculosis
cagcaccaccucgugca

SEQ ID NO: 867940 - RNA, 14 nt, Mycobacterium avium subsp. paratuberculosis
cagcaccaccuugu

SEQ ID NO: 867941 - RNA, 21 nt, Mycobacterium avium subsp. paratuberculosis
cagcaccaccuugucaccgaa

SEQ ID NO: 867942 - RNA, 23 nt, Mycobacterium avium subsp. paratuberculosis
cagcacauccgguugcaccgcga

SEQ ID NO: 867943 - RNA, 17 nt, Mycobacterium avium subsp. paratuberculosis
cagcaccaggcccuccu

SEQ ID NO: 867944 - RNA, 20 nt, Mycobacterium avium subsp. paratuberculosis
cagcaccauccgcgcgagcg

SEQ ID NO: 867945 - RNA, 12 nt, Mycobacterium avium subsp. paratuberculosis
cagcaccaggcg

SEQ ID NO: 867946 - RNA, 20 nt, Mycobacterium avium subsp. paratuberculosis
cagcaccaggcugaccagcg

SEQ ID NO: 867947 - RNA, 14 nt, Mycobacterium avium subsp. paratuberculosis
cagcaccacguugc

SEQ ID NO: 867948 - RNA, 15 nt, Mycobacterium avium subsp. paratuberculosis
cagcaccacguugcg

SEQ ID NO: 867949 - RNA, 20 nt, Mycobacterium avium subsp. paratuberculosis
cagcaccacuuccagcaccg

SEQ ID NO: 867950 - RNA, 13 nt, Mycobacterium avium subsp. paratuberculosis
cagcaccagcggc

SEQ ID NO: 867951 - RNA, 13 nt, Mycobacterium avium subsp. paratuberculosis
cagcaccagcuca

SEQ ID NO: 867952 - RNA, 23 nt, Mycobacterium avium subsp. paratuberculosis
cagcaccaggaaggcgaccgcgu

SEQ ID NO: 867953 - RNA, 18 nt, Mycobacterium avium subsp. paratuberculosis
cagcaccaugaucaggcc

SEQ ID NO: 867954 - RNA, 14 nt, Mycobacterium avium subsp. paratuberculosis
cagcaccgucggcg

SEQ ID NO: 867955 - RNA, 17 nt, Mycobacterium avium subsp. paratuberculosis
cagcaccgucggcgugu

SEQ ID NO: 867956 - RNA, 17 nt, Mycobacterium avium subsp. paratuberculosis
cagcaccgucugcgccg

SEQ ID NO: 867957 - RNA, 12 nt, Mycobacterium avium subsp. paratuberculosis
cagcaccgggug

SEQ ID NO: 867958 - RNA, 13 nt, Mycobacterium avium subsp. paratuberculosis
cagcaccgggccc

SEQ ID NO: 867959 - RNA, 17 nt, Mycobacterium avium subsp. paratuberculosis
cagcaccggcuggucgg

SEQ ID NO: 867960 - RNA, 23 nt, Mycobacterium avium subsp. paratuberculosis
cagcaccgggaaggugucggccg

SEQ ID NO: 867961 - RNA, 23 nt, Mycobacterium avium subsp. paratuberculosis
cagcacgcccagaucgacgccga

SEQ ID NO: 867962 - RNA, 16 nt, Mycobacterium avium subsp. paratuberculosis
cagcacgcccagcccg

SEQ ID NO: 867963 - RNA, 18 nt, Mycobacterium avium subsp. paratuberculosis
cagcacgcccccgcuggc

SEQ ID NO: 867964 - RNA, 20 nt, Mycobacterium avium subsp. paratuberculosis
cagcacgcccccgcuggccc

SEQ ID NO: 867965 - RNA, 14 nt, Mycobacterium avium subsp. paratuberculosis
cagcacgcccucgu

SEQ ID NO: 867966 - RNA, 14 nt, Mycobacterium avium subsp. paratuberculosis
cagcacgcccugga

SEQ ID NO: 867967 - RNA, 20 nt, Mycobacterium avium subsp. paratuberculosis
cagcacgcccuggaaggcga

SEQ ID NO: 867968 - RNA, 18 nt, Mycobacterium avium subsp. paratuberculosis
cagcacgaugacgaccgg

SEQ ID NO: 867969 - RNA, 21 nt, Mycobacterium avium subsp. paratuberculosis
cagcacgaugacgaccggguc

SEQ ID NO: 867970 - RNA, 22 nt, Mycobacterium avium subsp. paratuberculosis
cagcacgaugaucccgaggaug

SEQ ID NO: 867971 - RNA, 20 nt, Mycobacterium avium subsp. paratuberculosis
cagcacgaucccgccgcccg

SEQ ID NO: 867972 - RNA, 17 nt, Mycobacterium avium subsp. paratuberculosis
cagcacgaucgagccgg

SEQ ID NO: 867973 - RNA, 20 nt, Mycobacterium avium subsp. paratuberculosis
cagcacgaucgagccggugg

SEQ ID NO: 867974 - RNA, 23 nt, Mycobacterium avium subsp. paratuberculosis
cagcaccucgcccugcagcgcga

SEQ ID NO: 867975 - RNA, 16 nt, Mycobacterium avium subsp. paratuberculosis
cagcaccucgcgcagc

SEQ ID NO: 867976 - RNA, 21 nt, Mycobacterium avium subsp. paratuberculosis
cagcaccucgcgcagcaccga

SEQ ID NO: 867977 - RNA, 16 nt, Mycobacterium avium subsp. paratuberculosis
cagcaccucgcgcgcg

SEQ ID NO: 867978 - RNA, 17 nt, Mycobacterium avium subsp. paratuberculosis
cagcaccucgcgcgcga

SEQ ID NO: 867979 - RNA, 17 nt, Mycobacterium avium subsp. paratuberculosis
cagcaccucgcggcagc

SEQ ID NO: 867980 - RNA, 14 nt, Mycobacterium avium subsp. paratuberculosis
cagcaccuccgaca

SEQ ID NO: 867981 - RNA, 16 nt, Mycobacterium avium subsp. paratuberculosis
cagcaccuccgacagc

SEQ ID NO: 867982 - RNA, 16 nt, Mycobacterium avium subsp. paratuberculosis
cagcaccuccggcagc

SEQ ID NO: 867983 - RNA, 18 nt, Mycobacterium avium subsp. paratuberculosis
cagcaccucgaacgccgg

SEQ ID NO: 867984 - RNA, 19 nt, Mycobacterium avium subsp. paratuberculosis
cagcacggugaugcgggug

SEQ ID NO: 867985 - RNA, 22 nt, Mycobacterium avium subsp. paratuberculosis
cagcacggugaugcggguguug

SEQ ID NO: 867986 - RNA, 15 nt, Mycobacterium avium subsp. paratuberculosis
cagcacggucagcgg

SEQ ID NO: 867987 - RNA, 16 nt, Mycobacterium avium subsp. paratuberculosis
cagcacggucagcggc

SEQ ID NO: 867988 - RNA, 17 nt, Mycobacterium avium subsp. paratuberculosis
cagcacggucagcggcc

SEQ ID NO: 867989 - RNA, 23 nt, Mycobacterium avium subsp. paratuberculosis
cagcacggucagcggccagccca

SEQ ID NO: 867990 - RNA, 15 nt, Mycobacterium avium subsp. paratuberculosis
cagcacggucccguc

SEQ ID NO: 867991 - RNA, 23 nt, Mycobacterium avium subsp. paratuberculosis
cagcacgucgggguggccggcca

SEQ ID NO: 867992 - RNA, 20 nt, Mycobacterium avium subsp. paratuberculosis
cagcacgucggucagcgagc

SEQ ID NO: 867993 - RNA, 11 nt, Mycobacterium avium subsp. paratuberculosis
cagcacgucgu

SEQ ID NO: 867994 - RNA, 21 nt, Mycobacterium avium subsp. paratuberculosis
cagcacgucaccgcugaugcc

SEQ ID NO: 867995 - RNA, 15 nt, Mycobacterium avium subsp. paratuberculosis
cagcacggcggcgcu

SEQ ID NO: 867996 - RNA, 16 nt, Mycobacterium avium subsp. paratuberculosis
cagcacggcggcgcug

SEQ ID NO: 867997 - RNA, 14 nt, Mycobacterium avium subsp. paratuberculosis
cagcacggcggcgu

SEQ ID NO: 867998 - RNA, 15 nt, Mycobacterium avium subsp. paratuberculosis
cagcacggcggcgug

SEQ ID NO: 867999 - RNA, 14 nt, Mycobacterium avium subsp. paratuberculosis
cagcacgggcgggc

SEQ ID NO: 868000 - RNA, 15 nt, Mycobacterium avium subsp. paratuberculosis
cagcacgggcgggca

SEQ ID NO: 868001 - RNA, 16 nt, Mycobacterium avium subsp. paratuberculosis
cagcacgggcgggcag

SEQ ID NO: 868002 - RNA, 20 nt, Mycobacterium avium subsp. paratuberculosis
cagcacgggcgggcagaugg

SEQ ID NO: 868003 - RNA, 14 nt, Mycobacterium avium subsp. paratuberculosis
cagcacggggacgc

SEQ ID NO: 868004 - RNA, 15 nt, Mycobacterium avium subsp. paratuberculosis
cagcacggccgcggc

SEQ ID NO: 868005 - RNA, 21 nt, Mycobacterium avium subsp. paratuberculosis
cagcacggccacugccccggc

SEQ ID NO: 868006 - RNA, 23 nt, Mycobacterium avium subsp. paratuberculosis
cagcacggccacugccccggcga

SEQ ID NO: 868007 - RNA, 12 nt, Mycobacterium avium subsp. paratuberculosis
cagcacgccgcg

SEQ ID NO: 868008 - RNA, 14 nt, Mycobacterium avium subsp. paratuberculosis
cagcacggcgacca

SEQ ID NO: 868009 - RNA, 16 nt, Mycobacterium avium subsp. paratuberculosis
cagcacggcgaccagc

SEQ ID NO: 868010 - RNA, 20 nt, Mycobacterium avium subsp. paratuberculosis
cagcacggcgaccagcgagc

SEQ ID NO: 868011 - RNA, 17 nt, Mycobacterium avium subsp. paratuberculosis
cagcagccacgacacca

SEQ ID NO: 868012 - RNA, 18 nt, Mycobacterium avium subsp. paratuberculosis
cagcagccacgccagcca

SEQ ID NO: 868013 - RNA, 23 nt, Mycobacterium avium subsp. paratuberculosis
cagcagccagcccagccgccagc

SEQ ID NO: 868014 - RNA, 16 nt, Mycobacterium avium subsp. paratuberculosis
cagcagccccugcacc

SEQ ID NO: 868015 - RNA, 17 nt, Mycobacterium avium subsp. paratuberculosis
cagcagccccugcacca

SEQ ID NO: 868016 - RNA, 19 nt, Mycobacterium avium subsp. paratuberculosis
cagcagccccugcaccacg

SEQ ID NO: 868017 - RNA, 14 nt, Mycobacterium avium subsp. paratuberculosis
cagcagcccgaaca

SEQ ID NO: 868018 - RNA, 21 nt, Mycobacterium avium subsp. paratuberculosis
cagcagcccgaacagccgggc

SEQ ID NO: 868019 - RNA, 14 nt, Mycobacterium avium subsp. paratuberculosis
cagcagcccgauca

SEQ ID NO: 868020 - RNA, 16 nt, Mycobacterium avium subsp. paratuberculosis
cagcagcccgaucacc

SEQ ID NO: 868021 - RNA, 16 nt, Mycobacterium avium subsp. paratuberculosis
cagcagcccgggcugc

SEQ ID NO: 868022 - RNA, 16 nt, Mycobacterium avium subsp. paratuberculosis
cagcagcccggccagc

SEQ ID NO: 868023 - RNA, 18 nt, Mycobacterium avium subsp. paratuberculosis
cagcagcccggccagccg

SEQ ID NO: 868024 - RNA, 13 nt, Mycobacterium avium subsp. paratuberculosis
cagcagccaggac

SEQ ID NO: 868025 - RNA, 19 nt, Mycobacterium avium subsp. paratuberculosis
cagcagccaggacagcguc

SEQ ID NO: 868026 - RNA, 20 nt, Mycobacterium avium subsp. paratuberculosis
cagcagccaggacagcguca

SEQ ID NO: 868027 - RNA, 15 nt, Mycobacterium avium subsp. paratuberculosis
cagcagcccgccgau

SEQ ID NO: 868028 - RNA, 16 nt, Mycobacterium avium subsp. paratuberculosis
cagcagcccgccgaug

SEQ ID NO: 868029 - RNA, 17 nt, Mycobacterium avium subsp. paratuberculosis
cagcagcccgccgaugg

SEQ ID NO: 868030 - RNA, 24 nt, Mycobacterium avium subsp. paratuberculosis
cagcagcccgccgauggacacgcu

SEQ ID NO: 868031 - RNA, 13 nt, Mycobacterium avium subsp. paratuberculosis
cagcagcaggucc

SEQ ID NO: 868032 - RNA, 18 nt, Mycobacterium avium subsp. paratuberculosis
cagcagcaggucggccag

SEQ ID NO: 868033 - RNA, 13 nt, Mycobacterium avium subsp. paratuberculosis
cagcagcaccaga

SEQ ID NO: 868034 - RNA, 14 nt, Mycobacterium avium subsp. paratuberculosis
cagcagcaccagcg

SEQ ID NO: 868035 - RNA, 17 nt, Mycobacterium avium subsp. paratuberculosis
cagcagcaccagcgccg

SEQ ID NO: 868036 - RNA, 14 nt, Mycobacterium avium subsp. paratuberculosis
cagcagcaccaggc

SEQ ID NO: 868037 - RNA, 20 nt, Mycobacterium avium subsp. paratuberculosis
cagcagcaccaggcugacca

SEQ ID NO: 868038 - RNA, 13 nt, Mycobacterium avium subsp. paratuberculosis
cagcagcaccccg

SEQ ID NO: 868039 - RNA, 14 nt, Mycobacterium avium subsp. paratuberculosis
cagcagcagcgcgc

SEQ ID NO: 868040 - RNA, 15 nt, Mycobacterium avium subsp. paratuberculosis
cagcagcagcgcggc

SEQ ID NO: 868041 - RNA, 14 nt, Mycobacterium avium subsp. paratuberculosis
cagcagcaacgcgg

SEQ ID NO: 868042 - RNA, 21 nt, Mycobacterium avium subsp. paratuberculosis
cagcagcaacgcgguguuggc

SEQ ID NO: 868043 - RNA, 17 nt, Mycobacterium avium subsp. paratuberculosis
cagcagaugcgccucga

SEQ ID NO: 868044 - RNA, 19 nt, Mycobacterium avium subsp. paratuberculosis
cagcagaugcgccucgauc

SEQ ID NO: 868045 - RNA, 16 nt, Mycobacterium avium subsp. paratuberculosis
cagcagaugcgcgucg

SEQ ID NO: 868046 - RNA, 18 nt, Mycobacterium avium subsp. paratuberculosis
cagcagaugcgugcggug

SEQ ID NO: 868047 - RNA, 16 nt, Mycobacterium avium subsp. paratuberculosis
cagcagaugccgccca

SEQ ID NO: 868048 - RNA, 17 nt, Mycobacterium avium subsp. paratuberculosis
cagcagauacuccucgc

SEQ ID NO: 868049 - RNA, 19 nt, Mycobacterium avium subsp. paratuberculosis
cagcagauacuccucgcgg

SEQ ID NO: 868050 - RNA, 22 nt, Mycobacterium avium subsp. paratuberculosis
cagcagauacuccucgcggucu

SEQ ID NO: 868051 - RNA, 17 nt, Mycobacterium avium subsp. paratuberculosis
cagcagauagcccagcc

SEQ ID NO: 868052 - RNA, 22 nt, Mycobacterium avium subsp. paratuberculosis
cagcagauagcccagccagccg

SEQ ID NO: 868053 - RNA, 21 nt, Mycobacterium avium subsp. paratuberculosis
cagcacguugucgcccgggua

SEQ ID NO: 868054 - RNA, 17 nt, Mycobacterium avium subsp. paratuberculosis
cagcacguugugggcgg

SEQ ID NO: 868055 - RNA, 21 nt, Mycobacterium avium subsp. paratuberculosis
cagcacguugugggcgggcgc

SEQ ID NO: 868056 - RNA, 22 nt, Mycobacterium avium subsp. paratuberculosis
cagcacguugugggcgggcgcg

SEQ ID NO: 868057 - RNA, 19 nt, Mycobacterium avium subsp. paratuberculosis
cagcacguuguucaggucg

SEQ ID NO: 868058 - RNA, 20 nt, Mycobacterium avium subsp. paratuberculosis
cagcacguuguucaggucga

SEQ ID NO: 868059 - RNA, 16 nt, Mycobacterium avium subsp. paratuberculosis
cagcacgucgcggccc

SEQ ID NO: 868060 - RNA, 18 nt, Mycobacterium avium subsp. paratuberculosis
cagcacgugcccagcccg

SEQ ID NO: 868061 - RNA, 19 nt, Mycobacterium avium subsp. paratuberculosis
cagcacgugcccagcccgc

SEQ ID NO: 868062 - RNA, 21 nt, Mycobacterium avium subsp. paratuberculosis
cagcacgugcccagcccgcgc

SEQ ID NO: 868063 - RNA, 14 nt, Mycobacterium avium subsp. paratuberculosis
cagcacgugcccgc

SEQ ID NO: 868064 - RNA, 22 nt, Mycobacterium avium subsp. paratuberculosis
cagcacgugcccgccgugcgcc

SEQ ID NO: 868065 - RNA, 23 nt, Mycobacterium avium subsp. paratuberculosis
cagcacgugcccgccgugcgccc

SEQ ID NO: 868066 - RNA, 14 nt, Mycobacterium avium subsp. paratuberculosis
cagcaucacgucgg

SEQ ID NO: 868067 - RNA, 19 nt, Mycobacterium avium subsp. paratuberculosis
cagcaucacgucggcgagc

SEQ ID NO: 868068 - RNA, 16 nt, Mycobacterium avium subsp. paratuberculosis
cagcagucccucgauc

SEQ ID NO: 868069 - RNA, 19 nt, Mycobacterium avium subsp. paratuberculosis
cagcagucccucgaucagc

SEQ ID NO: 868070 - RNA, 23 nt, Mycobacterium avium subsp. paratuberculosis
cagcagugccaacacggcggcgc

SEQ ID NO: 868071 - RNA, 16 nt, Mycobacterium avium subsp. paratuberculosis
cagcagugccaccacc

SEQ ID NO: 868072 - RNA, 21 nt, Mycobacterium avium subsp. paratuberculosis
cagcagguuguagucggcgcc

SEQ ID NO: 868073 - RNA, 23 nt, Mycobacterium avium subsp. paratuberculosis
cagcagguuguagucggcgccga

SEQ ID NO: 868074 - RNA, 17 nt, Mycobacterium avium subsp. paratuberculosis
cagcagguugcgguguu

SEQ ID NO: 868075 - RNA, 20 nt, Mycobacterium avium subsp. paratuberculosis
cagcaggugcaucgccaccg

SEQ ID NO: 868076 - RNA, 15 nt, Mycobacterium avium subsp. paratuberculosis
cagcaggugcgccag

SEQ ID NO: 868077 - RNA, 17 nt, Mycobacterium avium subsp. paratuberculosis
cagcaggucgucgacgu

SEQ ID NO: 868078 - RNA, 19 nt, Mycobacterium avium subsp. paratuberculosis
cagcaggugcaucgaccgg

SEQ ID NO: 868079 - RNA, 20 nt, Mycobacterium avium subsp. paratuberculosis
cagcaggugcaucgaccggc

SEQ ID NO: 868080 - RNA, 21 nt, Mycobacterium avium subsp. paratuberculosis
cagcaggugcaucgaccggcg

SEQ ID NO: 868081 - RNA, 23 nt, Mycobacterium avium subsp. paratuberculosis
cagcaggugcaucgaccggcgga

SEQ ID NO: 868082 - RNA, 16 nt, Mycobacterium avium subsp. paratuberculosis
cagcaggucggcgugc

SEQ ID NO: 868083 - RNA, 20 nt, Mycobacterium avium subsp. paratuberculosis
cagcaggucggcgugcucgu

SEQ ID NO: 868084 - RNA, 14 nt, Mycobacterium avium subsp. paratuberculosis
cagcaggucggcca

SEQ ID NO: 868085 - RNA, 14 nt, Mycobacterium avium subsp. paratuberculosis
cagcaggucgaucu

SEQ ID NO: 868086 - RNA, 17 nt, Mycobacterium avium subsp. paratuberculosis
cagcaggucgaucugcg

SEQ ID NO: 868087 - RNA, 20 nt, Mycobacterium avium subsp. paratuberculosis
cagcaggucgaaggcggccg

SEQ ID NO: 868088 - RNA, 17 nt, Mycobacterium avium subsp. paratuberculosis
cagcaggucgagcaugc

SEQ ID NO: 868089 - RNA, 22 nt, Mycobacterium avium subsp. paratuberculosis
cagcaggucgagcaugcguccg

SEQ ID NO: 868090 - RNA, 14 nt, Mycobacterium avium subsp. paratuberculosis
cagcagguccaugg

SEQ ID NO: 868091 - RNA, 19 nt, Mycobacterium avium subsp. paratuberculosis
cagcagguauuuggugacc

SEQ ID NO: 868092 - RNA, 20 nt, Mycobacterium avium subsp. paratuberculosis
cagcagguauuuggugaccu

SEQ ID NO: 868093 - RNA, 19 nt, Mycobacterium avium subsp. paratuberculosis
cagcagguccgccggugcc

SEQ ID NO: 868094 - RNA, 18 nt, Mycobacterium avium subsp. paratuberculosis
cagcagguaaaccagcag

SEQ ID NO: 868095 - RNA, 21 nt, Mycobacterium avium subsp. paratuberculosis
cagcagguaaaccagcagcgc

SEQ ID NO: 868096 - RNA, 20 nt, Mycobacterium avium subsp. paratuberculosis
cagcagguagaagccgcgac

SEQ ID NO: 868097 - RNA, 21 nt, Mycobacterium avium subsp. paratuberculosis
cagcagguagaagccgcgacg

SEQ ID NO: 868098 - RNA, 15 nt, Mycobacterium avium subsp. paratuberculosis
cagcagguagaucgc

SEQ ID NO: 868099 - RNA, 17 nt, Mycobacterium avium subsp. paratuberculosis
cagcagguagaucgcca

SEQ ID NO: 868100 - RNA, 17 nt, Mycobacterium avium subsp. paratuberculosis
cagcagguagcggcuga

SEQ ID NO: 868101 - RNA, 19 nt, Mycobacterium avium subsp. paratuberculosis
cagcagguagcggcugacc

SEQ ID NO: 868102 - RNA, 13 nt, Mycobacterium avium subsp. paratuberculosis
cagcagccgcacc

SEQ ID NO: 868103 - RNA, 13 nt, Mycobacterium avium subsp. paratuberculosis
cagcagccgcgac

SEQ ID NO: 868104 - RNA, 13 nt, Mycobacterium avium subsp. paratuberculosis
cagcagccgccgg

SEQ ID NO: 868105 - RNA, 17 nt, Mycobacterium avium subsp. paratuberculosis
cagcagccgcgccgacg

SEQ ID NO: 868106 - RNA, 17 nt, Mycobacterium avium subsp. paratuberculosis
cagcagccgcgccgccg

SEQ ID NO: 868107 - RNA, 14 nt, Mycobacterium avium subsp. paratuberculosis
cagcagccgcgcga

SEQ ID NO: 868108 - RNA, 13 nt, Mycobacterium avium subsp. paratuberculosis
cagcagccggcag

SEQ ID NO: 868109 - RNA, 22 nt, Mycobacterium avium subsp. paratuberculosis
cagcagccguuccaucgggccc

SEQ ID NO: 868110 - RNA, 16 nt, Mycobacterium avium subsp. paratuberculosis
cagcagccgggccugc

SEQ ID NO: 868111 - RNA, 19 nt, Mycobacterium avium subsp. paratuberculosis
cagcagccgggccugcggc

SEQ ID NO: 868112 - RNA, 21 nt, Mycobacterium avium subsp. paratuberculosis
cagcagccgggccugcggcgc

SEQ ID NO: 868113 - RNA, 14 nt, Mycobacterium avium subsp. paratuberculosis
cagcagcgccagca

SEQ ID NO: 868114 - RNA, 19 nt, Mycobacterium avium subsp. paratuberculosis
cagcagcgcaccggcgaug

SEQ ID NO: 868115 - RNA, 20 nt, Mycobacterium avium subsp. paratuberculosis
cagcagcgccagcagcggca

SEQ ID NO: 868116 - RNA, 20 nt, Mycobacterium avium subsp. paratuberculosis
cagcagcgaggccucgccgc

SEQ ID NO: 868117 - RNA, 23 nt, Mycobacterium avium subsp. paratuberculosis
cagcagcgaggcguccagcgcgu

SEQ ID NO: 868118 - RNA, 19 nt, Mycobacterium avium subsp. paratuberculosis
cagcagcgacuugaccagc

SEQ ID NO: 868119 - RNA, 22 nt, Mycobacterium avium subsp. paratuberculosis
cagcagcgacuugaccagcagc

SEQ ID NO: 868120 - RNA, 19 nt, Mycobacterium avium subsp. paratuberculosis
cagcagcgagaaccggcgc

SEQ ID NO: 868121 - RNA, 22 nt, Mycobacterium avium subsp. paratuberculosis
cagcagcgagaccggcacggug

SEQ ID NO: 868122 - RNA, 14 nt, Mycobacterium avium subsp. paratuberculosis
cagcagccggucga

SEQ ID NO: 868123 - RNA, 16 nt, Mycobacterium avium subsp. paratuberculosis
cagcagccggucgagg

SEQ ID NO: 868124 - RNA, 23 nt, Mycobacterium avium subsp. paratuberculosis
cagcagccggucgaggucgccga

SEQ ID NO: 868125 - RNA, 21 nt, Mycobacterium avium subsp. paratuberculosis
cagcaggcuguccugcgguuc

SEQ ID NO: 868126 - RNA, 17 nt, Mycobacterium avium subsp. paratuberculosis
cagcaggcuggcggcga

SEQ ID NO: 868127 - RNA, 19 nt, Mycobacterium avium subsp. paratuberculosis
cagcaggcuggcggcgauc

SEQ ID NO: 868128 - RNA, 20 nt, Mycobacterium avium subsp. paratuberculosis
cagcaggcuggcggcgauca

SEQ ID NO: 868129 - RNA, 22 nt, Mycobacterium avium subsp. paratuberculosis
cagcaggcuggcggcgaucacc

SEQ ID NO: 868130 - RNA, 14 nt, Mycobacterium avium subsp. paratuberculosis
cagcaggcuggcgu

SEQ ID NO: 868131 - RNA, 15 nt, Mycobacterium avium subsp. paratuberculosis
cagcaggcuggcggc

SEQ ID NO: 868132 - RNA, 18 nt, Mycobacterium avium subsp. paratuberculosis
cagcaggcggacggcgac

SEQ ID NO: 868133 - RNA, 15 nt, Mycobacterium avium subsp. paratuberculosis
cagcaggcgccgguc

SEQ ID NO: 868134 - RNA, 16 nt, Mycobacterium avium subsp. paratuberculosis
cagcaggcgcgccgag

SEQ ID NO: 868135 - RNA, 18 nt, Mycobacterium avium subsp. paratuberculosis
cagcaggcgcgccgagcg

SEQ ID NO: 868136 - RNA, 19 nt, Mycobacterium avium subsp. paratuberculosis
cagcaggcgcgccgagcgc

SEQ ID NO: 868137 - RNA, 13 nt, Mycobacterium avium subsp. paratuberculosis
cagcaggcgccgc

SEQ ID NO: 868138 - RNA, 14 nt, Mycobacterium avium subsp. paratuberculosis
cagcaggcgccgca

SEQ ID NO: 868139 - RNA, 22 nt, Mycobacterium avium subsp. paratuberculosis
cagcaggcgccgcagcaggugc

SEQ ID NO: 868140 - RNA, 16 nt, Mycobacterium avium subsp. paratuberculosis
cagcagcgccggcagc

SEQ ID NO: 868141 - RNA, 15 nt, Mycobacterium avium subsp. paratuberculosis
cagcagcgccgcggc

SEQ ID NO: 868142 - RNA, 17 nt, Mycobacterium avium subsp. paratuberculosis
cagcagcgccgcggccg

SEQ ID NO: 868143 - RNA, 18 nt, Mycobacterium avium subsp. paratuberculosis
cagcagcgccgcggccgg

SEQ ID NO: 868144 - RNA, 14 nt, Mycobacterium avium subsp. paratuberculosis
cagcagcgcccacc

SEQ ID NO: 868145 - RNA, 18 nt, Mycobacterium avium subsp. paratuberculosis
cagcagcgcccaccgcuc

SEQ ID NO: 868146 - RNA, 21 nt, Mycobacterium avium subsp. paratuberculosis
cagcagcgcccaccgcucguc

SEQ ID NO: 868147 - RNA, 19 nt, Mycobacterium avium subsp. paratuberculosis
cagcaucgggacgccugcc

SEQ ID NO: 868148 - RNA, 19 nt, Mycobacterium avium subsp. paratuberculosis
cagcaucuccgagucggcg

SEQ ID NO: 868149 - RNA, 20 nt, Mycobacterium avium subsp. paratuberculosis
cagcaucuccgagucggcgu

SEQ ID NO: 868150 - RNA, 21 nt, Mycobacterium avium subsp. paratuberculosis
cagcaucuccgagucggcguc

SEQ ID NO: 868151 - RNA, 15 nt, Mycobacterium avium subsp. paratuberculosis
cagcaucagcauccc

SEQ ID NO: 868152 - RNA, 13 nt, Mycobacterium avium subsp. paratuberculosis
cagcaucggcaga

SEQ ID NO: 868153 - RNA, 21 nt, Mycobacterium avium subsp. paratuberculosis
cagcaucuuggccacgggguc

SEQ ID NO: 868154 - RNA, 15 nt, Mycobacterium avium subsp. paratuberculosis
cagcaugcccacgcc

SEQ ID NO: 868155 - RNA, 22 nt, Mycobacterium avium subsp. paratuberculosis
cagcaugcccacgccgucgacc

SEQ ID NO: 868156 - RNA, 20 nt, Mycobacterium avium subsp. paratuberculosis
cagccaaucgccgaugacca

SEQ ID NO: 868157 - RNA, 15 nt, Mycobacterium avium subsp. paratuberculosis
cagccacaccgccgc

SEQ ID NO: 868158 - RNA, 16 nt, Mycobacterium avium subsp. paratuberculosis
cagccacaccgccgcg

SEQ ID NO: 868159 - RNA, 18 nt, Mycobacterium avium subsp. paratuberculosis
cagccacaccgccgcggc

SEQ ID NO: 868160 - RNA, 21 nt, Mycobacterium avium subsp. paratuberculosis
cagccacaccgccgcggcggu

SEQ ID NO: 868161 - RNA, 16 nt, Mycobacterium avium subsp. paratuberculosis
cagccacaccgccggc

SEQ ID NO: 868162 - RNA, 17 nt, Mycobacterium avium subsp. paratuberculosis
cagccacaccgccggcg

SEQ ID NO: 868163 - RNA, 18 nt, Mycobacterium avium subsp. paratuberculosis
cagccacaccgccggcgc

SEQ ID NO: 868164 - RNA, 12 nt, Mycobacterium avium subsp. paratuberculosis
cagccacagccg

SEQ ID NO: 868165 - RNA, 22 nt, Mycobacterium avium subsp. paratuberculosis
cagccaaugccggaucgggacc

SEQ ID NO: 868166 - RNA, 17 nt, Mycobacterium avium subsp. paratuberculosis
cagccacuccaccaccg

SEQ ID NO: 868167 - RNA, 18 nt, Mycobacterium avium subsp. paratuberculosis
cagccacuccaccaccgg

SEQ ID NO: 868168 - RNA, 22 nt, Mycobacterium avium subsp. paratuberculosis
cagccacuccaccaccggccgc

SEQ ID NO: 868169 - RNA, 16 nt, Mycobacterium avium subsp. paratuberculosis
cagccacagccgcaug

SEQ ID NO: 868170 - RNA, 18 nt, Mycobacterium avium subsp. paratuberculosis
cagccacagcucgggcag

SEQ ID NO: 868171 - RNA, 23 nt, Mycobacterium avium subsp. paratuberculosis
cagccacauguucuccucgucgc

SEQ ID NO: 868172 - RNA, 12 nt, Mycobacterium avium subsp. paratuberculosis
cagccaccacau

SEQ ID NO: 868173 - RNA, 20 nt, Mycobacterium avium subsp. paratuberculosis
cagccagaucgaggccagcg

SEQ ID NO: 868174 - RNA, 21 nt, Mycobacterium avium subsp. paratuberculosis
cagccagaucgaggccagcgc

SEQ ID NO: 868175 - RNA, 17 nt, Mycobacterium avium subsp. paratuberculosis
cagccagaacacgcccc

SEQ ID NO: 868176 - RNA, 18 nt, Mycobacterium avium subsp. paratuberculosis
cagccagaacacgccccg

SEQ ID NO: 868177 - RNA, 15 nt, Mycobacterium avium subsp. paratuberculosis
cagccagaccucgcc

SEQ ID NO: 868178 - RNA, 19 nt, Mycobacterium avium subsp. paratuberculosis
cagccagaccucgccgacg

SEQ ID NO: 868179 - RNA, 22 nt, Mycobacterium avium subsp. paratuberculosis
cagccagccggugcggucggcg

SEQ ID NO: 868180 - RNA, 14 nt, Mycobacterium avium subsp. paratuberculosis
cagccagccggugg

SEQ ID NO: 868181 - RNA, 15 nt, Mycobacterium avium subsp. paratuberculosis
cagccagccgguggc

SEQ ID NO: 868182 - RNA, 20 nt, Mycobacterium avium subsp. paratuberculosis
cagccagccgguggcggcca

SEQ ID NO: 868183 - RNA, 14 nt, Mycobacterium avium subsp. paratuberculosis
cagccagccgcgcc

SEQ ID NO: 868184 - RNA, 15 nt, Mycobacterium avium subsp. paratuberculosis
cagccagccgcgccg

SEQ ID NO: 868185 - RNA, 16 nt, Mycobacterium avium subsp. paratuberculosis
cagccagccgcccagc

SEQ ID NO: 868186 - RNA, 20 nt, Mycobacterium avium subsp. paratuberculosis
cagccagccgcccagcaucg

SEQ ID NO: 868187 - RNA, 16 nt, Mycobacterium avium subsp. paratuberculosis
cagccagcccguggcc

SEQ ID NO: 868188 - RNA, 19 nt, Mycobacterium avium subsp. paratuberculosis
cagccagcccguggccagc

SEQ ID NO: 868189 - RNA, 21 nt, Mycobacterium avium subsp. paratuberculosis
cagccagcccguggccagcgc

SEQ ID NO: 868190 - RNA, 14 nt, Mycobacterium avium subsp. paratuberculosis
cagccagcccagcc

SEQ ID NO: 868191 - RNA, 16 nt, Mycobacterium avium subsp. paratuberculosis
cagccagcccagccgc

SEQ ID NO: 868192 - RNA, 13 nt, Mycobacterium avium subsp. paratuberculosis
cagccagccgccc

SEQ ID NO: 868193 - RNA, 15 nt, Mycobacterium avium subsp. paratuberculosis
cagccagcguuuggc

SEQ ID NO: 868194 - RNA, 15 nt, Mycobacterium avium subsp. paratuberculosis
cagccagcucggcgu

SEQ ID NO: 868195 - RNA, 23 nt, Mycobacterium avium subsp. paratuberculosis
cagccagcuggugaagcugccga

SEQ ID NO: 868196 - RNA, 15 nt, Mycobacterium avium subsp. paratuberculosis
cagccaggacagcgu

SEQ ID NO: 868197 - RNA, 16 nt, Mycobacterium avium subsp. paratuberculosis
cagccaggacagcguc

SEQ ID NO: 868198 - RNA, 15 nt, Mycobacterium avium subsp. paratuberculosis
cagccaggccgccgg

SEQ ID NO: 868199 - RNA, 16 nt, Mycobacterium avium subsp. paratuberculosis
cagccaggccgccggg

SEQ ID NO: 868200 - RNA, 19 nt, Mycobacterium avium subsp. paratuberculosis
cagccaggccgccgggccg

SEQ ID NO: 868201 - RNA, 14 nt, Mycobacterium avium subsp. paratuberculosis
cagccaggccgucg

SEQ ID NO: 868202 - RNA, 20 nt, Mycobacterium avium subsp. paratuberculosis
cagccaggccgucggcgcgg

SEQ ID NO: 868203 - RNA, 22 nt, Mycobacterium avium subsp. paratuberculosis
cagccaggauccgaugacgcug

SEQ ID NO: 868204 - RNA, 22 nt, Mycobacterium avium subsp. paratuberculosis
cagccaggcgaugaagccggcg

SEQ ID NO: 868205 - RNA, 24 nt, Mycobacterium avium subsp. paratuberculosis
cagccagcggucacggacaggugu

SEQ ID NO: 868206 - RNA, 14 nt, Mycobacterium avium subsp. paratuberculosis
cagccagcgcccgg

SEQ ID NO: 868207 - RNA, 16 nt, Mycobacterium avium subsp. paratuberculosis
cagccagcgcccggcg

SEQ ID NO: 868208 - RNA, 12 nt, Mycobacterium avium subsp. paratuberculosis
cagccagcgcgc

SEQ ID NO: 868209 - RNA, 13 nt, Mycobacterium avium subsp. paratuberculosis
cagccagcgcgcg

SEQ ID NO: 868210 - RNA, 14 nt, Mycobacterium avium subsp. paratuberculosis
cagccagcgcgcga

SEQ ID NO: 868211 - RNA, 16 nt, Mycobacterium avium subsp. paratuberculosis
cagccagcgcgcgauc

SEQ ID NO: 868212 - RNA, 19 nt, Mycobacterium avium subsp. paratuberculosis
cagccagccuggcggcgac

SEQ ID NO: 868213 - RNA, 20 nt, Mycobacterium avium subsp. paratuberculosis
cagccagcgacaacguggug

SEQ ID NO: 868214 - RNA, 22 nt, Mycobacterium avium subsp. paratuberculosis
cagccagucgaagaccacgaac

SEQ ID NO: 868215 - RNA, 15 nt, Mycobacterium avium subsp. paratuberculosis
cagccaguccgccgc

SEQ ID NO: 868216 - RNA, 14 nt, Mycobacterium avium subsp. paratuberculosis
cagccagucgccgg

SEQ ID NO: 868217 - RNA, 22 nt, Mycobacterium avium subsp. paratuberculosis
cagccagucgccggccaggccg

SEQ ID NO: 868218 - RNA, 20 nt, Mycobacterium avium subsp. paratuberculosis
cagccaggugugcggcacga

SEQ ID NO: 868219 - RNA, 23 nt, Mycobacterium avium subsp. paratuberculosis
cagccaggugugcggcacgaugg

SEQ ID NO: 868220 - RNA, 20 nt, Mycobacterium avium subsp. paratuberculosis
cagccagguacuccgguacc

SEQ ID NO: 868221 - RNA, 17 nt, Mycobacterium avium subsp. paratuberculosis
cagccagguccgggcac

SEQ ID NO: 868222 - RNA, 17 nt, Mycobacterium avium subsp. paratuberculosis
cagccaguugggggcca

SEQ ID NO: 868223 - RNA, 20 nt, Mycobacterium avium subsp. paratuberculosis
cagccaguugggggccagcg

SEQ ID NO: 868224 - RNA, 22 nt, Mycobacterium avium subsp. paratuberculosis
cagccaguugggggccagcgcc

SEQ ID NO: 868225 - RNA, 19 nt, Mycobacterium avium subsp. paratuberculosis
cagccauaccuugucggcg

SEQ ID NO: 868226 - RNA, 20 nt, Mycobacterium avium subsp. paratuberculosis
cagccauaccuugucggcgu

SEQ ID NO: 868227 - RNA, 17 nt, Mycobacterium avium subsp. paratuberculosis
cagccauacugacgccg

SEQ ID NO: 868228 - RNA, 18 nt, Mycobacterium avium subsp. paratuberculosis
cagccauacugacgccgg

SEQ ID NO: 868229 - RNA, 20 nt, Mycobacterium avium subsp. paratuberculosis
cagccauacugacgccgguc

SEQ ID NO: 868230 - RNA, 21 nt, Mycobacterium avium subsp. paratuberculosis
cagccauacugacgccggucg

SEQ ID NO: 868231 - RNA, 15 nt, Mycobacterium avium subsp. paratuberculosis
cagccauucgucggg

SEQ ID NO: 868232 - RNA, 15 nt, Mycobacterium avium subsp. paratuberculosis
cagccaugccggugg

SEQ ID NO: 868233 - RNA, 17 nt, Mycobacterium avium subsp. paratuberculosis
cagcccagccagcgaca

SEQ ID NO: 868234 - RNA, 15 nt, Mycobacterium avium subsp. paratuberculosis
cagcccaggcccagc

SEQ ID NO: 868235 - RNA, 16 nt, Mycobacterium avium subsp. paratuberculosis
cagcccaggcccagca

SEQ ID NO: 868236 - RNA, 23 nt, Mycobacterium avium subsp. paratuberculosis
cagcccaggucgggacguccgcg

SEQ ID NO: 868237 - RNA, 14 nt, Mycobacterium avium subsp. paratuberculosis
cagccccaccggcc

SEQ ID NO: 868238 - RNA, 22 nt, Mycobacterium avium subsp. paratuberculosis
cagccccagggugcgccgcucg

SEQ ID NO: 868239 - RNA, 15 nt, Mycobacterium avium subsp. paratuberculosis
cagccccagcgagca

SEQ ID NO: 868240 - RNA, 20 nt, Mycobacterium avium subsp. paratuberculosis
cagcccccacgcucggcgca

SEQ ID NO: 868241 - RNA, 13 nt, Mycobacterium avium subsp. paratuberculosis
cagccccagcgga

SEQ ID NO: 868242 - RNA, 23 nt, Mycobacterium avium subsp. paratuberculosis
cagccccagcacgaugacgaccg

SEQ ID NO: 868243 - RNA, 15 nt, Mycobacterium avium subsp. paratuberculosis
cagccccaccaccgc

SEQ ID NO: 868244 - RNA, 17 nt, Mycobacterium avium subsp. paratuberculosis
cagccccaccaccgcca

SEQ ID NO: 868245 - RNA, 20 nt, Mycobacterium avium subsp. paratuberculosis
cagccccaccaccgccacca

SEQ ID NO: 868246 - RNA, 22 nt, Mycobacterium avium subsp. paratuberculosis
cagccccaccaccgccaccagc

SEQ ID NO: 868247 - RNA, 15 nt, Mycobacterium avium subsp. paratuberculosis
cagcccaucccgauc

SEQ ID NO: 868248 - RNA, 21 nt, Mycobacterium avium subsp. paratuberculosis
cagcccaucccgauccgcgcc

SEQ ID NO: 868249 - RNA, 20 nt, Mycobacterium avium subsp. paratuberculosis
cagccccgucggucccgacg

SEQ ID NO: 868250 - RNA, 19 nt, Mycobacterium avium subsp. paratuberculosis
cagccccgggaaccagccc

SEQ ID NO: 868251 - RNA, 21 nt, Mycobacterium avium subsp. paratuberculosis
cagcccgcccacauacaccgg

SEQ ID NO: 868252 - RNA, 21 nt, Mycobacterium avium subsp. paratuberculosis
cagcccgcccaccacgaacgc

SEQ ID NO: 868253 - RNA, 16 nt, Mycobacterium avium subsp. paratuberculosis
cagcccgcccagcgcc

SEQ ID NO: 868254 - RNA, 19 nt, Mycobacterium avium subsp. paratuberculosis
cagcccgcccagcgccacg

SEQ ID NO: 868255 - RNA, 14 nt, Mycobacterium avium subsp. paratuberculosis
cagcccccgcagcc

SEQ ID NO: 868256 - RNA, 15 nt, Mycobacterium avium subsp. paratuberculosis
cagcccccgcagccc

SEQ ID NO: 868257 - RNA, 22 nt, Mycobacterium avium subsp. paratuberculosis
cagcccccgcgggucgucgacg

SEQ ID NO: 868258 - RNA, 14 nt, Mycobacterium avium subsp. paratuberculosis
cagcccgccgcguc

SEQ ID NO: 868259 - RNA, 15 nt, Mycobacterium avium subsp. paratuberculosis
cagcccgccgcgucc

SEQ ID NO: 868260 - RNA, 15 nt, Mycobacterium avium subsp. paratuberculosis
cagccccucgacguc

SEQ ID NO: 868261 - RNA, 16 nt, Mycobacterium avium subsp. paratuberculosis
cagccccucgacgucc

SEQ ID NO: 868262 - RNA, 12 nt, Mycobacterium avium subsp. paratuberculosis
cagccccucgcc

SEQ ID NO: 868263 - RNA, 14 nt, Mycobacterium avium subsp. paratuberculosis
cagcccgccgacca

SEQ ID NO: 868264 - RNA, 14 nt, Mycobacterium avium subsp. paratuberculosis
cagcccgccgggau

SEQ ID NO: 868265 - RNA, 15 nt, Mycobacterium avium subsp. paratuberculosis
cagcccgccgggaug

SEQ ID NO: 868266 - RNA, 20 nt, Mycobacterium avium subsp. paratuberculosis
cagcccgccgggaugcgcca

SEQ ID NO: 868267 - RNA, 13 nt, Mycobacterium avium subsp. paratuberculosis
cagcccgcgcaug

SEQ ID NO: 868268 - RNA, 12 nt, Mycobacterium avium subsp. paratuberculosis
cagcccgcgcca

SEQ ID NO: 868269 - RNA, 16 nt, Mycobacterium avium subsp. paratuberculosis
cagcccgcgccagcuc

SEQ ID NO: 868270 - RNA, 20 nt, Mycobacterium avium subsp. paratuberculosis
cagcccgcgccagcucggcg

SEQ ID NO: 868271 - RNA, 22 nt, Mycobacterium avium subsp. paratuberculosis
cagcccgcgccagcucggcggc

SEQ ID NO: 868272 - RNA, 16 nt, Mycobacterium avium subsp. paratuberculosis
cagcccgcgccgagca

SEQ ID NO: 868273 - RNA, 20 nt, Mycobacterium avium subsp. paratuberculosis
cagcccgcgccgagcaaccg

SEQ ID NO: 868274 - RNA, 16 nt, Mycobacterium avium subsp. paratuberculosis
cagccgccggcucagc

SEQ ID NO: 868275 - RNA, 19 nt, Mycobacterium avium subsp. paratuberculosis
cagccgccgggccacgccg

SEQ ID NO: 868276 - RNA, 12 nt, Mycobacterium avium subsp. paratuberculosis
cagccgccgguc

SEQ ID NO: 868277 - RNA, 13 nt, Mycobacterium avium subsp. paratuberculosis
cagccgccggucc

SEQ ID NO: 868278 - RNA, 14 nt, Mycobacterium avium subsp. paratuberculosis
cagccgccgucgcg

SEQ ID NO: 868279 - RNA, 15 nt, Mycobacterium avium subsp. paratuberculosis
cagccgccgucgcgc

SEQ ID NO: 868280 - RNA, 17 nt, Mycobacterium avium subsp. paratuberculosis
cagccgccgucgcgcca

SEQ ID NO: 868281 - RNA, 13 nt, Mycobacterium avium subsp. paratuberculosis
cagccgccgcgac

SEQ ID NO: 868282 - RNA, 23 nt, Mycobacterium avium subsp. paratuberculosis
cagccgccgcgacacccgcgacg

SEQ ID NO: 868283 - RNA, 22 nt, Mycobacterium avium subsp. paratuberculosis
cagccgccgcgccaccgaggcc

SEQ ID NO: 868284 - RNA, 16 nt, Mycobacterium avium subsp. paratuberculosis
cagccgccgcguggcc

SEQ ID NO: 868285 - RNA, 12 nt, Mycobacterium avium subsp. paratuberculosis
cagccgccggcc

SEQ ID NO: 868286 - RNA, 13 nt, Mycobacterium avium subsp. paratuberculosis
cagccgccggcca

SEQ ID NO: 868287 - RNA, 15 nt, Mycobacterium avium subsp. paratuberculosis
cagccgccggccacc

SEQ ID NO: 868288 - RNA, 17 nt, Mycobacterium avium subsp. paratuberculosis
cagccgcgacggcgggu

SEQ ID NO: 868289 - RNA, 14 nt, Mycobacterium avium subsp. paratuberculosis
cagccgccuggcga

SEQ ID NO: 868290 - RNA, 15 nt, Mycobacterium avium subsp. paratuberculosis
cagccgccuggcgaa

SEQ ID NO: 868291 - RNA, 15 nt, Mycobacterium avium subsp. paratuberculosis
cagccgcgacacgug

SEQ ID NO: 868292 - RNA, 17 nt, Mycobacterium avium subsp. paratuberculosis
cagccgcgacacgugca

SEQ ID NO: 868293 - RNA, 15 nt, Mycobacterium avium subsp. paratuberculosis
cagccgcgacagccg

SEQ ID NO: 868294 - RNA, 16 nt, Mycobacterium avium subsp. paratuberculosis
cagccgcgacagccgc

SEQ ID NO: 868295 - RNA, 19 nt, Mycobacterium avium subsp. paratuberculosis
cagccgcgacagccgcccg

SEQ ID NO: 868296 - RNA, 21 nt, Mycobacterium avium subsp. paratuberculosis
cagccgcgacagccgcccggc

SEQ ID NO: 868297 - RNA, 14 nt, Mycobacterium avium subsp. paratuberculosis
cagccgcgccgggc

SEQ ID NO: 868298 - RNA, 13 nt, Mycobacterium avium subsp. paratuberculosis
cagccgcgccggg

SEQ ID NO: 868299 - RNA, 14 nt, Mycobacterium avium subsp. paratuberculosis
cagccgcgccgccg

SEQ ID NO: 868300 - RNA, 16 nt, Mycobacterium avium subsp. paratuberculosis
cagccgcgccgccgcg

SEQ ID NO: 868301 - RNA, 19 nt, Mycobacterium avium subsp. paratuberculosis
cagccgcgccgcgccgccu

SEQ ID NO: 868302 - RNA, 13 nt, Mycobacterium avium subsp. paratuberculosis
cagccgcgcgacg

SEQ ID NO: 868303 - RNA, 12 nt, Mycobacterium avium subsp. paratuberculosis
cagccgcgcgag

SEQ ID NO: 868304 - RNA, 16 nt, Mycobacterium avium subsp. paratuberculosis
cagccgcgcccacccg

SEQ ID NO: 868305 - RNA, 17 nt, Mycobacterium avium subsp. paratuberculosis
cagccgcgcccgaugga

SEQ ID NO: 868306 - RNA, 12 nt, Mycobacterium avium subsp. paratuberculosis
cagccgcgccga

SEQ ID NO: 868307 - RNA, 15 nt, Mycobacterium avium subsp. paratuberculosis
cagccgcgccgacag

SEQ ID NO: 868308 - RNA, 23 nt, Mycobacterium avium subsp. paratuberculosis
cagccgcgccgacagaugcggca

SEQ ID NO: 868309 - RNA, 14 nt, Mycobacterium avium subsp. paratuberculosis
cagccgcgccgacg

SEQ ID NO: 868310 - RNA, 16 nt, Mycobacterium avium subsp. paratuberculosis
cagccgcgccgacgcc

SEQ ID NO: 868311 - RNA, 14 nt, Mycobacterium avium subsp. paratuberculosis
cagccggccaacag

SEQ ID NO: 868312 - RNA, 17 nt, Mycobacterium avium subsp. paratuberculosis
cagccgcgguggcggug

SEQ ID NO: 868313 - RNA, 13 nt, Mycobacterium avium subsp. paratuberculosis
cagccgcgucacg

SEQ ID NO: 868314 - RNA, 17 nt, Mycobacterium avium subsp. paratuberculosis
cagccgcgucacgucgg

SEQ ID NO: 868315 - RNA, 18 nt, Mycobacterium avium subsp. paratuberculosis
cagccgcgucacgucggc

SEQ ID NO: 868316 - RNA, 16 nt, Mycobacterium avium subsp. paratuberculosis
cagccgcucccggcgc

SEQ ID NO: 868317 - RNA, 18 nt, Mycobacterium avium subsp. paratuberculosis
cagccgcucccggcgcag

SEQ ID NO: 868318 - RNA, 20 nt, Mycobacterium avium subsp. paratuberculosis
cagccgcucccggcgcagca

SEQ ID NO: 868319 - RNA, 15 nt, Mycobacterium avium subsp. paratuberculosis
cagccgcuccgcggc

SEQ ID NO: 868320 - RNA, 17 nt, Mycobacterium avium subsp. paratuberculosis
cagccgcuccgcggcgg

SEQ ID NO: 868321 - RNA, 16 nt, Mycobacterium avium subsp. paratuberculosis
cagccgcuccggcccg

SEQ ID NO: 868322 - RNA, 17 nt, Mycobacterium avium subsp. paratuberculosis
cagccgcuccggcccga

SEQ ID NO: 868323 - RNA, 14 nt, Mycobacterium avium subsp. paratuberculosis
cagccgcuccucgu

SEQ ID NO: 868324 - RNA, 14 nt, Mycobacterium avium subsp. paratuberculosis
cagccgcgcggcgu

SEQ ID NO: 868325 - RNA, 16 nt, Mycobacterium avium subsp. paratuberculosis
cagccgcgcggcgucg

SEQ ID NO: 868326 - RNA, 20 nt, Mycobacterium avium subsp. paratuberculosis
cagccgcgcggcgucggccg

SEQ ID NO: 868327 - RNA, 14 nt, Mycobacterium avium subsp. paratuberculosis
cagccgcgcggccg

SEQ ID NO: 868328 - RNA, 16 nt, Mycobacterium avium subsp. paratuberculosis
cagccgcgcggccggc

SEQ ID NO: 868329 - RNA, 18 nt, Mycobacterium avium subsp. paratuberculosis
cagccgcgcggccggcca

SEQ ID NO: 868330 - RNA, 19 nt, Mycobacterium avium subsp. paratuberculosis
cagccgcgcggccggccac

SEQ ID NO: 868331 - RNA, 20 nt, Mycobacterium avium subsp. paratuberculosis
cagccgcgcggccggccacg

SEQ ID NO: 868332 - RNA, 15 nt, Mycobacterium avium subsp. paratuberculosis
cagccgcggacggcc

SEQ ID NO: 868333 - RNA, 17 nt, Mycobacterium avium subsp. paratuberculosis
cagccgcggacggccag

SEQ ID NO: 868334 - RNA, 20 nt, Mycobacterium avium subsp. paratuberculosis
cagccgcgcgugcagccggg

SEQ ID NO: 868335 - RNA, 14 nt, Mycobacterium avium subsp. paratuberculosis
cagccgcggcucga

SEQ ID NO: 868336 - RNA, 16 nt, Mycobacterium avium subsp. paratuberculosis
cagccgagacauagac

SEQ ID NO: 868337 - RNA, 13 nt, Mycobacterium avium subsp. paratuberculosis
cagccgagccggg

SEQ ID NO: 868338 - RNA, 15 nt, Mycobacterium avium subsp. paratuberculosis
cagccgagccgggcc

SEQ ID NO: 868339 - RNA, 15 nt, Mycobacterium avium subsp. paratuberculosis
cagccgagccggguc

SEQ ID NO: 868340 - RNA, 16 nt, Mycobacterium avium subsp. paratuberculosis
cagccgagccggguca

SEQ ID NO: 868341 - RNA, 13 nt, Mycobacterium avium subsp. paratuberculosis
cagccgccgcgga

SEQ ID NO: 868342 - RNA, 17 nt, Mycobacterium avium subsp. paratuberculosis
cagccgccgcggagcgg

SEQ ID NO: 868343 - RNA, 15 nt, Mycobacterium avium subsp. paratuberculosis
cagccgccgccgacc

SEQ ID NO: 868344 - RNA, 16 nt, Mycobacterium avium subsp. paratuberculosis
cagccgccgccgacca

SEQ ID NO: 868345 - RNA, 19 nt, Mycobacterium avium subsp. paratuberculosis
cagccgcccuuguugaugg

SEQ ID NO: 868346 - RNA, 22 nt, Mycobacterium avium subsp. paratuberculosis
cagccgcccuuguugauggugu

SEQ ID NO: 868347 - RNA, 19 nt, Mycobacterium avium subsp. paratuberculosis
cagccgauacaugugccga

SEQ ID NO: 868348 - RNA, 15 nt, Mycobacterium avium subsp. paratuberculosis
cagccgcccggcgcc

SEQ ID NO: 868349 - RNA, 21 nt, Mycobacterium avium subsp. paratuberculosis
cagccgcccggcgccccgcca

SEQ ID NO: 868350 - RNA, 13 nt, Mycobacterium avium subsp. paratuberculosis
cagccgcccgucc

SEQ ID NO: 868351 - RNA, 14 nt, Mycobacterium avium subsp. paratuberculosis
cagccgcccguccu

SEQ ID NO: 868352 - RNA, 17 nt, Mycobacterium avium subsp. paratuberculosis
cagccgcccguccugga

SEQ ID NO: 868353 - RNA, 12 nt, Mycobacterium avium subsp. paratuberculosis
cagcccggccag

SEQ ID NO: 868354 - RNA, 20 nt, Mycobacterium avium subsp. paratuberculosis
cagccgaaguauccggucag

SEQ ID NO: 868355 - RNA, 14 nt, Mycobacterium avium subsp. paratuberculosis
cagcccggccgccg

SEQ ID NO: 868356 - RNA, 15 nt, Mycobacterium avium subsp. paratuberculosis
cagcccggccgccga

SEQ ID NO: 868357 - RNA, 14 nt, Mycobacterium avium subsp. paratuberculosis
cagcccggcccagc

SEQ ID NO: 868358 - RNA, 16 nt, Mycobacterium avium subsp. paratuberculosis
cagcccggcccagccg

SEQ ID NO: 868359 - RNA, 16 nt, Mycobacterium avium subsp. paratuberculosis
cagcccggcccgcauc

SEQ ID NO: 868360 - RNA, 15 nt, Mycobacterium avium subsp. paratuberculosis
cagcccggcccgucg

SEQ ID NO: 868361 - RNA, 13 nt, Mycobacterium avium subsp. paratuberculosis
cagcccggccagc

SEQ ID NO: 868362 - RNA, 14 nt, Mycobacterium avium subsp. paratuberculosis
cagcccggccagca

SEQ ID NO: 868363 - RNA, 15 nt, Mycobacterium avium subsp. paratuberculosis
cagcccggccagcac

SEQ ID NO: 868364 - RNA, 18 nt, Mycobacterium avium subsp. paratuberculosis
cagcccggccagcacccg

SEQ ID NO: 868365 - RNA, 15 nt, Mycobacterium avium subsp. paratuberculosis
cagcccggccagccg

SEQ ID NO: 868366 - RNA, 19 nt, Mycobacterium avium subsp. paratuberculosis
cagcccggccagccgggcg

SEQ ID NO: 868367 - RNA, 14 nt, Mycobacterium avium subsp. paratuberculosis
cagcccggccagcg

SEQ ID NO: 868368 - RNA, 16 nt, Mycobacterium avium subsp. paratuberculosis
cagcccggccagcggc

SEQ ID NO: 868369 - RNA, 17 nt, Mycobacterium avium subsp. paratuberculosis
cagcccggccagcggca

SEQ ID NO: 868370 - RNA, 18 nt, Mycobacterium avium subsp. paratuberculosis
cagcccggaggcgaugcg

SEQ ID NO: 868371 - RNA, 20 nt, Mycobacterium avium subsp. paratuberculosis
cagcccggaguagccgguuc

SEQ ID NO: 868372 - RNA, 23 nt, Mycobacterium avium subsp. paratuberculosis
cagcccgcgcgagcgcagcgcca

SEQ ID NO: 868373 - RNA, 22 nt, Mycobacterium avium subsp. paratuberculosis
cagcccggaaucgucggccacg

SEQ ID NO: 868374 - RNA, 20 nt, Mycobacterium avium subsp. paratuberculosis
cagcccgcugaccaggccga

SEQ ID NO: 868375 - RNA, 23 nt, Mycobacterium avium subsp. paratuberculosis
cagcccgcugaccaggccgauga

SEQ ID NO: 868376 - RNA, 13 nt, Mycobacterium avium subsp. paratuberculosis
cagcccgcgucgc

SEQ ID NO: 868377 - RNA, 14 nt, Mycobacterium avium subsp. paratuberculosis
cagcccgcgucgcg

SEQ ID NO: 868378 - RNA, 15 nt, Mycobacterium avium subsp. paratuberculosis
cagcccgcgucgcgc

SEQ ID NO: 868379 - RNA, 17 nt, Mycobacterium avium subsp. paratuberculosis
cagcccgcgucgcgcag

SEQ ID NO: 868380 - RNA, 16 nt, Mycobacterium avium subsp. paratuberculosis
cagcccgcggaucgcg

SEQ ID NO: 868381 - RNA, 19 nt, Mycobacterium avium subsp. paratuberculosis
cagcccgcguccagcagca

SEQ ID NO: 868382 - RNA, 18 nt, Mycobacterium avium subsp. paratuberculosis
cagcgccagggugccccg

SEQ ID NO: 868383 - RNA, 17 nt, Mycobacterium avium subsp. paratuberculosis
cagcgccagguggguga

SEQ ID NO: 868384 - RNA, 14 nt, Mycobacterium avium subsp. paratuberculosis
cagcgccaugccgc

SEQ ID NO: 868385 - RNA, 17 nt, Mycobacterium avium subsp. paratuberculosis
cagcgccaugccgccga

SEQ ID NO: 868386 - RNA, 18 nt, Mycobacterium avium subsp. paratuberculosis
cagcgccaugccgccgac

SEQ ID NO: 868387 - RNA, 19 nt, Mycobacterium avium subsp. paratuberculosis
cagcgccaugccgccgacc

SEQ ID NO: 868388 - RNA, 20 nt, Mycobacterium avium subsp. paratuberculosis
cagcgccacgcucaugcccg

SEQ ID NO: 868389 - RNA, 13 nt, Mycobacterium avium subsp. paratuberculosis
cagcgccgcgacg

SEQ ID NO: 868390 - RNA, 17 nt, Mycobacterium avium subsp. paratuberculosis
cagcgccgcgacgaacu

SEQ ID NO: 868391 - RNA, 18 nt, Mycobacterium avium subsp. paratuberculosis
cagcgccgcgcgcgcggc

SEQ ID NO: 868392 - RNA, 18 nt, Mycobacterium avium subsp. paratuberculosis
cagcgccgcccgcaguuc

SEQ ID NO: 868393 - RNA, 15 nt, Mycobacterium avium subsp. paratuberculosis
cagcgccgccaccgg

SEQ ID NO: 868394 - RNA, 16 nt, Mycobacterium avium subsp. paratuberculosis
cagcgccgccaccggc

SEQ ID NO: 868395 - RNA, 15 nt, Mycobacterium avium subsp. paratuberculosis
cagcgccgccagccg

SEQ ID NO: 868396 - RNA, 19 nt, Mycobacterium avium subsp. paratuberculosis
cagcgccgccagccgcagc

SEQ ID NO: 868397 - RNA, 15 nt, Mycobacterium avium subsp. paratuberculosis
cagcgccgccacggc

SEQ ID NO: 868398 - RNA, 19 nt, Mycobacterium avium subsp. paratuberculosis
cagcgccgccaaccagguc

SEQ ID NO: 868399 - RNA, 16 nt, Mycobacterium avium subsp. paratuberculosis
cagcgcccaccgcucg

SEQ ID NO: 868400 - RNA, 18 nt, Mycobacterium avium subsp. paratuberculosis
cagcgcauccaccagggc

SEQ ID NO: 868401 - RNA, 18 nt, Mycobacterium avium subsp. paratuberculosis
cagcgcaucgccggcgau

SEQ ID NO: 868402 - RNA, 21 nt, Mycobacterium avium subsp. paratuberculosis
cagcgcaucggucaccagcuc

SEQ ID NO: 868403 - RNA, 15 nt, Mycobacterium avium subsp. paratuberculosis
cagcgcaucggugag

SEQ ID NO: 868404 - RNA, 21 nt, Mycobacterium avium subsp. paratuberculosis
cagcgcaucggugagacgacc

SEQ ID NO: 868405 - RNA, 15 nt, Mycobacterium avium subsp. paratuberculosis
cagcgcaucguugcc

SEQ ID NO: 868406 - RNA, 23 nt, Mycobacterium avium subsp. paratuberculosis
cagcgcaucguugccggcggcga

SEQ ID NO: 868407 - RNA, 17 nt, Mycobacterium avium subsp. paratuberculosis
cagcgccaacauggcgc

SEQ ID NO: 868408 - RNA, 13 nt, Mycobacterium avium subsp. paratuberculosis
cagcgccacaccg

SEQ ID NO: 868409 - RNA, 17 nt, Mycobacterium avium subsp. paratuberculosis
cagcgccacaccgaaga

SEQ ID NO: 868410 - RNA, 16 nt, Mycobacterium avium subsp. paratuberculosis
cagcgccaccagcacc

SEQ ID NO: 868411 - RNA, 17 nt, Mycobacterium avium subsp. paratuberculosis
cagcgccaccagcaccg

SEQ ID NO: 868412 - RNA, 14 nt, Mycobacterium avium subsp. paratuberculosis
cagcgccaccagca

SEQ ID NO: 868413 - RNA, 14 nt, Mycobacterium avium subsp. paratuberculosis
cagcgccaccagcu

SEQ ID NO: 868414 - RNA, 15 nt, Mycobacterium avium subsp. paratuberculosis
cagcgccaccagcuc

SEQ ID NO: 868415 - RNA, 16 nt, Mycobacterium avium subsp. paratuberculosis
cagcgccaccagcucc

SEQ ID NO: 868416 - RNA, 19 nt, Mycobacterium avium subsp. paratuberculosis
cagcgagcgguuggcgacg

SEQ ID NO: 868417 - RNA, 22 nt, Mycobacterium avium subsp. paratuberculosis
cagcgaucggcggcucgccggc

SEQ ID NO: 868418 - RNA, 19 nt, Mycobacterium avium subsp. paratuberculosis
cagcgauugcggccgccgg

SEQ ID NO: 868419 - RNA, 20 nt, Mycobacterium avium subsp. paratuberculosis
cagcgauugcggccgccggc

SEQ ID NO: 868420 - RNA, 22 nt, Mycobacterium avium subsp. paratuberculosis
cagcgauugcggccgccggcca

SEQ ID NO: 868421 - RNA, 15 nt, Mycobacterium avium subsp. paratuberculosis
cagcgauucccgccg

SEQ ID NO: 868422 - RNA, 18 nt, Mycobacterium avium subsp. paratuberculosis
cagcgauucccgccggau

SEQ ID NO: 868423 - RNA, 17 nt, Mycobacterium avium subsp. paratuberculosis
cagcgcaguucaccgaa

SEQ ID NO: 868424 - RNA, 21 nt, Mycobacterium avium subsp. paratuberculosis
cagcgcaguucaccgaagucc

SEQ ID NO: 868425 - RNA, 13 nt, Mycobacterium avium subsp. paratuberculosis
cagcgcaaccgcg

SEQ ID NO: 868426 - RNA, 18 nt, Mycobacterium avium subsp. paratuberculosis
cagcgcaaccgcggcggc

SEQ ID NO: 868427 - RNA, 16 nt, Mycobacterium avium subsp. paratuberculosis
cagccguugggcagcu

SEQ ID NO: 868428 - RNA, 19 nt, Mycobacterium avium subsp. paratuberculosis
cagccguugggcagcucgg

SEQ ID NO: 868429 - RNA, 20 nt, Mycobacterium avium subsp. paratuberculosis
cagccguugggcagcucggc

SEQ ID NO: 868430 - RNA, 15 nt, Mycobacterium avium subsp. paratuberculosis
cagccguuguccacg

SEQ ID NO: 868431 - RNA, 16 nt, Mycobacterium avium subsp. paratuberculosis
cagccguuguccacga

SEQ ID NO: 868432 - RNA, 15 nt, Mycobacterium avium subsp. paratuberculosis
cagccggcgagcgcg

SEQ ID NO: 868433 - RNA, 12 nt, Mycobacterium avium subsp. paratuberculosis
cagccggcgcac

SEQ ID NO: 868434 - RNA, 14 nt, Mycobacterium avium subsp. paratuberculosis
cagccggcgcacca

SEQ ID NO: 868435 - RNA, 18 nt, Mycobacterium avium subsp. paratuberculosis
cagccguucuagguucga

SEQ ID NO: 868436 - RNA, 11 nt, Mycobacterium avium subsp. paratuberculosis
cagccggccga

SEQ ID NO: 868437 - RNA, 15 nt, Mycobacterium avium subsp. paratuberculosis
cagccggccgacgcg

SEQ ID NO: 868438 - RNA, 15 nt, Mycobacterium avium subsp. paratuberculosis
cagccggccggccga

SEQ ID NO: 868439 - RNA, 17 nt, Mycobacterium avium subsp. paratuberculosis
cagccggccggccgaca

SEQ ID NO: 868440 - RNA, 13 nt, Mycobacterium avium subsp. paratuberculosis
cagccggccggcg

SEQ ID NO: 868441 - RNA, 14 nt, Mycobacterium avium subsp. paratuberculosis
cagccggccggcga

SEQ ID NO: 868442 - RNA, 23 nt, Mycobacterium avium subsp. paratuberculosis
cagccggccggcgaagccgcuca

SEQ ID NO: 868443 - RNA, 18 nt, Mycobacterium avium subsp. paratuberculosis
cagccggccggcggacgc

SEQ ID NO: 868444 - RNA, 11 nt, Mycobacterium avium subsp. paratuberculosis
cagccggccgu

SEQ ID NO: 868445 - RNA, 17 nt, Mycobacterium avium subsp. paratuberculosis
cagccggccguccacgg

SEQ ID NO: 868446 - RNA, 22 nt, Mycobacterium avium subsp. paratuberculosis
cagccggccugcuuuucggccg

SEQ ID NO: 868447 - RNA, 13 nt, Mycobacterium avium subsp. paratuberculosis
cagccggccaccg

SEQ ID NO: 868448 - RNA, 20 nt, Mycobacterium avium subsp. paratuberculosis
cagccggccaccgccccagc

SEQ ID NO: 868449 - RNA, 22 nt, Mycobacterium avium subsp. paratuberculosis
cagccggccaccgccccagccg

SEQ ID NO: 868450 - RNA, 13 nt, Mycobacterium avium subsp. paratuberculosis
cagccggccaccu

SEQ ID NO: 868451 - RNA, 15 nt, Mycobacterium avium subsp. paratuberculosis
cagccggccaucucg

SEQ ID NO: 868452 - RNA, 15 nt, Mycobacterium avium subsp. paratuberculosis
cagccuggcggcgac

SEQ ID NO: 868453 - RNA, 17 nt, Mycobacterium avium subsp. paratuberculosis
cagccuucuucgccggg

SEQ ID NO: 868454 - RNA, 15 nt, Mycobacterium avium subsp. paratuberculosis
cagccuugcagccgc

SEQ ID NO: 868455 - RNA, 19 nt, Mycobacterium avium subsp. paratuberculosis
cagccuugcagccgcugcc

SEQ ID NO: 868456 - RNA, 20 nt, Mycobacterium avium subsp. paratuberculosis
cagccuugcagccgcugccg

SEQ ID NO: 868457 - RNA, 21 nt, Mycobacterium avium subsp. paratuberculosis
cagccugcggugaugcgcggc

SEQ ID NO: 868458 - RNA, 19 nt, Mycobacterium avium subsp. paratuberculosis
cagccugaucuugcugguc

SEQ ID NO: 868459 - RNA, 16 nt, Mycobacterium avium subsp. paratuberculosis
cagcgacgagagcgga

SEQ ID NO: 868460 - RNA, 19 nt, Mycobacterium avium subsp. paratuberculosis
cagcgaccugguccaccgc

SEQ ID NO: 868461 - RNA, 22 nt, Mycobacterium avium subsp. paratuberculosis
cagcgaccugguccaccgcggc

SEQ ID NO: 868462 - RNA, 15 nt, Mycobacterium avium subsp. paratuberculosis
cagcgacgccagcgg

SEQ ID NO: 868463 - RNA, 17 nt, Mycobacterium avium subsp. paratuberculosis
cagcgacgccagcggca

SEQ ID NO: 868464 - RNA, 22 nt, Mycobacterium avium subsp. paratuberculosis
cagcgacgcccagaacgacgcg

SEQ ID NO: 868465 - RNA, 19 nt, Mycobacterium avium subsp. paratuberculosis
cagcgacuugaccagcagc

SEQ ID NO: 868466 - RNA, 15 nt, Mycobacterium avium subsp. paratuberculosis
cagcgacuugccgcc

SEQ ID NO: 868467 - RNA, 16 nt, Mycobacterium avium subsp. paratuberculosis
cagcgacuugccgccg

SEQ ID NO: 868468 - RNA, 17 nt, Mycobacterium avium subsp. paratuberculosis
cagcgacuugccgccgg

SEQ ID NO: 868469 - RNA, 18 nt, Mycobacterium avium subsp. paratuberculosis
cagcgacuugccgccggc

SEQ ID NO: 868470 - RNA, 21 nt, Mycobacterium avium subsp. paratuberculosis
cagcgacuugccgccggcgca

SEQ ID NO: 868471 - RNA, 17 nt, Mycobacterium avium subsp. paratuberculosis
cagcgagaagucgccga

SEQ ID NO: 868472 - RNA, 21 nt, Mycobacterium avium subsp. paratuberculosis
cagcgagaagucgccgacgcc

SEQ ID NO: 868473 - RNA, 19 nt, Mycobacterium avium subsp. paratuberculosis
cagcgagaagucgcucagc

SEQ ID NO: 868474 - RNA, 13 nt, Mycobacterium avium subsp. paratuberculosis
cagcgagaccggc

SEQ ID NO: 868475 - RNA, 14 nt, Mycobacterium avium subsp. paratuberculosis
cagcgagaccggca

SEQ ID NO: 868476 - RNA, 15 nt, Mycobacterium avium subsp. paratuberculosis
cagcgagaccggcac

SEQ ID NO: 868477 - RNA, 21 nt, Mycobacterium avium subsp. paratuberculosis
cagcgagaccggcacggugca

SEQ ID NO: 868478 - RNA, 16 nt, Mycobacterium avium subsp. paratuberculosis
cagcgagaccucccgg

SEQ ID NO: 868479 - RNA, 19 nt, Mycobacterium avium subsp. paratuberculosis
cagcgagaccucccggcgc

SEQ ID NO: 868480 - RNA, 13 nt, Mycobacterium avium subsp. paratuberculosis
cagcgagacgacc

SEQ ID NO: 868481 - RNA, 14 nt, Mycobacterium avium subsp. paratuberculosis
cagcgagacgacca

SEQ ID NO: 868482 - RNA, 21 nt, Mycobacterium avium subsp. paratuberculosis
cagcgagcccuucgcggugug

SEQ ID NO: 868483 - RNA, 19 nt, Mycobacterium avium subsp. paratuberculosis
cagcgagcaggucaccgga

SEQ ID NO: 868484 - RNA, 14 nt, Mycobacterium avium subsp. paratuberculosis
cagcgagccgauga

SEQ ID NO: 868485 - RNA, 14 nt, Mycobacterium avium subsp. paratuberculosis
cagcgagccgucga

SEQ ID NO: 868486 - RNA, 15 nt, Mycobacterium avium subsp. paratuberculosis
cagcgagccgucgac

SEQ ID NO: 868487 - RNA, 15 nt, Mycobacterium avium subsp. paratuberculosis
cagcgaccagucggc

SEQ ID NO: 868488 - RNA, 18 nt, Mycobacterium avium subsp. paratuberculosis
cagcgaccagucggcguc

SEQ ID NO: 868489 - RNA, 19 nt, Mycobacterium avium subsp. paratuberculosis
cagcgaccagucggcgucu

SEQ ID NO: 868490 - RNA, 19 nt, Mycobacterium avium subsp. paratuberculosis
cagcgacccgaaccggauc

SEQ ID NO: 868491 - RNA, 14 nt, Mycobacterium avium subsp. paratuberculosis
cagcgacagcgcgu

SEQ ID NO: 868492 - RNA, 16 nt, Mycobacterium avium subsp. paratuberculosis
cagcgacaugaccacc

SEQ ID NO: 868493 - RNA, 19 nt, Mycobacterium avium subsp. paratuberculosis
cagcgacaugaccaccgcg

SEQ ID NO: 868494 - RNA, 23 nt, Mycobacterium avium subsp. paratuberculosis
cagcgacaugaccaccgcgucgg

SEQ ID NO: 868495 - RNA, 21 nt, Mycobacterium avium subsp. paratuberculosis
cagcgaaccgacauaggucag

SEQ ID NO: 868496 - RNA, 13 nt, Mycobacterium avium subsp. paratuberculosis
cagccuucgccgc

SEQ ID NO: 868497 - RNA, 16 nt, Mycobacterium avium subsp. paratuberculosis
cagcgaacccgccagg

SEQ ID NO: 868498 - RNA, 17 nt, Mycobacterium avium subsp. paratuberculosis
cagccuucuuggcgggc

SEQ ID NO: 868499 - RNA, 19 nt, Mycobacterium avium subsp. paratuberculosis
cagcgaaagcgcuuggcgg

SEQ ID NO: 868500 - RNA, 18 nt, Mycobacterium avium subsp. paratuberculosis
cacggugcacacgccgag

SEQ ID NO: 868501 - RNA, 19 nt, Mycobacterium avium subsp. paratuberculosis
cacggugcacacgccgagg

SEQ ID NO: 868502 - RNA, 15 nt, Mycobacterium avium subsp. paratuberculosis
cacggugcagcagcg

SEQ ID NO: 868503 - RNA, 22 nt, Mycobacterium avium subsp. paratuberculosis
cacggugcagcagcgccgcgac

SEQ ID NO: 868504 - RNA, 23 nt, Mycobacterium avium subsp. paratuberculosis
cacggugcagcagcgccgcgacg

SEQ ID NO: 868505 - RNA, 22 nt, Mycobacterium avium subsp. paratuberculosis
cacggugccgaguucgaccucg

SEQ ID NO: 868506 - RNA, 23 nt, Mycobacterium avium subsp. paratuberculosis
cacggugccgaguucgaccucgg

SEQ ID NO: 868507 - RNA, 15 nt, Mycobacterium avium subsp. paratuberculosis
cacggugccgccguc

SEQ ID NO: 868508 - RNA, 16 nt, Mycobacterium avium subsp. paratuberculosis
cacgguggccgccacc

SEQ ID NO: 868509 - RNA, 14 nt, Mycobacterium avium subsp. paratuberculosis
cacgguggccgcga

SEQ ID NO: 868510 - RNA, 17 nt, Mycobacterium avium subsp. paratuberculosis
cacggugcgcaccgaca

SEQ ID NO: 868511 - RNA, 14 nt, Mycobacterium avium subsp. paratuberculosis
cacggugcgccggc

SEQ ID NO: 868512 - RNA, 16 nt, Mycobacterium avium subsp. paratuberculosis
cacggugcgccggcag

SEQ ID NO: 868513 - RNA, 17 nt, Mycobacterium avium subsp. paratuberculosis
cacggugcgggugccga

SEQ ID NO: 868514 - RNA, 20 nt, Mycobacterium avium subsp. paratuberculosis
cacggugcgggugccgaaca

SEQ ID NO: 868515 - RNA, 13 nt, Mycobacterium avium subsp. paratuberculosis
cacggugaucagc

SEQ ID NO: 868516 - RNA, 14 nt, Mycobacterium avium subsp. paratuberculosis
cacggucggcgggu

SEQ ID NO: 868517 - RNA, 14 nt, Mycobacterium avium subsp. paratuberculosis
cacggucggcgucc

SEQ ID NO: 868518 - RNA, 17 nt, Mycobacterium avium subsp. paratuberculosis
cacggugaacgggccgc

SEQ ID NO: 868519 - RNA, 16 nt, Mycobacterium avium subsp. paratuberculosis
cacggugaacgucgau

SEQ ID NO: 868520 - RNA, 18 nt, Mycobacterium avium subsp. paratuberculosis
cacggucuggcuggugac

SEQ ID NO: 868521 - RNA, 18 nt, Mycobacterium avium subsp. paratuberculosis
cacggucugguggcagcg

SEQ ID NO: 868522 - RNA, 13 nt, Mycobacterium avium subsp. paratuberculosis
cacggucggcccc

SEQ ID NO: 868523 - RNA, 17 nt, Mycobacterium avium subsp. paratuberculosis
cacggucggccccgcgc

SEQ ID NO: 868524 - RNA, 17 nt, Mycobacterium avium subsp. paratuberculosis
cacggucgccgcgccgc

SEQ ID NO: 868525 - RNA, 19 nt, Mycobacterium avium subsp. paratuberculosis
cacggucgccgcgccgccg

SEQ ID NO: 868526 - RNA, 21 nt, Mycobacterium avium subsp. paratuberculosis
cacggucgccgcgccgccggu

SEQ ID NO: 868527 - RNA, 22 nt, Mycobacterium avium subsp. paratuberculosis
cacggucgccgcgccgccggug

SEQ ID NO: 868528 - RNA, 12 nt, Mycobacterium avium subsp. paratuberculosis
cacggucgccgg

SEQ ID NO: 868529 - RNA, 17 nt, Mycobacterium avium subsp. paratuberculosis
cacgguguagacgcggg

SEQ ID NO: 868530 - RNA, 21 nt, Mycobacterium avium subsp. paratuberculosis
cacgguguagacgcgggccgg

SEQ ID NO: 868531 - RNA, 16 nt, Mycobacterium avium subsp. paratuberculosis
cacggugggcgccggg

SEQ ID NO: 868532 - RNA, 22 nt, Mycobacterium avium subsp. paratuberculosis
cacgguggugacccgcaacucg

SEQ ID NO: 868533 - RNA, 13 nt, Mycobacterium avium subsp. paratuberculosis
cacggugggacgg

SEQ ID NO: 868534 - RNA, 16 nt, Mycobacterium avium subsp. paratuberculosis
cacggugggacggcgg

SEQ ID NO: 868535 - RNA, 18 nt, Mycobacterium avium subsp. paratuberculosis
cacggugggacggcgggu

SEQ ID NO: 868536 - RNA, 17 nt, Mycobacterium avium subsp. paratuberculosis
cacgguguugcgcaccc

SEQ ID NO: 868537 - RNA, 20 nt, Mycobacterium avium subsp. paratuberculosis
cacggugucgcuguaggcca

SEQ ID NO: 868538 - RNA, 18 nt, Mycobacterium avium subsp. paratuberculosis
cacgguuggccggcccgc

SEQ ID NO: 868539 - RNA, 14 nt, Mycobacterium avium subsp. paratuberculosis
cacgguuucgccgu

SEQ ID NO: 868540 - RNA, 19 nt, Mycobacterium avium subsp. paratuberculosis
cacgguuucgccguacagc

SEQ ID NO: 868541 - RNA, 15 nt, Mycobacterium avium subsp. paratuberculosis
cacguacagcggcgg

SEQ ID NO: 868542 - RNA, 20 nt, Mycobacterium avium subsp. paratuberculosis
cacgggcggcagggccagca

SEQ ID NO: 868543 - RNA, 19 nt, Mycobacterium avium subsp. paratuberculosis
cacgggcacaccgucgucc

SEQ ID NO: 868544 - RNA, 15 nt, Mycobacterium avium subsp. paratuberculosis
cacgggaugaucggc

SEQ ID NO: 868545 - RNA, 16 nt, Mycobacterium avium subsp. paratuberculosis
cacgggaugaucggcg

SEQ ID NO: 868546 - RNA, 16 nt, Mycobacterium avium subsp. paratuberculosis
cacgggaugcggcacg

SEQ ID NO: 868547 - RNA, 14 nt, Mycobacterium avium subsp. paratuberculosis
cacgggccgcgccg

SEQ ID NO: 868548 - RNA, 22 nt, Mycobacterium avium subsp. paratuberculosis
cacggggacgcugaacagcccg

SEQ ID NO: 868549 - RNA, 18 nt, Mycobacterium avium subsp. paratuberculosis
cacgggggaguagcgcgc

SEQ ID NO: 868550 - RNA, 19 nt, Mycobacterium avium subsp. paratuberculosis
cacgggggaguagcgcgcg

SEQ ID NO: 868551 - RNA, 19 nt, Mycobacterium avium subsp. paratuberculosis
cacggggugcgugacgggc

SEQ ID NO: 868552 - RNA, 22 nt, Mycobacterium avium subsp. paratuberculosis
cacggggugcgugacgggcuga

SEQ ID NO: 868553 - RNA, 13 nt, Mycobacterium avium subsp. paratuberculosis
cacgggucgccga

SEQ ID NO: 868554 - RNA, 13 nt, Mycobacterium avium subsp. paratuberculosis
cacgggucgccgu

SEQ ID NO: 868555 - RNA, 15 nt, Mycobacterium avium subsp. paratuberculosis
cacgggucgccgugg

SEQ ID NO: 868556 - RNA, 15 nt, Mycobacterium avium subsp. paratuberculosis
cacgggucggucggc

SEQ ID NO: 868557 - RNA, 18 nt, Mycobacterium avium subsp. paratuberculosis
cacgggucggucggcccg

SEQ ID NO: 868558 - RNA, 14 nt, Mycobacterium avium subsp. paratuberculosis
cacggggcagaccg

SEQ ID NO: 868559 - RNA, 14 nt, Mycobacterium avium subsp. paratuberculosis
cacgggcggcgggg

SEQ ID NO: 868560 - RNA, 13 nt, Mycobacterium avium subsp. paratuberculosis
cacgggcgggcag

SEQ ID NO: 868561 - RNA, 13 nt, Mycobacterium avium subsp. paratuberculosis
cacgggcggucgg

SEQ ID NO: 868562 - RNA, 18 nt, Mycobacterium avium subsp. paratuberculosis
cacgggcggucggacgcg

SEQ ID NO: 868563 - RNA, 24 nt, Mycobacterium avium subsp. paratuberculosis
cacgggcguguaguccaggucgau

SEQ ID NO: 868564 - RNA, 16 nt, Mycobacterium avium subsp. paratuberculosis
cacgggcugaccgcca

SEQ ID NO: 868565 - RNA, 17 nt, Mycobacterium avium subsp. paratuberculosis
cacgggcugaccgccag

SEQ ID NO: 868566 - RNA, 15 nt, Mycobacterium avium subsp. paratuberculosis
cacggucagcucgcg

SEQ ID NO: 868567 - RNA, 21 nt, Mycobacterium avium subsp. paratuberculosis
cacggucagcucgcgcccggc

SEQ ID NO: 868568 - RNA, 13 nt, Mycobacterium avium subsp. paratuberculosis
cacggucaggccg

SEQ ID NO: 868569 - RNA, 14 nt, Mycobacterium avium subsp. paratuberculosis
cacggucaggccgg

SEQ ID NO: 868570 - RNA, 18 nt, Mycobacterium avium subsp. paratuberculosis
cacggucaggcgcagcca

SEQ ID NO: 868571 - RNA, 15 nt, Mycobacterium avium subsp. paratuberculosis
cacgguccagguccu

SEQ ID NO: 868572 - RNA, 23 nt, Mycobacterium avium subsp. paratuberculosis
cacgguccagguccuugaggaug

SEQ ID NO: 868573 - RNA, 18 nt, Mycobacterium avium subsp. paratuberculosis
cacgguccaucagcaccg

SEQ ID NO: 868574 - RNA, 22 nt, Mycobacterium avium subsp. paratuberculosis
cacgguccccgcgcccgccgcg

SEQ ID NO: 868575 - RNA, 18 nt, Mycobacterium avium subsp. paratuberculosis
cacggguugagccagacg

SEQ ID NO: 868576 - RNA, 17 nt, Mycobacterium avium subsp. paratuberculosis
cacggucacagccgcga

SEQ ID NO: 868577 - RNA, 21 nt, Mycobacterium avium subsp. paratuberculosis
cacggucacagccgcgauagc

SEQ ID NO: 868578 - RNA, 14 nt, Mycobacterium avium subsp. paratuberculosis
cacggucagcgcgu

SEQ ID NO: 868579 - RNA, 16 nt, Mycobacterium avium subsp. paratuberculosis
cacggucagcgcgucg

SEQ ID NO: 868580 - RNA, 20 nt, Mycobacterium avium subsp. paratuberculosis
cacggucagcgcgucggcga

SEQ ID NO: 868581 - RNA, 22 nt, Mycobacterium avium subsp. paratuberculosis
cacggucagcgcgucggcgacc

SEQ ID NO: 868582 - RNA, 15 nt, Mycobacterium avium subsp. paratuberculosis
cacggucagcggcca

SEQ ID NO: 868583 - RNA, 14 nt, Mycobacterium avium subsp. paratuberculosis
cacggucagcucgc

SEQ ID NO: 868584 - RNA, 12 nt, Mycobacterium avium subsp. paratuberculosis
cacggcggccga

SEQ ID NO: 868585 - RNA, 22 nt, Mycobacterium avium subsp. paratuberculosis
cacggcggccgaauccggccgg

SEQ ID NO: 868586 - RNA, 16 nt, Mycobacterium avium subsp. paratuberculosis
cacggcggcgaacgcc

SEQ ID NO: 868587 - RNA, 13 nt, Mycobacterium avium subsp. paratuberculosis
cacggcggcgaag

SEQ ID NO: 868588 - RNA, 14 nt, Mycobacterium avium subsp. paratuberculosis
cacggcgcgcaccg

SEQ ID NO: 868589 - RNA, 19 nt, Mycobacterium avium subsp. paratuberculosis
cacggcgcgcaccgcgggc

SEQ ID NO: 868590 - RNA, 14 nt, Mycobacterium avium subsp. paratuberculosis
cacggcgcugagcg

SEQ ID NO: 868591 - RNA, 16 nt, Mycobacterium avium subsp. paratuberculosis
cacggcgcugagcgac

SEQ ID NO: 868592 - RNA, 17 nt, Mycobacterium avium subsp. paratuberculosis
cacggcgcugagcgaca

SEQ ID NO: 868593 - RNA, 23 nt, Mycobacterium avium subsp. paratuberculosis
cacggcgcuggcgaccaucagcc

SEQ ID NO: 868594 - RNA, 14 nt, Mycobacterium avium subsp. paratuberculosis
cacggcucgggggc

SEQ ID NO: 868595 - RNA, 22 nt, Mycobacterium avium subsp. paratuberculosis
cacggcguugaccaacgccgcc

SEQ ID NO: 868596 - RNA, 23 nt, Mycobacterium avium subsp. paratuberculosis
cacggcguugaccaacgccgccu

SEQ ID NO: 868597 - RNA, 18 nt, Mycobacterium avium subsp. paratuberculosis
cacggcguugaccgggcc

SEQ ID NO: 868598 - RNA, 19 nt, Mycobacterium avium subsp. paratuberculosis
cacggcguugaccgggccg

SEQ ID NO: 868599 - RNA, 13 nt, Mycobacterium avium subsp. paratuberculosis
cacggcugccgac

SEQ ID NO: 868600 - RNA, 14 nt, Mycobacterium avium subsp. paratuberculosis
cacggcgucggcgu

SEQ ID NO: 868601 - RNA, 12 nt, Mycobacterium avium subsp. paratuberculosis
cacggcgucggc

SEQ ID NO: 868602 - RNA, 20 nt, Mycobacterium avium subsp. paratuberculosis
cacggcggugucggcggcaa

SEQ ID NO: 868603 - RNA, 24 nt, Mycobacterium avium subsp. paratuberculosis
cacggcggggucaagcggcagacc

SEQ ID NO: 868604 - RNA, 18 nt, Mycobacterium avium subsp. paratuberculosis
cacggcggggucucaauc

SEQ ID NO: 868605 - RNA, 13 nt, Mycobacterium avium subsp. paratuberculosis
cacggcgggucgg

SEQ ID NO: 868606 - RNA, 22 nt, Mycobacterium avium subsp. paratuberculosis
cacggcgguagcguggguucga

SEQ ID NO: 868607 - RNA, 13 nt, Mycobacterium avium subsp. paratuberculosis
cacggcggcgcgg

SEQ ID NO: 868608 - RNA, 18 nt, Mycobacterium avium subsp. paratuberculosis
cacggcggcgcgggcggc

SEQ ID NO: 868609 - RNA, 22 nt, Mycobacterium avium subsp. paratuberculosis
cacggcgccaccagccacaccg

SEQ ID NO: 868610 - RNA, 11 nt, Mycobacterium avium subsp. paratuberculosis
cacggcgccgu

SEQ ID NO: 868611 - RNA, 13 nt, Mycobacterium avium subsp. paratuberculosis
cacggcgccgugc

SEQ ID NO: 868612 - RNA, 18 nt, Mycobacterium avium subsp. paratuberculosis
cacggcgccgugccgcgc

SEQ ID NO: 868613 - RNA, 20 nt, Mycobacterium avium subsp. paratuberculosis
cacggcgccgugccgcgcgg

SEQ ID NO: 868614 - RNA, 21 nt, Mycobacterium avium subsp. paratuberculosis
cacggcgccgugccgcgcggc

SEQ ID NO: 868615 - RNA, 22 nt, Mycobacterium avium subsp. paratuberculosis
cacggcgccgugccgcgcggcg

SEQ ID NO: 868616 - RNA, 15 nt, Mycobacterium avium subsp. paratuberculosis
cacggcgccgugcgc

SEQ ID NO: 868617 - RNA, 23 nt, Mycobacterium avium subsp. paratuberculosis
cacggcgcccucgaugcgcaccg

SEQ ID NO: 868618 - RNA, 24 nt, Mycobacterium avium subsp. paratuberculosis
cacggcgauguaggacgccgcacc

SEQ ID NO: 868619 - RNA, 17 nt, Mycobacterium avium subsp. paratuberculosis
cacggccggccggccga

SEQ ID NO: 868620 - RNA, 16 nt, Mycobacterium avium subsp. paratuberculosis
cacggcgaacaccucg

SEQ ID NO: 868621 - RNA, 23 nt, Mycobacterium avium subsp. paratuberculosis
cacggcgaccccguucgccgaca

SEQ ID NO: 868622 - RNA, 18 nt, Mycobacterium avium subsp. paratuberculosis
cacggcgacgaccaccag

SEQ ID NO: 868623 - RNA, 21 nt, Mycobacterium avium subsp. paratuberculosis
cacggcgacgaccaccaggag

SEQ ID NO: 868624 - RNA, 19 nt, Mycobacterium avium subsp. paratuberculosis
cacggccgcaacggcgguc

SEQ ID NO: 868625 - RNA, 14 nt, Mycobacterium avium subsp. paratuberculosis
cacggccggcaacg

SEQ ID NO: 868626 - RNA, 13 nt, Mycobacterium avium subsp. paratuberculosis
cacggccggcagc

SEQ ID NO: 868627 - RNA, 14 nt, Mycobacterium avium subsp. paratuberculosis
cacggccggcagca

SEQ ID NO: 868628 - RNA, 23 nt, Mycobacterium avium subsp. paratuberculosis
cacggccgggauuucccgggcga

SEQ ID NO: 868629 - RNA, 15 nt, Mycobacterium avium subsp. paratuberculosis
cacggccgcagcggc

SEQ ID NO: 868630 - RNA, 13 nt, Mycobacterium avium subsp. paratuberculosis
cacggccgccagc

SEQ ID NO: 868631 - RNA, 15 nt, Mycobacterium avium subsp. paratuberculosis
cacggccgccagcag

SEQ ID NO: 868632 - RNA, 19 nt, Mycobacterium avium subsp. paratuberculosis
cacggccgccagcagcacg

SEQ ID NO: 868633 - RNA, 20 nt, Mycobacterium avium subsp. paratuberculosis
cacggccgccagcagcacgg

SEQ ID NO: 868634 - RNA, 22 nt, Mycobacterium avium subsp. paratuberculosis
cacggccgccagcagcacggca

SEQ ID NO: 868635 - RNA, 14 nt, Mycobacterium avium subsp. paratuberculosis
cacggccgccagga

SEQ ID NO: 868636 - RNA, 14 nt, Mycobacterium avium subsp. paratuberculosis
cacggccgccaggg

SEQ ID NO: 868637 - RNA, 19 nt, Mycobacterium avium subsp. paratuberculosis
cacggccgccuccagcacg

SEQ ID NO: 868638 - RNA, 20 nt, Mycobacterium avium subsp. paratuberculosis
cacggccgccuccagcacgu

SEQ ID NO: 868639 - RNA, 21 nt, Mycobacterium avium subsp. paratuberculosis
cacggccgccuccagcacguc

SEQ ID NO: 868640 - RNA, 22 nt, Mycobacterium avium subsp. paratuberculosis
cacggccgccuccagcacgucg

SEQ ID NO: 868641 - RNA, 23 nt, Mycobacterium avium subsp. paratuberculosis
cacggccgccuccagcacgucgg

SEQ ID NO: 868642 - RNA, 12 nt, Mycobacterium avium subsp. paratuberculosis
cacggccgcggc

SEQ ID NO: 868643 - RNA, 17 nt, Mycobacterium avium subsp. paratuberculosis
cacggccgcggccagcg

SEQ ID NO: 868644 - RNA, 19 nt, Mycobacterium avium subsp. paratuberculosis
cacggccgcggccagcgag

SEQ ID NO: 868645 - RNA, 15 nt, Mycobacterium avium subsp. paratuberculosis
cacggccgcggcccg

SEQ ID NO: 868646 - RNA, 21 nt, Mycobacterium avium subsp. paratuberculosis
cacggccgcggcccggccacc

SEQ ID NO: 868647 - RNA, 18 nt, Mycobacterium avium subsp. paratuberculosis
cacggccugcuuggucgc

SEQ ID NO: 868648 - RNA, 20 nt, Mycobacterium avium subsp. paratuberculosis
cacggccugguacagcaccg

SEQ ID NO: 868649 - RNA, 15 nt, Mycobacterium avium subsp. paratuberculosis
cacggccucgaucau

SEQ ID NO: 868650 - RNA, 19 nt, Mycobacterium avium subsp. paratuberculosis
cacggccucgaucaucacc

SEQ ID NO: 868651 - RNA, 23 nt, Mycobacterium avium subsp. paratuberculosis
cacggccucgaucaucaccaccg

SEQ ID NO: 868652 - RNA, 20 nt, Mycobacterium avium subsp. paratuberculosis
cacggccucgcccagcgccg

SEQ ID NO: 868653 - RNA, 17 nt, Mycobacterium avium subsp. paratuberculosis
cacggccguccaggcgc

SEQ ID NO: 868654 - RNA, 19 nt, Mycobacterium avium subsp. paratuberculosis
cacggccguccaggcgcca

SEQ ID NO: 868655 - RNA, 16 nt, Mycobacterium avium subsp. paratuberculosis
cacggccuugccgauc

SEQ ID NO: 868656 - RNA, 19 nt, Mycobacterium avium subsp. paratuberculosis
cacggccuugccgaucagc

SEQ ID NO: 868657 - RNA, 21 nt, Mycobacterium avium subsp. paratuberculosis
cacggcgaauauuucgccgau

SEQ ID NO: 868658 - RNA, 23 nt, Mycobacterium avium subsp. paratuberculosis
cacggcgaauauuucgccgaucu

SEQ ID NO: 868659 - RNA, 20 nt, Mycobacterium avium subsp. paratuberculosis
caccucaucgcccagccggc

SEQ ID NO: 868660 - RNA, 14 nt, Mycobacterium avium subsp. paratuberculosis
caccguucgggugc

SEQ ID NO: 868661 - RNA, 18 nt, Mycobacterium avium subsp. paratuberculosis
caccguucccaccggcuu

SEQ ID NO: 868662 - RNA, 19 nt, Mycobacterium avium subsp. paratuberculosis
caccguucccaccggcuuc

SEQ ID NO: 868663 - RNA, 21 nt, Mycobacterium avium subsp. paratuberculosis
caccguugucucggcgccguc

SEQ ID NO: 868664 - RNA, 18 nt, Mycobacterium avium subsp. paratuberculosis
caccguugugacccgcuc

SEQ ID NO: 868665 - RNA, 13 nt, Mycobacterium avium subsp. paratuberculosis
cacgcggacacga

SEQ ID NO: 868666 - RNA, 19 nt, Mycobacterium avium subsp. paratuberculosis
cacgcggacacgaacgacg

SEQ ID NO: 868667 - RNA, 23 nt, Mycobacterium avium subsp. paratuberculosis
cacgcggacacgaacgacgcggc

SEQ ID NO: 868668 - RNA, 19 nt, Mycobacterium avium subsp. paratuberculosis
cacgcggacagggcggcga

SEQ ID NO: 868669 - RNA, 22 nt, Mycobacterium avium subsp. paratuberculosis
cacgcggacagggcggcgaccu

SEQ ID NO: 868670 - RNA, 19 nt, Mycobacterium avium subsp. paratuberculosis
cacgcgcgggucgucggcc

SEQ ID NO: 868671 - RNA, 13 nt, Mycobacterium avium subsp. paratuberculosis
cacgcgccggcgc

SEQ ID NO: 868672 - RNA, 17 nt, Mycobacterium avium subsp. paratuberculosis
cacgcgccggcgcgggc

SEQ ID NO: 868673 - RNA, 19 nt, Mycobacterium avium subsp. paratuberculosis
caccuccagcccggcgaug

SEQ ID NO: 868674 - RNA, 19 nt, Mycobacterium avium subsp. paratuberculosis
cacgcgcgccccggucccg

SEQ ID NO: 868675 - RNA, 14 nt, Mycobacterium avium subsp. paratuberculosis
cacgcgcgcccggc

SEQ ID NO: 868676 - RNA, 15 nt, Mycobacterium avium subsp. paratuberculosis
cacgcgcgcccggca

SEQ ID NO: 868677 - RNA, 15 nt, Mycobacterium avium subsp. paratuberculosis
cacgcguagccgacc

SEQ ID NO: 868678 - RNA, 16 nt, Mycobacterium avium subsp. paratuberculosis
cacgcguagccgacca

SEQ ID NO: 868679 - RNA, 18 nt, Mycobacterium avium subsp. paratuberculosis
cacgcguagccgaccaac

SEQ ID NO: 868680 - RNA, 14 nt, Mycobacterium avium subsp. paratuberculosis
cacgcgucaccgga

SEQ ID NO: 868681 - RNA, 16 nt, Mycobacterium avium subsp. paratuberculosis
cacgcgucaggcgucg

SEQ ID NO: 868682 - RNA, 17 nt, Mycobacterium avium subsp. paratuberculosis
cacgcgucaggcgucgu

SEQ ID NO: 868683 - RNA, 21 nt, Mycobacterium avium subsp. paratuberculosis
cacgcguucggacaccucggc

SEQ ID NO: 868684 - RNA, 22 nt, Mycobacterium avium subsp. paratuberculosis
cacgcguucggacaccucggcc

SEQ ID NO: 868685 - RNA, 22 nt, Mycobacterium avium subsp. paratuberculosis
cacgcgguccacuuccgcgcag

SEQ ID NO: 868686 - RNA, 22 nt, Mycobacterium avium subsp. paratuberculosis
cacgcggcuucauaugacgccg

SEQ ID NO: 868687 - RNA, 24 nt, Mycobacterium avium subsp. paratuberculosis
cacgcggcuucauaugacgccggc

SEQ ID NO: 868688 - RNA, 16 nt, Mycobacterium avium subsp. paratuberculosis
cacgcggcuggcccgg

SEQ ID NO: 868689 - RNA, 18 nt, Mycobacterium avium subsp. paratuberculosis
cacgcggcuggcccggcg

SEQ ID NO: 868690 - RNA, 19 nt, Mycobacterium avium subsp. paratuberculosis
cacgcggcuggcccggcgc

SEQ ID NO: 868691 - RNA, 22 nt, Mycobacterium avium subsp. paratuberculosis
cacgcggcuggcccggcgcggc

SEQ ID NO: 868692 - RNA, 13 nt, Mycobacterium avium subsp. paratuberculosis
cacgcggcggcgg

SEQ ID NO: 868693 - RNA, 19 nt, Mycobacterium avium subsp. paratuberculosis
cacgcgcucagcgcggcca

SEQ ID NO: 868694 - RNA, 12 nt, Mycobacterium avium subsp. paratuberculosis
cacgcggcgcgc

SEQ ID NO: 868695 - RNA, 13 nt, Mycobacterium avium subsp. paratuberculosis
cacgcggcgcgca

SEQ ID NO: 868696 - RNA, 16 nt, Mycobacterium avium subsp. paratuberculosis
cacgcggccgcgccgg

SEQ ID NO: 868697 - RNA, 18 nt, Mycobacterium avium subsp. paratuberculosis
cacgcggccgcgccggcc

SEQ ID NO: 868698 - RNA, 12 nt, Mycobacterium avium subsp. paratuberculosis
cacgcucgccag

SEQ ID NO: 868699 - RNA, 15 nt, Mycobacterium avium subsp. paratuberculosis
cacgcucgcaggcga

SEQ ID NO: 868700 - RNA, 18 nt, Mycobacterium avium subsp. paratuberculosis
cacgcucgcaggcgagcc

SEQ ID NO: 868701 - RNA, 13 nt, Mycobacterium avium subsp. paratuberculosis
cacgcucggcgag

SEQ ID NO: 868702 - RNA, 14 nt, Mycobacterium avium subsp. paratuberculosis
cacgcucggcgagc

SEQ ID NO: 868703 - RNA, 13 nt, Mycobacterium avium subsp. paratuberculosis
cacgcucggcgcc

SEQ ID NO: 868704 - RNA, 15 nt, Mycobacterium avium subsp. paratuberculosis
cacgcucggcgccga

SEQ ID NO: 868705 - RNA, 17 nt, Mycobacterium avium subsp. paratuberculosis
cacgcucggcgccgagc

SEQ ID NO: 868706 - RNA, 16 nt, Mycobacterium avium subsp. paratuberculosis
cacgcucucgccgguc

SEQ ID NO: 868707 - RNA, 17 nt, Mycobacterium avium subsp. paratuberculosis
cacgcucucgccgguca

SEQ ID NO: 868708 - RNA, 14 nt, Mycobacterium avium subsp. paratuberculosis
cacgcucggcgcgc

SEQ ID NO: 868709 - RNA, 21 nt, Mycobacterium avium subsp. paratuberculosis
cacgcucggcgcgcggggccg

SEQ ID NO: 868710 - RNA, 18 nt, Mycobacterium avium subsp. paratuberculosis
cacgcucggcggcgcgca

SEQ ID NO: 868711 - RNA, 21 nt, Mycobacterium avium subsp. paratuberculosis
cacgcucgggccggcgccgac

SEQ ID NO: 868712 - RNA, 14 nt, Mycobacterium avium subsp. paratuberculosis
cacgcucacgcucg

SEQ ID NO: 868713 - RNA, 16 nt, Mycobacterium avium subsp. paratuberculosis
cacgcuagcgugacgc

SEQ ID NO: 868714 - RNA, 19 nt, Mycobacterium avium subsp. paratuberculosis
cacgcuagcgugacgcucg

SEQ ID NO: 868715 - RNA, 16 nt, Mycobacterium avium subsp. paratuberculosis
cacgcguugcagcgcc

SEQ ID NO: 868716 - RNA, 17 nt, Mycobacterium avium subsp. paratuberculosis
cacgcguugcagcgccg

SEQ ID NO: 868717 - RNA, 22 nt, Mycobacterium avium subsp. paratuberculosis
cacgcguugcagcgccgcggcg

SEQ ID NO: 868718 - RNA, 17 nt, Mycobacterium avium subsp. paratuberculosis
cacggccaucacggugc

SEQ ID NO: 868719 - RNA, 20 nt, Mycobacterium avium subsp. paratuberculosis
cacggccaucacggugccga

SEQ ID NO: 868720 - RNA, 20 nt, Mycobacterium avium subsp. paratuberculosis
cacggccagccagccgccca

SEQ ID NO: 868721 - RNA, 21 nt, Mycobacterium avium subsp. paratuberculosis
cacggccagccagccgcccag

SEQ ID NO: 868722 - RNA, 23 nt, Mycobacterium avium subsp. paratuberculosis
cacggccagccagccgcccagca

SEQ ID NO: 868723 - RNA, 14 nt, Mycobacterium avium subsp. paratuberculosis
cacggccagcgccg

SEQ ID NO: 868724 - RNA, 17 nt, Mycobacterium avium subsp. paratuberculosis
cacggccagcgccguca

SEQ ID NO: 868725 - RNA, 16 nt, Mycobacterium avium subsp. paratuberculosis
cacggcccgcgccccg

SEQ ID NO: 868726 - RNA, 21 nt, Mycobacterium avium subsp. paratuberculosis
cacggcccgcgccccggcggc

SEQ ID NO: 868727 - RNA, 14 nt, Mycobacterium avium subsp. paratuberculosis
cacggcccgcggca

SEQ ID NO: 868728 - RNA, 16 nt, Mycobacterium avium subsp. paratuberculosis
cacggcccgcggcacg

SEQ ID NO: 868729 - RNA, 21 nt, Mycobacterium avium subsp. paratuberculosis
cacggcccgcggcacgcugcg

SEQ ID NO: 868730 - RNA, 18 nt, Mycobacterium avium subsp. paratuberculosis
cacggcccgcucgggcca

SEQ ID NO: 868731 - RNA, 19 nt, Mycobacterium avium subsp. paratuberculosis
cacggcccgcucgggccau

SEQ ID NO: 868732 - RNA, 22 nt, Mycobacterium avium subsp. paratuberculosis
cacggccaugcagaccagcccg

SEQ ID NO: 868733 - RNA, 15 nt, Mycobacterium avium subsp. paratuberculosis
cacggcccaucacca

SEQ ID NO: 868734 - RNA, 17 nt, Mycobacterium avium subsp. paratuberculosis
cacggcccaucaccagc

SEQ ID NO: 868735 - RNA, 14 nt, Mycobacterium avium subsp. paratuberculosis
cacggccccagccg

SEQ ID NO: 868736 - RNA, 18 nt, Mycobacterium avium subsp. paratuberculosis
cacggccccagccgccgc

SEQ ID NO: 868737 - RNA, 22 nt, Mycobacterium avium subsp. paratuberculosis
cacggccccagccgccgcgaca

SEQ ID NO: 868738 - RNA, 16 nt, Mycobacterium avium subsp. paratuberculosis
cacggccagcaccgcc

SEQ ID NO: 868739 - RNA, 17 nt, Mycobacterium avium subsp. paratuberculosis
cacggccagcaccgcca

SEQ ID NO: 868740 - RNA, 19 nt, Mycobacterium avium subsp. paratuberculosis
cacggccagcaccgccagc

SEQ ID NO: 868741 - RNA, 20 nt, Mycobacterium avium subsp. paratuberculosis
cacggccagcaccgccagcg

SEQ ID NO: 868742 - RNA, 22 nt, Mycobacterium avium subsp. paratuberculosis
cacggccagcaccgccagcgcc

SEQ ID NO: 868743 - RNA, 21 nt, Mycobacterium avium subsp. paratuberculosis
cacggccaggaagccggcgac

SEQ ID NO: 868744 - RNA, 22 nt, Mycobacterium avium subsp. paratuberculosis
cacggccaggaagccggcgacg

SEQ ID NO: 868745 - RNA, 17 nt, Mycobacterium avium subsp. paratuberculosis
cacggccacugccccgg

SEQ ID NO: 868746 - RNA, 18 nt, Mycobacterium avium subsp. paratuberculosis
cacggccacugccccggc

SEQ ID NO: 868747 - RNA, 19 nt, Mycobacterium avium subsp. paratuberculosis
cacggccaacugcaucgcc

SEQ ID NO: 868748 - RNA, 21 nt, Mycobacterium avium subsp. paratuberculosis
cacggccaccacggcaccgcc

SEQ ID NO: 868749 - RNA, 14 nt, Mycobacterium avium subsp. paratuberculosis
cacggccaccagca

SEQ ID NO: 868750 - RNA, 16 nt, Mycobacterium avium subsp. paratuberculosis
cacggccaccagcagc

SEQ ID NO: 868751 - RNA, 17 nt, Mycobacterium avium subsp. paratuberculosis
cacggccaccagcagcg

SEQ ID NO: 868752 - RNA, 14 nt, Mycobacterium avium subsp. paratuberculosis
cacggccaccgccg

SEQ ID NO: 868753 - RNA, 14 nt, Mycobacterium avium subsp. paratuberculosis
cacggcaucgaugg

SEQ ID NO: 868754 - RNA, 20 nt, Mycobacterium avium subsp. paratuberculosis
cacggcaucgauggcgggcg

SEQ ID NO: 868755 - RNA, 22 nt, Mycobacterium avium subsp. paratuberculosis
cacggcauggcgaacacgucgg

SEQ ID NO: 868756 - RNA, 19 nt, Mycobacterium avium subsp. paratuberculosis
cacggcauagauaccggcc

SEQ ID NO: 868757 - RNA, 20 nt, Mycobacterium avium subsp. paratuberculosis
cacggcauagauaccggcca

SEQ ID NO: 868758 - RNA, 15 nt, Mycobacterium avium subsp. paratuberculosis
cacggcaggcggccc

SEQ ID NO: 868759 - RNA, 17 nt, Mycobacterium avium subsp. paratuberculosis
cacggcaggcggcccgc

SEQ ID NO: 868760 - RNA, 21 nt, Mycobacterium avium subsp. paratuberculosis
cacggcaggcggcccgcucga

SEQ ID NO: 868761 - RNA, 12 nt, Mycobacterium avium subsp. paratuberculosis
cacggcagcccg

SEQ ID NO: 868762 - RNA, 13 nt, Mycobacterium avium subsp. paratuberculosis
cacggcagcccga

SEQ ID NO: 868763 - RNA, 19 nt, Mycobacterium avium subsp. paratuberculosis
cacggcaccgccgcgcggc

SEQ ID NO: 868764 - RNA, 13 nt, Mycobacterium avium subsp. paratuberculosis
cacggcaccgcga

SEQ ID NO: 868765 - RNA, 16 nt, Mycobacterium avium subsp. paratuberculosis
cacggcaccgcgagca

SEQ ID NO: 868766 - RNA, 13 nt, Mycobacterium avium subsp. paratuberculosis
cacggcacgcccg

SEQ ID NO: 868767 - RNA, 21 nt, Mycobacterium avium subsp. paratuberculosis
cacggcagcaacugaccgauc

SEQ ID NO: 868768 - RNA, 22 nt, Mycobacterium avium subsp. paratuberculosis
cacggcaaugguugcggcgggc

SEQ ID NO: 868769 - RNA, 19 nt, Mycobacterium avium subsp. paratuberculosis
cacggaucgcccacccgca

SEQ ID NO: 868770 - RNA, 23 nt, Mycobacterium avium subsp. paratuberculosis
cacggaucgcccacccgcacgcc

SEQ ID NO: 868771 - RNA, 13 nt, Mycobacterium avium subsp. paratuberculosis
cacggagcgcccg

SEQ ID NO: 868772 - RNA, 22 nt, Mycobacterium avium subsp. paratuberculosis
cacggagcgcccggccagccgg

SEQ ID NO: 868773 - RNA, 17 nt, Mycobacterium avium subsp. paratuberculosis
cacggauacccgcggcc

SEQ ID NO: 868774 - RNA, 20 nt, Mycobacterium avium subsp. paratuberculosis
cacgcugcgcacccgguccg

SEQ ID NO: 868775 - RNA, 19 nt, Mycobacterium avium subsp. paratuberculosis
cacgcuggugugacgcucg

SEQ ID NO: 868776 - RNA, 20 nt, Mycobacterium avium subsp. paratuberculosis
cacgcuggugugacgcucgc

SEQ ID NO: 868777 - RNA, 18 nt, Mycobacterium avium subsp. paratuberculosis
cacgcugggcuccgaccg

SEQ ID NO: 868778 - RNA, 23 nt, Mycobacterium avium subsp. paratuberculosis
cacgcuggugacgugcaccugca

SEQ ID NO: 868779 - RNA, 16 nt, Mycobacterium avium subsp. paratuberculosis
cacgcuguuggaaccg

SEQ ID NO: 868780 - RNA, 22 nt, Mycobacterium avium subsp. paratuberculosis
cacgcuguuggaaccggccacc

SEQ ID NO: 868781 - RNA, 14 nt, Mycobacterium avium subsp. paratuberculosis
cacgcuggcgucca

SEQ ID NO: 868782 - RNA, 19 nt, Mycobacterium avium subsp. paratuberculosis
cacgcuggcguccaggucg

SEQ ID NO: 868783 - RNA, 14 nt, Mycobacterium avium subsp. paratuberculosis
cacgcuggcgugac

SEQ ID NO: 868784 - RNA, 19 nt, Mycobacterium avium subsp. paratuberculosis
cacgcuggcgugacacucg

SEQ ID NO: 868785 - RNA, 20 nt, Mycobacterium avium subsp. paratuberculosis
cacgcuggcgugacagucga

SEQ ID NO: 868786 - RNA, 20 nt, Mycobacterium avium subsp. paratuberculosis
cacgcuggcgugacgcucgc

SEQ ID NO: 868787 - RNA, 19 nt, Mycobacterium avium subsp. paratuberculosis
cacgcuggcgugacggucg

SEQ ID NO: 868788 - RNA, 19 nt, Mycobacterium avium subsp. paratuberculosis
cacgcuggcgugacguucg

SEQ ID NO: 868789 - RNA, 21 nt, Mycobacterium avium subsp. paratuberculosis
cacgcuggcguggcacccggg

SEQ ID NO: 868790 - RNA, 18 nt, Mycobacterium avium subsp. paratuberculosis
cacgcuggcguggcgccg

SEQ ID NO: 868791 - RNA, 23 nt, Mycobacterium avium subsp. paratuberculosis
cacgcuggcguggcgccggcgcg

SEQ ID NO: 868792 - RNA, 18 nt, Mycobacterium avium subsp. paratuberculosis
cacgcuggcguggcucgg

SEQ ID NO: 868793 - RNA, 20 nt, Mycobacterium avium subsp. paratuberculosis
cacgcugcgccagccgucgc

SEQ ID NO: 868794 - RNA, 15 nt, Mycobacterium avium subsp. paratuberculosis
cacgcugcgcgccga

SEQ ID NO: 868795 - RNA, 20 nt, Mycobacterium avium subsp. paratuberculosis
cacgcugaagcccaccgccg

SEQ ID NO: 868796 - RNA, 15 nt, Mycobacterium avium subsp. paratuberculosis
cacgcugaucaccac

SEQ ID NO: 868797 - RNA, 16 nt, Mycobacterium avium subsp. paratuberculosis
cacgcugaucgaccgg

SEQ ID NO: 868798 - RNA, 17 nt, Mycobacterium avium subsp. paratuberculosis
cacgcugauggauucgg

SEQ ID NO: 868799 - RNA, 15 nt, Mycobacterium avium subsp. paratuberculosis
cacgcugaacggugc

SEQ ID NO: 868800 - RNA, 18 nt, Mycobacterium avium subsp. paratuberculosis
cacgcugaacggugccgu

SEQ ID NO: 868801 - RNA, 19 nt, Mycobacterium avium subsp. paratuberculosis
cacgcugaacggugccguc

SEQ ID NO: 868802 - RNA, 20 nt, Mycobacterium avium subsp. paratuberculosis
cacgcugaacggugccguca

SEQ ID NO: 868803 - RNA, 17 nt, Mycobacterium avium subsp. paratuberculosis
cacuuaacaccucgccu

SEQ ID NO: 868804 - RNA, 14 nt, Mycobacterium avium subsp. paratuberculosis
cacugucggcgcgg

SEQ ID NO: 868805 - RNA, 15 nt, Mycobacterium avium subsp. paratuberculosis
cacuggucgugcugg

SEQ ID NO: 868806 - RNA, 19 nt, Mycobacterium avium subsp. paratuberculosis
cagaagcuccacgccgccg

SEQ ID NO: 868807 - RNA, 23 nt, Mycobacterium avium subsp. paratuberculosis
cagaccacaagggccaccgggcc

SEQ ID NO: 868808 - RNA, 16 nt, Mycobacterium avium subsp. paratuberculosis
cagaccagcccgucgu

SEQ ID NO: 868809 - RNA, 14 nt, Mycobacterium avium subsp. paratuberculosis
cagaccauggcgcg

SEQ ID NO: 868810 - RNA, 16 nt, Mycobacterium avium subsp. paratuberculosis
cagaccauggcgcggc

SEQ ID NO: 868811 - RNA, 17 nt, Mycobacterium avium subsp. paratuberculosis
cagaccauggcgcggcg

SEQ ID NO: 868812 - RNA, 21 nt, Mycobacterium avium subsp. paratuberculosis
cagaccauggcgcggcggccg

SEQ ID NO: 868813 - RNA, 22 nt, Mycobacterium avium subsp. paratuberculosis
cagaccauggcgcggcggccgg

SEQ ID NO: 868814 - RNA, 14 nt, Mycobacterium avium subsp. paratuberculosis
cagacccagcagcg

SEQ ID NO: 868815 - RNA, 16 nt, Mycobacterium avium subsp. paratuberculosis
cagacccagcagcggc

SEQ ID NO: 868816 - RNA, 23 nt, Mycobacterium avium subsp. paratuberculosis
cagacccagcagcggccggcgca

SEQ ID NO: 868817 - RNA, 14 nt, Mycobacterium avium subsp. paratuberculosis
cagacccagcaucg

SEQ ID NO: 868818 - RNA, 15 nt, Mycobacterium avium subsp. paratuberculosis
cagacccagcaucgc

SEQ ID NO: 868819 - RNA, 14 nt, Mycobacterium avium subsp. paratuberculosis
cagacccagcguca

SEQ ID NO: 868820 - RNA, 19 nt, Mycobacterium avium subsp. paratuberculosis
cagaccgaagaucaccgcg

SEQ ID NO: 868821 - RNA, 21 nt, Mycobacterium avium subsp. paratuberculosis
cagaccgaagaucaccgcgac

SEQ ID NO: 868822 - RNA, 13 nt, Mycobacterium avium subsp. paratuberculosis
cagaccccggcgu

SEQ ID NO: 868823 - RNA, 15 nt, Mycobacterium avium subsp. paratuberculosis
cagaccccggcgucc

SEQ ID NO: 868824 - RNA, 16 nt, Mycobacterium avium subsp. paratuberculosis
cagaccccacaccuuc

SEQ ID NO: 868825 - RNA, 23 nt, Mycobacterium avium subsp. paratuberculosis
cagaccccacaccuucgcggucg

SEQ ID NO: 868826 - RNA, 16 nt, Mycobacterium avium subsp. paratuberculosis
cagagcagcgccugcu

SEQ ID NO: 868827 - RNA, 17 nt, Mycobacterium avium subsp. paratuberculosis
cagagcgaugggcgcga

SEQ ID NO: 868828 - RNA, 15 nt, Mycobacterium avium subsp. paratuberculosis
cagagcccgaacacg

SEQ ID NO: 868829 - RNA, 18 nt, Mycobacterium avium subsp. paratuberculosis
cagagcccgaacacgggc

SEQ ID NO: 868830 - RNA, 22 nt, Mycobacterium avium subsp. paratuberculosis
cagagcccgaacacgggcggca

SEQ ID NO: 868831 - RNA, 17 nt, Mycobacterium avium subsp. paratuberculosis
cagacugcgcaccgcca

SEQ ID NO: 868832 - RNA, 22 nt, Mycobacterium avium subsp. paratuberculosis
cagacugaugaagccgccgacg

SEQ ID NO: 868833 - RNA, 19 nt, Mycobacterium avium subsp. paratuberculosis
cagacugaugcccucgccg

SEQ ID NO: 868834 - RNA, 20 nt, Mycobacterium avium subsp. paratuberculosis
cagacgguaugcccgccgcg

SEQ ID NO: 868835 - RNA, 12 nt, Mycobacterium avium subsp. paratuberculosis
cagaccgcgauc

SEQ ID NO: 868836 - RNA, 14 nt, Mycobacterium avium subsp. paratuberculosis
cagaccggacagcu

SEQ ID NO: 868837 - RNA, 12 nt, Mycobacterium avium subsp. paratuberculosis
cagaccgcggcg

SEQ ID NO: 868838 - RNA, 22 nt, Mycobacterium avium subsp. paratuberculosis
cagaccgugugccagcccguug

SEQ ID NO: 868839 - RNA, 20 nt, Mycobacterium avium subsp. paratuberculosis
cagaccguucuccgaggcgu

SEQ ID NO: 868840 - RNA, 23 nt, Mycobacterium avium subsp. paratuberculosis
cagaccguucuccgaggcguccu

SEQ ID NO: 868841 - RNA, 21 nt, Mycobacterium avium subsp. paratuberculosis
cagaccguggaggacgaggcc

SEQ ID NO: 868842 - RNA, 19 nt, Mycobacterium avium subsp. paratuberculosis
cagaccguccgguucggcg

SEQ ID NO: 868843 - RNA, 22 nt, Mycobacterium avium subsp. paratuberculosis
cagaccguccgguucggcggca

SEQ ID NO: 868844 - RNA, 18 nt, Mycobacterium avium subsp. paratuberculosis
cagaccggugagcaccgg

SEQ ID NO: 868845 - RNA, 20 nt, Mycobacterium avium subsp. paratuberculosis
cagaccggugagcaccggga

SEQ ID NO: 868846 - RNA, 22 nt, Mycobacterium avium subsp. paratuberculosis
cagaccgguugcggcgaacgcg

SEQ ID NO: 868847 - RNA, 14 nt, Mycobacterium avium subsp. paratuberculosis
cagaccggcggcga

SEQ ID NO: 868848 - RNA, 16 nt, Mycobacterium avium subsp. paratuberculosis
cagaccggcggcgauc

SEQ ID NO: 868849 - RNA, 16 nt, Mycobacterium avium subsp. paratuberculosis
cagaccggccggggcg

SEQ ID NO: 868850 - RNA, 19 nt, Mycobacterium avium subsp. paratuberculosis
cagaccggccggggcgggc

SEQ ID NO: 868851 - RNA, 18 nt, Mycobacterium avium subsp. paratuberculosis
cagacgaacgcggccgcc

SEQ ID NO: 868852 - RNA, 18 nt, Mycobacterium avium subsp. paratuberculosis
cagacgaauucggagacc

SEQ ID NO: 868853 - RNA, 23 nt, Mycobacterium avium subsp. paratuberculosis
cagacgaauucggagaccagguc

SEQ ID NO: 868854 - RNA, 15 nt, Mycobacterium avium subsp. paratuberculosis
cagaccucgccgacg

SEQ ID NO: 868855 - RNA, 21 nt, Mycobacterium avium subsp. paratuberculosis
cagaccucgccgacggugucc

SEQ ID NO: 868856 - RNA, 16 nt, Mycobacterium avium subsp. paratuberculosis
cagacgcgggcgccca

SEQ ID NO: 868857 - RNA, 17 nt, Mycobacterium avium subsp. paratuberculosis
cagacggacacccgcgc

SEQ ID NO: 868858 - RNA, 18 nt, Mycobacterium avium subsp. paratuberculosis
cagacggacacccgcgcg

SEQ ID NO: 868859 - RNA, 22 nt, Mycobacterium avium subsp. paratuberculosis
cagacggacacccgcgcggugc

SEQ ID NO: 868860 - RNA, 15 nt, Mycobacterium avium subsp. paratuberculosis
cagacgcgcaccgcc

SEQ ID NO: 868861 - RNA, 16 nt, Mycobacterium avium subsp. paratuberculosis
cagacgcgcaccgcca

SEQ ID NO: 868862 - RNA, 21 nt, Mycobacterium avium subsp. paratuberculosis
cagacgaucacgacgcgaccg

SEQ ID NO: 868863 - RNA, 19 nt, Mycobacterium avium subsp. paratuberculosis
cacguucaccaccggagcg

SEQ ID NO: 868864 - RNA, 18 nt, Mycobacterium avium subsp. paratuberculosis
cacguucgcggucgagcg

SEQ ID NO: 868865 - RNA, 13 nt, Mycobacterium avium subsp. paratuberculosis
cacguucggcgag

SEQ ID NO: 868866 - RNA, 14 nt, Mycobacterium avium subsp. paratuberculosis
cacguucggcgggc

SEQ ID NO: 868867 - RNA, 17 nt, Mycobacterium avium subsp. paratuberculosis
cacguucggcgggcgcg

SEQ ID NO: 868868 - RNA, 18 nt, Mycobacterium avium subsp. paratuberculosis
cacguucggcgggcgcgc

SEQ ID NO: 868869 - RNA, 20 nt, Mycobacterium avium subsp. paratuberculosis
cacguucggcgggcgcgcgc

SEQ ID NO: 868870 - RNA, 20 nt, Mycobacterium avium subsp. paratuberculosis
cacguucagcgacuugccgc

SEQ ID NO: 868871 - RNA, 14 nt, Mycobacterium avium subsp. paratuberculosis
cacguugacguaga

SEQ ID NO: 868872 - RNA, 22 nt, Mycobacterium avium subsp. paratuberculosis
cacguugacguagacgacgggc

SEQ ID NO: 868873 - RNA, 16 nt, Mycobacterium avium subsp. paratuberculosis
cacuaccgccucgcca

SEQ ID NO: 868874 - RNA, 16 nt, Mycobacterium avium subsp. paratuberculosis
cacucgauggcggcga

SEQ ID NO: 868875 - RNA, 18 nt, Mycobacterium avium subsp. paratuberculosis
cacucgauggcggcgaug

SEQ ID NO: 868876 - RNA, 12 nt, Mycobacterium avium subsp. paratuberculosis
cacucggcgaug

SEQ ID NO: 868877 - RNA, 14 nt, Mycobacterium avium subsp. paratuberculosis
cacucggcgaugcg

SEQ ID NO: 868878 - RNA, 22 nt, Mycobacterium avium subsp. paratuberculosis
cacucggacagguggccgauca

SEQ ID NO: 868879 - RNA, 15 nt, Mycobacterium avium subsp. paratuberculosis
cacucgcccagggcg

SEQ ID NO: 868880 - RNA, 17 nt, Mycobacterium avium subsp. paratuberculosis
cacucgccgcgaacgac

SEQ ID NO: 868881 - RNA, 18 nt, Mycobacterium avium subsp. paratuberculosis
cacucgccgcgaacgacg

SEQ ID NO: 868882 - RNA, 18 nt, Mycobacterium avium subsp. paratuberculosis
cacucgcgggacggcggc

SEQ ID NO: 868883 - RNA, 19 nt, Mycobacterium avium subsp. paratuberculosis
cacucgcgggacggcggcg

SEQ ID NO: 868884 - RNA, 20 nt, Mycobacterium avium subsp. paratuberculosis
cacucgcgggacggcggcga

SEQ ID NO: 868885 - RNA, 22 nt, Mycobacterium avium subsp. paratuberculosis
cacugaaagccgaggcgcaaca

SEQ ID NO: 868886 - RNA, 16 nt, Mycobacterium avium subsp. paratuberculosis
cacugagcgcaggccg

SEQ ID NO: 868887 - RNA, 16 nt, Mycobacterium avium subsp. paratuberculosis
cacugccccggcgaac

SEQ ID NO: 868888 - RNA, 17 nt, Mycobacterium avium subsp. paratuberculosis
cacugccccggcgaacg

SEQ ID NO: 868889 - RNA, 14 nt, Mycobacterium avium subsp. paratuberculosis
cacugcccgcaucg

SEQ ID NO: 868890 - RNA, 19 nt, Mycobacterium avium subsp. paratuberculosis
cacucuggcgugacguucg

SEQ ID NO: 868891 - RNA, 18 nt, Mycobacterium avium subsp. paratuberculosis
cacucggucaccgguguc

SEQ ID NO: 868892 - RNA, 12 nt, Mycobacterium avium subsp. paratuberculosis
cacucgucgacg

SEQ ID NO: 868893 - RNA, 11 nt, Mycobacterium avium subsp. paratuberculosis
cacucgucgau

SEQ ID NO: 868894 - RNA, 22 nt, Mycobacterium avium subsp. paratuberculosis
cacucgucgaucgacgccgaca

SEQ ID NO: 868895 - RNA, 13 nt, Mycobacterium avium subsp. paratuberculosis
cacucgucggcgg

SEQ ID NO: 868896 - RNA, 14 nt, Mycobacterium avium subsp. paratuberculosis
cacucgucggcggu

SEQ ID NO: 868897 - RNA, 17 nt, Mycobacterium avium subsp. paratuberculosis
cacuggcgugacgcucg

SEQ ID NO: 868898 - RNA, 21 nt, Mycobacterium avium subsp. paratuberculosis
cacuggcuggucacccacugg

SEQ ID NO: 868899 - RNA, 15 nt, Mycobacterium avium subsp. paratuberculosis
cacugggcgucggcg

SEQ ID NO: 868900 - RNA, 13 nt, Mycobacterium avium subsp. paratuberculosis
cacugcccguagu

SEQ ID NO: 868901 - RNA, 18 nt, Mycobacterium avium subsp. paratuberculosis
cacugcccguagucggcg

SEQ ID NO: 868902 - RNA, 20 nt, Mycobacterium avium subsp. paratuberculosis
cacugccugacccggccgug

SEQ ID NO: 868903 - RNA, 21 nt, Mycobacterium avium subsp. paratuberculosis
cacugccugacccggccgugc

SEQ ID NO: 868904 - RNA, 12 nt, Mycobacterium avium subsp. paratuberculosis
cacugccgguca

SEQ ID NO: 868905 - RNA, 16 nt, Mycobacterium avium subsp. paratuberculosis
cacguccuggacgucg

SEQ ID NO: 868906 - RNA, 21 nt, Mycobacterium avium subsp. paratuberculosis
cacguccuggacgucgucgcu

SEQ ID NO: 868907 - RNA, 13 nt, Mycobacterium avium subsp. paratuberculosis
cacguccuggcgc

SEQ ID NO: 868908 - RNA, 16 nt, Mycobacterium avium subsp. paratuberculosis
cacgucgacacgccgg

SEQ ID NO: 868909 - RNA, 20 nt, Mycobacterium avium subsp. paratuberculosis
cacgucgacacgccggccgu

SEQ ID NO: 868910 - RNA, 22 nt, Mycobacterium avium subsp. paratuberculosis
cacgucgacacgccggccguuc

SEQ ID NO: 868911 - RNA, 12 nt, Mycobacterium avium subsp. paratuberculosis
cacgucgacgcc

SEQ ID NO: 868912 - RNA, 23 nt, Mycobacterium avium subsp. paratuberculosis
cacgucgacgcccugccacagcg

SEQ ID NO: 868913 - RNA, 13 nt, Mycobacterium avium subsp. paratuberculosis
cacgucgacgccg

SEQ ID NO: 868914 - RNA, 16 nt, Mycobacterium avium subsp. paratuberculosis
cacgucgacgccgguc

SEQ ID NO: 868915 - RNA, 20 nt, Mycobacterium avium subsp. paratuberculosis
cacgucgacgccggucucga

SEQ ID NO: 868916 - RNA, 13 nt, Mycobacterium avium subsp. paratuberculosis
cacgucgacggcc

SEQ ID NO: 868917 - RNA, 15 nt, Mycobacterium avium subsp. paratuberculosis
cacgucgacggccgc

SEQ ID NO: 868918 - RNA, 13 nt, Mycobacterium avium subsp. paratuberculosis
cacgucgagcucc

SEQ ID NO: 868919 - RNA, 18 nt, Mycobacterium avium subsp. paratuberculosis
cacgucgaggucggacgc

SEQ ID NO: 868920 - RNA, 18 nt, Mycobacterium avium subsp. paratuberculosis
cacgucgaucacgccgcc

SEQ ID NO: 868921 - RNA, 20 nt, Mycobacterium avium subsp. paratuberculosis
cacgucgaucacgccgccgg

SEQ ID NO: 868922 - RNA, 14 nt, Mycobacterium avium subsp. paratuberculosis
cacgucgagcaccg

SEQ ID NO: 868923 - RNA, 15 nt, Mycobacterium avium subsp. paratuberculosis
cacgucgagcggccc

SEQ ID NO: 868924 - RNA, 22 nt, Mycobacterium avium subsp. paratuberculosis
cacgucgagcggcccgucgccg

SEQ ID NO: 868925 - RNA, 23 nt, Mycobacterium avium subsp. paratuberculosis
cacgucgagcggcccgucgccga

SEQ ID NO: 868926 - RNA, 13 nt, Mycobacterium avium subsp. paratuberculosis
cacgucgaacccg

SEQ ID NO: 868927 - RNA, 16 nt, Mycobacterium avium subsp. paratuberculosis
cacgucgaacccgacc

SEQ ID NO: 868928 - RNA, 20 nt, Mycobacterium avium subsp. paratuberculosis
cacgucgaacccgaccccgg

SEQ ID NO: 868929 - RNA, 16 nt, Mycobacterium avium subsp. paratuberculosis
cacguccuagacacga

SEQ ID NO: 868930 - RNA, 19 nt, Mycobacterium avium subsp. paratuberculosis
cacguccggaugcggcgcc

SEQ ID NO: 868931 - RNA, 22 nt, Mycobacterium avium subsp. paratuberculosis
cacguccggaugcggcgcccac

SEQ ID NO: 868932 - RNA, 22 nt, Mycobacterium avium subsp. paratuberculosis
cacguccgccuccgaccagccg

SEQ ID NO: 868933 - RNA, 12 nt, Mycobacterium avium subsp. paratuberculosis
cacguccgcggu

SEQ ID NO: 868934 - RNA, 16 nt, Mycobacterium avium subsp. paratuberculosis
cacguccgcggugagc

SEQ ID NO: 868935 - RNA, 17 nt, Mycobacterium avium subsp. paratuberculosis
cacguccgcggugagca

SEQ ID NO: 868936 - RNA, 19 nt, Mycobacterium avium subsp. paratuberculosis
cacguccgcggugagcacc

SEQ ID NO: 868937 - RNA, 14 nt, Mycobacterium avium subsp. paratuberculosis
cacguccccgggca

SEQ ID NO: 868938 - RNA, 17 nt, Mycobacterium avium subsp. paratuberculosis
cacguccccgggcgugc

SEQ ID NO: 868939 - RNA, 15 nt, Mycobacterium avium subsp. paratuberculosis
cacguccccgugcag

SEQ ID NO: 868940 - RNA, 19 nt, Mycobacterium avium subsp. paratuberculosis
cacguccccgugcagccgg

SEQ ID NO: 868941 - RNA, 21 nt, Mycobacterium avium subsp. paratuberculosis
cacguccccgugcagccgggc

SEQ ID NO: 868942 - RNA, 14 nt, Mycobacterium avium subsp. paratuberculosis
cacgucccgcucga

SEQ ID NO: 868943 - RNA, 20 nt, Mycobacterium avium subsp. paratuberculosis
cacguccagcucucgagcac

SEQ ID NO: 868944 - RNA, 19 nt, Mycobacterium avium subsp. paratuberculosis
cacgucauuucggucggca

SEQ ID NO: 868945 - RNA, 15 nt, Mycobacterium avium subsp. paratuberculosis
cacguccacgccgcg

SEQ ID NO: 868946 - RNA, 16 nt, Mycobacterium avium subsp. paratuberculosis
cacguccacgccgcgg

SEQ ID NO: 868947 - RNA, 16 nt, Mycobacterium avium subsp. paratuberculosis
cacguccagcccgcgc

SEQ ID NO: 868948 - RNA, 20 nt, Mycobacterium avium subsp. paratuberculosis
cacgucaccgcgcuugccgc

SEQ ID NO: 868949 - RNA, 14 nt, Mycobacterium avium subsp. paratuberculosis
cacgucaccgcuga

SEQ ID NO: 868950 - RNA, 14 nt, Mycobacterium avium subsp. paratuberculosis
cacguaguccgacg

SEQ ID NO: 868951 - RNA, 14 nt, Mycobacterium avium subsp. paratuberculosis
cacguagucgaccg

SEQ ID NO: 868952 - RNA, 18 nt, Mycobacterium avium subsp. paratuberculosis
cacguagucgaccgggau

SEQ ID NO: 868953 - RNA, 20 nt, Mycobacterium avium subsp. paratuberculosis
cacguauccgcggucgacca

SEQ ID NO: 868954 - RNA, 17 nt, Mycobacterium avium subsp. paratuberculosis
cacgucacgggccaggc

SEQ ID NO: 868955 - RNA, 18 nt, Mycobacterium avium subsp. paratuberculosis
cacgucacgggccaggcg

SEQ ID NO: 868956 - RNA, 13 nt, Mycobacterium avium subsp. paratuberculosis
cacguaggcgauc

SEQ ID NO: 868957 - RNA, 14 nt, Mycobacterium avium subsp. paratuberculosis
cacguaggcgauca

SEQ ID NO: 868958 - RNA, 19 nt, Mycobacterium avium subsp. paratuberculosis
cacguaggcgaucagcgcg

SEQ ID NO: 868959 - RNA, 15 nt, Mycobacterium avium subsp. paratuberculosis
cacguaggcgauguc

SEQ ID NO: 868960 - RNA, 14 nt, Mycobacterium avium subsp. paratuberculosis
cacguaggcggcga

SEQ ID NO: 868961 - RNA, 17 nt, Mycobacterium avium subsp. paratuberculosis
cacguagcgcggccgcc

SEQ ID NO: 868962 - RNA, 14 nt, Mycobacterium avium subsp. paratuberculosis
cacguagaaggcgc

SEQ ID NO: 868963 - RNA, 16 nt, Mycobacterium avium subsp. paratuberculosis
cacguagaaggcgccg

SEQ ID NO: 868964 - RNA, 17 nt, Mycobacterium avium subsp. paratuberculosis
cacguagaaggcgccgu

SEQ ID NO: 868965 - RNA, 14 nt, Mycobacterium avium subsp. paratuberculosis
cacguagacggugu

SEQ ID NO: 868966 - RNA, 18 nt, Mycobacterium avium subsp. paratuberculosis
cacguguucucacggcga

SEQ ID NO: 868967 - RNA, 21 nt, Mycobacterium avium subsp. paratuberculosis
cacguggugaucagcauccgc

SEQ ID NO: 868968 - RNA, 20 nt, Mycobacterium avium subsp. paratuberculosis
cacguguccgacgccgucga

SEQ ID NO: 868969 - RNA, 23 nt, Mycobacterium avium subsp. paratuberculosis
cacguguccgacgccgucgagcc

SEQ ID NO: 868970 - RNA, 23 nt, Mycobacterium avium subsp. paratuberculosis
cacguguccgucgccggaggcga

SEQ ID NO: 868971 - RNA, 14 nt, Mycobacterium avium subsp. paratuberculosis
cacgugucggcguc

SEQ ID NO: 868972 - RNA, 15 nt, Mycobacterium avium subsp. paratuberculosis
cacgugucggcgucg

SEQ ID NO: 868973 - RNA, 16 nt, Mycobacterium avium subsp. paratuberculosis
cacgugucggcgucga

SEQ ID NO: 868974 - RNA, 14 nt, Mycobacterium avium subsp. paratuberculosis
cacgugcuggcgcu

SEQ ID NO: 868975 - RNA, 13 nt, Mycobacterium avium subsp. paratuberculosis
cacguggccgauc

SEQ ID NO: 868976 - RNA, 14 nt, Mycobacterium avium subsp. paratuberculosis
cacguggccgauca

SEQ ID NO: 868977 - RNA, 19 nt, Mycobacterium avium subsp. paratuberculosis
cacguggccgaucagcugc

SEQ ID NO: 868978 - RNA, 19 nt, Mycobacterium avium subsp. paratuberculosis
cacguggccgggcucgagu

SEQ ID NO: 868979 - RNA, 21 nt, Mycobacterium avium subsp. paratuberculosis
cacguggcugaccgacggcga

SEQ ID NO: 868980 - RNA, 19 nt, Mycobacterium avium subsp. paratuberculosis
cacguggaccgagcgcgcg

SEQ ID NO: 868981 - RNA, 20 nt, Mycobacterium avium subsp. paratuberculosis
cacguggucgcugaccuucu

SEQ ID NO: 868982 - RNA, 23 nt, Mycobacterium avium subsp. paratuberculosis
cacguggucgcugaccuucuugg

SEQ ID NO: 868983 - RNA, 22 nt, Mycobacterium avium subsp. paratuberculosis
cacgugaugagcgaggacgucg

SEQ ID NO: 868984 - RNA, 23 nt, Mycobacterium avium subsp. paratuberculosis
cacgugaugagcgaggacgucga

SEQ ID NO: 868985 - RNA, 20 nt, Mycobacterium avium subsp. paratuberculosis
cacgugcaccgcggccaacc

SEQ ID NO: 868986 - RNA, 15 nt, Mycobacterium avium subsp. paratuberculosis
cacgugcacggcgcc

SEQ ID NO: 868987 - RNA, 16 nt, Mycobacterium avium subsp. paratuberculosis
cacgugcacggcgccg

SEQ ID NO: 868988 - RNA, 17 nt, Mycobacterium avium subsp. paratuberculosis
cacgugcacggcgccgu

SEQ ID NO: 868989 - RNA, 22 nt, Mycobacterium avium subsp. paratuberculosis
cacgugcacggcgccgugccgc

SEQ ID NO: 868990 - RNA, 14 nt, Mycobacterium avium subsp. paratuberculosis
cacgugcagcucgg

SEQ ID NO: 868991 - RNA, 13 nt, Mycobacterium avium subsp. paratuberculosis
cacgugccacugg

SEQ ID NO: 868992 - RNA, 20 nt, Mycobacterium avium subsp. paratuberculosis
cacgugccacuggcgccacc

SEQ ID NO: 868993 - RNA, 16 nt, Mycobacterium avium subsp. paratuberculosis
cacgugcccagcccgc

SEQ ID NO: 868994 - RNA, 13 nt, Mycobacterium avium subsp. paratuberculosis
cacgugcaucugc

SEQ ID NO: 868995 - RNA, 16 nt, Mycobacterium avium subsp. paratuberculosis
cacgugcccgccgugc

SEQ ID NO: 868996 - RNA, 22 nt, Mycobacterium avium subsp. paratuberculosis
cacgugcccgccgugcgccccg

SEQ ID NO: 868997 - RNA, 14 nt, Mycobacterium avium subsp. paratuberculosis
cacgugcgcgaagc

SEQ ID NO: 868998 - RNA, 13 nt, Mycobacterium avium subsp. paratuberculosis
cacgugcgcgccg

SEQ ID NO: 868999 - RNA, 15 nt, Mycobacterium avium subsp. paratuberculosis
cacgugcgcgccgac

SEQ ID NO: 869000 - RNA, 15 nt, Mycobacterium avium subsp. paratuberculosis
cacgugcgcggcguc

SEQ ID NO: 869001 - RNA, 16 nt, Mycobacterium avium subsp. paratuberculosis
cacgugcgcggcgucc

SEQ ID NO: 869002 - RNA, 14 nt, Mycobacterium avium subsp. paratuberculosis
cacgugcgcgggaa

SEQ ID NO: 869003 - RNA, 19 nt, Mycobacterium avium subsp. paratuberculosis
cacgugcggauggccccgg

SEQ ID NO: 869004 - RNA, 15 nt, Mycobacterium avium subsp. paratuberculosis
cacgugcggcgcccu

SEQ ID NO: 869005 - RNA, 23 nt, Mycobacterium avium subsp. paratuberculosis
cacgugcggcugcgcguucggcg

SEQ ID NO: 869006 - RNA, 18 nt, Mycobacterium avium subsp. paratuberculosis
cacgugcggguuggcgcc

SEQ ID NO: 869007 - RNA, 17 nt, Mycobacterium avium subsp. paratuberculosis
cacgucguccggcgcgc

SEQ ID NO: 869008 - RNA, 17 nt, Mycobacterium avium subsp. paratuberculosis
cacgucgucggacagca

SEQ ID NO: 869009 - RNA, 13 nt, Mycobacterium avium subsp. paratuberculosis
cacgucggugacg

SEQ ID NO: 869010 - RNA, 16 nt, Mycobacterium avium subsp. paratuberculosis
cacgucggugccgcgu

SEQ ID NO: 869011 - RNA, 20 nt, Mycobacterium avium subsp. paratuberculosis
cacgucggggaugucgucgg

SEQ ID NO: 869012 - RNA, 22 nt, Mycobacterium avium subsp. paratuberculosis
cacgucggggaugucgucgggc

SEQ ID NO: 869013 - RNA, 17 nt, Mycobacterium avium subsp. paratuberculosis
cacgucggggccggugg

SEQ ID NO: 869014 - RNA, 18 nt, Mycobacterium avium subsp. paratuberculosis
cacgucgggguggccggc

SEQ ID NO: 869015 - RNA, 19 nt, Mycobacterium avium subsp. paratuberculosis
cacgucgggguggccggcc

SEQ ID NO: 869016 - RNA, 20 nt, Mycobacterium avium subsp. paratuberculosis
cacgucggguucgccgguga

SEQ ID NO: 869017 - RNA, 18 nt, Mycobacterium avium subsp. paratuberculosis
cacgucggucagcgagcg

SEQ ID NO: 869018 - RNA, 15 nt, Mycobacterium avium subsp. paratuberculosis
cacgucugcucggcg

SEQ ID NO: 869019 - RNA, 16 nt, Mycobacterium avium subsp. paratuberculosis
cacgucugcucggcgg

SEQ ID NO: 869020 - RNA, 18 nt, Mycobacterium avium subsp. paratuberculosis
cacgucugcucggcgggu

SEQ ID NO: 869021 - RNA, 20 nt, Mycobacterium avium subsp. paratuberculosis
cacgucugcucggcggguca

SEQ ID NO: 869022 - RNA, 22 nt, Mycobacterium avium subsp. paratuberculosis
cacgucguugagcacacccagc

SEQ ID NO: 869023 - RNA, 14 nt, Mycobacterium avium subsp. paratuberculosis
cacgucggcggccg

SEQ ID NO: 869024 - RNA, 15 nt, Mycobacterium avium subsp. paratuberculosis
cacgucggcggccgc

SEQ ID NO: 869025 - RNA, 16 nt, Mycobacterium avium subsp. paratuberculosis
cacgucggccacgccg

SEQ ID NO: 869026 - RNA, 17 nt, Mycobacterium avium subsp. paratuberculosis
cacgucggccacgccgg

SEQ ID NO: 869027 - RNA, 19 nt, Mycobacterium avium subsp. paratuberculosis
cacgucggccacgccgggc

SEQ ID NO: 869028 - RNA, 20 nt, Mycobacterium avium subsp. paratuberculosis
cacgucggccacgccgggca

SEQ ID NO: 869029 - RNA, 14 nt, Mycobacterium avium subsp. paratuberculosis
cacgucggccagcg

SEQ ID NO: 869030 - RNA, 19 nt, Mycobacterium avium subsp. paratuberculosis
cacgucggccagcgcguga

SEQ ID NO: 869031 - RNA, 11 nt, Mycobacterium avium subsp. paratuberculosis
cacgucggccu

SEQ ID NO: 869032 - RNA, 13 nt, Mycobacterium avium subsp. paratuberculosis
cacgucggccugc

SEQ ID NO: 869033 - RNA, 13 nt, Mycobacterium avium subsp. paratuberculosis
cacgucggcgagc

SEQ ID NO: 869034 - RNA, 21 nt, Mycobacterium avium subsp. paratuberculosis
cacgucggcgauggcggcgug

SEQ ID NO: 869035 - RNA, 22 nt, Mycobacterium avium subsp. paratuberculosis
cacgucggcgauggcggcgugc

SEQ ID NO: 869036 - RNA, 12 nt, Mycobacterium avium subsp. paratuberculosis
cacgucggcgcg

SEQ ID NO: 869037 - RNA, 14 nt, Mycobacterium avium subsp. paratuberculosis
cacgucggcgcgca

SEQ ID NO: 869038 - RNA, 21 nt, Mycobacterium avium subsp. paratuberculosis
cacgucggcgcgcaggcuggc

SEQ ID NO: 869039 - RNA, 12 nt, Mycobacterium avium subsp. paratuberculosis
cacgucggcggc

SEQ ID NO: 869040 - RNA, 13 nt, Mycobacterium avium subsp. paratuberculosis
cacgucggcggcc

SEQ ID NO: 869041 - RNA, 20 nt, Mycobacterium avium subsp. paratuberculosis
cacgucgccguucuugucga

SEQ ID NO: 869042 - RNA, 15 nt, Mycobacterium avium subsp. paratuberculosis
cacgucgcgccgaug

SEQ ID NO: 869043 - RNA, 13 nt, Mycobacterium avium subsp. paratuberculosis
cacgucgaugccg

SEQ ID NO: 869044 - RNA, 15 nt, Mycobacterium avium subsp. paratuberculosis
cacgucgcccagcgu

SEQ ID NO: 869045 - RNA, 19 nt, Mycobacterium avium subsp. paratuberculosis
caaauagccgucggcggcc

SEQ ID NO: 869046 - RNA, 16 nt, Mycobacterium avium subsp. paratuberculosis
caaaucgcuugcgccg

SEQ ID NO: 869047 - RNA, 17 nt, Mycobacterium avium subsp. paratuberculosis
caacaacgccagcguga

SEQ ID NO: 869048 - RNA, 18 nt, Mycobacterium avium subsp. paratuberculosis
caacaacucgacgcucgg

SEQ ID NO: 869049 - RNA, 22 nt, Mycobacterium avium subsp. paratuberculosis
caacaacucgacgcucggcgau

SEQ ID NO: 869050 - RNA, 19 nt, Mycobacterium avium subsp. paratuberculosis
caacaacucgacguucggc

SEQ ID NO: 869051 - RNA, 17 nt, Mycobacterium avium subsp. paratuberculosis
caacaacuucgagcaga

SEQ ID NO: 869052 - RNA, 20 nt, Mycobacterium avium subsp. paratuberculosis
caacaccgggauccggcgcg

SEQ ID NO: 869053 - RNA, 14 nt, Mycobacterium avium subsp. paratuberculosis
caacaccggcggcg

SEQ ID NO: 869054 - RNA, 15 nt, Mycobacterium avium subsp. paratuberculosis
caacaccggcggcga

SEQ ID NO: 869055 - RNA, 22 nt, Mycobacterium avium subsp. paratuberculosis
caacaccggcggcgacggcacc

SEQ ID NO: 869056 - RNA, 14 nt, Mycobacterium avium subsp. paratuberculosis
caaagcccgggaug

SEQ ID NO: 869057 - RNA, 20 nt, Mycobacterium avium subsp. paratuberculosis
caaagcguugccgcgcgccc

SEQ ID NO: 869058 - RNA, 13 nt, Mycobacterium avium subsp. paratuberculosis
caaagccguucgc

SEQ ID NO: 869059 - RNA, 18 nt, Mycobacterium avium subsp. paratuberculosis
caaagccguucgcgccga

SEQ ID NO: 869060 - RNA, 17 nt, Mycobacterium avium subsp. paratuberculosis
caacaugucccgggcac

SEQ ID NO: 869061 - RNA, 14 nt, Mycobacterium avium subsp. paratuberculosis
caacaucgacgugc

SEQ ID NO: 869062 - RNA, 15 nt, Mycobacterium avium subsp. paratuberculosis
caacaucgacgugcc

SEQ ID NO: 869063 - RNA, 16 nt, Mycobacterium avium subsp. paratuberculosis
caacaucgacgugccg

SEQ ID NO: 869064 - RNA, 24 nt, Mycobacterium avium subsp. paratuberculosis
caacauccgcgacgacaccaccgu

SEQ ID NO: 869065 - RNA, 19 nt, Mycobacterium avium subsp. paratuberculosis
caacauccugguccggcgc

SEQ ID NO: 869066 - RNA, 20 nt, Mycobacterium avium subsp. paratuberculosis
caacauccugguccggcgcc

SEQ ID NO: 869067 - RNA, 16 nt, Mycobacterium avium subsp. paratuberculosis
caacaugaucggcgcg

SEQ ID NO: 869068 - RNA, 17 nt, Mycobacterium avium subsp. paratuberculosis
caacaugaucggcgcga

SEQ ID NO: 869069 - RNA, 22 nt, Mycobacterium avium subsp. paratuberculosis
caacaugauuccgccgggcggc

SEQ ID NO: 869070 - RNA, 19 nt, Mycobacterium avium subsp. paratuberculosis
caacaugcugcacggggug

SEQ ID NO: 869071 - RNA, 17 nt, Mycobacterium avium subsp. paratuberculosis
caacauugugcuguugg

SEQ ID NO: 869072 - RNA, 14 nt, Mycobacterium avium subsp. paratuberculosis
caaccacagcggcg

SEQ ID NO: 869073 - RNA, 12 nt, Mycobacterium avium subsp. paratuberculosis
caaccaccggca

SEQ ID NO: 869074 - RNA, 18 nt, Mycobacterium avium subsp. paratuberculosis
caaccaucgaggcgauca

SEQ ID NO: 869075 - RNA, 17 nt, Mycobacterium avium subsp. paratuberculosis
caaccaggcgcucgucg

SEQ ID NO: 869076 - RNA, 20 nt, Mycobacterium avium subsp. paratuberculosis
caaccagugcacgcucggcg

SEQ ID NO: 869077 - RNA, 23 nt, Mycobacterium avium subsp. paratuberculosis
caaccagugcacgcucggcgggg

SEQ ID NO: 869078 - RNA, 13 nt, Mycobacterium avium subsp. paratuberculosis
caacaccucggcg

SEQ ID NO: 869079 - RNA, 14 nt, Mycobacterium avium subsp. paratuberculosis
caacaccucggcga

SEQ ID NO: 869080 - RNA, 16 nt, Mycobacterium avium subsp. paratuberculosis
caacaccucggcgacg

SEQ ID NO: 869081 - RNA, 14 nt, Mycobacterium avium subsp. paratuberculosis
caacaccucgggca

SEQ ID NO: 869082 - RNA, 14 nt, Mycobacterium avium subsp. paratuberculosis
caacacgccggcgg

SEQ ID NO: 869083 - RNA, 16 nt, Mycobacterium avium subsp. paratuberculosis
caacacgccggcggcc

SEQ ID NO: 869084 - RNA, 22 nt, Mycobacterium avium subsp. paratuberculosis
caacagcgcgccggccggcacg

SEQ ID NO: 869085 - RNA, 13 nt, Mycobacterium avium subsp. paratuberculosis
caacagcggcccg

SEQ ID NO: 869086 - RNA, 16 nt, Mycobacterium avium subsp. paratuberculosis
caacagcgucucgacg

SEQ ID NO: 869087 - RNA, 22 nt, Mycobacterium avium subsp. paratuberculosis
caacagcgucucgacggcgccg

SEQ ID NO: 869088 - RNA, 23 nt, Mycobacterium avium subsp. paratuberculosis
caacagcgucucgacggcgccga

SEQ ID NO: 869089 - RNA, 17 nt, Mycobacterium avium subsp. paratuberculosis
caacagcgugcacaccc

SEQ ID NO: 869090 - RNA, 12 nt, Mycobacterium avium subsp. paratuberculosis
caacagccgccc

SEQ ID NO: 869091 - RNA, 15 nt, Mycobacterium avium subsp. paratuberculosis
caacagccggcccga

SEQ ID NO: 869092 - RNA, 13 nt, Mycobacterium avium subsp. paratuberculosis
caacagcgccgag

SEQ ID NO: 869093 - RNA, 16 nt, Mycobacterium avium subsp. paratuberculosis
caacagcgccgagacg

SEQ ID NO: 869094 - RNA, 16 nt, Mycobacterium avium subsp. paratuberculosis
caacagguucgacagc

SEQ ID NO: 869095 - RNA, 19 nt, Mycobacterium avium subsp. paratuberculosis
caacagugcgcaggcggcg

SEQ ID NO: 869096 - RNA, 20 nt, Mycobacterium avium subsp. paratuberculosis
caacagugcgcaggcggcgc

SEQ ID NO: 869097 - RNA, 16 nt, Mycobacterium avium subsp. paratuberculosis
caacagggccgcgcgg

SEQ ID NO: 869098 - RNA, 14 nt, Mycobacterium avium subsp. paratuberculosis
caacaggucggcgu

SEQ ID NO: 869099 - RNA, 15 nt, Mycobacterium avium subsp. paratuberculosis
caacaggucggcgug

SEQ ID NO: 869100 - RNA, 19 nt, Mycobacterium avium subsp. paratuberculosis
caacaggucggcgugcagc

SEQ ID NO: 869101 - RNA, 22 nt, Mycobacterium avium subsp. paratuberculosis
caacaggucggcgugcagcacg

SEQ ID NO: 869102 - RNA, 16 nt, Mycobacterium avium subsp. paratuberculosis
caacagggccaccgcg

SEQ ID NO: 869103 - RNA, 22 nt, Mycobacterium avium subsp. paratuberculosis
caacagcucuugaaucgguucg

SEQ ID NO: 869104 - RNA, 19 nt, Mycobacterium avium subsp. paratuberculosis
caacaggauuccggggaac

SEQ ID NO: 869105 - RNA, 16 nt, Mycobacterium avium subsp. paratuberculosis
caacaggcccagcagc

SEQ ID NO: 869106 - RNA, 19 nt, Mycobacterium avium subsp. paratuberculosis
caacgauucacccagcgag

SEQ ID NO: 869107 - RNA, 16 nt, Mycobacterium avium subsp. paratuberculosis
caacgaggcacggccc

SEQ ID NO: 869108 - RNA, 18 nt, Mycobacterium avium subsp. paratuberculosis
caacgaggcacggcccgc

SEQ ID NO: 869109 - RNA, 20 nt, Mycobacterium avium subsp. paratuberculosis
caacgcaaugcgucgcggcg

SEQ ID NO: 869110 - RNA, 19 nt, Mycobacterium avium subsp. paratuberculosis
caacgcacgggcggcgggg

SEQ ID NO: 869111 - RNA, 20 nt, Mycobacterium avium subsp. paratuberculosis
caacgagcgcgccgaggugg

SEQ ID NO: 869112 - RNA, 22 nt, Mycobacterium avium subsp. paratuberculosis
caacgagcugacgaacgcgccg

SEQ ID NO: 869113 - RNA, 18 nt, Mycobacterium avium subsp. paratuberculosis
caacgacgaagucgguca

SEQ ID NO: 869114 - RNA, 20 nt, Mycobacterium avium subsp. paratuberculosis
caacgacccggccaccgccg

SEQ ID NO: 869115 - RNA, 18 nt, Mycobacterium avium subsp. paratuberculosis
caacgacgucggcgucau

SEQ ID NO: 869116 - RNA, 13 nt, Mycobacterium avium subsp. paratuberculosis
caacgacagcgac

SEQ ID NO: 869117 - RNA, 14 nt, Mycobacterium avium subsp. paratuberculosis
caacgacagcgacg

SEQ ID NO: 869118 - RNA, 17 nt, Mycobacterium avium subsp. paratuberculosis
caacgacagcgacgggc

SEQ ID NO: 869119 - RNA, 18 nt, Mycobacterium avium subsp. paratuberculosis
caacgacagcgacgggcc

SEQ ID NO: 869120 - RNA, 24 nt, Mycobacterium avium subsp. paratuberculosis
caacgacagcgacgggccgggcac

SEQ ID NO: 869121 - RNA, 15 nt, Mycobacterium avium subsp. paratuberculosis
caaccugggcggcgg

SEQ ID NO: 869122 - RNA, 14 nt, Mycobacterium avium subsp. paratuberculosis
caacgcugaccgca

SEQ ID NO: 869123 - RNA, 20 nt, Mycobacterium avium subsp. paratuberculosis
caacgcgguguuggcggcgu

SEQ ID NO: 869124 - RNA, 21 nt, Mycobacterium avium subsp. paratuberculosis
caacgcgucgaacagccgggc

SEQ ID NO: 869125 - RNA, 22 nt, Mycobacterium avium subsp. paratuberculosis
caacgcgucgaacagccgggcc

SEQ ID NO: 869126 - RNA, 15 nt, Mycobacterium avium subsp. paratuberculosis
caacgcgucggcgcc

SEQ ID NO: 869127 - RNA, 16 nt, Mycobacterium avium subsp. paratuberculosis
caacgcgugaugcagc

SEQ ID NO: 869128 - RNA, 17 nt, Mycobacterium avium subsp. paratuberculosis
caacgcguucuccucga

SEQ ID NO: 869129 - RNA, 14 nt, Mycobacterium avium subsp. paratuberculosis
caacgcgccgaugc

SEQ ID NO: 869130 - RNA, 17 nt, Mycobacterium avium subsp. paratuberculosis
caacgcggacacggccg

SEQ ID NO: 869131 - RNA, 14 nt, Mycobacterium avium subsp. paratuberculosis
caacgcgcgcgacg

SEQ ID NO: 869132 - RNA, 18 nt, Mycobacterium avium subsp. paratuberculosis
caacgcgcgcgacggcgc

SEQ ID NO: 869133 - RNA, 19 nt, Mycobacterium avium subsp. paratuberculosis
caacgcgcgcgacggcgcg

SEQ ID NO: 869134 - RNA, 23 nt, Mycobacterium avium subsp. paratuberculosis
caacgcgcagccaggacuccuug

SEQ ID NO: 869135 - RNA, 14 nt, Mycobacterium avium subsp. paratuberculosis
caacgcgccggcgg

SEQ ID NO: 869136 - RNA, 22 nt, Mycobacterium avium subsp. paratuberculosis
caacgcgccggcggucgacacg

SEQ ID NO: 869137 - RNA, 17 nt, Mycobacterium avium subsp. paratuberculosis
caacgcggcaugaccgg

SEQ ID NO: 869138 - RNA, 19 nt, Mycobacterium avium subsp. paratuberculosis
caacgcggcaugaccggcc

SEQ ID NO: 869139 - RNA, 20 nt, Mycobacterium avium subsp. paratuberculosis
caacgcggcaugaccggcca

SEQ ID NO: 869140 - RNA, 15 nt, Mycobacterium avium subsp. paratuberculosis
caacgcggccaccac

SEQ ID NO: 869141 - RNA, 13 nt, Mycobacterium avium subsp. paratuberculosis
caacgcggcgccg

SEQ ID NO: 869142 - RNA, 14 nt, Mycobacterium avium subsp. paratuberculosis
caacgcggcgccgg

SEQ ID NO: 869143 - RNA, 15 nt, Mycobacterium avium subsp. paratuberculosis
caacgcggcgccggu

SEQ ID NO: 869144 - RNA, 14 nt, Mycobacterium avium subsp. paratuberculosis
caacgcggcgguga

SEQ ID NO: 869145 - RNA, 14 nt, Mycobacterium avium subsp. paratuberculosis
caacgcggugaccg

SEQ ID NO: 869146 - RNA, 14 nt, Mycobacterium avium subsp. paratuberculosis
caacgccgccgaca

SEQ ID NO: 869147 - RNA, 21 nt, Mycobacterium avium subsp. paratuberculosis
caacgccacaaacagcgcggc

SEQ ID NO: 869148 - RNA, 14 nt, Mycobacterium avium subsp. paratuberculosis
caacgccggcgugc

SEQ ID NO: 869149 - RNA, 14 nt, Mycobacterium avium subsp. paratuberculosis
caacgccgggucga

SEQ ID NO: 869150 - RNA, 15 nt, Mycobacterium avium subsp. paratuberculosis
caacgccgccuccga

SEQ ID NO: 869151 - RNA, 17 nt, Mycobacterium avium subsp. paratuberculosis
caacgccgccuccgaca

SEQ ID NO: 869152 - RNA, 22 nt, Mycobacterium avium subsp. paratuberculosis
caacgccuccgaauccagcgcg

SEQ ID NO: 869153 - RNA, 15 nt, Mycobacterium avium subsp. paratuberculosis
caacgccucgucgac

SEQ ID NO: 869154 - RNA, 14 nt, Mycobacterium avium subsp. paratuberculosis
caacgcgacgaagc

SEQ ID NO: 869155 - RNA, 21 nt, Mycobacterium avium subsp. paratuberculosis
caacgcgauucucgcugcggc

SEQ ID NO: 869156 - RNA, 14 nt, Mycobacterium avium subsp. paratuberculosis
caacgcgcacauca

SEQ ID NO: 869157 - RNA, 12 nt, Mycobacterium avium subsp. paratuberculosis
caaccccgcgcg

SEQ ID NO: 869158 - RNA, 22 nt, Mycobacterium avium subsp. paratuberculosis
caaccccgcgcgcgggccagcg

SEQ ID NO: 869159 - RNA, 13 nt, Mycobacterium avium subsp. paratuberculosis
caaccccgcggug

SEQ ID NO: 869160 - RNA, 12 nt, Mycobacterium avium subsp. paratuberculosis
caaccccgggcg

SEQ ID NO: 869161 - RNA, 14 nt, Mycobacterium avium subsp. paratuberculosis
caacccgaccucgu

SEQ ID NO: 869162 - RNA, 16 nt, Mycobacterium avium subsp. paratuberculosis
caacccgaccucgucg

SEQ ID NO: 869163 - RNA, 22 nt, Mycobacterium avium subsp. paratuberculosis
caacccgcucaggucggccgcg

SEQ ID NO: 869164 - RNA, 11 nt, Mycobacterium avium subsp. paratuberculosis
caacccggaca

SEQ ID NO: 869165 - RNA, 20 nt, Mycobacterium avium subsp. paratuberculosis
caacccggacagcgcgacgc

SEQ ID NO: 869166 - RNA, 22 nt, Mycobacterium avium subsp. paratuberculosis
caaccgaggcaaucgagcgggc

SEQ ID NO: 869167 - RNA, 19 nt, Mycobacterium avium subsp. paratuberculosis
caaccgaaucgagccgagg

SEQ ID NO: 869168 - RNA, 15 nt, Mycobacterium avium subsp. paratuberculosis
caacccgucgcgggu

SEQ ID NO: 869169 - RNA, 16 nt, Mycobacterium avium subsp. paratuberculosis
caacccgggccggaca

SEQ ID NO: 869170 - RNA, 22 nt, Mycobacterium avium subsp. paratuberculosis
caacccggucuuguugugcugc

SEQ ID NO: 869171 - RNA, 15 nt, Mycobacterium avium subsp. paratuberculosis
caaccgcccagcggc

SEQ ID NO: 869172 - RNA, 13 nt, Mycobacterium avium subsp. paratuberculosis
caaccgcccggcg

SEQ ID NO: 869173 - RNA, 16 nt, Mycobacterium avium subsp. paratuberculosis
caaccgcccggcgccg

SEQ ID NO: 869174 - RNA, 16 nt, Mycobacterium avium subsp. paratuberculosis
caaccgauuucggcca

SEQ ID NO: 869175 - RNA, 22 nt, Mycobacterium avium subsp. paratuberculosis
caaccgauuucggccagccggg

SEQ ID NO: 869176 - RNA, 14 nt, Mycobacterium avium subsp. paratuberculosis
caaccgcagcggcu

SEQ ID NO: 869177 - RNA, 19 nt, Mycobacterium avium subsp. paratuberculosis
caaccgcauucggccgcca

SEQ ID NO: 869178 - RNA, 15 nt, Mycobacterium avium subsp. paratuberculosis
caaccgccacgacgc

SEQ ID NO: 869179 - RNA, 15 nt, Mycobacterium avium subsp. paratuberculosis
caaccgccggcagcg

SEQ ID NO: 869180 - RNA, 13 nt, Mycobacterium avium subsp. paratuberculosis
caaccgcggcggc

SEQ ID NO: 869181 - RNA, 17 nt, Mycobacterium avium subsp. paratuberculosis
caaccgcggacuggcca

SEQ ID NO: 869182 - RNA, 22 nt, Mycobacterium avium subsp. paratuberculosis
caaccgcggacuggccaccgcg

SEQ ID NO: 869183 - RNA, 19 nt, Mycobacterium avium subsp. paratuberculosis
caaccgugacuggguggga

SEQ ID NO: 869184 - RNA, 20 nt, Mycobacterium avium subsp. paratuberculosis
caaccguuggugcgguguca

SEQ ID NO: 869185 - RNA, 13 nt, Mycobacterium avium subsp. paratuberculosis
caaccgcucggcg

SEQ ID NO: 869186 - RNA, 14 nt, Mycobacterium avium subsp. paratuberculosis
caaccgcucggcga

SEQ ID NO: 869187 - RNA, 15 nt, Mycobacterium avium subsp. paratuberculosis
caaccgcucggcgau

SEQ ID NO: 869188 - RNA, 16 nt, Mycobacterium avium subsp. paratuberculosis
caaccgcucggcgauc

SEQ ID NO: 869189 - RNA, 21 nt, Mycobacterium avium subsp. paratuberculosis
caaccggaauggcagcagccg

SEQ ID NO: 869190 - RNA, 12 nt, Mycobacterium avium subsp. paratuberculosis
caaccggaucgg

SEQ ID NO: 869191 - RNA, 12 nt, Mycobacterium avium subsp. paratuberculosis
caaccggcggcu

SEQ ID NO: 869192 - RNA, 21 nt, Mycobacterium avium subsp. paratuberculosis
caaccggcggcugggcagccg

SEQ ID NO: 869193 - RNA, 23 nt, Mycobacterium avium subsp. paratuberculosis
caaccggcggcugggcagccgcg

SEQ ID NO: 869194 - RNA, 15 nt, Mycobacterium avium subsp. paratuberculosis
caaccggccccgagc

SEQ ID NO: 869195 - RNA, 22 nt, Mycobacterium avium subsp. paratuberculosis
caaccgggauaccgcgaccgcc

SEQ ID NO: 869196 - RNA, 14 nt, Mycobacterium avium subsp. paratuberculosis
caaccgggccgcac

SEQ ID NO: 869197 - RNA, 23 nt, Mycobacterium avium subsp. paratuberculosis
caaccgguagaagaugcgccggg

SEQ ID NO: 869198 - RNA, 19 nt, Mycobacterium avium subsp. paratuberculosis
caaccgguagcgguccucg

SEQ ID NO: 869199 - RNA, 21 nt, Mycobacterium avium subsp. paratuberculosis
caaccgguccgccgucggggu

SEQ ID NO: 869200 - RNA, 16 nt, Mycobacterium avium subsp. paratuberculosis
caaccggugugccugg

SEQ ID NO: 869201 - RNA, 18 nt, Mycobacterium avium subsp. paratuberculosis
caaccgguucggacacgg

SEQ ID NO: 869202 - RNA, 22 nt, Mycobacterium avium subsp. paratuberculosis
caaccgguucggacacggcgcc

SEQ ID NO: 869203 - RNA, 12 nt, Mycobacterium avium subsp. paratuberculosis
caaucucgucgg

SEQ ID NO: 869204 - RNA, 17 nt, Mycobacterium avium subsp. paratuberculosis
caaucuucuccgcggcc

SEQ ID NO: 869205 - RNA, 18 nt, Mycobacterium avium subsp. paratuberculosis
caaucuucuccgcggccg

SEQ ID NO: 869206 - RNA, 21 nt, Mycobacterium avium subsp. paratuberculosis
caaucuucuccgcggccgcgc

SEQ ID NO: 869207 - RNA, 16 nt, Mycobacterium avium subsp. paratuberculosis
caaugaugucggcggg

SEQ ID NO: 869208 - RNA, 21 nt, Mycobacterium avium subsp. paratuberculosis
caaugcuuuuugcggacccag

SEQ ID NO: 869209 - RNA, 17 nt, Mycobacterium avium subsp. paratuberculosis
caauggauccgaucagc

SEQ ID NO: 869210 - RNA, 14 nt, Mycobacterium avium subsp. paratuberculosis
caauggccccggcg

SEQ ID NO: 869211 - RNA, 15 nt, Mycobacterium avium subsp. paratuberculosis
caauggccccggcgu

SEQ ID NO: 869212 - RNA, 18 nt, Mycobacterium avium subsp. paratuberculosis
caaugcgucgcggcggcg

SEQ ID NO: 869213 - RNA, 20 nt, Mycobacterium avium subsp. paratuberculosis
caauuccucagcccggcagc

SEQ ID NO: 869214 - RNA, 13 nt, Mycobacterium avium subsp. paratuberculosis
caauucgacugcg

SEQ ID NO: 869215 - RNA, 16 nt, Mycobacterium avium subsp. paratuberculosis
caauucgacugcgaug

SEQ ID NO: 869216 - RNA, 15 nt, Mycobacterium avium subsp. paratuberculosis
caauugacgccgaca

SEQ ID NO: 869217 - RNA, 17 nt, Mycobacterium avium subsp. paratuberculosis
caauucggugacggcgu

SEQ ID NO: 869218 - RNA, 21 nt, Mycobacterium avium subsp. paratuberculosis
caaguagacucagcgucgaug

SEQ ID NO: 869219 - RNA, 19 nt, Mycobacterium avium subsp. paratuberculosis
caaguagcgcuccaccagg

SEQ ID NO: 869220 - RNA, 13 nt, Mycobacterium avium subsp. paratuberculosis
caagggccgggcg

SEQ ID NO: 869221 - RNA, 20 nt, Mycobacterium avium subsp. paratuberculosis
caagggcggguaggcgccga

SEQ ID NO: 869222 - RNA, 20 nt, Mycobacterium avium subsp. paratuberculosis
caagguguuguaggagcugc

SEQ ID NO: 869223 - RNA, 12 nt, Mycobacterium avium subsp. paratuberculosis
caagucgaacgg

SEQ ID NO: 869224 - RNA, 15 nt, Mycobacterium avium subsp. paratuberculosis
caagucaugccgcgc

SEQ ID NO: 869225 - RNA, 18 nt, Mycobacterium avium subsp. paratuberculosis
caauacggugcccgccgc

SEQ ID NO: 869226 - RNA, 20 nt, Mycobacterium avium subsp. paratuberculosis
caauacggugcccgccgcga

SEQ ID NO: 869227 - RNA, 21 nt, Mycobacterium avium subsp. paratuberculosis
caauacggugcccgccgcgac

SEQ ID NO: 869228 - RNA, 21 nt, Mycobacterium avium subsp. paratuberculosis
caauccuguuccccggcgggc

SEQ ID NO: 869229 - RNA, 14 nt, Mycobacterium avium subsp. paratuberculosis
caauccggccccgc

SEQ ID NO: 869230 - RNA, 20 nt, Mycobacterium avium subsp. paratuberculosis
caauccggcgggccucgccg

SEQ ID NO: 869231 - RNA, 12 nt, Mycobacterium avium subsp. paratuberculosis
caaucaccgcgg

SEQ ID NO: 869232 - RNA, 15 nt, Mycobacterium avium subsp. paratuberculosis
caacuacgagcagca

SEQ ID NO: 869233 - RNA, 16 nt, Mycobacterium avium subsp. paratuberculosis
caacugcaccagcggc

SEQ ID NO: 869234 - RNA, 21 nt, Mycobacterium avium subsp. paratuberculosis
caacugcagauaggacccggc

SEQ ID NO: 869235 - RNA, 19 nt, Mycobacterium avium subsp. paratuberculosis
caacugcaucgccagcaca

SEQ ID NO: 869236 - RNA, 23 nt, Mycobacterium avium subsp. paratuberculosis
caacugcauuucggacggcgacg

SEQ ID NO: 869237 - RNA, 19 nt, Mycobacterium avium subsp. paratuberculosis
caacugaucgagcucggcc

SEQ ID NO: 869238 - RNA, 19 nt, Mycobacterium avium subsp. paratuberculosis
caacugaauuccuggccgg

SEQ ID NO: 869239 - RNA, 21 nt, Mycobacterium avium subsp. paratuberculosis
caacugaccgauggccgcccg

SEQ ID NO: 869240 - RNA, 15 nt, Mycobacterium avium subsp. paratuberculosis
caacgguucggccgc

SEQ ID NO: 869241 - RNA, 23 nt, Mycobacterium avium subsp. paratuberculosis
caacgguuuccaccaccacccgg

SEQ ID NO: 869242 - RNA, 16 nt, Mycobacterium avium subsp. paratuberculosis
caacguguacucggcg

SEQ ID NO: 869243 - RNA, 18 nt, Mycobacterium avium subsp. paratuberculosis
caacguguacucggcguc

SEQ ID NO: 869244 - RNA, 22 nt, Mycobacterium avium subsp. paratuberculosis
caacguguacucggcgucgccg

SEQ ID NO: 869245 - RNA, 23 nt, Mycobacterium avium subsp. paratuberculosis
caacguguacucggcgucgccga

SEQ ID NO: 869246 - RNA, 15 nt, Mycobacterium avium subsp. paratuberculosis
caacgugaugagcgc

SEQ ID NO: 869247 - RNA, 21 nt, Mycobacterium avium subsp. paratuberculosis
caacgucucugucgucgacca

SEQ ID NO: 869248 - RNA, 20 nt, Mycobacterium avium subsp. paratuberculosis
caacgucuggccaccgaagc

SEQ ID NO: 869249 - RNA, 19 nt, Mycobacterium avium subsp. paratuberculosis
caacggaucgagcgcaccg

SEQ ID NO: 869250 - RNA, 20 nt, Mycobacterium avium subsp. paratuberculosis
caacggauucagcgucgcca

SEQ ID NO: 869251 - RNA, 14 nt, Mycobacterium avium subsp. paratuberculosis
caacggcaccgaca

SEQ ID NO: 869252 - RNA, 18 nt, Mycobacterium avium subsp. paratuberculosis
caacggccaaccgcccgg

SEQ ID NO: 869253 - RNA, 20 nt, Mycobacterium avium subsp. paratuberculosis
caacggccaaccgcccggcg

SEQ ID NO: 869254 - RNA, 21 nt, Mycobacterium avium subsp. paratuberculosis
caacggccaugaagccguugc

SEQ ID NO: 869255 - RNA, 23 nt, Mycobacterium avium subsp. paratuberculosis
caacggccaugaagccguugccg

SEQ ID NO: 869256 - RNA, 14 nt, Mycobacterium avium subsp. paratuberculosis
caacggccgcacgu

SEQ ID NO: 869257 - RNA, 13 nt, Mycobacterium avium subsp. paratuberculosis
caacggccgcagc

SEQ ID NO: 869258 - RNA, 14 nt, Mycobacterium avium subsp. paratuberculosis
caacggccgcagcg

SEQ ID NO: 869259 - RNA, 16 nt, Mycobacterium avium subsp. paratuberculosis
caacggccgcagcgac

SEQ ID NO: 869260 - RNA, 16 nt, Mycobacterium avium subsp. paratuberculosis
caacggccggcgccgc

SEQ ID NO: 869261 - RNA, 22 nt, Mycobacterium avium subsp. paratuberculosis
caacggccggcgccgccggggc

SEQ ID NO: 869262 - RNA, 14 nt, Mycobacterium avium subsp. paratuberculosis
caacggcgucgaca

SEQ ID NO: 869263 - RNA, 16 nt, Mycobacterium avium subsp. paratuberculosis
caacggcucccaggcc

SEQ ID NO: 869264 - RNA, 14 nt, Mycobacterium avium subsp. paratuberculosis
caacggcggcggcg

SEQ ID NO: 869265 - RNA, 16 nt, Mycobacterium avium subsp. paratuberculosis
caacggcggcggcggc

SEQ ID NO: 869266 - RNA, 17 nt, Mycobacterium avium subsp. paratuberculosis
caacgggaagagcggcg

SEQ ID NO: 869267 - RNA, 18 nt, Mycobacterium avium subsp. paratuberculosis
caacgggaagagcggcgu

SEQ ID NO: 869268 - RNA, 19 nt, Mycobacterium avium subsp. paratuberculosis
caacggcuugcgcagguug

SEQ ID NO: 869269 - RNA, 18 nt, Mycobacterium avium subsp. paratuberculosis
caacgggauggcucagcg

SEQ ID NO: 869270 - RNA, 23 nt, Mycobacterium avium subsp. paratuberculosis
caacgggauggcucagcgcaccg

SEQ ID NO: 869271 - RNA, 14 nt, Mycobacterium avium subsp. paratuberculosis
caacgggccgcagc

SEQ ID NO: 869272 - RNA, 15 nt, Mycobacterium avium subsp. paratuberculosis
caacgggccgcagcc

SEQ ID NO: 869273 - RNA, 16 nt, Mycobacterium avium subsp. paratuberculosis
caacgggccgcagccg

SEQ ID NO: 869274 - RNA, 13 nt, Mycobacterium avium subsp. paratuberculosis
caacgggcggcgg

SEQ ID NO: 869275 - RNA, 16 nt, Mycobacterium avium subsp. paratuberculosis
caacgggucgagcacg

SEQ ID NO: 869276 - RNA, 17 nt, Mycobacterium avium subsp. paratuberculosis
caacgggucgagcacgu

SEQ ID NO: 869277 - RNA, 19 nt, Mycobacterium avium subsp. paratuberculosis
caacgguacgugcgccggc

SEQ ID NO: 869278 - RNA, 22 nt, Mycobacterium avium subsp. paratuberculosis
caacgguacgugcgccggcggu

SEQ ID NO: 869279 - RNA, 22 nt, Mycobacterium avium subsp. paratuberculosis
caagcuggucgccaaacugcgc

SEQ ID NO: 869280 - RNA, 22 nt, Mycobacterium avium subsp. paratuberculosis
caagcugauucgggaucagccg

SEQ ID NO: 869281 - RNA, 23 nt, Mycobacterium avium subsp. paratuberculosis
caaggcaagucgucggugggccg

SEQ ID NO: 869282 - RNA, 17 nt, Mycobacterium avium subsp. paratuberculosis
caaggagguggucgagc

SEQ ID NO: 869283 - RNA, 18 nt, Mycobacterium avium subsp. paratuberculosis
caaggcgaugcccagcca

SEQ ID NO: 869284 - RNA, 16 nt, Mycobacterium avium subsp. paratuberculosis
caaggcccccgccucg

SEQ ID NO: 869285 - RNA, 23 nt, Mycobacterium avium subsp. paratuberculosis
caaggcccccgccucgccgguca

SEQ ID NO: 869286 - RNA, 15 nt, Mycobacterium avium subsp. paratuberculosis
caaggccagcaaccg

SEQ ID NO: 869287 - RNA, 23 nt, Mycobacterium avium subsp. paratuberculosis
caaggccgacagguagcaggcgc

SEQ ID NO: 869288 - RNA, 19 nt, Mycobacterium avium subsp. paratuberculosis
caaggccugcgccuuggcc

SEQ ID NO: 869289 - RNA, 22 nt, Mycobacterium avium subsp. paratuberculosis
caagccggcgucgaugaugccg

SEQ ID NO: 869290 - RNA, 19 nt, Mycobacterium avium subsp. paratuberculosis
caagccgggcggcagcagc

SEQ ID NO: 869291 - RNA, 17 nt, Mycobacterium avium subsp. paratuberculosis
caagccggccagcagcg

SEQ ID NO: 869292 - RNA, 16 nt, Mycobacterium avium subsp. paratuberculosis
caagccggagaaggcg

SEQ ID NO: 869293 - RNA, 14 nt, Mycobacterium avium subsp. paratuberculosis
caagacccgcguca

SEQ ID NO: 869294 - RNA, 20 nt, Mycobacterium avium subsp. paratuberculosis
caagacccgcgucaucgggc

SEQ ID NO: 869295 - RNA, 13 nt, Mycobacterium avium subsp. paratuberculosis
caagaccgcgguc

SEQ ID NO: 869296 - RNA, 16 nt, Mycobacterium avium subsp. paratuberculosis
caagaccgcggucacc

SEQ ID NO: 869297 - RNA, 17 nt, Mycobacterium avium subsp. paratuberculosis
caagaccgcggucaccg

SEQ ID NO: 869298 - RNA, 20 nt, Mycobacterium avium subsp. paratuberculosis
caagaccgcggucaccgguc

SEQ ID NO: 869299 - RNA, 21 nt, Mycobacterium avium subsp. paratuberculosis
caagaccgcggucaccggucg

SEQ ID NO: 869300 - RNA, 15 nt, Mycobacterium avium subsp. paratuberculosis
caagauaccggccgg

SEQ ID NO: 869301 - RNA, 20 nt, Mycobacterium avium subsp. paratuberculosis
caagacggugggcccgccgu

SEQ ID NO: 869302 - RNA, 22 nt, Mycobacterium avium subsp. paratuberculosis
caagacggugggcccgccgucg

SEQ ID NO: 869303 - RNA, 21 nt, Mycobacterium avium subsp. paratuberculosis
caagacguccgcgucggcgcc

SEQ ID NO: 869304 - RNA, 23 nt, Mycobacterium avium subsp. paratuberculosis
caagacguccgcgucggcgccgg

SEQ ID NO: 869305 - RNA, 19 nt, Mycobacterium avium subsp. paratuberculosis
cacauguucuccucgucgc

SEQ ID NO: 869306 - RNA, 23 nt, Mycobacterium avium subsp. paratuberculosis
cacaugggccacggcgcgaggac

SEQ ID NO: 869307 - RNA, 18 nt, Mycobacterium avium subsp. paratuberculosis
cacaugggcgcguuggcc

SEQ ID NO: 869308 - RNA, 22 nt, Mycobacterium avium subsp. paratuberculosis
cacauugcgauacgacgggaug

SEQ ID NO: 869309 - RNA, 17 nt, Mycobacterium avium subsp. paratuberculosis
caccaacagcggcccga

SEQ ID NO: 869310 - RNA, 23 nt, Mycobacterium avium subsp. paratuberculosis
caccaacagcggcccgaucaccg

SEQ ID NO: 869311 - RNA, 16 nt, Mycobacterium avium subsp. paratuberculosis
caccaacaggucggcg

SEQ ID NO: 869312 - RNA, 17 nt, Mycobacterium avium subsp. paratuberculosis
caccaacaggucggcgu

SEQ ID NO: 869313 - RNA, 17 nt, Mycobacterium avium subsp. paratuberculosis
caccaacaucgacgugc

SEQ ID NO: 869314 - RNA, 22 nt, Mycobacterium avium subsp. paratuberculosis
caccaaauagccgucggcggcc

SEQ ID NO: 869315 - RNA, 23 nt, Mycobacterium avium subsp. paratuberculosis
caccaaauagccgucggcggccu

SEQ ID NO: 869316 - RNA, 17 nt, Mycobacterium avium subsp. paratuberculosis
caccaccacggagcgcc

SEQ ID NO: 869317 - RNA, 16 nt, Mycobacterium avium subsp. paratuberculosis
caccaccacggccaug

SEQ ID NO: 869318 - RNA, 15 nt, Mycobacterium avium subsp. paratuberculosis
caccaccacggggcg

SEQ ID NO: 869319 - RNA, 14 nt, Mycobacterium avium subsp. paratuberculosis
caccaccaccgccg

SEQ ID NO: 869320 - RNA, 15 nt, Mycobacterium avium subsp. paratuberculosis
caccaccaccgccgu

SEQ ID NO: 869321 - RNA, 15 nt, Mycobacterium avium subsp. paratuberculosis
caccaacccgaucgg

SEQ ID NO: 869322 - RNA, 22 nt, Mycobacterium avium subsp. paratuberculosis
caccaacccgaucggcccggcc

SEQ ID NO: 869323 - RNA, 14 nt, Mycobacterium avium subsp. paratuberculosis
caccaaccgcucgg

SEQ ID NO: 869324 - RNA, 15 nt, Mycobacterium avium subsp. paratuberculosis
caccaaccgcucggc

SEQ ID NO: 869325 - RNA, 16 nt, Mycobacterium avium subsp. paratuberculosis
caccaaccgcucggcg

SEQ ID NO: 869326 - RNA, 13 nt, Mycobacterium avium subsp. paratuberculosis
caccaccaggggc

SEQ ID NO: 869327 - RNA, 14 nt, Mycobacterium avium subsp. paratuberculosis
caccaccagcucgu

SEQ ID NO: 869328 - RNA, 20 nt, Mycobacterium avium subsp. paratuberculosis
caccaccacguugcacggca

SEQ ID NO: 869329 - RNA, 22 nt, Mycobacterium avium subsp. paratuberculosis
caccaccaggucuccgucggcg

SEQ ID NO: 869330 - RNA, 19 nt, Mycobacterium avium subsp. paratuberculosis
caccaccaugucguugacg

SEQ ID NO: 869331 - RNA, 14 nt, Mycobacterium avium subsp. paratuberculosis
caccaccgccggcc

SEQ ID NO: 869332 - RNA, 21 nt, Mycobacterium avium subsp. paratuberculosis
caccaccgccggcccaggcag

SEQ ID NO: 869333 - RNA, 13 nt, Mycobacterium avium subsp. paratuberculosis
caccaccgccggg

SEQ ID NO: 869334 - RNA, 14 nt, Mycobacterium avium subsp. paratuberculosis
caccacgaugaagc

SEQ ID NO: 869335 - RNA, 22 nt, Mycobacterium avium subsp. paratuberculosis
caccacgaugaagccgugcccg

SEQ ID NO: 869336 - RNA, 19 nt, Mycobacterium avium subsp. paratuberculosis
caccacgaucagcgcgucg

SEQ ID NO: 869337 - RNA, 16 nt, Mycobacterium avium subsp. paratuberculosis
caccaccgggucgucg

SEQ ID NO: 869338 - RNA, 18 nt, Mycobacterium avium subsp. paratuberculosis
caccaccgggucgucgcg

SEQ ID NO: 869339 - RNA, 20 nt, Mycobacterium avium subsp. paratuberculosis
caccacgaccuccgugccga

SEQ ID NO: 869340 - RNA, 14 nt, Mycobacterium avium subsp. paratuberculosis
caccacgacgccgg

SEQ ID NO: 869341 - RNA, 13 nt, Mycobacterium avium subsp. paratuberculosis
caccacgacgggg

SEQ ID NO: 869342 - RNA, 23 nt, Mycobacterium avium subsp. paratuberculosis
caccacgacggggaacucgguga

SEQ ID NO: 869343 - RNA, 13 nt, Mycobacterium avium subsp. paratuberculosis
caccacgacgucg

SEQ ID NO: 869344 - RNA, 13 nt, Mycobacterium avium subsp. paratuberculosis
caccacgaucacc

SEQ ID NO: 869345 - RNA, 16 nt, Mycobacterium avium subsp. paratuberculosis
caccacgaucaccaga

SEQ ID NO: 869346 - RNA, 13 nt, Mycobacterium avium subsp. paratuberculosis
caccaccggagcg

SEQ ID NO: 869347 - RNA, 18 nt, Mycobacterium avium subsp. paratuberculosis
caccaccggagcggcggu

SEQ ID NO: 869348 - RNA, 14 nt, Mycobacterium avium subsp. paratuberculosis
caccaccggcaacc

SEQ ID NO: 869349 - RNA, 23 nt, Mycobacterium avium subsp. paratuberculosis
caccaccggcaaccgccacgacg

SEQ ID NO: 869350 - RNA, 19 nt, Mycobacterium avium subsp. paratuberculosis
caccaccggccgcccggcg

SEQ ID NO: 869351 - RNA, 21 nt, Mycobacterium avium subsp. paratuberculosis
caccaccggccgcccggcgag

SEQ ID NO: 869352 - RNA, 15 nt, Mycobacterium avium subsp. paratuberculosis
caccaccggccgcgc

SEQ ID NO: 869353 - RNA, 23 nt, Mycobacterium avium subsp. paratuberculosis
caccaccgcgccgucgucgucgg

SEQ ID NO: 869354 - RNA, 13 nt, Mycobacterium avium subsp. paratuberculosis
caccaccgcgcgc

SEQ ID NO: 869355 - RNA, 15 nt, Mycobacterium avium subsp. paratuberculosis
caccaccgcggcgcc

SEQ ID NO: 869356 - RNA, 14 nt, Mycobacterium avium subsp. paratuberculosis
caccaccgcgguga

SEQ ID NO: 869357 - RNA, 16 nt, Mycobacterium avium subsp. paratuberculosis
caccaccgcggugagc

SEQ ID NO: 869358 - RNA, 21 nt, Mycobacterium avium subsp. paratuberculosis
caccaccgcggugagcggccg

SEQ ID NO: 869359 - RNA, 21 nt, Mycobacterium avium subsp. paratuberculosis
caccaccgccgucaccgccag

SEQ ID NO: 869360 - RNA, 12 nt, Mycobacterium avium subsp. paratuberculosis
caccaccgcgag

SEQ ID NO: 869361 - RNA, 11 nt, Mycobacterium avium subsp. paratuberculosis
caccaccgcgc

SEQ ID NO: 869362 - RNA, 16 nt, Mycobacterium avium subsp. paratuberculosis
caccaccgcgccgucg

SEQ ID NO: 869363 - RNA, 18 nt, Mycobacterium avium subsp. paratuberculosis
caccacgggucggucggc

SEQ ID NO: 869364 - RNA, 19 nt, Mycobacterium avium subsp. paratuberculosis
caccacgggucggucggcc

SEQ ID NO: 869365 - RNA, 22 nt, Mycobacterium avium subsp. paratuberculosis
caccacgggucggucggcccgc

SEQ ID NO: 869366 - RNA, 13 nt, Mycobacterium avium subsp. paratuberculosis
caccacgguggcg

SEQ ID NO: 869367 - RNA, 17 nt, Mycobacterium avium subsp. paratuberculosis
caccacgguggcgccgc

SEQ ID NO: 869368 - RNA, 18 nt, Mycobacterium avium subsp. paratuberculosis
caccacgguggcgccgcg

SEQ ID NO: 869369 - RNA, 19 nt, Mycobacterium avium subsp. paratuberculosis
caccacgguggcgccgcgc

SEQ ID NO: 869370 - RNA, 20 nt, Mycobacterium avium subsp. paratuberculosis
caccacgguggcgccgcgca

SEQ ID NO: 869371 - RNA, 22 nt, Mycobacterium avium subsp. paratuberculosis
caccacgguggcgccgcgcagc

SEQ ID NO: 869372 - RNA, 23 nt, Mycobacterium avium subsp. paratuberculosis
caccacgguggcgccgcgcagcc

SEQ ID NO: 869373 - RNA, 19 nt, Mycobacterium avium subsp. paratuberculosis
caccacgguggcgccggca

SEQ ID NO: 869374 - RNA, 14 nt, Mycobacterium avium subsp. paratuberculosis
caccacgguguagc

SEQ ID NO: 869375 - RNA, 21 nt, Mycobacterium avium subsp. paratuberculosis
caccacgguguagcggcggcu

SEQ ID NO: 869376 - RNA, 11 nt, Mycobacterium avium subsp. paratuberculosis
caccacggcgg

SEQ ID NO: 869377 - RNA, 18 nt, Mycobacterium avium subsp. paratuberculosis
caccacggagcgcccggc

SEQ ID NO: 869378 - RNA, 19 nt, Mycobacterium avium subsp. paratuberculosis
caccacggagcgcccggcc

SEQ ID NO: 869379 - RNA, 13 nt, Mycobacterium avium subsp. paratuberculosis
caccacggcaccg

SEQ ID NO: 869380 - RNA, 18 nt, Mycobacterium avium subsp. paratuberculosis
caccacggcaccgccgcg

SEQ ID NO: 869381 - RNA, 19 nt, Mycobacterium avium subsp. paratuberculosis
caccacggcaccgccgcgc

SEQ ID NO: 869382 - RNA, 17 nt, Mycobacterium avium subsp. paratuberculosis
caccacggccgccgagg

SEQ ID NO: 869383 - RNA, 19 nt, Mycobacterium avium subsp. paratuberculosis
caccacggccgccgaggcg

SEQ ID NO: 869384 - RNA, 16 nt, Mycobacterium avium subsp. paratuberculosis
caccacggccggcaac

SEQ ID NO: 869385 - RNA, 22 nt, Mycobacterium avium subsp. paratuberculosis
caccacggccaggaagccggcg

SEQ ID NO: 869386 - RNA, 23 nt, Mycobacterium avium subsp. paratuberculosis
caccacggccaucacggugccga

SEQ ID NO: 869387 - RNA, 13 nt, Mycobacterium avium subsp. paratuberculosis
caccacggcccgc

SEQ ID NO: 869388 - RNA, 14 nt, Mycobacterium avium subsp. paratuberculosis
caccacggcccgcg

SEQ ID NO: 869389 - RNA, 15 nt, Mycobacterium avium subsp. paratuberculosis
caccacggcccgcgc

SEQ ID NO: 869390 - RNA, 12 nt, Mycobacterium avium subsp. paratuberculosis
caccacggccga

SEQ ID NO: 869391 - RNA, 16 nt, Mycobacterium avium subsp. paratuberculosis
caccacggccgaugca

SEQ ID NO: 869392 - RNA, 13 nt, Mycobacterium avium subsp. paratuberculosis
caccacggccgcc

SEQ ID NO: 869393 - RNA, 13 nt, Mycobacterium avium subsp. paratuberculosis
caccacgccgacg

SEQ ID NO: 869394 - RNA, 14 nt, Mycobacterium avium subsp. paratuberculosis
caccacgccgacgu

SEQ ID NO: 869395 - RNA, 22 nt, Mycobacterium avium subsp. paratuberculosis
caccacgccgacguggguggug

SEQ ID NO: 869396 - RNA, 14 nt, Mycobacterium avium subsp. paratuberculosis
caccacgccgagca

SEQ ID NO: 869397 - RNA, 23 nt, Mycobacterium avium subsp. paratuberculosis
caccacgcccgacgacgacgucg

SEQ ID NO: 869398 - RNA, 20 nt, Mycobacterium avium subsp. paratuberculosis
cacaaacagcgcggccggaa

SEQ ID NO: 869399 - RNA, 16 nt, Mycobacterium avium subsp. paratuberculosis
cacagcagggcaccga

SEQ ID NO: 869400 - RNA, 20 nt, Mycobacterium avium subsp. paratuberculosis
cacagcagggcaccgacggc

SEQ ID NO: 869401 - RNA, 24 nt, Mycobacterium avium subsp. paratuberculosis
cacagcaugaagaucagcaccguc

SEQ ID NO: 869402 - RNA, 13 nt, Mycobacterium avium subsp. paratuberculosis
cacagccagcgcc

SEQ ID NO: 869403 - RNA, 15 nt, Mycobacterium avium subsp. paratuberculosis
cacagccagcgcccg

SEQ ID NO: 869404 - RNA, 21 nt, Mycobacterium avium subsp. paratuberculosis
cacagccagcgcccggcgacc

SEQ ID NO: 869405 - RNA, 19 nt, Mycobacterium avium subsp. paratuberculosis
cacagcccccacgcucggc

SEQ ID NO: 869406 - RNA, 20 nt, Mycobacterium avium subsp. paratuberculosis
cacagccgcuuggcgcgccg

SEQ ID NO: 869407 - RNA, 14 nt, Mycobacterium avium subsp. paratuberculosis
cacagccggcgcgc

SEQ ID NO: 869408 - RNA, 15 nt, Mycobacterium avium subsp. paratuberculosis
cacagccggcggcgg

SEQ ID NO: 869409 - RNA, 23 nt, Mycobacterium avium subsp. paratuberculosis
cacagccggggaucgcgcagccg

SEQ ID NO: 869410 - RNA, 15 nt, Mycobacterium avium subsp. paratuberculosis
cacagcucaccugcg

SEQ ID NO: 869411 - RNA, 12 nt, Mycobacterium avium subsp. paratuberculosis
cacagcucgggc

SEQ ID NO: 869412 - RNA, 19 nt, Mycobacterium avium subsp. paratuberculosis
cacagcugacgggccggcg

SEQ ID NO: 869413 - RNA, 16 nt, Mycobacterium avium subsp. paratuberculosis
cacagcugccggccgu

SEQ ID NO: 869414 - RNA, 16 nt, Mycobacterium avium subsp. paratuberculosis
cacagcugcuggcugc

SEQ ID NO: 869415 - RNA, 23 nt, Mycobacterium avium subsp. paratuberculosis
cacagcccguugcugcguucggc

SEQ ID NO: 869416 - RNA, 15 nt, Mycobacterium avium subsp. paratuberculosis
cacagcuugucccag

SEQ ID NO: 869417 - RNA, 18 nt, Mycobacterium avium subsp. paratuberculosis
cacaggcacacgaacacc

SEQ ID NO: 869418 - RNA, 19 nt, Mycobacterium avium subsp. paratuberculosis
cacagcuuucgggcggccu

SEQ ID NO: 869419 - RNA, 14 nt, Mycobacterium avium subsp. paratuberculosis
cacaggaacgcgac

SEQ ID NO: 869420 - RNA, 15 nt, Mycobacterium avium subsp. paratuberculosis
cacaggaacgcgacg

SEQ ID NO: 869421 - RNA, 19 nt, Mycobacterium avium subsp. paratuberculosis
cacaggacguugaggcggc

SEQ ID NO: 869422 - RNA, 20 nt, Mycobacterium avium subsp. paratuberculosis
cacaggacguugaggcggcg

SEQ ID NO: 869423 - RNA, 21 nt, Mycobacterium avium subsp. paratuberculosis
cacaggacguugaggcggcgg

SEQ ID NO: 869424 - RNA, 23 nt, Mycobacterium avium subsp. paratuberculosis
cacaggacguugaggcggcggcg

SEQ ID NO: 869425 - RNA, 14 nt, Mycobacterium avium subsp. paratuberculosis
cacaggccgccgca

SEQ ID NO: 869426 - RNA, 16 nt, Mycobacterium avium subsp. paratuberculosis
cacaggccgccgcauu

SEQ ID NO: 869427 - RNA, 13 nt, Mycobacterium avium subsp. paratuberculosis
cacaggccgccuc

SEQ ID NO: 869428 - RNA, 19 nt, Mycobacterium avium subsp. paratuberculosis
cacaucacgguggccgcca

SEQ ID NO: 869429 - RNA, 20 nt, Mycobacterium avium subsp. paratuberculosis
cacaucacgguggccgccac

SEQ ID NO: 869430 - RNA, 15 nt, Mycobacterium avium subsp. paratuberculosis
cacaucagcucggcg

SEQ ID NO: 869431 - RNA, 17 nt, Mycobacterium avium subsp. paratuberculosis
cacaucagcucggcggc

SEQ ID NO: 869432 - RNA, 18 nt, Mycobacterium avium subsp. paratuberculosis
cacaucagcucggcggcc

SEQ ID NO: 869433 - RNA, 13 nt, Mycobacterium avium subsp. paratuberculosis
cacaugcccgucg

SEQ ID NO: 869434 - RNA, 16 nt, Mycobacterium avium subsp. paratuberculosis
cacaugccgaggcaca

SEQ ID NO: 869435 - RNA, 16 nt, Mycobacterium avium subsp. paratuberculosis
cacagugcgucgccca

SEQ ID NO: 869436 - RNA, 14 nt, Mycobacterium avium subsp. paratuberculosis
cacauacgcggcgg

SEQ ID NO: 869437 - RNA, 16 nt, Mycobacterium avium subsp. paratuberculosis
cacauacgcggcggcc

SEQ ID NO: 869438 - RNA, 23 nt, Mycobacterium avium subsp. paratuberculosis
cacauaccgggacaucgucgcgc

SEQ ID NO: 869439 - RNA, 23 nt, Mycobacterium avium subsp. paratuberculosis
cacauacaccgggaucggcggcg

SEQ ID NO: 869440 - RNA, 17 nt, Mycobacterium avium subsp. paratuberculosis
caccagcgauccggcgc

SEQ ID NO: 869441 - RNA, 15 nt, Mycobacterium avium subsp. paratuberculosis
caccagcgcaggucc

SEQ ID NO: 869442 - RNA, 19 nt, Mycobacterium avium subsp. paratuberculosis
caccagcgcagguccucgg

SEQ ID NO: 869443 - RNA, 17 nt, Mycobacterium avium subsp. paratuberculosis
caccagcggcugcagca

SEQ ID NO: 869444 - RNA, 22 nt, Mycobacterium avium subsp. paratuberculosis
caccagcgggcugugccggcgg

SEQ ID NO: 869445 - RNA, 13 nt, Mycobacterium avium subsp. paratuberculosis
caccagcggggug

SEQ ID NO: 869446 - RNA, 15 nt, Mycobacterium avium subsp. paratuberculosis
caccagcucggugau

SEQ ID NO: 869447 - RNA, 18 nt, Mycobacterium avium subsp. paratuberculosis
caccagcucgaggccgcg

SEQ ID NO: 869448 - RNA, 22 nt, Mycobacterium avium subsp. paratuberculosis
caccagcucgccgauguggcgg

SEQ ID NO: 869449 - RNA, 20 nt, Mycobacterium avium subsp. paratuberculosis
caccagcguguugagcucgc

SEQ ID NO: 869450 - RNA, 19 nt, Mycobacterium avium subsp. paratuberculosis
caccagcguuccagcaccc

SEQ ID NO: 869451 - RNA, 19 nt, Mycobacterium avium subsp. paratuberculosis
caccagcguucgucgccgg

SEQ ID NO: 869452 - RNA, 18 nt, Mycobacterium avium subsp. paratuberculosis
caccagcguguagacggu

SEQ ID NO: 869453 - RNA, 14 nt, Mycobacterium avium subsp. paratuberculosis
caccagcgucgacg

SEQ ID NO: 869454 - RNA, 20 nt, Mycobacterium avium subsp. paratuberculosis
caccagcgucgacgcgguga

SEQ ID NO: 869455 - RNA, 15 nt, Mycobacterium avium subsp. paratuberculosis
caccagcggucggcg

SEQ ID NO: 869456 - RNA, 17 nt, Mycobacterium avium subsp. paratuberculosis
caccagcgugcugccgg

SEQ ID NO: 869457 - RNA, 19 nt, Mycobacterium avium subsp. paratuberculosis
caccagcguggccggcagg

SEQ ID NO: 869458 - RNA, 22 nt, Mycobacterium avium subsp. paratuberculosis
caccagcguggccggcagguug

SEQ ID NO: 869459 - RNA, 17 nt, Mycobacterium avium subsp. paratuberculosis
caccagccgcaggugcu

SEQ ID NO: 869460 - RNA, 19 nt, Mycobacterium avium subsp. paratuberculosis
caccagccggccggcgaag

SEQ ID NO: 869461 - RNA, 17 nt, Mycobacterium avium subsp. paratuberculosis
caccagcgacagcaccc

SEQ ID NO: 869462 - RNA, 14 nt, Mycobacterium avium subsp. paratuberculosis
caccagcgaggucu

SEQ ID NO: 869463 - RNA, 13 nt, Mycobacterium avium subsp. paratuberculosis
caccagccggccg

SEQ ID NO: 869464 - RNA, 13 nt, Mycobacterium avium subsp. paratuberculosis
caccagcccggcc

SEQ ID NO: 869465 - RNA, 16 nt, Mycobacterium avium subsp. paratuberculosis
caccagcccggccgag

SEQ ID NO: 869466 - RNA, 18 nt, Mycobacterium avium subsp. paratuberculosis
caccacguugcacggcag

SEQ ID NO: 869467 - RNA, 18 nt, Mycobacterium avium subsp. paratuberculosis
caccagcccgaugccgcc

SEQ ID NO: 869468 - RNA, 22 nt, Mycobacterium avium subsp. paratuberculosis
caccagcccgaugccgccgagg

SEQ ID NO: 869469 - RNA, 19 nt, Mycobacterium avium subsp. paratuberculosis
caccacgucggugccgcgu

SEQ ID NO: 869470 - RNA, 13 nt, Mycobacterium avium subsp. paratuberculosis
caccacgucgucc

SEQ ID NO: 869471 - RNA, 14 nt, Mycobacterium avium subsp. paratuberculosis
caccacgucgucgg

SEQ ID NO: 869472 - RNA, 16 nt, Mycobacterium avium subsp. paratuberculosis
caccacgucgucggcc

SEQ ID NO: 869473 - RNA, 19 nt, Mycobacterium avium subsp. paratuberculosis
caccacgucgucggccugc

SEQ ID NO: 869474 - RNA, 17 nt, Mycobacterium avium subsp. paratuberculosis
caccacguugcgcggcc

SEQ ID NO: 869475 - RNA, 19 nt, Mycobacterium avium subsp. paratuberculosis
caccacguugcgcggccgc

SEQ ID NO: 869476 - RNA, 20 nt, Mycobacterium avium subsp. paratuberculosis
caccacguugcgcggccgca

SEQ ID NO: 869477 - RNA, 17 nt, Mycobacterium avium subsp. paratuberculosis
caccacggucaccccga

SEQ ID NO: 869478 - RNA, 16 nt, Mycobacterium avium subsp. paratuberculosis
caccacggucagggcc

SEQ ID NO: 869479 - RNA, 17 nt, Mycobacterium avium subsp. paratuberculosis
caccacgguccccgcgc

SEQ ID NO: 869480 - RNA, 23 nt, Mycobacterium avium subsp. paratuberculosis
caccacgguccccgcgcccgccg

SEQ ID NO: 869481 - RNA, 20 nt, Mycobacterium avium subsp. paratuberculosis
caccacggugaacgggccgc

SEQ ID NO: 869482 - RNA, 19 nt, Mycobacterium avium subsp. paratuberculosis
caccacggugaucucgccg

SEQ ID NO: 869483 - RNA, 16 nt, Mycobacterium avium subsp. paratuberculosis
caccacgguggccgcg

SEQ ID NO: 869484 - RNA, 20 nt, Mycobacterium avium subsp. paratuberculosis
caccacguacuccugcgcga

SEQ ID NO: 869485 - RNA, 16 nt, Mycobacterium avium subsp. paratuberculosis
caccacguagccgacc

SEQ ID NO: 869486 - RNA, 13 nt, Mycobacterium avium subsp. paratuberculosis
caccacguaggcg

SEQ ID NO: 869487 - RNA, 17 nt, Mycobacterium avium subsp. paratuberculosis
caccacguaggcgauca

SEQ ID NO: 869488 - RNA, 19 nt, Mycobacterium avium subsp. paratuberculosis
caccacguaggcgaucagc

SEQ ID NO: 869489 - RNA, 23 nt, Mycobacterium avium subsp. paratuberculosis
caccacguaggcgaucagcgcgc

SEQ ID NO: 869490 - RNA, 18 nt, Mycobacterium avium subsp. paratuberculosis
caccacguccaccagcac

SEQ ID NO: 869491 - RNA, 14 nt, Mycobacterium avium subsp. paratuberculosis
caccacguccgcgg

SEQ ID NO: 869492 - RNA, 19 nt, Mycobacterium avium subsp. paratuberculosis
caccaggcgguccgacacc

SEQ ID NO: 869493 - RNA, 16 nt, Mycobacterium avium subsp. paratuberculosis
caccaggcgccgucga

SEQ ID NO: 869494 - RNA, 18 nt, Mycobacterium avium subsp. paratuberculosis
caccaggcgccgucgaug

SEQ ID NO: 869495 - RNA, 14 nt, Mycobacterium avium subsp. paratuberculosis
caccagcucggcgc

SEQ ID NO: 869496 - RNA, 18 nt, Mycobacterium avium subsp. paratuberculosis
caccagcugauucgcggu

SEQ ID NO: 869497 - RNA, 13 nt, Mycobacterium avium subsp. paratuberculosis
caccagcugcgga

SEQ ID NO: 869498 - RNA, 13 nt, Mycobacterium avium subsp. paratuberculosis
caccaggcgccac

SEQ ID NO: 869499 - RNA, 14 nt, Mycobacterium avium subsp. paratuberculosis
caccaggcgccaca

SEQ ID NO: 869500 - RNA, 18 nt, Mycobacterium avium subsp. paratuberculosis
caccaggcgccacagcag

SEQ ID NO: 869501 - RNA, 21 nt, Mycobacterium avium subsp. paratuberculosis
caccaggcucgcucccgcgcg

SEQ ID NO: 869502 - RNA, 22 nt, Mycobacterium avium subsp. paratuberculosis
caccagggacaugccgagcagc

SEQ ID NO: 869503 - RNA, 18 nt, Mycobacterium avium subsp. paratuberculosis
caccaggcugcucggcgg

SEQ ID NO: 869504 - RNA, 21 nt, Mycobacterium avium subsp. paratuberculosis
caccaggcugcucggcgggcu

SEQ ID NO: 869505 - RNA, 13 nt, Mycobacterium avium subsp. paratuberculosis
caccagggcgucg

SEQ ID NO: 869506 - RNA, 14 nt, Mycobacterium avium subsp. paratuberculosis
caccagggcgucga

SEQ ID NO: 869507 - RNA, 17 nt, Mycobacterium avium subsp. paratuberculosis
caccagggcgucgagcg

SEQ ID NO: 869508 - RNA, 16 nt, Mycobacterium avium subsp. paratuberculosis
caccagggcgaccgcc

SEQ ID NO: 869509 - RNA, 17 nt, Mycobacterium avium subsp. paratuberculosis
caccagggcgaccgccg

SEQ ID NO: 869510 - RNA, 19 nt, Mycobacterium avium subsp. paratuberculosis
caccagggcgaccgccgcg

SEQ ID NO: 869511 - RNA, 13 nt, Mycobacterium avium subsp. paratuberculosis
caccagggccgcg

SEQ ID NO: 869512 - RNA, 14 nt, Mycobacterium avium subsp. paratuberculosis
caccagggccgcga

SEQ ID NO: 869513 - RNA, 16 nt, Mycobacterium avium subsp. paratuberculosis
caccagggccgcgagc

SEQ ID NO: 869514 - RNA, 17 nt, Mycobacterium avium subsp. paratuberculosis
caccagggccgcgagcg

SEQ ID NO: 869515 - RNA, 19 nt, Mycobacterium avium subsp. paratuberculosis
caccaguuucacgucggcg

SEQ ID NO: 869516 - RNA, 20 nt, Mycobacterium avium subsp. paratuberculosis
caccaguuucacgucggcga

SEQ ID NO: 869517 - RNA, 21 nt, Mycobacterium avium subsp. paratuberculosis
caccaguuucacgucggcgau

SEQ ID NO: 869518 - RNA, 19 nt, Mycobacterium avium subsp. paratuberculosis
caccagguccuugaucggg

SEQ ID NO: 869519 - RNA, 22 nt, Mycobacterium avium subsp. paratuberculosis
caccaggucgagguccucggcg

SEQ ID NO: 869520 - RNA, 23 nt, Mycobacterium avium subsp. paratuberculosis
caccaggucgagguccucggcga

SEQ ID NO: 869521 - RNA, 17 nt, Mycobacterium avium subsp. paratuberculosis
caccaguguccgggcgc

SEQ ID NO: 869522 - RNA, 18 nt, Mycobacterium avium subsp. paratuberculosis
caccaguguccgggcgcc

SEQ ID NO: 869523 - RNA, 21 nt, Mycobacterium avium subsp. paratuberculosis
caccaguguccgggcgcccag

SEQ ID NO: 869524 - RNA, 22 nt, Mycobacterium avium subsp. paratuberculosis
caccaguuccugcaugccgggc

SEQ ID NO: 869525 - RNA, 20 nt, Mycobacterium avium subsp. paratuberculosis
caccaguucgcguacccgcg

SEQ ID NO: 869526 - RNA, 18 nt, Mycobacterium avium subsp. paratuberculosis
caccaguugcaccggcac

SEQ ID NO: 869527 - RNA, 19 nt, Mycobacterium avium subsp. paratuberculosis
caccagggugucgaugacg

SEQ ID NO: 869528 - RNA, 14 nt, Mycobacterium avium subsp. paratuberculosis
caccagguaggcgg

SEQ ID NO: 869529 - RNA, 20 nt, Mycobacterium avium subsp. paratuberculosis
caccagguagguggccgucg

SEQ ID NO: 869530 - RNA, 14 nt, Mycobacterium avium subsp. paratuberculosis
caccaggguggccg

SEQ ID NO: 869531 - RNA, 16 nt, Mycobacterium avium subsp. paratuberculosis
caccaggguggccgcc

SEQ ID NO: 869532 - RNA, 20 nt, Mycobacterium avium subsp. paratuberculosis
caccaggguggccgccacca

SEQ ID NO: 869533 - RNA, 16 nt, Mycobacterium avium subsp. paratuberculosis
caccagggugcgcacg

SEQ ID NO: 869534 - RNA, 17 nt, Mycobacterium avium subsp. paratuberculosis
caccagggugcgcagcg

SEQ ID NO: 869535 - RNA, 19 nt, Mycobacterium avium subsp. paratuberculosis
caccagggugcgcagcgcg

SEQ ID NO: 869536 - RNA, 15 nt, Mycobacterium avium subsp. paratuberculosis
caccagggugccgcc

SEQ ID NO: 869537 - RNA, 20 nt, Mycobacterium avium subsp. paratuberculosis
caccagggugccgccgggca

SEQ ID NO: 869538 - RNA, 21 nt, Mycobacterium avium subsp. paratuberculosis
caccagggugccgccgggcac

SEQ ID NO: 869539 - RNA, 22 nt, Mycobacterium avium subsp. paratuberculosis
caccagggcguguugcaggcgg

SEQ ID NO: 869540 - RNA, 21 nt, Mycobacterium avium subsp. paratuberculosis
caccagggucuucagcccgcg

SEQ ID NO: 869541 - RNA, 17 nt, Mycobacterium avium subsp. paratuberculosis
caccagggugacggagu

SEQ ID NO: 869542 - RNA, 17 nt, Mycobacterium avium subsp. paratuberculosis
caccagggugccccgcg

SEQ ID NO: 869543 - RNA, 14 nt, Mycobacterium avium subsp. paratuberculosis
caccagggugccgc

SEQ ID NO: 869544 - RNA, 20 nt, Mycobacterium avium subsp. paratuberculosis
cacccgacuucggcucggcg

SEQ ID NO: 869545 - RNA, 21 nt, Mycobacterium avium subsp. paratuberculosis
cacccgacuucggcucggcga

SEQ ID NO: 869546 - RNA, 22 nt, Mycobacterium avium subsp. paratuberculosis
cacccgacuucggcucggcgac

SEQ ID NO: 869547 - RNA, 15 nt, Mycobacterium avium subsp. paratuberculosis
cacccgacacgccga

SEQ ID NO: 869548 - RNA, 16 nt, Mycobacterium avium subsp. paratuberculosis
cacccgaccgacgccc

SEQ ID NO: 869549 - RNA, 17 nt, Mycobacterium avium subsp. paratuberculosis
cacccgaccgacgcccg

SEQ ID NO: 869550 - RNA, 19 nt, Mycobacterium avium subsp. paratuberculosis
cacccgaccgacgcccggc

SEQ ID NO: 869551 - RNA, 18 nt, Mycobacterium avium subsp. paratuberculosis
cacccgacgaaaucgucg

SEQ ID NO: 869552 - RNA, 19 nt, Mycobacterium avium subsp. paratuberculosis
cacccgacgaagccgccgc

SEQ ID NO: 869553 - RNA, 12 nt, Mycobacterium avium subsp. paratuberculosis
cacccgacgucg

SEQ ID NO: 869554 - RNA, 13 nt, Mycobacterium avium subsp. paratuberculosis
cacccgacgucga

SEQ ID NO: 869555 - RNA, 15 nt, Mycobacterium avium subsp. paratuberculosis
cacccgacgucgacg

SEQ ID NO: 869556 - RNA, 17 nt, Mycobacterium avium subsp. paratuberculosis
cacccgacgucgacgcg

SEQ ID NO: 869557 - RNA, 19 nt, Mycobacterium avium subsp. paratuberculosis
cacccgauccacggcgacc

SEQ ID NO: 869558 - RNA, 20 nt, Mycobacterium avium subsp. paratuberculosis
cacccgauccacggcgaccc

SEQ ID NO: 869559 - RNA, 18 nt, Mycobacterium avium subsp. paratuberculosis
cacccgaugcucgaugcg

SEQ ID NO: 869560 - RNA, 19 nt, Mycobacterium avium subsp. paratuberculosis
cacccgcaacaccacgucg

SEQ ID NO: 869561 - RNA, 20 nt, Mycobacterium avium subsp. paratuberculosis
cacccgcaacaccacgucgg

SEQ ID NO: 869562 - RNA, 23 nt, Mycobacterium avium subsp. paratuberculosis
cacccgcaacgcgcgcgacggcg

SEQ ID NO: 869563 - RNA, 17 nt, Mycobacterium avium subsp. paratuberculosis
cacccgcaccucgcccg

SEQ ID NO: 869564 - RNA, 21 nt, Mycobacterium avium subsp. paratuberculosis
cacccgcaccucgcccggcuc

SEQ ID NO: 869565 - RNA, 23 nt, Mycobacterium avium subsp. paratuberculosis
cacccgcaccucgcccggcucga

SEQ ID NO: 869566 - RNA, 17 nt, Mycobacterium avium subsp. paratuberculosis
cacccgcacgcccgggc

SEQ ID NO: 869567 - RNA, 16 nt, Mycobacterium avium subsp. paratuberculosis
cacccgaugaccggcc

SEQ ID NO: 869568 - RNA, 18 nt, Mycobacterium avium subsp. paratuberculosis
cacccgaugaccggcccg

SEQ ID NO: 869569 - RNA, 14 nt, Mycobacterium avium subsp. paratuberculosis
cacccgcagcgacc

SEQ ID NO: 869570 - RNA, 17 nt, Mycobacterium avium subsp. paratuberculosis
cacccgcagcgaccgcg

SEQ ID NO: 869571 - RNA, 13 nt, Mycobacterium avium subsp. paratuberculosis
cacccgcagcgcg

SEQ ID NO: 869572 - RNA, 20 nt, Mycobacterium avium subsp. paratuberculosis
cacccgcagccgcgagucga

SEQ ID NO: 869573 - RNA, 17 nt, Mycobacterium avium subsp. paratuberculosis
cacccgcagcuccagcg

SEQ ID NO: 869574 - RNA, 17 nt, Mycobacterium avium subsp. paratuberculosis
cacccgcagcucgccga

SEQ ID NO: 869575 - RNA, 20 nt, Mycobacterium avium subsp. paratuberculosis
cacccgcagcucgccgagcg

SEQ ID NO: 869576 - RNA, 13 nt, Mycobacterium avium subsp. paratuberculosis
cacccgcggcgcg

SEQ ID NO: 869577 - RNA, 14 nt, Mycobacterium avium subsp. paratuberculosis
cacccgcggcgcga

SEQ ID NO: 869578 - RNA, 17 nt, Mycobacterium avium subsp. paratuberculosis
cacccgcgggucgucgg

SEQ ID NO: 869579 - RNA, 18 nt, Mycobacterium avium subsp. paratuberculosis
cacccgcgcggugcccgg

SEQ ID NO: 869580 - RNA, 22 nt, Mycobacterium avium subsp. paratuberculosis
cacccgcggccgcugcgcccag

SEQ ID NO: 869581 - RNA, 14 nt, Mycobacterium avium subsp. paratuberculosis
cacccgcggccggc

SEQ ID NO: 869582 - RNA, 17 nt, Mycobacterium avium subsp. paratuberculosis
cacccgcggccggccca

SEQ ID NO: 869583 - RNA, 13 nt, Mycobacterium avium subsp. paratuberculosis
cacccgcgaucgg

SEQ ID NO: 869584 - RNA, 16 nt, Mycobacterium avium subsp. paratuberculosis
cacccgcgcacgcucg

SEQ ID NO: 869585 - RNA, 17 nt, Mycobacterium avium subsp. paratuberculosis
cacccgcgcacgcucgc

SEQ ID NO: 869586 - RNA, 18 nt, Mycobacterium avium subsp. paratuberculosis
cacccgcgcacgcucgcg

SEQ ID NO: 869587 - RNA, 14 nt, Mycobacterium avium subsp. paratuberculosis
cacccgcgcccgca

SEQ ID NO: 869588 - RNA, 15 nt, Mycobacterium avium subsp. paratuberculosis
cacccgccccgccgc

SEQ ID NO: 869589 - RNA, 16 nt, Mycobacterium avium subsp. paratuberculosis
cacccgccccgccgcg

SEQ ID NO: 869590 - RNA, 13 nt, Mycobacterium avium subsp. paratuberculosis
cacccgcccggac

SEQ ID NO: 869591 - RNA, 15 nt, Mycobacterium avium subsp. paratuberculosis
cacccgcccggacgc

SEQ ID NO: 869592 - RNA, 17 nt, Mycobacterium avium subsp. paratuberculosis
cacccgcagggcgccgg

SEQ ID NO: 869593 - RNA, 20 nt, Mycobacterium avium subsp. paratuberculosis
caccauggcuuccgccgaga

SEQ ID NO: 869594 - RNA, 16 nt, Mycobacterium avium subsp. paratuberculosis
caccaugggcgggacg

SEQ ID NO: 869595 - RNA, 21 nt, Mycobacterium avium subsp. paratuberculosis
caccaugucggcgucgccgag

SEQ ID NO: 869596 - RNA, 22 nt, Mycobacterium avium subsp. paratuberculosis
caccaugucguugacgcugggc

SEQ ID NO: 869597 - RNA, 15 nt, Mycobacterium avium subsp. paratuberculosis
caccaucacgucgcg

SEQ ID NO: 869598 - RNA, 11 nt, Mycobacterium avium subsp. paratuberculosis
caccaugccgg

SEQ ID NO: 869599 - RNA, 16 nt, Mycobacterium avium subsp. paratuberculosis
caccaugccggcgucc

SEQ ID NO: 869600 - RNA, 22 nt, Mycobacterium avium subsp. paratuberculosis
caccaugccggcguccaguucg

SEQ ID NO: 869601 - RNA, 16 nt, Mycobacterium avium subsp. paratuberculosis
caccaucagcaccgcc

SEQ ID NO: 869602 - RNA, 17 nt, Mycobacterium avium subsp. paratuberculosis
caccccugccgccaccg

SEQ ID NO: 869603 - RNA, 23 nt, Mycobacterium avium subsp. paratuberculosis
caccccuggcggguacagccgca

SEQ ID NO: 869604 - RNA, 13 nt, Mycobacterium avium subsp. paratuberculosis
caccccgcgccgg

SEQ ID NO: 869605 - RNA, 16 nt, Mycobacterium avium subsp. paratuberculosis
caccccgcgccgggcg

SEQ ID NO: 869606 - RNA, 21 nt, Mycobacterium avium subsp. paratuberculosis
caccccguugccgccggcgcc

SEQ ID NO: 869607 - RNA, 15 nt, Mycobacterium avium subsp. paratuberculosis
caccccgcccagcgc

SEQ ID NO: 869608 - RNA, 17 nt, Mycobacterium avium subsp. paratuberculosis
caccccgaucgcgauca

SEQ ID NO: 869609 - RNA, 20 nt, Mycobacterium avium subsp. paratuberculosis
caccccgcagaacaccagcg

SEQ ID NO: 869610 - RNA, 22 nt, Mycobacterium avium subsp. paratuberculosis
caccccgcagaacaccagcgca

SEQ ID NO: 869611 - RNA, 20 nt, Mycobacterium avium subsp. paratuberculosis
caccccgccgcagcccaggc

SEQ ID NO: 869612 - RNA, 13 nt, Mycobacterium avium subsp. paratuberculosis
caccccgcgaguc

SEQ ID NO: 869613 - RNA, 13 nt, Mycobacterium avium subsp. paratuberculosis
caccccgagcucg

SEQ ID NO: 869614 - RNA, 22 nt, Mycobacterium avium subsp. paratuberculosis
caccccgaguucggccagaucg

SEQ ID NO: 869615 - RNA, 20 nt, Mycobacterium avium subsp. paratuberculosis
caccccgaucaacaccgcca

SEQ ID NO: 869616 - RNA, 16 nt, Mycobacterium avium subsp. paratuberculosis
caccccgaacccggcc

SEQ ID NO: 869617 - RNA, 20 nt, Mycobacterium avium subsp. paratuberculosis
caccccgaacccggccagcg

SEQ ID NO: 869618 - RNA, 14 nt, Mycobacterium avium subsp. paratuberculosis
caccccgaccgacg

SEQ ID NO: 869619 - RNA, 23 nt, Mycobacterium avium subsp. paratuberculosis
caccccgaccgacgcggucaccg

SEQ ID NO: 869620 - RNA, 18 nt, Mycobacterium avium subsp. paratuberculosis
cacccaaaaaggcgcggg

SEQ ID NO: 869621 - RNA, 12 nt, Mycobacterium avium subsp. paratuberculosis
cacccccggcgc

SEQ ID NO: 869622 - RNA, 22 nt, Mycobacterium avium subsp. paratuberculosis
cacccccucggcgccgguggug

SEQ ID NO: 869623 - RNA, 17 nt, Mycobacterium avium subsp. paratuberculosis
caccggggucaccuugg

SEQ ID NO: 869624 - RNA, 20 nt, Mycobacterium avium subsp. paratuberculosis
caccggggucaccuuggccg

SEQ ID NO: 869625 - RNA, 22 nt, Mycobacterium avium subsp. paratuberculosis
caccggggucaccuuggccgga

SEQ ID NO: 869626 - RNA, 13 nt, Mycobacterium avium subsp. paratuberculosis
caccggggucugc

SEQ ID NO: 869627 - RNA, 22 nt, Mycobacterium avium subsp. paratuberculosis
caccgggcguggcuugaucgca

SEQ ID NO: 869628 - RNA, 17 nt, Mycobacterium avium subsp. paratuberculosis
caccgggcucggucacc

SEQ ID NO: 869629 - RNA, 14 nt, Mycobacterium avium subsp. paratuberculosis
caccgggcugucgg

SEQ ID NO: 869630 - RNA, 19 nt, Mycobacterium avium subsp. paratuberculosis
caccgggcugucgggcagg

SEQ ID NO: 869631 - RNA, 21 nt, Mycobacterium avium subsp. paratuberculosis
caccggggccaacuccggcgg

SEQ ID NO: 869632 - RNA, 23 nt, Mycobacterium avium subsp. paratuberculosis
caccggggccagguacuccucga

SEQ ID NO: 869633 - RNA, 16 nt, Mycobacterium avium subsp. paratuberculosis
caccggggccggcggg

SEQ ID NO: 869634 - RNA, 17 nt, Mycobacterium avium subsp. paratuberculosis
caccggggccggcgggg

SEQ ID NO: 869635 - RNA, 18 nt, Mycobacterium avium subsp. paratuberculosis
caccggggccggcggggg

SEQ ID NO: 869636 - RNA, 14 nt, Mycobacterium avium subsp. paratuberculosis
caccgggcccgccc

SEQ ID NO: 869637 - RNA, 15 nt, Mycobacterium avium subsp. paratuberculosis
caccgggcccgcccg

SEQ ID NO: 869638 - RNA, 16 nt, Mycobacterium avium subsp. paratuberculosis
caccgggcgucggcgg

SEQ ID NO: 869639 - RNA, 14 nt, Mycobacterium avium subsp. paratuberculosis
caccgggcgucggg

SEQ ID NO: 869640 - RNA, 17 nt, Mycobacterium avium subsp. paratuberculosis
caccggggugccgccca

SEQ ID NO: 869641 - RNA, 18 nt, Mycobacterium avium subsp. paratuberculosis
caccggguacaccggcuc

SEQ ID NO: 869642 - RNA, 19 nt, Mycobacterium avium subsp. paratuberculosis
caccggguacaccggcucg

SEQ ID NO: 869643 - RNA, 20 nt, Mycobacterium avium subsp. paratuberculosis
caccggguacaccggcucgc

SEQ ID NO: 869644 - RNA, 18 nt, Mycobacterium avium subsp. paratuberculosis
caccgggucguccgcgac

SEQ ID NO: 869645 - RNA, 14 nt, Mycobacterium avium subsp. paratuberculosis
caccgggucgucgc

SEQ ID NO: 869646 - RNA, 21 nt, Mycobacterium avium subsp. paratuberculosis
caccgggucgucgcggaaccg

SEQ ID NO: 869647 - RNA, 20 nt, Mycobacterium avium subsp. paratuberculosis
caccgggugauaccggccca

SEQ ID NO: 869648 - RNA, 23 nt, Mycobacterium avium subsp. paratuberculosis
caccgggugauaccggcccagcg

SEQ ID NO: 869649 - RNA, 18 nt, Mycobacterium avium subsp. paratuberculosis
caccgggugaugucgccg

SEQ ID NO: 869650 - RNA, 19 nt, Mycobacterium avium subsp. paratuberculosis
caccgggugaugucgccga

SEQ ID NO: 869651 - RNA, 22 nt, Mycobacterium avium subsp. paratuberculosis
caccgggugaugucgccgacca

SEQ ID NO: 869652 - RNA, 16 nt, Mycobacterium avium subsp. paratuberculosis
caccgggugcguccag

SEQ ID NO: 869653 - RNA, 23 nt, Mycobacterium avium subsp. paratuberculosis
caccgggugcguccagaccggcc

SEQ ID NO: 869654 - RNA, 21 nt, Mycobacterium avium subsp. paratuberculosis
caccgggucccccgccgaccg

SEQ ID NO: 869655 - RNA, 23 nt, Mycobacterium avium subsp. paratuberculosis
caccgggucccccgccgaccggu

SEQ ID NO: 869656 - RNA, 20 nt, Mycobacterium avium subsp. paratuberculosis
caccgggccgaaggcggcgc

SEQ ID NO: 869657 - RNA, 22 nt, Mycobacterium avium subsp. paratuberculosis
caccgggccgaaggcggcgccg

SEQ ID NO: 869658 - RNA, 13 nt, Mycobacterium avium subsp. paratuberculosis
caccgggccgagg

SEQ ID NO: 869659 - RNA, 17 nt, Mycobacterium avium subsp. paratuberculosis
caccgggcagccgcaca

SEQ ID NO: 869660 - RNA, 14 nt, Mycobacterium avium subsp. paratuberculosis
caccggcgccaggu

SEQ ID NO: 869661 - RNA, 14 nt, Mycobacterium avium subsp. paratuberculosis
caccggcgccccgg

SEQ ID NO: 869662 - RNA, 15 nt, Mycobacterium avium subsp. paratuberculosis
caccggcgccccggg

SEQ ID NO: 869663 - RNA, 16 nt, Mycobacterium avium subsp. paratuberculosis
caccggcgccgccacc

SEQ ID NO: 869664 - RNA, 12 nt, Mycobacterium avium subsp. paratuberculosis
caccggcgccgc

SEQ ID NO: 869665 - RNA, 12 nt, Mycobacterium avium subsp. paratuberculosis
caccggcgccuc

SEQ ID NO: 869666 - RNA, 15 nt, Mycobacterium avium subsp. paratuberculosis
caccgggcaccgaca

SEQ ID NO: 869667 - RNA, 17 nt, Mycobacterium avium subsp. paratuberculosis
caccggcgaguccgcgg

SEQ ID NO: 869668 - RNA, 23 nt, Mycobacterium avium subsp. paratuberculosis
caccggcgaguccgcggaggcga

SEQ ID NO: 869669 - RNA, 15 nt, Mycobacterium avium subsp. paratuberculosis
caccggcgaugcaga

SEQ ID NO: 869670 - RNA, 16 nt, Mycobacterium avium subsp. paratuberculosis
caccggcgcagcgcgu

SEQ ID NO: 869671 - RNA, 14 nt, Mycobacterium avium subsp. paratuberculosis
caccggccuucacc

SEQ ID NO: 869672 - RNA, 14 nt, Mycobacterium avium subsp. paratuberculosis
caccggccggcccc

SEQ ID NO: 869673 - RNA, 15 nt, Mycobacterium avium subsp. paratuberculosis
caccgucagccaggu

SEQ ID NO: 869674 - RNA, 17 nt, Mycobacterium avium subsp. paratuberculosis
caccgucagcgucagca

SEQ ID NO: 869675 - RNA, 14 nt, Mycobacterium avium subsp. paratuberculosis
caccgucaggguga

SEQ ID NO: 869676 - RNA, 22 nt, Mycobacterium avium subsp. paratuberculosis
caccgucagggugacguggcgg

SEQ ID NO: 869677 - RNA, 16 nt, Mycobacterium avium subsp. paratuberculosis
caccgucccggugucg

SEQ ID NO: 869678 - RNA, 18 nt, Mycobacterium avium subsp. paratuberculosis
caccguccacagccggcg

SEQ ID NO: 869679 - RNA, 20 nt, Mycobacterium avium subsp. paratuberculosis
caccguccacagccggcggc

SEQ ID NO: 869680 - RNA, 21 nt, Mycobacterium avium subsp. paratuberculosis
caccgucaucgugugggcgcc

SEQ ID NO: 869681 - RNA, 13 nt, Mycobacterium avium subsp. paratuberculosis
caccgucgccacg

SEQ ID NO: 869682 - RNA, 22 nt, Mycobacterium avium subsp. paratuberculosis
caccgucgauggacagggcgac

SEQ ID NO: 869683 - RNA, 13 nt, Mycobacterium avium subsp. paratuberculosis
caccgucugcugg

SEQ ID NO: 869684 - RNA, 19 nt, Mycobacterium avium subsp. paratuberculosis
caccgucuuggucucgccg

SEQ ID NO: 869685 - RNA, 21 nt, Mycobacterium avium subsp. paratuberculosis
caccgucuuggucucgccgau

SEQ ID NO: 869686 - RNA, 22 nt, Mycobacterium avium subsp. paratuberculosis
caccgucuuggucucgccgauc

SEQ ID NO: 869687 - RNA, 19 nt, Mycobacterium avium subsp. paratuberculosis
caccgucuucggggccgcc

SEQ ID NO: 869688 - RNA, 20 nt, Mycobacterium avium subsp. paratuberculosis
caccgucuucggggccgccg

SEQ ID NO: 869689 - RNA, 23 nt, Mycobacterium avium subsp. paratuberculosis
caccgucuucggggccgccgucg

SEQ ID NO: 869690 - RNA, 22 nt, Mycobacterium avium subsp. paratuberculosis
caccguccuuguaggugaucgu

SEQ ID NO: 869691 - RNA, 22 nt, Mycobacterium avium subsp. paratuberculosis
caccgugucgucgcugacgccg

SEQ ID NO: 869692 - RNA, 22 nt, Mycobacterium avium subsp. paratuberculosis
caccgugugacgaugcugagca

SEQ ID NO: 869693 - RNA, 17 nt, Mycobacterium avium subsp. paratuberculosis
caccguguucaccagcg

SEQ ID NO: 869694 - RNA, 20 nt, Mycobacterium avium subsp. paratuberculosis
caccguguucaccagcgggg

SEQ ID NO: 869695 - RNA, 22 nt, Mycobacterium avium subsp. paratuberculosis
caccguguugaucucgucgaug

SEQ ID NO: 869696 - RNA, 20 nt, Mycobacterium avium subsp. paratuberculosis
caccguggucggcagcaccg

SEQ ID NO: 869697 - RNA, 23 nt, Mycobacterium avium subsp. paratuberculosis
caccguggucggcagcaccggca

SEQ ID NO: 869698 - RNA, 16 nt, Mycobacterium avium subsp. paratuberculosis
caccguggugacccgg

SEQ ID NO: 869699 - RNA, 17 nt, Mycobacterium avium subsp. paratuberculosis
caccgugguggcggcga

SEQ ID NO: 869700 - RNA, 16 nt, Mycobacterium avium subsp. paratuberculosis
caccguggugugcccg

SEQ ID NO: 869701 - RNA, 20 nt, Mycobacterium avium subsp. paratuberculosis
caccguggugugcccgcggg

SEQ ID NO: 869702 - RNA, 23 nt, Mycobacterium avium subsp. paratuberculosis
caccguggugugcccgcgggcca

SEQ ID NO: 869703 - RNA, 14 nt, Mycobacterium avium subsp. paratuberculosis
caccgugucggcgg

SEQ ID NO: 869704 - RNA, 18 nt, Mycobacterium avium subsp. paratuberculosis
caccgugcccgagccgau

SEQ ID NO: 869705 - RNA, 13 nt, Mycobacterium avium subsp. paratuberculosis
caccgugccgccc

SEQ ID NO: 869706 - RNA, 19 nt, Mycobacterium avium subsp. paratuberculosis
caccgugccgcccgucgcc

SEQ ID NO: 869707 - RNA, 12 nt, Mycobacterium avium subsp. paratuberculosis
caccgugccgcg

SEQ ID NO: 869708 - RNA, 21 nt, Mycobacterium avium subsp. paratuberculosis
caccgugccgcgcggcgguga

SEQ ID NO: 869709 - RNA, 14 nt, Mycobacterium avium subsp. paratuberculosis
caccgugccgucac

SEQ ID NO: 869710 - RNA, 19 nt, Mycobacterium avium subsp. paratuberculosis
caccgugccgucacgcccg

SEQ ID NO: 869711 - RNA, 18 nt, Mycobacterium avium subsp. paratuberculosis
caccgugccgucgcgggc

SEQ ID NO: 869712 - RNA, 22 nt, Mycobacterium avium subsp. paratuberculosis
caccgugccgucgcgggcgucg

SEQ ID NO: 869713 - RNA, 20 nt, Mycobacterium avium subsp. paratuberculosis
caccgugccgucggcgucga

SEQ ID NO: 869714 - RNA, 19 nt, Mycobacterium avium subsp. paratuberculosis
caccgugccuuacgccggg

SEQ ID NO: 869715 - RNA, 18 nt, Mycobacterium avium subsp. paratuberculosis
caccgugaucgccaccac

SEQ ID NO: 869716 - RNA, 15 nt, Mycobacterium avium subsp. paratuberculosis
caccgcgacacgucg

SEQ ID NO: 869717 - RNA, 18 nt, Mycobacterium avium subsp. paratuberculosis
caccgcgaccagcucggg

SEQ ID NO: 869718 - RNA, 19 nt, Mycobacterium avium subsp. paratuberculosis
caccgcgaacucgucgaug

SEQ ID NO: 869719 - RNA, 23 nt, Mycobacterium avium subsp. paratuberculosis
caccgcgaacagcacguaggucc

SEQ ID NO: 869720 - RNA, 19 nt, Mycobacterium avium subsp. paratuberculosis
caccgcgaacaucgccagc

SEQ ID NO: 869721 - RNA, 20 nt, Mycobacterium avium subsp. paratuberculosis
caccgcgaacaucgccagca

SEQ ID NO: 869722 - RNA, 22 nt, Mycobacterium avium subsp. paratuberculosis
caccgcgaacgagacgaagucc

SEQ ID NO: 869723 - RNA, 16 nt, Mycobacterium avium subsp. paratuberculosis
caccgcgacccaggcc

SEQ ID NO: 869724 - RNA, 15 nt, Mycobacterium avium subsp. paratuberculosis
caccgcgaccaugcc

SEQ ID NO: 869725 - RNA, 19 nt, Mycobacterium avium subsp. paratuberculosis
caccgcgaccaugcccggc

SEQ ID NO: 869726 - RNA, 15 nt, Mycobacterium avium subsp. paratuberculosis
caccgcgacgaucgc

SEQ ID NO: 869727 - RNA, 16 nt, Mycobacterium avium subsp. paratuberculosis
caccgcgacgaucgcg

SEQ ID NO: 869728 - RNA, 20 nt, Mycobacterium avium subsp. paratuberculosis
caccgcgacgaucgcgacgg

SEQ ID NO: 869729 - RNA, 18 nt, Mycobacterium avium subsp. paratuberculosis
caccgcgguguugagcgc

SEQ ID NO: 869730 - RNA, 21 nt, Mycobacterium avium subsp. paratuberculosis
caccgcgguugcccucgguca

SEQ ID NO: 869731 - RNA, 15 nt, Mycobacterium avium subsp. paratuberculosis
caccgcgucggccca

SEQ ID NO: 869732 - RNA, 20 nt, Mycobacterium avium subsp. paratuberculosis
caccgcguugaucagcgcca

SEQ ID NO: 869733 - RNA, 22 nt, Mycobacterium avium subsp. paratuberculosis
caccgcguugaucagcgccagg

SEQ ID NO: 869734 - RNA, 23 nt, Mycobacterium avium subsp. paratuberculosis
caccgcguccuucuccgccgggc

SEQ ID NO: 869735 - RNA, 15 nt, Mycobacterium avium subsp. paratuberculosis
caccgcgucgaccac

SEQ ID NO: 869736 - RNA, 17 nt, Mycobacterium avium subsp. paratuberculosis
caccgcgucgaccaccg

SEQ ID NO: 869737 - RNA, 20 nt, Mycobacterium avium subsp. paratuberculosis
caccgcgucgaccaccgccg

SEQ ID NO: 869738 - RNA, 13 nt, Mycobacterium avium subsp. paratuberculosis
caccgcgucgaug

SEQ ID NO: 869739 - RNA, 15 nt, Mycobacterium avium subsp. paratuberculosis
caccgcgucgaugcg

SEQ ID NO: 869740 - RNA, 22 nt, Mycobacterium avium subsp. paratuberculosis
caccgcgucgaugcgggcccgc

SEQ ID NO: 869741 - RNA, 16 nt, Mycobacterium avium subsp. paratuberculosis
caccgcgucgaugucg

SEQ ID NO: 869742 - RNA, 13 nt, Mycobacterium avium subsp. paratuberculosis
caccgcgucggcc

SEQ ID NO: 869743 - RNA, 15 nt, Mycobacterium avium subsp. paratuberculosis
caccgcgucagcagc

SEQ ID NO: 869744 - RNA, 20 nt, Mycobacterium avium subsp. paratuberculosis
caccgcgucagcagcgcgac

SEQ ID NO: 869745 - RNA, 14 nt, Mycobacterium avium subsp. paratuberculosis
caccgcguagaacu

SEQ ID NO: 869746 - RNA, 22 nt, Mycobacterium avium subsp. paratuberculosis
caccgcugagguagucccgcgc

SEQ ID NO: 869747 - RNA, 14 nt, Mycobacterium avium subsp. paratuberculosis
caccgcugaugccg

SEQ ID NO: 869748 - RNA, 16 nt, Mycobacterium avium subsp. paratuberculosis
caccgcugaugccgcc

SEQ ID NO: 869749 - RNA, 18 nt, Mycobacterium avium subsp. paratuberculosis
caccgcugaugccgccga

SEQ ID NO: 869750 - RNA, 19 nt, Mycobacterium avium subsp. paratuberculosis
caccgcugaugccgccgaa

SEQ ID NO: 869751 - RNA, 22 nt, Mycobacterium avium subsp. paratuberculosis
caccgcugaugccgccgaagcg

SEQ ID NO: 869752 - RNA, 15 nt, Mycobacterium avium subsp. paratuberculosis
caccgcugccacggu

SEQ ID NO: 869753 - RNA, 20 nt, Mycobacterium avium subsp. paratuberculosis
caccgcguuggccgccacga

SEQ ID NO: 869754 - RNA, 21 nt, Mycobacterium avium subsp. paratuberculosis
caccgcguuggccgccacgau

SEQ ID NO: 869755 - RNA, 19 nt, Mycobacterium avium subsp. paratuberculosis
caccgcguugucggcgacg

SEQ ID NO: 869756 - RNA, 15 nt, Mycobacterium avium subsp. paratuberculosis
caccgcgugcgagcc

SEQ ID NO: 869757 - RNA, 13 nt, Mycobacterium avium subsp. paratuberculosis
caccgcugccggc

SEQ ID NO: 869758 - RNA, 15 nt, Mycobacterium avium subsp. paratuberculosis
caccgcuggaaccga

SEQ ID NO: 869759 - RNA, 20 nt, Mycobacterium avium subsp. paratuberculosis
caccgcuggccgaggccucc

SEQ ID NO: 869760 - RNA, 16 nt, Mycobacterium avium subsp. paratuberculosis
caccgcugggcggcgc

SEQ ID NO: 869761 - RNA, 17 nt, Mycobacterium avium subsp. paratuberculosis
caccgcugggcggcgcg

SEQ ID NO: 869762 - RNA, 18 nt, Mycobacterium avium subsp. paratuberculosis
caccgcugggcggcgcgg

SEQ ID NO: 869763 - RNA, 19 nt, Mycobacterium avium subsp. paratuberculosis
caccgcugggcggcgcggc

SEQ ID NO: 869764 - RNA, 12 nt, Mycobacterium avium subsp. paratuberculosis
caccgcugucgg

SEQ ID NO: 869765 - RNA, 17 nt, Mycobacterium avium subsp. paratuberculosis
caccgcugucgguguga

SEQ ID NO: 869766 - RNA, 17 nt, Mycobacterium avium subsp. paratuberculosis
caccgcuguggacaggu

SEQ ID NO: 869767 - RNA, 20 nt, Mycobacterium avium subsp. paratuberculosis
caccgcuguggacaggucga

SEQ ID NO: 869768 - RNA, 17 nt, Mycobacterium avium subsp. paratuberculosis
caccggcagcagcgcgu

SEQ ID NO: 869769 - RNA, 19 nt, Mycobacterium avium subsp. paratuberculosis
caccggcagugaucggcgg

SEQ ID NO: 869770 - RNA, 20 nt, Mycobacterium avium subsp. paratuberculosis
caccggcagugaucggcgga

SEQ ID NO: 869771 - RNA, 16 nt, Mycobacterium avium subsp. paratuberculosis
caccggcaucgguggc

SEQ ID NO: 869772 - RNA, 13 nt, Mycobacterium avium subsp. paratuberculosis
caccggccacucg

SEQ ID NO: 869773 - RNA, 18 nt, Mycobacterium avium subsp. paratuberculosis
caccggccacucgcgucc

SEQ ID NO: 869774 - RNA, 17 nt, Mycobacterium avium subsp. paratuberculosis
caccggccagggccgcc

SEQ ID NO: 869775 - RNA, 18 nt, Mycobacterium avium subsp. paratuberculosis
caccggccagggccgccg

SEQ ID NO: 869776 - RNA, 20 nt, Mycobacterium avium subsp. paratuberculosis
caccggccagggccgccgca

SEQ ID NO: 869777 - RNA, 14 nt, Mycobacterium avium subsp. paratuberculosis
caccggccgggacg

SEQ ID NO: 869778 - RNA, 15 nt, Mycobacterium avium subsp. paratuberculosis
caccggccgguccgc

SEQ ID NO: 869779 - RNA, 17 nt, Mycobacterium avium subsp. paratuberculosis
caccggccgguccgccc

SEQ ID NO: 869780 - RNA, 13 nt, Mycobacterium avium subsp. paratuberculosis
caccggccgcgcg

SEQ ID NO: 869781 - RNA, 18 nt, Mycobacterium avium subsp. paratuberculosis
caccggccgagccgaugc

SEQ ID NO: 869782 - RNA, 22 nt, Mycobacterium avium subsp. paratuberculosis
caccggccgagccgaugcccag

SEQ ID NO: 869783 - RNA, 18 nt, Mycobacterium avium subsp. paratuberculosis
caccggccgauggcccag

SEQ ID NO: 869784 - RNA, 18 nt, Mycobacterium avium subsp. paratuberculosis
caccggccgcccggcgag

SEQ ID NO: 869785 - RNA, 14 nt, Mycobacterium avium subsp. paratuberculosis
caccggcccagccg

SEQ ID NO: 869786 - RNA, 17 nt, Mycobacterium avium subsp. paratuberculosis
caccggcccagccggcg

SEQ ID NO: 869787 - RNA, 19 nt, Mycobacterium avium subsp. paratuberculosis
caccggcccagccggcggu

SEQ ID NO: 869788 - RNA, 18 nt, Mycobacterium avium subsp. paratuberculosis
caccggcaugugccacag

SEQ ID NO: 869789 - RNA, 14 nt, Mycobacterium avium subsp. paratuberculosis
caccggcccggccg

SEQ ID NO: 869790 - RNA, 15 nt, Mycobacterium avium subsp. paratuberculosis
caccggcccggccgg

SEQ ID NO: 869791 - RNA, 17 nt, Mycobacterium avium subsp. paratuberculosis
caccggcccggccggcg

SEQ ID NO: 869792 - RNA, 21 nt, Mycobacterium avium subsp. paratuberculosis
caccggcaaucgggacgccac

SEQ ID NO: 869793 - RNA, 13 nt, Mycobacterium avium subsp. paratuberculosis
caccggcaccacg

SEQ ID NO: 869794 - RNA, 14 nt, Mycobacterium avium subsp. paratuberculosis
caccggcaccacga

SEQ ID NO: 869795 - RNA, 20 nt, Mycobacterium avium subsp. paratuberculosis
caccggcaaggugccguccg

SEQ ID NO: 869796 - RNA, 13 nt, Mycobacterium avium subsp. paratuberculosis
caccggcaaccgc

SEQ ID NO: 869797 - RNA, 17 nt, Mycobacterium avium subsp. paratuberculosis
caccggcaaccgccacg

SEQ ID NO: 869798 - RNA, 18 nt, Mycobacterium avium subsp. paratuberculosis
caccggcaaccgccacga

SEQ ID NO: 869799 - RNA, 21 nt, Mycobacterium avium subsp. paratuberculosis
caccggcaaccgccacgacgc

SEQ ID NO: 869800 - RNA, 17 nt, Mycobacterium avium subsp. paratuberculosis
caccggaugcaccggca

SEQ ID NO: 869801 - RNA, 20 nt, Mycobacterium avium subsp. paratuberculosis
caccggaugcucaccgguca

SEQ ID NO: 869802 - RNA, 18 nt, Mycobacterium avium subsp. paratuberculosis
caccggauggcgcccggc

SEQ ID NO: 869803 - RNA, 21 nt, Mycobacterium avium subsp. paratuberculosis
caccggauggcgcccggcagc

SEQ ID NO: 869804 - RNA, 23 nt, Mycobacterium avium subsp. paratuberculosis
caccggauggcgcccggcagccg

SEQ ID NO: 869805 - RNA, 18 nt, Mycobacterium avium subsp. paratuberculosis
caccggcacgaucgucgc

SEQ ID NO: 869806 - RNA, 13 nt, Mycobacterium avium subsp. paratuberculosis
caccggcacgucg

SEQ ID NO: 869807 - RNA, 16 nt, Mycobacterium avium subsp. paratuberculosis
caccggcagccgcagc

SEQ ID NO: 869808 - RNA, 17 nt, Mycobacterium avium subsp. paratuberculosis
caccggcagccgcagcg

SEQ ID NO: 869809 - RNA, 13 nt, Mycobacterium avium subsp. paratuberculosis
caccggcagcgcc

SEQ ID NO: 869810 - RNA, 14 nt, Mycobacterium avium subsp. paratuberculosis
caccggcagcgcca

SEQ ID NO: 869811 - RNA, 17 nt, Mycobacterium avium subsp. paratuberculosis
caccggcagcgccacca

SEQ ID NO: 869812 - RNA, 14 nt, Mycobacterium avium subsp. paratuberculosis
caccggcacgucgg

SEQ ID NO: 869813 - RNA, 16 nt, Mycobacterium avium subsp. paratuberculosis
caccggcacgucggcc

SEQ ID NO: 869814 - RNA, 20 nt, Mycobacterium avium subsp. paratuberculosis
caccggcacgucggccacgc

SEQ ID NO: 869815 - RNA, 15 nt, Mycobacterium avium subsp. paratuberculosis
caccggcagcaccgc

SEQ ID NO: 869816 - RNA, 17 nt, Mycobacterium avium subsp. paratuberculosis
caccggcagcaccgccg

SEQ ID NO: 869817 - RNA, 19 nt, Mycobacterium avium subsp. paratuberculosis
caccggcagcaccgccgag

SEQ ID NO: 869818 - RNA, 21 nt, Mycobacterium avium subsp. paratuberculosis
caccggcagcaccgccgagcc

SEQ ID NO: 869819 - RNA, 14 nt, Mycobacterium avium subsp. paratuberculosis
caccggcagcagcg

SEQ ID NO: 869820 - RNA, 16 nt, Mycobacterium avium subsp. paratuberculosis
caccggcacggcaccg

SEQ ID NO: 869821 - RNA, 18 nt, Mycobacterium avium subsp. paratuberculosis
caccggcacggcaccgcg

SEQ ID NO: 869822 - RNA, 19 nt, Mycobacterium avium subsp. paratuberculosis
caccggcacggcaccgcga

SEQ ID NO: 869823 - RNA, 14 nt, Mycobacterium avium subsp. paratuberculosis
caccggcaccgcgg

SEQ ID NO: 869824 - RNA, 17 nt, Mycobacterium avium subsp. paratuberculosis
caccggcaccgcggcga

SEQ ID NO: 869825 - RNA, 19 nt, Mycobacterium avium subsp. paratuberculosis
caccggcaccgcggcgaug

SEQ ID NO: 869826 - RNA, 15 nt, Mycobacterium avium subsp. paratuberculosis
caccggcacccccaa

SEQ ID NO: 869827 - RNA, 16 nt, Mycobacterium avium subsp. paratuberculosis
caccggcacccccaau

SEQ ID NO: 869828 - RNA, 18 nt, Mycobacterium avium subsp. paratuberculosis
caccggcaccgcccccgc

SEQ ID NO: 869829 - RNA, 23 nt, Mycobacterium avium subsp. paratuberculosis
caccggcaccgcccccgcggcgg

SEQ ID NO: 869830 - RNA, 16 nt, Mycobacterium avium subsp. paratuberculosis
caccgccuugcccggc

SEQ ID NO: 869831 - RNA, 17 nt, Mycobacterium avium subsp. paratuberculosis
caccgccuugcccggcu

SEQ ID NO: 869832 - RNA, 19 nt, Mycobacterium avium subsp. paratuberculosis
caccgccuugcccggcucg

SEQ ID NO: 869833 - RNA, 20 nt, Mycobacterium avium subsp. paratuberculosis
caccgccuugcccggcucgg

SEQ ID NO: 869834 - RNA, 23 nt, Mycobacterium avium subsp. paratuberculosis
caccgccuugcccggcucggugc

SEQ ID NO: 869835 - RNA, 15 nt, Mycobacterium avium subsp. paratuberculosis
caccgccuuccgcca

SEQ ID NO: 869836 - RNA, 17 nt, Mycobacterium avium subsp. paratuberculosis
caccgccuucgacggcc

SEQ ID NO: 869837 - RNA, 19 nt, Mycobacterium avium subsp. paratuberculosis
caccgccuucgacggccgg

SEQ ID NO: 869838 - RNA, 20 nt, Mycobacterium avium subsp. paratuberculosis
caccgccuucgacggccggc

SEQ ID NO: 869839 - RNA, 13 nt, Mycobacterium avium subsp. paratuberculosis
caccgccgucacc

SEQ ID NO: 869840 - RNA, 19 nt, Mycobacterium avium subsp. paratuberculosis
caccgccgucggggcgucg

SEQ ID NO: 869841 - RNA, 23 nt, Mycobacterium avium subsp. paratuberculosis
caccgccuccucgaugucggugg

SEQ ID NO: 869842 - RNA, 15 nt, Mycobacterium avium subsp. paratuberculosis
caccgccugcgcgau

SEQ ID NO: 869843 - RNA, 12 nt, Mycobacterium avium subsp. paratuberculosis
caccgccgagcc

SEQ ID NO: 869844 - RNA, 19 nt, Mycobacterium avium subsp. paratuberculosis
caccgccgagccgucgucg

SEQ ID NO: 869845 - RNA, 14 nt, Mycobacterium avium subsp. paratuberculosis
caccgccgauggcg

SEQ ID NO: 869846 - RNA, 20 nt, Mycobacterium avium subsp. paratuberculosis
caccgccgauggcgacgguc

SEQ ID NO: 869847 - RNA, 14 nt, Mycobacterium avium subsp. paratuberculosis
caccgccgccagca

SEQ ID NO: 869848 - RNA, 13 nt, Mycobacterium avium subsp. paratuberculosis
caccgccgccgac

SEQ ID NO: 869849 - RNA, 17 nt, Mycobacterium avium subsp. paratuberculosis
caccgccggcgccgucg

SEQ ID NO: 869850 - RNA, 13 nt, Mycobacterium avium subsp. paratuberculosis
caccgccggcgcg

SEQ ID NO: 869851 - RNA, 15 nt, Mycobacterium avium subsp. paratuberculosis
caccgccggcgcgga

SEQ ID NO: 869852 - RNA, 12 nt, Mycobacterium avium subsp. paratuberculosis
caccgccggcgg

SEQ ID NO: 869853 - RNA, 13 nt, Mycobacterium avium subsp. paratuberculosis
caccgccggcggc

SEQ ID NO: 869854 - RNA, 14 nt, Mycobacterium avium subsp. paratuberculosis
caccgccggcggcc

SEQ ID NO: 869855 - RNA, 18 nt, Mycobacterium avium subsp. paratuberculosis
caccgccggcggccuccg

SEQ ID NO: 869856 - RNA, 14 nt, Mycobacterium avium subsp. paratuberculosis
caccgccagcaccg

SEQ ID NO: 869857 - RNA, 16 nt, Mycobacterium avium subsp. paratuberculosis
caccgccagcaccgcc

SEQ ID NO: 869858 - RNA, 13 nt, Mycobacterium avium subsp. paratuberculosis
caccgccacgccg

SEQ ID NO: 869859 - RNA, 15 nt, Mycobacterium avium subsp. paratuberculosis
caccgccgacaucgc

SEQ ID NO: 869860 - RNA, 16 nt, Mycobacterium avium subsp. paratuberculosis
caccgccacgccguug

SEQ ID NO: 869861 - RNA, 14 nt, Mycobacterium avium subsp. paratuberculosis
caccgccacggcga

SEQ ID NO: 869862 - RNA, 16 nt, Mycobacterium avium subsp. paratuberculosis
caccgccacggcgacg

SEQ ID NO: 869863 - RNA, 17 nt, Mycobacterium avium subsp. paratuberculosis
caccgccacggcgacga

SEQ ID NO: 869864 - RNA, 13 nt, Mycobacterium avium subsp. paratuberculosis
caccgcccgcgcg

SEQ ID NO: 869865 - RNA, 14 nt, Mycobacterium avium subsp. paratuberculosis
caccgcccgcgcga

SEQ ID NO: 869866 - RNA, 15 nt, Mycobacterium avium subsp. paratuberculosis
caccgcccgcggugu

SEQ ID NO: 869867 - RNA, 16 nt, Mycobacterium avium subsp. paratuberculosis
caccgcccgcggugug

SEQ ID NO: 869868 - RNA, 14 nt, Mycobacterium avium subsp. paratuberculosis
caccgcccggaccg

SEQ ID NO: 869869 - RNA, 18 nt, Mycobacterium avium subsp. paratuberculosis
caccgcccggaccggcuc

SEQ ID NO: 869870 - RNA, 20 nt, Mycobacterium avium subsp. paratuberculosis
caccgcccggaugccggcgc

SEQ ID NO: 869871 - RNA, 17 nt, Mycobacterium avium subsp. paratuberculosis
caccgcauuugccgaca

SEQ ID NO: 869872 - RNA, 22 nt, Mycobacterium avium subsp. paratuberculosis
caccgcauggggcaguagcgac

SEQ ID NO: 869873 - RNA, 23 nt, Mycobacterium avium subsp. paratuberculosis
caccgcauggggcaguagcgacg

SEQ ID NO: 869874 - RNA, 18 nt, Mycobacterium avium subsp. paratuberculosis
caccgccaccagcaggcc

SEQ ID NO: 869875 - RNA, 20 nt, Mycobacterium avium subsp. paratuberculosis
caccgccaccagcaggccca

SEQ ID NO: 869876 - RNA, 16 nt, Mycobacterium avium subsp. paratuberculosis
caccgccaccagcgca

SEQ ID NO: 869877 - RNA, 14 nt, Mycobacterium avium subsp. paratuberculosis
caccgccaccaggc

SEQ ID NO: 869878 - RNA, 16 nt, Mycobacterium avium subsp. paratuberculosis
caccgccaccaggccg

SEQ ID NO: 869879 - RNA, 15 nt, Mycobacterium avium subsp. paratuberculosis
caccgccaccgcccg

SEQ ID NO: 869880 - RNA, 13 nt, Mycobacterium avium subsp. paratuberculosis
caccgccaccgcg

SEQ ID NO: 869881 - RNA, 14 nt, Mycobacterium avium subsp. paratuberculosis
caccgccaccgcga

SEQ ID NO: 869882 - RNA, 17 nt, Mycobacterium avium subsp. paratuberculosis
caccgccaccggcccgg

SEQ ID NO: 869883 - RNA, 16 nt, Mycobacterium avium subsp. paratuberculosis
caccgcauggccggcg

SEQ ID NO: 869884 - RNA, 17 nt, Mycobacterium avium subsp. paratuberculosis
caccgauggguuggccg

SEQ ID NO: 869885 - RNA, 19 nt, Mycobacterium avium subsp. paratuberculosis
caccgauggguuggccguc

SEQ ID NO: 869886 - RNA, 22 nt, Mycobacterium avium subsp. paratuberculosis
caccgauggguuggccgucgcg

SEQ ID NO: 869887 - RNA, 12 nt, Mycobacterium avium subsp. paratuberculosis
caccgaucggca

SEQ ID NO: 869888 - RNA, 15 nt, Mycobacterium avium subsp. paratuberculosis
caccgaugcccgaca

SEQ ID NO: 869889 - RNA, 21 nt, Mycobacterium avium subsp. paratuberculosis
caccgaucaggaucggcgggc

SEQ ID NO: 869890 - RNA, 14 nt, Mycobacterium avium subsp. paratuberculosis
caccgaucggcacg

SEQ ID NO: 869891 - RNA, 18 nt, Mycobacterium avium subsp. paratuberculosis
caccgaucggcacgucga

SEQ ID NO: 869892 - RNA, 23 nt, Mycobacterium avium subsp. paratuberculosis
caccgacgcucgccaccccgcgc

SEQ ID NO: 869893 - RNA, 21 nt, Mycobacterium avium subsp. paratuberculosis
caccgacggagccgagcacca

SEQ ID NO: 869894 - RNA, 15 nt, Mycobacterium avium subsp. paratuberculosis
caccgacggccgcac

SEQ ID NO: 869895 - RNA, 19 nt, Mycobacterium avium subsp. paratuberculosis
caccgacaagggccgggcg

SEQ ID NO: 869896 - RNA, 21 nt, Mycobacterium avium subsp. paratuberculosis
caccgacgaccaucagcgccc

SEQ ID NO: 869897 - RNA, 18 nt, Mycobacterium avium subsp. paratuberculosis
caccgacgaccucggugu

SEQ ID NO: 869898 - RNA, 15 nt, Mycobacterium avium subsp. paratuberculosis
caccgacgccagcgg

SEQ ID NO: 869899 - RNA, 17 nt, Mycobacterium avium subsp. paratuberculosis
caccgacgccagcgggc

SEQ ID NO: 869900 - RNA, 13 nt, Mycobacterium avium subsp. paratuberculosis
caccgacgcggcg

SEQ ID NO: 869901 - RNA, 15 nt, Mycobacterium avium subsp. paratuberculosis
caccgacgcggcgac

SEQ ID NO: 869902 - RNA, 14 nt, Mycobacterium avium subsp. paratuberculosis
caccgacgcggcgg

SEQ ID NO: 869903 - RNA, 18 nt, Mycobacterium avium subsp. paratuberculosis
caccgacgcggcggccga

SEQ ID NO: 869904 - RNA, 18 nt, Mycobacterium avium subsp. paratuberculosis
caccgacgcgucgcggcg

SEQ ID NO: 869905 - RNA, 19 nt, Mycobacterium avium subsp. paratuberculosis
caccgacgcgucgcggcgg

SEQ ID NO: 869906 - RNA, 22 nt, Mycobacterium avium subsp. paratuberculosis
caccgacgcgucgcggcggggg

SEQ ID NO: 869907 - RNA, 19 nt, Mycobacterium avium subsp. paratuberculosis
cacccgcugcucgaccucg

SEQ ID NO: 869908 - RNA, 23 nt, Mycobacterium avium subsp. paratuberculosis
cacccgcugcucgaccucggcga

SEQ ID NO: 869909 - RNA, 13 nt, Mycobacterium avium subsp. paratuberculosis
cacccgcugguca

SEQ ID NO: 869910 - RNA, 15 nt, Mycobacterium avium subsp. paratuberculosis
cacccgcucgcgggc

SEQ ID NO: 869911 - RNA, 21 nt, Mycobacterium avium subsp. paratuberculosis
cacccgcucgcgggcccgcgc

SEQ ID NO: 869912 - RNA, 13 nt, Mycobacterium avium subsp. paratuberculosis
cacccgcucggcg

SEQ ID NO: 869913 - RNA, 16 nt, Mycobacterium avium subsp. paratuberculosis
cacccgcugauccagc

SEQ ID NO: 869914 - RNA, 16 nt, Mycobacterium avium subsp. paratuberculosis
cacccggauggucugc

SEQ ID NO: 869915 - RNA, 18 nt, Mycobacterium avium subsp. paratuberculosis
cacccggaugucgugcgg

SEQ ID NO: 869916 - RNA, 22 nt, Mycobacterium avium subsp. paratuberculosis
cacccgcuuuugccgucggugc

SEQ ID NO: 869917 - RNA, 18 nt, Mycobacterium avium subsp. paratuberculosis
cacccggacgugaucgcg

SEQ ID NO: 869918 - RNA, 20 nt, Mycobacterium avium subsp. paratuberculosis
cacccggacgugaucgcggu

SEQ ID NO: 869919 - RNA, 16 nt, Mycobacterium avium subsp. paratuberculosis
cacccggcccaccacc

SEQ ID NO: 869920 - RNA, 17 nt, Mycobacterium avium subsp. paratuberculosis
cacccggcccaccggcc

SEQ ID NO: 869921 - RNA, 21 nt, Mycobacterium avium subsp. paratuberculosis
cacccggcccaccggcccggc

SEQ ID NO: 869922 - RNA, 22 nt, Mycobacterium avium subsp. paratuberculosis
cacccggcccaccggcccggcg

SEQ ID NO: 869923 - RNA, 23 nt, Mycobacterium avium subsp. paratuberculosis
cacccggcccaccggcccggcgg

SEQ ID NO: 869924 - RNA, 16 nt, Mycobacterium avium subsp. paratuberculosis
cacccggcccacgccg

SEQ ID NO: 869925 - RNA, 14 nt, Mycobacterium avium subsp. paratuberculosis
cacccggcccccga

SEQ ID NO: 869926 - RNA, 21 nt, Mycobacterium avium subsp. paratuberculosis
cacccggcccuauggcaucgc

SEQ ID NO: 869927 - RNA, 15 nt, Mycobacterium avium subsp. paratuberculosis
cacccggcggggacc

SEQ ID NO: 869928 - RNA, 23 nt, Mycobacterium avium subsp. paratuberculosis
cacccggcuucgcugcgccggcg

SEQ ID NO: 869929 - RNA, 24 nt, Mycobacterium avium subsp. paratuberculosis
cacccggccggcgaaacacagcag

SEQ ID NO: 869930 - RNA, 17 nt, Mycobacterium avium subsp. paratuberculosis
cacccggcgcgcggaga

SEQ ID NO: 869931 - RNA, 12 nt, Mycobacterium avium subsp. paratuberculosis
cacccggcgcgg

SEQ ID NO: 869932 - RNA, 14 nt, Mycobacterium avium subsp. paratuberculosis
cacccggcgcggcc

SEQ ID NO: 869933 - RNA, 15 nt, Mycobacterium avium subsp. paratuberculosis
cacccggcggcaccg

SEQ ID NO: 869934 - RNA, 21 nt, Mycobacterium avium subsp. paratuberculosis
cacccggcggcaccgcggcuc

SEQ ID NO: 869935 - RNA, 17 nt, Mycobacterium avium subsp. paratuberculosis
cacccggcgggccagau

SEQ ID NO: 869936 - RNA, 18 nt, Mycobacterium avium subsp. paratuberculosis
cacccggcgggccagaug

SEQ ID NO: 869937 - RNA, 21 nt, Mycobacterium avium subsp. paratuberculosis
cacccggugggacugggcgcc

SEQ ID NO: 869938 - RNA, 22 nt, Mycobacterium avium subsp. paratuberculosis
cacccggugggacugggcgccg

SEQ ID NO: 869939 - RNA, 18 nt, Mycobacterium avium subsp. paratuberculosis
cacccgguuccaccgggc

SEQ ID NO: 869940 - RNA, 21 nt, Mycobacterium avium subsp. paratuberculosis
cacccgguuccaccgggccgc

SEQ ID NO: 869941 - RNA, 22 nt, Mycobacterium avium subsp. paratuberculosis
cacccgguucugggcgggcucg

SEQ ID NO: 869942 - RNA, 23 nt, Mycobacterium avium subsp. paratuberculosis
cacccgguucugggcgggcucga

SEQ ID NO: 869943 - RNA, 16 nt, Mycobacterium avium subsp. paratuberculosis
cacccgguugagcacc

SEQ ID NO: 869944 - RNA, 17 nt, Mycobacterium avium subsp. paratuberculosis
cacccgguugagcaccg

SEQ ID NO: 869945 - RNA, 23 nt, Mycobacterium avium subsp. paratuberculosis
cacccguaacacgaucaccccga

SEQ ID NO: 869946 - RNA, 18 nt, Mycobacterium avium subsp. paratuberculosis
cacccgucgacucggcgg

SEQ ID NO: 869947 - RNA, 19 nt, Mycobacterium avium subsp. paratuberculosis
cacccgucgacucggcggu

SEQ ID NO: 869948 - RNA, 21 nt, Mycobacterium avium subsp. paratuberculosis
cacccgucgacucggcggugc

SEQ ID NO: 869949 - RNA, 17 nt, Mycobacterium avium subsp. paratuberculosis
cacccgugggccgaccg

SEQ ID NO: 869950 - RNA, 20 nt, Mycobacterium avium subsp. paratuberculosis
cacccgugggccgaccggcc

SEQ ID NO: 869951 - RNA, 18 nt, Mycobacterium avium subsp. paratuberculosis
cacccguggugggcgaac

SEQ ID NO: 869952 - RNA, 21 nt, Mycobacterium avium subsp. paratuberculosis
cacccguggugggcgaacagc

SEQ ID NO: 869953 - RNA, 14 nt, Mycobacterium avium subsp. paratuberculosis
cacccgguccccgg

SEQ ID NO: 869954 - RNA, 16 nt, Mycobacterium avium subsp. paratuberculosis
cacccgguccggcccg

SEQ ID NO: 869955 - RNA, 18 nt, Mycobacterium avium subsp. paratuberculosis
cacccgguccggcccggg

SEQ ID NO: 869956 - RNA, 21 nt, Mycobacterium avium subsp. paratuberculosis
cacccgguccggcuggucggc

SEQ ID NO: 869957 - RNA, 21 nt, Mycobacterium avium subsp. paratuberculosis
cacccgguccuucucgcacag

SEQ ID NO: 869958 - RNA, 22 nt, Mycobacterium avium subsp. paratuberculosis
cacccgguccuucucgcacagc

SEQ ID NO: 869959 - RNA, 23 nt, Mycobacterium avium subsp. paratuberculosis
cacccgguccuucucgcacagca

SEQ ID NO: 869960 - RNA, 12 nt, Mycobacterium avium subsp. paratuberculosis
cacccgggucga

SEQ ID NO: 869961 - RNA, 15 nt, Mycobacterium avium subsp. paratuberculosis
cacccgggucgagcg

SEQ ID NO: 869962 - RNA, 20 nt, Mycobacterium avium subsp. paratuberculosis
cacccgggugaucaacgcgg

SEQ ID NO: 869963 - RNA, 23 nt, Mycobacterium avium subsp. paratuberculosis
cacccgggugaucaacgcggaca

SEQ ID NO: 869964 - RNA, 14 nt, Mycobacterium avium subsp. paratuberculosis
cacccgggugcccg

SEQ ID NO: 869965 - RNA, 20 nt, Mycobacterium avium subsp. paratuberculosis
cacccggguggacaccgcga

SEQ ID NO: 869966 - RNA, 12 nt, Mycobacterium avium subsp. paratuberculosis
cacccgggcgcc

SEQ ID NO: 869967 - RNA, 13 nt, Mycobacterium avium subsp. paratuberculosis
cacccgggcgccg

SEQ ID NO: 869968 - RNA, 15 nt, Mycobacterium avium subsp. paratuberculosis
cacccgggcgccggc

SEQ ID NO: 869969 - RNA, 16 nt, Mycobacterium avium subsp. paratuberculosis
cacccgggcgccggcg

SEQ ID NO: 869970 - RNA, 13 nt, Mycobacterium avium subsp. paratuberculosis
cacccgggcgcga

SEQ ID NO: 869971 - RNA, 18 nt, Mycobacterium avium subsp. paratuberculosis
cacccgggcgcgacgguc

SEQ ID NO: 869972 - RNA, 17 nt, Mycobacterium avium subsp. paratuberculosis
cacccgggcagcuuccg

SEQ ID NO: 869973 - RNA, 23 nt, Mycobacterium avium subsp. paratuberculosis
cacccgggcccggucgucgccgg

SEQ ID NO: 869974 - RNA, 20 nt, Mycobacterium avium subsp. paratuberculosis
cacccgggccugcggcggcc

SEQ ID NO: 869975 - RNA, 22 nt, Mycobacterium avium subsp. paratuberculosis
cacccgggccugcggcggccgc

SEQ ID NO: 869976 - RNA, 15 nt, Mycobacterium avium subsp. paratuberculosis
caccgacaccaccgg

SEQ ID NO: 869977 - RNA, 23 nt, Mycobacterium avium subsp. paratuberculosis
caccgaagaaccccgagaucgcg

SEQ ID NO: 869978 - RNA, 15 nt, Mycobacterium avium subsp. paratuberculosis
caccgaaucgccgag

SEQ ID NO: 869979 - RNA, 16 nt, Mycobacterium avium subsp. paratuberculosis
caccgaaucgccgagc

SEQ ID NO: 869980 - RNA, 17 nt, Mycobacterium avium subsp. paratuberculosis
caccgaaucgccgagcu

SEQ ID NO: 869981 - RNA, 20 nt, Mycobacterium avium subsp. paratuberculosis
caccgaaucgccgagcucga

SEQ ID NO: 869982 - RNA, 17 nt, Mycobacterium avium subsp. paratuberculosis
caccgaagccgacgucg

SEQ ID NO: 869983 - RNA, 14 nt, Mycobacterium avium subsp. paratuberculosis
caccgaaguccgcc

SEQ ID NO: 869984 - RNA, 15 nt, Mycobacterium avium subsp. paratuberculosis
caccgaaguccgcca

SEQ ID NO: 869985 - RNA, 16 nt, Mycobacterium avium subsp. paratuberculosis
caccgaaguccgccag

SEQ ID NO: 869986 - RNA, 16 nt, Mycobacterium avium subsp. paratuberculosis
caccgaaccggcgggg

SEQ ID NO: 869987 - RNA, 18 nt, Mycobacterium avium subsp. paratuberculosis
cacccuuuuccaucuggg

SEQ ID NO: 869988 - RNA, 15 nt, Mycobacterium avium subsp. paratuberculosis
caccgaacgccagca

SEQ ID NO: 869989 - RNA, 16 nt, Mycobacterium avium subsp. paratuberculosis
caccgaacgccagcag

SEQ ID NO: 869990 - RNA, 13 nt, Mycobacterium avium subsp. paratuberculosis
caccgaacgccga

SEQ ID NO: 869991 - RNA, 14 nt, Mycobacterium avium subsp. paratuberculosis
caccgaacgccgag

SEQ ID NO: 869992 - RNA, 17 nt, Mycobacterium avium subsp. paratuberculosis
caccgaaagccguagcg

SEQ ID NO: 869993 - RNA, 17 nt, Mycobacterium avium subsp. paratuberculosis
caccgaacccaccagcg

SEQ ID NO: 869994 - RNA, 16 nt, Mycobacterium avium subsp. paratuberculosis
caccgaacccggaucg

SEQ ID NO: 869995 - RNA, 18 nt, Mycobacterium avium subsp. paratuberculosis
caccgaaccgccccgcgc

SEQ ID NO: 869996 - RNA, 13 nt, Mycobacterium avium subsp. paratuberculosis
caccgaaccggcg

SEQ ID NO: 869997 - RNA, 18 nt, Mycobacterium avium subsp. paratuberculosis
cacccguuggcaggcccg

SEQ ID NO: 869998 - RNA, 17 nt, Mycobacterium avium subsp. paratuberculosis
cacccguuugaggcgag

SEQ ID NO: 869999 - RNA, 14 nt, Mycobacterium avium subsp. paratuberculosis
cacccucaccacga

SEQ ID NO: 870000 - RNA, 20 nt, Mycobacterium avium subsp. paratuberculosis
cacccucagggagcugcccg

SEQ ID NO: 870001 - RNA, 13 nt, Mycobacterium avium subsp. paratuberculosis
cacccuccucgcg

SEQ ID NO: 870002 - RNA, 16 nt, Mycobacterium avium subsp. paratuberculosis
cacccguuccucgacg

SEQ ID NO: 870003 - RNA, 18 nt, Mycobacterium avium subsp. paratuberculosis
cacccguuccucgacgua

SEQ ID NO: 870004 - RNA, 17 nt, Mycobacterium avium subsp. paratuberculosis
cacccguucggcgucga

SEQ ID NO: 870005 - RNA, 17 nt, Mycobacterium avium subsp. paratuberculosis
cacccucgaggccgacg

SEQ ID NO: 870006 - RNA, 15 nt, Mycobacterium avium subsp. paratuberculosis
cacccucgccgccgc

SEQ ID NO: 870007 - RNA, 15 nt, Mycobacterium avium subsp. paratuberculosis
cacccucgcgcagga

SEQ ID NO: 870008 - RNA, 20 nt, Mycobacterium avium subsp. paratuberculosis
cacccucggcccgccacccg

SEQ ID NO: 870009 - RNA, 12 nt, Mycobacterium avium subsp. paratuberculosis
cacccucggcgu

SEQ ID NO: 870010 - RNA, 15 nt, Mycobacterium avium subsp. paratuberculosis
cacccucggcguccc

SEQ ID NO: 870011 - RNA, 17 nt, Mycobacterium avium subsp. paratuberculosis
cacccucggcgucccgu

SEQ ID NO: 870012 - RNA, 19 nt, Mycobacterium avium subsp. paratuberculosis
cacccucgggguagccggc

SEQ ID NO: 870013 - RNA, 18 nt, Mycobacterium avium subsp. paratuberculosis
cacccucggucgggcgau

SEQ ID NO: 870014 - RNA, 12 nt, Mycobacterium avium subsp. paratuberculosis
cacccugccgac

SEQ ID NO: 870015 - RNA, 14 nt, Mycobacterium avium subsp. paratuberculosis
cacccugccgaccu

SEQ ID NO: 870016 - RNA, 22 nt, Mycobacterium avium subsp. paratuberculosis
cacccugccgaccugcgcgacg

SEQ ID NO: 870017 - RNA, 23 nt, Mycobacterium avium subsp. paratuberculosis
cacccugcgccacaacagguucg

SEQ ID NO: 870018 - RNA, 18 nt, Mycobacterium avium subsp. paratuberculosis
cacccuucaucagcaccg

SEQ ID NO: 870019 - RNA, 21 nt, Mycobacterium avium subsp. paratuberculosis
cacccuugacuaccgcgccca

SEQ ID NO: 870020 - RNA, 14 nt, Mycobacterium avium subsp. paratuberculosis
auguugcggccggc

SEQ ID NO: 870021 - RNA, 17 nt, Mycobacterium avium subsp. paratuberculosis
auguugaccacccgcag

SEQ ID NO: 870022 - RNA, 15 nt, Mycobacterium avium subsp. paratuberculosis
augugggccgcagca

SEQ ID NO: 870023 - RNA, 18 nt, Mycobacterium avium subsp. paratuberculosis
augugggccgcagcagcg

SEQ ID NO: 870024 - RNA, 14 nt, Mycobacterium avium subsp. paratuberculosis
auguggucggccac

SEQ ID NO: 870025 - RNA, 22 nt, Mycobacterium avium subsp. paratuberculosis
auguggcgggcguccugcgggg

SEQ ID NO: 870026 - RNA, 22 nt, Mycobacterium avium subsp. paratuberculosis
auguggcguucgaugcccugcc

SEQ ID NO: 870027 - RNA, 15 nt, Mycobacterium avium subsp. paratuberculosis
augugggcgucgucg

SEQ ID NO: 870028 - RNA, 16 nt, Mycobacterium avium subsp. paratuberculosis
augugagguggcuggg

SEQ ID NO: 870029 - RNA, 19 nt, Mycobacterium avium subsp. paratuberculosis
augugcuugaucagcgggc

SEQ ID NO: 870030 - RNA, 14 nt, Mycobacterium avium subsp. paratuberculosis
auguggaagccgcg

SEQ ID NO: 870031 - RNA, 16 nt, Mycobacterium avium subsp. paratuberculosis
auguggaagccgcgau

SEQ ID NO: 870032 - RNA, 20 nt, Mycobacterium avium subsp. paratuberculosis
auguggaagccgcgaucggc

SEQ ID NO: 870033 - RNA, 20 nt, Mycobacterium avium subsp. paratuberculosis
augugcgugguugcaaucuc

SEQ ID NO: 870034 - RNA, 13 nt, Mycobacterium avium subsp. paratuberculosis
auguggccgucgc

SEQ ID NO: 870035 - RNA, 13 nt, Mycobacterium avium subsp. paratuberculosis
augugcugcaggu

SEQ ID NO: 870036 - RNA, 14 nt, Mycobacterium avium subsp. paratuberculosis
augugcugcagguu

SEQ ID NO: 870037 - RNA, 19 nt, Mycobacterium avium subsp. paratuberculosis
augugccugcgggcccagc

SEQ ID NO: 870038 - RNA, 23 nt, Mycobacterium avium subsp. paratuberculosis
auuaggucgguggccaccaccga

SEQ ID NO: 870039 - RNA, 19 nt, Mycobacterium avium subsp. paratuberculosis
auucuguugccggacaccu

SEQ ID NO: 870040 - RNA, 19 nt, Mycobacterium avium subsp. paratuberculosis
auucuguugucggcucgcc

SEQ ID NO: 870041 - RNA, 15 nt, Mycobacterium avium subsp. paratuberculosis
auugaacgccgccaa

SEQ ID NO: 870042 - RNA, 24 nt, Mycobacterium avium subsp. paratuberculosis
auugaagcccugcucggugaugcc

SEQ ID NO: 870043 - RNA, 17 nt, Mycobacterium avium subsp. paratuberculosis
auugaggcuggcgauca

SEQ ID NO: 870044 - RNA, 17 nt, Mycobacterium avium subsp. paratuberculosis
auugaagaagcgggcca

SEQ ID NO: 870045 - RNA, 14 nt, Mycobacterium avium subsp. paratuberculosis
auugaccagcacgu

SEQ ID NO: 870046 - RNA, 21 nt, Mycobacterium avium subsp. paratuberculosis
auucgggccugaccaaggaca

SEQ ID NO: 870047 - RNA, 23 nt, Mycobacterium avium subsp. paratuberculosis
auucggugagccaguucgccagc

SEQ ID NO: 870048 - RNA, 18 nt, Mycobacterium avium subsp. paratuberculosis
auucggcgaucucgucgc

SEQ ID NO: 870049 - RNA, 12 nt, Mycobacterium avium subsp. paratuberculosis
auucggcgacgc

SEQ ID NO: 870050 - RNA, 18 nt, Mycobacterium avium subsp. paratuberculosis
auucgcgggugcgcucga

SEQ ID NO: 870051 - RNA, 21 nt, Mycobacterium avium subsp. paratuberculosis
auucgcgggugcgcucgacgg

SEQ ID NO: 870052 - RNA, 15 nt, Mycobacterium avium subsp. paratuberculosis
auuccucggaccggu

SEQ ID NO: 870053 - RNA, 18 nt, Mycobacterium avium subsp. paratuberculosis
auucgaacugggugggca

SEQ ID NO: 870054 - RNA, 20 nt, Mycobacterium avium subsp. paratuberculosis
auucgaagaacacgcaggug

SEQ ID NO: 870055 - RNA, 12 nt, Mycobacterium avium subsp. paratuberculosis
auucgaagcccg

SEQ ID NO: 870056 - RNA, 16 nt, Mycobacterium avium subsp. paratuberculosis
auuguucggccaccgc

SEQ ID NO: 870057 - RNA, 17 nt, Mycobacterium avium subsp. paratuberculosis
auugcuuacgcaucgcc

SEQ ID NO: 870058 - RNA, 14 nt, Mycobacterium avium subsp. paratuberculosis
auuggacagcggcg

SEQ ID NO: 870059 - RNA, 15 nt, Mycobacterium avium subsp. paratuberculosis
auugcaccaccgucu

SEQ ID NO: 870060 - RNA, 20 nt, Mycobacterium avium subsp. paratuberculosis
auugccgguggugcggcccu

SEQ ID NO: 870061 - RNA, 13 nt, Mycobacterium avium subsp. paratuberculosis
auugcgagccggu

SEQ ID NO: 870062 - RNA, 15 nt, Mycobacterium avium subsp. paratuberculosis
auugcgagccggucu

SEQ ID NO: 870063 - RNA, 23 nt, Mycobacterium avium subsp. paratuberculosis
augaucugguuccacagcugcag

SEQ ID NO: 870064 - RNA, 20 nt, Mycobacterium avium subsp. paratuberculosis
augaucuugaugucggggcg

SEQ ID NO: 870065 - RNA, 14 nt, Mycobacterium avium subsp. paratuberculosis
augaucuuggugaa

SEQ ID NO: 870066 - RNA, 23 nt, Mycobacterium avium subsp. paratuberculosis
augaugaaaccggccagcagcag

SEQ ID NO: 870067 - RNA, 14 nt, Mycobacterium avium subsp. paratuberculosis
augaucgcccgcuc

SEQ ID NO: 870068 - RNA, 22 nt, Mycobacterium avium subsp. paratuberculosis
augaucucgccgagcgggucgu

SEQ ID NO: 870069 - RNA, 15 nt, Mycobacterium avium subsp. paratuberculosis
augauguagcggcgg

SEQ ID NO: 870070 - RNA, 19 nt, Mycobacterium avium subsp. paratuberculosis
augaugucguuggugucga

SEQ ID NO: 870071 - RNA, 22 nt, Mycobacterium avium subsp. paratuberculosis
augccgagcagcucggcggccu

SEQ ID NO: 870072 - RNA, 16 nt, Mycobacterium avium subsp. paratuberculosis
augauggucaccgucg

SEQ ID NO: 870073 - RNA, 23 nt, Mycobacterium avium subsp. paratuberculosis
augauggugggcaccgcgaacga

SEQ ID NO: 870074 - RNA, 21 nt, Mycobacterium avium subsp. paratuberculosis
augccgagguagucggccucc

SEQ ID NO: 870075 - RNA, 20 nt, Mycobacterium avium subsp. paratuberculosis
augccgagccgcuugguggc

SEQ ID NO: 870076 - RNA, 21 nt, Mycobacterium avium subsp. paratuberculosis
augccgaucggggcgcagccc

SEQ ID NO: 870077 - RNA, 16 nt, Mycobacterium avium subsp. paratuberculosis
augccgcagccgaucu

SEQ ID NO: 870078 - RNA, 16 nt, Mycobacterium avium subsp. paratuberculosis
augccgcccaccaccg

SEQ ID NO: 870079 - RNA, 17 nt, Mycobacterium avium subsp. paratuberculosis
augccgcccaccaccgg

SEQ ID NO: 870080 - RNA, 18 nt, Mycobacterium avium subsp. paratuberculosis
augccguugccaggccgc

SEQ ID NO: 870081 - RNA, 20 nt, Mycobacterium avium subsp. paratuberculosis
augccguugccaggccgcga

SEQ ID NO: 870082 - RNA, 21 nt, Mycobacterium avium subsp. paratuberculosis
augccguugccaggccgcgag

SEQ ID NO: 870083 - RNA, 23 nt, Mycobacterium avium subsp. paratuberculosis
augccguugccaggccgcgagca

SEQ ID NO: 870084 - RNA, 17 nt, Mycobacterium avium subsp. paratuberculosis
augccguuggugacgcu

SEQ ID NO: 870085 - RNA, 22 nt, Mycobacterium avium subsp. paratuberculosis
augccguuggugacgcucaccc

SEQ ID NO: 870086 - RNA, 19 nt, Mycobacterium avium subsp. paratuberculosis
augccgucacugucggcgc

SEQ ID NO: 870087 - RNA, 20 nt, Mycobacterium avium subsp. paratuberculosis
augccgucacugucggcgcg

SEQ ID NO: 870088 - RNA, 12 nt, Mycobacterium avium subsp. paratuberculosis
augccgucgacg

SEQ ID NO: 870089 - RNA, 22 nt, Mycobacterium avium subsp. paratuberculosis
augccguaaguggcgccgcggu

SEQ ID NO: 870090 - RNA, 23 nt, Mycobacterium avium subsp. paratuberculosis
augccguaaguggcgccgcgguc

SEQ ID NO: 870091 - RNA, 22 nt, Mycobacterium avium subsp. paratuberculosis
augccguccagcaacgccgaca

SEQ ID NO: 870092 - RNA, 24 nt, Mycobacterium avium subsp. paratuberculosis
augccguccagcaacgccgacauc

SEQ ID NO: 870093 - RNA, 15 nt, Mycobacterium avium subsp. paratuberculosis
augccgugccagccg

SEQ ID NO: 870094 - RNA, 18 nt, Mycobacterium avium subsp. paratuberculosis
augccgugcgcgcuggug

SEQ ID NO: 870095 - RNA, 22 nt, Mycobacterium avium subsp. paratuberculosis
augccgucggugguccagucga

SEQ ID NO: 870096 - RNA, 21 nt, Mycobacterium avium subsp. paratuberculosis
augccgucgaucuugucgucc

SEQ ID NO: 870097 - RNA, 18 nt, Mycobacterium avium subsp. paratuberculosis
augccggguuucggcccg

SEQ ID NO: 870098 - RNA, 21 nt, Mycobacterium avium subsp. paratuberculosis
augccggguuucggcccggcu

SEQ ID NO: 870099 - RNA, 22 nt, Mycobacterium avium subsp. paratuberculosis
augccggguuucggcccggcuc

SEQ ID NO: 870100 - RNA, 17 nt, Mycobacterium avium subsp. paratuberculosis
augccgguacggccgac

SEQ ID NO: 870101 - RNA, 16 nt, Mycobacterium avium subsp. paratuberculosis
augccggaggcgccgu

SEQ ID NO: 870102 - RNA, 17 nt, Mycobacterium avium subsp. paratuberculosis
augccgggcaaccacag

SEQ ID NO: 870103 - RNA, 23 nt, Mycobacterium avium subsp. paratuberculosis
augccgggcaaccacagcggcgc

SEQ ID NO: 870104 - RNA, 14 nt, Mycobacterium avium subsp. paratuberculosis
augccgcucggcgc

SEQ ID NO: 870105 - RNA, 15 nt, Mycobacterium avium subsp. paratuberculosis
augccgggccagccg

SEQ ID NO: 870106 - RNA, 17 nt, Mycobacterium avium subsp. paratuberculosis
augccgggccagccggc

SEQ ID NO: 870107 - RNA, 19 nt, Mycobacterium avium subsp. paratuberculosis
augccgggccagccggccc

SEQ ID NO: 870108 - RNA, 21 nt, Mycobacterium avium subsp. paratuberculosis
augccggaaaaguucggcggg

SEQ ID NO: 870109 - RNA, 22 nt, Mycobacterium avium subsp. paratuberculosis
augccggaaaaguucggcgggg

SEQ ID NO: 870110 - RNA, 14 nt, Mycobacterium avium subsp. paratuberculosis
augccgcgggccag

SEQ ID NO: 870111 - RNA, 14 nt, Mycobacterium avium subsp. paratuberculosis
augccgcgcucguc

SEQ ID NO: 870112 - RNA, 16 nt, Mycobacterium avium subsp. paratuberculosis
augccgcgcugcgccg

SEQ ID NO: 870113 - RNA, 23 nt, Mycobacterium avium subsp. paratuberculosis
augccgcgcuugguggcgacgaa

SEQ ID NO: 870114 - RNA, 17 nt, Mycobacterium avium subsp. paratuberculosis
augcuggggucggccag

SEQ ID NO: 870115 - RNA, 18 nt, Mycobacterium avium subsp. paratuberculosis
augcuggggucggccagc

SEQ ID NO: 870116 - RNA, 16 nt, Mycobacterium avium subsp. paratuberculosis
augcuggugacgccgc

SEQ ID NO: 870117 - RNA, 17 nt, Mycobacterium avium subsp. paratuberculosis
augcuggugacgccgcu

SEQ ID NO: 870118 - RNA, 23 nt, Mycobacterium avium subsp. paratuberculosis
augcugugcgcuugggucgccgg

SEQ ID NO: 870119 - RNA, 13 nt, Mycobacterium avium subsp. paratuberculosis
augcgucaacccg

SEQ ID NO: 870120 - RNA, 20 nt, Mycobacterium avium subsp. paratuberculosis
augcgucccguuggcgccgg

SEQ ID NO: 870121 - RNA, 19 nt, Mycobacterium avium subsp. paratuberculosis
augcggugcugccgugccg

SEQ ID NO: 870122 - RNA, 22 nt, Mycobacterium avium subsp. paratuberculosis
augcgguggucgaacacggcgc

SEQ ID NO: 870123 - RNA, 15 nt, Mycobacterium avium subsp. paratuberculosis
augcgucgcggcggc

SEQ ID NO: 870124 - RNA, 18 nt, Mycobacterium avium subsp. paratuberculosis
augcgucgcggcggcgcu

SEQ ID NO: 870125 - RNA, 15 nt, Mycobacterium avium subsp. paratuberculosis
augcguuccgcgaca

SEQ ID NO: 870126 - RNA, 14 nt, Mycobacterium avium subsp. paratuberculosis
augcguucggccgc

SEQ ID NO: 870127 - RNA, 17 nt, Mycobacterium avium subsp. paratuberculosis
augcguucggccgcagc

SEQ ID NO: 870128 - RNA, 16 nt, Mycobacterium avium subsp. paratuberculosis
augcguuugccgucga

SEQ ID NO: 870129 - RNA, 15 nt, Mycobacterium avium subsp. paratuberculosis
augcguuggccgagc

SEQ ID NO: 870130 - RNA, 13 nt, Mycobacterium avium subsp. paratuberculosis
augcggucggcgc

SEQ ID NO: 870131 - RNA, 15 nt, Mycobacterium avium subsp. paratuberculosis
augcggucggcgcgg

SEQ ID NO: 870132 - RNA, 22 nt, Mycobacterium avium subsp. paratuberculosis
augcggguguugcgcagcgucu

SEQ ID NO: 870133 - RNA, 16 nt, Mycobacterium avium subsp. paratuberculosis
augcggggcggcggga

SEQ ID NO: 870134 - RNA, 13 nt, Mycobacterium avium subsp. paratuberculosis
augcggaucucgg

SEQ ID NO: 870135 - RNA, 14 nt, Mycobacterium avium subsp. paratuberculosis
augcggggccggcg

SEQ ID NO: 870136 - RNA, 17 nt, Mycobacterium avium subsp. paratuberculosis
augcggggccggcggcg

SEQ ID NO: 870137 - RNA, 15 nt, Mycobacterium avium subsp. paratuberculosis
augcggcccagcccg

SEQ ID NO: 870138 - RNA, 19 nt, Mycobacterium avium subsp. paratuberculosis
augcgggcgcugccguccu

SEQ ID NO: 870139 - RNA, 17 nt, Mycobacterium avium subsp. paratuberculosis
augcggaugcccgccgg

SEQ ID NO: 870140 - RNA, 18 nt, Mycobacterium avium subsp. paratuberculosis
augcggaugcccgccggc

SEQ ID NO: 870141 - RNA, 19 nt, Mycobacterium avium subsp. paratuberculosis
augcggaugcccgccggcg

SEQ ID NO: 870142 - RNA, 20 nt, Mycobacterium avium subsp. paratuberculosis
augcggaugcccgccggcgu

SEQ ID NO: 870143 - RNA, 15 nt, Mycobacterium avium subsp. paratuberculosis
augcggcacgcguca

SEQ ID NO: 870144 - RNA, 11 nt, Mycobacterium avium subsp. paratuberculosis
augcgcugcaa

SEQ ID NO: 870145 - RNA, 13 nt, Mycobacterium avium subsp. paratuberculosis
augcgcucgccga

SEQ ID NO: 870146 - RNA, 15 nt, Mycobacterium avium subsp. paratuberculosis
augcgcucgccgauc

SEQ ID NO: 870147 - RNA, 20 nt, Mycobacterium avium subsp. paratuberculosis
augcgcaccgugccgcccgu

SEQ ID NO: 870148 - RNA, 17 nt, Mycobacterium avium subsp. paratuberculosis
augcgcaccugcggccc

SEQ ID NO: 870149 - RNA, 16 nt, Mycobacterium avium subsp. paratuberculosis
augcgcagcgcccagg

SEQ ID NO: 870150 - RNA, 12 nt, Mycobacterium avium subsp. paratuberculosis
augcgcaccccc

SEQ ID NO: 870151 - RNA, 14 nt, Mycobacterium avium subsp. paratuberculosis
augcgcaccgcggc

SEQ ID NO: 870152 - RNA, 17 nt, Mycobacterium avium subsp. paratuberculosis
augcgcacgucggccgc

SEQ ID NO: 870153 - RNA, 19 nt, Mycobacterium avium subsp. paratuberculosis
augcgcacgucggccgcca

SEQ ID NO: 870154 - RNA, 19 nt, Mycobacterium avium subsp. paratuberculosis
augcgaugggugaucgcgg

SEQ ID NO: 870155 - RNA, 15 nt, Mycobacterium avium subsp. paratuberculosis
augcgaugaccaccc

SEQ ID NO: 870156 - RNA, 18 nt, Mycobacterium avium subsp. paratuberculosis
augcgaucauuccgccga

SEQ ID NO: 870157 - RNA, 13 nt, Mycobacterium avium subsp. paratuberculosis
augcgcaccacgc

SEQ ID NO: 870158 - RNA, 21 nt, Mycobacterium avium subsp. paratuberculosis
auggaaugugccugcgggccc

SEQ ID NO: 870159 - RNA, 18 nt, Mycobacterium avium subsp. paratuberculosis
auggacagccaccgugcc

SEQ ID NO: 870160 - RNA, 16 nt, Mycobacterium avium subsp. paratuberculosis
auggccagcgcggcgu

SEQ ID NO: 870161 - RNA, 17 nt, Mycobacterium avium subsp. paratuberculosis
auggccagcgcggcguc

SEQ ID NO: 870162 - RNA, 15 nt, Mycobacterium avium subsp. paratuberculosis
auggccagcgcgucg

SEQ ID NO: 870163 - RNA, 19 nt, Mycobacterium avium subsp. paratuberculosis
auggccagcucgucgcgga

SEQ ID NO: 870164 - RNA, 19 nt, Mycobacterium avium subsp. paratuberculosis
auggccagcaccaccgcga

SEQ ID NO: 870165 - RNA, 21 nt, Mycobacterium avium subsp. paratuberculosis
auggccagcaccaccgcgagc

SEQ ID NO: 870166 - RNA, 23 nt, Mycobacterium avium subsp. paratuberculosis
auggccagcaccaccgcgagcgg

SEQ ID NO: 870167 - RNA, 16 nt, Mycobacterium avium subsp. paratuberculosis
auggacagggcgacau

SEQ ID NO: 870168 - RNA, 22 nt, Mycobacterium avium subsp. paratuberculosis
auggacagggcgacaucggcac

SEQ ID NO: 870169 - RNA, 14 nt, Mycobacterium avium subsp. paratuberculosis
auggacacgcccug

SEQ ID NO: 870170 - RNA, 14 nt, Mycobacterium avium subsp. paratuberculosis
auggcgaccgcgac

SEQ ID NO: 870171 - RNA, 15 nt, Mycobacterium avium subsp. paratuberculosis
auggcgaccgcgacg

SEQ ID NO: 870172 - RNA, 16 nt, Mycobacterium avium subsp. paratuberculosis
auggcgaccgcgcagg

SEQ ID NO: 870173 - RNA, 18 nt, Mycobacterium avium subsp. paratuberculosis
auggcgaacacgucggcc

SEQ ID NO: 870174 - RNA, 16 nt, Mycobacterium avium subsp. paratuberculosis
auggcgaaccagcgcc

SEQ ID NO: 870175 - RNA, 17 nt, Mycobacterium avium subsp. paratuberculosis
auggcgaaccagcgccc

SEQ ID NO: 870176 - RNA, 22 nt, Mycobacterium avium subsp. paratuberculosis
auggccgucgggucggcgagca

SEQ ID NO: 870177 - RNA, 14 nt, Mycobacterium avium subsp. paratuberculosis
auggccagcaccau

SEQ ID NO: 870178 - RNA, 13 nt, Mycobacterium avium subsp. paratuberculosis
auggccaucuggc

SEQ ID NO: 870179 - RNA, 18 nt, Mycobacterium avium subsp. paratuberculosis
auggcccaggccgcgguc

SEQ ID NO: 870180 - RNA, 20 nt, Mycobacterium avium subsp. paratuberculosis
auggccucgucgaugucggc

SEQ ID NO: 870181 - RNA, 15 nt, Mycobacterium avium subsp. paratuberculosis
auggcccgcugcgcc

SEQ ID NO: 870182 - RNA, 18 nt, Mycobacterium avium subsp. paratuberculosis
auggcccgcugcgccgac

SEQ ID NO: 870183 - RNA, 17 nt, Mycobacterium avium subsp. paratuberculosis
auggcccggaccgccgc

SEQ ID NO: 870184 - RNA, 16 nt, Mycobacterium avium subsp. paratuberculosis
augggaaccgcucggc

SEQ ID NO: 870185 - RNA, 19 nt, Mycobacterium avium subsp. paratuberculosis
auggcucagcgcaccgccg

SEQ ID NO: 870186 - RNA, 21 nt, Mycobacterium avium subsp. paratuberculosis
auggcucagcgcaccgccguc

SEQ ID NO: 870187 - RNA, 18 nt, Mycobacterium avium subsp. paratuberculosis
auggcguucugcaccgac

SEQ ID NO: 870188 - RNA, 16 nt, Mycobacterium avium subsp. paratuberculosis
auggcgugccggcgcu

SEQ ID NO: 870189 - RNA, 14 nt, Mycobacterium avium subsp. paratuberculosis
auggcgugcugaug

SEQ ID NO: 870190 - RNA, 14 nt, Mycobacterium avium subsp. paratuberculosis
auggcgucggccag

SEQ ID NO: 870191 - RNA, 20 nt, Mycobacterium avium subsp. paratuberculosis
auggcgucgacgugcgcggc

SEQ ID NO: 870192 - RNA, 14 nt, Mycobacterium avium subsp. paratuberculosis
auggcggcgcgcuc

SEQ ID NO: 870193 - RNA, 17 nt, Mycobacterium avium subsp. paratuberculosis
auggcggccgccgcgau

SEQ ID NO: 870194 - RNA, 18 nt, Mycobacterium avium subsp. paratuberculosis
auggcggccgccgcgauc

SEQ ID NO: 870195 - RNA, 13 nt, Mycobacterium avium subsp. paratuberculosis
auggcggccugca

SEQ ID NO: 870196 - RNA, 16 nt, Mycobacterium avium subsp. paratuberculosis
auggcgcuggccgcga

SEQ ID NO: 870197 - RNA, 16 nt, Mycobacterium avium subsp. paratuberculosis
auggcgcugcgcgaca

SEQ ID NO: 870198 - RNA, 16 nt, Mycobacterium avium subsp. paratuberculosis
auggcggcccgcgccg

SEQ ID NO: 870199 - RNA, 14 nt, Mycobacterium avium subsp. paratuberculosis
auggcggccagccg

SEQ ID NO: 870200 - RNA, 16 nt, Mycobacterium avium subsp. paratuberculosis
auggcggccagccggu

SEQ ID NO: 870201 - RNA, 15 nt, Mycobacterium avium subsp. paratuberculosis
auggcggcaucccca

SEQ ID NO: 870202 - RNA, 19 nt, Mycobacterium avium subsp. paratuberculosis
auggcggaacugacuucgg

SEQ ID NO: 870203 - RNA, 15 nt, Mycobacterium avium subsp. paratuberculosis
augguggccgucggc

SEQ ID NO: 870204 - RNA, 14 nt, Mycobacterium avium subsp. paratuberculosis
augguggcgcugcc

SEQ ID NO: 870205 - RNA, 16 nt, Mycobacterium avium subsp. paratuberculosis
augguggcgcugccga

SEQ ID NO: 870206 - RNA, 14 nt, Mycobacterium avium subsp. paratuberculosis
augguggcggccac

SEQ ID NO: 870207 - RNA, 14 nt, Mycobacterium avium subsp. paratuberculosis
augguggcggcgcc

SEQ ID NO: 870208 - RNA, 19 nt, Mycobacterium avium subsp. paratuberculosis
augguggcggcgccggaug

SEQ ID NO: 870209 - RNA, 13 nt, Mycobacterium avium subsp. paratuberculosis
auggugguaccga

SEQ ID NO: 870210 - RNA, 15 nt, Mycobacterium avium subsp. paratuberculosis
auggugguaccgacc

SEQ ID NO: 870211 - RNA, 14 nt, Mycobacterium avium subsp. paratuberculosis
augguggucgccgu

SEQ ID NO: 870212 - RNA, 17 nt, Mycobacterium avium subsp. paratuberculosis
augguggucgccgucgu

SEQ ID NO: 870213 - RNA, 20 nt, Mycobacterium avium subsp. paratuberculosis
augguguuccaccagcggcc

SEQ ID NO: 870214 - RNA, 19 nt, Mycobacterium avium subsp. paratuberculosis
auggugucaggaucgccgg

SEQ ID NO: 870215 - RNA, 13 nt, Mycobacterium avium subsp. paratuberculosis
auggugacggccg

SEQ ID NO: 870216 - RNA, 19 nt, Mycobacterium avium subsp. paratuberculosis
auggugcccuucgaguugc

SEQ ID NO: 870217 - RNA, 13 nt, Mycobacterium avium subsp. paratuberculosis
auggugaucgacc

SEQ ID NO: 870218 - RNA, 23 nt, Mycobacterium avium subsp. paratuberculosis
auggucggcgacgccgucggggu

SEQ ID NO: 870219 - RNA, 21 nt, Mycobacterium avium subsp. paratuberculosis
auggucgggacgucggcgcgc

SEQ ID NO: 870220 - RNA, 13 nt, Mycobacterium avium subsp. paratuberculosis
auggucgucgucg

SEQ ID NO: 870221 - RNA, 16 nt, Mycobacterium avium subsp. paratuberculosis
auggucucccgggcgg

SEQ ID NO: 870222 - RNA, 13 nt, Mycobacterium avium subsp. paratuberculosis
auggucugcccgc

SEQ ID NO: 870223 - RNA, 19 nt, Mycobacterium avium subsp. paratuberculosis
auggucugcccgccgccga

SEQ ID NO: 870224 - RNA, 21 nt, Mycobacterium avium subsp. paratuberculosis
augggccagguccucgcuggc

SEQ ID NO: 870225 - RNA, 14 nt, Mycobacterium avium subsp. paratuberculosis
augggcccggcccg

SEQ ID NO: 870226 - RNA, 13 nt, Mycobacterium avium subsp. paratuberculosis
augggcagcgccc

SEQ ID NO: 870227 - RNA, 22 nt, Mycobacterium avium subsp. paratuberculosis
augggcagcgccccgguccggc

SEQ ID NO: 870228 - RNA, 17 nt, Mycobacterium avium subsp. paratuberculosis
augguccugcaccgagu

SEQ ID NO: 870229 - RNA, 15 nt, Mycobacterium avium subsp. paratuberculosis
auggucgagccgcag

SEQ ID NO: 870230 - RNA, 22 nt, Mycobacterium avium subsp. paratuberculosis
auggucgagccgcagucgauca

SEQ ID NO: 870231 - RNA, 23 nt, Mycobacterium avium subsp. paratuberculosis
auggucgagggcguucgcggugg

SEQ ID NO: 870232 - RNA, 20 nt, Mycobacterium avium subsp. paratuberculosis
auggucgccgacgguggcga

SEQ ID NO: 870233 - RNA, 14 nt, Mycobacterium avium subsp. paratuberculosis
augggccgcccgcu

SEQ ID NO: 870234 - RNA, 12 nt, Mycobacterium avium subsp. paratuberculosis
auggucgcggcc

SEQ ID NO: 870235 - RNA, 19 nt, Mycobacterium avium subsp. paratuberculosis
augucuagccgccgagcgu

SEQ ID NO: 870236 - RNA, 16 nt, Mycobacterium avium subsp. paratuberculosis
augucguuggugucga

SEQ ID NO: 870237 - RNA, 15 nt, Mycobacterium avium subsp. paratuberculosis
augucgguggcgcgc

SEQ ID NO: 870238 - RNA, 18 nt, Mycobacterium avium subsp. paratuberculosis
augucggugugcagcagc

SEQ ID NO: 870239 - RNA, 13 nt, Mycobacterium avium subsp. paratuberculosis
augucgucgggcg

SEQ ID NO: 870240 - RNA, 16 nt, Mycobacterium avium subsp. paratuberculosis
augucgucgucgacgc

SEQ ID NO: 870241 - RNA, 14 nt, Mycobacterium avium subsp. paratuberculosis
augucguugaugcc

SEQ ID NO: 870242 - RNA, 16 nt, Mycobacterium avium subsp. paratuberculosis
augucguugaugccgu

SEQ ID NO: 870243 - RNA, 19 nt, Mycobacterium avium subsp. paratuberculosis
augucguugaugccgucga

SEQ ID NO: 870244 - RNA, 14 nt, Mycobacterium avium subsp. paratuberculosis
augucguacgggcg

SEQ ID NO: 870245 - RNA, 22 nt, Mycobacterium avium subsp. paratuberculosis
augucggugccgauccgcaccg

SEQ ID NO: 870246 - RNA, 17 nt, Mycobacterium avium subsp. paratuberculosis
augucggugcggcgggc

SEQ ID NO: 870247 - RNA, 18 nt, Mycobacterium avium subsp. paratuberculosis
augucggcgaaccagggc

SEQ ID NO: 870248 - RNA, 14 nt, Mycobacterium avium subsp. paratuberculosis
augucggcggcccg

SEQ ID NO: 870249 - RNA, 15 nt, Mycobacterium avium subsp. paratuberculosis
augucggcggccggg

SEQ ID NO: 870250 - RNA, 17 nt, Mycobacterium avium subsp. paratuberculosis
augucgaagaagcggcc

SEQ ID NO: 870251 - RNA, 17 nt, Mycobacterium avium subsp. paratuberculosis
augucgaccaccgggua

SEQ ID NO: 870252 - RNA, 15 nt, Mycobacterium avium subsp. paratuberculosis
augucggccagcgcg

SEQ ID NO: 870253 - RNA, 14 nt, Mycobacterium avium subsp. paratuberculosis
auguagcagcgcgg

SEQ ID NO: 870254 - RNA, 16 nt, Mycobacterium avium subsp. paratuberculosis
auguccgccggccggu

SEQ ID NO: 870255 - RNA, 20 nt, Mycobacterium avium subsp. paratuberculosis
auguccggcaggcucagcag

SEQ ID NO: 870256 - RNA, 16 nt, Mycobacterium avium subsp. paratuberculosis
auguccuacggcgggu

SEQ ID NO: 870257 - RNA, 13 nt, Mycobacterium avium subsp. paratuberculosis
aucgaggacaccg

SEQ ID NO: 870258 - RNA, 21 nt, Mycobacterium avium subsp. paratuberculosis
aucgaggaccggcgccggccg

SEQ ID NO: 870259 - RNA, 17 nt, Mycobacterium avium subsp. paratuberculosis
aucgaggccagcgcgau

SEQ ID NO: 870260 - RNA, 23 nt, Mycobacterium avium subsp. paratuberculosis
aucgaggccagcgcgaucgccgg

SEQ ID NO: 870261 - RNA, 19 nt, Mycobacterium avium subsp. paratuberculosis
aucgagucccgcgcggcgc

SEQ ID NO: 870262 - RNA, 17 nt, Mycobacterium avium subsp. paratuberculosis
aucgagggcgcgcagcg

SEQ ID NO: 870263 - RNA, 21 nt, Mycobacterium avium subsp. paratuberculosis
aucgagguaggccaccggguc

SEQ ID NO: 870264 - RNA, 21 nt, Mycobacterium avium subsp. paratuberculosis
aucgaggugauguuggccgcg

SEQ ID NO: 870265 - RNA, 18 nt, Mycobacterium avium subsp. paratuberculosis
aucgaucccgucggccau

SEQ ID NO: 870266 - RNA, 20 nt, Mycobacterium avium subsp. paratuberculosis
aucgaucccuuggcggcggc

SEQ ID NO: 870267 - RNA, 21 nt, Mycobacterium avium subsp. paratuberculosis
aucgauaacgcgcgcgccguc

SEQ ID NO: 870268 - RNA, 13 nt, Mycobacterium avium subsp. paratuberculosis
aucgaguuccgcg

SEQ ID NO: 870269 - RNA, 16 nt, Mycobacterium avium subsp. paratuberculosis
aucgagaugccgggaa

SEQ ID NO: 870270 - RNA, 23 nt, Mycobacterium avium subsp. paratuberculosis
aucgagcugcaacgcgucggcgc

SEQ ID NO: 870271 - RNA, 11 nt, Mycobacterium avium subsp. paratuberculosis
aucgagcacca

SEQ ID NO: 870272 - RNA, 17 nt, Mycobacterium avium subsp. paratuberculosis
aucgagcaccagcgucg

SEQ ID NO: 870273 - RNA, 16 nt, Mycobacterium avium subsp. paratuberculosis
aucgagcaccgggcgu

SEQ ID NO: 870274 - RNA, 18 nt, Mycobacterium avium subsp. paratuberculosis
aucgagccgccugcgcgc

SEQ ID NO: 870275 - RNA, 22 nt, Mycobacterium avium subsp. paratuberculosis
aucgagccgccugcgcgccguc

SEQ ID NO: 870276 - RNA, 20 nt, Mycobacterium avium subsp. paratuberculosis
aucgagccgguacggcucgu

SEQ ID NO: 870277 - RNA, 16 nt, Mycobacterium avium subsp. paratuberculosis
aucgagcgcaccgccc

SEQ ID NO: 870278 - RNA, 17 nt, Mycobacterium avium subsp. paratuberculosis
aucgagcgcaccgccca

SEQ ID NO: 870279 - RNA, 14 nt, Mycobacterium avium subsp. paratuberculosis
aucgacuugccgcc

SEQ ID NO: 870280 - RNA, 16 nt, Mycobacterium avium subsp. paratuberculosis
aucgacuugccgccgc

SEQ ID NO: 870281 - RNA, 14 nt, Mycobacterium avium subsp. paratuberculosis
aucgacugcgacac

SEQ ID NO: 870282 - RNA, 19 nt, Mycobacterium avium subsp. paratuberculosis
aucgacugcgacacccgcu

SEQ ID NO: 870283 - RNA, 15 nt, Mycobacterium avium subsp. paratuberculosis
aucgagaucagggcg

SEQ ID NO: 870284 - RNA, 16 nt, Mycobacterium avium subsp. paratuberculosis
aucgagaccaugucgg

SEQ ID NO: 870285 - RNA, 18 nt, Mycobacterium avium subsp. paratuberculosis
aucgaccggguuggcgcg

SEQ ID NO: 870286 - RNA, 15 nt, Mycobacterium avium subsp. paratuberculosis
aucgacccccaccgc

SEQ ID NO: 870287 - RNA, 17 nt, Mycobacterium avium subsp. paratuberculosis
aucgacccccaccgcga

SEQ ID NO: 870288 - RNA, 18 nt, Mycobacterium avium subsp. paratuberculosis
aucgacccccaccgcgac

SEQ ID NO: 870289 - RNA, 19 nt, Mycobacterium avium subsp. paratuberculosis
aucgacgucaccaccgggu

SEQ ID NO: 870290 - RNA, 20 nt, Mycobacterium avium subsp. paratuberculosis
aucgacgucaccaccggguc

SEQ ID NO: 870291 - RNA, 22 nt, Mycobacterium avium subsp. paratuberculosis
aucgacgucaccaccgggucgu

SEQ ID NO: 870292 - RNA, 18 nt, Mycobacterium avium subsp. paratuberculosis
aucgacuccagcaccggc

SEQ ID NO: 870293 - RNA, 13 nt, Mycobacterium avium subsp. paratuberculosis
aucgacuccgggu

SEQ ID NO: 870294 - RNA, 15 nt, Mycobacterium avium subsp. paratuberculosis
aucgacgacgccagc

SEQ ID NO: 870295 - RNA, 13 nt, Mycobacterium avium subsp. paratuberculosis
aucgacgccgaca

SEQ ID NO: 870296 - RNA, 21 nt, Mycobacterium avium subsp. paratuberculosis
aucgacgccgacaucgcggcg

SEQ ID NO: 870297 - RNA, 14 nt, Mycobacterium avium subsp. paratuberculosis
aucgacgccgcggu

SEQ ID NO: 870298 - RNA, 21 nt, Mycobacterium avium subsp. paratuberculosis
aucaggcccucgucggcgagc

SEQ ID NO: 870299 - RNA, 13 nt, Mycobacterium avium subsp. paratuberculosis
aucaggccggcca

SEQ ID NO: 870300 - RNA, 14 nt, Mycobacterium avium subsp. paratuberculosis
aucaggccggccac

SEQ ID NO: 870301 - RNA, 17 nt, Mycobacterium avium subsp. paratuberculosis
aucaggaugacgccgcg

SEQ ID NO: 870302 - RNA, 22 nt, Mycobacterium avium subsp. paratuberculosis
aucgacagguucuuggcggccu

SEQ ID NO: 870303 - RNA, 17 nt, Mycobacterium avium subsp. paratuberculosis
aucgacaugcccggcga

SEQ ID NO: 870304 - RNA, 23 nt, Mycobacterium avium subsp. paratuberculosis
aucgacaugcccggcgacggcgc

SEQ ID NO: 870305 - RNA, 22 nt, Mycobacterium avium subsp. paratuberculosis
aucaggcggucgaacgcggcgc

SEQ ID NO: 870306 - RNA, 14 nt, Mycobacterium avium subsp. paratuberculosis
aucaggcggccggc

SEQ ID NO: 870307 - RNA, 15 nt, Mycobacterium avium subsp. paratuberculosis
aucaggcggccggcc

SEQ ID NO: 870308 - RNA, 19 nt, Mycobacterium avium subsp. paratuberculosis
aucgaugaauccgcgcagc

SEQ ID NO: 870309 - RNA, 20 nt, Mycobacterium avium subsp. paratuberculosis
aucgaugaauccgcgcagca

SEQ ID NO: 870310 - RNA, 14 nt, Mycobacterium avium subsp. paratuberculosis
aucgcaccgcgagc

SEQ ID NO: 870311 - RNA, 14 nt, Mycobacterium avium subsp. paratuberculosis
aucgcacagauacg

SEQ ID NO: 870312 - RNA, 13 nt, Mycobacterium avium subsp. paratuberculosis
aucgcagcgcgcg

SEQ ID NO: 870313 - RNA, 16 nt, Mycobacterium avium subsp. paratuberculosis
aucgcagcgcgcggcg

SEQ ID NO: 870314 - RNA, 18 nt, Mycobacterium avium subsp. paratuberculosis
aucgcagcgcgcggcgca

SEQ ID NO: 870315 - RNA, 19 nt, Mycobacterium avium subsp. paratuberculosis
aucgcaggauggccugcac

SEQ ID NO: 870316 - RNA, 16 nt, Mycobacterium avium subsp. paratuberculosis
aucgcccgccgcgagc

SEQ ID NO: 870317 - RNA, 21 nt, Mycobacterium avium subsp. paratuberculosis
aucgcccgcuccgcgggcagc

SEQ ID NO: 870318 - RNA, 17 nt, Mycobacterium avium subsp. paratuberculosis
aucgcccgcuccgcggu

SEQ ID NO: 870319 - RNA, 13 nt, Mycobacterium avium subsp. paratuberculosis
aucgccccggcga

SEQ ID NO: 870320 - RNA, 16 nt, Mycobacterium avium subsp. paratuberculosis
aucgccccggcgacgu

SEQ ID NO: 870321 - RNA, 18 nt, Mycobacterium avium subsp. paratuberculosis
aucgccccggcgacgucg

SEQ ID NO: 870322 - RNA, 22 nt, Mycobacterium avium subsp. paratuberculosis
aucgccccggcgacgucgccgg

SEQ ID NO: 870323 - RNA, 20 nt, Mycobacterium avium subsp. paratuberculosis
aucgccccgcuggaacgccg

SEQ ID NO: 870324 - RNA, 21 nt, Mycobacterium avium subsp. paratuberculosis
aucgccccgcuggaacgccga

SEQ ID NO: 870325 - RNA, 15 nt, Mycobacterium avium subsp. paratuberculosis
aucgccccaggcgga

SEQ ID NO: 870326 - RNA, 14 nt, Mycobacterium avium subsp. paratuberculosis
aucgcccagucccg

SEQ ID NO: 870327 - RNA, 19 nt, Mycobacterium avium subsp. paratuberculosis
aucgcccagugcgcgccgu

SEQ ID NO: 870328 - RNA, 18 nt, Mycobacterium avium subsp. paratuberculosis
aucgcccagcaccgcgac

SEQ ID NO: 870329 - RNA, 12 nt, Mycobacterium avium subsp. paratuberculosis
aucgcccagccg

SEQ ID NO: 870330 - RNA, 19 nt, Mycobacterium avium subsp. paratuberculosis
aucgccaguccggcgccga

SEQ ID NO: 870331 - RNA, 20 nt, Mycobacterium avium subsp. paratuberculosis
aucgccaguccggcgccgac

SEQ ID NO: 870332 - RNA, 17 nt, Mycobacterium avium subsp. paratuberculosis
aucgccaucagcagcgc

SEQ ID NO: 870333 - RNA, 18 nt, Mycobacterium avium subsp. paratuberculosis
aucgcccaacaacucgac

SEQ ID NO: 870334 - RNA, 20 nt, Mycobacterium avium subsp. paratuberculosis
aucgcccaacaacucgacgu

SEQ ID NO: 870335 - RNA, 20 nt, Mycobacterium avium subsp. paratuberculosis
aucgccaggaaccacacccc

SEQ ID NO: 870336 - RNA, 23 nt, Mycobacterium avium subsp. paratuberculosis
aucgccaggaaccacaccccggc

SEQ ID NO: 870337 - RNA, 21 nt, Mycobacterium avium subsp. paratuberculosis
aucgccaggcguugcaccgcg

SEQ ID NO: 870338 - RNA, 12 nt, Mycobacterium avium subsp. paratuberculosis
aucgccagcgcc

SEQ ID NO: 870339 - RNA, 13 nt, Mycobacterium avium subsp. paratuberculosis
aucgccagcgccc

SEQ ID NO: 870340 - RNA, 16 nt, Mycobacterium avium subsp. paratuberculosis
aucgccagcgcgcaga

SEQ ID NO: 870341 - RNA, 17 nt, Mycobacterium avium subsp. paratuberculosis
aucgccagcccggcgua

SEQ ID NO: 870342 - RNA, 14 nt, Mycobacterium avium subsp. paratuberculosis
aucgccagcaacga

SEQ ID NO: 870343 - RNA, 21 nt, Mycobacterium avium subsp. paratuberculosis
aucgccagcaacgacccggcc

SEQ ID NO: 870344 - RNA, 23 nt, Mycobacterium avium subsp. paratuberculosis
aucgccagcaacgacccggccac

SEQ ID NO: 870345 - RNA, 18 nt, Mycobacterium avium subsp. paratuberculosis
aucgccagcacauagcgc

SEQ ID NO: 870346 - RNA, 16 nt, Mycobacterium avium subsp. paratuberculosis
aucgccagcaccggcg

SEQ ID NO: 870347 - RNA, 18 nt, Mycobacterium avium subsp. paratuberculosis
aucgccagcaccggcgcg

SEQ ID NO: 870348 - RNA, 14 nt, Mycobacterium avium subsp. paratuberculosis
aucgccagcacggu

SEQ ID NO: 870349 - RNA, 13 nt, Mycobacterium avium subsp. paratuberculosis
aucgccacggcgg

SEQ ID NO: 870350 - RNA, 14 nt, Mycobacterium avium subsp. paratuberculosis
aucgccacgccgac

SEQ ID NO: 870351 - RNA, 16 nt, Mycobacterium avium subsp. paratuberculosis
aucgccacgccguggc

SEQ ID NO: 870352 - RNA, 15 nt, Mycobacterium avium subsp. paratuberculosis
aucgccaccgagauc

SEQ ID NO: 870353 - RNA, 17 nt, Mycobacterium avium subsp. paratuberculosis
aucgccaccgucgucga

SEQ ID NO: 870354 - RNA, 21 nt, Mycobacterium avium subsp. paratuberculosis
aucgccaccuggaagcgcauc

SEQ ID NO: 870355 - RNA, 15 nt, Mycobacterium avium subsp. paratuberculosis
aucggacaucggcag

SEQ ID NO: 870356 - RNA, 16 nt, Mycobacterium avium subsp. paratuberculosis
aucggacaucggcagc

SEQ ID NO: 870357 - RNA, 17 nt, Mycobacterium avium subsp. paratuberculosis
aucgcuuuccggucagg

SEQ ID NO: 870358 - RNA, 15 nt, Mycobacterium avium subsp. paratuberculosis
aucgcuugcgccgca

SEQ ID NO: 870359 - RNA, 20 nt, Mycobacterium avium subsp. paratuberculosis
aucgcuugcgccgcagcggu

SEQ ID NO: 870360 - RNA, 18 nt, Mycobacterium avium subsp. paratuberculosis
aucgcugccguccacccg

SEQ ID NO: 870361 - RNA, 14 nt, Mycobacterium avium subsp. paratuberculosis
aucgcuucggccag

SEQ ID NO: 870362 - RNA, 19 nt, Mycobacterium avium subsp. paratuberculosis
aucgcuucggccagcgcgu

SEQ ID NO: 870363 - RNA, 20 nt, Mycobacterium avium subsp. paratuberculosis
aucgcuucggccagcgcguc

SEQ ID NO: 870364 - RNA, 12 nt, Mycobacterium avium subsp. paratuberculosis
aucgcgugccga

SEQ ID NO: 870365 - RNA, 15 nt, Mycobacterium avium subsp. paratuberculosis
aucgcgugccgacca

SEQ ID NO: 870366 - RNA, 20 nt, Mycobacterium avium subsp. paratuberculosis
aucgcgugccgaccagccga

SEQ ID NO: 870367 - RNA, 19 nt, Mycobacterium avium subsp. paratuberculosis
aucgcgucggugucgccga

SEQ ID NO: 870368 - RNA, 14 nt, Mycobacterium avium subsp. paratuberculosis
aucgcgugcgucac

SEQ ID NO: 870369 - RNA, 23 nt, Mycobacterium avium subsp. paratuberculosis
aucgcgugcgucacgcuggugac

SEQ ID NO: 870370 - RNA, 15 nt, Mycobacterium avium subsp. paratuberculosis
aucgcguuagcaagg

SEQ ID NO: 870371 - RNA, 16 nt, Mycobacterium avium subsp. paratuberculosis
aucgcuacaccccacc

SEQ ID NO: 870372 - RNA, 15 nt, Mycobacterium avium subsp. paratuberculosis
aucgcugcgcccgcc

SEQ ID NO: 870373 - RNA, 17 nt, Mycobacterium avium subsp. paratuberculosis
aucgcuggggugcccac

SEQ ID NO: 870374 - RNA, 21 nt, Mycobacterium avium subsp. paratuberculosis
aucgcuggggugcccaccagc

SEQ ID NO: 870375 - RNA, 20 nt, Mycobacterium avium subsp. paratuberculosis
aucgcugguggccgacgugc

SEQ ID NO: 870376 - RNA, 15 nt, Mycobacterium avium subsp. paratuberculosis
aucgcggcccacccg

SEQ ID NO: 870377 - RNA, 17 nt, Mycobacterium avium subsp. paratuberculosis
aucgcggcccacccgca

SEQ ID NO: 870378 - RNA, 23 nt, Mycobacterium avium subsp. paratuberculosis
aucgcggcccacccgcagggcgc

SEQ ID NO: 870379 - RNA, 15 nt, Mycobacterium avium subsp. paratuberculosis
aucgcggcccgccgc

SEQ ID NO: 870380 - RNA, 16 nt, Mycobacterium avium subsp. paratuberculosis
aucgcggccaccacga

SEQ ID NO: 870381 - RNA, 19 nt, Mycobacterium avium subsp. paratuberculosis
aucgcgcugaccaggccgu

SEQ ID NO: 870382 - RNA, 20 nt, Mycobacterium avium subsp. paratuberculosis
aucgcgcugaccaggccguc

SEQ ID NO: 870383 - RNA, 22 nt, Mycobacterium avium subsp. paratuberculosis
aucgcgcugaccaggccgucca

SEQ ID NO: 870384 - RNA, 19 nt, Mycobacterium avium subsp. paratuberculosis
aucgcgccggccgccgcga

SEQ ID NO: 870385 - RNA, 13 nt, Mycobacterium avium subsp. paratuberculosis
aucgcgcagccgc

SEQ ID NO: 870386 - RNA, 13 nt, Mycobacterium avium subsp. paratuberculosis
aucgcgccgcaug

SEQ ID NO: 870387 - RNA, 17 nt, Mycobacterium avium subsp. paratuberculosis
aucgcgccugcaccggc

SEQ ID NO: 870388 - RNA, 15 nt, Mycobacterium avium subsp. paratuberculosis
aucgcgcgcggcggc

SEQ ID NO: 870389 - RNA, 18 nt, Mycobacterium avium subsp. paratuberculosis
aucgcgcgcggcggccac

SEQ ID NO: 870390 - RNA, 20 nt, Mycobacterium avium subsp. paratuberculosis
aucgcguaguccagcacggc

SEQ ID NO: 870391 - RNA, 23 nt, Mycobacterium avium subsp. paratuberculosis
aucgcgucggaauacagcagcug

SEQ ID NO: 870392 - RNA, 13 nt, Mycobacterium avium subsp. paratuberculosis
aucgcgucgacga

SEQ ID NO: 870393 - RNA, 18 nt, Mycobacterium avium subsp. paratuberculosis
aucgcgucgacgauggcg

SEQ ID NO: 870394 - RNA, 13 nt, Mycobacterium avium subsp. paratuberculosis
aucgcgucgacgg

SEQ ID NO: 870395 - RNA, 16 nt, Mycobacterium avium subsp. paratuberculosis
aucgcgucgacggcgc

SEQ ID NO: 870396 - RNA, 17 nt, Mycobacterium avium subsp. paratuberculosis
aucgcgucgacggcgcc

SEQ ID NO: 870397 - RNA, 21 nt, Mycobacterium avium subsp. paratuberculosis
aucgcgucgaugccggcgauc

SEQ ID NO: 870398 - RNA, 13 nt, Mycobacterium avium subsp. paratuberculosis
aucgcggugacgc

SEQ ID NO: 870399 - RNA, 19 nt, Mycobacterium avium subsp. paratuberculosis
aucgcggugacgcgccggc

SEQ ID NO: 870400 - RNA, 21 nt, Mycobacterium avium subsp. paratuberculosis
aucgcggugacgcgccggccc

SEQ ID NO: 870401 - RNA, 22 nt, Mycobacterium avium subsp. paratuberculosis
aucgcgguggcuuccagcccgu

SEQ ID NO: 870402 - RNA, 19 nt, Mycobacterium avium subsp. paratuberculosis
aucgcguaggguucgccga

SEQ ID NO: 870403 - RNA, 20 nt, Mycobacterium avium subsp. paratuberculosis
aucgcguaggguucgccgau

SEQ ID NO: 870404 - RNA, 15 nt, Mycobacterium avium subsp. paratuberculosis
aucgcgguagcgcuc

SEQ ID NO: 870405 - RNA, 19 nt, Mycobacterium avium subsp. paratuberculosis
aucgcggcguuguggccac

SEQ ID NO: 870406 - RNA, 14 nt, Mycobacterium avium subsp. paratuberculosis
aucgcgggugacgg

SEQ ID NO: 870407 - RNA, 18 nt, Mycobacterium avium subsp. paratuberculosis
aucgcgggaucggccggc

SEQ ID NO: 870408 - RNA, 17 nt, Mycobacterium avium subsp. paratuberculosis
aucgcgggccaccggcg

SEQ ID NO: 870409 - RNA, 20 nt, Mycobacterium avium subsp. paratuberculosis
aucgcgggccaccggcgcca

SEQ ID NO: 870410 - RNA, 17 nt, Mycobacterium avium subsp. paratuberculosis
aucgcgggcgacccgcu

SEQ ID NO: 870411 - RNA, 14 nt, Mycobacterium avium subsp. paratuberculosis
aucgcggcggucag

SEQ ID NO: 870412 - RNA, 14 nt, Mycobacterium avium subsp. paratuberculosis
aucgcggccgcccg

SEQ ID NO: 870413 - RNA, 17 nt, Mycobacterium avium subsp. paratuberculosis
aucgcggccgcccgguc

SEQ ID NO: 870414 - RNA, 17 nt, Mycobacterium avium subsp. paratuberculosis
aucgcggcgagcagcgc

SEQ ID NO: 870415 - RNA, 14 nt, Mycobacterium avium subsp. paratuberculosis
aucgcggcgauggu

SEQ ID NO: 870416 - RNA, 13 nt, Mycobacterium avium subsp. paratuberculosis
aucgcccggcgcc

SEQ ID NO: 870417 - RNA, 16 nt, Mycobacterium avium subsp. paratuberculosis
aucgcccgggcggcgg

SEQ ID NO: 870418 - RNA, 18 nt, Mycobacterium avium subsp. paratuberculosis
aucgcccgggcggcgggg

SEQ ID NO: 870419 - RNA, 20 nt, Mycobacterium avium subsp. paratuberculosis
aucgcccgggcggcggggcu

SEQ ID NO: 870420 - RNA, 15 nt, Mycobacterium avium subsp. paratuberculosis
aucgcccgguaggcc

SEQ ID NO: 870421 - RNA, 15 nt, Mycobacterium avium subsp. paratuberculosis
aucgccgacgccagc

SEQ ID NO: 870422 - RNA, 13 nt, Mycobacterium avium subsp. paratuberculosis
aucgccgacgucg

SEQ ID NO: 870423 - RNA, 13 nt, Mycobacterium avium subsp. paratuberculosis
aucgccgacgucu

SEQ ID NO: 870424 - RNA, 19 nt, Mycobacterium avium subsp. paratuberculosis
aucgccgagggcgacgaug

SEQ ID NO: 870425 - RNA, 17 nt, Mycobacterium avium subsp. paratuberculosis
aucgccgagucgaucgc

SEQ ID NO: 870426 - RNA, 22 nt, Mycobacterium avium subsp. paratuberculosis
aucgccgauccggcgccgcggg

SEQ ID NO: 870427 - RNA, 15 nt, Mycobacterium avium subsp. paratuberculosis
aucgccgccaucgcc

SEQ ID NO: 870428 - RNA, 17 nt, Mycobacterium avium subsp. paratuberculosis
aucgccgcccaucggca

SEQ ID NO: 870429 - RNA, 13 nt, Mycobacterium avium subsp. paratuberculosis
aucgccggacagc

SEQ ID NO: 870430 - RNA, 17 nt, Mycobacterium avium subsp. paratuberculosis
aucgccggacagcgggc

SEQ ID NO: 870431 - RNA, 17 nt, Mycobacterium avium subsp. paratuberculosis
aucgccggaucgagcac

SEQ ID NO: 870432 - RNA, 14 nt, Mycobacterium avium subsp. paratuberculosis
aucgccggcgcgcu

SEQ ID NO: 870433 - RNA, 20 nt, Mycobacterium avium subsp. paratuberculosis
aucgccgggauauucgccca

SEQ ID NO: 870434 - RNA, 20 nt, Mycobacterium avium subsp. paratuberculosis
aucgccgggauggugagccc

SEQ ID NO: 870435 - RNA, 14 nt, Mycobacterium avium subsp. paratuberculosis
aucgccggggcgcu

SEQ ID NO: 870436 - RNA, 21 nt, Mycobacterium avium subsp. paratuberculosis
aucgccgggucgcacgccggu

SEQ ID NO: 870437 - RNA, 21 nt, Mycobacterium avium subsp. paratuberculosis
aucgccgucacguagcgcggc

SEQ ID NO: 870438 - RNA, 13 nt, Mycobacterium avium subsp. paratuberculosis
aucgccgucgcca

SEQ ID NO: 870439 - RNA, 17 nt, Mycobacterium avium subsp. paratuberculosis
aucgccgucgccaccga

SEQ ID NO: 870440 - RNA, 15 nt, Mycobacterium avium subsp. paratuberculosis
aucgccgcggccgga

SEQ ID NO: 870441 - RNA, 23 nt, Mycobacterium avium subsp. paratuberculosis
aucgccgcaacuugcccgacggc

SEQ ID NO: 870442 - RNA, 13 nt, Mycobacterium avium subsp. paratuberculosis
aucgccgcggugg

SEQ ID NO: 870443 - RNA, 17 nt, Mycobacterium avium subsp. paratuberculosis
aucgccgcgguggcgcc

SEQ ID NO: 870444 - RNA, 23 nt, Mycobacterium avium subsp. paratuberculosis
aucgccgcgguggcgccgcgggc

SEQ ID NO: 870445 - RNA, 17 nt, Mycobacterium avium subsp. paratuberculosis
aucgccgcgcacccggc

SEQ ID NO: 870446 - RNA, 21 nt, Mycobacterium avium subsp. paratuberculosis
aucgccgcgcauucaccagcu

SEQ ID NO: 870447 - RNA, 12 nt, Mycobacterium avium subsp. paratuberculosis
aucgccgcgccc

SEQ ID NO: 870448 - RNA, 18 nt, Mycobacterium avium subsp. paratuberculosis
aucgcgagcagggcgggc

SEQ ID NO: 870449 - RNA, 22 nt, Mycobacterium avium subsp. paratuberculosis
aucgcgacggccggggccagca

SEQ ID NO: 870450 - RNA, 15 nt, Mycobacterium avium subsp. paratuberculosis
aucgcgaacgcgccg

SEQ ID NO: 870451 - RNA, 17 nt, Mycobacterium avium subsp. paratuberculosis
aucgcgaagaccagcgu

SEQ ID NO: 870452 - RNA, 18 nt, Mycobacterium avium subsp. paratuberculosis
aucgcgaccaccggccga

SEQ ID NO: 870453 - RNA, 22 nt, Mycobacterium avium subsp. paratuberculosis
aucgcgaccaccggccgaccgg

SEQ ID NO: 870454 - RNA, 23 nt, Mycobacterium avium subsp. paratuberculosis
aucgcgauccgggcgccggccgg

SEQ ID NO: 870455 - RNA, 16 nt, Mycobacterium avium subsp. paratuberculosis
aucgcgaucgacagcu

SEQ ID NO: 870456 - RNA, 17 nt, Mycobacterium avium subsp. paratuberculosis
aucgcgaucgacagcuc

SEQ ID NO: 870457 - RNA, 16 nt, Mycobacterium avium subsp. paratuberculosis
aucgcgaucgccgauc

SEQ ID NO: 870458 - RNA, 14 nt, Mycobacterium avium subsp. paratuberculosis
aucgcgcaccaggg

SEQ ID NO: 870459 - RNA, 16 nt, Mycobacterium avium subsp. paratuberculosis
aucgccuguccgacca

SEQ ID NO: 870460 - RNA, 14 nt, Mycobacterium avium subsp. paratuberculosis
aucgccucggccac

SEQ ID NO: 870461 - RNA, 14 nt, Mycobacterium avium subsp. paratuberculosis
aucgccucggcggc

SEQ ID NO: 870462 - RNA, 18 nt, Mycobacterium avium subsp. paratuberculosis
aucgccucggucgcguga

SEQ ID NO: 870463 - RNA, 18 nt, Mycobacterium avium subsp. paratuberculosis
aucgccugagcaaccggu

SEQ ID NO: 870464 - RNA, 14 nt, Mycobacterium avium subsp. paratuberculosis
aucgccgugagauc

SEQ ID NO: 870465 - RNA, 22 nt, Mycobacterium avium subsp. paratuberculosis
aucgccgugagauccagcagcc

SEQ ID NO: 870466 - RNA, 23 nt, Mycobacterium avium subsp. paratuberculosis
aucgccgugagauccagcagcca

SEQ ID NO: 870467 - RNA, 12 nt, Mycobacterium avium subsp. paratuberculosis
aucgccggucgu

SEQ ID NO: 870468 - RNA, 16 nt, Mycobacterium avium subsp. paratuberculosis
aucgccggugcgggcu

SEQ ID NO: 870469 - RNA, 14 nt, Mycobacterium avium subsp. paratuberculosis
aucgccucgaccag

SEQ ID NO: 870470 - RNA, 18 nt, Mycobacterium avium subsp. paratuberculosis
aucgccucgaccagcacc

SEQ ID NO: 870471 - RNA, 17 nt, Mycobacterium avium subsp. paratuberculosis
aucgccucgaccaggcu

SEQ ID NO: 870472 - RNA, 17 nt, Mycobacterium avium subsp. paratuberculosis
aucuacgucgucgccgg

SEQ ID NO: 870473 - RNA, 13 nt, Mycobacterium avium subsp. paratuberculosis
aucuccgggaacg

SEQ ID NO: 870474 - RNA, 18 nt, Mycobacterium avium subsp. paratuberculosis
aucuccgggaacgcggcg

SEQ ID NO: 870475 - RNA, 21 nt, Mycobacterium avium subsp. paratuberculosis
aucguucccugcgcggcgaug

SEQ ID NO: 870476 - RNA, 14 nt, Mycobacterium avium subsp. paratuberculosis
aucgugaucgccca

SEQ ID NO: 870477 - RNA, 15 nt, Mycobacterium avium subsp. paratuberculosis
aucgugaucgcccac

SEQ ID NO: 870478 - RNA, 21 nt, Mycobacterium avium subsp. paratuberculosis
aucgugacgccguccgacgug

SEQ ID NO: 870479 - RNA, 16 nt, Mycobacterium avium subsp. paratuberculosis
aucgugaauucggccg

SEQ ID NO: 870480 - RNA, 18 nt, Mycobacterium avium subsp. paratuberculosis
aucgugaauucggccggg

SEQ ID NO: 870481 - RNA, 16 nt, Mycobacterium avium subsp. paratuberculosis
aucgucuugaccgccc

SEQ ID NO: 870482 - RNA, 15 nt, Mycobacterium avium subsp. paratuberculosis
aucgucuugcggccc

SEQ ID NO: 870483 - RNA, 22 nt, Mycobacterium avium subsp. paratuberculosis
aucguccacaccgggaaggugg

SEQ ID NO: 870484 - RNA, 15 nt, Mycobacterium avium subsp. paratuberculosis
aucgucccgucgacc

SEQ ID NO: 870485 - RNA, 17 nt, Mycobacterium avium subsp. paratuberculosis
aucguccgaggccccgc

SEQ ID NO: 870486 - RNA, 15 nt, Mycobacterium avium subsp. paratuberculosis
aucguccggcgccac

SEQ ID NO: 870487 - RNA, 16 nt, Mycobacterium avium subsp. paratuberculosis
aucguccucgcgccgu

SEQ ID NO: 870488 - RNA, 14 nt, Mycobacterium avium subsp. paratuberculosis
aucgucucggccag

SEQ ID NO: 870489 - RNA, 17 nt, Mycobacterium avium subsp. paratuberculosis
aucgucucggccagccg

SEQ ID NO: 870490 - RNA, 16 nt, Mycobacterium avium subsp. paratuberculosis
aucgucucggccgcgg

SEQ ID NO: 870491 - RNA, 15 nt, Mycobacterium avium subsp. paratuberculosis
aucgucggcgccggc

SEQ ID NO: 870492 - RNA, 17 nt, Mycobacterium avium subsp. paratuberculosis
aucgucggcgccggcgc

SEQ ID NO: 870493 - RNA, 13 nt, Mycobacterium avium subsp. paratuberculosis
aucgucgggccgg

SEQ ID NO: 870494 - RNA, 21 nt, Mycobacterium avium subsp. paratuberculosis
aucgucgaacucgggcccgag

SEQ ID NO: 870495 - RNA, 12 nt, Mycobacterium avium subsp. paratuberculosis
aucgucgaccac

SEQ ID NO: 870496 - RNA, 17 nt, Mycobacterium avium subsp. paratuberculosis
aucgucgacccggccgc

SEQ ID NO: 870497 - RNA, 18 nt, Mycobacterium avium subsp. paratuberculosis
aucggggcgcagcccggc

SEQ ID NO: 870498 - RNA, 19 nt, Mycobacterium avium subsp. paratuberculosis
aucggggcgcagcccggcg

SEQ ID NO: 870499 - RNA, 17 nt, Mycobacterium avium subsp. paratuberculosis
aucgggacgccacggcg

SEQ ID NO: 870500 - RNA, 15 nt, Mycobacterium avium subsp. paratuberculosis
aucgggacgccugcc

SEQ ID NO: 870501 - RNA, 21 nt, Mycobacterium avium subsp. paratuberculosis
aucggguaacccuccggcgcc

SEQ ID NO: 870502 - RNA, 12 nt, Mycobacterium avium subsp. paratuberculosis
aucgggucaccg

SEQ ID NO: 870503 - RNA, 14 nt, Mycobacterium avium subsp. paratuberculosis
aucggggugaccgu

SEQ ID NO: 870504 - RNA, 19 nt, Mycobacterium avium subsp. paratuberculosis
aucgucaacaugcugcacg

SEQ ID NO: 870505 - RNA, 17 nt, Mycobacterium avium subsp. paratuberculosis
aucgggucaccggccga

SEQ ID NO: 870506 - RNA, 18 nt, Mycobacterium avium subsp. paratuberculosis
aucggguccagcgccgag

SEQ ID NO: 870507 - RNA, 20 nt, Mycobacterium avium subsp. paratuberculosis
aucgguaaauugaacgccgc

SEQ ID NO: 870508 - RNA, 21 nt, Mycobacterium avium subsp. paratuberculosis
aucgguaaauugaacgccgcc

SEQ ID NO: 870509 - RNA, 21 nt, Mycobacterium avium subsp. paratuberculosis
aucggcuccagcgcccgccgc

SEQ ID NO: 870510 - RNA, 14 nt, Mycobacterium avium subsp. paratuberculosis
aucggcucggcgcc

SEQ ID NO: 870511 - RNA, 16 nt, Mycobacterium avium subsp. paratuberculosis
aucggcucggucgaca

SEQ ID NO: 870512 - RNA, 22 nt, Mycobacterium avium subsp. paratuberculosis
aucggcucguggaacgacgcca

SEQ ID NO: 870513 - RNA, 19 nt, Mycobacterium avium subsp. paratuberculosis
aucggcucaccgaacgcga

SEQ ID NO: 870514 - RNA, 18 nt, Mycobacterium avium subsp. paratuberculosis
aucggcguucaucgugcc

SEQ ID NO: 870515 - RNA, 18 nt, Mycobacterium avium subsp. paratuberculosis
aucggcguuggcggcguc

SEQ ID NO: 870516 - RNA, 14 nt, Mycobacterium avium subsp. paratuberculosis
aucggcugcgggcc

SEQ ID NO: 870517 - RNA, 17 nt, Mycobacterium avium subsp. paratuberculosis
aucggcucgagcucguc

SEQ ID NO: 870518 - RNA, 18 nt, Mycobacterium avium subsp. paratuberculosis
aucggcuggucggcggcc

SEQ ID NO: 870519 - RNA, 22 nt, Mycobacterium avium subsp. paratuberculosis
aucgggaacggguagugcacgg

SEQ ID NO: 870520 - RNA, 22 nt, Mycobacterium avium subsp. paratuberculosis
aucgggaaguccuccgucgagu

SEQ ID NO: 870521 - RNA, 18 nt, Mycobacterium avium subsp. paratuberculosis
aucgggaccgcgggcgca

SEQ ID NO: 870522 - RNA, 12 nt, Mycobacterium avium subsp. paratuberculosis
aucggcgguggu

SEQ ID NO: 870523 - RNA, 18 nt, Mycobacterium avium subsp. paratuberculosis
aucggcgggacccgcgac

SEQ ID NO: 870524 - RNA, 19 nt, Mycobacterium avium subsp. paratuberculosis
aucggcgggacccgcgacc

SEQ ID NO: 870525 - RNA, 13 nt, Mycobacterium avium subsp. paratuberculosis
aucggcggggcgc

SEQ ID NO: 870526 - RNA, 18 nt, Mycobacterium avium subsp. paratuberculosis
aucggcggggcgcguucg

SEQ ID NO: 870527 - RNA, 19 nt, Mycobacterium avium subsp. paratuberculosis
aucggcgggugcgggcgcu

SEQ ID NO: 870528 - RNA, 23 nt, Mycobacterium avium subsp. paratuberculosis
aucggcgggugcgggcgcugcaa

SEQ ID NO: 870529 - RNA, 19 nt, Mycobacterium avium subsp. paratuberculosis
aucggcgguccgccgcagc

SEQ ID NO: 870530 - RNA, 23 nt, Mycobacterium avium subsp. paratuberculosis
aucggcggccaccagccggccgg

SEQ ID NO: 870531 - RNA, 13 nt, Mycobacterium avium subsp. paratuberculosis
aucggcggcgacg

SEQ ID NO: 870532 - RNA, 15 nt, Mycobacterium avium subsp. paratuberculosis
aucggcggcgacggc

SEQ ID NO: 870533 - RNA, 14 nt, Mycobacterium avium subsp. paratuberculosis
aucggcggaacccg

SEQ ID NO: 870534 - RNA, 22 nt, Mycobacterium avium subsp. paratuberculosis
aucggcggaagcucaucgaggu

SEQ ID NO: 870535 - RNA, 22 nt, Mycobacterium avium subsp. paratuberculosis
aucggcgcgaagucgagcaggu

SEQ ID NO: 870536 - RNA, 13 nt, Mycobacterium avium subsp. paratuberculosis
aucggcgcgccga

SEQ ID NO: 870537 - RNA, 16 nt, Mycobacterium avium subsp. paratuberculosis
aucggcgccacgacca

SEQ ID NO: 870538 - RNA, 16 nt, Mycobacterium avium subsp. paratuberculosis
aucggcgagugcaccu

SEQ ID NO: 870539 - RNA, 23 nt, Mycobacterium avium subsp. paratuberculosis
aucggcccgaucucgcgcggguc

SEQ ID NO: 870540 - RNA, 18 nt, Mycobacterium avium subsp. paratuberculosis
aucggcgacggcgacggc

SEQ ID NO: 870541 - RNA, 17 nt, Mycobacterium avium subsp. paratuberculosis
aucggcgccugcgagca

SEQ ID NO: 870542 - RNA, 13 nt, Mycobacterium avium subsp. paratuberculosis
aucggcgcccacc

SEQ ID NO: 870543 - RNA, 15 nt, Mycobacterium avium subsp. paratuberculosis
aucggcgcccaccgc

SEQ ID NO: 870544 - RNA, 17 nt, Mycobacterium avium subsp. paratuberculosis
aucggcgcccaccgcgg

SEQ ID NO: 870545 - RNA, 21 nt, Mycobacterium avium subsp. paratuberculosis
aucggcgcccaccgcggcgcg

SEQ ID NO: 870546 - RNA, 22 nt, Mycobacterium avium subsp. paratuberculosis
aucggcgcccaccgcggcgcgc

SEQ ID NO: 870547 - RNA, 17 nt, Mycobacterium avium subsp. paratuberculosis
aucggcgcccucgccga

SEQ ID NO: 870548 - RNA, 14 nt, Mycobacterium avium subsp. paratuberculosis
aucggcgccgacgg

SEQ ID NO: 870549 - RNA, 14 nt, Mycobacterium avium subsp. paratuberculosis
aucggccagcgcgg

SEQ ID NO: 870550 - RNA, 15 nt, Mycobacterium avium subsp. paratuberculosis
aucggccagcgcggc

SEQ ID NO: 870551 - RNA, 19 nt, Mycobacterium avium subsp. paratuberculosis
aucggccaggaaccaccgg

SEQ ID NO: 870552 - RNA, 13 nt, Mycobacterium avium subsp. paratuberculosis
aucggccaggcgc

SEQ ID NO: 870553 - RNA, 22 nt, Mycobacterium avium subsp. paratuberculosis
aucggccagguugucgucgggc

SEQ ID NO: 870554 - RNA, 19 nt, Mycobacterium avium subsp. paratuberculosis
aucggcaucgcgcgcggcg

SEQ ID NO: 870555 - RNA, 18 nt, Mycobacterium avium subsp. paratuberculosis
aucggcaugacgcccagc

SEQ ID NO: 870556 - RNA, 13 nt, Mycobacterium avium subsp. paratuberculosis
aucggcccggcca

SEQ ID NO: 870557 - RNA, 20 nt, Mycobacterium avium subsp. paratuberculosis
aucggcccgacggguucgcg

SEQ ID NO: 870558 - RNA, 18 nt, Mycobacterium avium subsp. paratuberculosis
aucggccgcaagcgaagc

SEQ ID NO: 870559 - RNA, 13 nt, Mycobacterium avium subsp. paratuberculosis
aucggccgcgggg

SEQ ID NO: 870560 - RNA, 22 nt, Mycobacterium avium subsp. paratuberculosis
aucggccgcggggccggcgcug

SEQ ID NO: 870561 - RNA, 21 nt, Mycobacterium avium subsp. paratuberculosis
aucggccgggucgcaggcagc

SEQ ID NO: 870562 - RNA, 22 nt, Mycobacterium avium subsp. paratuberculosis
aucggccgggucgcaggcagca

SEQ ID NO: 870563 - RNA, 14 nt, Mycobacterium avium subsp. paratuberculosis
aucggcacgccggg

SEQ ID NO: 870564 - RNA, 15 nt, Mycobacterium avium subsp. paratuberculosis
aucggcacgucgagc

SEQ ID NO: 870565 - RNA, 21 nt, Mycobacterium avium subsp. paratuberculosis
aucggcagaccggugagcacc

SEQ ID NO: 870566 - RNA, 22 nt, Mycobacterium avium subsp. paratuberculosis
aucggcagcagggugccgccgc

SEQ ID NO: 870567 - RNA, 18 nt, Mycobacterium avium subsp. paratuberculosis
aucggcagcccggaggcg

SEQ ID NO: 870568 - RNA, 15 nt, Mycobacterium avium subsp. paratuberculosis
aucggcagcgccaac

SEQ ID NO: 870569 - RNA, 15 nt, Mycobacterium avium subsp. paratuberculosis
aucggcagcgcguug

SEQ ID NO: 870570 - RNA, 17 nt, Mycobacterium avium subsp. paratuberculosis
aucggcaggucgucgac

SEQ ID NO: 870571 - RNA, 19 nt, Mycobacterium avium subsp. paratuberculosis
aucggcaggucgucgacgu

SEQ ID NO: 870572 - RNA, 19 nt, Mycobacterium avium subsp. paratuberculosis
aucggcaguccgcgccggu

SEQ ID NO: 870573 - RNA, 17 nt, Mycobacterium avium subsp. paratuberculosis
aucggauucggguggcg

SEQ ID NO: 870574 - RNA, 22 nt, Mycobacterium avium subsp. paratuberculosis
aucggauucggguggcgucgcc

SEQ ID NO: 870575 - RNA, 21 nt, Mycobacterium avium subsp. paratuberculosis
aucggaugccggggcagcacc

SEQ ID NO: 870576 - RNA, 21 nt, Mycobacterium avium subsp. paratuberculosis
aucggauggugcccaccgggc

SEQ ID NO: 870577 - RNA, 23 nt, Mycobacterium avium subsp. paratuberculosis
aucggauggugcccaccgggcag

SEQ ID NO: 870578 - RNA, 16 nt, Mycobacterium avium subsp. paratuberculosis
aucggauccgccugcc

SEQ ID NO: 870579 - RNA, 16 nt, Mycobacterium avium subsp. paratuberculosis
aucugguucaccgcca

SEQ ID NO: 870580 - RNA, 17 nt, Mycobacterium avium subsp. paratuberculosis
aucugguucaccgccac

SEQ ID NO: 870581 - RNA, 20 nt, Mycobacterium avium subsp. paratuberculosis
aucuggucggccagcgcgcg

SEQ ID NO: 870582 - RNA, 15 nt, Mycobacterium avium subsp. paratuberculosis
aucugcucgugguuc

SEQ ID NO: 870583 - RNA, 22 nt, Mycobacterium avium subsp. paratuberculosis
aucugcuccucggucagcggcg

SEQ ID NO: 870584 - RNA, 23 nt, Mycobacterium avium subsp. paratuberculosis
aucugcuccucggucagcggcgu

SEQ ID NO: 870585 - RNA, 17 nt, Mycobacterium avium subsp. paratuberculosis
aucugcuccgggguggc

SEQ ID NO: 870586 - RNA, 18 nt, Mycobacterium avium subsp. paratuberculosis
aucugcuccucggucagc

SEQ ID NO: 870587 - RNA, 13 nt, Mycobacterium avium subsp. paratuberculosis
aucucgcgccgcg

SEQ ID NO: 870588 - RNA, 15 nt, Mycobacterium avium subsp. paratuberculosis
aucucgcgccgcgca

SEQ ID NO: 870589 - RNA, 21 nt, Mycobacterium avium subsp. paratuberculosis
aucucgccgcgguggugggcg

SEQ ID NO: 870590 - RNA, 23 nt, Mycobacterium avium subsp. paratuberculosis
aucugcgccgccuccgggcugcc

SEQ ID NO: 870591 - RNA, 18 nt, Mycobacterium avium subsp. paratuberculosis
aucucgaaugcggcugcc

SEQ ID NO: 870592 - RNA, 13 nt, Mycobacterium avium subsp. paratuberculosis
aucugcggcacca

SEQ ID NO: 870593 - RNA, 21 nt, Mycobacterium avium subsp. paratuberculosis
aucugcgucauggagaucacc

SEQ ID NO: 870594 - RNA, 13 nt, Mycobacterium avium subsp. paratuberculosis
aucucaccggcgg

SEQ ID NO: 870595 - RNA, 16 nt, Mycobacterium avium subsp. paratuberculosis
aucuccucggacccga

SEQ ID NO: 870596 - RNA, 15 nt, Mycobacterium avium subsp. paratuberculosis
aucucgaccagcgcc

SEQ ID NO: 870597 - RNA, 23 nt, Mycobacterium avium subsp. paratuberculosis
aucuccuuggggcugaccucgcc

SEQ ID NO: 870598 - RNA, 22 nt, Mycobacterium avium subsp. paratuberculosis
aucucgaccugggucaucaccu

SEQ ID NO: 870599 - RNA, 14 nt, Mycobacterium avium subsp. paratuberculosis
aucuucucgcugcu

SEQ ID NO: 870600 - RNA, 19 nt, Mycobacterium avium subsp. paratuberculosis
aucuucucggugucgucga

SEQ ID NO: 870601 - RNA, 21 nt, Mycobacterium avium subsp. paratuberculosis
aucuucucggugucgucgacc

SEQ ID NO: 870602 - RNA, 22 nt, Mycobacterium avium subsp. paratuberculosis
aucuuccuucuugaacagcgcc

SEQ ID NO: 870603 - RNA, 15 nt, Mycobacterium avium subsp. paratuberculosis
aucuguucggcggcg

SEQ ID NO: 870604 - RNA, 22 nt, Mycobacterium avium subsp. paratuberculosis
aucuguucggcggcgauccggc

SEQ ID NO: 870605 - RNA, 16 nt, Mycobacterium avium subsp. paratuberculosis
aucuucaguucggccg

SEQ ID NO: 870606 - RNA, 13 nt, Mycobacterium avium subsp. paratuberculosis
augacgucgcgcu

SEQ ID NO: 870607 - RNA, 21 nt, Mycobacterium avium subsp. paratuberculosis
augacgucgcgcugccggccc

SEQ ID NO: 870608 - RNA, 18 nt, Mycobacterium avium subsp. paratuberculosis
augacguagucgcugagc

SEQ ID NO: 870609 - RNA, 17 nt, Mycobacterium avium subsp. paratuberculosis
augacgugcaccaccgc

SEQ ID NO: 870610 - RNA, 18 nt, Mycobacterium avium subsp. paratuberculosis
augacgugcaccaccgcg

SEQ ID NO: 870611 - RNA, 24 nt, Mycobacterium avium subsp. paratuberculosis
augacgugguugcguucgccggcg

SEQ ID NO: 870612 - RNA, 19 nt, Mycobacterium avium subsp. paratuberculosis
augacggucugcaccggga

SEQ ID NO: 870613 - RNA, 19 nt, Mycobacterium avium subsp. paratuberculosis
augaccuccuugcccagcg

SEQ ID NO: 870614 - RNA, 15 nt, Mycobacterium avium subsp. paratuberculosis
augaccucgcgcagc

SEQ ID NO: 870615 - RNA, 21 nt, Mycobacterium avium subsp. paratuberculosis
augaguugcggguccaucgcc

SEQ ID NO: 870616 - RNA, 13 nt, Mycobacterium avium subsp. paratuberculosis
augauccgcggcg

SEQ ID NO: 870617 - RNA, 15 nt, Mycobacterium avium subsp. paratuberculosis
augaucagccgcccg

SEQ ID NO: 870618 - RNA, 20 nt, Mycobacterium avium subsp. paratuberculosis
augaucagcgccguggcccg

SEQ ID NO: 870619 - RNA, 19 nt, Mycobacterium avium subsp. paratuberculosis
augaauccgcgcagcagcg

SEQ ID NO: 870620 - RNA, 13 nt, Mycobacterium avium subsp. paratuberculosis
augaccggcccgg

SEQ ID NO: 870621 - RNA, 23 nt, Mycobacterium avium subsp. paratuberculosis
augaccggcccggcggccggccg

SEQ ID NO: 870622 - RNA, 17 nt, Mycobacterium avium subsp. paratuberculosis
augaccggccugcagcg

SEQ ID NO: 870623 - RNA, 19 nt, Mycobacterium avium subsp. paratuberculosis
augaccgcgucggcgccgu

SEQ ID NO: 870624 - RNA, 15 nt, Mycobacterium avium subsp. paratuberculosis
augaccgcggcgggc

SEQ ID NO: 870625 - RNA, 15 nt, Mycobacterium avium subsp. paratuberculosis
augaauucggcgauc

SEQ ID NO: 870626 - RNA, 12 nt, Mycobacterium avium subsp. paratuberculosis
aucagagcgggc

SEQ ID NO: 870627 - RNA, 21 nt, Mycobacterium avium subsp. paratuberculosis
aucacguucaccugacgcauc

SEQ ID NO: 870628 - RNA, 13 nt, Mycobacterium avium subsp. paratuberculosis
aucagcaccaggu

SEQ ID NO: 870629 - RNA, 23 nt, Mycobacterium avium subsp. paratuberculosis
aucagcaccagguugucgccgcg

SEQ ID NO: 870630 - RNA, 12 nt, Mycobacterium avium subsp. paratuberculosis
aucagcaccgaa

SEQ ID NO: 870631 - RNA, 13 nt, Mycobacterium avium subsp. paratuberculosis
aucagcgccacca

SEQ ID NO: 870632 - RNA, 12 nt, Mycobacterium avium subsp. paratuberculosis
aucagcgcccgc

SEQ ID NO: 870633 - RNA, 14 nt, Mycobacterium avium subsp. paratuberculosis
aucagcgcccgcgc

SEQ ID NO: 870634 - RNA, 19 nt, Mycobacterium avium subsp. paratuberculosis
aucagcgacucgaccccgc

SEQ ID NO: 870635 - RNA, 22 nt, Mycobacterium avium subsp. paratuberculosis
aucagcgacucgaccccgccca

SEQ ID NO: 870636 - RNA, 21 nt, Mycobacterium avium subsp. paratuberculosis
aucagcagguugauccgcgcg

SEQ ID NO: 870637 - RNA, 17 nt, Mycobacterium avium subsp. paratuberculosis
aucagcgacaccacggu

SEQ ID NO: 870638 - RNA, 14 nt, Mycobacterium avium subsp. paratuberculosis
aucagcgacgucag

SEQ ID NO: 870639 - RNA, 20 nt, Mycobacterium avium subsp. paratuberculosis
aucagcgacgucaggucgac

SEQ ID NO: 870640 - RNA, 19 nt, Mycobacterium avium subsp. paratuberculosis
aucagcagccgggccugcg

SEQ ID NO: 870641 - RNA, 21 nt, Mycobacterium avium subsp. paratuberculosis
aucagcagcgccucgccgggc

SEQ ID NO: 870642 - RNA, 23 nt, Mycobacterium avium subsp. paratuberculosis
aucagcagcuugaucgccggggc

SEQ ID NO: 870643 - RNA, 20 nt, Mycobacterium avium subsp. paratuberculosis
aucagcaggcccucggccag

SEQ ID NO: 870644 - RNA, 17 nt, Mycobacterium avium subsp. paratuberculosis
aucagcaggcuggcggc

SEQ ID NO: 870645 - RNA, 19 nt, Mycobacterium avium subsp. paratuberculosis
aucagcaggcuggcggcga

SEQ ID NO: 870646 - RNA, 16 nt, Mycobacterium avium subsp. paratuberculosis
aucagcgccaugcugc

SEQ ID NO: 870647 - RNA, 13 nt, Mycobacterium avium subsp. paratuberculosis
aucagcgccgucu

SEQ ID NO: 870648 - RNA, 14 nt, Mycobacterium avium subsp. paratuberculosis
aucagcgccugguc

SEQ ID NO: 870649 - RNA, 15 nt, Mycobacterium avium subsp. paratuberculosis
aucagcgcgcacagc

SEQ ID NO: 870650 - RNA, 14 nt, Mycobacterium avium subsp. paratuberculosis
aucagcgcgccgcc

SEQ ID NO: 870651 - RNA, 15 nt, Mycobacterium avium subsp. paratuberculosis
aucagcgcgccgccc

SEQ ID NO: 870652 - RNA, 16 nt, Mycobacterium avium subsp. paratuberculosis
aucagcgcgccgccca

SEQ ID NO: 870653 - RNA, 22 nt, Mycobacterium avium subsp. paratuberculosis
aucagcgcgccgcccagcggug

SEQ ID NO: 870654 - RNA, 20 nt, Mycobacterium avium subsp. paratuberculosis
aucagcggagugaccgccag

SEQ ID NO: 870655 - RNA, 22 nt, Mycobacterium avium subsp. paratuberculosis
aucagcggagugaccgccagca

SEQ ID NO: 870656 - RNA, 22 nt, Mycobacterium avium subsp. paratuberculosis
aucagcggauagaggcggcgca

SEQ ID NO: 870657 - RNA, 22 nt, Mycobacterium avium subsp. paratuberculosis
aucaggaucggcgggcgccgaa

SEQ ID NO: 870658 - RNA, 16 nt, Mycobacterium avium subsp. paratuberculosis
aucaccccggcgacgg

SEQ ID NO: 870659 - RNA, 21 nt, Mycobacterium avium subsp. paratuberculosis
aucacccggcggcaccgcggc

SEQ ID NO: 870660 - RNA, 19 nt, Mycobacterium avium subsp. paratuberculosis
aucaccaucacgucgcgcu

SEQ ID NO: 870661 - RNA, 17 nt, Mycobacterium avium subsp. paratuberculosis
aucaccaccgccgccga

SEQ ID NO: 870662 - RNA, 14 nt, Mycobacterium avium subsp. paratuberculosis
aucaccaccgccgg

SEQ ID NO: 870663 - RNA, 13 nt, Mycobacterium avium subsp. paratuberculosis
aucaccagaccgg

SEQ ID NO: 870664 - RNA, 20 nt, Mycobacterium avium subsp. paratuberculosis
aucaccaugaucagcgccgu

SEQ ID NO: 870665 - RNA, 17 nt, Mycobacterium avium subsp. paratuberculosis
aucaccagcggcugcag

SEQ ID NO: 870666 - RNA, 22 nt, Mycobacterium avium subsp. paratuberculosis
aucacgaagaacuugucgucgu

SEQ ID NO: 870667 - RNA, 15 nt, Mycobacterium avium subsp. paratuberculosis
aucacgguggccgcc

SEQ ID NO: 870668 - RNA, 17 nt, Mycobacterium avium subsp. paratuberculosis
aucacgguggccgccac

SEQ ID NO: 870669 - RNA, 16 nt, Mycobacterium avium subsp. paratuberculosis
aucacgucccgcucga

SEQ ID NO: 870670 - RNA, 22 nt, Mycobacterium avium subsp. paratuberculosis
aucacggugccgaguucgaccu

SEQ ID NO: 870671 - RNA, 13 nt, Mycobacterium avium subsp. paratuberculosis
aucacgugcuggc

SEQ ID NO: 870672 - RNA, 16 nt, Mycobacterium avium subsp. paratuberculosis
aucacgugcuggcgcu

SEQ ID NO: 870673 - RNA, 14 nt, Mycobacterium avium subsp. paratuberculosis
aucacgucggcgag

SEQ ID NO: 870674 - RNA, 15 nt, Mycobacterium avium subsp. paratuberculosis
aucacgucggcgagc

SEQ ID NO: 870675 - RNA, 13 nt, Mycobacterium avium subsp. paratuberculosis
aucacgucggcgu

SEQ ID NO: 870676 - RNA, 16 nt, Mycobacterium avium subsp. paratuberculosis
aucaccuugucgcuga

SEQ ID NO: 870677 - RNA, 23 nt, Mycobacterium avium subsp. paratuberculosis
aucaccuugucgcugaccaccga

SEQ ID NO: 870678 - RNA, 19 nt, Mycobacterium avium subsp. paratuberculosis
aucaccuuguugcgggcgu

SEQ ID NO: 870679 - RNA, 20 nt, Mycobacterium avium subsp. paratuberculosis
aucaccuugcggccggcggc

SEQ ID NO: 870680 - RNA, 22 nt, Mycobacterium avium subsp. paratuberculosis
aucaccuugcggccggcggcgu

SEQ ID NO: 870681 - RNA, 23 nt, Mycobacterium avium subsp. paratuberculosis
aucaccuugcggccggcggcguc

SEQ ID NO: 870682 - RNA, 13 nt, Mycobacterium avium subsp. paratuberculosis
aucaccucgaacu

SEQ ID NO: 870683 - RNA, 19 nt, Mycobacterium avium subsp. paratuberculosis
aucaccucgccggccgggc

SEQ ID NO: 870684 - RNA, 20 nt, Mycobacterium avium subsp. paratuberculosis
aucaaugcgggauucgcgca

SEQ ID NO: 870685 - RNA, 20 nt, Mycobacterium avium subsp. paratuberculosis
aucacaucggacaucggcag

SEQ ID NO: 870686 - RNA, 17 nt, Mycobacterium avium subsp. paratuberculosis
aucacaccaccacgcga

SEQ ID NO: 870687 - RNA, 20 nt, Mycobacterium avium subsp. paratuberculosis
aucaaaucccgcagcucgca

SEQ ID NO: 870688 - RNA, 18 nt, Mycobacterium avium subsp. paratuberculosis
aucaacaccaacgacagc

SEQ ID NO: 870689 - RNA, 14 nt, Mycobacterium avium subsp. paratuberculosis
aucaacaccgccag

SEQ ID NO: 870690 - RNA, 13 nt, Mycobacterium avium subsp. paratuberculosis
aucaacaccgcgc

SEQ ID NO: 870691 - RNA, 14 nt, Mycobacterium avium subsp. paratuberculosis
aucaacagccgccc

SEQ ID NO: 870692 - RNA, 15 nt, Mycobacterium avium subsp. paratuberculosis
aucaacgggucgagc

SEQ ID NO: 870693 - RNA, 22 nt, Mycobacterium avium subsp. paratuberculosis
auagccuuugccgugcucggcg

SEQ ID NO: 870694 - RNA, 21 nt, Mycobacterium avium subsp. paratuberculosis
auagccggugaucgcggcgcu

SEQ ID NO: 870695 - RNA, 22 nt, Mycobacterium avium subsp. paratuberculosis
auaggacccggcgagcggcacc

SEQ ID NO: 870696 - RNA, 20 nt, Mycobacterium avium subsp. paratuberculosis
auaggccagcaccagcgugu

SEQ ID NO: 870697 - RNA, 16 nt, Mycobacterium avium subsp. paratuberculosis
auaggucacgccgggg

SEQ ID NO: 870698 - RNA, 16 nt, Mycobacterium avium subsp. paratuberculosis
auaucgcaccggcgcc

SEQ ID NO: 870699 - RNA, 21 nt, Mycobacterium avium subsp. paratuberculosis
auagagcuggugggccaucgc

SEQ ID NO: 870700 - RNA, 14 nt, Mycobacterium avium subsp. paratuberculosis
auagaucaucccgg

SEQ ID NO: 870701 - RNA, 22 nt, Mycobacterium avium subsp. paratuberculosis
auagccccgccaggcggcgacg

SEQ ID NO: 870702 - RNA, 14 nt, Mycobacterium avium subsp. paratuberculosis
auagcccgccgcgg

SEQ ID NO: 870703 - RNA, 20 nt, Mycobacterium avium subsp. paratuberculosis
auagccaucagaacgcccgc

SEQ ID NO: 870704 - RNA, 22 nt, Mycobacterium avium subsp. paratuberculosis
auagcccagccaguccgccgcc

SEQ ID NO: 870705 - RNA, 22 nt, Mycobacterium avium subsp. paratuberculosis
auacgccucaccccagcgcgac

SEQ ID NO: 870706 - RNA, 16 nt, Mycobacterium avium subsp. paratuberculosis
auacucguccucccgg

SEQ ID NO: 870707 - RNA, 20 nt, Mycobacterium avium subsp. paratuberculosis
aguuucacguucggcgggcg

SEQ ID NO: 870708 - RNA, 14 nt, Mycobacterium avium subsp. paratuberculosis
auaaccucggcggc

SEQ ID NO: 870709 - RNA, 20 nt, Mycobacterium avium subsp. paratuberculosis
auaaccucggcggcggcgcg

SEQ ID NO: 870710 - RNA, 16 nt, Mycobacterium avium subsp. paratuberculosis
auaaccgcgcggcgcc

SEQ ID NO: 870711 - RNA, 15 nt, Mycobacterium avium subsp. paratuberculosis
auacgccgcgacgau

SEQ ID NO: 870712 - RNA, 15 nt, Mycobacterium avium subsp. paratuberculosis
auacccgcgcggcgc

SEQ ID NO: 870713 - RNA, 16 nt, Mycobacterium avium subsp. paratuberculosis
auacccgcggccuccg

SEQ ID NO: 870714 - RNA, 13 nt, Mycobacterium avium subsp. paratuberculosis
auaccgcccgcgc

SEQ ID NO: 870715 - RNA, 23 nt, Mycobacterium avium subsp. paratuberculosis
auaccgcccgcgcuggugcugcu

SEQ ID NO: 870716 - RNA, 15 nt, Mycobacterium avium subsp. paratuberculosis
auaccgccggccgcg

SEQ ID NO: 870717 - RNA, 16 nt, Mycobacterium avium subsp. paratuberculosis
auaccgccggccgcgc

SEQ ID NO: 870718 - RNA, 14 nt, Mycobacterium avium subsp. paratuberculosis
auaccguccgcgcc

SEQ ID NO: 870719 - RNA, 13 nt, Mycobacterium avium subsp. paratuberculosis
auaccggccagca

SEQ ID NO: 870720 - RNA, 16 nt, Mycobacterium avium subsp. paratuberculosis
auaccggccagcacga

SEQ ID NO: 870721 - RNA, 16 nt, Mycobacterium avium subsp. paratuberculosis
agucacccggcccccg

SEQ ID NO: 870722 - RNA, 13 nt, Mycobacterium avium subsp. paratuberculosis
agucacccggcug

SEQ ID NO: 870723 - RNA, 14 nt, Mycobacterium avium subsp. paratuberculosis
agugaaccccgggc

SEQ ID NO: 870724 - RNA, 15 nt, Mycobacterium avium subsp. paratuberculosis
agugaaccccgggcu

SEQ ID NO: 870725 - RNA, 20 nt, Mycobacterium avium subsp. paratuberculosis
agugacggguuggucggcgc

SEQ ID NO: 870726 - RNA, 17 nt, Mycobacterium avium subsp. paratuberculosis
agugcggcccgccgggc

SEQ ID NO: 870727 - RNA, 20 nt, Mycobacterium avium subsp. paratuberculosis
agugcgaucgccgugagauc

SEQ ID NO: 870728 - RNA, 15 nt, Mycobacterium avium subsp. paratuberculosis
agugcgaaucaucgu

SEQ ID NO: 870729 - RNA, 21 nt, Mycobacterium avium subsp. paratuberculosis
agugaggggauccagcggcgg

SEQ ID NO: 870730 - RNA, 15 nt, Mycobacterium avium subsp. paratuberculosis
agugaggacgaggcg

SEQ ID NO: 870731 - RNA, 13 nt, Mycobacterium avium subsp. paratuberculosis
agugaggccagca

SEQ ID NO: 870732 - RNA, 14 nt, Mycobacterium avium subsp. paratuberculosis
agugaggccgaggc

SEQ ID NO: 870733 - RNA, 19 nt, Mycobacterium avium subsp. paratuberculosis
agugcucgaacgcgccgau

SEQ ID NO: 870734 - RNA, 20 nt, Mycobacterium avium subsp. paratuberculosis
agugcucgauggccagcgcg

SEQ ID NO: 870735 - RNA, 23 nt, Mycobacterium avium subsp. paratuberculosis
agugcucggcguugagccggcgc

SEQ ID NO: 870736 - RNA, 17 nt, Mycobacterium avium subsp. paratuberculosis
agugcuacugccgacgc

SEQ ID NO: 870737 - RNA, 23 nt, Mycobacterium avium subsp. paratuberculosis
agugcgggcaucggcuggucggc

SEQ ID NO: 870738 - RNA, 22 nt, Mycobacterium avium subsp. paratuberculosis
agugcuggacggcccgacgacg

SEQ ID NO: 870739 - RNA, 21 nt, Mycobacterium avium subsp. paratuberculosis
agugcuucuugaagaaccggg

SEQ ID NO: 870740 - RNA, 23 nt, Mycobacterium avium subsp. paratuberculosis
agugcuugcccugguacgcgccg

SEQ ID NO: 870741 - RNA, 19 nt, Mycobacterium avium subsp. paratuberculosis
aguggacaugcagccgccg

SEQ ID NO: 870742 - RNA, 16 nt, Mycobacterium avium subsp. paratuberculosis
aguggaagucagcgcg

SEQ ID NO: 870743 - RNA, 20 nt, Mycobacterium avium subsp. paratuberculosis
aguggaucggcccgacgggu

SEQ ID NO: 870744 - RNA, 17 nt, Mycobacterium avium subsp. paratuberculosis
aguucgaccuccacccg

SEQ ID NO: 870745 - RNA, 17 nt, Mycobacterium avium subsp. paratuberculosis
aguucgaugacgucgcg

SEQ ID NO: 870746 - RNA, 18 nt, Mycobacterium avium subsp. paratuberculosis
aguucgacguagcccgcc

SEQ ID NO: 870747 - RNA, 16 nt, Mycobacterium avium subsp. paratuberculosis
aguucgagcgccgcgg

SEQ ID NO: 870748 - RNA, 17 nt, Mycobacterium avium subsp. paratuberculosis
aguucgagcgccgcggc

SEQ ID NO: 870749 - RNA, 20 nt, Mycobacterium avium subsp. paratuberculosis
aguucggcaucccggagaac

SEQ ID NO: 870750 - RNA, 11 nt, Mycobacterium avium subsp. paratuberculosis
aguucggccag

SEQ ID NO: 870751 - RNA, 16 nt, Mycobacterium avium subsp. paratuberculosis
aguucggccagcgcgg

SEQ ID NO: 870752 - RNA, 18 nt, Mycobacterium avium subsp. paratuberculosis
aguucggccagcgcggug

SEQ ID NO: 870753 - RNA, 22 nt, Mycobacterium avium subsp. paratuberculosis
aguuccgacaucagugcgggca

SEQ ID NO: 870754 - RNA, 18 nt, Mycobacterium avium subsp. paratuberculosis
aguuccucgccggaguuc

SEQ ID NO: 870755 - RNA, 17 nt, Mycobacterium avium subsp. paratuberculosis
aguuccuugauccggcc

SEQ ID NO: 870756 - RNA, 16 nt, Mycobacterium avium subsp. paratuberculosis
aguuccucggcgaugc

SEQ ID NO: 870757 - RNA, 13 nt, Mycobacterium avium subsp. paratuberculosis
aguuccugcaugc

SEQ ID NO: 870758 - RNA, 23 nt, Mycobacterium avium subsp. paratuberculosis
aguuccugcgaccgccgccgcga

SEQ ID NO: 870759 - RNA, 13 nt, Mycobacterium avium subsp. paratuberculosis
aguggugcaggug

SEQ ID NO: 870760 - RNA, 19 nt, Mycobacterium avium subsp. paratuberculosis
agugguggccgaacggguc

SEQ ID NO: 870761 - RNA, 17 nt, Mycobacterium avium subsp. paratuberculosis
aguggucgucgucgaac

SEQ ID NO: 870762 - RNA, 22 nt, Mycobacterium avium subsp. paratuberculosis
agugguugagcagcagaccgcc

SEQ ID NO: 870763 - RNA, 23 nt, Mycobacterium avium subsp. paratuberculosis
agugucguggcgacaucgccgcg

SEQ ID NO: 870764 - RNA, 15 nt, Mycobacterium avium subsp. paratuberculosis
agugucguggcgugc

SEQ ID NO: 870765 - RNA, 19 nt, Mycobacterium avium subsp. paratuberculosis
aguucaucguggaauccuu

SEQ ID NO: 870766 - RNA, 12 nt, Mycobacterium avium subsp. paratuberculosis
aguucucgccgu

SEQ ID NO: 870767 - RNA, 14 nt, Mycobacterium avium subsp. paratuberculosis
aguucggcggcccg

SEQ ID NO: 870768 - RNA, 19 nt, Mycobacterium avium subsp. paratuberculosis
aguucgcuggcggggcgug

SEQ ID NO: 870769 - RNA, 17 nt, Mycobacterium avium subsp. paratuberculosis
aguucggcgcgcaucuu

SEQ ID NO: 870770 - RNA, 15 nt, Mycobacterium avium subsp. paratuberculosis
aguugaucgcggcgg

SEQ ID NO: 870771 - RNA, 22 nt, Mycobacterium avium subsp. paratuberculosis
aguugcaacccggugcccgaga

SEQ ID NO: 870772 - RNA, 15 nt, Mycobacterium avium subsp. paratuberculosis
aguugcaccggcacc

SEQ ID NO: 870773 - RNA, 16 nt, Mycobacterium avium subsp. paratuberculosis
aguugcaccggcaccg

SEQ ID NO: 870774 - RNA, 17 nt, Mycobacterium avium subsp. paratuberculosis
aguugcaccggcaccgc

SEQ ID NO: 870775 - RNA, 22 nt, Mycobacterium avium subsp. paratuberculosis
aguugcaccggcaccgcggucu

SEQ ID NO: 870776 - RNA, 14 nt, Mycobacterium avium subsp. paratuberculosis
aguugcgcgccgau

SEQ ID NO: 870777 - RNA, 19 nt, Mycobacterium avium subsp. paratuberculosis
aguugcggccggcgguguc

SEQ ID NO: 870778 - RNA, 22 nt, Mycobacterium avium subsp. paratuberculosis
aguugcgaccccgccgucgacg

SEQ ID NO: 870779 - RNA, 22 nt, Mycobacterium avium subsp. paratuberculosis
aguugcccaacuggcgaccggu

SEQ ID NO: 870780 - RNA, 17 nt, Mycobacterium avium subsp. paratuberculosis
aguugccgccgccggga

SEQ ID NO: 870781 - RNA, 19 nt, Mycobacterium avium subsp. paratuberculosis
aguugccggccaucugcug

SEQ ID NO: 870782 - RNA, 14 nt, Mycobacterium avium subsp. paratuberculosis
aguaacgcgagaug

SEQ ID NO: 870783 - RNA, 15 nt, Mycobacterium avium subsp. paratuberculosis
aguacugcucgacgu

SEQ ID NO: 870784 - RNA, 15 nt, Mycobacterium avium subsp. paratuberculosis
aguaguuccggcggu

SEQ ID NO: 870785 - RNA, 23 nt, Mycobacterium avium subsp. paratuberculosis
aguaguuccggcgguccugcggc

SEQ ID NO: 870786 - RNA, 16 nt, Mycobacterium avium subsp. paratuberculosis
aguagaacuucgccag

SEQ ID NO: 870787 - RNA, 18 nt, Mycobacterium avium subsp. paratuberculosis
aguaucuuguucgccgac

SEQ ID NO: 870788 - RNA, 15 nt, Mycobacterium avium subsp. paratuberculosis
agguuggucagcagc

SEQ ID NO: 870789 - RNA, 13 nt, Mycobacterium avium subsp. paratuberculosis
agguuggacaccu

SEQ ID NO: 870790 - RNA, 15 nt, Mycobacterium avium subsp. paratuberculosis
agguugcgccguccg

SEQ ID NO: 870791 - RNA, 15 nt, Mycobacterium avium subsp. paratuberculosis
agguuguagaccggg

SEQ ID NO: 870792 - RNA, 14 nt, Mycobacterium avium subsp. paratuberculosis
agguuuugcagcgg

SEQ ID NO: 870793 - RNA, 16 nt, Mycobacterium avium subsp. paratuberculosis
agguugucgucgggca

SEQ ID NO: 870794 - RNA, 22 nt, Mycobacterium avium subsp. paratuberculosis
agguuuggccagcaccgcggcg

SEQ ID NO: 870795 - RNA, 16 nt, Mycobacterium avium subsp. paratuberculosis
aggugcgccgccgcgu

SEQ ID NO: 870796 - RNA, 20 nt, Mycobacterium avium subsp. paratuberculosis
aggugcgccgcucgucggcc

SEQ ID NO: 870797 - RNA, 13 nt, Mycobacterium avium subsp. paratuberculosis
aggugcggcaccu

SEQ ID NO: 870798 - RNA, 21 nt, Mycobacterium avium subsp. paratuberculosis
aggugcagcgugguccagcac

SEQ ID NO: 870799 - RNA, 19 nt, Mycobacterium avium subsp. paratuberculosis
aggugcauccagucggcgc

SEQ ID NO: 870800 - RNA, 18 nt, Mycobacterium avium subsp. paratuberculosis
aggugcaucgaccggcgg

SEQ ID NO: 870801 - RNA, 17 nt, Mycobacterium avium subsp. paratuberculosis
aggugcaucgccaccgu

SEQ ID NO: 870802 - RNA, 14 nt, Mycobacterium avium subsp. paratuberculosis
aggugauggcccgc

SEQ ID NO: 870803 - RNA, 14 nt, Mycobacterium avium subsp. paratuberculosis
aggugcaccaccca

SEQ ID NO: 870804 - RNA, 16 nt, Mycobacterium avium subsp. paratuberculosis
aggugcacccgcggcg

SEQ ID NO: 870805 - RNA, 17 nt, Mycobacterium avium subsp. paratuberculosis
aggugcacccgcggcgc

SEQ ID NO: 870806 - RNA, 18 nt, Mycobacterium avium subsp. paratuberculosis
aggugcacccgcggcgcg

SEQ ID NO: 870807 - RNA, 23 nt, Mycobacterium avium subsp. paratuberculosis
aggugauguuggccgcgacgccg

SEQ ID NO: 870808 - RNA, 15 nt, Mycobacterium avium subsp. paratuberculosis
aggugcacgccgagc

SEQ ID NO: 870809 - RNA, 18 nt, Mycobacterium avium subsp. paratuberculosis
aggugcacgccgagcagc

SEQ ID NO: 870810 - RNA, 18 nt, Mycobacterium avium subsp. paratuberculosis
agguauuuggugaccugc

SEQ ID NO: 870811 - RNA, 20 nt, Mycobacterium avium subsp. paratuberculosis
agguauucaucgcggccgcc

SEQ ID NO: 870812 - RNA, 21 nt, Mycobacterium avium subsp. paratuberculosis
agggugccccgcgaccgcagc

SEQ ID NO: 870813 - RNA, 22 nt, Mycobacterium avium subsp. paratuberculosis
agggugccccgcgaccgcagca

SEQ ID NO: 870814 - RNA, 22 nt, Mycobacterium avium subsp. paratuberculosis
agggugccgcugcccgccgcgu

SEQ ID NO: 870815 - RNA, 17 nt, Mycobacterium avium subsp. paratuberculosis
agggugccggccaccgg

SEQ ID NO: 870816 - RNA, 13 nt, Mycobacterium avium subsp. paratuberculosis
agguauucgucga

SEQ ID NO: 870817 - RNA, 14 nt, Mycobacterium avium subsp. paratuberculosis
aggucaccgcgcga

SEQ ID NO: 870818 - RNA, 20 nt, Mycobacterium avium subsp. paratuberculosis
aggucaccggauucggcucc

SEQ ID NO: 870819 - RNA, 15 nt, Mycobacterium avium subsp. paratuberculosis
agggucucgcgcagc

SEQ ID NO: 870820 - RNA, 16 nt, Mycobacterium avium subsp. paratuberculosis
agggucgggugcggcg

SEQ ID NO: 870821 - RNA, 15 nt, Mycobacterium avium subsp. paratuberculosis
agggucggucgagcc

SEQ ID NO: 870822 - RNA, 13 nt, Mycobacterium avium subsp. paratuberculosis
agggucgguggcc

SEQ ID NO: 870823 - RNA, 23 nt, Mycobacterium avium subsp. paratuberculosis
agggugaaacacaaacucgccca

SEQ ID NO: 870824 - RNA, 15 nt, Mycobacterium avium subsp. paratuberculosis
agggugacgguggcg

SEQ ID NO: 870825 - RNA, 23 nt, Mycobacterium avium subsp. paratuberculosis
agggucuggcccggugcgacgcc

SEQ ID NO: 870826 - RNA, 22 nt, Mycobacterium avium subsp. paratuberculosis
agggugaugucgcugccgccgc

SEQ ID NO: 870827 - RNA, 18 nt, Mycobacterium avium subsp. paratuberculosis
aggucccaggcguggucg

SEQ ID NO: 870828 - RNA, 20 nt, Mycobacterium avium subsp. paratuberculosis
agguccaggaucacgcggcg

SEQ ID NO: 870829 - RNA, 21 nt, Mycobacterium avium subsp. paratuberculosis
agguccgcgaacucgucgacg

SEQ ID NO: 870830 - RNA, 13 nt, Mycobacterium avium subsp. paratuberculosis
agguccgcggugg

SEQ ID NO: 870831 - RNA, 18 nt, Mycobacterium avium subsp. paratuberculosis
agguccgcggugguggug

SEQ ID NO: 870832 - RNA, 16 nt, Mycobacterium avium subsp. paratuberculosis
agguccggcagcgcgc

SEQ ID NO: 870833 - RNA, 17 nt, Mycobacterium avium subsp. paratuberculosis
agguccggcagcgcgcc

SEQ ID NO: 870834 - RNA, 17 nt, Mycobacterium avium subsp. paratuberculosis
agguccgggaacagcga

SEQ ID NO: 870835 - RNA, 19 nt, Mycobacterium avium subsp. paratuberculosis
agguccgggaacagcgacu

SEQ ID NO: 870836 - RNA, 18 nt, Mycobacterium avium subsp. paratuberculosis
agguccgguucgaccggc

SEQ ID NO: 870837 - RNA, 15 nt, Mycobacterium avium subsp. paratuberculosis
agguccucgcuggcg

SEQ ID NO: 870838 - RNA, 23 nt, Mycobacterium avium subsp. paratuberculosis
aggucaucgagccgagcaccggc

SEQ ID NO: 870839 - RNA, 18 nt, Mycobacterium avium subsp. paratuberculosis
aggucaucagcgacguca

SEQ ID NO: 870840 - RNA, 19 nt, Mycobacterium avium subsp. paratuberculosis
aggucaucagcgacgucag

SEQ ID NO: 870841 - RNA, 15 nt, Mycobacterium avium subsp. paratuberculosis
aggucauagggcucg

SEQ ID NO: 870842 - RNA, 12 nt, Mycobacterium avium subsp. paratuberculosis
aggucagcggcc

SEQ ID NO: 870843 - RNA, 21 nt, Mycobacterium avium subsp. paratuberculosis
agguccacaccguggagacgu

SEQ ID NO: 870844 - RNA, 22 nt, Mycobacterium avium subsp. paratuberculosis
agguccacccgccccgccgcgg

SEQ ID NO: 870845 - RNA, 21 nt, Mycobacterium avium subsp. paratuberculosis
aggucauggcgaccgcgacgg

SEQ ID NO: 870846 - RNA, 23 nt, Mycobacterium avium subsp. paratuberculosis
aggucauggcgaccgcgacggug

SEQ ID NO: 870847 - RNA, 18 nt, Mycobacterium avium subsp. paratuberculosis
aggucaugguggcggcgc

SEQ ID NO: 870848 - RNA, 19 nt, Mycobacterium avium subsp. paratuberculosis
aggucaugguggcggcgcc

SEQ ID NO: 870849 - RNA, 15 nt, Mycobacterium avium subsp. paratuberculosis
aggucggucgcggca

SEQ ID NO: 870850 - RNA, 17 nt, Mycobacterium avium subsp. paratuberculosis
aggugaccaucgggucg

SEQ ID NO: 870851 - RNA, 20 nt, Mycobacterium avium subsp. paratuberculosis
aggugaccaucgggucgucg

SEQ ID NO: 870852 - RNA, 21 nt, Mycobacterium avium subsp. paratuberculosis
aggugaccaucgggucgucgg

SEQ ID NO: 870853 - RNA, 22 nt, Mycobacterium avium subsp. paratuberculosis
aggugaccggcgaggugcgcca

SEQ ID NO: 870854 - RNA, 17 nt, Mycobacterium avium subsp. paratuberculosis
aggugaccucgagcagc

SEQ ID NO: 870855 - RNA, 16 nt, Mycobacterium avium subsp. paratuberculosis
aggugacgucgccgau

SEQ ID NO: 870856 - RNA, 19 nt, Mycobacterium avium subsp. paratuberculosis
aggugacgucgcgccgcuc

SEQ ID NO: 870857 - RNA, 23 nt, Mycobacterium avium subsp. paratuberculosis
aggugacgucgcgccgcucggcc

SEQ ID NO: 870858 - RNA, 19 nt, Mycobacterium avium subsp. paratuberculosis
aggugagcaacgccagcgc

SEQ ID NO: 870859 - RNA, 20 nt, Mycobacterium avium subsp. paratuberculosis
aggugagcaacgccagcgcg

SEQ ID NO: 870860 - RNA, 13 nt, Mycobacterium avium subsp. paratuberculosis
aggugagccgggu

SEQ ID NO: 870861 - RNA, 14 nt, Mycobacterium avium subsp. paratuberculosis
aggugagccgggug

SEQ ID NO: 870862 - RNA, 17 nt, Mycobacterium avium subsp. paratuberculosis
aggugaucgccagcccg

SEQ ID NO: 870863 - RNA, 18 nt, Mycobacterium avium subsp. paratuberculosis
aggugaucgccucgacca

SEQ ID NO: 870864 - RNA, 15 nt, Mycobacterium avium subsp. paratuberculosis
aggucggcggucgcg

SEQ ID NO: 870865 - RNA, 13 nt, Mycobacterium avium subsp. paratuberculosis
aggucggcgugau

SEQ ID NO: 870866 - RNA, 20 nt, Mycobacterium avium subsp. paratuberculosis
aggucgggacguccgcgcga

SEQ ID NO: 870867 - RNA, 12 nt, Mycobacterium avium subsp. paratuberculosis
aggucgggcucg

SEQ ID NO: 870868 - RNA, 14 nt, Mycobacterium avium subsp. paratuberculosis
aggucgggcucgcg

SEQ ID NO: 870869 - RNA, 19 nt, Mycobacterium avium subsp. paratuberculosis
aggucggucaccgagcuca

SEQ ID NO: 870870 - RNA, 17 nt, Mycobacterium avium subsp. paratuberculosis
aggucggugccgcggcg

SEQ ID NO: 870871 - RNA, 16 nt, Mycobacterium avium subsp. paratuberculosis
aggucggugcgcgggg

SEQ ID NO: 870872 - RNA, 23 nt, Mycobacterium avium subsp. paratuberculosis
aggucggugcgcgggguggcgcc

SEQ ID NO: 870873 - RNA, 14 nt, Mycobacterium avium subsp. paratuberculosis
aggucgaaccacgc

SEQ ID NO: 870874 - RNA, 18 nt, Mycobacterium avium subsp. paratuberculosis
aggucgaaccacgcggcg

SEQ ID NO: 870875 - RNA, 22 nt, Mycobacterium avium subsp. paratuberculosis
agguccuucaacuugcgcgacg

SEQ ID NO: 870876 - RNA, 14 nt, Mycobacterium avium subsp. paratuberculosis
aggucgaaggcggc

SEQ ID NO: 870877 - RNA, 21 nt, Mycobacterium avium subsp. paratuberculosis
aggucgaaggcggccgcgagc

SEQ ID NO: 870878 - RNA, 16 nt, Mycobacterium avium subsp. paratuberculosis
aggucgaagggcaucg

SEQ ID NO: 870879 - RNA, 19 nt, Mycobacterium avium subsp. paratuberculosis
aggucgaccaucugccggc

SEQ ID NO: 870880 - RNA, 18 nt, Mycobacterium avium subsp. paratuberculosis
aggucgaccggcucgccg

SEQ ID NO: 870881 - RNA, 19 nt, Mycobacterium avium subsp. paratuberculosis
aggucgaccggcucgccgu

SEQ ID NO: 870882 - RNA, 18 nt, Mycobacterium avium subsp. paratuberculosis
aggucgacggagucgucg

SEQ ID NO: 870883 - RNA, 19 nt, Mycobacterium avium subsp. paratuberculosis
aggucgacggagucgucgg

SEQ ID NO: 870884 - RNA, 22 nt, Mycobacterium avium subsp. paratuberculosis
aggucgcacaccagcacggcgg

SEQ ID NO: 870885 - RNA, 19 nt, Mycobacterium avium subsp. paratuberculosis
aggucgacggggucggaca

SEQ ID NO: 870886 - RNA, 20 nt, Mycobacterium avium subsp. paratuberculosis
aggucgacggggucggacag

SEQ ID NO: 870887 - RNA, 16 nt, Mycobacterium avium subsp. paratuberculosis
aggucgagcaccaggu

SEQ ID NO: 870888 - RNA, 17 nt, Mycobacterium avium subsp. paratuberculosis
aggucgaggccggccag

SEQ ID NO: 870889 - RNA, 22 nt, Mycobacterium avium subsp. paratuberculosis
aggucgaggccggccagcgggu

SEQ ID NO: 870890 - RNA, 17 nt, Mycobacterium avium subsp. paratuberculosis
aggucgaucucggccag

SEQ ID NO: 870891 - RNA, 15 nt, Mycobacterium avium subsp. paratuberculosis
aggucggccgcggcc

SEQ ID NO: 870892 - RNA, 16 nt, Mycobacterium avium subsp. paratuberculosis
aggucggccgcggccg

SEQ ID NO: 870893 - RNA, 20 nt, Mycobacterium avium subsp. paratuberculosis
aggucggccgcggccggcgg

SEQ ID NO: 870894 - RNA, 14 nt, Mycobacterium avium subsp. paratuberculosis
aggucggccagcgc

SEQ ID NO: 870895 - RNA, 15 nt, Mycobacterium avium subsp. paratuberculosis
aggucggccagcgcc

SEQ ID NO: 870896 - RNA, 18 nt, Mycobacterium avium subsp. paratuberculosis
aggucggccagcgccgcc

SEQ ID NO: 870897 - RNA, 20 nt, Mycobacterium avium subsp. paratuberculosis
aggucggccagcgccgcccg

SEQ ID NO: 870898 - RNA, 16 nt, Mycobacterium avium subsp. paratuberculosis
aggucggccagcugcg

SEQ ID NO: 870899 - RNA, 20 nt, Mycobacterium avium subsp. paratuberculosis
aggucggccagcugcggguu

SEQ ID NO: 870900 - RNA, 22 nt, Mycobacterium avium subsp. paratuberculosis
aggcguuggucaccaucagcgg

SEQ ID NO: 870901 - RNA, 13 nt, Mycobacterium avium subsp. paratuberculosis
aggcucacgcugc

SEQ ID NO: 870902 - RNA, 18 nt, Mycobacterium avium subsp. paratuberculosis
aggcucaggaucagcagc

SEQ ID NO: 870903 - RNA, 18 nt, Mycobacterium avium subsp. paratuberculosis
aggcucaggccgguggcg

SEQ ID NO: 870904 - RNA, 16 nt, Mycobacterium avium subsp. paratuberculosis
aggcucgccacgcgua

SEQ ID NO: 870905 - RNA, 23 nt, Mycobacterium avium subsp. paratuberculosis
aggcuggcggcgaucaccgccgc

SEQ ID NO: 870906 - RNA, 21 nt, Mycobacterium avium subsp. paratuberculosis
aggcugacgcgaccgcgcggc

SEQ ID NO: 870907 - RNA, 22 nt, Mycobacterium avium subsp. paratuberculosis
aggcugaaucccuccggcaggc

SEQ ID NO: 870908 - RNA, 15 nt, Mycobacterium avium subsp. paratuberculosis
aggcugaacgucguc

SEQ ID NO: 870909 - RNA, 16 nt, Mycobacterium avium subsp. paratuberculosis
aggcucggcagccggc

SEQ ID NO: 870910 - RNA, 18 nt, Mycobacterium avium subsp. paratuberculosis
aggcguugaucacguugu

SEQ ID NO: 870911 - RNA, 21 nt, Mycobacterium avium subsp. paratuberculosis
aggcguugcgucccgcgccgg

SEQ ID NO: 870912 - RNA, 22 nt, Mycobacterium avium subsp. paratuberculosis
aggcguugcgucccgcgccgga

SEQ ID NO: 870913 - RNA, 18 nt, Mycobacterium avium subsp. paratuberculosis
aggcguuggagccgacca

SEQ ID NO: 870914 - RNA, 17 nt, Mycobacterium avium subsp. paratuberculosis
aggcguucgaccccaac

SEQ ID NO: 870915 - RNA, 22 nt, Mycobacterium avium subsp. paratuberculosis
aggcguccagggccaccgcguc

SEQ ID NO: 870916 - RNA, 13 nt, Mycobacterium avium subsp. paratuberculosis
aggcguccagcac

SEQ ID NO: 870917 - RNA, 15 nt, Mycobacterium avium subsp. paratuberculosis
aggcguccagccagc

SEQ ID NO: 870918 - RNA, 22 nt, Mycobacterium avium subsp. paratuberculosis
aggcguccuccucguccgcggc

SEQ ID NO: 870919 - RNA, 17 nt, Mycobacterium avium subsp. paratuberculosis
aggcguagugcgcccag

SEQ ID NO: 870920 - RNA, 15 nt, Mycobacterium avium subsp. paratuberculosis
aggcgguuucaccga

SEQ ID NO: 870921 - RNA, 23 nt, Mycobacterium avium subsp. paratuberculosis
aggcguacaccagggugccgccg

SEQ ID NO: 870922 - RNA, 15 nt, Mycobacterium avium subsp. paratuberculosis
aggcgggcacacgcg

SEQ ID NO: 870923 - RNA, 22 nt, Mycobacterium avium subsp. paratuberculosis
aggcggggguucguugcgccgc

SEQ ID NO: 870924 - RNA, 15 nt, Mycobacterium avium subsp. paratuberculosis
aggcgggccagcucg

SEQ ID NO: 870925 - RNA, 17 nt, Mycobacterium avium subsp. paratuberculosis
aggcgguuccgguggcg

SEQ ID NO: 870926 - RNA, 12 nt, Mycobacterium avium subsp. paratuberculosis
aggcggucgacu

SEQ ID NO: 870927 - RNA, 21 nt, Mycobacterium avium subsp. paratuberculosis
aggcgggugaggacgcccggc

SEQ ID NO: 870928 - RNA, 12 nt, Mycobacterium avium subsp. paratuberculosis
aggcggccgcga

SEQ ID NO: 870929 - RNA, 23 nt, Mycobacterium avium subsp. paratuberculosis
aggcggcgugccagggcagcgcg

SEQ ID NO: 870930 - RNA, 18 nt, Mycobacterium avium subsp. paratuberculosis
aggcggcguagucggcgc

SEQ ID NO: 870931 - RNA, 17 nt, Mycobacterium avium subsp. paratuberculosis
aggcggcgucgaugucg

SEQ ID NO: 870932 - RNA, 18 nt, Mycobacterium avium subsp. paratuberculosis
aggcggcgccggccgggc

SEQ ID NO: 870933 - RNA, 14 nt, Mycobacterium avium subsp. paratuberculosis
aggcggcgcgcagc

SEQ ID NO: 870934 - RNA, 22 nt, Mycobacterium avium subsp. paratuberculosis
aggcggcgagauuggccucggc

SEQ ID NO: 870935 - RNA, 18 nt, Mycobacterium avium subsp. paratuberculosis
aggcggcgagcugaucgg

SEQ ID NO: 870936 - RNA, 20 nt, Mycobacterium avium subsp. paratuberculosis
aggcggcgacgaacgccggc

SEQ ID NO: 870937 - RNA, 21 nt, Mycobacterium avium subsp. paratuberculosis
aggcggccggcccggcccgac

SEQ ID NO: 870938 - RNA, 12 nt, Mycobacterium avium subsp. paratuberculosis
aggcggccgggc

SEQ ID NO: 870939 - RNA, 14 nt, Mycobacterium avium subsp. paratuberculosis
aggcggccagcgcc

SEQ ID NO: 870940 - RNA, 21 nt, Mycobacterium avium subsp. paratuberculosis
aggcggccagcgcccgcgggu

SEQ ID NO: 870941 - RNA, 20 nt, Mycobacterium avium subsp. paratuberculosis
aggcggccagcucccgggcg

SEQ ID NO: 870942 - RNA, 19 nt, Mycobacterium avium subsp. paratuberculosis
aggcggccagggcggcgcc

SEQ ID NO: 870943 - RNA, 22 nt, Mycobacterium avium subsp. paratuberculosis
aggcggccagggcggcgccggc

SEQ ID NO: 870944 - RNA, 13 nt, Mycobacterium avium subsp. paratuberculosis
aggcggccaccgc

SEQ ID NO: 870945 - RNA, 16 nt, Mycobacterium avium subsp. paratuberculosis
aggcggccaccgcggc

SEQ ID NO: 870946 - RNA, 14 nt, Mycobacterium avium subsp. paratuberculosis
aggcggccagcagc

SEQ ID NO: 870947 - RNA, 15 nt, Mycobacterium avium subsp. paratuberculosis
aggcggccagcagca

SEQ ID NO: 870948 - RNA, 14 nt, Mycobacterium avium subsp. paratuberculosis
agggcuccgcgcug

SEQ ID NO: 870949 - RNA, 16 nt, Mycobacterium avium subsp. paratuberculosis
agggcuccgcgcugac

SEQ ID NO: 870950 - RNA, 21 nt, Mycobacterium avium subsp. paratuberculosis
agggcuccgcgcugaccagcg

SEQ ID NO: 870951 - RNA, 14 nt, Mycobacterium avium subsp. paratuberculosis
agggcgugcgcggc

SEQ ID NO: 870952 - RNA, 18 nt, Mycobacterium avium subsp. paratuberculosis
agggcguggaacgcgucg

SEQ ID NO: 870953 - RNA, 16 nt, Mycobacterium avium subsp. paratuberculosis
agggcguucgacgucc

SEQ ID NO: 870954 - RNA, 13 nt, Mycobacterium avium subsp. paratuberculosis
agggcguugauca

SEQ ID NO: 870955 - RNA, 13 nt, Mycobacterium avium subsp. paratuberculosis
agggcgucgagcg

SEQ ID NO: 870956 - RNA, 20 nt, Mycobacterium avium subsp. paratuberculosis
agggcgccguuguaggccgc

SEQ ID NO: 870957 - RNA, 16 nt, Mycobacterium avium subsp. paratuberculosis
agggcgguggcggcga

SEQ ID NO: 870958 - RNA, 14 nt, Mycobacterium avium subsp. paratuberculosis
agggcgcgcagcga

SEQ ID NO: 870959 - RNA, 16 nt, Mycobacterium avium subsp. paratuberculosis
agggcgccgucggcgg

SEQ ID NO: 870960 - RNA, 15 nt, Mycobacterium avium subsp. paratuberculosis
agggcucggcgucgu

SEQ ID NO: 870961 - RNA, 22 nt, Mycobacterium avium subsp. paratuberculosis
agggucgagacaccgucgcgca

SEQ ID NO: 870962 - RNA, 17 nt, Mycobacterium avium subsp. paratuberculosis
aggggcgcgcgccggga

SEQ ID NO: 870963 - RNA, 16 nt, Mycobacterium avium subsp. paratuberculosis
aggggaacaacgcgca

SEQ ID NO: 870964 - RNA, 13 nt, Mycobacterium avium subsp. paratuberculosis
agggccagcggca

SEQ ID NO: 870965 - RNA, 16 nt, Mycobacterium avium subsp. paratuberculosis
agggccagcaccauga

SEQ ID NO: 870966 - RNA, 20 nt, Mycobacterium avium subsp. paratuberculosis
aggcugugggccagcagcgu

SEQ ID NO: 870967 - RNA, 22 nt, Mycobacterium avium subsp. paratuberculosis
agggcgauaaccucggcggcgg

SEQ ID NO: 870968 - RNA, 17 nt, Mycobacterium avium subsp. paratuberculosis
agggcgaucaccgcggc

SEQ ID NO: 870969 - RNA, 22 nt, Mycobacterium avium subsp. paratuberculosis
agggcgagcucguucucggcga

SEQ ID NO: 870970 - RNA, 14 nt, Mycobacterium avium subsp. paratuberculosis
agggcgaggacggc

SEQ ID NO: 870971 - RNA, 21 nt, Mycobacterium avium subsp. paratuberculosis
agggccgaaaaaccugcggug

SEQ ID NO: 870972 - RNA, 16 nt, Mycobacterium avium subsp. paratuberculosis
agggcccgcagccgcu

SEQ ID NO: 870973 - RNA, 20 nt, Mycobacterium avium subsp. paratuberculosis
agggcccgcagccgcuggcc

SEQ ID NO: 870974 - RNA, 14 nt, Mycobacterium avium subsp. paratuberculosis
agggcccgccggug

SEQ ID NO: 870975 - RNA, 19 nt, Mycobacterium avium subsp. paratuberculosis
agggccauccggccggcga

SEQ ID NO: 870976 - RNA, 15 nt, Mycobacterium avium subsp. paratuberculosis
agggccgccgcugga

SEQ ID NO: 870977 - RNA, 14 nt, Mycobacterium avium subsp. paratuberculosis
agggccgccgcaua

SEQ ID NO: 870978 - RNA, 22 nt, Mycobacterium avium subsp. paratuberculosis
agggccgccgcauaccgcccgc

SEQ ID NO: 870979 - RNA, 20 nt, Mycobacterium avium subsp. paratuberculosis
aggccagcacgccggucagc

SEQ ID NO: 870980 - RNA, 12 nt, Mycobacterium avium subsp. paratuberculosis
aggccagcaccc

SEQ ID NO: 870981 - RNA, 23 nt, Mycobacterium avium subsp. paratuberculosis
aggccagcacccggucggugagc

SEQ ID NO: 870982 - RNA, 12 nt, Mycobacterium avium subsp. paratuberculosis
aggccagcaccu

SEQ ID NO: 870983 - RNA, 22 nt, Mycobacterium avium subsp. paratuberculosis
aggccagcaccuggcgcaccgc

SEQ ID NO: 870984 - RNA, 14 nt, Mycobacterium avium subsp. paratuberculosis
aggccagcacgcag

SEQ ID NO: 870985 - RNA, 21 nt, Mycobacterium avium subsp. paratuberculosis
aggcauuccaccgcgcggcgc

SEQ ID NO: 870986 - RNA, 17 nt, Mycobacterium avium subsp. paratuberculosis
aggccagcagcgcggcg

SEQ ID NO: 870987 - RNA, 16 nt, Mycobacterium avium subsp. paratuberculosis
aggccagcccggcgug

SEQ ID NO: 870988 - RNA, 20 nt, Mycobacterium avium subsp. paratuberculosis
aggcccagcgaggcggccag

SEQ ID NO: 870989 - RNA, 16 nt, Mycobacterium avium subsp. paratuberculosis
aggccagcgcgaucgc

SEQ ID NO: 870990 - RNA, 12 nt, Mycobacterium avium subsp. paratuberculosis
agcuggccgccc

SEQ ID NO: 870991 - RNA, 19 nt, Mycobacterium avium subsp. paratuberculosis
agcuggccgcccaccacga

SEQ ID NO: 870992 - RNA, 15 nt, Mycobacterium avium subsp. paratuberculosis
agcuggccgcgcagc

SEQ ID NO: 870993 - RNA, 22 nt, Mycobacterium avium subsp. paratuberculosis
agcuggaacaccacggccggca

SEQ ID NO: 870994 - RNA, 21 nt, Mycobacterium avium subsp. paratuberculosis
agcugcugucgaacaccgugc

SEQ ID NO: 870995 - RNA, 12 nt, Mycobacterium avium subsp. paratuberculosis
agcuggccaccg

SEQ ID NO: 870996 - RNA, 13 nt, Mycobacterium avium subsp. paratuberculosis
agcuggccaccgc

SEQ ID NO: 870997 - RNA, 19 nt, Mycobacterium avium subsp. paratuberculosis
agcuggagaggcccggcag

SEQ ID NO: 870998 - RNA, 13 nt, Mycobacterium avium subsp. paratuberculosis
aggcaggccggca

SEQ ID NO: 870999 - RNA, 15 nt, Mycobacterium avium subsp. paratuberculosis
aggcaggccggcagc

SEQ ID NO: 871000 - RNA, 21 nt, Mycobacterium avium subsp. paratuberculosis
aggcaggccggcagccggcgc

SEQ ID NO: 871001 - RNA, 22 nt, Mycobacterium avium subsp. paratuberculosis
aggcaggccggcagccggcgcg

SEQ ID NO: 871002 - RNA, 19 nt, Mycobacterium avium subsp. paratuberculosis
aggcaguuccaugucgacg

SEQ ID NO: 871003 - RNA, 18 nt, Mycobacterium avium subsp. paratuberculosis
aggcaguucgaugccggg

SEQ ID NO: 871004 - RNA, 23 nt, Mycobacterium avium subsp. paratuberculosis
aggcaguucgaugccgggcaugg

SEQ ID NO: 871005 - RNA, 13 nt, Mycobacterium avium subsp. paratuberculosis
aggcagcccggcu

SEQ ID NO: 871006 - RNA, 15 nt, Mycobacterium avium subsp. paratuberculosis
aggccguaucccacc

SEQ ID NO: 871007 - RNA, 20 nt, Mycobacterium avium subsp. paratuberculosis
aggccguaucccaccacgaa

SEQ ID NO: 871008 - RNA, 16 nt, Mycobacterium avium subsp. paratuberculosis
aggccguagagcacga

SEQ ID NO: 871009 - RNA, 17 nt, Mycobacterium avium subsp. paratuberculosis
aggccguagcgagcgcu

SEQ ID NO: 871010 - RNA, 14 nt, Mycobacterium avium subsp. paratuberculosis
aggccgucggcgcg

SEQ ID NO: 871011 - RNA, 20 nt, Mycobacterium avium subsp. paratuberculosis
aggccgucggcgcggccgga

SEQ ID NO: 871012 - RNA, 18 nt, Mycobacterium avium subsp. paratuberculosis
aggccgucggggaugccg

SEQ ID NO: 871013 - RNA, 13 nt, Mycobacterium avium subsp. paratuberculosis
aggccgucgccgg

SEQ ID NO: 871014 - RNA, 14 nt, Mycobacterium avium subsp. paratuberculosis
aggccgucgccggu

SEQ ID NO: 871015 - RNA, 14 nt, Mycobacterium avium subsp. paratuberculosis
aggccguccagcag

SEQ ID NO: 871016 - RNA, 16 nt, Mycobacterium avium subsp. paratuberculosis
aggccguccagcagca

SEQ ID NO: 871017 - RNA, 20 nt, Mycobacterium avium subsp. paratuberculosis
aggccgucgaggcgcugcag

SEQ ID NO: 871018 - RNA, 14 nt, Mycobacterium avium subsp. paratuberculosis
aggccgggcuggcg

SEQ ID NO: 871019 - RNA, 16 nt, Mycobacterium avium subsp. paratuberculosis
aggccgggcuggcgcu

SEQ ID NO: 871020 - RNA, 20 nt, Mycobacterium avium subsp. paratuberculosis
aggccgggcuggcgcuggau

SEQ ID NO: 871021 - RNA, 16 nt, Mycobacterium avium subsp. paratuberculosis
aggccgggcugguccg

SEQ ID NO: 871022 - RNA, 21 nt, Mycobacterium avium subsp. paratuberculosis
aggccgggcugguccggaacc

SEQ ID NO: 871023 - RNA, 18 nt, Mycobacterium avium subsp. paratuberculosis
aggccggucacccaggcc

SEQ ID NO: 871024 - RNA, 19 nt, Mycobacterium avium subsp. paratuberculosis
aggccggccagcgggucgu

SEQ ID NO: 871025 - RNA, 16 nt, Mycobacterium avium subsp. paratuberculosis
aggccggccaccaggu

SEQ ID NO: 871026 - RNA, 21 nt, Mycobacterium avium subsp. paratuberculosis
aggccgcgcugaacgcggugg

SEQ ID NO: 871027 - RNA, 17 nt, Mycobacterium avium subsp. paratuberculosis
aggccggcgguggugcc

SEQ ID NO: 871028 - RNA, 20 nt, Mycobacterium avium subsp. paratuberculosis
aggccgggcagugcgcggcg

SEQ ID NO: 871029 - RNA, 22 nt, Mycobacterium avium subsp. paratuberculosis
aggccgggcagugcgcggcguc

SEQ ID NO: 871030 - RNA, 15 nt, Mycobacterium avium subsp. paratuberculosis
aggccggcgccgcgg

SEQ ID NO: 871031 - RNA, 17 nt, Mycobacterium avium subsp. paratuberculosis
aggccggcgccgcgggu

SEQ ID NO: 871032 - RNA, 13 nt, Mycobacterium avium subsp. paratuberculosis
aggccggcgccgg

SEQ ID NO: 871033 - RNA, 14 nt, Mycobacterium avium subsp. paratuberculosis
aggccggcgacgcc

SEQ ID NO: 871034 - RNA, 21 nt, Mycobacterium avium subsp. paratuberculosis
aggccggcgagcucgcggccg

SEQ ID NO: 871035 - RNA, 19 nt, Mycobacterium avium subsp. paratuberculosis
aggccggccgcagcugcug

SEQ ID NO: 871036 - RNA, 23 nt, Mycobacterium avium subsp. paratuberculosis
aggccgccgcauuccucggccag

SEQ ID NO: 871037 - RNA, 22 nt, Mycobacterium avium subsp. paratuberculosis
aggccgccgccaccgucgccgg

SEQ ID NO: 871038 - RNA, 12 nt, Mycobacterium avium subsp. paratuberculosis
aggccgccgcga

SEQ ID NO: 871039 - RNA, 22 nt, Mycobacterium avium subsp. paratuberculosis
aggccgccgcgaccgucagcag

SEQ ID NO: 871040 - RNA, 15 nt, Mycobacterium avium subsp. paratuberculosis
aggccgaggcugacg

SEQ ID NO: 871041 - RNA, 15 nt, Mycobacterium avium subsp. paratuberculosis
aggccgaggcugucg

SEQ ID NO: 871042 - RNA, 17 nt, Mycobacterium avium subsp. paratuberculosis
aggccgaggucggucgc

SEQ ID NO: 871043 - RNA, 23 nt, Mycobacterium avium subsp. paratuberculosis
aggccgaggucggucgcggcauc

SEQ ID NO: 871044 - RNA, 23 nt, Mycobacterium avium subsp. paratuberculosis
aggcccgguugagugcgccgugc

SEQ ID NO: 871045 - RNA, 14 nt, Mycobacterium avium subsp. paratuberculosis
aggccgacgcuggc

SEQ ID NO: 871046 - RNA, 23 nt, Mycobacterium avium subsp. paratuberculosis
aggccgacgugcuuggccagcuc

SEQ ID NO: 871047 - RNA, 14 nt, Mycobacterium avium subsp. paratuberculosis
aggcccgggcggcg

SEQ ID NO: 871048 - RNA, 19 nt, Mycobacterium avium subsp. paratuberculosis
aggccgacgccggccacca

SEQ ID NO: 871049 - RNA, 22 nt, Mycobacterium avium subsp. paratuberculosis
aggccgagcgcaagggccgaca

SEQ ID NO: 871050 - RNA, 13 nt, Mycobacterium avium subsp. paratuberculosis
aggccgagcgcgc

SEQ ID NO: 871051 - RNA, 14 nt, Mycobacterium avium subsp. paratuberculosis
aggccgagcgcgcu

SEQ ID NO: 871052 - RNA, 16 nt, Mycobacterium avium subsp. paratuberculosis
aggccgagcgcgcugg

SEQ ID NO: 871053 - RNA, 17 nt, Mycobacterium avium subsp. paratuberculosis
aggccgcgacgggcugu

SEQ ID NO: 871054 - RNA, 16 nt, Mycobacterium avium subsp. paratuberculosis
aggccgcgccgggcga

SEQ ID NO: 871055 - RNA, 14 nt, Mycobacterium avium subsp. paratuberculosis
aggccgcgccgugc

SEQ ID NO: 871056 - RNA, 15 nt, Mycobacterium avium subsp. paratuberculosis
aggccgcgccgugcg

SEQ ID NO: 871057 - RNA, 15 nt, Mycobacterium avium subsp. paratuberculosis
aggccgcgccgauca

SEQ ID NO: 871058 - RNA, 20 nt, Mycobacterium avium subsp. paratuberculosis
aggccgccugcccgggcgcc

SEQ ID NO: 871059 - RNA, 22 nt, Mycobacterium avium subsp. paratuberculosis
aggccgccugcccgggcgccga

SEQ ID NO: 871060 - RNA, 23 nt, Mycobacterium avium subsp. paratuberculosis
aggccgccugcccgggcgccgag

SEQ ID NO: 871061 - RNA, 17 nt, Mycobacterium avium subsp. paratuberculosis
aggccgccgggccgccg

SEQ ID NO: 871062 - RNA, 12 nt, Mycobacterium avium subsp. paratuberculosis
aggccgcgcugg

SEQ ID NO: 871063 - RNA, 16 nt, Mycobacterium avium subsp. paratuberculosis
aggccgcgcuggccag

SEQ ID NO: 871064 - RNA, 14 nt, Mycobacterium avium subsp. paratuberculosis
aggccgcgcuggcg

SEQ ID NO: 871065 - RNA, 18 nt, Mycobacterium avium subsp. paratuberculosis
aggccgcugacaagcgca

SEQ ID NO: 871066 - RNA, 17 nt, Mycobacterium avium subsp. paratuberculosis
aggccgcugcccggcgc

SEQ ID NO: 871067 - RNA, 18 nt, Mycobacterium avium subsp. paratuberculosis
aggccgcugcccggcgcu

SEQ ID NO: 871068 - RNA, 19 nt, Mycobacterium avium subsp. paratuberculosis
aggccgcgggcguucauca

SEQ ID NO: 871069 - RNA, 13 nt, Mycobacterium avium subsp. paratuberculosis
aggccgcggucgc

SEQ ID NO: 871070 - RNA, 14 nt, Mycobacterium avium subsp. paratuberculosis
aggccgcggucgcc

SEQ ID NO: 871071 - RNA, 21 nt, Mycobacterium avium subsp. paratuberculosis
aggccgcggucgccccggccg

SEQ ID NO: 871072 - RNA, 23 nt, Mycobacterium avium subsp. paratuberculosis
aggccgcggucgccccggccgcg

SEQ ID NO: 871073 - RNA, 21 nt, Mycobacterium avium subsp. paratuberculosis
aggccgcguagcucgccgcgg

SEQ ID NO: 871074 - RNA, 19 nt, Mycobacterium avium subsp. paratuberculosis
aggccgcgcgggcggcguc

SEQ ID NO: 871075 - RNA, 20 nt, Mycobacterium avium subsp. paratuberculosis
aggccgcgcgggcggcgucg

SEQ ID NO: 871076 - RNA, 22 nt, Mycobacterium avium subsp. paratuberculosis
aggccgcgcgggcggcgucgua

SEQ ID NO: 871077 - RNA, 13 nt, Mycobacterium avium subsp. paratuberculosis
aggccgcgcggug

SEQ ID NO: 871078 - RNA, 18 nt, Mycobacterium avium subsp. paratuberculosis
aggccucuacucagccga

SEQ ID NO: 871079 - RNA, 16 nt, Mycobacterium avium subsp. paratuberculosis
aggccugcgcggccgc

SEQ ID NO: 871080 - RNA, 17 nt, Mycobacterium avium subsp. paratuberculosis
aggccugcgcggccgcg

SEQ ID NO: 871081 - RNA, 17 nt, Mycobacterium avium subsp. paratuberculosis
aggcgaaauaacccacc

SEQ ID NO: 871082 - RNA, 19 nt, Mycobacterium avium subsp. paratuberculosis
aggcgaacaccagcccggc

SEQ ID NO: 871083 - RNA, 21 nt, Mycobacterium avium subsp. paratuberculosis
aggccuugcugagccggcccu

SEQ ID NO: 871084 - RNA, 23 nt, Mycobacterium avium subsp. paratuberculosis
aggccuuggugaugggcagcgcc

SEQ ID NO: 871085 - RNA, 20 nt, Mycobacterium avium subsp. paratuberculosis
aggccuuccgcaacaucguc

SEQ ID NO: 871086 - RNA, 18 nt, Mycobacterium avium subsp. paratuberculosis
aggccgucucgagccggc

SEQ ID NO: 871087 - RNA, 20 nt, Mycobacterium avium subsp. paratuberculosis
aggccgucucgagccggcgc

SEQ ID NO: 871088 - RNA, 18 nt, Mycobacterium avium subsp. paratuberculosis
aggccgugaucggccagc

SEQ ID NO: 871089 - RNA, 16 nt, Mycobacterium avium subsp. paratuberculosis
aggccguuguccgucg

SEQ ID NO: 871090 - RNA, 17 nt, Mycobacterium avium subsp. paratuberculosis
aggccguuguccgucga

SEQ ID NO: 871091 - RNA, 21 nt, Mycobacterium avium subsp. paratuberculosis
aggccuccagguagacgaugc

SEQ ID NO: 871092 - RNA, 13 nt, Mycobacterium avium subsp. paratuberculosis
aggcgaugcccag

SEQ ID NO: 871093 - RNA, 15 nt, Mycobacterium avium subsp. paratuberculosis
aggcgaugccgccga

SEQ ID NO: 871094 - RNA, 16 nt, Mycobacterium avium subsp. paratuberculosis
aggcgauggcgucggc

SEQ ID NO: 871095 - RNA, 19 nt, Mycobacterium avium subsp. paratuberculosis
aggcgauggcgucggccag

SEQ ID NO: 871096 - RNA, 13 nt, Mycobacterium avium subsp. paratuberculosis
aggcgauggugcc

SEQ ID NO: 871097 - RNA, 18 nt, Mycobacterium avium subsp. paratuberculosis
aggcgauggugcccucgu

SEQ ID NO: 871098 - RNA, 15 nt, Mycobacterium avium subsp. paratuberculosis
aggcgauggugccgg

SEQ ID NO: 871099 - RNA, 17 nt, Mycobacterium avium subsp. paratuberculosis
aggcgauggugccggcc

SEQ ID NO: 871100 - RNA, 16 nt, Mycobacterium avium subsp. paratuberculosis
aggcgaugucgacgug

SEQ ID NO: 871101 - RNA, 22 nt, Mycobacterium avium subsp. paratuberculosis
aggcgaugucgacgugggcgcc

SEQ ID NO: 871102 - RNA, 21 nt, Mycobacterium avium subsp. paratuberculosis
aggcgaucaucgccccggaga

SEQ ID NO: 871103 - RNA, 14 nt, Mycobacterium avium subsp. paratuberculosis
aggcgaucgcggcc

SEQ ID NO: 871104 - RNA, 15 nt, Mycobacterium avium subsp. paratuberculosis
aggcgaucucgccga

SEQ ID NO: 871105 - RNA, 15 nt, Mycobacterium avium subsp. paratuberculosis
aggcgaggaccgaga

SEQ ID NO: 871106 - RNA, 19 nt, Mycobacterium avium subsp. paratuberculosis
aggcgagccgacagucgcg

SEQ ID NO: 871107 - RNA, 21 nt, Mycobacterium avium subsp. paratuberculosis
aggcgagcacggcacgcccgu

SEQ ID NO: 871108 - RNA, 15 nt, Mycobacterium avium subsp. paratuberculosis
aggcgacgucggucg

SEQ ID NO: 871109 - RNA, 17 nt, Mycobacterium avium subsp. paratuberculosis
aggcgacuguccaggcc

SEQ ID NO: 871110 - RNA, 16 nt, Mycobacterium avium subsp. paratuberculosis
aggcgaacauggcggc

SEQ ID NO: 871111 - RNA, 20 nt, Mycobacterium avium subsp. paratuberculosis
aggcgaacauggcggccagc

SEQ ID NO: 871112 - RNA, 15 nt, Mycobacterium avium subsp. paratuberculosis
aggcgaagagcggca

SEQ ID NO: 871113 - RNA, 16 nt, Mycobacterium avium subsp. paratuberculosis
aggcgaagagcggcac

SEQ ID NO: 871114 - RNA, 19 nt, Mycobacterium avium subsp. paratuberculosis
aggcgaaguuggucaccac

SEQ ID NO: 871115 - RNA, 19 nt, Mycobacterium avium subsp. paratuberculosis
aggcgaaucggcgcacagc

SEQ ID NO: 871116 - RNA, 17 nt, Mycobacterium avium subsp. paratuberculosis
aggcgaaugcggccaug

SEQ ID NO: 871117 - RNA, 15 nt, Mycobacterium avium subsp. paratuberculosis
aggcgaccaugccca

SEQ ID NO: 871118 - RNA, 17 nt, Mycobacterium avium subsp. paratuberculosis
aggcgaccaugcccagc

SEQ ID NO: 871119 - RNA, 19 nt, Mycobacterium avium subsp. paratuberculosis
aggcgaccaugcccagcag

SEQ ID NO: 871120 - RNA, 14 nt, Mycobacterium avium subsp. paratuberculosis
aggcgcgggcgucc

SEQ ID NO: 871121 - RNA, 20 nt, Mycobacterium avium subsp. paratuberculosis
aggcgcggguguugccggag

SEQ ID NO: 871122 - RNA, 13 nt, Mycobacterium avium subsp. paratuberculosis
aggcgcggcgcga

SEQ ID NO: 871123 - RNA, 15 nt, Mycobacterium avium subsp. paratuberculosis
aggcgcucggcccgc

SEQ ID NO: 871124 - RNA, 17 nt, Mycobacterium avium subsp. paratuberculosis
aggcggaccugggugcg

SEQ ID NO: 871125 - RNA, 16 nt, Mycobacterium avium subsp. paratuberculosis
aggcggacggcgaccu

SEQ ID NO: 871126 - RNA, 15 nt, Mycobacterium avium subsp. paratuberculosis
aggcggaucggcccg

SEQ ID NO: 871127 - RNA, 16 nt, Mycobacterium avium subsp. paratuberculosis
aggcgcgaaagcgcga

SEQ ID NO: 871128 - RNA, 18 nt, Mycobacterium avium subsp. paratuberculosis
aggcgcgcagcaggcgcc

SEQ ID NO: 871129 - RNA, 20 nt, Mycobacterium avium subsp. paratuberculosis
aggcgcgcagguagccgccg

SEQ ID NO: 871130 - RNA, 14 nt, Mycobacterium avium subsp. paratuberculosis
aggcgcgccgagcg

SEQ ID NO: 871131 - RNA, 14 nt, Mycobacterium avium subsp. paratuberculosis
aggcgccgucgaug

SEQ ID NO: 871132 - RNA, 17 nt, Mycobacterium avium subsp. paratuberculosis
aggcgccgucgauggcg

SEQ ID NO: 871133 - RNA, 13 nt, Mycobacterium avium subsp. paratuberculosis
aggcgccggcgcg

SEQ ID NO: 871134 - RNA, 14 nt, Mycobacterium avium subsp. paratuberculosis
aggcgccggcgcgg

SEQ ID NO: 871135 - RNA, 16 nt, Mycobacterium avium subsp. paratuberculosis
aggcgccggcgcgggg

SEQ ID NO: 871136 - RNA, 12 nt, Mycobacterium avium subsp. paratuberculosis
aggcgccgccgc

SEQ ID NO: 871137 - RNA, 21 nt, Mycobacterium avium subsp. paratuberculosis
aggcgccgaugcccgccccgg

SEQ ID NO: 871138 - RNA, 14 nt, Mycobacterium avium subsp. paratuberculosis
aggcgcagcccgag

SEQ ID NO: 871139 - RNA, 13 nt, Mycobacterium avium subsp. paratuberculosis
aggcgcagccagc

SEQ ID NO: 871140 - RNA, 18 nt, Mycobacterium avium subsp. paratuberculosis
aggcgcaccgccaccgcg

SEQ ID NO: 871141 - RNA, 14 nt, Mycobacterium avium subsp. paratuberculosis
aggcgcaccgccgg

SEQ ID NO: 871142 - RNA, 17 nt, Mycobacterium avium subsp. paratuberculosis
aggcgcaccgccgggca

SEQ ID NO: 871143 - RNA, 14 nt, Mycobacterium avium subsp. paratuberculosis
aggcgcccagcacc

SEQ ID NO: 871144 - RNA, 19 nt, Mycobacterium avium subsp. paratuberculosis
aggcgccauugucggaucg

SEQ ID NO: 871145 - RNA, 17 nt, Mycobacterium avium subsp. paratuberculosis
aggcgccacaacugguc

SEQ ID NO: 871146 - RNA, 15 nt, Mycobacterium avium subsp. paratuberculosis
aggcgccacagcagc

SEQ ID NO: 871147 - RNA, 18 nt, Mycobacterium avium subsp. paratuberculosis
aggcgcaugccagaccac

SEQ ID NO: 871148 - RNA, 20 nt, Mycobacterium avium subsp. paratuberculosis
agcacgcugaagcccaccgc

SEQ ID NO: 871149 - RNA, 22 nt, Mycobacterium avium subsp. paratuberculosis
agcacgcggaucgcgcugacca

SEQ ID NO: 871150 - RNA, 14 nt, Mycobacterium avium subsp. paratuberculosis
agcacgcggccgcg

SEQ ID NO: 871151 - RNA, 15 nt, Mycobacterium avium subsp. paratuberculosis
agcacgcggccgcgc

SEQ ID NO: 871152 - RNA, 19 nt, Mycobacterium avium subsp. paratuberculosis
agcacgcggccgcgccggc

SEQ ID NO: 871153 - RNA, 12 nt, Mycobacterium avium subsp. paratuberculosis
agcacggcacgc

SEQ ID NO: 871154 - RNA, 20 nt, Mycobacterium avium subsp. paratuberculosis
agcacggcauagauaccggc

SEQ ID NO: 871155 - RNA, 16 nt, Mycobacterium avium subsp. paratuberculosis
agcacggccaccagca

SEQ ID NO: 871156 - RNA, 20 nt, Mycobacterium avium subsp. paratuberculosis
agcacggccaccagcagcga

SEQ ID NO: 871157 - RNA, 19 nt, Mycobacterium avium subsp. paratuberculosis
agcacggccacugccccgg

SEQ ID NO: 871158 - RNA, 15 nt, Mycobacterium avium subsp. paratuberculosis
agcacggccagccag

SEQ ID NO: 871159 - RNA, 16 nt, Mycobacterium avium subsp. paratuberculosis
agcacggccagccagc

SEQ ID NO: 871160 - RNA, 20 nt, Mycobacterium avium subsp. paratuberculosis
agcacggccagccagccgcc

SEQ ID NO: 871161 - RNA, 23 nt, Mycobacterium avium subsp. paratuberculosis
agcacggccagccagccgcccag

SEQ ID NO: 871162 - RNA, 13 nt, Mycobacterium avium subsp. paratuberculosis
agcacggccgcgg

SEQ ID NO: 871163 - RNA, 13 nt, Mycobacterium avium subsp. paratuberculosis
agcacgccgcgga

SEQ ID NO: 871164 - RNA, 17 nt, Mycobacterium avium subsp. paratuberculosis
agcacgccggccggcgu

SEQ ID NO: 871165 - RNA, 13 nt, Mycobacterium avium subsp. paratuberculosis
agcacgccgggca

SEQ ID NO: 871166 - RNA, 14 nt, Mycobacterium avium subsp. paratuberculosis
agcacgccggucag

SEQ ID NO: 871167 - RNA, 22 nt, Mycobacterium avium subsp. paratuberculosis
agcacgccguccuuggccgcca

SEQ ID NO: 871168 - RNA, 15 nt, Mycobacterium avium subsp. paratuberculosis
agcacgccgccggug

SEQ ID NO: 871169 - RNA, 19 nt, Mycobacterium avium subsp. paratuberculosis
agcacgcccuggaaggcga

SEQ ID NO: 871170 - RNA, 15 nt, Mycobacterium avium subsp. paratuberculosis
agcacgcccagaucg

SEQ ID NO: 871171 - RNA, 20 nt, Mycobacterium avium subsp. paratuberculosis
agcaccucgaagccgacguc

SEQ ID NO: 871172 - RNA, 19 nt, Mycobacterium avium subsp. paratuberculosis
agcacgcccucggcuuccg

SEQ ID NO: 871173 - RNA, 22 nt, Mycobacterium avium subsp. paratuberculosis
agcaccugcucgaugcgcgcca

SEQ ID NO: 871174 - RNA, 18 nt, Mycobacterium avium subsp. paratuberculosis
agcaccuggcgcaccgcc

SEQ ID NO: 871175 - RNA, 23 nt, Mycobacterium avium subsp. paratuberculosis
agcaccuggcgcaccgccgcggg

SEQ ID NO: 871176 - RNA, 21 nt, Mycobacterium avium subsp. paratuberculosis
agcaccuucagcgggcgcagc

SEQ ID NO: 871177 - RNA, 18 nt, Mycobacterium avium subsp. paratuberculosis
agcaccuuccaucgacgc

SEQ ID NO: 871178 - RNA, 16 nt, Mycobacterium avium subsp. paratuberculosis
agcaccucgcgcagca

SEQ ID NO: 871179 - RNA, 23 nt, Mycobacterium avium subsp. paratuberculosis
agcaccucgcgcagcaccgaugc

SEQ ID NO: 871180 - RNA, 16 nt, Mycobacterium avium subsp. paratuberculosis
agcaccucgcgcgcga

SEQ ID NO: 871181 - RNA, 16 nt, Mycobacterium avium subsp. paratuberculosis
agcaccucggcgacca

SEQ ID NO: 871182 - RNA, 13 nt, Mycobacterium avium subsp. paratuberculosis
agcaccucgucgc

SEQ ID NO: 871183 - RNA, 14 nt, Mycobacterium avium subsp. paratuberculosis
agcaccucgucgcc

SEQ ID NO: 871184 - RNA, 20 nt, Mycobacterium avium subsp. paratuberculosis
agcaccucgucgcccggcgu

SEQ ID NO: 871185 - RNA, 16 nt, Mycobacterium avium subsp. paratuberculosis
agcaccucgucgccgu

SEQ ID NO: 871186 - RNA, 17 nt, Mycobacterium avium subsp. paratuberculosis
agcaccugaacggccgc

SEQ ID NO: 871187 - RNA, 18 nt, Mycobacterium avium subsp. paratuberculosis
agcaccugaacggccgcg

SEQ ID NO: 871188 - RNA, 23 nt, Mycobacterium avium subsp. paratuberculosis
agcaccugaacggccgcgcagau

SEQ ID NO: 871189 - RNA, 20 nt, Mycobacterium avium subsp. paratuberculosis
agcaccugaccgucggccag

SEQ ID NO: 871190 - RNA, 15 nt, Mycobacterium avium subsp. paratuberculosis
agcacgacaccgacg

SEQ ID NO: 871191 - RNA, 19 nt, Mycobacterium avium subsp. paratuberculosis
agcacgacaccgacgacca

SEQ ID NO: 871192 - RNA, 19 nt, Mycobacterium avium subsp. paratuberculosis
agcacgaccacacccgcac

SEQ ID NO: 871193 - RNA, 16 nt, Mycobacterium avium subsp. paratuberculosis
agcacgaaggccgccg

SEQ ID NO: 871194 - RNA, 17 nt, Mycobacterium avium subsp. paratuberculosis
agcacgaaggccgccgg

SEQ ID NO: 871195 - RNA, 15 nt, Mycobacterium avium subsp. paratuberculosis
agcacgaacaccacg

SEQ ID NO: 871196 - RNA, 15 nt, Mycobacterium avium subsp. paratuberculosis
agcacgaacgcggcc

SEQ ID NO: 871197 - RNA, 18 nt, Mycobacterium avium subsp. paratuberculosis
agcacgaucccgccgccc

SEQ ID NO: 871198 - RNA, 14 nt, Mycobacterium avium subsp. paratuberculosis
agcacgaucgagcc

SEQ ID NO: 871199 - RNA, 17 nt, Mycobacterium avium subsp. paratuberculosis
agcacgaucgagccggu

SEQ ID NO: 871200 - RNA, 19 nt, Mycobacterium avium subsp. paratuberculosis
agcacgaucggguagacgu

SEQ ID NO: 871201 - RNA, 21 nt, Mycobacterium avium subsp. paratuberculosis
agcacgacgccgcugggcgug

SEQ ID NO: 871202 - RNA, 14 nt, Mycobacterium avium subsp. paratuberculosis
agcacgacgucgac

SEQ ID NO: 871203 - RNA, 15 nt, Mycobacterium avium subsp. paratuberculosis
agcacgacgucgacg

SEQ ID NO: 871204 - RNA, 16 nt, Mycobacterium avium subsp. paratuberculosis
agcacgacgucgacgu

SEQ ID NO: 871205 - RNA, 15 nt, Mycobacterium avium subsp. paratuberculosis
agcagaacgccauca

SEQ ID NO: 871206 - RNA, 20 nt, Mycobacterium avium subsp. paratuberculosis
agcagaacuucuccgccggc

SEQ ID NO: 871207 - RNA, 21 nt, Mycobacterium avium subsp. paratuberculosis
agcagaacuucuccgccggca

SEQ ID NO: 871208 - RNA, 20 nt, Mycobacterium avium subsp. paratuberculosis
agcagaccgaacccgggcgc

SEQ ID NO: 871209 - RNA, 14 nt, Mycobacterium avium subsp. paratuberculosis
agcagaccgccggu

SEQ ID NO: 871210 - RNA, 19 nt, Mycobacterium avium subsp. paratuberculosis
agcagaccgcgaucagccc

SEQ ID NO: 871211 - RNA, 21 nt, Mycobacterium avium subsp. paratuberculosis
agcagaccgcgaucagcccca

SEQ ID NO: 871212 - RNA, 22 nt, Mycobacterium avium subsp. paratuberculosis
agcagaccgcgaucagccccag

SEQ ID NO: 871213 - RNA, 18 nt, Mycobacterium avium subsp. paratuberculosis
agcacuucauggucgucg

SEQ ID NO: 871214 - RNA, 15 nt, Mycobacterium avium subsp. paratuberculosis
agcacucgcgggacg

SEQ ID NO: 871215 - RNA, 20 nt, Mycobacterium avium subsp. paratuberculosis
agcacucgcgggacggcggc

SEQ ID NO: 871216 - RNA, 22 nt, Mycobacterium avium subsp. paratuberculosis
agcacucgcgggacggcggcga

SEQ ID NO: 871217 - RNA, 23 nt, Mycobacterium avium subsp. paratuberculosis
agcacgugcccagcccgcgcgag

SEQ ID NO: 871218 - RNA, 17 nt, Mycobacterium avium subsp. paratuberculosis
agcacgugcccgccgug

SEQ ID NO: 871219 - RNA, 18 nt, Mycobacterium avium subsp. paratuberculosis
agcacguuguucaggucg

SEQ ID NO: 871220 - RNA, 17 nt, Mycobacterium avium subsp. paratuberculosis
agcacgucgggguggcc

SEQ ID NO: 871221 - RNA, 22 nt, Mycobacterium avium subsp. paratuberculosis
agcacgucgggguggccggcca

SEQ ID NO: 871222 - RNA, 23 nt, Mycobacterium avium subsp. paratuberculosis
agcacgucgggguggccggccag

SEQ ID NO: 871223 - RNA, 18 nt, Mycobacterium avium subsp. paratuberculosis
agcacgucgagcaccgcg

SEQ ID NO: 871224 - RNA, 18 nt, Mycobacterium avium subsp. paratuberculosis
agcacguccccgggcacc

SEQ ID NO: 871225 - RNA, 21 nt, Mycobacterium avium subsp. paratuberculosis
agcacguccccgggcaccccg

SEQ ID NO: 871226 - RNA, 19 nt, Mycobacterium avium subsp. paratuberculosis
agcacggugaucagcagca

SEQ ID NO: 871227 - RNA, 18 nt, Mycobacterium avium subsp. paratuberculosis
agcacggugaugcgggug

SEQ ID NO: 871228 - RNA, 22 nt, Mycobacterium avium subsp. paratuberculosis
agcacgguguugcgcacccgcg

SEQ ID NO: 871229 - RNA, 13 nt, Mycobacterium avium subsp. paratuberculosis
agcacgucaccgc

SEQ ID NO: 871230 - RNA, 14 nt, Mycobacterium avium subsp. paratuberculosis
agcacggcggcgcu

SEQ ID NO: 871231 - RNA, 18 nt, Mycobacterium avium subsp. paratuberculosis
agcacggucagcggccag

SEQ ID NO: 871232 - RNA, 22 nt, Mycobacterium avium subsp. paratuberculosis
agcacggcucguccaucagcag

SEQ ID NO: 871233 - RNA, 22 nt, Mycobacterium avium subsp. paratuberculosis
agcagacgugaaaucccccgac

SEQ ID NO: 871234 - RNA, 20 nt, Mycobacterium avium subsp. paratuberculosis
agcagacgcaaaaaccccca

SEQ ID NO: 871235 - RNA, 12 nt, Mycobacterium avium subsp. paratuberculosis
aaaccccgccgu

SEQ ID NO: 871236 - RNA, 16 nt, Mycobacterium avium subsp. paratuberculosis
aaaccgggccugcgcg

SEQ ID NO: 871237 - RNA, 12 nt, Mycobacterium avium subsp. paratuberculosis
aaaccggcgccg

SEQ ID NO: 871238 - RNA, 13 nt, Mycobacterium avium subsp. paratuberculosis
aaaccggcgccga

SEQ ID NO: 871239 - RNA, 17 nt, Mycobacterium avium subsp. paratuberculosis
agcagauccucagcagc

SEQ ID NO: 871240 - RNA, 18 nt, Mycobacterium avium subsp. paratuberculosis
agcagaucuuccaucacg

SEQ ID NO: 871241 - RNA, 14 nt, Mycobacterium avium subsp. paratuberculosis
agcagaugccgccc

SEQ ID NO: 871242 - RNA, 15 nt, Mycobacterium avium subsp. paratuberculosis
agcagaugcgcgucg

SEQ ID NO: 871243 - RNA, 15 nt, Mycobacterium avium subsp. paratuberculosis
agcagcaacgcggug

SEQ ID NO: 871244 - RNA, 23 nt, Mycobacterium avium subsp. paratuberculosis
agcagcaccacccgcaccucgcc

SEQ ID NO: 871245 - RNA, 13 nt, Mycobacterium avium subsp. paratuberculosis
agcagcaccccga

SEQ ID NO: 871246 - RNA, 12 nt, Mycobacterium avium subsp. paratuberculosis
agcagcacccga

SEQ ID NO: 871247 - RNA, 13 nt, Mycobacterium avium subsp. paratuberculosis
agcagcacccgac

SEQ ID NO: 871248 - RNA, 22 nt, Mycobacterium avium subsp. paratuberculosis
agcagcacccgacuucggcucg

SEQ ID NO: 871249 - RNA, 15 nt, Mycobacterium avium subsp. paratuberculosis
agcagcacccgggug

SEQ ID NO: 871250 - RNA, 15 nt, Mycobacterium avium subsp. paratuberculosis
agcagcaacggcggc

SEQ ID NO: 871251 - RNA, 16 nt, Mycobacterium avium subsp. paratuberculosis
agcagcaacggcggcg

SEQ ID NO: 871252 - RNA, 23 nt, Mycobacterium avium subsp. paratuberculosis
agcagcaccagaugcaccucgcc

SEQ ID NO: 871253 - RNA, 17 nt, Mycobacterium avium subsp. paratuberculosis
agcagcaccagcgccgc

SEQ ID NO: 871254 - RNA, 15 nt, Mycobacterium avium subsp. paratuberculosis
agcagcaccagcgcg

SEQ ID NO: 871255 - RNA, 24 nt, Mycobacterium avium subsp. paratuberculosis
agcagcaccaggcugaccagcgcc

SEQ ID NO: 871256 - RNA, 20 nt, Mycobacterium avium subsp. paratuberculosis
agcagcacgcccagcccgcg

SEQ ID NO: 871257 - RNA, 14 nt, Mycobacterium avium subsp. paratuberculosis
agcagcaccagggc

SEQ ID NO: 871258 - RNA, 12 nt, Mycobacterium avium subsp. paratuberculosis
agcagcaccgca

SEQ ID NO: 871259 - RNA, 14 nt, Mycobacterium avium subsp. paratuberculosis
agcagcaccgcaug

SEQ ID NO: 871260 - RNA, 12 nt, Mycobacterium avium subsp. paratuberculosis
agcagcaccgcg

SEQ ID NO: 871261 - RNA, 15 nt, Mycobacterium avium subsp. paratuberculosis
agcagcaccgcgacc

SEQ ID NO: 871262 - RNA, 17 nt, Mycobacterium avium subsp. paratuberculosis
agcagcaccggcaccgc

SEQ ID NO: 871263 - RNA, 14 nt, Mycobacterium avium subsp. paratuberculosis
agcagcaccggcgc

SEQ ID NO: 871264 - RNA, 18 nt, Mycobacterium avium subsp. paratuberculosis
agcagcaccggcgccucg

SEQ ID NO: 871265 - RNA, 15 nt, Mycobacterium avium subsp. paratuberculosis
agcagcagaccgccg

SEQ ID NO: 871266 - RNA, 16 nt, Mycobacterium avium subsp. paratuberculosis
agcagcagaccgccgg

SEQ ID NO: 871267 - RNA, 16 nt, Mycobacterium avium subsp. paratuberculosis
agcagcagaccgcgau

SEQ ID NO: 871268 - RNA, 17 nt, Mycobacterium avium subsp. paratuberculosis
agcagcacggcaauggu

SEQ ID NO: 871269 - RNA, 19 nt, Mycobacterium avium subsp. paratuberculosis
agcagcagaaccagcaccg

SEQ ID NO: 871270 - RNA, 20 nt, Mycobacterium avium subsp. paratuberculosis
agcagcagaaccagcaccgc

SEQ ID NO: 871271 - RNA, 21 nt, Mycobacterium avium subsp. paratuberculosis
agcagcagaaccagcaccgcc

SEQ ID NO: 871272 - RNA, 13 nt, Mycobacterium avium subsp. paratuberculosis
agcagcagcgccg

SEQ ID NO: 871273 - RNA, 22 nt, Mycobacterium avium subsp. paratuberculosis
agcagcaggucggccagcugcg

SEQ ID NO: 871274 - RNA, 17 nt, Mycobacterium avium subsp. paratuberculosis
agcagcaggucggcgug

SEQ ID NO: 871275 - RNA, 14 nt, Mycobacterium avium subsp. paratuberculosis
agcagcagcgcggc

SEQ ID NO: 871276 - RNA, 16 nt, Mycobacterium avium subsp. paratuberculosis
agcagcagcgcggugc

SEQ ID NO: 871277 - RNA, 17 nt, Mycobacterium avium subsp. paratuberculosis
agcagcagcgcggugcc

SEQ ID NO: 871278 - RNA, 19 nt, Mycobacterium avium subsp. paratuberculosis
agcagcagcgcggugccga

SEQ ID NO: 871279 - RNA, 15 nt, Mycobacterium avium subsp. paratuberculosis
agcagcagcggcagc

SEQ ID NO: 871280 - RNA, 12 nt, Mycobacterium avium subsp. paratuberculosis
agcagcagcgcc

SEQ ID NO: 871281 - RNA, 12 nt, Mycobacterium avium subsp. paratuberculosis
agcagcagcccg

SEQ ID NO: 871282 - RNA, 15 nt, Mycobacterium avium subsp. paratuberculosis
agcagcagccgcagc

SEQ ID NO: 871283 - RNA, 17 nt, Mycobacterium avium subsp. paratuberculosis
agcagcagccgccgggc

SEQ ID NO: 871284 - RNA, 13 nt, Mycobacterium avium subsp. paratuberculosis
agcagcagccgcg

SEQ ID NO: 871285 - RNA, 14 nt, Mycobacterium avium subsp. paratuberculosis
agcagcagccgcgc

SEQ ID NO: 871286 - RNA, 15 nt, Mycobacterium avium subsp. paratuberculosis
agcagcagccgcgcc

SEQ ID NO: 871287 - RNA, 13 nt, Mycobacterium avium subsp. paratuberculosis
agcagcccggcga

SEQ ID NO: 871288 - RNA, 15 nt, Mycobacterium avium subsp. paratuberculosis
agcagccccugcacc

SEQ ID NO: 871289 - RNA, 17 nt, Mycobacterium avium subsp. paratuberculosis
agcagccccugcaccac

SEQ ID NO: 871290 - RNA, 19 nt, Mycobacterium avium subsp. paratuberculosis
agcagccccugcaccacga

SEQ ID NO: 871291 - RNA, 23 nt, Mycobacterium avium subsp. paratuberculosis
agcagcccggccagccgggcggc

SEQ ID NO: 871292 - RNA, 16 nt, Mycobacterium avium subsp. paratuberculosis
agcagcaugccgagca

SEQ ID NO: 871293 - RNA, 18 nt, Mycobacterium avium subsp. paratuberculosis
agcagcaugccgagcacc

SEQ ID NO: 871294 - RNA, 23 nt, Mycobacterium avium subsp. paratuberculosis
agcagccacgacaccagcgucgc

SEQ ID NO: 871295 - RNA, 22 nt, Mycobacterium avium subsp. paratuberculosis
agcagccacgccagccaggcga

SEQ ID NO: 871296 - RNA, 19 nt, Mycobacterium avium subsp. paratuberculosis
agcagcagcgccgccaccg

SEQ ID NO: 871297 - RNA, 19 nt, Mycobacterium avium subsp. paratuberculosis
agcaaggucgucgcggcca

SEQ ID NO: 871298 - RNA, 15 nt, Mycobacterium avium subsp. paratuberculosis
agcaagucggcggug

SEQ ID NO: 871299 - RNA, 19 nt, Mycobacterium avium subsp. paratuberculosis
agcaagucggcggugaugc

SEQ ID NO: 871300 - RNA, 17 nt, Mycobacterium avium subsp. paratuberculosis
agcaacugcucgaccag

SEQ ID NO: 871301 - RNA, 15 nt, Mycobacterium avium subsp. paratuberculosis
agcaacggccgcagc

SEQ ID NO: 871302 - RNA, 16 nt, Mycobacterium avium subsp. paratuberculosis
agcaacgguacgugcg

SEQ ID NO: 871303 - RNA, 21 nt, Mycobacterium avium subsp. paratuberculosis
agcaacgguacgugcgccggc

SEQ ID NO: 871304 - RNA, 19 nt, Mycobacterium avium subsp. paratuberculosis
agcacaaaagggcccaugc

SEQ ID NO: 871305 - RNA, 13 nt, Mycobacterium avium subsp. paratuberculosis
agcaauugacgcc

SEQ ID NO: 871306 - RNA, 18 nt, Mycobacterium avium subsp. paratuberculosis
acuuucgcgagcgcgcuu

SEQ ID NO: 871307 - RNA, 18 nt, Mycobacterium avium subsp. paratuberculosis
agcaaaccgaccgccgcg

SEQ ID NO: 871308 - RNA, 21 nt, Mycobacterium avium subsp. paratuberculosis
agcaacauccugguccggcgc

SEQ ID NO: 871309 - RNA, 20 nt, Mycobacterium avium subsp. paratuberculosis
agcaaccccgcggugcacga

SEQ ID NO: 871310 - RNA, 17 nt, Mycobacterium avium subsp. paratuberculosis
agcaacccgaaagcccc

SEQ ID NO: 871311 - RNA, 19 nt, Mycobacterium avium subsp. paratuberculosis
agcaacccgaaagccccca

SEQ ID NO: 871312 - RNA, 14 nt, Mycobacterium avium subsp. paratuberculosis
agcaacccgccgag

SEQ ID NO: 871313 - RNA, 14 nt, Mycobacterium avium subsp. paratuberculosis
agcaaccggcggcu

SEQ ID NO: 871314 - RNA, 23 nt, Mycobacterium avium subsp. paratuberculosis
agcaaccggcggcugggcagccg

SEQ ID NO: 871315 - RNA, 20 nt, Mycobacterium avium subsp. paratuberculosis
agcaaccgggauaccgcgac

SEQ ID NO: 871316 - RNA, 23 nt, Mycobacterium avium subsp. paratuberculosis
agcaacgcgguguuggcggcguc

SEQ ID NO: 871317 - RNA, 14 nt, Mycobacterium avium subsp. paratuberculosis
agcaacggcggcgg

SEQ ID NO: 871318 - RNA, 21 nt, Mycobacterium avium subsp. paratuberculosis
agcaacggcggcggcaccgau

SEQ ID NO: 871319 - RNA, 18 nt, Mycobacterium avium subsp. paratuberculosis
agcaccgucugcgccguc

SEQ ID NO: 871320 - RNA, 20 nt, Mycobacterium avium subsp. paratuberculosis
agcaccguugugacccgcuc

SEQ ID NO: 871321 - RNA, 15 nt, Mycobacterium avium subsp. paratuberculosis
agcaccgucagccag

SEQ ID NO: 871322 - RNA, 13 nt, Mycobacterium avium subsp. paratuberculosis
agcaccgugccgu

SEQ ID NO: 871323 - RNA, 16 nt, Mycobacterium avium subsp. paratuberculosis
agcaccgugccgucgg

SEQ ID NO: 871324 - RNA, 19 nt, Mycobacterium avium subsp. paratuberculosis
agcaccgugccgucggcgu

SEQ ID NO: 871325 - RNA, 21 nt, Mycobacterium avium subsp. paratuberculosis
agcaccgugccgucggcgucg

SEQ ID NO: 871326 - RNA, 23 nt, Mycobacterium avium subsp. paratuberculosis
agcaccgggugauaccggcccag

SEQ ID NO: 871327 - RNA, 21 nt, Mycobacterium avium subsp. paratuberculosis
agcaccggggucugcacgaug

SEQ ID NO: 871328 - RNA, 17 nt, Mycobacterium avium subsp. paratuberculosis
agcaccggcggcagcga

SEQ ID NO: 871329 - RNA, 13 nt, Mycobacterium avium subsp. paratuberculosis
agcaccggcgccu

SEQ ID NO: 871330 - RNA, 17 nt, Mycobacterium avium subsp. paratuberculosis
agcaccggcgcgccgcg

SEQ ID NO: 871331 - RNA, 15 nt, Mycobacterium avium subsp. paratuberculosis
agcaccgggcccagc

SEQ ID NO: 871332 - RNA, 14 nt, Mycobacterium avium subsp. paratuberculosis
agcaccgggcgucg

SEQ ID NO: 871333 - RNA, 17 nt, Mycobacterium avium subsp. paratuberculosis
agcaccggcaccgccag

SEQ ID NO: 871334 - RNA, 20 nt, Mycobacterium avium subsp. paratuberculosis
agcaccggcaccgccagcca

SEQ ID NO: 871335 - RNA, 17 nt, Mycobacterium avium subsp. paratuberculosis
agcaccggcaccgcggc

SEQ ID NO: 871336 - RNA, 20 nt, Mycobacterium avium subsp. paratuberculosis
agcaccggcaccgcggcgau

SEQ ID NO: 871337 - RNA, 16 nt, Mycobacterium avium subsp. paratuberculosis
agcaccggaucgacca

SEQ ID NO: 871338 - RNA, 16 nt, Mycobacterium avium subsp. paratuberculosis
agcaccgcgcggcggu

SEQ ID NO: 871339 - RNA, 17 nt, Mycobacterium avium subsp. paratuberculosis
agcaccgcgcggcggug

SEQ ID NO: 871340 - RNA, 20 nt, Mycobacterium avium subsp. paratuberculosis
agcaccgcggccgucgcggc

SEQ ID NO: 871341 - RNA, 22 nt, Mycobacterium avium subsp. paratuberculosis
agcaccgcggccgucgcggcga

SEQ ID NO: 871342 - RNA, 15 nt, Mycobacterium avium subsp. paratuberculosis
agcaccgcggcgauc

SEQ ID NO: 871343 - RNA, 20 nt, Mycobacterium avium subsp. paratuberculosis
agcaccggcagcaccgccga

SEQ ID NO: 871344 - RNA, 16 nt, Mycobacterium avium subsp. paratuberculosis
agcaccggcagccgca

SEQ ID NO: 871345 - RNA, 18 nt, Mycobacterium avium subsp. paratuberculosis
agcaccggcagccgcagc

SEQ ID NO: 871346 - RNA, 20 nt, Mycobacterium avium subsp. paratuberculosis
agcaccggcagccgcagcga

SEQ ID NO: 871347 - RNA, 16 nt, Mycobacterium avium subsp. paratuberculosis
agcaccggcgucgaca

SEQ ID NO: 871348 - RNA, 19 nt, Mycobacterium avium subsp. paratuberculosis
agcaccggcgucgacagcc

SEQ ID NO: 871349 - RNA, 21 nt, Mycobacterium avium subsp. paratuberculosis
agcaccggcgucgacagccgg

SEQ ID NO: 871350 - RNA, 13 nt, Mycobacterium avium subsp. paratuberculosis
agcaccggcuggc

SEQ ID NO: 871351 - RNA, 15 nt, Mycobacterium avium subsp. paratuberculosis
agcaccggcuggccg

SEQ ID NO: 871352 - RNA, 22 nt, Mycobacterium avium subsp. paratuberculosis
agcaccggcuggugcagcagcu

SEQ ID NO: 871353 - RNA, 22 nt, Mycobacterium avium subsp. paratuberculosis
agcacccgcugauccagcagcg

SEQ ID NO: 871354 - RNA, 14 nt, Mycobacterium avium subsp. paratuberculosis
agcacccgcugcag

SEQ ID NO: 871355 - RNA, 21 nt, Mycobacterium avium subsp. paratuberculosis
agcacccgguuccaccgggcc

SEQ ID NO: 871356 - RNA, 23 nt, Mycobacterium avium subsp. paratuberculosis
agcacccgguuccaccgggccgc

SEQ ID NO: 871357 - RNA, 17 nt, Mycobacterium avium subsp. paratuberculosis
agcaccgaaccggcggg

SEQ ID NO: 871358 - RNA, 14 nt, Mycobacterium avium subsp. paratuberculosis
agcaccgacgcgcc

SEQ ID NO: 871359 - RNA, 17 nt, Mycobacterium avium subsp. paratuberculosis
agcaccgacgcggcgac

SEQ ID NO: 871360 - RNA, 19 nt, Mycobacterium avium subsp. paratuberculosis
agcaccgacuccuccggcc

SEQ ID NO: 871361 - RNA, 21 nt, Mycobacterium avium subsp. paratuberculosis
agcaccgacuccuccggcccg

SEQ ID NO: 871362 - RNA, 22 nt, Mycobacterium avium subsp. paratuberculosis
agcaccgacuccuccggcccga

SEQ ID NO: 871363 - RNA, 19 nt, Mycobacterium avium subsp. paratuberculosis
agcaccgagaucucgucga

SEQ ID NO: 871364 - RNA, 13 nt, Mycobacterium avium subsp. paratuberculosis
agcaccgccaccg

SEQ ID NO: 871365 - RNA, 14 nt, Mycobacterium avium subsp. paratuberculosis
agcaccgccaccgg

SEQ ID NO: 871366 - RNA, 21 nt, Mycobacterium avium subsp. paratuberculosis
agcaccgagaacagaugccgg

SEQ ID NO: 871367 - RNA, 19 nt, Mycobacterium avium subsp. paratuberculosis
agcaccgcgggggcggccg

SEQ ID NO: 871368 - RNA, 14 nt, Mycobacterium avium subsp. paratuberculosis
agcaccgcgucgau

SEQ ID NO: 871369 - RNA, 16 nt, Mycobacterium avium subsp. paratuberculosis
agcaccgcgucgaugu

SEQ ID NO: 871370 - RNA, 21 nt, Mycobacterium avium subsp. paratuberculosis
agcaccgcgucgaugucgucg

SEQ ID NO: 871371 - RNA, 22 nt, Mycobacterium avium subsp. paratuberculosis
agcaccgcgucggcgcuggcca

SEQ ID NO: 871372 - RNA, 15 nt, Mycobacterium avium subsp. paratuberculosis
agcaccgccagcgcc

SEQ ID NO: 871373 - RNA, 18 nt, Mycobacterium avium subsp. paratuberculosis
agcaccgccagcgccggc

SEQ ID NO: 871374 - RNA, 18 nt, Mycobacterium avium subsp. paratuberculosis
agcaccgcgaacaucgcc

SEQ ID NO: 871375 - RNA, 20 nt, Mycobacterium avium subsp. paratuberculosis
agcaccgcgaccacgccgcg

SEQ ID NO: 871376 - RNA, 22 nt, Mycobacterium avium subsp. paratuberculosis
agcaccgcgaccacgccgcggu

SEQ ID NO: 871377 - RNA, 18 nt, Mycobacterium avium subsp. paratuberculosis
agcaccgcgaucgccgac

SEQ ID NO: 871378 - RNA, 17 nt, Mycobacterium avium subsp. paratuberculosis
agcaccgccucggccac

SEQ ID NO: 871379 - RNA, 14 nt, Mycobacterium avium subsp. paratuberculosis
agcaccgccgcggc

SEQ ID NO: 871380 - RNA, 18 nt, Mycobacterium avium subsp. paratuberculosis
agcaccgccgcggccgcg

SEQ ID NO: 871381 - RNA, 16 nt, Mycobacterium avium subsp. paratuberculosis
agcaccgccgcgggcu

SEQ ID NO: 871382 - RNA, 20 nt, Mycobacterium avium subsp. paratuberculosis
agcaccgccgcgggcucccg

SEQ ID NO: 871383 - RNA, 20 nt, Mycobacterium avium subsp. paratuberculosis
agcaccgccgacaucgcccg

SEQ ID NO: 871384 - RNA, 16 nt, Mycobacterium avium subsp. paratuberculosis
agcaccgccgagccgu

SEQ ID NO: 871385 - RNA, 14 nt, Mycobacterium avium subsp. paratuberculosis
agcaccgccacgcc

SEQ ID NO: 871386 - RNA, 19 nt, Mycobacterium avium subsp. paratuberculosis
agcacaggaacgcgacggu

SEQ ID NO: 871387 - RNA, 18 nt, Mycobacterium avium subsp. paratuberculosis
agcacaccgucgcccgcc

SEQ ID NO: 871388 - RNA, 17 nt, Mycobacterium avium subsp. paratuberculosis
agcacagcacggcaucg

SEQ ID NO: 871389 - RNA, 21 nt, Mycobacterium avium subsp. paratuberculosis
agcacaccuuccaccaccgcg

SEQ ID NO: 871390 - RNA, 14 nt, Mycobacterium avium subsp. paratuberculosis
agcacagccgucgc

SEQ ID NO: 871391 - RNA, 15 nt, Mycobacterium avium subsp. paratuberculosis
agcaccaccgcgagc

SEQ ID NO: 871392 - RNA, 15 nt, Mycobacterium avium subsp. paratuberculosis
agcaccacccgggug

SEQ ID NO: 871393 - RNA, 19 nt, Mycobacterium avium subsp. paratuberculosis
agcaccacccggucgaugu

SEQ ID NO: 871394 - RNA, 19 nt, Mycobacterium avium subsp. paratuberculosis
agcaccaccaacagcagcg

SEQ ID NO: 871395 - RNA, 22 nt, Mycobacterium avium subsp. paratuberculosis
agcaccaccaacggcucgccgc

SEQ ID NO: 871396 - RNA, 14 nt, Mycobacterium avium subsp. paratuberculosis
agcaccaccaggcc

SEQ ID NO: 871397 - RNA, 18 nt, Mycobacterium avium subsp. paratuberculosis
agcaccacggcccgcgcc

SEQ ID NO: 871398 - RNA, 18 nt, Mycobacterium avium subsp. paratuberculosis
agcaccaccgucaccgcc

SEQ ID NO: 871399 - RNA, 19 nt, Mycobacterium avium subsp. paratuberculosis
agcaccacuuccagcaccg

SEQ ID NO: 871400 - RNA, 18 nt, Mycobacterium avium subsp. paratuberculosis
agcaccagaugcaccucg

SEQ ID NO: 871401 - RNA, 19 nt, Mycobacterium avium subsp. paratuberculosis
agcaccagcaacaccaggg

SEQ ID NO: 871402 - RNA, 23 nt, Mycobacterium avium subsp. paratuberculosis
agcaccacggugaucucgccgag

SEQ ID NO: 871403 - RNA, 16 nt, Mycobacterium avium subsp. paratuberculosis
agcaccagcaccaccg

SEQ ID NO: 871404 - RNA, 16 nt, Mycobacterium avium subsp. paratuberculosis
agcaccagcacggcga

SEQ ID NO: 871405 - RNA, 17 nt, Mycobacterium avium subsp. paratuberculosis
agcaccagcccggccag

SEQ ID NO: 871406 - RNA, 18 nt, Mycobacterium avium subsp. paratuberculosis
agcaccagcccggccagc

SEQ ID NO: 871407 - RNA, 14 nt, Mycobacterium avium subsp. paratuberculosis
agcaccagcgccgc

SEQ ID NO: 871408 - RNA, 12 nt, Mycobacterium avium subsp. paratuberculosis
agcaccagcgcg

SEQ ID NO: 871409 - RNA, 13 nt, Mycobacterium avium subsp. paratuberculosis
agcaccagcgcgc

SEQ ID NO: 871410 - RNA, 13 nt, Mycobacterium avium subsp. paratuberculosis
agcaccagcggca

SEQ ID NO: 871411 - RNA, 19 nt, Mycobacterium avium subsp. paratuberculosis
agcaccagcggcaccaggu

SEQ ID NO: 871412 - RNA, 20 nt, Mycobacterium avium subsp. paratuberculosis
agcaccagcguggccggcag

SEQ ID NO: 871413 - RNA, 14 nt, Mycobacterium avium subsp. paratuberculosis
agcaccaggcgggu

SEQ ID NO: 871414 - RNA, 16 nt, Mycobacterium avium subsp. paratuberculosis
agcaccaggaaggcga

SEQ ID NO: 871415 - RNA, 21 nt, Mycobacterium avium subsp. paratuberculosis
agcaccaggaaggcgaccgcg

SEQ ID NO: 871416 - RNA, 19 nt, Mycobacterium avium subsp. paratuberculosis
agcaccaggcccucgccgc

SEQ ID NO: 871417 - RNA, 20 nt, Mycobacterium avium subsp. paratuberculosis
agcaccaggcccucgccgcg

SEQ ID NO: 871418 - RNA, 23 nt, Mycobacterium avium subsp. paratuberculosis
agcaccaggcccucgccgcgguc

SEQ ID NO: 871419 - RNA, 21 nt, Mycobacterium avium subsp. paratuberculosis
agcaccagggucuucagcccg

SEQ ID NO: 871420 - RNA, 18 nt, Mycobacterium avium subsp. paratuberculosis
agcaccaguugcaccggc

SEQ ID NO: 871421 - RNA, 14 nt, Mycobacterium avium subsp. paratuberculosis
agcaccauccgcgc

SEQ ID NO: 871422 - RNA, 17 nt, Mycobacterium avium subsp. paratuberculosis
agcacccagcacagcga

SEQ ID NO: 871423 - RNA, 18 nt, Mycobacterium avium subsp. paratuberculosis
agcaccccggcggccgcg

SEQ ID NO: 871424 - RNA, 14 nt, Mycobacterium avium subsp. paratuberculosis
agcaccccgucgag

SEQ ID NO: 871425 - RNA, 13 nt, Mycobacterium avium subsp. paratuberculosis
agcacccggccca

SEQ ID NO: 871426 - RNA, 14 nt, Mycobacterium avium subsp. paratuberculosis
agcacccggcccac

SEQ ID NO: 871427 - RNA, 14 nt, Mycobacterium avium subsp. paratuberculosis
agcacccggccggc

SEQ ID NO: 871428 - RNA, 16 nt, Mycobacterium avium subsp. paratuberculosis
agcacccggccggcga

SEQ ID NO: 871429 - RNA, 19 nt, Mycobacterium avium subsp. paratuberculosis
aaaccguugaccaccaggu

SEQ ID NO: 871430 - RNA, 17 nt, Mycobacterium avium subsp. paratuberculosis
aaaccguuuucggcgcg

SEQ ID NO: 871431 - RNA, 17 nt, Mycobacterium avium subsp. paratuberculosis
aaaccgucuccggcgcg

SEQ ID NO: 871432 - RNA, 12 nt, Mycobacterium avium subsp. paratuberculosis
agccgcgguggc

SEQ ID NO: 871433 - RNA, 17 nt, Mycobacterium avium subsp. paratuberculosis
agccgcgguggcggugu

SEQ ID NO: 871434 - RNA, 18 nt, Mycobacterium avium subsp. paratuberculosis
agccgcgguucggcgucg

SEQ ID NO: 871435 - RNA, 13 nt, Mycobacterium avium subsp. paratuberculosis
agccgcgucacgu

SEQ ID NO: 871436 - RNA, 20 nt, Mycobacterium avium subsp. paratuberculosis
agccgcgucacgucggccug

SEQ ID NO: 871437 - RNA, 21 nt, Mycobacterium avium subsp. paratuberculosis
agccgcgucacgucggccugc

SEQ ID NO: 871438 - RNA, 17 nt, Mycobacterium avium subsp. paratuberculosis
aaaccuugaucggcccc

SEQ ID NO: 871439 - RNA, 14 nt, Mycobacterium avium subsp. paratuberculosis
agccgccugcgcgc

SEQ ID NO: 871440 - RNA, 15 nt, Mycobacterium avium subsp. paratuberculosis
agccgcaccggcgcc

SEQ ID NO: 871441 - RNA, 16 nt, Mycobacterium avium subsp. paratuberculosis
agccgcaccggcgccg

SEQ ID NO: 871442 - RNA, 17 nt, Mycobacterium avium subsp. paratuberculosis
agccgcaccucggggcg

SEQ ID NO: 871443 - RNA, 22 nt, Mycobacterium avium subsp. paratuberculosis
agccgcaccucggggcguggcg

SEQ ID NO: 871444 - RNA, 17 nt, Mycobacterium avium subsp. paratuberculosis
agccgcacgaaccgcuc

SEQ ID NO: 871445 - RNA, 17 nt, Mycobacterium avium subsp. paratuberculosis
agccgccggggcgccgc

SEQ ID NO: 871446 - RNA, 19 nt, Mycobacterium avium subsp. paratuberculosis
agccgccggggcgccgccg

SEQ ID NO: 871447 - RNA, 21 nt, Mycobacterium avium subsp. paratuberculosis
agccgccgguccagugccggc

SEQ ID NO: 871448 - RNA, 13 nt, Mycobacterium avium subsp. paratuberculosis
agccgccgguggc

SEQ ID NO: 871449 - RNA, 20 nt, Mycobacterium avium subsp. paratuberculosis
agccgccgguggcgucggug

SEQ ID NO: 871450 - RNA, 20 nt, Mycobacterium avium subsp. paratuberculosis
agccgccguagccggcggug

SEQ ID NO: 871451 - RNA, 16 nt, Mycobacterium avium subsp. paratuberculosis
agccgccguccccgcg

SEQ ID NO: 871452 - RNA, 17 nt, Mycobacterium avium subsp. paratuberculosis
agccgccguccccgcgc

SEQ ID NO: 871453 - RNA, 17 nt, Mycobacterium avium subsp. paratuberculosis
agccgccggaucggcag

SEQ ID NO: 871454 - RNA, 22 nt, Mycobacterium avium subsp. paratuberculosis
agccgccggaucggcagcgcgu

SEQ ID NO: 871455 - RNA, 11 nt, Mycobacterium avium subsp. paratuberculosis
agccgccggcc

SEQ ID NO: 871456 - RNA, 13 nt, Mycobacterium avium subsp. paratuberculosis
agccgccggccac

SEQ ID NO: 871457 - RNA, 13 nt, Mycobacterium avium subsp. paratuberculosis
agccgcacaccgc

SEQ ID NO: 871458 - RNA, 17 nt, Mycobacterium avium subsp. paratuberculosis
agccgcacaccgcggcg

SEQ ID NO: 871459 - RNA, 19 nt, Mycobacterium avium subsp. paratuberculosis
agccgcacaccgcggcggc

SEQ ID NO: 871460 - RNA, 23 nt, Mycobacterium avium subsp. paratuberculosis
agccgcacaccgcggcggcgucg

SEQ ID NO: 871461 - RNA, 13 nt, Mycobacterium avium subsp. paratuberculosis
agccgcaccaggu

SEQ ID NO: 871462 - RNA, 12 nt, Mycobacterium avium subsp. paratuberculosis
agccgcaccgcc

SEQ ID NO: 871463 - RNA, 13 nt, Mycobacterium avium subsp. paratuberculosis
agccgcaccgcga

SEQ ID NO: 871464 - RNA, 15 nt, Mycobacterium avium subsp. paratuberculosis
agccgcaccgcgacc

SEQ ID NO: 871465 - RNA, 15 nt, Mycobacterium avium subsp. paratuberculosis
agccgagcggcgcca

SEQ ID NO: 871466 - RNA, 16 nt, Mycobacterium avium subsp. paratuberculosis
agccgagcggcgccac

SEQ ID NO: 871467 - RNA, 19 nt, Mycobacterium avium subsp. paratuberculosis
agccgagccgacccgggcu

SEQ ID NO: 871468 - RNA, 13 nt, Mycobacterium avium subsp. paratuberculosis
agccgagccgggc

SEQ ID NO: 871469 - RNA, 14 nt, Mycobacterium avium subsp. paratuberculosis
agccgagccgggcc

SEQ ID NO: 871470 - RNA, 16 nt, Mycobacterium avium subsp. paratuberculosis
agccgagccgggccag

SEQ ID NO: 871471 - RNA, 12 nt, Mycobacterium avium subsp. paratuberculosis
agccgagccggu

SEQ ID NO: 871472 - RNA, 15 nt, Mycobacterium avium subsp. paratuberculosis
agccgagcaccaggc

SEQ ID NO: 871473 - RNA, 16 nt, Mycobacterium avium subsp. paratuberculosis
agccgagcaccggcag

SEQ ID NO: 871474 - RNA, 19 nt, Mycobacterium avium subsp. paratuberculosis
agccgagacugaugguggc

SEQ ID NO: 871475 - RNA, 14 nt, Mycobacterium avium subsp. paratuberculosis
agccgagaucgacc

SEQ ID NO: 871476 - RNA, 18 nt, Mycobacterium avium subsp. paratuberculosis
agccgcaacacggccucg

SEQ ID NO: 871477 - RNA, 21 nt, Mycobacterium avium subsp. paratuberculosis
agccgauugucgcugcgaggc

SEQ ID NO: 871478 - RNA, 21 nt, Mycobacterium avium subsp. paratuberculosis
agccgaugaugaaaccggcca

SEQ ID NO: 871479 - RNA, 22 nt, Mycobacterium avium subsp. paratuberculosis
agccgaugaugaaaccggccag

SEQ ID NO: 871480 - RNA, 19 nt, Mycobacterium avium subsp. paratuberculosis
agccgaugcccagcagcgg

SEQ ID NO: 871481 - RNA, 15 nt, Mycobacterium avium subsp. paratuberculosis
agccgaugcgcccgc

SEQ ID NO: 871482 - RNA, 16 nt, Mycobacterium avium subsp. paratuberculosis
agccgaugcgcccgcg

SEQ ID NO: 871483 - RNA, 22 nt, Mycobacterium avium subsp. paratuberculosis
agccgaugcgcccgcgccaccc

SEQ ID NO: 871484 - RNA, 16 nt, Mycobacterium avium subsp. paratuberculosis
agccgacgucgaccag

SEQ ID NO: 871485 - RNA, 20 nt, Mycobacterium avium subsp. paratuberculosis
agccgacgucgaccagguag

SEQ ID NO: 871486 - RNA, 23 nt, Mycobacterium avium subsp. paratuberculosis
agccgacgucgaccagguaggcg

SEQ ID NO: 871487 - RNA, 17 nt, Mycobacterium avium subsp. paratuberculosis
agccgacgugcccgauc

SEQ ID NO: 871488 - RNA, 20 nt, Mycobacterium avium subsp. paratuberculosis
agccgacgugcccgaucucg

SEQ ID NO: 871489 - RNA, 13 nt, Mycobacterium avium subsp. paratuberculosis
agccgaccucggc

SEQ ID NO: 871490 - RNA, 17 nt, Mycobacterium avium subsp. paratuberculosis
agccgaccucggcgacg

SEQ ID NO: 871491 - RNA, 22 nt, Mycobacterium avium subsp. paratuberculosis
agccgaccuugacccaggcccg

SEQ ID NO: 871492 - RNA, 14 nt, Mycobacterium avium subsp. paratuberculosis
agccgaccagcgcg

SEQ ID NO: 871493 - RNA, 15 nt, Mycobacterium avium subsp. paratuberculosis
agccgaccagcgcga

SEQ ID NO: 871494 - RNA, 16 nt, Mycobacterium avium subsp. paratuberculosis
agccgaccagcgcgau

SEQ ID NO: 871495 - RNA, 21 nt, Mycobacterium avium subsp. paratuberculosis
agccgacaccgggucccccgc

SEQ ID NO: 871496 - RNA, 18 nt, Mycobacterium avium subsp. paratuberculosis
agccgaccaacgggcggc

SEQ ID NO: 871497 - RNA, 19 nt, Mycobacterium avium subsp. paratuberculosis
agccgaccaacgggcggcg

SEQ ID NO: 871498 - RNA, 16 nt, Mycobacterium avium subsp. paratuberculosis
agccgaccgacccggc

SEQ ID NO: 871499 - RNA, 17 nt, Mycobacterium avium subsp. paratuberculosis
agccgaccgacccggcc

SEQ ID NO: 871500 - RNA, 19 nt, Mycobacterium avium subsp. paratuberculosis
agccgaccgacccggccag

SEQ ID NO: 871501 - RNA, 20 nt, Mycobacterium avium subsp. paratuberculosis
agccgaccgacccggccagc

SEQ ID NO: 871502 - RNA, 18 nt, Mycobacterium avium subsp. paratuberculosis
agccgaccgaucagcgga

SEQ ID NO: 871503 - RNA, 16 nt, Mycobacterium avium subsp. paratuberculosis
agccgaaguauccggu

SEQ ID NO: 871504 - RNA, 19 nt, Mycobacterium avium subsp. paratuberculosis
agccgaaguauccggucag

SEQ ID NO: 871505 - RNA, 23 nt, Mycobacterium avium subsp. paratuberculosis
agccgaaguuggcgucgggcacc

SEQ ID NO: 871506 - RNA, 12 nt, Mycobacterium avium subsp. paratuberculosis
agcccgucgacg

SEQ ID NO: 871507 - RNA, 18 nt, Mycobacterium avium subsp. paratuberculosis
agcccgggcugcagcagc

SEQ ID NO: 871508 - RNA, 22 nt, Mycobacterium avium subsp. paratuberculosis
agcccggguugagcaggucagc

SEQ ID NO: 871509 - RNA, 22 nt, Mycobacterium avium subsp. paratuberculosis
agcccggucaccaucagcaccg

SEQ ID NO: 871510 - RNA, 18 nt, Mycobacterium avium subsp. paratuberculosis
agcccggucaguucgucg

SEQ ID NO: 871511 - RNA, 22 nt, Mycobacterium avium subsp. paratuberculosis
agcccgguuuccaguccggcgc

SEQ ID NO: 871512 - RNA, 20 nt, Mycobacterium avium subsp. paratuberculosis
agcccaagugcccgcgggug

SEQ ID NO: 871513 - RNA, 17 nt, Mycobacterium avium subsp. paratuberculosis
agccauuucagcagcgc

SEQ ID NO: 871514 - RNA, 18 nt, Mycobacterium avium subsp. paratuberculosis
agccauuucagcagcgcg

SEQ ID NO: 871515 - RNA, 19 nt, Mycobacterium avium subsp. paratuberculosis
agccauuucagcagcgcgg

SEQ ID NO: 871516 - RNA, 13 nt, Mycobacterium avium subsp. paratuberculosis
agccaggugguga

SEQ ID NO: 871517 - RNA, 16 nt, Mycobacterium avium subsp. paratuberculosis
agccagguccgggcac

SEQ ID NO: 871518 - RNA, 23 nt, Mycobacterium avium subsp. paratuberculosis
agccagguguuguccgguaggcc

SEQ ID NO: 871519 - RNA, 20 nt, Mycobacterium avium subsp. paratuberculosis
agcccaucagcacgcccucg

SEQ ID NO: 871520 - RNA, 23 nt, Mycobacterium avium subsp. paratuberculosis
agcccaucccgauccgcgccgcc

SEQ ID NO: 871521 - RNA, 23 nt, Mycobacterium avium subsp. paratuberculosis
agcccagcgcccguagccgcggu

SEQ ID NO: 871522 - RNA, 15 nt, Mycobacterium avium subsp. paratuberculosis
agcccagcuuggcgc

SEQ ID NO: 871523 - RNA, 12 nt, Mycobacterium avium subsp. paratuberculosis
agcccagcguga

SEQ ID NO: 871524 - RNA, 23 nt, Mycobacterium avium subsp. paratuberculosis
agcccaggcccagcagcaccgcg

SEQ ID NO: 871525 - RNA, 17 nt, Mycobacterium avium subsp. paratuberculosis
agcccaggcccggcacc

SEQ ID NO: 871526 - RNA, 15 nt, Mycobacterium avium subsp. paratuberculosis
agcccagccagcgac

SEQ ID NO: 871527 - RNA, 16 nt, Mycobacterium avium subsp. paratuberculosis
agcccagccaguccgc

SEQ ID NO: 871528 - RNA, 13 nt, Mycobacterium avium subsp. paratuberculosis
agcccaccgccgu

SEQ ID NO: 871529 - RNA, 13 nt, Mycobacterium avium subsp. paratuberculosis
agcccaccgcgcc

SEQ ID NO: 871530 - RNA, 16 nt, Mycobacterium avium subsp. paratuberculosis
agcccaugucgccggu

SEQ ID NO: 871531 - RNA, 19 nt, Mycobacterium avium subsp. paratuberculosis
agcccaugucgccggugcu

SEQ ID NO: 871532 - RNA, 15 nt, Mycobacterium avium subsp. paratuberculosis
agccccaccaccgcc

SEQ ID NO: 871533 - RNA, 22 nt, Mycobacterium avium subsp. paratuberculosis
agccccaccaccgccaccagcg

SEQ ID NO: 871534 - RNA, 22 nt, Mycobacterium avium subsp. paratuberculosis
agcccauguccagguacgcgac

SEQ ID NO: 871535 - RNA, 18 nt, Mycobacterium avium subsp. paratuberculosis
agccccgguuccaaccac

SEQ ID NO: 871536 - RNA, 20 nt, Mycobacterium avium subsp. paratuberculosis
agccccgguuccaaccaccg

SEQ ID NO: 871537 - RNA, 17 nt, Mycobacterium avium subsp. paratuberculosis
agccccgucggucccga

SEQ ID NO: 871538 - RNA, 18 nt, Mycobacterium avium subsp. paratuberculosis
agccccucccaccacggc

SEQ ID NO: 871539 - RNA, 20 nt, Mycobacterium avium subsp. paratuberculosis
agccccucgacguccaggcc

SEQ ID NO: 871540 - RNA, 13 nt, Mycobacterium avium subsp. paratuberculosis
agccccucggggc

SEQ ID NO: 871541 - RNA, 22 nt, Mycobacterium avium subsp. paratuberculosis
agccccucggggcugcgcggcu

SEQ ID NO: 871542 - RNA, 19 nt, Mycobacterium avium subsp. paratuberculosis
agcccgaaaguccccgggu

SEQ ID NO: 871543 - RNA, 19 nt, Mycobacterium avium subsp. paratuberculosis
agcccgaacagccgggcca

SEQ ID NO: 871544 - RNA, 20 nt, Mycobacterium avium subsp. paratuberculosis
agcccgaacagccgggccag

SEQ ID NO: 871545 - RNA, 17 nt, Mycobacterium avium subsp. paratuberculosis
agcccgaacagcuugcc

SEQ ID NO: 871546 - RNA, 21 nt, Mycobacterium avium subsp. paratuberculosis
agcccgaacagcuugccgauc

SEQ ID NO: 871547 - RNA, 15 nt, Mycobacterium avium subsp. paratuberculosis
agcccgcccaccacg

SEQ ID NO: 871548 - RNA, 14 nt, Mycobacterium avium subsp. paratuberculosis
agcccgcccagcgc

SEQ ID NO: 871549 - RNA, 15 nt, Mycobacterium avium subsp. paratuberculosis
agcccgcccagcgcc

SEQ ID NO: 871550 - RNA, 16 nt, Mycobacterium avium subsp. paratuberculosis
agcccgcccagcgcca

SEQ ID NO: 871551 - RNA, 15 nt, Mycobacterium avium subsp. paratuberculosis
agcccgccgauggac

SEQ ID NO: 871552 - RNA, 22 nt, Mycobacterium avium subsp. paratuberculosis
agcccgccgauggacacgcugc

SEQ ID NO: 871553 - RNA, 21 nt, Mycobacterium avium subsp. paratuberculosis
agcccgcccuuggccgcggag

SEQ ID NO: 871554 - RNA, 18 nt, Mycobacterium avium subsp. paratuberculosis
agcccgccucagugucgu

SEQ ID NO: 871555 - RNA, 12 nt, Mycobacterium avium subsp. paratuberculosis
agcccgccgcgg

SEQ ID NO: 871556 - RNA, 13 nt, Mycobacterium avium subsp. paratuberculosis
agcccgccgcgga

SEQ ID NO: 871557 - RNA, 17 nt, Mycobacterium avium subsp. paratuberculosis
agcccgccgcggcgacc

SEQ ID NO: 871558 - RNA, 18 nt, Mycobacterium avium subsp. paratuberculosis
agcccgccgcggcgaccg

SEQ ID NO: 871559 - RNA, 16 nt, Mycobacterium avium subsp. paratuberculosis
agcccgccggcggcga

SEQ ID NO: 871560 - RNA, 17 nt, Mycobacterium avium subsp. paratuberculosis
agcccgccggcggcgau

SEQ ID NO: 871561 - RNA, 15 nt, Mycobacterium avium subsp. paratuberculosis
agcccgccggcgggu

SEQ ID NO: 871562 - RNA, 12 nt, Mycobacterium avium subsp. paratuberculosis
agcccgccgggc

SEQ ID NO: 871563 - RNA, 19 nt, Mycobacterium avium subsp. paratuberculosis
agcccggcuaauucgggcc

SEQ ID NO: 871564 - RNA, 21 nt, Mycobacterium avium subsp. paratuberculosis
agcccggcuaauucgggccgc

SEQ ID NO: 871565 - RNA, 17 nt, Mycobacterium avium subsp. paratuberculosis
agcccgggcaggcggcg

SEQ ID NO: 871566 - RNA, 20 nt, Mycobacterium avium subsp. paratuberculosis
agcccggcgaacaccacggu

SEQ ID NO: 871567 - RNA, 23 nt, Mycobacterium avium subsp. paratuberculosis
agcccggcgcugcgcccggucag

SEQ ID NO: 871568 - RNA, 15 nt, Mycobacterium avium subsp. paratuberculosis
agcccggcgacgucg

SEQ ID NO: 871569 - RNA, 17 nt, Mycobacterium avium subsp. paratuberculosis
agcccggcgacgucguc

SEQ ID NO: 871570 - RNA, 15 nt, Mycobacterium avium subsp. paratuberculosis
agcccgcgccagcuc

SEQ ID NO: 871571 - RNA, 18 nt, Mycobacterium avium subsp. paratuberculosis
agcccgcgccagcucggc

SEQ ID NO: 871572 - RNA, 20 nt, Mycobacterium avium subsp. paratuberculosis
agcccgcgccagcucggcgg

SEQ ID NO: 871573 - RNA, 13 nt, Mycobacterium avium subsp. paratuberculosis
agcccgcgccgag

SEQ ID NO: 871574 - RNA, 15 nt, Mycobacterium avium subsp. paratuberculosis
agcccgcgccgagca

SEQ ID NO: 871575 - RNA, 13 nt, Mycobacterium avium subsp. paratuberculosis
agcccggccgcgg

SEQ ID NO: 871576 - RNA, 18 nt, Mycobacterium avium subsp. paratuberculosis
agcauguugaacgccgcg

SEQ ID NO: 871577 - RNA, 17 nt, Mycobacterium avium subsp. paratuberculosis
agcauguccucggggug

SEQ ID NO: 871578 - RNA, 18 nt, Mycobacterium avium subsp. paratuberculosis
agcaugucgcccgcgucg

SEQ ID NO: 871579 - RNA, 16 nt, Mycobacterium avium subsp. paratuberculosis
agcauggucucgcuga

SEQ ID NO: 871580 - RNA, 19 nt, Mycobacterium avium subsp. paratuberculosis
agcaucggguugccggcgg

SEQ ID NO: 871581 - RNA, 21 nt, Mycobacterium avium subsp. paratuberculosis
agcaucggguugccggcggcc

SEQ ID NO: 871582 - RNA, 15 nt, Mycobacterium avium subsp. paratuberculosis
agcaucucggugccg

SEQ ID NO: 871583 - RNA, 17 nt, Mycobacterium avium subsp. paratuberculosis
agcaucucggugccguc

SEQ ID NO: 871584 - RNA, 22 nt, Mycobacterium avium subsp. paratuberculosis
agcauccgcaacgugcgccggc

SEQ ID NO: 871585 - RNA, 21 nt, Mycobacterium avium subsp. paratuberculosis
agcauccgcaccagguaggug

SEQ ID NO: 871586 - RNA, 17 nt, Mycobacterium avium subsp. paratuberculosis
agcauccgccgacgaua

SEQ ID NO: 871587 - RNA, 15 nt, Mycobacterium avium subsp. paratuberculosis
agcauccgcuggugc

SEQ ID NO: 871588 - RNA, 19 nt, Mycobacterium avium subsp. paratuberculosis
agcauccgcuggugcgcgc

SEQ ID NO: 871589 - RNA, 23 nt, Mycobacterium avium subsp. paratuberculosis
agcauccgcuggugcgcgccggc

SEQ ID NO: 871590 - RNA, 13 nt, Mycobacterium avium subsp. paratuberculosis
agcauccggugcc

SEQ ID NO: 871591 - RNA, 15 nt, Mycobacterium avium subsp. paratuberculosis
agcauccggugccga

SEQ ID NO: 871592 - RNA, 18 nt, Mycobacterium avium subsp. paratuberculosis
agcaucgggacgccugcc

SEQ ID NO: 871593 - RNA, 19 nt, Mycobacterium avium subsp. paratuberculosis
agcaucgggacgccugccg

SEQ ID NO: 871594 - RNA, 13 nt, Mycobacterium avium subsp. paratuberculosis
agcaucgggcgca

SEQ ID NO: 871595 - RNA, 19 nt, Mycobacterium avium subsp. paratuberculosis
agcaucgggguuccaccgu

SEQ ID NO: 871596 - RNA, 16 nt, Mycobacterium avium subsp. paratuberculosis
agcaucggaugccggg

SEQ ID NO: 871597 - RNA, 15 nt, Mycobacterium avium subsp. paratuberculosis
agcauccagguggcg

SEQ ID NO: 871598 - RNA, 20 nt, Mycobacterium avium subsp. paratuberculosis
agcauccccuuggugcgguc

SEQ ID NO: 871599 - RNA, 23 nt, Mycobacterium avium subsp. paratuberculosis
agcaucaccgucaucucgguggu

SEQ ID NO: 871600 - RNA, 19 nt, Mycobacterium avium subsp. paratuberculosis
agcaguguccagucggccg

SEQ ID NO: 871601 - RNA, 20 nt, Mycobacterium avium subsp. paratuberculosis
agccaaugccggaucgggac

SEQ ID NO: 871602 - RNA, 15 nt, Mycobacterium avium subsp. paratuberculosis
agccacaccgccgcg

SEQ ID NO: 871603 - RNA, 14 nt, Mycobacterium avium subsp. paratuberculosis
agccacaccgccgg

SEQ ID NO: 871604 - RNA, 15 nt, Mycobacterium avium subsp. paratuberculosis
agccacaccgccggc

SEQ ID NO: 871605 - RNA, 16 nt, Mycobacterium avium subsp. paratuberculosis
agccacaucugguugc

SEQ ID NO: 871606 - RNA, 22 nt, Mycobacterium avium subsp. paratuberculosis
agccacauguucuccucgucgc

SEQ ID NO: 871607 - RNA, 16 nt, Mycobacterium avium subsp. paratuberculosis
agccacagcucgggca

SEQ ID NO: 871608 - RNA, 22 nt, Mycobacterium avium subsp. paratuberculosis
agccacccgcgccuccauucgg

SEQ ID NO: 871609 - RNA, 21 nt, Mycobacterium avium subsp. paratuberculosis
agccagaacacgccccggcgg

SEQ ID NO: 871610 - RNA, 22 nt, Mycobacterium avium subsp. paratuberculosis
agccagaacacgccccggcggg

SEQ ID NO: 871611 - RNA, 14 nt, Mycobacterium avium subsp. paratuberculosis
agccagaccucgcc

SEQ ID NO: 871612 - RNA, 19 nt, Mycobacterium avium subsp. paratuberculosis
agccacuccaggguucucg

SEQ ID NO: 871613 - RNA, 20 nt, Mycobacterium avium subsp. paratuberculosis
agccagaugucgcguucccg

SEQ ID NO: 871614 - RNA, 14 nt, Mycobacterium avium subsp. paratuberculosis
agccagcaccgccc

SEQ ID NO: 871615 - RNA, 19 nt, Mycobacterium avium subsp. paratuberculosis
agccagcaccgccccgguc

SEQ ID NO: 871616 - RNA, 20 nt, Mycobacterium avium subsp. paratuberculosis
agccagcaccgccccgguca

SEQ ID NO: 871617 - RNA, 23 nt, Mycobacterium avium subsp. paratuberculosis
agccagaucgaggccagcgcgau

SEQ ID NO: 871618 - RNA, 13 nt, Mycobacterium avium subsp. paratuberculosis
agccaggccgucg

SEQ ID NO: 871619 - RNA, 14 nt, Mycobacterium avium subsp. paratuberculosis
agccaggccgucgg

SEQ ID NO: 871620 - RNA, 18 nt, Mycobacterium avium subsp. paratuberculosis
agcagugcaucgcugccg

SEQ ID NO: 871621 - RNA, 22 nt, Mycobacterium avium subsp. paratuberculosis
agcagugcaucgcugccgucca

SEQ ID NO: 871622 - RNA, 23 nt, Mycobacterium avium subsp. paratuberculosis
agcagugcaucgcugccguccac

SEQ ID NO: 871623 - RNA, 13 nt, Mycobacterium avium subsp. paratuberculosis
agcaguccccgcc

SEQ ID NO: 871624 - RNA, 16 nt, Mycobacterium avium subsp. paratuberculosis
agcagucccucgauca

SEQ ID NO: 871625 - RNA, 14 nt, Mycobacterium avium subsp. paratuberculosis
agcagucggccugc

SEQ ID NO: 871626 - RNA, 18 nt, Mycobacterium avium subsp. paratuberculosis
agcagucgugacgcggcg

SEQ ID NO: 871627 - RNA, 19 nt, Mycobacterium avium subsp. paratuberculosis
agcagucgugacgcggcgu

SEQ ID NO: 871628 - RNA, 17 nt, Mycobacterium avium subsp. paratuberculosis
agcaguaugcccgccgc

SEQ ID NO: 871629 - RNA, 18 nt, Mycobacterium avium subsp. paratuberculosis
agcaguaugcccgccgcu

SEQ ID NO: 871630 - RNA, 16 nt, Mycobacterium avium subsp. paratuberculosis
agcaggugcgccagau

SEQ ID NO: 871631 - RNA, 21 nt, Mycobacterium avium subsp. paratuberculosis
agcaggugcgccagaucgcug

SEQ ID NO: 871632 - RNA, 16 nt, Mycobacterium avium subsp. paratuberculosis
agcaggucgucgacgu

SEQ ID NO: 871633 - RNA, 17 nt, Mycobacterium avium subsp. paratuberculosis
agcaggucgucgacguc

SEQ ID NO: 871634 - RNA, 21 nt, Mycobacterium avium subsp. paratuberculosis
agcagguuguagucggcgccg

SEQ ID NO: 871635 - RNA, 22 nt, Mycobacterium avium subsp. paratuberculosis
agcagguuguagucggcgccga

SEQ ID NO: 871636 - RNA, 15 nt, Mycobacterium avium subsp. paratuberculosis
agcaguagacgccgc

SEQ ID NO: 871637 - RNA, 17 nt, Mycobacterium avium subsp. paratuberculosis
agcaguagacgccgccg

SEQ ID NO: 871638 - RNA, 20 nt, Mycobacterium avium subsp. paratuberculosis
agcagguagcggcugaccga

SEQ ID NO: 871639 - RNA, 17 nt, Mycobacterium avium subsp. paratuberculosis
agcagguagaagccgcg

SEQ ID NO: 871640 - RNA, 19 nt, Mycobacterium avium subsp. paratuberculosis
agcagguagaagccgcgac

SEQ ID NO: 871641 - RNA, 14 nt, Mycobacterium avium subsp. paratuberculosis
agcagguccgccgg

SEQ ID NO: 871642 - RNA, 16 nt, Mycobacterium avium subsp. paratuberculosis
agcagguccgccggug

SEQ ID NO: 871643 - RNA, 15 nt, Mycobacterium avium subsp. paratuberculosis
agcagguagaucgcc

SEQ ID NO: 871644 - RNA, 18 nt, Mycobacterium avium subsp. paratuberculosis
agcagguagaucgccagc

SEQ ID NO: 871645 - RNA, 17 nt, Mycobacterium avium subsp. paratuberculosis
agcagguccucgaucga

SEQ ID NO: 871646 - RNA, 21 nt, Mycobacterium avium subsp. paratuberculosis
agcaggucgaaggcggccgcg

SEQ ID NO: 871647 - RNA, 13 nt, Mycobacterium avium subsp. paratuberculosis
agcaggucgaucu

SEQ ID NO: 871648 - RNA, 18 nt, Mycobacterium avium subsp. paratuberculosis
agcaggucgaucugcggc

SEQ ID NO: 871649 - RNA, 20 nt, Mycobacterium avium subsp. paratuberculosis
agcaggaucuccggccggug

SEQ ID NO: 871650 - RNA, 17 nt, Mycobacterium avium subsp. paratuberculosis
agcaggaugaugaccga

SEQ ID NO: 871651 - RNA, 20 nt, Mycobacterium avium subsp. paratuberculosis
agcagguaaaccagcagcgc

SEQ ID NO: 871652 - RNA, 14 nt, Mycobacterium avium subsp. paratuberculosis
agcaggcccucggc

SEQ ID NO: 871653 - RNA, 12 nt, Mycobacterium avium subsp. paratuberculosis
agcaggcccagg

SEQ ID NO: 871654 - RNA, 17 nt, Mycobacterium avium subsp. paratuberculosis
agcaggacgcgcccggc

SEQ ID NO: 871655 - RNA, 14 nt, Mycobacterium avium subsp. paratuberculosis
agcaggaccgagcc

SEQ ID NO: 871656 - RNA, 12 nt, Mycobacterium avium subsp. paratuberculosis
agcagcggggcg

SEQ ID NO: 871657 - RNA, 21 nt, Mycobacterium avium subsp. paratuberculosis
agcagcggggugagcaccgcg

SEQ ID NO: 871658 - RNA, 22 nt, Mycobacterium avium subsp. paratuberculosis
agcagcggggugagcaccgcga

SEQ ID NO: 871659 - RNA, 20 nt, Mycobacterium avium subsp. paratuberculosis
agcagcggggugugcucggc

SEQ ID NO: 871660 - RNA, 23 nt, Mycobacterium avium subsp. paratuberculosis
agcagcggggugugcucggcggc

SEQ ID NO: 871661 - RNA, 23 nt, Mycobacterium avium subsp. paratuberculosis
agcagcgggucgucgggccgggg

SEQ ID NO: 871662 - RNA, 20 nt, Mycobacterium avium subsp. paratuberculosis
agcagcgucugcgccccggc

SEQ ID NO: 871663 - RNA, 14 nt, Mycobacterium avium subsp. paratuberculosis
agcagcuucaugcc

SEQ ID NO: 871664 - RNA, 15 nt, Mycobacterium avium subsp. paratuberculosis
agcagcuugaucgcc

SEQ ID NO: 871665 - RNA, 19 nt, Mycobacterium avium subsp. paratuberculosis
agcagcgcggucaacaccg

SEQ ID NO: 871666 - RNA, 15 nt, Mycobacterium avium subsp. paratuberculosis
agcagcgcggugccg

SEQ ID NO: 871667 - RNA, 23 nt, Mycobacterium avium subsp. paratuberculosis
agcagcgcgucgcgggcccgggc

SEQ ID NO: 871668 - RNA, 14 nt, Mycobacterium avium subsp. paratuberculosis
agcagcgcgccgac

SEQ ID NO: 871669 - RNA, 15 nt, Mycobacterium avium subsp. paratuberculosis
agcagcgcgccgcgc

SEQ ID NO: 871670 - RNA, 13 nt, Mycobacterium avium subsp. paratuberculosis
agcagcgcgcggu

SEQ ID NO: 871671 - RNA, 21 nt, Mycobacterium avium subsp. paratuberculosis
agcagcgcggcauggcuggcg

SEQ ID NO: 871672 - RNA, 23 nt, Mycobacterium avium subsp. paratuberculosis
agcagcgcggcauggcuggcggc

SEQ ID NO: 871673 - RNA, 13 nt, Mycobacterium avium subsp. paratuberculosis
agcagcggcaccc

SEQ ID NO: 871674 - RNA, 14 nt, Mycobacterium avium subsp. paratuberculosis
agcagcggcacccg

SEQ ID NO: 871675 - RNA, 21 nt, Mycobacterium avium subsp. paratuberculosis
agcagcggcacccgguccggc

SEQ ID NO: 871676 - RNA, 15 nt, Mycobacterium avium subsp. paratuberculosis
agcagcggcagccac

SEQ ID NO: 871677 - RNA, 13 nt, Mycobacterium avium subsp. paratuberculosis
agcagcggcagcg

SEQ ID NO: 871678 - RNA, 18 nt, Mycobacterium avium subsp. paratuberculosis
agcagcggcaugcccccg

SEQ ID NO: 871679 - RNA, 16 nt, Mycobacterium avium subsp. paratuberculosis
agcagcggccggcgca

SEQ ID NO: 871680 - RNA, 18 nt, Mycobacterium avium subsp. paratuberculosis
agcagcggccggcgcagc

SEQ ID NO: 871681 - RNA, 21 nt, Mycobacterium avium subsp. paratuberculosis
agcagcggcuugagcgccagc

SEQ ID NO: 871682 - RNA, 17 nt, Mycobacterium avium subsp. paratuberculosis
agcagcgggcccgggcu

SEQ ID NO: 871683 - RNA, 14 nt, Mycobacterium avium subsp. paratuberculosis
agcagcgggccgaa

SEQ ID NO: 871684 - RNA, 18 nt, Mycobacterium avium subsp. paratuberculosis
agcagcgacuugaccagc

SEQ ID NO: 871685 - RNA, 15 nt, Mycobacterium avium subsp. paratuberculosis
agcagcgagaccggc

SEQ ID NO: 871686 - RNA, 13 nt, Mycobacterium avium subsp. paratuberculosis
agcagcgaacccg

SEQ ID NO: 871687 - RNA, 21 nt, Mycobacterium avium subsp. paratuberculosis
agcagccgcugcugggugccg

SEQ ID NO: 871688 - RNA, 14 nt, Mycobacterium avium subsp. paratuberculosis
agcagccgggccag

SEQ ID NO: 871689 - RNA, 20 nt, Mycobacterium avium subsp. paratuberculosis
agcagccgggccugcggcgc

SEQ ID NO: 871690 - RNA, 23 nt, Mycobacterium avium subsp. paratuberculosis
agcagccggucgaggucgccgac

SEQ ID NO: 871691 - RNA, 12 nt, Mycobacterium avium subsp. paratuberculosis
agcagccgcagc

SEQ ID NO: 871692 - RNA, 18 nt, Mycobacterium avium subsp. paratuberculosis
agcagccgcagcgcgcga

SEQ ID NO: 871693 - RNA, 16 nt, Mycobacterium avium subsp. paratuberculosis
agcagccgcagcggcg

SEQ ID NO: 871694 - RNA, 18 nt, Mycobacterium avium subsp. paratuberculosis
agcagccgcagcggcggc

SEQ ID NO: 871695 - RNA, 13 nt, Mycobacterium avium subsp. paratuberculosis
agcagccgcgaca

SEQ ID NO: 871696 - RNA, 17 nt, Mycobacterium avium subsp. paratuberculosis
agcagccgcgccgacgc

SEQ ID NO: 871697 - RNA, 14 nt, Mycobacterium avium subsp. paratuberculosis
agcagccgcgccgc

SEQ ID NO: 871698 - RNA, 15 nt, Mycobacterium avium subsp. paratuberculosis
agcagccgcgccgcc

SEQ ID NO: 871699 - RNA, 17 nt, Mycobacterium avium subsp. paratuberculosis
agcagccgcgccgccgc

SEQ ID NO: 871700 - RNA, 19 nt, Mycobacterium avium subsp. paratuberculosis
agcagccgcgccgccgcgu

SEQ ID NO: 871701 - RNA, 21 nt, Mycobacterium avium subsp. paratuberculosis
agcagcgccugcugccaggac

SEQ ID NO: 871702 - RNA, 19 nt, Mycobacterium avium subsp. paratuberculosis
agcagcgccucgccgggcc

SEQ ID NO: 871703 - RNA, 15 nt, Mycobacterium avium subsp. paratuberculosis
agcagcgccggcagc

SEQ ID NO: 871704 - RNA, 16 nt, Mycobacterium avium subsp. paratuberculosis
agcagcgccggcagcg

SEQ ID NO: 871705 - RNA, 19 nt, Mycobacterium avium subsp. paratuberculosis
agcagcgcccaccgcucgu

SEQ ID NO: 871706 - RNA, 20 nt, Mycobacterium avium subsp. paratuberculosis
agcagcgcccaccgcucguc

SEQ ID NO: 871707 - RNA, 12 nt, Mycobacterium avium subsp. paratuberculosis
agcagcgccagc

SEQ ID NO: 871708 - RNA, 14 nt, Mycobacterium avium subsp. paratuberculosis
agcagcgccagcac

SEQ ID NO: 871709 - RNA, 15 nt, Mycobacterium avium subsp. paratuberculosis
agcagcgccagcacc

SEQ ID NO: 871710 - RNA, 18 nt, Mycobacterium avium subsp. paratuberculosis
agcucagacugccgagca

SEQ ID NO: 871711 - RNA, 23 nt, Mycobacterium avium subsp. paratuberculosis
agcucccccgacaccgccagcag

SEQ ID NO: 871712 - RNA, 17 nt, Mycobacterium avium subsp. paratuberculosis
agcucccccgucgggcc

SEQ ID NO: 871713 - RNA, 17 nt, Mycobacterium avium subsp. paratuberculosis
agcucccacgacgacug

SEQ ID NO: 871714 - RNA, 21 nt, Mycobacterium avium subsp. paratuberculosis
agcucccaggacgcggugacg

SEQ ID NO: 871715 - RNA, 17 nt, Mycobacterium avium subsp. paratuberculosis
agcucccgagcaucgcc

SEQ ID NO: 871716 - RNA, 22 nt, Mycobacterium avium subsp. paratuberculosis
agcucccggcagaucgcggccc

SEQ ID NO: 871717 - RNA, 13 nt, Mycobacterium avium subsp. paratuberculosis
agcucccgggcgg

SEQ ID NO: 871718 - RNA, 16 nt, Mycobacterium avium subsp. paratuberculosis
agcucccgggcggcgc

SEQ ID NO: 871719 - RNA, 13 nt, Mycobacterium avium subsp. paratuberculosis
agcuccguccacc

SEQ ID NO: 871720 - RNA, 17 nt, Mycobacterium avium subsp. paratuberculosis
agcuccguccaccggca

SEQ ID NO: 871721 - RNA, 13 nt, Mycobacterium avium subsp. paratuberculosis
agcuccgccaccc

SEQ ID NO: 871722 - RNA, 14 nt, Mycobacterium avium subsp. paratuberculosis
agcucaccugcgug

SEQ ID NO: 871723 - RNA, 17 nt, Mycobacterium avium subsp. paratuberculosis
agcucacggugucggcg

SEQ ID NO: 871724 - RNA, 20 nt, Mycobacterium avium subsp. paratuberculosis
agcuccuccggguccccgcc

SEQ ID NO: 871725 - RNA, 19 nt, Mycobacterium avium subsp. paratuberculosis
agcuccucgauggucgucg

SEQ ID NO: 871726 - RNA, 19 nt, Mycobacterium avium subsp. paratuberculosis
agcucgccggccgcgggcg

SEQ ID NO: 871727 - RNA, 14 nt, Mycobacterium avium subsp. paratuberculosis
agcucgccggcgcg

SEQ ID NO: 871728 - RNA, 19 nt, Mycobacterium avium subsp. paratuberculosis
agcucgccggcgcgcagcc

SEQ ID NO: 871729 - RNA, 15 nt, Mycobacterium avium subsp. paratuberculosis
agcucgccgguggcg

SEQ ID NO: 871730 - RNA, 19 nt, Mycobacterium avium subsp. paratuberculosis
agcucgccgguggcggcga

SEQ ID NO: 871731 - RNA, 20 nt, Mycobacterium avium subsp. paratuberculosis
agcucgcgaacuacuucguc

SEQ ID NO: 871732 - RNA, 18 nt, Mycobacterium avium subsp. paratuberculosis
agcucgcgaagcgcgaug

SEQ ID NO: 871733 - RNA, 17 nt, Mycobacterium avium subsp. paratuberculosis
agcucgcgcagccggcc

SEQ ID NO: 871734 - RNA, 23 nt, Mycobacterium avium subsp. paratuberculosis
agcucgcgcagccggccgaccgc

SEQ ID NO: 871735 - RNA, 17 nt, Mycobacterium avium subsp. paratuberculosis
agcucgcgcagcuggcc

SEQ ID NO: 871736 - RNA, 18 nt, Mycobacterium avium subsp. paratuberculosis
agcucgcgcaucagcgga

SEQ ID NO: 871737 - RNA, 14 nt, Mycobacterium avium subsp. paratuberculosis
agcucgcgccgacc

SEQ ID NO: 871738 - RNA, 19 nt, Mycobacterium avium subsp. paratuberculosis
agcucgcgccgacccgccc

SEQ ID NO: 871739 - RNA, 13 nt, Mycobacterium avium subsp. paratuberculosis
agcuccucggcgg

SEQ ID NO: 871740 - RNA, 18 nt, Mycobacterium avium subsp. paratuberculosis
agcucgcugagcgggacg

SEQ ID NO: 871741 - RNA, 17 nt, Mycobacterium avium subsp. paratuberculosis
agcucgcugaucagcuc

SEQ ID NO: 871742 - RNA, 23 nt, Mycobacterium avium subsp. paratuberculosis
agcucgcggauccgggccggcgu

SEQ ID NO: 871743 - RNA, 18 nt, Mycobacterium avium subsp. paratuberculosis
agcucgcguagcgaggug

SEQ ID NO: 871744 - RNA, 13 nt, Mycobacterium avium subsp. paratuberculosis
agcucgcgucgac

SEQ ID NO: 871745 - RNA, 14 nt, Mycobacterium avium subsp. paratuberculosis
agcucgcgucgacg

SEQ ID NO: 871746 - RNA, 15 nt, Mycobacterium avium subsp. paratuberculosis
agcucgcgucgacgu

SEQ ID NO: 871747 - RNA, 21 nt, Mycobacterium avium subsp. paratuberculosis
agcucgcguucgggcccggcc

SEQ ID NO: 871748 - RNA, 22 nt, Mycobacterium avium subsp. paratuberculosis
agcucgcguucgggcccggccg

SEQ ID NO: 871749 - RNA, 20 nt, Mycobacterium avium subsp. paratuberculosis
agcucggugaucugcaccag

SEQ ID NO: 871750 - RNA, 19 nt, Mycobacterium avium subsp. paratuberculosis
agcucgguggcgucggcgg

SEQ ID NO: 871751 - RNA, 16 nt, Mycobacterium avium subsp. paratuberculosis
agcucgucagcgcggg

SEQ ID NO: 871752 - RNA, 19 nt, Mycobacterium avium subsp. paratuberculosis
agcucgucagcgcgggcca

SEQ ID NO: 871753 - RNA, 20 nt, Mycobacterium avium subsp. paratuberculosis
agcucgucagcgcgggccag

SEQ ID NO: 871754 - RNA, 18 nt, Mycobacterium avium subsp. paratuberculosis
agcugacacccgacgaag

SEQ ID NO: 871755 - RNA, 13 nt, Mycobacterium avium subsp. paratuberculosis
agcugaccggcca

SEQ ID NO: 871756 - RNA, 19 nt, Mycobacterium avium subsp. paratuberculosis
agcugacgaacgcgccgcc

SEQ ID NO: 871757 - RNA, 21 nt, Mycobacterium avium subsp. paratuberculosis
agcugacgaacgcgccgccca

SEQ ID NO: 871758 - RNA, 22 nt, Mycobacterium avium subsp. paratuberculosis
agcugacgauucuugaccaccu

SEQ ID NO: 871759 - RNA, 18 nt, Mycobacterium avium subsp. paratuberculosis
agcugaagugcacucggc

SEQ ID NO: 871760 - RNA, 22 nt, Mycobacterium avium subsp. paratuberculosis
agcugaagugcacucggcgaug

SEQ ID NO: 871761 - RNA, 16 nt, Mycobacterium avium subsp. paratuberculosis
agcucguucucggcga

SEQ ID NO: 871762 - RNA, 18 nt, Mycobacterium avium subsp. paratuberculosis
agcucguugccggcggcc

SEQ ID NO: 871763 - RNA, 15 nt, Mycobacterium avium subsp. paratuberculosis
agcucgucgccgacc

SEQ ID NO: 871764 - RNA, 20 nt, Mycobacterium avium subsp. paratuberculosis
agcucgugaugguccagcac

SEQ ID NO: 871765 - RNA, 23 nt, Mycobacterium avium subsp. paratuberculosis
agcucgucggguguggcgccgug

SEQ ID NO: 871766 - RNA, 16 nt, Mycobacterium avium subsp. paratuberculosis
agcucgucgagccggc

SEQ ID NO: 871767 - RNA, 17 nt, Mycobacterium avium subsp. paratuberculosis
agcucgucgagccggcc

SEQ ID NO: 871768 - RNA, 15 nt, Mycobacterium avium subsp. paratuberculosis
agcugcugccgccgc

SEQ ID NO: 871769 - RNA, 15 nt, Mycobacterium avium subsp. paratuberculosis
agcugcugcgcggcg

SEQ ID NO: 871770 - RNA, 18 nt, Mycobacterium avium subsp. paratuberculosis
agcugcugcggccggacc

SEQ ID NO: 871771 - RNA, 15 nt, Mycobacterium avium subsp. paratuberculosis
agcugcuggcgugaa

SEQ ID NO: 871772 - RNA, 17 nt, Mycobacterium avium subsp. paratuberculosis
agcugcucggccaccgc

SEQ ID NO: 871773 - RNA, 18 nt, Mycobacterium avium subsp. paratuberculosis
agcugcucggccaccgcg

SEQ ID NO: 871774 - RNA, 19 nt, Mycobacterium avium subsp. paratuberculosis
agcugcucggccaccgcgc

SEQ ID NO: 871775 - RNA, 14 nt, Mycobacterium avium subsp. paratuberculosis
agcugaucgcggcc

SEQ ID NO: 871776 - RNA, 19 nt, Mycobacterium avium subsp. paratuberculosis
agcugaucgcggccggcga

SEQ ID NO: 871777 - RNA, 14 nt, Mycobacterium avium subsp. paratuberculosis
agcugaucgcgucg

SEQ ID NO: 871778 - RNA, 21 nt, Mycobacterium avium subsp. paratuberculosis
agcugaucgcgucgacggcgc

SEQ ID NO: 871779 - RNA, 22 nt, Mycobacterium avium subsp. paratuberculosis
agcugaucggcguuggcggcgu

SEQ ID NO: 871780 - RNA, 23 nt, Mycobacterium avium subsp. paratuberculosis
agcugaucggcguuggcggcguc

SEQ ID NO: 871781 - RNA, 14 nt, Mycobacterium avium subsp. paratuberculosis
agcugaucggggcc

SEQ ID NO: 871782 - RNA, 15 nt, Mycobacterium avium subsp. paratuberculosis
agcugcgucggcacc

SEQ ID NO: 871783 - RNA, 21 nt, Mycobacterium avium subsp. paratuberculosis
agcugcgucggcaccagcggc

SEQ ID NO: 871784 - RNA, 15 nt, Mycobacterium avium subsp. paratuberculosis
agcuaucagcucgcg

SEQ ID NO: 871785 - RNA, 18 nt, Mycobacterium avium subsp. paratuberculosis
agcuagcuucacgcucgg

SEQ ID NO: 871786 - RNA, 15 nt, Mycobacterium avium subsp. paratuberculosis
agcuaggucguggcg

SEQ ID NO: 871787 - RNA, 17 nt, Mycobacterium avium subsp. paratuberculosis
agcuaguuucacgcucg

SEQ ID NO: 871788 - RNA, 22 nt, Mycobacterium avium subsp. paratuberculosis
agcuaguuucacgcucggcggg

SEQ ID NO: 871789 - RNA, 22 nt, Mycobacterium avium subsp. paratuberculosis
agcguuccuuacgccgacguca

SEQ ID NO: 871790 - RNA, 20 nt, Mycobacterium avium subsp. paratuberculosis
agcguucguagaaccggccc

SEQ ID NO: 871791 - RNA, 21 nt, Mycobacterium avium subsp. paratuberculosis
agcguugccgcgcgcccgcgg

SEQ ID NO: 871792 - RNA, 22 nt, Mycobacterium avium subsp. paratuberculosis
agcguugccgcgcgcccgcggc

SEQ ID NO: 871793 - RNA, 16 nt, Mycobacterium avium subsp. paratuberculosis
agcgugacgucgacgu

SEQ ID NO: 871794 - RNA, 13 nt, Mycobacterium avium subsp. paratuberculosis
agcgugacccugc

SEQ ID NO: 871795 - RNA, 23 nt, Mycobacterium avium subsp. paratuberculosis
agcgugccguccagcuccgccga

SEQ ID NO: 871796 - RNA, 15 nt, Mycobacterium avium subsp. paratuberculosis
agcgugcgcggcugg

SEQ ID NO: 871797 - RNA, 17 nt, Mycobacterium avium subsp. paratuberculosis
agcgugcgcggcuggcc

SEQ ID NO: 871798 - RNA, 12 nt, Mycobacterium avium subsp. paratuberculosis
agcgugcugacg

SEQ ID NO: 871799 - RNA, 17 nt, Mycobacterium avium subsp. paratuberculosis
agcgugcugacgucguc

SEQ ID NO: 871800 - RNA, 23 nt, Mycobacterium avium subsp. paratuberculosis
agcgugcugacgucgucgcccac

SEQ ID NO: 871801 - RNA, 20 nt, Mycobacterium avium subsp. paratuberculosis
agcgugcugccggacacccc

SEQ ID NO: 871802 - RNA, 14 nt, Mycobacterium avium subsp. paratuberculosis
agcguuccgccguc

SEQ ID NO: 871803 - RNA, 15 nt, Mycobacterium avium subsp. paratuberculosis
agcguuccggcggcc

SEQ ID NO: 871804 - RNA, 16 nt, Mycobacterium avium subsp. paratuberculosis
agcguuccggcggccg

SEQ ID NO: 871805 - RNA, 15 nt, Mycobacterium avium subsp. paratuberculosis
agcgugggcaccggc

SEQ ID NO: 871806 - RNA, 17 nt, Mycobacterium avium subsp. paratuberculosis
agcgugggcaccggcac

SEQ ID NO: 871807 - RNA, 20 nt, Mycobacterium avium subsp. paratuberculosis
agcgugggcaccggcaccgc

SEQ ID NO: 871808 - RNA, 14 nt, Mycobacterium avium subsp. paratuberculosis
agcguggacaccgc

SEQ ID NO: 871809 - RNA, 17 nt, Mycobacterium avium subsp. paratuberculosis
agcguggacaccgcacc

SEQ ID NO: 871810 - RNA, 21 nt, Mycobacterium avium subsp. paratuberculosis
agcguggcgcgccccggcccg

SEQ ID NO: 871811 - RNA, 14 nt, Mycobacterium avium subsp. paratuberculosis
agcggugacaucgc

SEQ ID NO: 871812 - RNA, 16 nt, Mycobacterium avium subsp. paratuberculosis
agcggugacaucgcca

SEQ ID NO: 871813 - RNA, 20 nt, Mycobacterium avium subsp. paratuberculosis
agcggugaccucgagcaccg

SEQ ID NO: 871814 - RNA, 17 nt, Mycobacterium avium subsp. paratuberculosis
agcggucgcggaaccgg

SEQ ID NO: 871815 - RNA, 14 nt, Mycobacterium avium subsp. paratuberculosis
agcggucggcgguu

SEQ ID NO: 871816 - RNA, 20 nt, Mycobacterium avium subsp. paratuberculosis
agcggucgggaucggugaag

SEQ ID NO: 871817 - RNA, 14 nt, Mycobacterium avium subsp. paratuberculosis
agcggucgggugcg

SEQ ID NO: 871818 - RNA, 19 nt, Mycobacterium avium subsp. paratuberculosis
agcgguccauccagcgccg

SEQ ID NO: 871819 - RNA, 23 nt, Mycobacterium avium subsp. paratuberculosis
agcgguccauccagcgccgcagc

SEQ ID NO: 871820 - RNA, 22 nt, Mycobacterium avium subsp. paratuberculosis
agcgguccagcgugaacgugug

SEQ ID NO: 871821 - RNA, 13 nt, Mycobacterium avium subsp. paratuberculosis
agcgguccagcgu

SEQ ID NO: 871822 - RNA, 16 nt, Mycobacterium avium subsp. paratuberculosis
agcggugcagccccgc

SEQ ID NO: 871823 - RNA, 18 nt, Mycobacterium avium subsp. paratuberculosis
agcggugcagccccgcac

SEQ ID NO: 871824 - RNA, 19 nt, Mycobacterium avium subsp. paratuberculosis
agcggugaucgcgucaacc

SEQ ID NO: 871825 - RNA, 14 nt, Mycobacterium avium subsp. paratuberculosis
agcggugccgcccg

SEQ ID NO: 871826 - RNA, 23 nt, Mycobacterium avium subsp. paratuberculosis
agcgguggcguucacaguaggcg

SEQ ID NO: 871827 - RNA, 12 nt, Mycobacterium avium subsp. paratuberculosis
agcgguggccac

SEQ ID NO: 871828 - RNA, 23 nt, Mycobacterium avium subsp. paratuberculosis
agcguccgggcguagugcagcug

SEQ ID NO: 871829 - RNA, 14 nt, Mycobacterium avium subsp. paratuberculosis
agcgucccgucggc

SEQ ID NO: 871830 - RNA, 15 nt, Mycobacterium avium subsp. paratuberculosis
agcgucgacgcggug

SEQ ID NO: 871831 - RNA, 18 nt, Mycobacterium avium subsp. paratuberculosis
agcgucgacugcaccgac

SEQ ID NO: 871832 - RNA, 20 nt, Mycobacterium avium subsp. paratuberculosis
agcgucgacugcaccgacuc

SEQ ID NO: 871833 - RNA, 19 nt, Mycobacterium avium subsp. paratuberculosis
agcgucgccaauccggcgg

SEQ ID NO: 871834 - RNA, 20 nt, Mycobacterium avium subsp. paratuberculosis
agcgucgccaauccggcggg

SEQ ID NO: 871835 - RNA, 13 nt, Mycobacterium avium subsp. paratuberculosis
agcgucgccacca

SEQ ID NO: 871836 - RNA, 14 nt, Mycobacterium avium subsp. paratuberculosis
agcgucgccaccac

SEQ ID NO: 871837 - RNA, 16 nt, Mycobacterium avium subsp. paratuberculosis
agcgucgccaccaccu

SEQ ID NO: 871838 - RNA, 15 nt, Mycobacterium avium subsp. paratuberculosis
agcgucgccagccgc

SEQ ID NO: 871839 - RNA, 16 nt, Mycobacterium avium subsp. paratuberculosis
agcgucgccagccgcc

SEQ ID NO: 871840 - RNA, 17 nt, Mycobacterium avium subsp. paratuberculosis
agcgucgccagccgccg

SEQ ID NO: 871841 - RNA, 15 nt, Mycobacterium avium subsp. paratuberculosis
agcgucucggcggcc

SEQ ID NO: 871842 - RNA, 16 nt, Mycobacterium avium subsp. paratuberculosis
agcgucucggcggccg

SEQ ID NO: 871843 - RNA, 19 nt, Mycobacterium avium subsp. paratuberculosis
agcgucucggcggccgagc

SEQ ID NO: 871844 - RNA, 18 nt, Mycobacterium avium subsp. paratuberculosis
agcgucuucuucucgccg

SEQ ID NO: 871845 - RNA, 22 nt, Mycobacterium avium subsp. paratuberculosis
agcgucuucuucucgccguccc

SEQ ID NO: 871846 - RNA, 19 nt, Mycobacterium avium subsp. paratuberculosis
agcgugaaacuaacuucac

SEQ ID NO: 871847 - RNA, 20 nt, Mycobacterium avium subsp. paratuberculosis
agcgugaaacuaacuucacg

SEQ ID NO: 871848 - RNA, 20 nt, Mycobacterium avium subsp. paratuberculosis
agcgucuggcagccggccgg

SEQ ID NO: 871849 - RNA, 15 nt, Mycobacterium avium subsp. paratuberculosis
agcgucuggcgggug

SEQ ID NO: 871850 - RNA, 19 nt, Mycobacterium avium subsp. paratuberculosis
agcgugaacaccgcguugg

SEQ ID NO: 871851 - RNA, 15 nt, Mycobacterium avium subsp. paratuberculosis
agcgugaacagcgcc

SEQ ID NO: 871852 - RNA, 16 nt, Mycobacterium avium subsp. paratuberculosis
agcgugaacagcgccc

SEQ ID NO: 871853 - RNA, 18 nt, Mycobacterium avium subsp. paratuberculosis
agcgugaacagcgcccgg

SEQ ID NO: 871854 - RNA, 16 nt, Mycobacterium avium subsp. paratuberculosis
agcgugacagucgacc

SEQ ID NO: 871855 - RNA, 17 nt, Mycobacterium avium subsp. paratuberculosis
agcgugacagucgaccu

SEQ ID NO: 871856 - RNA, 20 nt, Mycobacterium avium subsp. paratuberculosis
agcgugaacuuaacuucacg

SEQ ID NO: 871857 - RNA, 20 nt, Mycobacterium avium subsp. paratuberculosis
agcgugaagcuagcuucacg

SEQ ID NO: 871858 - RNA, 21 nt, Mycobacterium avium subsp. paratuberculosis
agcgugaagcuagcuucacgc

SEQ ID NO: 871859 - RNA, 17 nt, Mycobacterium avium subsp. paratuberculosis
agcggacccggucggcc

SEQ ID NO: 871860 - RNA, 18 nt, Mycobacterium avium subsp. paratuberculosis
agcggacccggucggccg

SEQ ID NO: 871861 - RNA, 18 nt, Mycobacterium avium subsp. paratuberculosis
agcggacccuucagccag

SEQ ID NO: 871862 - RNA, 22 nt, Mycobacterium avium subsp. paratuberculosis
agcggacccuucagccagaucg

SEQ ID NO: 871863 - RNA, 19 nt, Mycobacterium avium subsp. paratuberculosis
agcgcugucgcgggcccgc

SEQ ID NO: 871864 - RNA, 21 nt, Mycobacterium avium subsp. paratuberculosis
agcgcugucgcgggcccgcgu

SEQ ID NO: 871865 - RNA, 18 nt, Mycobacterium avium subsp. paratuberculosis
agcgcugguugucgacgc

SEQ ID NO: 871866 - RNA, 15 nt, Mycobacterium avium subsp. paratuberculosis
agcgcugguaccggu

SEQ ID NO: 871867 - RNA, 19 nt, Mycobacterium avium subsp. paratuberculosis
agcgcugguaguacaccgg

SEQ ID NO: 871868 - RNA, 15 nt, Mycobacterium avium subsp. paratuberculosis
agcgcuggucggcga

SEQ ID NO: 871869 - RNA, 20 nt, Mycobacterium avium subsp. paratuberculosis
agcgcuccugcagcgcggcg

SEQ ID NO: 871870 - RNA, 15 nt, Mycobacterium avium subsp. paratuberculosis
agcgcuuccagcgcg

SEQ ID NO: 871871 - RNA, 16 nt, Mycobacterium avium subsp. paratuberculosis
agcgcuuccagcgcgg

SEQ ID NO: 871872 - RNA, 19 nt, Mycobacterium avium subsp. paratuberculosis
agcgcuuccagcgcggcga

SEQ ID NO: 871873 - RNA, 19 nt, Mycobacterium avium subsp. paratuberculosis
agcggcaccuuggugagca

SEQ ID NO: 871874 - RNA, 23 nt, Mycobacterium avium subsp. paratuberculosis
agcggcacgaaguugguguccac

SEQ ID NO: 871875 - RNA, 15 nt, Mycobacterium avium subsp. paratuberculosis
agcggcaccgucacc

SEQ ID NO: 871876 - RNA, 15 nt, Mycobacterium avium subsp. paratuberculosis
agcggcacgggcacc

SEQ ID NO: 871877 - RNA, 18 nt, Mycobacterium avium subsp. paratuberculosis
agcggcacgggcaccgac

SEQ ID NO: 871878 - RNA, 18 nt, Mycobacterium avium subsp. paratuberculosis
agcggcacgaucggcagc

SEQ ID NO: 871879 - RNA, 21 nt, Mycobacterium avium subsp. paratuberculosis
agcggcacgaucggcagcgcc

SEQ ID NO: 871880 - RNA, 21 nt, Mycobacterium avium subsp. paratuberculosis
agcggcagauggucucgaucu

SEQ ID NO: 871881 - RNA, 15 nt, Mycobacterium avium subsp. paratuberculosis
agcggcagccacggc

SEQ ID NO: 871882 - RNA, 17 nt, Mycobacterium avium subsp. paratuberculosis
agcggcagccacggcag

SEQ ID NO: 871883 - RNA, 18 nt, Mycobacterium avium subsp. paratuberculosis
agcggcagccacggcagc

SEQ ID NO: 871884 - RNA, 12 nt, Mycobacterium avium subsp. paratuberculosis
agcggcagcagc

SEQ ID NO: 871885 - RNA, 18 nt, Mycobacterium avium subsp. paratuberculosis
agcggcagcagcaccagc

SEQ ID NO: 871886 - RNA, 14 nt, Mycobacterium avium subsp. paratuberculosis
agcggacgacggcc

SEQ ID NO: 871887 - RNA, 16 nt, Mycobacterium avium subsp. paratuberculosis
agcggacgacggccag

SEQ ID NO: 871888 - RNA, 16 nt, Mycobacterium avium subsp. paratuberculosis
agcggaucggcggcga

SEQ ID NO: 871889 - RNA, 18 nt, Mycobacterium avium subsp. paratuberculosis
agcggagugaccgccagc

SEQ ID NO: 871890 - RNA, 23 nt, Mycobacterium avium subsp. paratuberculosis
agcggagugaccgccagcaccgc

SEQ ID NO: 871891 - RNA, 18 nt, Mycobacterium avium subsp. paratuberculosis
agcggaucaggucgguca

SEQ ID NO: 871892 - RNA, 14 nt, Mycobacterium avium subsp. paratuberculosis
agcgcuacugccgc

SEQ ID NO: 871893 - RNA, 20 nt, Mycobacterium avium subsp. paratuberculosis
agcgcuaacaaaagcccgag

SEQ ID NO: 871894 - RNA, 13 nt, Mycobacterium avium subsp. paratuberculosis
agcgcuaaccgcg

SEQ ID NO: 871895 - RNA, 13 nt, Mycobacterium avium subsp. paratuberculosis
agcgcuaccgcgc

SEQ ID NO: 871896 - RNA, 14 nt, Mycobacterium avium subsp. paratuberculosis
agcgcuaccgcgcu

SEQ ID NO: 871897 - RNA, 15 nt, Mycobacterium avium subsp. paratuberculosis
agcgcuaccgcgcuc

SEQ ID NO: 871898 - RNA, 21 nt, Mycobacterium avium subsp. paratuberculosis
agcgcguugcggaucucgacc

SEQ ID NO: 871899 - RNA, 14 nt, Mycobacterium avium subsp. paratuberculosis
agcgcguuggccag

SEQ ID NO: 871900 - RNA, 18 nt, Mycobacterium avium subsp. paratuberculosis
agcgcguucuccaccgcg

SEQ ID NO: 871901 - RNA, 21 nt, Mycobacterium avium subsp. paratuberculosis
agcgcguucagggugcaggcc

SEQ ID NO: 871902 - RNA, 20 nt, Mycobacterium avium subsp. paratuberculosis
agcgcguagagcaucagguc

SEQ ID NO: 871903 - RNA, 16 nt, Mycobacterium avium subsp. paratuberculosis
agcgcguagucggcgu

SEQ ID NO: 871904 - RNA, 20 nt, Mycobacterium avium subsp. paratuberculosis
agcgcguagucggcgucggc

SEQ ID NO: 871905 - RNA, 21 nt, Mycobacterium avium subsp. paratuberculosis
agcgcguagucggcgucggcc

SEQ ID NO: 871906 - RNA, 22 nt, Mycobacterium avium subsp. paratuberculosis
agcgcggugaagucggugccca

SEQ ID NO: 871907 - RNA, 15 nt, Mycobacterium avium subsp. paratuberculosis
agcgcggugcccagc

SEQ ID NO: 871908 - RNA, 16 nt, Mycobacterium avium subsp. paratuberculosis
agcgcggugccgaccu

SEQ ID NO: 871909 - RNA, 18 nt, Mycobacterium avium subsp. paratuberculosis
agcgcgguggucagcggc

SEQ ID NO: 871910 - RNA, 17 nt, Mycobacterium avium subsp. paratuberculosis
agcgcgguuuccggcga

SEQ ID NO: 871911 - RNA, 19 nt, Mycobacterium avium subsp. paratuberculosis
agcgcgguuuccggcgauu

SEQ ID NO: 871912 - RNA, 18 nt, Mycobacterium avium subsp. paratuberculosis
agcgcggucaacaccggg

SEQ ID NO: 871913 - RNA, 18 nt, Mycobacterium avium subsp. paratuberculosis
agcgcgguccacgguggc

SEQ ID NO: 871914 - RNA, 19 nt, Mycobacterium avium subsp. paratuberculosis
agcgcgguccacgguggcg

SEQ ID NO: 871915 - RNA, 19 nt, Mycobacterium avium subsp. paratuberculosis
agcgcggucgccaccacca

SEQ ID NO: 871916 - RNA, 18 nt, Mycobacterium avium subsp. paratuberculosis
agcgcgggcagcccaggu

SEQ ID NO: 871917 - RNA, 13 nt, Mycobacterium avium subsp. paratuberculosis
agcgcgggccagc

SEQ ID NO: 871918 - RNA, 21 nt, Mycobacterium avium subsp. paratuberculosis
agcgcggggucggccagucgu

SEQ ID NO: 871919 - RNA, 17 nt, Mycobacterium avium subsp. paratuberculosis
agcgcggcgaacccgag

SEQ ID NO: 871920 - RNA, 19 nt, Mycobacterium avium subsp. paratuberculosis
agcgcggcgaacccgagca

SEQ ID NO: 871921 - RNA, 14 nt, Mycobacterium avium subsp. paratuberculosis
agcgcggccgcccg

SEQ ID NO: 871922 - RNA, 15 nt, Mycobacterium avium subsp. paratuberculosis
agcgcggccgcccgu

SEQ ID NO: 871923 - RNA, 12 nt, Mycobacterium avium subsp. paratuberculosis
agcgcggcccgc

SEQ ID NO: 871924 - RNA, 13 nt, Mycobacterium avium subsp. paratuberculosis
agcgcggcccgcc

SEQ ID NO: 871925 - RNA, 16 nt, Mycobacterium avium subsp. paratuberculosis
agcgcggcccgcggcg

SEQ ID NO: 871926 - RNA, 12 nt, Mycobacterium avium subsp. paratuberculosis
agcgcggccagc

SEQ ID NO: 871927 - RNA, 15 nt, Mycobacterium avium subsp. paratuberculosis
agcgcggccacaccg

SEQ ID NO: 871928 - RNA, 14 nt, Mycobacterium avium subsp. paratuberculosis
agcgcggccaccac

SEQ ID NO: 871929 - RNA, 23 nt, Mycobacterium avium subsp. paratuberculosis
agcgcggccaccaccacggccau

SEQ ID NO: 871930 - RNA, 20 nt, Mycobacterium avium subsp. paratuberculosis
agcgcggcauggcuggcggc

SEQ ID NO: 871931 - RNA, 13 nt, Mycobacterium avium subsp. paratuberculosis
agcgcggcaugcc

SEQ ID NO: 871932 - RNA, 15 nt, Mycobacterium avium subsp. paratuberculosis
agcgcggcaugccgc

SEQ ID NO: 871933 - RNA, 22 nt, Mycobacterium avium subsp. paratuberculosis
agcggguugcgguccccggaga

SEQ ID NO: 871934 - RNA, 17 nt, Mycobacterium avium subsp. paratuberculosis
agcggguuuggccgcgg

SEQ ID NO: 871935 - RNA, 17 nt, Mycobacterium avium subsp. paratuberculosis
agcggguugccgcuggc

SEQ ID NO: 871936 - RNA, 20 nt, Mycobacterium avium subsp. paratuberculosis
agcggguuguucuccagcgg

SEQ ID NO: 871937 - RNA, 22 nt, Mycobacterium avium subsp. paratuberculosis
agcgggucgucgggccggggaa

SEQ ID NO: 871938 - RNA, 18 nt, Mycobacterium avium subsp. paratuberculosis
agcgggucgugcaucggc

SEQ ID NO: 871939 - RNA, 20 nt, Mycobacterium avium subsp. paratuberculosis
agcgggucgugcaucggcgc

SEQ ID NO: 871940 - RNA, 19 nt, Mycobacterium avium subsp. paratuberculosis
agcgggugaaucgacaccg

SEQ ID NO: 871941 - RNA, 19 nt, Mycobacterium avium subsp. paratuberculosis
agcgggugauggccgccgc

SEQ ID NO: 871942 - RNA, 18 nt, Mycobacterium avium subsp. paratuberculosis
agcggcuuggucaccagc

SEQ ID NO: 871943 - RNA, 23 nt, Mycobacterium avium subsp. paratuberculosis
agcggggcgaacccggcgcccgg

SEQ ID NO: 871944 - RNA, 18 nt, Mycobacterium avium subsp. paratuberculosis
agcggggcguccagcgag

SEQ ID NO: 871945 - RNA, 15 nt, Mycobacterium avium subsp. paratuberculosis
agcggcuugagccgg

SEQ ID NO: 871946 - RNA, 19 nt, Mycobacterium avium subsp. paratuberculosis
agcggcuugagccggaucg

SEQ ID NO: 871947 - RNA, 18 nt, Mycobacterium avium subsp. paratuberculosis
agcggcuugagcgccagc

SEQ ID NO: 871948 - RNA, 20 nt, Mycobacterium avium subsp. paratuberculosis
agcggcuugagcgccagcgc

SEQ ID NO: 871949 - RNA, 21 nt, Mycobacterium avium subsp. paratuberculosis
agcggcuugagcgccagcgcg

SEQ ID NO: 871950 - RNA, 16 nt, Mycobacterium avium subsp. paratuberculosis
agcggcuguagcaccc

SEQ ID NO: 871951 - RNA, 17 nt, Mycobacterium avium subsp. paratuberculosis
agcggcuguagcacccg

SEQ ID NO: 871952 - RNA, 18 nt, Mycobacterium avium subsp. paratuberculosis
agcggcuguagcacccgg

SEQ ID NO: 871953 - RNA, 19 nt, Mycobacterium avium subsp. paratuberculosis
agcggcuguagcacccggc

SEQ ID NO: 871954 - RNA, 22 nt, Mycobacterium avium subsp. paratuberculosis
agcggcuguagcacccggccgg

SEQ ID NO: 871955 - RNA, 23 nt, Mycobacterium avium subsp. paratuberculosis
agcggggcaagcagcggcagcca

SEQ ID NO: 871956 - RNA, 17 nt, Mycobacterium avium subsp. paratuberculosis
agcggggugugcucggc

SEQ ID NO: 871957 - RNA, 21 nt, Mycobacterium avium subsp. paratuberculosis
agcggggugugcucggcggcg

SEQ ID NO: 871958 - RNA, 21 nt, Mycobacterium avium subsp. paratuberculosis
agcgggguguucaccgcgccg

SEQ ID NO: 871959 - RNA, 21 nt, Mycobacterium avium subsp. paratuberculosis
agcggguaaccgcagccgggu

SEQ ID NO: 871960 - RNA, 23 nt, Mycobacterium avium subsp. paratuberculosis
agcggguaaccgcagccgggugc

SEQ ID NO: 871961 - RNA, 13 nt, Mycobacterium avium subsp. paratuberculosis
agcggggugagcu

SEQ ID NO: 871962 - RNA, 16 nt, Mycobacterium avium subsp. paratuberculosis
agcggguccagccgcc

SEQ ID NO: 871963 - RNA, 19 nt, Mycobacterium avium subsp. paratuberculosis
agcggguccagccgccggc

SEQ ID NO: 871964 - RNA, 16 nt, Mycobacterium avium subsp. paratuberculosis
agcggguccgccccga

SEQ ID NO: 871965 - RNA, 17 nt, Mycobacterium avium subsp. paratuberculosis
agcggguccgccccgag

SEQ ID NO: 871966 - RNA, 18 nt, Mycobacterium avium subsp. paratuberculosis
agcggguccgccccgaga

SEQ ID NO: 871967 - RNA, 23 nt, Mycobacterium avium subsp. paratuberculosis
agcgggucgauggcgacggggug

SEQ ID NO: 871968 - RNA, 15 nt, Mycobacterium avium subsp. paratuberculosis
agcgggucggccggc

SEQ ID NO: 871969 - RNA, 22 nt, Mycobacterium avium subsp. paratuberculosis
agcggcugcugcagcgcccggg

SEQ ID NO: 871970 - RNA, 20 nt, Mycobacterium avium subsp. paratuberculosis
agcggcugaccgagcggcgc

SEQ ID NO: 871971 - RNA, 22 nt, Mycobacterium avium subsp. paratuberculosis
agcggcggcacgguuggccggc

SEQ ID NO: 871972 - RNA, 16 nt, Mycobacterium avium subsp. paratuberculosis
agcggcgccgcagcuc

SEQ ID NO: 871973 - RNA, 17 nt, Mycobacterium avium subsp. paratuberculosis
agcggcucgcgggugcg

SEQ ID NO: 871974 - RNA, 22 nt, Mycobacterium avium subsp. paratuberculosis
agcggcucgcgggugcggcgcu

SEQ ID NO: 871975 - RNA, 23 nt, Mycobacterium avium subsp. paratuberculosis
agcggcucgcgggugcggcgcug

SEQ ID NO: 871976 - RNA, 15 nt, Mycobacterium avium subsp. paratuberculosis
agcggcgcgucgcug

SEQ ID NO: 871977 - RNA, 18 nt, Mycobacterium avium subsp. paratuberculosis
agcggcgcgucgcugggc

SEQ ID NO: 871978 - RNA, 21 nt, Mycobacterium avium subsp. paratuberculosis
agcggcgcgucgcugggcagc

SEQ ID NO: 871979 - RNA, 23 nt, Mycobacterium avium subsp. paratuberculosis
agcggcgcgucgcugggcagccg

SEQ ID NO: 871980 - RNA, 19 nt, Mycobacterium avium subsp. paratuberculosis
agcggcggaugggugcggu

SEQ ID NO: 871981 - RNA, 12 nt, Mycobacterium avium subsp. paratuberculosis
agcggcgcgguu

SEQ ID NO: 871982 - RNA, 12 nt, Mycobacterium avium subsp. paratuberculosis
agcggcgcgucc

SEQ ID NO: 871983 - RNA, 22 nt, Mycobacterium avium subsp. paratuberculosis
agcggcgcguccauggucgagc

SEQ ID NO: 871984 - RNA, 14 nt, Mycobacterium avium subsp. paratuberculosis
agcggcgcgccggg

SEQ ID NO: 871985 - RNA, 15 nt, Mycobacterium avium subsp. paratuberculosis
agcggcgcgccgggc

SEQ ID NO: 871986 - RNA, 18 nt, Mycobacterium avium subsp. paratuberculosis
agcggcgcgccgggcagc

SEQ ID NO: 871987 - RNA, 14 nt, Mycobacterium avium subsp. paratuberculosis
agcggcgcgcgccg

SEQ ID NO: 871988 - RNA, 18 nt, Mycobacterium avium subsp. paratuberculosis
agcggcgcgcgccgcagc

SEQ ID NO: 871989 - RNA, 14 nt, Mycobacterium avium subsp. paratuberculosis
agcggcgcugcagc

SEQ ID NO: 871990 - RNA, 17 nt, Mycobacterium avium subsp. paratuberculosis
agcggcgcugcagcagc

SEQ ID NO: 871991 - RNA, 20 nt, Mycobacterium avium subsp. paratuberculosis
agcggcgcugcagcagcccg

SEQ ID NO: 871992 - RNA, 14 nt, Mycobacterium avium subsp. paratuberculosis
agcggcgcuugacg

SEQ ID NO: 871993 - RNA, 21 nt, Mycobacterium avium subsp. paratuberculosis
agcggcgcuugacgaacgcca

SEQ ID NO: 871994 - RNA, 14 nt, Mycobacterium avium subsp. paratuberculosis
agcggcggaggggc

SEQ ID NO: 871995 - RNA, 13 nt, Mycobacterium avium subsp. paratuberculosis
agcggccagcccg

SEQ ID NO: 871996 - RNA, 13 nt, Mycobacterium avium subsp. paratuberculosis
agcggcgccggga

SEQ ID NO: 871997 - RNA, 13 nt, Mycobacterium avium subsp. paratuberculosis
agcggcgccgggu

SEQ ID NO: 871998 - RNA, 20 nt, Mycobacterium avium subsp. paratuberculosis
agcggcgccgggucaccgga

SEQ ID NO: 871999 - RNA, 16 nt, Mycobacterium avium subsp. paratuberculosis
agcggcgccuggucaa

SEQ ID NO: 872000 - RNA, 16 nt, Mycobacterium avium subsp. paratuberculosis
agcggcacgucgccgu

SEQ ID NO: 872001 - RNA, 18 nt, Mycobacterium avium subsp. paratuberculosis
agcggcagcgucgccagc

SEQ ID NO: 872002 - RNA, 20 nt, Mycobacterium avium subsp. paratuberculosis
agcggcagcgucgccagccg

SEQ ID NO: 872003 - RNA, 19 nt, Mycobacterium avium subsp. paratuberculosis
agcggcagcgacagcgcgu

SEQ ID NO: 872004 - RNA, 15 nt, Mycobacterium avium subsp. paratuberculosis
agcggcagcgccagc

SEQ ID NO: 872005 - RNA, 15 nt, Mycobacterium avium subsp. paratuberculosis
agcggcagcggcguc

SEQ ID NO: 872006 - RNA, 17 nt, Mycobacterium avium subsp. paratuberculosis
agcggcauggcgaugac

SEQ ID NO: 872007 - RNA, 15 nt, Mycobacterium avium subsp. paratuberculosis
agcggccacaccggg

SEQ ID NO: 872008 - RNA, 16 nt, Mycobacterium avium subsp. paratuberculosis
agcggcaggucgucgu

SEQ ID NO: 872009 - RNA, 20 nt, Mycobacterium avium subsp. paratuberculosis
agcggcaggucgucgucgcc

SEQ ID NO: 872010 - RNA, 22 nt, Mycobacterium avium subsp. paratuberculosis
agcggcaucgaggaccggcgcc

SEQ ID NO: 872011 - RNA, 12 nt, Mycobacterium avium subsp. paratuberculosis
agcggcaucgcc

SEQ ID NO: 872012 - RNA, 18 nt, Mycobacterium avium subsp. paratuberculosis
agcggcaucgccgccaag

SEQ ID NO: 872013 - RNA, 20 nt, Mycobacterium avium subsp. paratuberculosis
agcgaauccgggugucgacg

SEQ ID NO: 872014 - RNA, 14 nt, Mycobacterium avium subsp. paratuberculosis
agcgacagcacccg

SEQ ID NO: 872015 - RNA, 15 nt, Mycobacterium avium subsp. paratuberculosis
agcgacaccaggucg

SEQ ID NO: 872016 - RNA, 15 nt, Mycobacterium avium subsp. paratuberculosis
agcgacaacggcccc

SEQ ID NO: 872017 - RNA, 23 nt, Mycobacterium avium subsp. paratuberculosis
agcgacaacguggugugcaccag

SEQ ID NO: 872018 - RNA, 18 nt, Mycobacterium avium subsp. paratuberculosis
agcgacaaucggcucgcc

SEQ ID NO: 872019 - RNA, 13 nt, Mycobacterium avium subsp. paratuberculosis
agcgacggccggg

SEQ ID NO: 872020 - RNA, 15 nt, Mycobacterium avium subsp. paratuberculosis
agcgacgggccgggc

SEQ ID NO: 872021 - RNA, 23 nt, Mycobacterium avium subsp. paratuberculosis
agcgacgggccgggcacgucgac

SEQ ID NO: 872022 - RNA, 20 nt, Mycobacterium avium subsp. paratuberculosis
agcgacgcggugagcgcgcc

SEQ ID NO: 872023 - RNA, 19 nt, Mycobacterium avium subsp. paratuberculosis
agcgacggaucggccgcgu

SEQ ID NO: 872024 - RNA, 16 nt, Mycobacterium avium subsp. paratuberculosis
agcgacaugaccaccg

SEQ ID NO: 872025 - RNA, 17 nt, Mycobacterium avium subsp. paratuberculosis
agcgacaugaccaccgc

SEQ ID NO: 872026 - RNA, 15 nt, Mycobacterium avium subsp. paratuberculosis
agcgacagcgcgucg

SEQ ID NO: 872027 - RNA, 21 nt, Mycobacterium avium subsp. paratuberculosis
agcgacagcgcgucggccagc

SEQ ID NO: 872028 - RNA, 15 nt, Mycobacterium avium subsp. paratuberculosis
agcgcaccggcgaug

SEQ ID NO: 872029 - RNA, 12 nt, Mycobacterium avium subsp. paratuberculosis
agcgcagcgcca

SEQ ID NO: 872030 - RNA, 15 nt, Mycobacterium avium subsp. paratuberculosis
agcgcaccgcggagc

SEQ ID NO: 872031 - RNA, 20 nt, Mycobacterium avium subsp. paratuberculosis
agcgcaccgcggagcgcaac

SEQ ID NO: 872032 - RNA, 15 nt, Mycobacterium avium subsp. paratuberculosis
agcgcaccgccgucg

SEQ ID NO: 872033 - RNA, 16 nt, Mycobacterium avium subsp. paratuberculosis
agcgcaccgccgucgg

SEQ ID NO: 872034 - RNA, 23 nt, Mycobacterium avium subsp. paratuberculosis
agcgcaccgccgucggggcgucg

SEQ ID NO: 872035 - RNA, 15 nt, Mycobacterium avium subsp. paratuberculosis
agcgcaccgagcccg

SEQ ID NO: 872036 - RNA, 16 nt, Mycobacterium avium subsp. paratuberculosis
agcgcacacagcagca

SEQ ID NO: 872037 - RNA, 19 nt, Mycobacterium avium subsp. paratuberculosis
agcgcaccagauucaccag

SEQ ID NO: 872038 - RNA, 19 nt, Mycobacterium avium subsp. paratuberculosis
agcgagcugccggcggccg

SEQ ID NO: 872039 - RNA, 21 nt, Mycobacterium avium subsp. paratuberculosis
agcgcaacguguacucggcgu

SEQ ID NO: 872040 - RNA, 15 nt, Mycobacterium avium subsp. paratuberculosis
agcgcaagggccgac

SEQ ID NO: 872041 - RNA, 23 nt, Mycobacterium avium subsp. paratuberculosis
agcgcaagggccgacaucgucgg

SEQ ID NO: 872042 - RNA, 21 nt, Mycobacterium avium subsp. paratuberculosis
agcgaggacgucgagcggcgc

SEQ ID NO: 872043 - RNA, 15 nt, Mycobacterium avium subsp. paratuberculosis
agcgaggcggccagc

SEQ ID NO: 872044 - RNA, 19 nt, Mycobacterium avium subsp. paratuberculosis
agcgaggugugaggagucg

SEQ ID NO: 872045 - RNA, 15 nt, Mycobacterium avium subsp. paratuberculosis
agcgaguccagccag

SEQ ID NO: 872046 - RNA, 16 nt, Mycobacterium avium subsp. paratuberculosis
agcgaguccagccagc

SEQ ID NO: 872047 - RNA, 22 nt, Mycobacterium avium subsp. paratuberculosis
agcgaguccagccagccgcgcc

SEQ ID NO: 872048 - RNA, 16 nt, Mycobacterium avium subsp. paratuberculosis
agcgaggccucgccgc

SEQ ID NO: 872049 - RNA, 15 nt, Mycobacterium avium subsp. paratuberculosis
agcgaggcgacgucg

SEQ ID NO: 872050 - RNA, 13 nt, Mycobacterium avium subsp. paratuberculosis
agcgaggcgccac

SEQ ID NO: 872051 - RNA, 15 nt, Mycobacterium avium subsp. paratuberculosis
agcgaggcgcgcagg

SEQ ID NO: 872052 - RNA, 21 nt, Mycobacterium avium subsp. paratuberculosis
agcgagcgguuggcgacgcug

SEQ ID NO: 872053 - RNA, 14 nt, Mycobacterium avium subsp. paratuberculosis
agcgagccgucgac

SEQ ID NO: 872054 - RNA, 13 nt, Mycobacterium avium subsp. paratuberculosis
agcgagcgcuggc

SEQ ID NO: 872055 - RNA, 14 nt, Mycobacterium avium subsp. paratuberculosis
agcgagcgcuggcc

SEQ ID NO: 872056 - RNA, 19 nt, Mycobacterium avium subsp. paratuberculosis
agcgagcgggcacgccgcc

SEQ ID NO: 872057 - RNA, 20 nt, Mycobacterium avium subsp. paratuberculosis
agcgagcgggcacgccgccg

SEQ ID NO: 872058 - RNA, 21 nt, Mycobacterium avium subsp. paratuberculosis
agcgagcgggcacgccgccgc

SEQ ID NO: 872059 - RNA, 17 nt, Mycobacterium avium subsp. paratuberculosis
agcgacgucaggucgac

SEQ ID NO: 872060 - RNA, 23 nt, Mycobacterium avium subsp. paratuberculosis
agcgacgucaggucgaccggcuc

SEQ ID NO: 872061 - RNA, 16 nt, Mycobacterium avium subsp. paratuberculosis
agcgacgucugcggcu

SEQ ID NO: 872062 - RNA, 17 nt, Mycobacterium avium subsp. paratuberculosis
agcgacgucugcggcuc

SEQ ID NO: 872063 - RNA, 15 nt, Mycobacterium avium subsp. paratuberculosis
agcgacuccagcgcg

SEQ ID NO: 872064 - RNA, 16 nt, Mycobacterium avium subsp. paratuberculosis
agcgacuccagcgcga

SEQ ID NO: 872065 - RNA, 17 nt, Mycobacterium avium subsp. paratuberculosis
agcgacuccagcgcgau

SEQ ID NO: 872066 - RNA, 14 nt, Mycobacterium avium subsp. paratuberculosis
agcgacucguuggc

SEQ ID NO: 872067 - RNA, 15 nt, Mycobacterium avium subsp. paratuberculosis
agcgacucguuggcc

SEQ ID NO: 872068 - RNA, 14 nt, Mycobacterium avium subsp. paratuberculosis
agcgagccggcacg

SEQ ID NO: 872069 - RNA, 19 nt, Mycobacterium avium subsp. paratuberculosis
agcgagccggcacgcgcgc

SEQ ID NO: 872070 - RNA, 20 nt, Mycobacterium avium subsp. paratuberculosis
agcgagccggcacgcgcgcc

SEQ ID NO: 872071 - RNA, 20 nt, Mycobacterium avium subsp. paratuberculosis
agcgacucgaccccgcccag

SEQ ID NO: 872072 - RNA, 23 nt, Mycobacterium avium subsp. paratuberculosis
agcgacucgaccccgcccagcga

SEQ ID NO: 872073 - RNA, 15 nt, Mycobacterium avium subsp. paratuberculosis
agcgacuccugacgc

SEQ ID NO: 872074 - RNA, 14 nt, Mycobacterium avium subsp. paratuberculosis
agccgcuccaccgc

SEQ ID NO: 872075 - RNA, 15 nt, Mycobacterium avium subsp. paratuberculosis
agccgcuccaccgcg

SEQ ID NO: 872076 - RNA, 16 nt, Mycobacterium avium subsp. paratuberculosis
agccgcucacacagcc

SEQ ID NO: 872077 - RNA, 18 nt, Mycobacterium avium subsp. paratuberculosis
agccgcucacacagccgc

SEQ ID NO: 872078 - RNA, 17 nt, Mycobacterium avium subsp. paratuberculosis
agccgcucccggcgcag

SEQ ID NO: 872079 - RNA, 15 nt, Mycobacterium avium subsp. paratuberculosis
agccgcuccgcggcg

SEQ ID NO: 872080 - RNA, 18 nt, Mycobacterium avium subsp. paratuberculosis
agccgcuccgcggcgggc

SEQ ID NO: 872081 - RNA, 16 nt, Mycobacterium avium subsp. paratuberculosis
agccgcuccggcccga

SEQ ID NO: 872082 - RNA, 19 nt, Mycobacterium avium subsp. paratuberculosis
agccgcuccggcccgagca

SEQ ID NO: 872083 - RNA, 16 nt, Mycobacterium avium subsp. paratuberculosis
agccgcuccucguuga

SEQ ID NO: 872084 - RNA, 16 nt, Mycobacterium avium subsp. paratuberculosis
agccgcucggauuccc

SEQ ID NO: 872085 - RNA, 15 nt, Mycobacterium avium subsp. paratuberculosis
agccgggcucgagca

SEQ ID NO: 872086 - RNA, 16 nt, Mycobacterium avium subsp. paratuberculosis
agccgggugcccgcgu

SEQ ID NO: 872087 - RNA, 17 nt, Mycobacterium avium subsp. paratuberculosis
agccgggugcgggccag

SEQ ID NO: 872088 - RNA, 13 nt, Mycobacterium avium subsp. paratuberculosis
agccgggugcggu

SEQ ID NO: 872089 - RNA, 24 nt, Mycobacterium avium subsp. paratuberculosis
agccgggugcggugcagccgcggu

SEQ ID NO: 872090 - RNA, 17 nt, Mycobacterium avium subsp. paratuberculosis
agccggguggcccgcgc

SEQ ID NO: 872091 - RNA, 18 nt, Mycobacterium avium subsp. paratuberculosis
agccggguggcccgcgcg

SEQ ID NO: 872092 - RNA, 17 nt, Mycobacterium avium subsp. paratuberculosis
agccgggugaacccgac

SEQ ID NO: 872093 - RNA, 18 nt, Mycobacterium avium subsp. paratuberculosis
agccgggugaacccgacg

SEQ ID NO: 872094 - RNA, 23 nt, Mycobacterium avium subsp. paratuberculosis
agccgggugaacccgacguugcc

SEQ ID NO: 872095 - RNA, 18 nt, Mycobacterium avium subsp. paratuberculosis
agccggguagcgccgccg

SEQ ID NO: 872096 - RNA, 18 nt, Mycobacterium avium subsp. paratuberculosis
agccgggucauccagccg

SEQ ID NO: 872097 - RNA, 13 nt, Mycobacterium avium subsp. paratuberculosis
agccggggacggu

SEQ ID NO: 872098 - RNA, 22 nt, Mycobacterium avium subsp. paratuberculosis
agccggggacggugcagccggg

SEQ ID NO: 872099 - RNA, 17 nt, Mycobacterium avium subsp. paratuberculosis
agccggggcagcugcug

SEQ ID NO: 872100 - RNA, 23 nt, Mycobacterium avium subsp. paratuberculosis
agccgggggcggugcagccgggg

SEQ ID NO: 872101 - RNA, 13 nt, Mycobacterium avium subsp. paratuberculosis
agccgggguaggg

SEQ ID NO: 872102 - RNA, 18 nt, Mycobacterium avium subsp. paratuberculosis
agccgggguagggcggcg

SEQ ID NO: 872103 - RNA, 18 nt, Mycobacterium avium subsp. paratuberculosis
agccggggugcccgggcc

SEQ ID NO: 872104 - RNA, 16 nt, Mycobacterium avium subsp. paratuberculosis
agccgguagaucagcg

SEQ ID NO: 872105 - RNA, 16 nt, Mycobacterium avium subsp. paratuberculosis
agccgguccaugugcc

SEQ ID NO: 872106 - RNA, 21 nt, Mycobacterium avium subsp. paratuberculosis
agccgguccaugugccgcauc

SEQ ID NO: 872107 - RNA, 21 nt, Mycobacterium avium subsp. paratuberculosis
agccggucacgcugaucgacc

SEQ ID NO: 872108 - RNA, 15 nt, Mycobacterium avium subsp. paratuberculosis
agccgguccgaccag

SEQ ID NO: 872109 - RNA, 18 nt, Mycobacterium avium subsp. paratuberculosis
agccgguccgaccagcgg

SEQ ID NO: 872110 - RNA, 21 nt, Mycobacterium avium subsp. paratuberculosis
agccggucgcaggugaucuug

SEQ ID NO: 872111 - RNA, 13 nt, Mycobacterium avium subsp. paratuberculosis
agccggucgccgg

SEQ ID NO: 872112 - RNA, 17 nt, Mycobacterium avium subsp. paratuberculosis
agccggucgcgcaucgc

SEQ ID NO: 872113 - RNA, 21 nt, Mycobacterium avium subsp. paratuberculosis
agccggucgcgcaucgccucg

SEQ ID NO: 872114 - RNA, 15 nt, Mycobacterium avium subsp. paratuberculosis
agccggucggaggcc

SEQ ID NO: 872115 - RNA, 14 nt, Mycobacterium avium subsp. paratuberculosis
agccggucgggauc

SEQ ID NO: 872116 - RNA, 18 nt, Mycobacterium avium subsp. paratuberculosis
agccgguccggcggcacc

SEQ ID NO: 872117 - RNA, 22 nt, Mycobacterium avium subsp. paratuberculosis
agccgguccggcggcaccaccc

SEQ ID NO: 872118 - RNA, 19 nt, Mycobacterium avium subsp. paratuberculosis
agccggucgaacgccagcg

SEQ ID NO: 872119 - RNA, 21 nt, Mycobacterium avium subsp. paratuberculosis
agccggucgaacgccagcgcc

SEQ ID NO: 872120 - RNA, 13 nt, Mycobacterium avium subsp. paratuberculosis
agccggucgacga

SEQ ID NO: 872121 - RNA, 21 nt, Mycobacterium avium subsp. paratuberculosis
agccggucgaggucgccgaca

SEQ ID NO: 872122 - RNA, 23 nt, Mycobacterium avium subsp. paratuberculosis
agccggucgaggucgccgacagc

SEQ ID NO: 872123 - RNA, 17 nt, Mycobacterium avium subsp. paratuberculosis
agccggugaucgcggcg

SEQ ID NO: 872124 - RNA, 21 nt, Mycobacterium avium subsp. paratuberculosis
agccggugaugacgucgccca

SEQ ID NO: 872125 - RNA, 13 nt, Mycobacterium avium subsp. paratuberculosis
agccggugcccau

SEQ ID NO: 872126 - RNA, 14 nt, Mycobacterium avium subsp. paratuberculosis
agccggugcccauc

SEQ ID NO: 872127 - RNA, 15 nt, Mycobacterium avium subsp. paratuberculosis
agccggugcccaucg

SEQ ID NO: 872128 - RNA, 12 nt, Mycobacterium avium subsp. paratuberculosis
agccggugccga

SEQ ID NO: 872129 - RNA, 14 nt, Mycobacterium avium subsp. paratuberculosis
agccggugccgagg

SEQ ID NO: 872130 - RNA, 18 nt, Mycobacterium avium subsp. paratuberculosis
agccggugcgagccgcug

SEQ ID NO: 872131 - RNA, 16 nt, Mycobacterium avium subsp. paratuberculosis
agccggugcggucggc

SEQ ID NO: 872132 - RNA, 18 nt, Mycobacterium avium subsp. paratuberculosis
agccggugcggucggcgu

SEQ ID NO: 872133 - RNA, 19 nt, Mycobacterium avium subsp. paratuberculosis
agccggugcggucggcguc

SEQ ID NO: 872134 - RNA, 23 nt, Mycobacterium avium subsp. paratuberculosis
agccgguggcggccacgaucgcg

SEQ ID NO: 872135 - RNA, 18 nt, Mycobacterium avium subsp. paratuberculosis
agccgguggucaacgcgc

SEQ ID NO: 872136 - RNA, 19 nt, Mycobacterium avium subsp. paratuberculosis
agccguacacggcggcgaa

SEQ ID NO: 872137 - RNA, 19 nt, Mycobacterium avium subsp. paratuberculosis
agccgguugcgguggccga

SEQ ID NO: 872138 - RNA, 23 nt, Mycobacterium avium subsp. paratuberculosis
agccguaggacccuucgaacgcg

SEQ ID NO: 872139 - RNA, 13 nt, Mycobacterium avium subsp. paratuberculosis
agccguaggccag

SEQ ID NO: 872140 - RNA, 21 nt, Mycobacterium avium subsp. paratuberculosis
agccgucccgccgucucgacc

SEQ ID NO: 872141 - RNA, 16 nt, Mycobacterium avium subsp. paratuberculosis
agccgucccuguucgc

SEQ ID NO: 872142 - RNA, 22 nt, Mycobacterium avium subsp. paratuberculosis
agccgucccuguucgcgccggu

SEQ ID NO: 872143 - RNA, 16 nt, Mycobacterium avium subsp. paratuberculosis
agccgugcggcggcgg

SEQ ID NO: 872144 - RNA, 20 nt, Mycobacterium avium subsp. paratuberculosis
agccgugcggcggcggcggu

SEQ ID NO: 872145 - RNA, 18 nt, Mycobacterium avium subsp. paratuberculosis
agccguccggguucgacg

SEQ ID NO: 872146 - RNA, 14 nt, Mycobacterium avium subsp. paratuberculosis
agccgugggugccg

SEQ ID NO: 872147 - RNA, 18 nt, Mycobacterium avium subsp. paratuberculosis
agccgugggugccgacga

SEQ ID NO: 872148 - RNA, 21 nt, Mycobacterium avium subsp. paratuberculosis
agccgugggugccgacgagcu

SEQ ID NO: 872149 - RNA, 17 nt, Mycobacterium avium subsp. paratuberculosis
agccguuccaucgggcc

SEQ ID NO: 872150 - RNA, 21 nt, Mycobacterium avium subsp. paratuberculosis
agccguuccaucgggcccagc

SEQ ID NO: 872151 - RNA, 16 nt, Mycobacterium avium subsp. paratuberculosis
agccguugccgccgcg

SEQ ID NO: 872152 - RNA, 21 nt, Mycobacterium avium subsp. paratuberculosis
agccguugccgccgcgcgcgg

SEQ ID NO: 872153 - RNA, 17 nt, Mycobacterium avium subsp. paratuberculosis
agccguucgcgcacggc

SEQ ID NO: 872154 - RNA, 20 nt, Mycobacterium avium subsp. paratuberculosis
agccguucgcgcacggcgcg

SEQ ID NO: 872155 - RNA, 23 nt, Mycobacterium avium subsp. paratuberculosis
agccguugaugcgcaccgcggcg

SEQ ID NO: 872156 - RNA, 19 nt, Mycobacterium avium subsp. paratuberculosis
agccugggauugccgggca

SEQ ID NO: 872157 - RNA, 18 nt, Mycobacterium avium subsp. paratuberculosis
agccuggugauccucguc

SEQ ID NO: 872158 - RNA, 12 nt, Mycobacterium avium subsp. paratuberculosis
agccuggcacga

SEQ ID NO: 872159 - RNA, 19 nt, Mycobacterium avium subsp. paratuberculosis
agccuggcacgacgccgcc

SEQ ID NO: 872160 - RNA, 21 nt, Mycobacterium avium subsp. paratuberculosis
agccuggcacgacgccgccga

SEQ ID NO: 872161 - RNA, 20 nt, Mycobacterium avium subsp. paratuberculosis
agcgccucggugaagccgcg

SEQ ID NO: 872162 - RNA, 15 nt, Mycobacterium avium subsp. paratuberculosis
agcgccucgucgagc

SEQ ID NO: 872163 - RNA, 20 nt, Mycobacterium avium subsp. paratuberculosis
agcgccucgucgagccgggc

SEQ ID NO: 872164 - RNA, 21 nt, Mycobacterium avium subsp. paratuberculosis
agcgccucgucgagccgggcc

SEQ ID NO: 872165 - RNA, 15 nt, Mycobacterium avium subsp. paratuberculosis
agcgccucgccgggc

SEQ ID NO: 872166 - RNA, 19 nt, Mycobacterium avium subsp. paratuberculosis
agcgccucgccgggcccgc

SEQ ID NO: 872167 - RNA, 16 nt, Mycobacterium avium subsp. paratuberculosis
agcgccugcccggaga

SEQ ID NO: 872168 - RNA, 21 nt, Mycobacterium avium subsp. paratuberculosis
agcgccugguccucccgggug

SEQ ID NO: 872169 - RNA, 15 nt, Mycobacterium avium subsp. paratuberculosis
agcgccucgcgggug

SEQ ID NO: 872170 - RNA, 17 nt, Mycobacterium avium subsp. paratuberculosis
agcgccucgagcaccac

SEQ ID NO: 872171 - RNA, 13 nt, Mycobacterium avium subsp. paratuberculosis
agcgccucgccgg

SEQ ID NO: 872172 - RNA, 16 nt, Mycobacterium avium subsp. paratuberculosis
agcgccucggccucgu

SEQ ID NO: 872173 - RNA, 23 nt, Mycobacterium avium subsp. paratuberculosis
agcgccucggccucgucgacguc

SEQ ID NO: 872174 - RNA, 15 nt, Mycobacterium avium subsp. paratuberculosis
agcgccucggcgauc

SEQ ID NO: 872175 - RNA, 22 nt, Mycobacterium avium subsp. paratuberculosis
agcgccucggcgaucggccgcu

SEQ ID NO: 872176 - RNA, 21 nt, Mycobacterium avium subsp. paratuberculosis
agcgccucggcgggccgcccg

SEQ ID NO: 872177 - RNA, 16 nt, Mycobacterium avium subsp. paratuberculosis
agcgccucggcgucac

SEQ ID NO: 872178 - RNA, 19 nt, Mycobacterium avium subsp. paratuberculosis
agcgccucggcgucaccgc

SEQ ID NO: 872179 - RNA, 23 nt, Mycobacterium avium subsp. paratuberculosis
agcgccucggcgucaccgcgggu

SEQ ID NO: 872180 - RNA, 14 nt, Mycobacterium avium subsp. paratuberculosis
agcgccucggcgug

SEQ ID NO: 872181 - RNA, 17 nt, Mycobacterium avium subsp. paratuberculosis
agcgccucggcguggca

SEQ ID NO: 872182 - RNA, 22 nt, Mycobacterium avium subsp. paratuberculosis
agcgccucggcguggcaggcga

SEQ ID NO: 872183 - RNA, 15 nt, Mycobacterium avium subsp. paratuberculosis
agcgccgccaccggc

SEQ ID NO: 872184 - RNA, 16 nt, Mycobacterium avium subsp. paratuberculosis
agcgccgccaccggcc

SEQ ID NO: 872185 - RNA, 22 nt, Mycobacterium avium subsp. paratuberculosis
agcgccgccacggccaccgccg

SEQ ID NO: 872186 - RNA, 14 nt, Mycobacterium avium subsp. paratuberculosis
agcgccgccaucgc

SEQ ID NO: 872187 - RNA, 19 nt, Mycobacterium avium subsp. paratuberculosis
agcgccgaggugcugucgu

SEQ ID NO: 872188 - RNA, 13 nt, Mycobacterium avium subsp. paratuberculosis
agcgccgcaugcc

SEQ ID NO: 872189 - RNA, 13 nt, Mycobacterium avium subsp. paratuberculosis
agcgccgccaccg

SEQ ID NO: 872190 - RNA, 19 nt, Mycobacterium avium subsp. paratuberculosis
agcgccgccagccgcagca

SEQ ID NO: 872191 - RNA, 17 nt, Mycobacterium avium subsp. paratuberculosis
agcgccuccagccgcuc

SEQ ID NO: 872192 - RNA, 19 nt, Mycobacterium avium subsp. paratuberculosis
agcgccucccggaccacca

SEQ ID NO: 872193 - RNA, 15 nt, Mycobacterium avium subsp. paratuberculosis
agcgccgcccgcacc

SEQ ID NO: 872194 - RNA, 19 nt, Mycobacterium avium subsp. paratuberculosis
agcgccgcccguccagcgc

SEQ ID NO: 872195 - RNA, 20 nt, Mycobacterium avium subsp. paratuberculosis
agcgccgcccguccagcgca

SEQ ID NO: 872196 - RNA, 21 nt, Mycobacterium avium subsp. paratuberculosis
agcgccgcccguccagcgcau

SEQ ID NO: 872197 - RNA, 21 nt, Mycobacterium avium subsp. paratuberculosis
agcgcaggccguuguggccac

SEQ ID NO: 872198 - RNA, 14 nt, Mycobacterium avium subsp. paratuberculosis
agcgccagcgagug

SEQ ID NO: 872199 - RNA, 15 nt, Mycobacterium avium subsp. paratuberculosis
agcgccagcgccagc

SEQ ID NO: 872200 - RNA, 13 nt, Mycobacterium avium subsp. paratuberculosis
agcgccagcgcgg

SEQ ID NO: 872201 - RNA, 22 nt, Mycobacterium avium subsp. paratuberculosis
agcgccagcgcggugcccagcc

SEQ ID NO: 872202 - RNA, 21 nt, Mycobacterium avium subsp. paratuberculosis
agcgccagcguggccagcacc

SEQ ID NO: 872203 - RNA, 22 nt, Mycobacterium avium subsp. paratuberculosis
agcgccagcguggccagcaccg

SEQ ID NO: 872204 - RNA, 23 nt, Mycobacterium avium subsp. paratuberculosis
agcgccaggccauggcgcaccgc

SEQ ID NO: 872205 - RNA, 21 nt, Mycobacterium avium subsp. paratuberculosis
agcgcagcgccucggcggccc

SEQ ID NO: 872206 - RNA, 12 nt, Mycobacterium avium subsp. paratuberculosis
agcgcagcgccu

SEQ ID NO: 872207 - RNA, 21 nt, Mycobacterium avium subsp. paratuberculosis
agcgcagcggggaggcccagc

SEQ ID NO: 872208 - RNA, 22 nt, Mycobacterium avium subsp. paratuberculosis
agcgcagcggggaggcccagcc

SEQ ID NO: 872209 - RNA, 17 nt, Mycobacterium avium subsp. paratuberculosis
agcgcagcgucggcgug

SEQ ID NO: 872210 - RNA, 16 nt, Mycobacterium avium subsp. paratuberculosis
agcgcagcuccagguc

SEQ ID NO: 872211 - RNA, 13 nt, Mycobacterium avium subsp. paratuberculosis
agcgccagucgcg

SEQ ID NO: 872212 - RNA, 22 nt, Mycobacterium avium subsp. paratuberculosis
agcgccagggucuggcccggug

SEQ ID NO: 872213 - RNA, 13 nt, Mycobacterium avium subsp. paratuberculosis
agcgcccgcgcga

SEQ ID NO: 872214 - RNA, 14 nt, Mycobacterium avium subsp. paratuberculosis
agcgcccgcgcggg

SEQ ID NO: 872215 - RNA, 16 nt, Mycobacterium avium subsp. paratuberculosis
agcgcccgcgcgggcu

SEQ ID NO: 872216 - RNA, 14 nt, Mycobacterium avium subsp. paratuberculosis
agcgcccgcgcgug

SEQ ID NO: 872217 - RNA, 20 nt, Mycobacterium avium subsp. paratuberculosis
agcgcccgcgcgugggccaa

SEQ ID NO: 872218 - RNA, 22 nt, Mycobacterium avium subsp. paratuberculosis
agcgccauccgccgguucgucg

SEQ ID NO: 872219 - RNA, 17 nt, Mycobacterium avium subsp. paratuberculosis
agcgcccgcccggcccg

SEQ ID NO: 872220 - RNA, 19 nt, Mycobacterium avium subsp. paratuberculosis
agcgcccgcccggcccggc

SEQ ID NO: 872221 - RNA, 15 nt, Mycobacterium avium subsp. paratuberculosis
agcgccgaggccagc

SEQ ID NO: 872222 - RNA, 16 nt, Mycobacterium avium subsp. paratuberculosis
agcgccgaggccagca

SEQ ID NO: 872223 - RNA, 20 nt, Mycobacterium avium subsp. paratuberculosis
agcgccgaggccagcacgcc

SEQ ID NO: 872224 - RNA, 19 nt, Mycobacterium avium subsp. paratuberculosis
agcgccgagcacggcucgu

SEQ ID NO: 872225 - RNA, 13 nt, Mycobacterium avium subsp. paratuberculosis
agcgcccggcagc

SEQ ID NO: 872226 - RNA, 21 nt, Mycobacterium avium subsp. paratuberculosis
agcgcccggccagccggccgc

SEQ ID NO: 872227 - RNA, 15 nt, Mycobacterium avium subsp. paratuberculosis
agcgcccggccguga

SEQ ID NO: 872228 - RNA, 14 nt, Mycobacterium avium subsp. paratuberculosis
agcgcccggcgacc

SEQ ID NO: 872229 - RNA, 22 nt, Mycobacterium avium subsp. paratuberculosis
agcgcccggcgaccaccagccg

SEQ ID NO: 872230 - RNA, 14 nt, Mycobacterium avium subsp. paratuberculosis
agcgcccggcgauc

SEQ ID NO: 872231 - RNA, 22 nt, Mycobacterium avium subsp. paratuberculosis
agcgccugggcguacagcggcg

SEQ ID NO: 872232 - RNA, 16 nt, Mycobacterium avium subsp. paratuberculosis
agcgccuugccgacga

SEQ ID NO: 872233 - RNA, 21 nt, Mycobacterium avium subsp. paratuberculosis
agcgccuugccgacgacgucg

SEQ ID NO: 872234 - RNA, 22 nt, Mycobacterium avium subsp. paratuberculosis
agcgccuugccgacgacgucgu

SEQ ID NO: 872235 - RNA, 19 nt, Mycobacterium avium subsp. paratuberculosis
agcgccuugggucccaucg

SEQ ID NO: 872236 - RNA, 21 nt, Mycobacterium avium subsp. paratuberculosis
agcgccuucggcgccagcccg

SEQ ID NO: 872237 - RNA, 17 nt, Mycobacterium avium subsp. paratuberculosis
agcgcgaaaaccagcac

SEQ ID NO: 872238 - RNA, 18 nt, Mycobacterium avium subsp. paratuberculosis
agcgcgaacagcgcggcc

SEQ ID NO: 872239 - RNA, 20 nt, Mycobacterium avium subsp. paratuberculosis
agcgcgaacagcgcggccac

SEQ ID NO: 872240 - RNA, 19 nt, Mycobacterium avium subsp. paratuberculosis
agcgcgacaucgccggcga

SEQ ID NO: 872241 - RNA, 21 nt, Mycobacterium avium subsp. paratuberculosis
agcgcgacaucgccggcgacc

SEQ ID NO: 872242 - RNA, 18 nt, Mycobacterium avium subsp. paratuberculosis
agcgcgaccagcccggcc

SEQ ID NO: 872243 - RNA, 22 nt, Mycobacterium avium subsp. paratuberculosis
agcgcgaccucgguggugcuga

SEQ ID NO: 872244 - RNA, 17 nt, Mycobacterium avium subsp. paratuberculosis
agcgcgacgaacagcac

SEQ ID NO: 872245 - RNA, 20 nt, Mycobacterium avium subsp. paratuberculosis
agcgcgacgaacagcaccgc

SEQ ID NO: 872246 - RNA, 21 nt, Mycobacterium avium subsp. paratuberculosis
agcgcgacgaacagcaccgcc

SEQ ID NO: 872247 - RNA, 23 nt, Mycobacterium avium subsp. paratuberculosis
agcgcgacgaacagcaccgccac

SEQ ID NO: 872248 - RNA, 18 nt, Mycobacterium avium subsp. paratuberculosis
agcgcgacgcacgccggc

SEQ ID NO: 872249 - RNA, 16 nt, Mycobacterium avium subsp. paratuberculosis
agcgcgacgccgacgc

SEQ ID NO: 872250 - RNA, 21 nt, Mycobacterium avium subsp. paratuberculosis
agcgcgacgccgacgcccagc

SEQ ID NO: 872251 - RNA, 17 nt, Mycobacterium avium subsp. paratuberculosis
agcgcgcaucgcgggcc

SEQ ID NO: 872252 - RNA, 22 nt, Mycobacterium avium subsp. paratuberculosis
agcgcgcaucgcgggccaccgg

SEQ ID NO: 872253 - RNA, 21 nt, Mycobacterium avium subsp. paratuberculosis
agcgcgauguccgacagcccg

SEQ ID NO: 872254 - RNA, 15 nt, Mycobacterium avium subsp. paratuberculosis
agcgcgcacagcgcc

SEQ ID NO: 872255 - RNA, 22 nt, Mycobacterium avium subsp. paratuberculosis
agcgcgcacagcgccacaccga

SEQ ID NO: 872256 - RNA, 20 nt, Mycobacterium avium subsp. paratuberculosis
agcgcgcagaacaccaccgc

SEQ ID NO: 872257 - RNA, 15 nt, Mycobacterium avium subsp. paratuberculosis
agcgcgaugccggcc

SEQ ID NO: 872258 - RNA, 16 nt, Mycobacterium avium subsp. paratuberculosis
agcgcgaugccggcca

SEQ ID NO: 872259 - RNA, 17 nt, Mycobacterium avium subsp. paratuberculosis
agcgcgacgcgcaugcc

SEQ ID NO: 872260 - RNA, 17 nt, Mycobacterium avium subsp. paratuberculosis
agcgcgacgggcugcug

SEQ ID NO: 872261 - RNA, 22 nt, Mycobacterium avium subsp. paratuberculosis
agcgcgacugggugcucccgcc

SEQ ID NO: 872262 - RNA, 16 nt, Mycobacterium avium subsp. paratuberculosis
agcgcgaccccuacgg

SEQ ID NO: 872263 - RNA, 20 nt, Mycobacterium avium subsp. paratuberculosis
agcgcgacccgcucgacgcg

SEQ ID NO: 872264 - RNA, 22 nt, Mycobacterium avium subsp. paratuberculosis
agcgcgaggcgcaguagccgac

SEQ ID NO: 872265 - RNA, 16 nt, Mycobacterium avium subsp. paratuberculosis
agcgcgaggucgacgg

SEQ ID NO: 872266 - RNA, 14 nt, Mycobacterium avium subsp. paratuberculosis
agcgcgaucaacgg

SEQ ID NO: 872267 - RNA, 16 nt, Mycobacterium avium subsp. paratuberculosis
agcgcgaucgccggga

SEQ ID NO: 872268 - RNA, 18 nt, Mycobacterium avium subsp. paratuberculosis
agcgcgcggugaugaccu

SEQ ID NO: 872269 - RNA, 15 nt, Mycobacterium avium subsp. paratuberculosis
agcgcgcucaaccgc

SEQ ID NO: 872270 - RNA, 19 nt, Mycobacterium avium subsp. paratuberculosis
agcgcgcucaaccgcccag

SEQ ID NO: 872271 - RNA, 20 nt, Mycobacterium avium subsp. paratuberculosis
agcgcgcucaaccgcccagc

SEQ ID NO: 872272 - RNA, 22 nt, Mycobacterium avium subsp. paratuberculosis
agcgcgcucaaccgcccagcgg

SEQ ID NO: 872273 - RNA, 18 nt, Mycobacterium avium subsp. paratuberculosis
agcgcgcggugcgccagc

SEQ ID NO: 872274 - RNA, 20 nt, Mycobacterium avium subsp. paratuberculosis
agcgcgcggugcgccagcgc

SEQ ID NO: 872275 - RNA, 18 nt, Mycobacterium avium subsp. paratuberculosis
agcgcgcgggcgcgcgcc

SEQ ID NO: 872276 - RNA, 15 nt, Mycobacterium avium subsp. paratuberculosis
agcgcgcgggcgucc

SEQ ID NO: 872277 - RNA, 20 nt, Mycobacterium avium subsp. paratuberculosis
agcgcgcgggcguccucguc

SEQ ID NO: 872278 - RNA, 13 nt, Mycobacterium avium subsp. paratuberculosis
agcgcgcggcgca

SEQ ID NO: 872279 - RNA, 23 nt, Mycobacterium avium subsp. paratuberculosis
agcgcgcggcgcagaugaccggc

SEQ ID NO: 872280 - RNA, 18 nt, Mycobacterium avium subsp. paratuberculosis
agcgcgcgcucggucagc

SEQ ID NO: 872281 - RNA, 21 nt, Mycobacterium avium subsp. paratuberculosis
agcgcggauuccagcgcgacc

SEQ ID NO: 872282 - RNA, 16 nt, Mycobacterium avium subsp. paratuberculosis
agcgcggacaccaggu

SEQ ID NO: 872283 - RNA, 22 nt, Mycobacterium avium subsp. paratuberculosis
agcgcgcuuaauacagcgcguu

SEQ ID NO: 872284 - RNA, 14 nt, Mycobacterium avium subsp. paratuberculosis
agcgcgccggccag

SEQ ID NO: 872285 - RNA, 15 nt, Mycobacterium avium subsp. paratuberculosis
agcgcgcgcagcgcu

SEQ ID NO: 872286 - RNA, 17 nt, Mycobacterium avium subsp. paratuberculosis
agcgcgcgaucgccggu

SEQ ID NO: 872287 - RNA, 20 nt, Mycobacterium avium subsp. paratuberculosis
agcgcgcgaucuccgucacc

SEQ ID NO: 872288 - RNA, 12 nt, Mycobacterium avium subsp. paratuberculosis
agcgcgcgcagc

SEQ ID NO: 872289 - RNA, 13 nt, Mycobacterium avium subsp. paratuberculosis
agcgcgccggccc

SEQ ID NO: 872290 - RNA, 15 nt, Mycobacterium avium subsp. paratuberculosis
agcgcgccggccggc

SEQ ID NO: 872291 - RNA, 13 nt, Mycobacterium avium subsp. paratuberculosis
agcgcgccgucgg

SEQ ID NO: 872292 - RNA, 17 nt, Mycobacterium avium subsp. paratuberculosis
agcgcgccgaucgccca

SEQ ID NO: 872293 - RNA, 14 nt, Mycobacterium avium subsp. paratuberculosis
agcgcgccgcccag

SEQ ID NO: 872294 - RNA, 19 nt, Mycobacterium avium subsp. paratuberculosis
agcgcgccgcccagcggcc

SEQ ID NO: 872295 - RNA, 16 nt, Mycobacterium avium subsp. paratuberculosis
agcgcgccgcgcuggc

SEQ ID NO: 872296 - RNA, 12 nt, Mycobacterium avium subsp. paratuberculosis
agcgcgccggcc

SEQ ID NO: 872297 - RNA, 14 nt, Mycobacterium avium subsp. paratuberculosis
agcgcgccgccgau

SEQ ID NO: 872298 - RNA, 16 nt, Mycobacterium avium subsp. paratuberculosis
agcgcgccgccgaugu

SEQ ID NO: 872299 - RNA, 13 nt, Mycobacterium avium subsp. paratuberculosis
agcgcgccgccgc

SEQ ID NO: 872300 - RNA, 11 nt, Mycobacterium avium subsp. paratuberculosis
agcgcgccgag

SEQ ID NO: 872301 - RNA, 15 nt, Mycobacterium avium subsp. paratuberculosis
agcgcgccgagcagc

SEQ ID NO: 872302 - RNA, 16 nt, Mycobacterium avium subsp. paratuberculosis
agcgcgccgagcagcu

SEQ ID NO: 872303 - RNA, 21 nt, Mycobacterium avium subsp. paratuberculosis
agcgcgcccugaggcccggug

SEQ ID NO: 872304 - RNA, 16 nt, Mycobacterium avium subsp. paratuberculosis
acgcauguccgccguc

SEQ ID NO: 872305 - RNA, 20 nt, Mycobacterium avium subsp. paratuberculosis
acgcauguccgccgucaucg

SEQ ID NO: 872306 - RNA, 13 nt, Mycobacterium avium subsp. paratuberculosis
acgcaucggcgcc

SEQ ID NO: 872307 - RNA, 13 nt, Mycobacterium avium subsp. paratuberculosis
acgcaucgccgag

SEQ ID NO: 872308 - RNA, 18 nt, Mycobacterium avium subsp. paratuberculosis
acgcaucagggccagccg

SEQ ID NO: 872309 - RNA, 21 nt, Mycobacterium avium subsp. paratuberculosis
acgccaacugguccugcggcu

SEQ ID NO: 872310 - RNA, 23 nt, Mycobacterium avium subsp. paratuberculosis
acgccacaaacagcgcggccgga

SEQ ID NO: 872311 - RNA, 17 nt, Mycobacterium avium subsp. paratuberculosis
acgccaccacggcgucg

SEQ ID NO: 872312 - RNA, 14 nt, Mycobacterium avium subsp. paratuberculosis
acgccaccaucgag

SEQ ID NO: 872313 - RNA, 16 nt, Mycobacterium avium subsp. paratuberculosis
acgccaccuucaccgc

SEQ ID NO: 872314 - RNA, 21 nt, Mycobacterium avium subsp. paratuberculosis
acgccaccuucaccgcgccgg

SEQ ID NO: 872315 - RNA, 17 nt, Mycobacterium avium subsp. paratuberculosis
acgcagcggugcagccc

SEQ ID NO: 872316 - RNA, 12 nt, Mycobacterium avium subsp. paratuberculosis
acgcagcuggcc

SEQ ID NO: 872317 - RNA, 14 nt, Mycobacterium avium subsp. paratuberculosis
acgcagcggcguca

SEQ ID NO: 872318 - RNA, 16 nt, Mycobacterium avium subsp. paratuberculosis
acgcagcggcgucacg

SEQ ID NO: 872319 - RNA, 13 nt, Mycobacterium avium subsp. paratuberculosis
acgcagccgcgcc

SEQ ID NO: 872320 - RNA, 13 nt, Mycobacterium avium subsp. paratuberculosis
acgcagccgucga

SEQ ID NO: 872321 - RNA, 16 nt, Mycobacterium avium subsp. paratuberculosis
acgcagccgucgaucu

SEQ ID NO: 872322 - RNA, 15 nt, Mycobacterium avium subsp. paratuberculosis
acgcagugccgcacc

SEQ ID NO: 872323 - RNA, 20 nt, Mycobacterium avium subsp. paratuberculosis
acgcagugccgcaccagcac

SEQ ID NO: 872324 - RNA, 15 nt, Mycobacterium avium subsp. paratuberculosis
acgcaggugcgccgc

SEQ ID NO: 872325 - RNA, 16 nt, Mycobacterium avium subsp. paratuberculosis
acgcaggugcgccgcu

SEQ ID NO: 872326 - RNA, 20 nt, Mycobacterium avium subsp. paratuberculosis
acgcaggcguccagggccac

SEQ ID NO: 872327 - RNA, 17 nt, Mycobacterium avium subsp. paratuberculosis
acgcaggcguggcccag

SEQ ID NO: 872328 - RNA, 12 nt, Mycobacterium avium subsp. paratuberculosis
acgcagcgaucg

SEQ ID NO: 872329 - RNA, 18 nt, Mycobacterium avium subsp. paratuberculosis
acgcagcgaucggcggcu

SEQ ID NO: 872330 - RNA, 19 nt, Mycobacterium avium subsp. paratuberculosis
acgcagcgcauccgacacc

SEQ ID NO: 872331 - RNA, 21 nt, Mycobacterium avium subsp. paratuberculosis
acgauggccaggcccagcccg

SEQ ID NO: 872332 - RNA, 20 nt, Mycobacterium avium subsp. paratuberculosis
acgauggcccggaccgccgc

SEQ ID NO: 872333 - RNA, 18 nt, Mycobacterium avium subsp. paratuberculosis
acgaugcccagccccucg

SEQ ID NO: 872334 - RNA, 18 nt, Mycobacterium avium subsp. paratuberculosis
acgaugcccuuggccagc

SEQ ID NO: 872335 - RNA, 15 nt, Mycobacterium avium subsp. paratuberculosis
acgaugccggccggg

SEQ ID NO: 872336 - RNA, 18 nt, Mycobacterium avium subsp. paratuberculosis
acgaugccggccgggacg

SEQ ID NO: 872337 - RNA, 14 nt, Mycobacterium avium subsp. paratuberculosis
acgaugccggcguc

SEQ ID NO: 872338 - RNA, 12 nt, Mycobacterium avium subsp. paratuberculosis
acgaugccgggc

SEQ ID NO: 872339 - RNA, 21 nt, Mycobacterium avium subsp. paratuberculosis
acgaugcgcacccccggggcc

SEQ ID NO: 872340 - RNA, 16 nt, Mycobacterium avium subsp. paratuberculosis
acgaugccgcgcucga

SEQ ID NO: 872341 - RNA, 14 nt, Mycobacterium avium subsp. paratuberculosis
acgaugccgcggcg

SEQ ID NO: 872342 - RNA, 14 nt, Mycobacterium avium subsp. paratuberculosis
acgaugcggccggc

SEQ ID NO: 872343 - RNA, 19 nt, Mycobacterium avium subsp. paratuberculosis
acgaugcugauacccgcgc

SEQ ID NO: 872344 - RNA, 20 nt, Mycobacterium avium subsp. paratuberculosis
acgaugcugauacccgcgcg

SEQ ID NO: 872345 - RNA, 23 nt, Mycobacterium avium subsp. paratuberculosis
acgaugcugauacccgcgcggcg

SEQ ID NO: 872346 - RNA, 19 nt, Mycobacterium avium subsp. paratuberculosis
acgccaugucgaugucgac

SEQ ID NO: 872347 - RNA, 20 nt, Mycobacterium avium subsp. paratuberculosis
acgccaugugccggcgcucg

SEQ ID NO: 872348 - RNA, 22 nt, Mycobacterium avium subsp. paratuberculosis
acgccaugugccggcgcucguc

SEQ ID NO: 872349 - RNA, 24 nt, Mycobacterium avium subsp. paratuberculosis
acgccaugugccggcgcucgucgu

SEQ ID NO: 872350 - RNA, 15 nt, Mycobacterium avium subsp. paratuberculosis
acgccaugucgaugu

SEQ ID NO: 872351 - RNA, 16 nt, Mycobacterium avium subsp. paratuberculosis
acgccaugggcccagc

SEQ ID NO: 872352 - RNA, 12 nt, Mycobacterium avium subsp. paratuberculosis
acgcccaccggu

SEQ ID NO: 872353 - RNA, 12 nt, Mycobacterium avium subsp. paratuberculosis
acgcccaacuac

SEQ ID NO: 872354 - RNA, 15 nt, Mycobacterium avium subsp. paratuberculosis
acgcccacagcgcca

SEQ ID NO: 872355 - RNA, 18 nt, Mycobacterium avium subsp. paratuberculosis
acgcccacagcgccagca

SEQ ID NO: 872356 - RNA, 23 nt, Mycobacterium avium subsp. paratuberculosis
acgcccacagcugacgggccggc

SEQ ID NO: 872357 - RNA, 19 nt, Mycobacterium avium subsp. paratuberculosis
acgccaucgccucggccac

SEQ ID NO: 872358 - RNA, 22 nt, Mycobacterium avium subsp. paratuberculosis
acgccaucgccucggccaccag

SEQ ID NO: 872359 - RNA, 21 nt, Mycobacterium avium subsp. paratuberculosis
acgccaugaacucguccaccg

SEQ ID NO: 872360 - RNA, 14 nt, Mycobacterium avium subsp. paratuberculosis
acgccaguguggcc

SEQ ID NO: 872361 - RNA, 18 nt, Mycobacterium avium subsp. paratuberculosis
acgccaguguggccgcgg

SEQ ID NO: 872362 - RNA, 13 nt, Mycobacterium avium subsp. paratuberculosis
acgccagcgggcc

SEQ ID NO: 872363 - RNA, 21 nt, Mycobacterium avium subsp. paratuberculosis
acgccaguggcugcacgucac

SEQ ID NO: 872364 - RNA, 15 nt, Mycobacterium avium subsp. paratuberculosis
acgccaucagcacca

SEQ ID NO: 872365 - RNA, 21 nt, Mycobacterium avium subsp. paratuberculosis
acgccaguucgucggccgucg

SEQ ID NO: 872366 - RNA, 23 nt, Mycobacterium avium subsp. paratuberculosis
acgccaguucgucggccgucggc

SEQ ID NO: 872367 - RNA, 14 nt, Mycobacterium avium subsp. paratuberculosis
acgccagcgccgca

SEQ ID NO: 872368 - RNA, 22 nt, Mycobacterium avium subsp. paratuberculosis
acgccagcugccgcgacucggu

SEQ ID NO: 872369 - RNA, 16 nt, Mycobacterium avium subsp. paratuberculosis
acgccagcugcggauc

SEQ ID NO: 872370 - RNA, 15 nt, Mycobacterium avium subsp. paratuberculosis
acgccagcgugacgc

SEQ ID NO: 872371 - RNA, 20 nt, Mycobacterium avium subsp. paratuberculosis
acgccagcgugacgccgggc

SEQ ID NO: 872372 - RNA, 22 nt, Mycobacterium avium subsp. paratuberculosis
acgccagcgcgacccgcucgac

SEQ ID NO: 872373 - RNA, 18 nt, Mycobacterium avium subsp. paratuberculosis
acgccagcggcagcgcca

SEQ ID NO: 872374 - RNA, 15 nt, Mycobacterium avium subsp. paratuberculosis
acgccagccgggugg

SEQ ID NO: 872375 - RNA, 15 nt, Mycobacterium avium subsp. paratuberculosis
acgccacucgucgac

SEQ ID NO: 872376 - RNA, 17 nt, Mycobacterium avium subsp. paratuberculosis
acgccacucgucgacgu

SEQ ID NO: 872377 - RNA, 12 nt, Mycobacterium avium subsp. paratuberculosis
acgccacgcguc

SEQ ID NO: 872378 - RNA, 22 nt, Mycobacterium avium subsp. paratuberculosis
acgccacgcgucaggcgucgua

SEQ ID NO: 872379 - RNA, 12 nt, Mycobacterium avium subsp. paratuberculosis
acgccacggcga

SEQ ID NO: 872380 - RNA, 14 nt, Mycobacterium avium subsp. paratuberculosis
acgccacggcggcc

SEQ ID NO: 872381 - RNA, 15 nt, Mycobacterium avium subsp. paratuberculosis
acgccacggggcugc

SEQ ID NO: 872382 - RNA, 19 nt, Mycobacterium avium subsp. paratuberculosis
acgccacggggcugcgggc

SEQ ID NO: 872383 - RNA, 20 nt, Mycobacterium avium subsp. paratuberculosis
acgccacggggcugcgggcc

SEQ ID NO: 872384 - RNA, 12 nt, Mycobacterium avium subsp. paratuberculosis
acgccacguagc

SEQ ID NO: 872385 - RNA, 17 nt, Mycobacterium avium subsp. paratuberculosis
acgccagaugcgccgcg

SEQ ID NO: 872386 - RNA, 18 nt, Mycobacterium avium subsp. paratuberculosis
acgccagaugcgccgcgg

SEQ ID NO: 872387 - RNA, 21 nt, Mycobacterium avium subsp. paratuberculosis
acgccagcacguggccgggcu

SEQ ID NO: 872388 - RNA, 23 nt, Mycobacterium avium subsp. paratuberculosis
acgccagcacguggccgggcucg

SEQ ID NO: 872389 - RNA, 18 nt, Mycobacterium avium subsp. paratuberculosis
acgccagcagccgcagca

SEQ ID NO: 872390 - RNA, 22 nt, Mycobacterium avium subsp. paratuberculosis
acgccagcaugaucaccgccag

SEQ ID NO: 872391 - RNA, 16 nt, Mycobacterium avium subsp. paratuberculosis
acgccagccaggcgau

SEQ ID NO: 872392 - RNA, 18 nt, Mycobacterium avium subsp. paratuberculosis
acgccccauugccgcgcc

SEQ ID NO: 872393 - RNA, 20 nt, Mycobacterium avium subsp. paratuberculosis
acgccccauugccgcgccgg

SEQ ID NO: 872394 - RNA, 22 nt, Mycobacterium avium subsp. paratuberculosis
acgcccccgcuggcccggcguu

SEQ ID NO: 872395 - RNA, 22 nt, Mycobacterium avium subsp. paratuberculosis
acgcccccggugacgauccggu

SEQ ID NO: 872396 - RNA, 13 nt, Mycobacterium avium subsp. paratuberculosis
acgcccagcgcgg

SEQ ID NO: 872397 - RNA, 13 nt, Mycobacterium avium subsp. paratuberculosis
acgcccaggcuca

SEQ ID NO: 872398 - RNA, 14 nt, Mycobacterium avium subsp. paratuberculosis
acgcccagcgccgc

SEQ ID NO: 872399 - RNA, 16 nt, Mycobacterium avium subsp. paratuberculosis
acgcccagcgccgcgu

SEQ ID NO: 872400 - RNA, 12 nt, Mycobacterium avium subsp. paratuberculosis
acgcccagcccg

SEQ ID NO: 872401 - RNA, 17 nt, Mycobacterium avium subsp. paratuberculosis
acgcccagcccgcgggc

SEQ ID NO: 872402 - RNA, 14 nt, Mycobacterium avium subsp. paratuberculosis
acgcccacgccgag

SEQ ID NO: 872403 - RNA, 12 nt, Mycobacterium avium subsp. paratuberculosis
acgcccgacgac

SEQ ID NO: 872404 - RNA, 15 nt, Mycobacterium avium subsp. paratuberculosis
acgcccgacgacgac

SEQ ID NO: 872405 - RNA, 14 nt, Mycobacterium avium subsp. paratuberculosis
acgccccggcgucg

SEQ ID NO: 872406 - RNA, 14 nt, Mycobacterium avium subsp. paratuberculosis
acgccccggcgccg

SEQ ID NO: 872407 - RNA, 18 nt, Mycobacterium avium subsp. paratuberculosis
acgccccggcgccgucgu

SEQ ID NO: 872408 - RNA, 12 nt, Mycobacterium avium subsp. paratuberculosis
acgcccgcacca

SEQ ID NO: 872409 - RNA, 16 nt, Mycobacterium avium subsp. paratuberculosis
acgcccgcaccacgac

SEQ ID NO: 872410 - RNA, 22 nt, Mycobacterium avium subsp. paratuberculosis
acgcccgaucugggaucggugc

SEQ ID NO: 872411 - RNA, 14 nt, Mycobacterium avium subsp. paratuberculosis
acgcccgcagcgca

SEQ ID NO: 872412 - RNA, 16 nt, Mycobacterium avium subsp. paratuberculosis
acgcccgcagcgcauc

SEQ ID NO: 872413 - RNA, 19 nt, Mycobacterium avium subsp. paratuberculosis
acgcccgcgaggugucgac

SEQ ID NO: 872414 - RNA, 15 nt, Mycobacterium avium subsp. paratuberculosis
acgcccgcgaucggc

SEQ ID NO: 872415 - RNA, 22 nt, Mycobacterium avium subsp. paratuberculosis
acgcccgcgaucggcgccacga

SEQ ID NO: 872416 - RNA, 13 nt, Mycobacterium avium subsp. paratuberculosis
acgcccggucgac

SEQ ID NO: 872417 - RNA, 14 nt, Mycobacterium avium subsp. paratuberculosis
acgcccggucgacc

SEQ ID NO: 872418 - RNA, 19 nt, Mycobacterium avium subsp. paratuberculosis
acgcccggguacaccgacu

SEQ ID NO: 872419 - RNA, 22 nt, Mycobacterium avium subsp. paratuberculosis
acgcccguagcggugggcgcgu

SEQ ID NO: 872420 - RNA, 17 nt, Mycobacterium avium subsp. paratuberculosis
acgcccgucccgccgac

SEQ ID NO: 872421 - RNA, 17 nt, Mycobacterium avium subsp. paratuberculosis
acgcccugccacagcga

SEQ ID NO: 872422 - RNA, 20 nt, Mycobacterium avium subsp. paratuberculosis
acgcccucgucuuccgcggc

SEQ ID NO: 872423 - RNA, 21 nt, Mycobacterium avium subsp. paratuberculosis
acgcccucgucuuccgcggcg

SEQ ID NO: 872424 - RNA, 21 nt, Mycobacterium avium subsp. paratuberculosis
acgcccguucgagcgccggac

SEQ ID NO: 872425 - RNA, 19 nt, Mycobacterium avium subsp. paratuberculosis
acgcccuagcgggccagga

SEQ ID NO: 872426 - RNA, 17 nt, Mycobacterium avium subsp. paratuberculosis
acgcccggcuucgccgc

SEQ ID NO: 872427 - RNA, 19 nt, Mycobacterium avium subsp. paratuberculosis
acgcccggcuucgccgccg

SEQ ID NO: 872428 - RNA, 14 nt, Mycobacterium avium subsp. paratuberculosis
acgcccggcgccgg

SEQ ID NO: 872429 - RNA, 17 nt, Mycobacterium avium subsp. paratuberculosis
acgcccggcgccggcgg

SEQ ID NO: 872430 - RNA, 18 nt, Mycobacterium avium subsp. paratuberculosis
acgcccggcgccggcggc

SEQ ID NO: 872431 - RNA, 12 nt, Mycobacterium avium subsp. paratuberculosis
acgcccggccac

SEQ ID NO: 872432 - RNA, 13 nt, Mycobacterium avium subsp. paratuberculosis
acgcccggccacc

SEQ ID NO: 872433 - RNA, 13 nt, Mycobacterium avium subsp. paratuberculosis
acgcccgcucgau

SEQ ID NO: 872434 - RNA, 16 nt, Mycobacterium avium subsp. paratuberculosis
acgcccggacccgcuc

SEQ ID NO: 872435 - RNA, 18 nt, Mycobacterium avium subsp. paratuberculosis
acgcccggacccgcucgc

SEQ ID NO: 872436 - RNA, 18 nt, Mycobacterium avium subsp. paratuberculosis
accuggcagcauccgccg

SEQ ID NO: 872437 - RNA, 20 nt, Mycobacterium avium subsp. paratuberculosis
accuggcagcauccgccgac

SEQ ID NO: 872438 - RNA, 16 nt, Mycobacterium avium subsp. paratuberculosis
accuggaggccaacga

SEQ ID NO: 872439 - RNA, 20 nt, Mycobacterium avium subsp. paratuberculosis
accuggaggccaacgagcgc

SEQ ID NO: 872440 - RNA, 12 nt, Mycobacterium avium subsp. paratuberculosis
accuggccacca

SEQ ID NO: 872441 - RNA, 15 nt, Mycobacterium avium subsp. paratuberculosis
accuggccaccagca

SEQ ID NO: 872442 - RNA, 17 nt, Mycobacterium avium subsp. paratuberculosis
accugcuuggcggccug

SEQ ID NO: 872443 - RNA, 20 nt, Mycobacterium avium subsp. paratuberculosis
accugcuuggucuccggccc

SEQ ID NO: 872444 - RNA, 22 nt, Mycobacterium avium subsp. paratuberculosis
accugcuuguugagggugacgg

SEQ ID NO: 872445 - RNA, 23 nt, Mycobacterium avium subsp. paratuberculosis
accugcuuguugagggugacggu

SEQ ID NO: 872446 - RNA, 19 nt, Mycobacterium avium subsp. paratuberculosis
accuggaagcgcaucgccg

SEQ ID NO: 872447 - RNA, 22 nt, Mycobacterium avium subsp. paratuberculosis
accuggaagcgcaucgccggcg

SEQ ID NO: 872448 - RNA, 16 nt, Mycobacterium avium subsp. paratuberculosis
accuggcugacggcgu

SEQ ID NO: 872449 - RNA, 19 nt, Mycobacterium avium subsp. paratuberculosis
accuggcgcaccgccgcgg

SEQ ID NO: 872450 - RNA, 12 nt, Mycobacterium avium subsp. paratuberculosis
accuggccggcc

SEQ ID NO: 872451 - RNA, 15 nt, Mycobacterium avium subsp. paratuberculosis
accuggccggccucg

SEQ ID NO: 872452 - RNA, 16 nt, Mycobacterium avium subsp. paratuberculosis
accuggccggccucga

SEQ ID NO: 872453 - RNA, 14 nt, Mycobacterium avium subsp. paratuberculosis
accuggugcucgcg

SEQ ID NO: 872454 - RNA, 17 nt, Mycobacterium avium subsp. paratuberculosis
accugguucucccgucg

SEQ ID NO: 872455 - RNA, 14 nt, Mycobacterium avium subsp. paratuberculosis
accugggcggcggc

SEQ ID NO: 872456 - RNA, 15 nt, Mycobacterium avium subsp. paratuberculosis
accugggcggcggcg

SEQ ID NO: 872457 - RNA, 17 nt, Mycobacterium avium subsp. paratuberculosis
accuggucgccgaacgu

SEQ ID NO: 872458 - RNA, 17 nt, Mycobacterium avium subsp. paratuberculosis
accuggucgccgccguc

SEQ ID NO: 872459 - RNA, 16 nt, Mycobacterium avium subsp. paratuberculosis
accugguccaccgcgg

SEQ ID NO: 872460 - RNA, 17 nt, Mycobacterium avium subsp. paratuberculosis
accugguccaccgcggc

SEQ ID NO: 872461 - RNA, 20 nt, Mycobacterium avium subsp. paratuberculosis
accugguccaccgcggcggc

SEQ ID NO: 872462 - RNA, 23 nt, Mycobacterium avium subsp. paratuberculosis
accugguccaccgcggcggccag

SEQ ID NO: 872463 - RNA, 19 nt, Mycobacterium avium subsp. paratuberculosis
accugggucugcggccggg

SEQ ID NO: 872464 - RNA, 14 nt, Mycobacterium avium subsp. paratuberculosis
accugggugcgcca

SEQ ID NO: 872465 - RNA, 15 nt, Mycobacterium avium subsp. paratuberculosis
accugggugcgccac

SEQ ID NO: 872466 - RNA, 13 nt, Mycobacterium avium subsp. paratuberculosis
accugggcgucgu

SEQ ID NO: 872467 - RNA, 17 nt, Mycobacterium avium subsp. paratuberculosis
accugggcgucgucggc

SEQ ID NO: 872468 - RNA, 18 nt, Mycobacterium avium subsp. paratuberculosis
accugggcgucgucggcc

SEQ ID NO: 872469 - RNA, 21 nt, Mycobacterium avium subsp. paratuberculosis
accugggcgucgucggccggc

SEQ ID NO: 872470 - RNA, 21 nt, Mycobacterium avium subsp. paratuberculosis
accugggcggccaccgcgccc

SEQ ID NO: 872471 - RNA, 14 nt, Mycobacterium avium subsp. paratuberculosis
accugggcgccguc

SEQ ID NO: 872472 - RNA, 15 nt, Mycobacterium avium subsp. paratuberculosis
accugggcgccgucg

SEQ ID NO: 872473 - RNA, 16 nt, Mycobacterium avium subsp. paratuberculosis
accugggcgccgucgc

SEQ ID NO: 872474 - RNA, 22 nt, Mycobacterium avium subsp. paratuberculosis
accugggcgccgucgccgacgu

SEQ ID NO: 872475 - RNA, 22 nt, Mycobacterium avium subsp. paratuberculosis
accugccgcaacgggccgcagc

SEQ ID NO: 872476 - RNA, 14 nt, Mycobacterium avium subsp. paratuberculosis
accugccggcgauc

SEQ ID NO: 872477 - RNA, 15 nt, Mycobacterium avium subsp. paratuberculosis
accugcgcgacgcug

SEQ ID NO: 872478 - RNA, 22 nt, Mycobacterium avium subsp. paratuberculosis
accugcgcgacgcugauggcga

SEQ ID NO: 872479 - RNA, 16 nt, Mycobacterium avium subsp. paratuberculosis
accugcgcgacggcgc

SEQ ID NO: 872480 - RNA, 18 nt, Mycobacterium avium subsp. paratuberculosis
accugcgcgacggcgcug

SEQ ID NO: 872481 - RNA, 14 nt, Mycobacterium avium subsp. paratuberculosis
accgggcccggcgc

SEQ ID NO: 872482 - RNA, 15 nt, Mycobacterium avium subsp. paratuberculosis
accgggcccggcgcc

SEQ ID NO: 872483 - RNA, 17 nt, Mycobacterium avium subsp. paratuberculosis
accgggcccggcgccaa

SEQ ID NO: 872484 - RNA, 13 nt, Mycobacterium avium subsp. paratuberculosis
accgggcccguag

SEQ ID NO: 872485 - RNA, 14 nt, Mycobacterium avium subsp. paratuberculosis
accgggcccguagg

SEQ ID NO: 872486 - RNA, 20 nt, Mycobacterium avium subsp. paratuberculosis
accgggccgaaggcggcgcc

SEQ ID NO: 872487 - RNA, 22 nt, Mycobacterium avium subsp. paratuberculosis
accgggccgaaggcggcgccgg

SEQ ID NO: 872488 - RNA, 23 nt, Mycobacterium avium subsp. paratuberculosis
accgggccgaaggcggcgccggc

SEQ ID NO: 872489 - RNA, 17 nt, Mycobacterium avium subsp. paratuberculosis
accgggcacccggcgcg

SEQ ID NO: 872490 - RNA, 19 nt, Mycobacterium avium subsp. paratuberculosis
accgggcacccggcgcggc

SEQ ID NO: 872491 - RNA, 14 nt, Mycobacterium avium subsp. paratuberculosis
accgggcagccgca

SEQ ID NO: 872492 - RNA, 22 nt, Mycobacterium avium subsp. paratuberculosis
accgggcagccgcacaccgcgg

SEQ ID NO: 872493 - RNA, 22 nt, Mycobacterium avium subsp. paratuberculosis
accgggccaacgguucggccgc

SEQ ID NO: 872494 - RNA, 13 nt, Mycobacterium avium subsp. paratuberculosis
accgggcccagcu

SEQ ID NO: 872495 - RNA, 18 nt, Mycobacterium avium subsp. paratuberculosis
accgggcccagcucggug

SEQ ID NO: 872496 - RNA, 17 nt, Mycobacterium avium subsp. paratuberculosis
accgggcccgcccgcag

SEQ ID NO: 872497 - RNA, 18 nt, Mycobacterium avium subsp. paratuberculosis
accgggcccgcccgcagc

SEQ ID NO: 872498 - RNA, 21 nt, Mycobacterium avium subsp. paratuberculosis
accgggcccgcccgcagcggc

SEQ ID NO: 872499 - RNA, 17 nt, Mycobacterium avium subsp. paratuberculosis
accugcggcaccucggc

SEQ ID NO: 872500 - RNA, 12 nt, Mycobacterium avium subsp. paratuberculosis
accugcggcccc

SEQ ID NO: 872501 - RNA, 14 nt, Mycobacterium avium subsp. paratuberculosis
accugcggcccguc

SEQ ID NO: 872502 - RNA, 15 nt, Mycobacterium avium subsp. paratuberculosis
accugcggcccgucg

SEQ ID NO: 872503 - RNA, 19 nt, Mycobacterium avium subsp. paratuberculosis
accugcggcucgucggcga

SEQ ID NO: 872504 - RNA, 17 nt, Mycobacterium avium subsp. paratuberculosis
accugcgggcccaccgc

SEQ ID NO: 872505 - RNA, 18 nt, Mycobacterium avium subsp. paratuberculosis
accugcgggcccaccgcg

SEQ ID NO: 872506 - RNA, 19 nt, Mycobacterium avium subsp. paratuberculosis
accugcgggcccaccgcgc

SEQ ID NO: 872507 - RNA, 20 nt, Mycobacterium avium subsp. paratuberculosis
accugcgggcccaccgcgcg

SEQ ID NO: 872508 - RNA, 23 nt, Mycobacterium avium subsp. paratuberculosis
accugcgggcccaccgcgcgcug

SEQ ID NO: 872509 - RNA, 15 nt, Mycobacterium avium subsp. paratuberculosis
accugcucaccgagc

SEQ ID NO: 872510 - RNA, 22 nt, Mycobacterium avium subsp. paratuberculosis
accugcgguucgucgcggcggc

SEQ ID NO: 872511 - RNA, 21 nt, Mycobacterium avium subsp. paratuberculosis
accugcggcaggucggccagc

SEQ ID NO: 872512 - RNA, 17 nt, Mycobacterium avium subsp. paratuberculosis
accugcugggcggcacc

SEQ ID NO: 872513 - RNA, 15 nt, Mycobacterium avium subsp. paratuberculosis
accugcugggcgggc

SEQ ID NO: 872514 - RNA, 22 nt, Mycobacterium avium subsp. paratuberculosis
accugcugggcgggcagccgcu

SEQ ID NO: 872515 - RNA, 15 nt, Mycobacterium avium subsp. paratuberculosis
accugcugcucgucg

SEQ ID NO: 872516 - RNA, 23 nt, Mycobacterium avium subsp. paratuberculosis
accugcugcucgucgcgggcgcc

SEQ ID NO: 872517 - RNA, 17 nt, Mycobacterium avium subsp. paratuberculosis
accugcucgaugcgcgc

SEQ ID NO: 872518 - RNA, 21 nt, Mycobacterium avium subsp. paratuberculosis
accugcucgaugcgcgccagc

SEQ ID NO: 872519 - RNA, 22 nt, Mycobacterium avium subsp. paratuberculosis
accugcucgucggugacggugu

SEQ ID NO: 872520 - RNA, 21 nt, Mycobacterium avium subsp. paratuberculosis
accuguuuggcugucgcgcug

SEQ ID NO: 872521 - RNA, 18 nt, Mycobacterium avium subsp. paratuberculosis
accugguugccgcccucg

SEQ ID NO: 872522 - RNA, 17 nt, Mycobacterium avium subsp. paratuberculosis
accugguuggcccgcac

SEQ ID NO: 872523 - RNA, 17 nt, Mycobacterium avium subsp. paratuberculosis
accugugccauagacca

SEQ ID NO: 872524 - RNA, 14 nt, Mycobacterium avium subsp. paratuberculosis
accuucagcgggcg

SEQ ID NO: 872525 - RNA, 18 nt, Mycobacterium avium subsp. paratuberculosis
accuucagcgggcgcagc

SEQ ID NO: 872526 - RNA, 14 nt, Mycobacterium avium subsp. paratuberculosis
accuucaccgacca

SEQ ID NO: 872527 - RNA, 17 nt, Mycobacterium avium subsp. paratuberculosis
accuucaccgcgccggu

SEQ ID NO: 872528 - RNA, 23 nt, Mycobacterium avium subsp. paratuberculosis
accuucaccgcgccgguccggcc

SEQ ID NO: 872529 - RNA, 20 nt, Mycobacterium avium subsp. paratuberculosis
accuucccaaccccgggcgg

SEQ ID NO: 872530 - RNA, 17 nt, Mycobacterium avium subsp. paratuberculosis
accuucugcgcgccguc

SEQ ID NO: 872531 - RNA, 20 nt, Mycobacterium avium subsp. paratuberculosis
accuucgagccgccgccggc

SEQ ID NO: 872532 - RNA, 13 nt, Mycobacterium avium subsp. paratuberculosis
acgagaugcccca

SEQ ID NO: 872533 - RNA, 17 nt, Mycobacterium avium subsp. paratuberculosis
acgagaugccccaggcg

SEQ ID NO: 872534 - RNA, 13 nt, Mycobacterium avium subsp. paratuberculosis
accuugaccaccg

SEQ ID NO: 872535 - RNA, 14 nt, Mycobacterium avium subsp. paratuberculosis
accuugaccaccga

SEQ ID NO: 872536 - RNA, 13 nt, Mycobacterium avium subsp. paratuberculosis
accuugaccagcu

SEQ ID NO: 872537 - RNA, 22 nt, Mycobacterium avium subsp. paratuberculosis
acgagcagcgugcugacgucgu

SEQ ID NO: 872538 - RNA, 23 nt, Mycobacterium avium subsp. paratuberculosis
acgagcaggcugaucucggcggu

SEQ ID NO: 872539 - RNA, 17 nt, Mycobacterium avium subsp. paratuberculosis
acgagcccagccgucgc

SEQ ID NO: 872540 - RNA, 15 nt, Mycobacterium avium subsp. paratuberculosis
acgagcccgccggcg

SEQ ID NO: 872541 - RNA, 13 nt, Mycobacterium avium subsp. paratuberculosis
acgagcccgcgcc

SEQ ID NO: 872542 - RNA, 14 nt, Mycobacterium avium subsp. paratuberculosis
acgagcccgcgccc

SEQ ID NO: 872543 - RNA, 14 nt, Mycobacterium avium subsp. paratuberculosis
acgagcgcgccgag

SEQ ID NO: 872544 - RNA, 13 nt, Mycobacterium avium subsp. paratuberculosis
acgagcgggccga

SEQ ID NO: 872545 - RNA, 19 nt, Mycobacterium avium subsp. paratuberculosis
acgagcgaacacgugcagc

SEQ ID NO: 872546 - RNA, 16 nt, Mycobacterium avium subsp. paratuberculosis
acgagccgccgcgggu

SEQ ID NO: 872547 - RNA, 11 nt, Mycobacterium avium subsp. paratuberculosis
acgagccggac

SEQ ID NO: 872548 - RNA, 17 nt, Mycobacterium avium subsp. paratuberculosis
acgagcucaccgccgau

SEQ ID NO: 872549 - RNA, 23 nt, Mycobacterium avium subsp. paratuberculosis
acgaucagcagaugcgugcggug

SEQ ID NO: 872550 - RNA, 15 nt, Mycobacterium avium subsp. paratuberculosis
acgaucaccggcuug

SEQ ID NO: 872551 - RNA, 15 nt, Mycobacterium avium subsp. paratuberculosis
acgaucaccaccacc

SEQ ID NO: 872552 - RNA, 13 nt, Mycobacterium avium subsp. paratuberculosis
acgaucaccagac

SEQ ID NO: 872553 - RNA, 20 nt, Mycobacterium avium subsp. paratuberculosis
acgaucucccaacgcagcgc

SEQ ID NO: 872554 - RNA, 18 nt, Mycobacterium avium subsp. paratuberculosis
acgaucucguagguggcc

SEQ ID NO: 872555 - RNA, 20 nt, Mycobacterium avium subsp. paratuberculosis
acgaucugcacacgggcccg

SEQ ID NO: 872556 - RNA, 13 nt, Mycobacterium avium subsp. paratuberculosis
acgaucugcaggc

SEQ ID NO: 872557 - RNA, 16 nt, Mycobacterium avium subsp. paratuberculosis
acgaucugcaggccga

SEQ ID NO: 872558 - RNA, 16 nt, Mycobacterium avium subsp. paratuberculosis
acgaucagcgcgucga

SEQ ID NO: 872559 - RNA, 24 nt, Mycobacterium avium subsp. paratuberculosis
acgaugauccuggccuggucggcc

SEQ ID NO: 872560 - RNA, 16 nt, Mycobacterium avium subsp. paratuberculosis
acgaugaugcccccga

SEQ ID NO: 872561 - RNA, 18 nt, Mycobacterium avium subsp. paratuberculosis
acgaugaugucgcccggc

SEQ ID NO: 872562 - RNA, 20 nt, Mycobacterium avium subsp. paratuberculosis
acgaugaugucgcccggcgg

SEQ ID NO: 872563 - RNA, 18 nt, Mycobacterium avium subsp. paratuberculosis
acgaugaugucggccggc

SEQ ID NO: 872564 - RNA, 12 nt, Mycobacterium avium subsp. paratuberculosis
acgaugcccguc

SEQ ID NO: 872565 - RNA, 19 nt, Mycobacterium avium subsp. paratuberculosis
acgaugaacuccucgaucg

SEQ ID NO: 872566 - RNA, 15 nt, Mycobacterium avium subsp. paratuberculosis
acgaucucggcgguc

SEQ ID NO: 872567 - RNA, 23 nt, Mycobacterium avium subsp. paratuberculosis
acgaucuggcgcaucagcggggc

SEQ ID NO: 872568 - RNA, 14 nt, Mycobacterium avium subsp. paratuberculosis
acgaucucgccguc

SEQ ID NO: 872569 - RNA, 15 nt, Mycobacterium avium subsp. paratuberculosis
acgcguugcagcgcc

SEQ ID NO: 872570 - RNA, 17 nt, Mycobacterium avium subsp. paratuberculosis
acgcguugcagcgccgc

SEQ ID NO: 872571 - RNA, 21 nt, Mycobacterium avium subsp. paratuberculosis
acgcguugcagcgccgcggcg

SEQ ID NO: 872572 - RNA, 16 nt, Mycobacterium avium subsp. paratuberculosis
acgcguucgucggcgc

SEQ ID NO: 872573 - RNA, 18 nt, Mycobacterium avium subsp. paratuberculosis
acgcguucgucggcgcgu

SEQ ID NO: 872574 - RNA, 18 nt, Mycobacterium avium subsp. paratuberculosis
acgcgucguugucgucgc

SEQ ID NO: 872575 - RNA, 23 nt, Mycobacterium avium subsp. paratuberculosis
acgcgugcgucaucgcgcugggg

SEQ ID NO: 872576 - RNA, 14 nt, Mycobacterium avium subsp. paratuberculosis
acgcggcggacgau

SEQ ID NO: 872577 - RNA, 22 nt, Mycobacterium avium subsp. paratuberculosis
acgcggcggaggccugcgcggc

SEQ ID NO: 872578 - RNA, 14 nt, Mycobacterium avium subsp. paratuberculosis
acgcggcggccgac

SEQ ID NO: 872579 - RNA, 14 nt, Mycobacterium avium subsp. paratuberculosis
acgcggcgcgcauc

SEQ ID NO: 872580 - RNA, 18 nt, Mycobacterium avium subsp. paratuberculosis
acgcggcgcgcgauggac

SEQ ID NO: 872581 - RNA, 17 nt, Mycobacterium avium subsp. paratuberculosis
acgcggcgaccaccacc

SEQ ID NO: 872582 - RNA, 18 nt, Mycobacterium avium subsp. paratuberculosis
acgcggcgaccaccaccg

SEQ ID NO: 872583 - RNA, 20 nt, Mycobacterium avium subsp. paratuberculosis
acgcggcgaccaccaccgcc

SEQ ID NO: 872584 - RNA, 15 nt, Mycobacterium avium subsp. paratuberculosis
acgcguagccgacca

SEQ ID NO: 872585 - RNA, 16 nt, Mycobacterium avium subsp. paratuberculosis
acgcguacacggcccg

SEQ ID NO: 872586 - RNA, 14 nt, Mycobacterium avium subsp. paratuberculosis
acgcguacagcgcc

SEQ ID NO: 872587 - RNA, 16 nt, Mycobacterium avium subsp. paratuberculosis
acgcguagaaccagug

SEQ ID NO: 872588 - RNA, 18 nt, Mycobacterium avium subsp. paratuberculosis
acgcguagaaccagugcg

SEQ ID NO: 872589 - RNA, 12 nt, Mycobacterium avium subsp. paratuberculosis
acgcgucaccgg

SEQ ID NO: 872590 - RNA, 16 nt, Mycobacterium avium subsp. paratuberculosis
acgcgucaggcgucgu

SEQ ID NO: 872591 - RNA, 17 nt, Mycobacterium avium subsp. paratuberculosis
acgcguccgacggcugg

SEQ ID NO: 872592 - RNA, 20 nt, Mycobacterium avium subsp. paratuberculosis
acgcguccguagugcucggc

SEQ ID NO: 872593 - RNA, 19 nt, Mycobacterium avium subsp. paratuberculosis
acgcgucgaacagccgggc

SEQ ID NO: 872594 - RNA, 20 nt, Mycobacterium avium subsp. paratuberculosis
acgcgucgaacagccgggcc

SEQ ID NO: 872595 - RNA, 21 nt, Mycobacterium avium subsp. paratuberculosis
acgcgucgaacagccgggccg

SEQ ID NO: 872596 - RNA, 12 nt, Mycobacterium avium subsp. paratuberculosis
acgcgucgccgu

SEQ ID NO: 872597 - RNA, 23 nt, Mycobacterium avium subsp. paratuberculosis
acgcgucgcgccagcgguccagc

SEQ ID NO: 872598 - RNA, 14 nt, Mycobacterium avium subsp. paratuberculosis
acgcgucgcggcgg

SEQ ID NO: 872599 - RNA, 17 nt, Mycobacterium avium subsp. paratuberculosis
acgcgucggcgccggau

SEQ ID NO: 872600 - RNA, 19 nt, Mycobacterium avium subsp. paratuberculosis
acgcgucggcgccggaucg

SEQ ID NO: 872601 - RNA, 20 nt, Mycobacterium avium subsp. paratuberculosis
acgcgucggucagcggcguc

SEQ ID NO: 872602 - RNA, 20 nt, Mycobacterium avium subsp. paratuberculosis
acgcuauuggccgagccggg

SEQ ID NO: 872603 - RNA, 21 nt, Mycobacterium avium subsp. paratuberculosis
acgcuauuggccgagccgggc

SEQ ID NO: 872604 - RNA, 22 nt, Mycobacterium avium subsp. paratuberculosis
acgcucgggccggcgccgacga

SEQ ID NO: 872605 - RNA, 18 nt, Mycobacterium avium subsp. paratuberculosis
acgcuagcgugacagucg

SEQ ID NO: 872606 - RNA, 19 nt, Mycobacterium avium subsp. paratuberculosis
acgcuagcgugacgcucgc

SEQ ID NO: 872607 - RNA, 21 nt, Mycobacterium avium subsp. paratuberculosis
acgcuagcgugacgcucgcgu

SEQ ID NO: 872608 - RNA, 24 nt, Mycobacterium avium subsp. paratuberculosis
acgcuagcgugacgcucgcguggc

SEQ ID NO: 872609 - RNA, 21 nt, Mycobacterium avium subsp. paratuberculosis
acgcucuucagcgcgacagcc

SEQ ID NO: 872610 - RNA, 17 nt, Mycobacterium avium subsp. paratuberculosis
acgcugaacggugccgu

SEQ ID NO: 872611 - RNA, 19 nt, Mycobacterium avium subsp. paratuberculosis
acgcugaacggugccguca

SEQ ID NO: 872612 - RNA, 21 nt, Mycobacterium avium subsp. paratuberculosis
acgcugaacggugccgucacg

SEQ ID NO: 872613 - RNA, 23 nt, Mycobacterium avium subsp. paratuberculosis
acgcugaagaucgaaaugaccgc

SEQ ID NO: 872614 - RNA, 17 nt, Mycobacterium avium subsp. paratuberculosis
acgcugaagcccaccgc

SEQ ID NO: 872615 - RNA, 19 nt, Mycobacterium avium subsp. paratuberculosis
acgcugaagcccaccgccg

SEQ ID NO: 872616 - RNA, 20 nt, Mycobacterium avium subsp. paratuberculosis
acgcugaagcccaccgccgu

SEQ ID NO: 872617 - RNA, 17 nt, Mycobacterium avium subsp. paratuberculosis
acgcucucgccggucag

SEQ ID NO: 872618 - RNA, 23 nt, Mycobacterium avium subsp. paratuberculosis
acgcucggucgccacggccggca

SEQ ID NO: 872619 - RNA, 14 nt, Mycobacterium avium subsp. paratuberculosis
acgcugggcggcga

SEQ ID NO: 872620 - RNA, 16 nt, Mycobacterium avium subsp. paratuberculosis
acgcugggcggcgaca

SEQ ID NO: 872621 - RNA, 18 nt, Mycobacterium avium subsp. paratuberculosis
acgcugaccugugcgccc

SEQ ID NO: 872622 - RNA, 13 nt, Mycobacterium avium subsp. paratuberculosis
acgcuggccggca

SEQ ID NO: 872623 - RNA, 16 nt, Mycobacterium avium subsp. paratuberculosis
acgcuggcguccaggu

SEQ ID NO: 872624 - RNA, 20 nt, Mycobacterium avium subsp. paratuberculosis
acgcuggcgugacacucggu

SEQ ID NO: 872625 - RNA, 16 nt, Mycobacterium avium subsp. paratuberculosis
acgcuggcgugacgcu

SEQ ID NO: 872626 - RNA, 19 nt, Mycobacterium avium subsp. paratuberculosis
acgcuggcgugacgcucgg

SEQ ID NO: 872627 - RNA, 20 nt, Mycobacterium avium subsp. paratuberculosis
acgcuggcgugacgcucggc

SEQ ID NO: 872628 - RNA, 22 nt, Mycobacterium avium subsp. paratuberculosis
acgcuggcgugacgcucggcgg

SEQ ID NO: 872629 - RNA, 22 nt, Mycobacterium avium subsp. paratuberculosis
acgcuggcgugacguucgucag

SEQ ID NO: 872630 - RNA, 23 nt, Mycobacterium avium subsp. paratuberculosis
acgcuggcguggcacccgggcgc

SEQ ID NO: 872631 - RNA, 18 nt, Mycobacterium avium subsp. paratuberculosis
acgcuggcguggcgccgg

SEQ ID NO: 872632 - RNA, 19 nt, Mycobacterium avium subsp. paratuberculosis
acgcuggcguggcgccggc

SEQ ID NO: 872633 - RNA, 20 nt, Mycobacterium avium subsp. paratuberculosis
acgcuggcguggcgccggcg

SEQ ID NO: 872634 - RNA, 21 nt, Mycobacterium avium subsp. paratuberculosis
acgcuggcguggcgccggcgc

SEQ ID NO: 872635 - RNA, 18 nt, Mycobacterium avium subsp. paratuberculosis
acgcuggcguggcucggc

SEQ ID NO: 872636 - RNA, 16 nt, Mycobacterium avium subsp. paratuberculosis
acgcgccccgccggga

SEQ ID NO: 872637 - RNA, 13 nt, Mycobacterium avium subsp. paratuberculosis
acgcgcccggcga

SEQ ID NO: 872638 - RNA, 15 nt, Mycobacterium avium subsp. paratuberculosis
acgcgcccggcgacg

SEQ ID NO: 872639 - RNA, 16 nt, Mycobacterium avium subsp. paratuberculosis
acgcgcccggcgacgc

SEQ ID NO: 872640 - RNA, 19 nt, Mycobacterium avium subsp. paratuberculosis
acgcgcccggcgacgcggc

SEQ ID NO: 872641 - RNA, 14 nt, Mycobacterium avium subsp. paratuberculosis
acgcgcccggcggg

SEQ ID NO: 872642 - RNA, 22 nt, Mycobacterium avium subsp. paratuberculosis
acgcgccgaugccgaacgucac

SEQ ID NO: 872643 - RNA, 16 nt, Mycobacterium avium subsp. paratuberculosis
acgcgauggcgcuggc

SEQ ID NO: 872644 - RNA, 21 nt, Mycobacterium avium subsp. paratuberculosis
acgcgauggcggcgcgcucgu

SEQ ID NO: 872645 - RNA, 12 nt, Mycobacterium avium subsp. paratuberculosis
acgcgccacgcc

SEQ ID NO: 872646 - RNA, 17 nt, Mycobacterium avium subsp. paratuberculosis
acgcgccacgccccggc

SEQ ID NO: 872647 - RNA, 19 nt, Mycobacterium avium subsp. paratuberculosis
acgcgccacgccccggcgc

SEQ ID NO: 872648 - RNA, 24 nt, Mycobacterium avium subsp. paratuberculosis
acgcgauagaccucacggucggcg

SEQ ID NO: 872649 - RNA, 13 nt, Mycobacterium avium subsp. paratuberculosis
acgcgagcugcuu

SEQ ID NO: 872650 - RNA, 16 nt, Mycobacterium avium subsp. paratuberculosis
acgcgagcugcuucgu

SEQ ID NO: 872651 - RNA, 18 nt, Mycobacterium avium subsp. paratuberculosis
acgcgagcugcuucgucg

SEQ ID NO: 872652 - RNA, 19 nt, Mycobacterium avium subsp. paratuberculosis
acgcgacggcccgguccag

SEQ ID NO: 872653 - RNA, 20 nt, Mycobacterium avium subsp. paratuberculosis
acgcgacggcccgguccagu

SEQ ID NO: 872654 - RNA, 15 nt, Mycobacterium avium subsp. paratuberculosis
acgcgacgcgcucgg

SEQ ID NO: 872655 - RNA, 16 nt, Mycobacterium avium subsp. paratuberculosis
acgcgacgcgcucggc

SEQ ID NO: 872656 - RNA, 16 nt, Mycobacterium avium subsp. paratuberculosis
acgcgacggucgugcu

SEQ ID NO: 872657 - RNA, 16 nt, Mycobacterium avium subsp. paratuberculosis
acgcgagacgagccgc

SEQ ID NO: 872658 - RNA, 19 nt, Mycobacterium avium subsp. paratuberculosis
acgccuuacaaagccgguc

SEQ ID NO: 872659 - RNA, 19 nt, Mycobacterium avium subsp. paratuberculosis
acgcggcacgccgcucguc

SEQ ID NO: 872660 - RNA, 17 nt, Mycobacterium avium subsp. paratuberculosis
acgcggcaugaccggcc

SEQ ID NO: 872661 - RNA, 18 nt, Mycobacterium avium subsp. paratuberculosis
acgcggcaugaccggcca

SEQ ID NO: 872662 - RNA, 20 nt, Mycobacterium avium subsp. paratuberculosis
acgcggcaugaccggccagc

SEQ ID NO: 872663 - RNA, 19 nt, Mycobacterium avium subsp. paratuberculosis
acgcggccaccaccgcauc

SEQ ID NO: 872664 - RNA, 13 nt, Mycobacterium avium subsp. paratuberculosis
acgcggccgagcc

SEQ ID NO: 872665 - RNA, 17 nt, Mycobacterium avium subsp. paratuberculosis
acgcggccgccagcgca

SEQ ID NO: 872666 - RNA, 13 nt, Mycobacterium avium subsp. paratuberculosis
acgcggccgccau

SEQ ID NO: 872667 - RNA, 18 nt, Mycobacterium avium subsp. paratuberculosis
acgcggcaggcgccccag

SEQ ID NO: 872668 - RNA, 14 nt, Mycobacterium avium subsp. paratuberculosis
acgcggccagcgcc

SEQ ID NO: 872669 - RNA, 17 nt, Mycobacterium avium subsp. paratuberculosis
acgcggccagcgcccgc

SEQ ID NO: 872670 - RNA, 15 nt, Mycobacterium avium subsp. paratuberculosis
acgcggcgccgacgu

SEQ ID NO: 872671 - RNA, 17 nt, Mycobacterium avium subsp. paratuberculosis
acgcggcgccgacgucc

SEQ ID NO: 872672 - RNA, 12 nt, Mycobacterium avium subsp. paratuberculosis
acgcggcgccgg

SEQ ID NO: 872673 - RNA, 15 nt, Mycobacterium avium subsp. paratuberculosis
acgcggcgccguccu

SEQ ID NO: 872674 - RNA, 12 nt, Mycobacterium avium subsp. paratuberculosis
acgcggcgcgac

SEQ ID NO: 872675 - RNA, 13 nt, Mycobacterium avium subsp. paratuberculosis
acgcggcgcgaca

SEQ ID NO: 872676 - RNA, 21 nt, Mycobacterium avium subsp. paratuberculosis
acgcggcgcgacaccgcggcg

SEQ ID NO: 872677 - RNA, 22 nt, Mycobacterium avium subsp. paratuberculosis
acgcggcgcgacaccgcggcga

SEQ ID NO: 872678 - RNA, 23 nt, Mycobacterium avium subsp. paratuberculosis
acgcggcgcgacaccgcggcgac

SEQ ID NO: 872679 - RNA, 19 nt, Mycobacterium avium subsp. paratuberculosis
acgcggcgaacaccucggc

SEQ ID NO: 872680 - RNA, 18 nt, Mycobacterium avium subsp. paratuberculosis
acgcggcgaagcaggcca

SEQ ID NO: 872681 - RNA, 17 nt, Mycobacterium avium subsp. paratuberculosis
acgcggcgaaggccagc

SEQ ID NO: 872682 - RNA, 17 nt, Mycobacterium avium subsp. paratuberculosis
acgcggccucaccgcgg

SEQ ID NO: 872683 - RNA, 22 nt, Mycobacterium avium subsp. paratuberculosis
acgcggccucaccgcgggccag

SEQ ID NO: 872684 - RNA, 12 nt, Mycobacterium avium subsp. paratuberculosis
acgcggccucga

SEQ ID NO: 872685 - RNA, 13 nt, Mycobacterium avium subsp. paratuberculosis
acgcggccgcgcc

SEQ ID NO: 872686 - RNA, 14 nt, Mycobacterium avium subsp. paratuberculosis
acgcggccgcgccg

SEQ ID NO: 872687 - RNA, 21 nt, Mycobacterium avium subsp. paratuberculosis
acgcggccgcgccggccggac

SEQ ID NO: 872688 - RNA, 14 nt, Mycobacterium avium subsp. paratuberculosis
acgcgccgcccacc

SEQ ID NO: 872689 - RNA, 23 nt, Mycobacterium avium subsp. paratuberculosis
acgcgccgccgagcaacagcccg

SEQ ID NO: 872690 - RNA, 12 nt, Mycobacterium avium subsp. paratuberculosis
acgcgccggccu

SEQ ID NO: 872691 - RNA, 22 nt, Mycobacterium avium subsp. paratuberculosis
acgcgccggcgcacaucguggc

SEQ ID NO: 872692 - RNA, 13 nt, Mycobacterium avium subsp. paratuberculosis
acgcgccggcgcg

SEQ ID NO: 872693 - RNA, 16 nt, Mycobacterium avium subsp. paratuberculosis
acgcgccggcgcgggc

SEQ ID NO: 872694 - RNA, 17 nt, Mycobacterium avium subsp. paratuberculosis
acgcgccggcgcgggca

SEQ ID NO: 872695 - RNA, 15 nt, Mycobacterium avium subsp. paratuberculosis
acgcgccggcggucg

SEQ ID NO: 872696 - RNA, 13 nt, Mycobacterium avium subsp. paratuberculosis
acgcgccgggcaa

SEQ ID NO: 872697 - RNA, 21 nt, Mycobacterium avium subsp. paratuberculosis
acgcgccgggcaacagcgcgc

SEQ ID NO: 872698 - RNA, 19 nt, Mycobacterium avium subsp. paratuberculosis
acgcgccgcacugcacggc

SEQ ID NO: 872699 - RNA, 13 nt, Mycobacterium avium subsp. paratuberculosis
acgcgccggccag

SEQ ID NO: 872700 - RNA, 18 nt, Mycobacterium avium subsp. paratuberculosis
acgcgccggccagccggc

SEQ ID NO: 872701 - RNA, 19 nt, Mycobacterium avium subsp. paratuberculosis
acgcgccggccagccggcu

SEQ ID NO: 872702 - RNA, 14 nt, Mycobacterium avium subsp. paratuberculosis
acgcgccggugacc

SEQ ID NO: 872703 - RNA, 17 nt, Mycobacterium avium subsp. paratuberculosis
acgcgccggugaccccg

SEQ ID NO: 872704 - RNA, 17 nt, Mycobacterium avium subsp. paratuberculosis
acgcgccgucggcccac

SEQ ID NO: 872705 - RNA, 12 nt, Mycobacterium avium subsp. paratuberculosis
acgcgccgucgu

SEQ ID NO: 872706 - RNA, 14 nt, Mycobacterium avium subsp. paratuberculosis
acgcgccgucgucg

SEQ ID NO: 872707 - RNA, 23 nt, Mycobacterium avium subsp. paratuberculosis
acgcgccgucgucggacaccagc

SEQ ID NO: 872708 - RNA, 16 nt, Mycobacterium avium subsp. paratuberculosis
acgcgcgcccggcacc

SEQ ID NO: 872709 - RNA, 21 nt, Mycobacterium avium subsp. paratuberculosis
acgcgcgcccggcaccgcggc

SEQ ID NO: 872710 - RNA, 14 nt, Mycobacterium avium subsp. paratuberculosis
acgcgcgcgccguc

SEQ ID NO: 872711 - RNA, 13 nt, Mycobacterium avium subsp. paratuberculosis
acgcgcgcgacgg

SEQ ID NO: 872712 - RNA, 14 nt, Mycobacterium avium subsp. paratuberculosis
acgcgcgcgacggc

SEQ ID NO: 872713 - RNA, 20 nt, Mycobacterium avium subsp. paratuberculosis
acgcgcgcaguugcgcggcg

SEQ ID NO: 872714 - RNA, 18 nt, Mycobacterium avium subsp. paratuberculosis
acgcggaucgguggacgc

SEQ ID NO: 872715 - RNA, 16 nt, Mycobacterium avium subsp. paratuberculosis
acgcggauagcccagc

SEQ ID NO: 872716 - RNA, 21 nt, Mycobacterium avium subsp. paratuberculosis
acgccgcacgaauugccggug

SEQ ID NO: 872717 - RNA, 23 nt, Mycobacterium avium subsp. paratuberculosis
acgccgcacgcgaccgcgucgac

SEQ ID NO: 872718 - RNA, 21 nt, Mycobacterium avium subsp. paratuberculosis
acgccgcagcgcagcgucggc

SEQ ID NO: 872719 - RNA, 23 nt, Mycobacterium avium subsp. paratuberculosis
acgccgcauacaccuugucggcg

SEQ ID NO: 872720 - RNA, 15 nt, Mycobacterium avium subsp. paratuberculosis
acgccgauggugacc

SEQ ID NO: 872721 - RNA, 17 nt, Mycobacterium avium subsp. paratuberculosis
acgccgauggugaccuc

SEQ ID NO: 872722 - RNA, 17 nt, Mycobacterium avium subsp. paratuberculosis
acgccgaugugcucggu

SEQ ID NO: 872723 - RNA, 20 nt, Mycobacterium avium subsp. paratuberculosis
acgccgaugugcucggucaa

SEQ ID NO: 872724 - RNA, 20 nt, Mycobacterium avium subsp. paratuberculosis
acgccgauguuuugggugcu

SEQ ID NO: 872725 - RNA, 19 nt, Mycobacterium avium subsp. paratuberculosis
acgccgcccaggccccggc

SEQ ID NO: 872726 - RNA, 22 nt, Mycobacterium avium subsp. paratuberculosis
acgccgcccaggccccggccga

SEQ ID NO: 872727 - RNA, 17 nt, Mycobacterium avium subsp. paratuberculosis
acgccgccgacagcacc

SEQ ID NO: 872728 - RNA, 14 nt, Mycobacterium avium subsp. paratuberculosis
acgccgcccccgcc

SEQ ID NO: 872729 - RNA, 19 nt, Mycobacterium avium subsp. paratuberculosis
acgccgcccccgccgcgag

SEQ ID NO: 872730 - RNA, 20 nt, Mycobacterium avium subsp. paratuberculosis
acgccgcccucucacggcgg

SEQ ID NO: 872731 - RNA, 15 nt, Mycobacterium avium subsp. paratuberculosis
acgccgccgaacccc

SEQ ID NO: 872732 - RNA, 21 nt, Mycobacterium avium subsp. paratuberculosis
acgccgccgaaccccagcucc

SEQ ID NO: 872733 - RNA, 11 nt, Mycobacterium avium subsp. paratuberculosis
acgccgccgac

SEQ ID NO: 872734 - RNA, 20 nt, Mycobacterium avium subsp. paratuberculosis
acgccgcguccucgucgaug

SEQ ID NO: 872735 - RNA, 21 nt, Mycobacterium avium subsp. paratuberculosis
acgccgcgcuugacggccggg

SEQ ID NO: 872736 - RNA, 19 nt, Mycobacterium avium subsp. paratuberculosis
acgccgcggaaggccagcu

SEQ ID NO: 872737 - RNA, 21 nt, Mycobacterium avium subsp. paratuberculosis
acgccgcggaaggccagcucc

SEQ ID NO: 872738 - RNA, 19 nt, Mycobacterium avium subsp. paratuberculosis
acgccgcgggaggcccagu

SEQ ID NO: 872739 - RNA, 13 nt, Mycobacterium avium subsp. paratuberculosis
acgccgcggucgc

SEQ ID NO: 872740 - RNA, 16 nt, Mycobacterium avium subsp. paratuberculosis
acgccgcggucgcuga

SEQ ID NO: 872741 - RNA, 15 nt, Mycobacterium avium subsp. paratuberculosis
acgccgcggugcagc

SEQ ID NO: 872742 - RNA, 18 nt, Mycobacterium avium subsp. paratuberculosis
acgccgcgguggccggga

SEQ ID NO: 872743 - RNA, 14 nt, Mycobacterium avium subsp. paratuberculosis
acgccgcgcccguc

SEQ ID NO: 872744 - RNA, 22 nt, Mycobacterium avium subsp. paratuberculosis
acgccgcgcccgucgagcguca

SEQ ID NO: 872745 - RNA, 18 nt, Mycobacterium avium subsp. paratuberculosis
acgccgcgcagcggggcg

SEQ ID NO: 872746 - RNA, 14 nt, Mycobacterium avium subsp. paratuberculosis
acgccgcgcacgac

SEQ ID NO: 872747 - RNA, 20 nt, Mycobacterium avium subsp. paratuberculosis
acgccgccuugacgccgggc

SEQ ID NO: 872748 - RNA, 21 nt, Mycobacterium avium subsp. paratuberculosis
acgccgccuugacgccgggca

SEQ ID NO: 872749 - RNA, 20 nt, Mycobacterium avium subsp. paratuberculosis
acgccgccggcuagacgcgc

SEQ ID NO: 872750 - RNA, 22 nt, Mycobacterium avium subsp. paratuberculosis
acgccgccggcuagacgcgcag

SEQ ID NO: 872751 - RNA, 12 nt, Mycobacterium avium subsp. paratuberculosis
acgccgccggga

SEQ ID NO: 872752 - RNA, 14 nt, Mycobacterium avium subsp. paratuberculosis
acgccgccggggcg

SEQ ID NO: 872753 - RNA, 20 nt, Mycobacterium avium subsp. paratuberculosis
acgccgccgguggagauggc

SEQ ID NO: 872754 - RNA, 22 nt, Mycobacterium avium subsp. paratuberculosis
acgccgccgucguagccgcggg

SEQ ID NO: 872755 - RNA, 13 nt, Mycobacterium avium subsp. paratuberculosis
acgccgccgugga

SEQ ID NO: 872756 - RNA, 21 nt, Mycobacterium avium subsp. paratuberculosis
acgccgccguguaggccgcgc

SEQ ID NO: 872757 - RNA, 14 nt, Mycobacterium avium subsp. paratuberculosis
acgccgccgccgag

SEQ ID NO: 872758 - RNA, 20 nt, Mycobacterium avium subsp. paratuberculosis
acgccgccgccgagcucggc

SEQ ID NO: 872759 - RNA, 15 nt, Mycobacterium avium subsp. paratuberculosis
acgcccuuggcgccc

SEQ ID NO: 872760 - RNA, 17 nt, Mycobacterium avium subsp. paratuberculosis
acgcccuggccgccggc

SEQ ID NO: 872761 - RNA, 19 nt, Mycobacterium avium subsp. paratuberculosis
acgcccuggaaggcgauca

SEQ ID NO: 872762 - RNA, 15 nt, Mycobacterium avium subsp. paratuberculosis
acgccgaccgcgguc

SEQ ID NO: 872763 - RNA, 22 nt, Mycobacterium avium subsp. paratuberculosis
acgccgaccgcggucgcggcgc

SEQ ID NO: 872764 - RNA, 23 nt, Mycobacterium avium subsp. paratuberculosis
acgccgaccgcggucgcggcgcc

SEQ ID NO: 872765 - RNA, 13 nt, Mycobacterium avium subsp. paratuberculosis
acgccgaccaggu

SEQ ID NO: 872766 - RNA, 17 nt, Mycobacterium avium subsp. paratuberculosis
acgccgacaccgucgcc

SEQ ID NO: 872767 - RNA, 19 nt, Mycobacterium avium subsp. paratuberculosis
acgccgacaccgucgccgu

SEQ ID NO: 872768 - RNA, 17 nt, Mycobacterium avium subsp. paratuberculosis
acgccgacaucgcggcg

SEQ ID NO: 872769 - RNA, 18 nt, Mycobacterium avium subsp. paratuberculosis
acgccgacaucgcggcga

SEQ ID NO: 872770 - RNA, 19 nt, Mycobacterium avium subsp. paratuberculosis
acgccgacaucgcggcgau

SEQ ID NO: 872771 - RNA, 19 nt, Mycobacterium avium subsp. paratuberculosis
acgccgaagaucagcgcgu

SEQ ID NO: 872772 - RNA, 17 nt, Mycobacterium avium subsp. paratuberculosis
acgccgaacugccggac

SEQ ID NO: 872773 - RNA, 20 nt, Mycobacterium avium subsp. paratuberculosis
acgccgaacugccggaccag

SEQ ID NO: 872774 - RNA, 18 nt, Mycobacterium avium subsp. paratuberculosis
acgccgaucaccggcacg

SEQ ID NO: 872775 - RNA, 19 nt, Mycobacterium avium subsp. paratuberculosis
acgccgaucaccggcacgu

SEQ ID NO: 872776 - RNA, 16 nt, Mycobacterium avium subsp. paratuberculosis
acgccgaucgggaugu

SEQ ID NO: 872777 - RNA, 18 nt, Mycobacterium avium subsp. paratuberculosis
acgccgaucgggaugugc

SEQ ID NO: 872778 - RNA, 16 nt, Mycobacterium avium subsp. paratuberculosis
acgccgauccgcugcg

SEQ ID NO: 872779 - RNA, 19 nt, Mycobacterium avium subsp. paratuberculosis
acgccgauggccugguggc

SEQ ID NO: 872780 - RNA, 13 nt, Mycobacterium avium subsp. paratuberculosis
acgccgaugcggu

SEQ ID NO: 872781 - RNA, 17 nt, Mycobacterium avium subsp. paratuberculosis
acgccgagcaccuggcc

SEQ ID NO: 872782 - RNA, 17 nt, Mycobacterium avium subsp. paratuberculosis
acgccgagcagcucagc

SEQ ID NO: 872783 - RNA, 23 nt, Mycobacterium avium subsp. paratuberculosis
acgccgagcagcucagccgccug

SEQ ID NO: 872784 - RNA, 14 nt, Mycobacterium avium subsp. paratuberculosis
acgccgaggcgggu

SEQ ID NO: 872785 - RNA, 16 nt, Mycobacterium avium subsp. paratuberculosis
acgccgagggcggcgg

SEQ ID NO: 872786 - RNA, 17 nt, Mycobacterium avium subsp. paratuberculosis
acgccgagggcggcggc

SEQ ID NO: 872787 - RNA, 22 nt, Mycobacterium avium subsp. paratuberculosis
acgccgaguaacucggccuucg

SEQ ID NO: 872788 - RNA, 12 nt, Mycobacterium avium subsp. paratuberculosis
acgccgacgccc

SEQ ID NO: 872789 - RNA, 17 nt, Mycobacterium avium subsp. paratuberculosis
acgccgacgcccagcgc

SEQ ID NO: 872790 - RNA, 23 nt, Mycobacterium avium subsp. paratuberculosis
acgccgacguaggacagcaccac

SEQ ID NO: 872791 - RNA, 22 nt, Mycobacterium avium subsp. paratuberculosis
acgccgacgucaggguggccuc

SEQ ID NO: 872792 - RNA, 18 nt, Mycobacterium avium subsp. paratuberculosis
acgccgacuagcgcggcg

SEQ ID NO: 872793 - RNA, 22 nt, Mycobacterium avium subsp. paratuberculosis
acgccgacuagcgcggcggccu

SEQ ID NO: 872794 - RNA, 18 nt, Mycobacterium avium subsp. paratuberculosis
acgccgggcagcgcgcga

SEQ ID NO: 872795 - RNA, 20 nt, Mycobacterium avium subsp. paratuberculosis
acgccggucagcaccauggc

SEQ ID NO: 872796 - RNA, 18 nt, Mycobacterium avium subsp. paratuberculosis
acgccggguugggcggcg

SEQ ID NO: 872797 - RNA, 23 nt, Mycobacterium avium subsp. paratuberculosis
acgccggguugggcggcggccac

SEQ ID NO: 872798 - RNA, 16 nt, Mycobacterium avium subsp. paratuberculosis
acgccggguuuguccg

SEQ ID NO: 872799 - RNA, 21 nt, Mycobacterium avium subsp. paratuberculosis
acgccggugaaaccggcgccg

SEQ ID NO: 872800 - RNA, 22 nt, Mycobacterium avium subsp. paratuberculosis
acgccggugaaaccggcgccga

SEQ ID NO: 872801 - RNA, 12 nt, Mycobacterium avium subsp. paratuberculosis
acgccggugacc

SEQ ID NO: 872802 - RNA, 14 nt, Mycobacterium avium subsp. paratuberculosis
acgccggugaggug

SEQ ID NO: 872803 - RNA, 19 nt, Mycobacterium avium subsp. paratuberculosis
acgccguagaucacgccgg

SEQ ID NO: 872804 - RNA, 20 nt, Mycobacterium avium subsp. paratuberculosis
acgccguagaucacgccggu

SEQ ID NO: 872805 - RNA, 18 nt, Mycobacterium avium subsp. paratuberculosis
acgccgggcacucccuug

SEQ ID NO: 872806 - RNA, 13 nt, Mycobacterium avium subsp. paratuberculosis
acgccggcucggu

SEQ ID NO: 872807 - RNA, 15 nt, Mycobacterium avium subsp. paratuberculosis
acgccggcucggucu

SEQ ID NO: 872808 - RNA, 23 nt, Mycobacterium avium subsp. paratuberculosis
acgccggcgugcacaggccgccg

SEQ ID NO: 872809 - RNA, 14 nt, Mycobacterium avium subsp. paratuberculosis
acgccgggccgccg

SEQ ID NO: 872810 - RNA, 18 nt, Mycobacterium avium subsp. paratuberculosis
acgccgggccgccgcggc

SEQ ID NO: 872811 - RNA, 19 nt, Mycobacterium avium subsp. paratuberculosis
acgccgggccgccgcggcc

SEQ ID NO: 872812 - RNA, 20 nt, Mycobacterium avium subsp. paratuberculosis
acgccgggccgccgcggcca

SEQ ID NO: 872813 - RNA, 15 nt, Mycobacterium avium subsp. paratuberculosis
acgccgggguagagg

SEQ ID NO: 872814 - RNA, 19 nt, Mycobacterium avium subsp. paratuberculosis
acgccgggguagaggccgc

SEQ ID NO: 872815 - RNA, 23 nt, Mycobacterium avium subsp. paratuberculosis
acgccgggguagaggccgcggau

SEQ ID NO: 872816 - RNA, 17 nt, Mycobacterium avium subsp. paratuberculosis
acgccggggucgacagc

SEQ ID NO: 872817 - RNA, 16 nt, Mycobacterium avium subsp. paratuberculosis
acgccggguccacgaa

SEQ ID NO: 872818 - RNA, 18 nt, Mycobacterium avium subsp. paratuberculosis
acgccgggucccagugcc

SEQ ID NO: 872819 - RNA, 14 nt, Mycobacterium avium subsp. paratuberculosis
acgccgggucgacg

SEQ ID NO: 872820 - RNA, 18 nt, Mycobacterium avium subsp. paratuberculosis
acgccgggucgacgccga

SEQ ID NO: 872821 - RNA, 21 nt, Mycobacterium avium subsp. paratuberculosis
acgccgggucgacgccgagua

SEQ ID NO: 872822 - RNA, 19 nt, Mycobacterium avium subsp. paratuberculosis
acgccggauuggcgucggu

SEQ ID NO: 872823 - RNA, 22 nt, Mycobacterium avium subsp. paratuberculosis
acgccggauuggcgucgguggc

SEQ ID NO: 872824 - RNA, 23 nt, Mycobacterium avium subsp. paratuberculosis
acgccggauuggcgucgguggcg

SEQ ID NO: 872825 - RNA, 13 nt, Mycobacterium avium subsp. paratuberculosis
acgccgcugggcg

SEQ ID NO: 872826 - RNA, 13 nt, Mycobacterium avium subsp. paratuberculosis
acgccggacagcu

SEQ ID NO: 872827 - RNA, 14 nt, Mycobacterium avium subsp. paratuberculosis
acgccggaccccac

SEQ ID NO: 872828 - RNA, 18 nt, Mycobacterium avium subsp. paratuberculosis
acgccggaccccacagcg

SEQ ID NO: 872829 - RNA, 20 nt, Mycobacterium avium subsp. paratuberculosis
acgccggaccccacagcgcg

SEQ ID NO: 872830 - RNA, 22 nt, Mycobacterium avium subsp. paratuberculosis
acgccggaccccacagcgcgcc

SEQ ID NO: 872831 - RNA, 16 nt, Mycobacterium avium subsp. paratuberculosis
acgccgcucggccagc

SEQ ID NO: 872832 - RNA, 19 nt, Mycobacterium avium subsp. paratuberculosis
acgccgcucggccagcgca

SEQ ID NO: 872833 - RNA, 21 nt, Mycobacterium avium subsp. paratuberculosis
acgccgcucggccagcgcagc

SEQ ID NO: 872834 - RNA, 23 nt, Mycobacterium avium subsp. paratuberculosis
acgccgcucggccagcgcagcga

SEQ ID NO: 872835 - RNA, 17 nt, Mycobacterium avium subsp. paratuberculosis
acgccggcagccgcucg

SEQ ID NO: 872836 - RNA, 16 nt, Mycobacterium avium subsp. paratuberculosis
acgccggccaccaaca

SEQ ID NO: 872837 - RNA, 14 nt, Mycobacterium avium subsp. paratuberculosis
acgccggccccggc

SEQ ID NO: 872838 - RNA, 12 nt, Mycobacterium avium subsp. paratuberculosis
acgccggccggc

SEQ ID NO: 872839 - RNA, 13 nt, Mycobacterium avium subsp. paratuberculosis
acgccggccggcg

SEQ ID NO: 872840 - RNA, 19 nt, Mycobacterium avium subsp. paratuberculosis
acgccggccguucgccggc

SEQ ID NO: 872841 - RNA, 22 nt, Mycobacterium avium subsp. paratuberculosis
acgccggccguucgccggccag

SEQ ID NO: 872842 - RNA, 15 nt, Mycobacterium avium subsp. paratuberculosis
acgccggcgaggcgg

SEQ ID NO: 872843 - RNA, 12 nt, Mycobacterium avium subsp. paratuberculosis
acgccggcggcc

SEQ ID NO: 872844 - RNA, 14 nt, Mycobacterium avium subsp. paratuberculosis
acgccggcggccac

SEQ ID NO: 872845 - RNA, 12 nt, Mycobacterium avium subsp. paratuberculosis
acgccggccucu

SEQ ID NO: 872846 - RNA, 18 nt, Mycobacterium avium subsp. paratuberculosis
acgccggccucucgucga

SEQ ID NO: 872847 - RNA, 19 nt, Mycobacterium avium subsp. paratuberculosis
acgccggccucucgucgac

SEQ ID NO: 872848 - RNA, 14 nt, Mycobacterium avium subsp. paratuberculosis
acgccucgggccgg

SEQ ID NO: 872849 - RNA, 18 nt, Mycobacterium avium subsp. paratuberculosis
acgccucgggccggcagc

SEQ ID NO: 872850 - RNA, 17 nt, Mycobacterium avium subsp. paratuberculosis
acgccucgucgaccgcg

SEQ ID NO: 872851 - RNA, 20 nt, Mycobacterium avium subsp. paratuberculosis
acgccucgucgaccgcggcc

SEQ ID NO: 872852 - RNA, 22 nt, Mycobacterium avium subsp. paratuberculosis
acgccucgucgaccgcggccug

SEQ ID NO: 872853 - RNA, 17 nt, Mycobacterium avium subsp. paratuberculosis
acgccucgucgagcagc

SEQ ID NO: 872854 - RNA, 19 nt, Mycobacterium avium subsp. paratuberculosis
acgccucgucgagcagcgc

SEQ ID NO: 872855 - RNA, 21 nt, Mycobacterium avium subsp. paratuberculosis
acgccucgucgagcagcgccc

SEQ ID NO: 872856 - RNA, 19 nt, Mycobacterium avium subsp. paratuberculosis
acgccucguuggccagcuc

SEQ ID NO: 872857 - RNA, 21 nt, Mycobacterium avium subsp. paratuberculosis
acgccucguuggccagcucgg

SEQ ID NO: 872858 - RNA, 20 nt, Mycobacterium avium subsp. paratuberculosis
acgccuccacauacgcggcg

SEQ ID NO: 872859 - RNA, 21 nt, Mycobacterium avium subsp. paratuberculosis
acgccuccacauacgcggcgg

SEQ ID NO: 872860 - RNA, 23 nt, Mycobacterium avium subsp. paratuberculosis
acgccuccgaauccagcgcgccg

SEQ ID NO: 872861 - RNA, 13 nt, Mycobacterium avium subsp. paratuberculosis
acgccuccgccgc

SEQ ID NO: 872862 - RNA, 22 nt, Mycobacterium avium subsp. paratuberculosis
acgccguugcggugcucgucga

SEQ ID NO: 872863 - RNA, 17 nt, Mycobacterium avium subsp. paratuberculosis
acgccucaccccagcgc

SEQ ID NO: 872864 - RNA, 18 nt, Mycobacterium avium subsp. paratuberculosis
acgccucaccccagcgcg

SEQ ID NO: 872865 - RNA, 19 nt, Mycobacterium avium subsp. paratuberculosis
acgccucaccccagcgcga

SEQ ID NO: 872866 - RNA, 13 nt, Mycobacterium avium subsp. paratuberculosis
acgccucaggcga

SEQ ID NO: 872867 - RNA, 21 nt, Mycobacterium avium subsp. paratuberculosis
acgccuggcggaaggccgcgc

SEQ ID NO: 872868 - RNA, 22 nt, Mycobacterium avium subsp. paratuberculosis
acgccuggcggaaggccgcgcg

SEQ ID NO: 872869 - RNA, 16 nt, Mycobacterium avium subsp. paratuberculosis
acgccugccggcgccg

SEQ ID NO: 872870 - RNA, 17 nt, Mycobacterium avium subsp. paratuberculosis
acgccugccggcgccgg

SEQ ID NO: 872871 - RNA, 13 nt, Mycobacterium avium subsp. paratuberculosis
acgccugcgccgc

SEQ ID NO: 872872 - RNA, 22 nt, Mycobacterium avium subsp. paratuberculosis
acgccugcgcgaacagcgaagc

SEQ ID NO: 872873 - RNA, 14 nt, Mycobacterium avium subsp. paratuberculosis
acgccugcggccca

SEQ ID NO: 872874 - RNA, 20 nt, Mycobacterium avium subsp. paratuberculosis
acgccugcaccuugcccguc

SEQ ID NO: 872875 - RNA, 14 nt, Mycobacterium avium subsp. paratuberculosis
acgccucggcgagc

SEQ ID NO: 872876 - RNA, 19 nt, Mycobacterium avium subsp. paratuberculosis
acgccucggcgagccgcuc

SEQ ID NO: 872877 - RNA, 14 nt, Mycobacterium avium subsp. paratuberculosis
acgccucgcgcagc

SEQ ID NO: 872878 - RNA, 16 nt, Mycobacterium avium subsp. paratuberculosis
acgccgugcccggcgc

SEQ ID NO: 872879 - RNA, 17 nt, Mycobacterium avium subsp. paratuberculosis
acgccgugcccggcgcc

SEQ ID NO: 872880 - RNA, 20 nt, Mycobacterium avium subsp. paratuberculosis
acgccgugcccggcgcccug

SEQ ID NO: 872881 - RNA, 21 nt, Mycobacterium avium subsp. paratuberculosis
acgccgugcagaacagcacga

SEQ ID NO: 872882 - RNA, 14 nt, Mycobacterium avium subsp. paratuberculosis
acgccgugcaggag

SEQ ID NO: 872883 - RNA, 21 nt, Mycobacterium avium subsp. paratuberculosis
acgccguugaccccgacggcg

SEQ ID NO: 872884 - RNA, 14 nt, Mycobacterium avium subsp. paratuberculosis
acgccguguugacg

SEQ ID NO: 872885 - RNA, 23 nt, Mycobacterium avium subsp. paratuberculosis
acgccguggcggcgggccagcuc

SEQ ID NO: 872886 - RNA, 17 nt, Mycobacterium avium subsp. paratuberculosis
acgccgugguccagccg

SEQ ID NO: 872887 - RNA, 22 nt, Mycobacterium avium subsp. paratuberculosis
acgccgugguccagccggucgc

SEQ ID NO: 872888 - RNA, 14 nt, Mycobacterium avium subsp. paratuberculosis
acgccguggcccgc

SEQ ID NO: 872889 - RNA, 15 nt, Mycobacterium avium subsp. paratuberculosis
acgccguggcccgcc

SEQ ID NO: 872890 - RNA, 16 nt, Mycobacterium avium subsp. paratuberculosis
acgccguggcccgccc

SEQ ID NO: 872891 - RNA, 22 nt, Mycobacterium avium subsp. paratuberculosis
acgccguggcccgcccagcgca

SEQ ID NO: 872892 - RNA, 14 nt, Mycobacterium avium subsp. paratuberculosis
acgccgucggggua

SEQ ID NO: 872893 - RNA, 17 nt, Mycobacterium avium subsp. paratuberculosis
acgccgucgugcucggc

SEQ ID NO: 872894 - RNA, 19 nt, Mycobacterium avium subsp. paratuberculosis
acgccgucgugcucggcga

SEQ ID NO: 872895 - RNA, 20 nt, Mycobacterium avium subsp. paratuberculosis
acgccgucgugcucggcgag

SEQ ID NO: 872896 - RNA, 22 nt, Mycobacterium avium subsp. paratuberculosis
acgccgucgugcucggcgagca

SEQ ID NO: 872897 - RNA, 21 nt, Mycobacterium avium subsp. paratuberculosis
acgccgucacggaucgcccac

SEQ ID NO: 872898 - RNA, 20 nt, Mycobacterium avium subsp. paratuberculosis
acgccguccuuggccgccag

SEQ ID NO: 872899 - RNA, 21 nt, Mycobacterium avium subsp. paratuberculosis
acgccguccuuggccgccagc

SEQ ID NO: 872900 - RNA, 16 nt, Mycobacterium avium subsp. paratuberculosis
acgccgucgacgaucu

SEQ ID NO: 872901 - RNA, 15 nt, Mycobacterium avium subsp. paratuberculosis
acgcugggcuccgac

SEQ ID NO: 872902 - RNA, 14 nt, Mycobacterium avium subsp. paratuberculosis
acggcccccacgag

SEQ ID NO: 872903 - RNA, 22 nt, Mycobacterium avium subsp. paratuberculosis
acggccccccgggcaccagcgc

SEQ ID NO: 872904 - RNA, 20 nt, Mycobacterium avium subsp. paratuberculosis
acggcccgaacaccgugaac

SEQ ID NO: 872905 - RNA, 13 nt, Mycobacterium avium subsp. paratuberculosis
acggcccgacgac

SEQ ID NO: 872906 - RNA, 14 nt, Mycobacterium avium subsp. paratuberculosis
acggcccgacgacg

SEQ ID NO: 872907 - RNA, 16 nt, Mycobacterium avium subsp. paratuberculosis
acggccgcaccccacc

SEQ ID NO: 872908 - RNA, 22 nt, Mycobacterium avium subsp. paratuberculosis
acggccgcaccccacccgcgcg

SEQ ID NO: 872909 - RNA, 12 nt, Mycobacterium avium subsp. paratuberculosis
acggccgcacgu

SEQ ID NO: 872910 - RNA, 21 nt, Mycobacterium avium subsp. paratuberculosis
acggccgcacguauccgcggu

SEQ ID NO: 872911 - RNA, 22 nt, Mycobacterium avium subsp. paratuberculosis
acggccgcacguauccgcgguc

SEQ ID NO: 872912 - RNA, 13 nt, Mycobacterium avium subsp. paratuberculosis
acggccgcagcgg

SEQ ID NO: 872913 - RNA, 21 nt, Mycobacterium avium subsp. paratuberculosis
acggcccgccggagccgaucg

SEQ ID NO: 872914 - RNA, 11 nt, Mycobacterium avium subsp. paratuberculosis
acggcccgcgc

SEQ ID NO: 872915 - RNA, 19 nt, Mycobacterium avium subsp. paratuberculosis
acggcccgcgccccggcgg

SEQ ID NO: 872916 - RNA, 20 nt, Mycobacterium avium subsp. paratuberculosis
acggcccgcgccccggcggc

SEQ ID NO: 872917 - RNA, 18 nt, Mycobacterium avium subsp. paratuberculosis
acggcccgcggcacgcug

SEQ ID NO: 872918 - RNA, 17 nt, Mycobacterium avium subsp. paratuberculosis
acggcccggacggagcc

SEQ ID NO: 872919 - RNA, 21 nt, Mycobacterium avium subsp. paratuberculosis
acggcccggacggagccgugc

SEQ ID NO: 872920 - RNA, 20 nt, Mycobacterium avium subsp. paratuberculosis
acggcccgggaagccgcagc

SEQ ID NO: 872921 - RNA, 16 nt, Mycobacterium avium subsp. paratuberculosis
acggccugcaccacca

SEQ ID NO: 872922 - RNA, 16 nt, Mycobacterium avium subsp. paratuberculosis
acggccucgaucauca

SEQ ID NO: 872923 - RNA, 19 nt, Mycobacterium avium subsp. paratuberculosis
acggccucgaucaucacca

SEQ ID NO: 872924 - RNA, 22 nt, Mycobacterium avium subsp. paratuberculosis
acggccucgcccagcgccgcgg

SEQ ID NO: 872925 - RNA, 15 nt, Mycobacterium avium subsp. paratuberculosis
acggccucgccgucg

SEQ ID NO: 872926 - RNA, 14 nt, Mycobacterium avium subsp. paratuberculosis
acggccggugacuc

SEQ ID NO: 872927 - RNA, 21 nt, Mycobacterium avium subsp. paratuberculosis
acggccgguuccacgauuccu

SEQ ID NO: 872928 - RNA, 19 nt, Mycobacterium avium subsp. paratuberculosis
acggccguccaggcgccau

SEQ ID NO: 872929 - RNA, 16 nt, Mycobacterium avium subsp. paratuberculosis
acggccguccggucgc

SEQ ID NO: 872930 - RNA, 21 nt, Mycobacterium avium subsp. paratuberculosis
acggccguccggucgcugggc

SEQ ID NO: 872931 - RNA, 18 nt, Mycobacterium avium subsp. paratuberculosis
acggccgugaugccgggc

SEQ ID NO: 872932 - RNA, 18 nt, Mycobacterium avium subsp. paratuberculosis
acggccguucucgggaaa

SEQ ID NO: 872933 - RNA, 18 nt, Mycobacterium avium subsp. paratuberculosis
acggccggggccagcacc

SEQ ID NO: 872934 - RNA, 13 nt, Mycobacterium avium subsp. paratuberculosis
acggccgggucag

SEQ ID NO: 872935 - RNA, 14 nt, Mycobacterium avium subsp. paratuberculosis
acggccggcgccgc

SEQ ID NO: 872936 - RNA, 12 nt, Mycobacterium avium subsp. paratuberculosis
acggccggccgg

SEQ ID NO: 872937 - RNA, 13 nt, Mycobacterium avium subsp. paratuberculosis
acggccgacgccc

SEQ ID NO: 872938 - RNA, 16 nt, Mycobacterium avium subsp. paratuberculosis
acggccgacgcccagc

SEQ ID NO: 872939 - RNA, 19 nt, Mycobacterium avium subsp. paratuberculosis
acggccgcaacggcggucg

SEQ ID NO: 872940 - RNA, 19 nt, Mycobacterium avium subsp. paratuberculosis
acggccggcaacgacccgu

SEQ ID NO: 872941 - RNA, 17 nt, Mycobacterium avium subsp. paratuberculosis
acgcuggugugacgcuc

SEQ ID NO: 872942 - RNA, 18 nt, Mycobacterium avium subsp. paratuberculosis
acggccgaaacgcccggc

SEQ ID NO: 872943 - RNA, 14 nt, Mycobacterium avium subsp. paratuberculosis
acggccgccgaggc

SEQ ID NO: 872944 - RNA, 16 nt, Mycobacterium avium subsp. paratuberculosis
acggccgccgauuccg

SEQ ID NO: 872945 - RNA, 21 nt, Mycobacterium avium subsp. paratuberculosis
acggccgccgauuccggccgg

SEQ ID NO: 872946 - RNA, 23 nt, Mycobacterium avium subsp. paratuberculosis
acggccgccgauuccggccggcc

SEQ ID NO: 872947 - RNA, 14 nt, Mycobacterium avium subsp. paratuberculosis
acggccgccgcgac

SEQ ID NO: 872948 - RNA, 22 nt, Mycobacterium avium subsp. paratuberculosis
acggccgcgcagaucgccagca

SEQ ID NO: 872949 - RNA, 15 nt, Mycobacterium avium subsp. paratuberculosis
acggccgcggccagc

SEQ ID NO: 872950 - RNA, 16 nt, Mycobacterium avium subsp. paratuberculosis
acggccgcggccagcg

SEQ ID NO: 872951 - RNA, 14 nt, Mycobacterium avium subsp. paratuberculosis
acggccgcggcgcg

SEQ ID NO: 872952 - RNA, 17 nt, Mycobacterium avium subsp. paratuberculosis
acggccgcggcggugcc

SEQ ID NO: 872953 - RNA, 21 nt, Mycobacterium avium subsp. paratuberculosis
acggccgcggcggugccggug

SEQ ID NO: 872954 - RNA, 15 nt, Mycobacterium avium subsp. paratuberculosis
acggcgcgaaccggg

SEQ ID NO: 872955 - RNA, 21 nt, Mycobacterium avium subsp. paratuberculosis
acggcgcgaaccgggccagga

SEQ ID NO: 872956 - RNA, 20 nt, Mycobacterium avium subsp. paratuberculosis
acggcgccugauccgcgguc

SEQ ID NO: 872957 - RNA, 21 nt, Mycobacterium avium subsp. paratuberculosis
acggcgccugauccgcgguca

SEQ ID NO: 872958 - RNA, 23 nt, Mycobacterium avium subsp. paratuberculosis
acggcgccugauccgcggucaga

SEQ ID NO: 872959 - RNA, 13 nt, Mycobacterium avium subsp. paratuberculosis
acggcgccgacga

SEQ ID NO: 872960 - RNA, 13 nt, Mycobacterium avium subsp. paratuberculosis
acggcgccggugc

SEQ ID NO: 872961 - RNA, 16 nt, Mycobacterium avium subsp. paratuberculosis
acggcgccgugccgcg

SEQ ID NO: 872962 - RNA, 17 nt, Mycobacterium avium subsp. paratuberculosis
acggcgccgugccgcgc

SEQ ID NO: 872963 - RNA, 18 nt, Mycobacterium avium subsp. paratuberculosis
acggcgccgugccgcgcg

SEQ ID NO: 872964 - RNA, 19 nt, Mycobacterium avium subsp. paratuberculosis
acggcgccgugccgcgcgg

SEQ ID NO: 872965 - RNA, 22 nt, Mycobacterium avium subsp. paratuberculosis
acggcgccgugccgcgcggcga

SEQ ID NO: 872966 - RNA, 13 nt, Mycobacterium avium subsp. paratuberculosis
acggcgccgugcg

SEQ ID NO: 872967 - RNA, 14 nt, Mycobacterium avium subsp. paratuberculosis
acggcgccaccagc

SEQ ID NO: 872968 - RNA, 15 nt, Mycobacterium avium subsp. paratuberculosis
acggcgccaccagcc

SEQ ID NO: 872969 - RNA, 15 nt, Mycobacterium avium subsp. paratuberculosis
acggcgccgcggccg

SEQ ID NO: 872970 - RNA, 16 nt, Mycobacterium avium subsp. paratuberculosis
acggcgccgcggccgu

SEQ ID NO: 872971 - RNA, 13 nt, Mycobacterium avium subsp. paratuberculosis
acggcgccgcguc

SEQ ID NO: 872972 - RNA, 14 nt, Mycobacterium avium subsp. paratuberculosis
acggcgccgcgucg

SEQ ID NO: 872973 - RNA, 12 nt, Mycobacterium avium subsp. paratuberculosis
acggcgcccgcc

SEQ ID NO: 872974 - RNA, 17 nt, Mycobacterium avium subsp. paratuberculosis
acggcgcccgccccgac

SEQ ID NO: 872975 - RNA, 19 nt, Mycobacterium avium subsp. paratuberculosis
acggcgcccgccccgacgu

SEQ ID NO: 872976 - RNA, 20 nt, Mycobacterium avium subsp. paratuberculosis
acggcgcccgccccgacgug

SEQ ID NO: 872977 - RNA, 19 nt, Mycobacterium avium subsp. paratuberculosis
acggcgccaucguggccgc

SEQ ID NO: 872978 - RNA, 21 nt, Mycobacterium avium subsp. paratuberculosis
acggcgccaucguggccgcgu

SEQ ID NO: 872979 - RNA, 17 nt, Mycobacterium avium subsp. paratuberculosis
acggcgccaugcgccgc

SEQ ID NO: 872980 - RNA, 19 nt, Mycobacterium avium subsp. paratuberculosis
acggcgccaugcgccgcgc

SEQ ID NO: 872981 - RNA, 23 nt, Mycobacterium avium subsp. paratuberculosis
acggcgcccagguccaccaggug

SEQ ID NO: 872982 - RNA, 17 nt, Mycobacterium avium subsp. paratuberculosis
acggcgauguaggacgc

SEQ ID NO: 872983 - RNA, 22 nt, Mycobacterium avium subsp. paratuberculosis
acggcgauguaggacgccgcac

SEQ ID NO: 872984 - RNA, 15 nt, Mycobacterium avium subsp. paratuberculosis
acggcgacggcagcg

SEQ ID NO: 872985 - RNA, 16 nt, Mycobacterium avium subsp. paratuberculosis
acggcgacggcagcgc

SEQ ID NO: 872986 - RNA, 13 nt, Mycobacterium avium subsp. paratuberculosis
acggcgacggcca

SEQ ID NO: 872987 - RNA, 16 nt, Mycobacterium avium subsp. paratuberculosis
acggcgacggcguccg

SEQ ID NO: 872988 - RNA, 19 nt, Mycobacterium avium subsp. paratuberculosis
acggcgacggcguccgggc

SEQ ID NO: 872989 - RNA, 21 nt, Mycobacterium avium subsp. paratuberculosis
acggcgacggcguccgggcgc

SEQ ID NO: 872990 - RNA, 22 nt, Mycobacterium avium subsp. paratuberculosis
acggcgagcggcccugcgcggc

SEQ ID NO: 872991 - RNA, 15 nt, Mycobacterium avium subsp. paratuberculosis
acggcgaacggccgc

SEQ ID NO: 872992 - RNA, 19 nt, Mycobacterium avium subsp. paratuberculosis
acggcgaacggccgcgaug

SEQ ID NO: 872993 - RNA, 18 nt, Mycobacterium avium subsp. paratuberculosis
acggcgaacuuggccgac

SEQ ID NO: 872994 - RNA, 19 nt, Mycobacterium avium subsp. paratuberculosis
acggcgaacuuggccgaca

SEQ ID NO: 872995 - RNA, 16 nt, Mycobacterium avium subsp. paratuberculosis
acggcgaagccggcgu

SEQ ID NO: 872996 - RNA, 20 nt, Mycobacterium avium subsp. paratuberculosis
acggccugguacagcaccgc

SEQ ID NO: 872997 - RNA, 16 nt, Mycobacterium avium subsp. paratuberculosis
acggccuugccgauca

SEQ ID NO: 872998 - RNA, 18 nt, Mycobacterium avium subsp. paratuberculosis
acggcgaauauuucgccg

SEQ ID NO: 872999 - RNA, 19 nt, Mycobacterium avium subsp. paratuberculosis
acggcgaccacaccgucga

SEQ ID NO: 873000 - RNA, 20 nt, Mycobacterium avium subsp. paratuberculosis
acggcgaccacaccgucgac

SEQ ID NO: 873001 - RNA, 15 nt, Mycobacterium avium subsp. paratuberculosis
acggcgaccagcgag

SEQ ID NO: 873002 - RNA, 21 nt, Mycobacterium avium subsp. paratuberculosis
acggcgaccagcgagcccagc

SEQ ID NO: 873003 - RNA, 19 nt, Mycobacterium avium subsp. paratuberculosis
acggggcgaugccgacacc

SEQ ID NO: 873004 - RNA, 21 nt, Mycobacterium avium subsp. paratuberculosis
acggggcgaugccgacacccc

SEQ ID NO: 873005 - RNA, 12 nt, Mycobacterium avium subsp. paratuberculosis
acggggcgccgc

SEQ ID NO: 873006 - RNA, 20 nt, Mycobacterium avium subsp. paratuberculosis
acggggcguugguugcggcc

SEQ ID NO: 873007 - RNA, 15 nt, Mycobacterium avium subsp. paratuberculosis
acggggacgucgucg

SEQ ID NO: 873008 - RNA, 12 nt, Mycobacterium avium subsp. paratuberculosis
acggggcccgcg

SEQ ID NO: 873009 - RNA, 14 nt, Mycobacterium avium subsp. paratuberculosis
acgggccggcgggg

SEQ ID NO: 873010 - RNA, 12 nt, Mycobacterium avium subsp. paratuberculosis
acgggccgggca

SEQ ID NO: 873011 - RNA, 22 nt, Mycobacterium avium subsp. paratuberculosis
acgggccgggcaccgcgcccgc

SEQ ID NO: 873012 - RNA, 17 nt, Mycobacterium avium subsp. paratuberculosis
acgggccgggcacgucg

SEQ ID NO: 873013 - RNA, 20 nt, Mycobacterium avium subsp. paratuberculosis
acgggccgggcacgucgacg

SEQ ID NO: 873014 - RNA, 18 nt, Mycobacterium avium subsp. paratuberculosis
acgggcugucccggccgc

SEQ ID NO: 873015 - RNA, 21 nt, Mycobacterium avium subsp. paratuberculosis
acgggcugucccggccgcgac

SEQ ID NO: 873016 - RNA, 22 nt, Mycobacterium avium subsp. paratuberculosis
acgggcugucccggccgcgaca

SEQ ID NO: 873017 - RNA, 13 nt, Mycobacterium avium subsp. paratuberculosis
acgggccgcggcc

SEQ ID NO: 873018 - RNA, 15 nt, Mycobacterium avium subsp. paratuberculosis
acgggccgcggccag

SEQ ID NO: 873019 - RNA, 17 nt, Mycobacterium avium subsp. paratuberculosis
acgggccgcggccagcu

SEQ ID NO: 873020 - RNA, 14 nt, Mycobacterium avium subsp. paratuberculosis
acgggccauguccc

SEQ ID NO: 873021 - RNA, 18 nt, Mycobacterium avium subsp. paratuberculosis
acgggccauguccccgac

SEQ ID NO: 873022 - RNA, 19 nt, Mycobacterium avium subsp. paratuberculosis
acgggcccagcgcgacguc

SEQ ID NO: 873023 - RNA, 14 nt, Mycobacterium avium subsp. paratuberculosis
acgggcccgcgccu

SEQ ID NO: 873024 - RNA, 14 nt, Mycobacterium avium subsp. paratuberculosis
acgggcccgcggga

SEQ ID NO: 873025 - RNA, 16 nt, Mycobacterium avium subsp. paratuberculosis
acgggcccguccgcga

SEQ ID NO: 873026 - RNA, 17 nt, Mycobacterium avium subsp. paratuberculosis
acgggcccguccgcgaa

SEQ ID NO: 873027 - RNA, 12 nt, Mycobacterium avium subsp. paratuberculosis
acgggccgauca

SEQ ID NO: 873028 - RNA, 22 nt, Mycobacterium avium subsp. paratuberculosis
acgggccgaucacgcggaucgg

SEQ ID NO: 873029 - RNA, 12 nt, Mycobacterium avium subsp. paratuberculosis
acgggccgcacu

SEQ ID NO: 873030 - RNA, 12 nt, Mycobacterium avium subsp. paratuberculosis
acgggccgcauc

SEQ ID NO: 873031 - RNA, 18 nt, Mycobacterium avium subsp. paratuberculosis
acgggccgcauccgcgag

SEQ ID NO: 873032 - RNA, 15 nt, Mycobacterium avium subsp. paratuberculosis
acggcuuccgcggac

SEQ ID NO: 873033 - RNA, 22 nt, Mycobacterium avium subsp. paratuberculosis
acggcuggaaucccgccucggc

SEQ ID NO: 873034 - RNA, 16 nt, Mycobacterium avium subsp. paratuberculosis
acggcuggcgcaggug

SEQ ID NO: 873035 - RNA, 21 nt, Mycobacterium avium subsp. paratuberculosis
acggcugcgguuggccggccg

SEQ ID NO: 873036 - RNA, 16 nt, Mycobacterium avium subsp. paratuberculosis
acggcugcucccgaaa

SEQ ID NO: 873037 - RNA, 15 nt, Mycobacterium avium subsp. paratuberculosis
acggcugcugcgcgg

SEQ ID NO: 873038 - RNA, 20 nt, Mycobacterium avium subsp. paratuberculosis
acggcugcugcgcggcacgg

SEQ ID NO: 873039 - RNA, 13 nt, Mycobacterium avium subsp. paratuberculosis
acggcugcccggc

SEQ ID NO: 873040 - RNA, 16 nt, Mycobacterium avium subsp. paratuberculosis
acggcugcccggcccg

SEQ ID NO: 873041 - RNA, 17 nt, Mycobacterium avium subsp. paratuberculosis
acggcugcccggcccgc

SEQ ID NO: 873042 - RNA, 20 nt, Mycobacterium avium subsp. paratuberculosis
acggcugcccggcccgccgc

SEQ ID NO: 873043 - RNA, 14 nt, Mycobacterium avium subsp. paratuberculosis
acggcugccgaccu

SEQ ID NO: 873044 - RNA, 16 nt, Mycobacterium avium subsp. paratuberculosis
acggcugccgaccucg

SEQ ID NO: 873045 - RNA, 22 nt, Mycobacterium avium subsp. paratuberculosis
acggcugccgaccucgauggcg

SEQ ID NO: 873046 - RNA, 18 nt, Mycobacterium avium subsp. paratuberculosis
acggcuugcgcucggccg

SEQ ID NO: 873047 - RNA, 21 nt, Mycobacterium avium subsp. paratuberculosis
acggcuugcgcucggccgggu

SEQ ID NO: 873048 - RNA, 22 nt, Mycobacterium avium subsp. paratuberculosis
acggcuuuggugacgccgacgu

SEQ ID NO: 873049 - RNA, 17 nt, Mycobacterium avium subsp. paratuberculosis
acgggcagggugaccga

SEQ ID NO: 873050 - RNA, 17 nt, Mycobacterium avium subsp. paratuberculosis
acgggcauccggcucag

SEQ ID NO: 873051 - RNA, 15 nt, Mycobacterium avium subsp. paratuberculosis
acgggcaugccgucg

SEQ ID NO: 873052 - RNA, 16 nt, Mycobacterium avium subsp. paratuberculosis
acgggcaugccgucgg

SEQ ID NO: 873053 - RNA, 12 nt, Mycobacterium avium subsp. paratuberculosis
acgggccaggcg

SEQ ID NO: 873054 - RNA, 13 nt, Mycobacterium avium subsp. paratuberculosis
acgggccaggcgc

SEQ ID NO: 873055 - RNA, 14 nt, Mycobacterium avium subsp. paratuberculosis
acgggccaggcgcg

SEQ ID NO: 873056 - RNA, 17 nt, Mycobacterium avium subsp. paratuberculosis
acggcguugcuggcgcg

SEQ ID NO: 873057 - RNA, 18 nt, Mycobacterium avium subsp. paratuberculosis
acggcguugaccaacgcc

SEQ ID NO: 873058 - RNA, 21 nt, Mycobacterium avium subsp. paratuberculosis
acggcguugaccaacgccgcc

SEQ ID NO: 873059 - RNA, 14 nt, Mycobacterium avium subsp. paratuberculosis
acggcguugaccgg

SEQ ID NO: 873060 - RNA, 22 nt, Mycobacterium avium subsp. paratuberculosis
acggcgucuggccggagcggug

SEQ ID NO: 873061 - RNA, 21 nt, Mycobacterium avium subsp. paratuberculosis
acggcguggaacacgcccagc

SEQ ID NO: 873062 - RNA, 14 nt, Mycobacterium avium subsp. paratuberculosis
acggcucaacggcc

SEQ ID NO: 873063 - RNA, 15 nt, Mycobacterium avium subsp. paratuberculosis
acggcucaacggccg

SEQ ID NO: 873064 - RNA, 22 nt, Mycobacterium avium subsp. paratuberculosis
acggcucaacggccggcgccgc

SEQ ID NO: 873065 - RNA, 14 nt, Mycobacterium avium subsp. paratuberculosis
acggcucccaggcc

SEQ ID NO: 873066 - RNA, 21 nt, Mycobacterium avium subsp. paratuberculosis
acggcucccaggcccaucgcg

SEQ ID NO: 873067 - RNA, 19 nt, Mycobacterium avium subsp. paratuberculosis
acggcuccuaugucggugc

SEQ ID NO: 873068 - RNA, 20 nt, Mycobacterium avium subsp. paratuberculosis
acggcucggucaagccggcc

SEQ ID NO: 873069 - RNA, 22 nt, Mycobacterium avium subsp. paratuberculosis
acggcucggucaagccggccag

SEQ ID NO: 873070 - RNA, 16 nt, Mycobacterium avium subsp. paratuberculosis
acggcucuucgcggcg

SEQ ID NO: 873071 - RNA, 18 nt, Mycobacterium avium subsp. paratuberculosis
acggcucuucgcggcggg

SEQ ID NO: 873072 - RNA, 16 nt, Mycobacterium avium subsp. paratuberculosis
acggcucuucggcgcc

SEQ ID NO: 873073 - RNA, 18 nt, Mycobacterium avium subsp. paratuberculosis
acggcucuucggcgccga

SEQ ID NO: 873074 - RNA, 23 nt, Mycobacterium avium subsp. paratuberculosis
acggcgcgguggcgugcagcgcg

SEQ ID NO: 873075 - RNA, 13 nt, Mycobacterium avium subsp. paratuberculosis
acggcgcgucgua

SEQ ID NO: 873076 - RNA, 23 nt, Mycobacterium avium subsp. paratuberculosis
acggcgcgucguagucgcucggc

SEQ ID NO: 873077 - RNA, 15 nt, Mycobacterium avium subsp. paratuberculosis
acggcgcgcccgacg

SEQ ID NO: 873078 - RNA, 14 nt, Mycobacterium avium subsp. paratuberculosis
acggcgcgcaccgc

SEQ ID NO: 873079 - RNA, 16 nt, Mycobacterium avium subsp. paratuberculosis
acggcgcgcaccgcgg

SEQ ID NO: 873080 - RNA, 16 nt, Mycobacterium avium subsp. paratuberculosis
acggcgucguugagca

SEQ ID NO: 873081 - RNA, 15 nt, Mycobacterium avium subsp. paratuberculosis
acggcgucggcggcc

SEQ ID NO: 873082 - RNA, 20 nt, Mycobacterium avium subsp. paratuberculosis
acggcgucggcgucgggcgg

SEQ ID NO: 873083 - RNA, 13 nt, Mycobacterium avium subsp. paratuberculosis
acggcgucgcuga

SEQ ID NO: 873084 - RNA, 22 nt, Mycobacterium avium subsp. paratuberculosis
acggcgucgcugaacgcgucgu

SEQ ID NO: 873085 - RNA, 16 nt, Mycobacterium avium subsp. paratuberculosis
acggcgcuggccgcgg

SEQ ID NO: 873086 - RNA, 20 nt, Mycobacterium avium subsp. paratuberculosis
acggcgcuggccgcggccag

SEQ ID NO: 873087 - RNA, 22 nt, Mycobacterium avium subsp. paratuberculosis
acggcgcuggccgcggccagcu

SEQ ID NO: 873088 - RNA, 14 nt, Mycobacterium avium subsp. paratuberculosis
acggcgcuguggcc

SEQ ID NO: 873089 - RNA, 20 nt, Mycobacterium avium subsp. paratuberculosis
acggcguccagcugcgcgcc

SEQ ID NO: 873090 - RNA, 17 nt, Mycobacterium avium subsp. paratuberculosis
acggcguccgggcgcug

SEQ ID NO: 873091 - RNA, 12 nt, Mycobacterium avium subsp. paratuberculosis
acggcgucgaca

SEQ ID NO: 873092 - RNA, 19 nt, Mycobacterium avium subsp. paratuberculosis
acguagcagcagaccgcga

SEQ ID NO: 873093 - RNA, 16 nt, Mycobacterium avium subsp. paratuberculosis
acguagcccagcgcgu

SEQ ID NO: 873094 - RNA, 18 nt, Mycobacterium avium subsp. paratuberculosis
acguagcccagcgcguug

SEQ ID NO: 873095 - RNA, 20 nt, Mycobacterium avium subsp. paratuberculosis
acguagcaccagucggccau

SEQ ID NO: 873096 - RNA, 16 nt, Mycobacterium avium subsp. paratuberculosis
acguagaagucgauug

SEQ ID NO: 873097 - RNA, 21 nt, Mycobacterium avium subsp. paratuberculosis
acguagacggugucgcccucg

SEQ ID NO: 873098 - RNA, 18 nt, Mycobacterium avium subsp. paratuberculosis
acgucagcccgcgucgcg

SEQ ID NO: 873099 - RNA, 20 nt, Mycobacterium avium subsp. paratuberculosis
acgucagcucccccgacacc

SEQ ID NO: 873100 - RNA, 20 nt, Mycobacterium avium subsp. paratuberculosis
acgucaccaccgggucgucg

SEQ ID NO: 873101 - RNA, 13 nt, Mycobacterium avium subsp. paratuberculosis
acgucaccgacgc

SEQ ID NO: 873102 - RNA, 20 nt, Mycobacterium avium subsp. paratuberculosis
acgucaccgcgcuugccgcg

SEQ ID NO: 873103 - RNA, 12 nt, Mycobacterium avium subsp. paratuberculosis
acgucacggcga

SEQ ID NO: 873104 - RNA, 19 nt, Mycobacterium avium subsp. paratuberculosis
acgucacgggccaggcgcg

SEQ ID NO: 873105 - RNA, 14 nt, Mycobacterium avium subsp. paratuberculosis
acgucacggugacg

SEQ ID NO: 873106 - RNA, 15 nt, Mycobacterium avium subsp. paratuberculosis
acgucauccggcugc

SEQ ID NO: 873107 - RNA, 16 nt, Mycobacterium avium subsp. paratuberculosis
acgucaggcccagcga

SEQ ID NO: 873108 - RNA, 17 nt, Mycobacterium avium subsp. paratuberculosis
acgucaggcccagcgag

SEQ ID NO: 873109 - RNA, 16 nt, Mycobacterium avium subsp. paratuberculosis
acgucaggccggucag

SEQ ID NO: 873110 - RNA, 13 nt, Mycobacterium avium subsp. paratuberculosis
acgucaggccgua

SEQ ID NO: 873111 - RNA, 17 nt, Mycobacterium avium subsp. paratuberculosis
acgucaggccguagcgg

SEQ ID NO: 873112 - RNA, 17 nt, Mycobacterium avium subsp. paratuberculosis
acgucaggguggccucg

SEQ ID NO: 873113 - RNA, 17 nt, Mycobacterium avium subsp. paratuberculosis
acgucaggucgaccggc

SEQ ID NO: 873114 - RNA, 20 nt, Mycobacterium avium subsp. paratuberculosis
acgucaggucgaccggcucg

SEQ ID NO: 873115 - RNA, 21 nt, Mycobacterium avium subsp. paratuberculosis
acgucaggucgaccggcucgc

SEQ ID NO: 873116 - RNA, 15 nt, Mycobacterium avium subsp. paratuberculosis
acguccaccagcacc

SEQ ID NO: 873117 - RNA, 23 nt, Mycobacterium avium subsp. paratuberculosis
acguccaccagcaccaggcgggu

SEQ ID NO: 873118 - RNA, 23 nt, Mycobacterium avium subsp. paratuberculosis
acguccaccggauggcgcccggc

SEQ ID NO: 873119 - RNA, 18 nt, Mycobacterium avium subsp. paratuberculosis
acguccccgggcaccccg

SEQ ID NO: 873120 - RNA, 20 nt, Mycobacterium avium subsp. paratuberculosis
acguccccgggcaccccggu

SEQ ID NO: 873121 - RNA, 17 nt, Mycobacterium avium subsp. paratuberculosis
acgucccgcccggcgcc

SEQ ID NO: 873122 - RNA, 16 nt, Mycobacterium avium subsp. paratuberculosis
acguccgcgucggcgc

SEQ ID NO: 873123 - RNA, 20 nt, Mycobacterium avium subsp. paratuberculosis
acguccgcgucggcgccggc

SEQ ID NO: 873124 - RNA, 23 nt, Mycobacterium avium subsp. paratuberculosis
acguccgcgucggcgccggccaa

SEQ ID NO: 873125 - RNA, 17 nt, Mycobacterium avium subsp. paratuberculosis
acguccggaugcggcgc

SEQ ID NO: 873126 - RNA, 20 nt, Mycobacterium avium subsp. paratuberculosis
acguccggaugcggcgccca

SEQ ID NO: 873127 - RNA, 15 nt, Mycobacterium avium subsp. paratuberculosis
acguccaucauggcg

SEQ ID NO: 873128 - RNA, 13 nt, Mycobacterium avium subsp. paratuberculosis
acguccagcggcc

SEQ ID NO: 873129 - RNA, 13 nt, Mycobacterium avium subsp. paratuberculosis
acguccaggccgg

SEQ ID NO: 873130 - RNA, 16 nt, Mycobacterium avium subsp. paratuberculosis
acguccaggccggcgc

SEQ ID NO: 873131 - RNA, 18 nt, Mycobacterium avium subsp. paratuberculosis
acguccaggccggcgccg

SEQ ID NO: 873132 - RNA, 23 nt, Mycobacterium avium subsp. paratuberculosis
acguccaggccggcgccgcgggu

SEQ ID NO: 873133 - RNA, 15 nt, Mycobacterium avium subsp. paratuberculosis
acguccacgccgcgg

SEQ ID NO: 873134 - RNA, 16 nt, Mycobacterium avium subsp. paratuberculosis
acguccacgccgcggg

SEQ ID NO: 873135 - RNA, 19 nt, Mycobacterium avium subsp. paratuberculosis
acguccacguugaugccgc

SEQ ID NO: 873136 - RNA, 16 nt, Mycobacterium avium subsp. paratuberculosis
acguccagcccgcgcc

SEQ ID NO: 873137 - RNA, 14 nt, Mycobacterium avium subsp. paratuberculosis
acguccagcgccgc

SEQ ID NO: 873138 - RNA, 16 nt, Mycobacterium avium subsp. paratuberculosis
acgguggagcggccca

SEQ ID NO: 873139 - RNA, 13 nt, Mycobacterium avium subsp. paratuberculosis
acgguggccgucu

SEQ ID NO: 873140 - RNA, 20 nt, Mycobacterium avium subsp. paratuberculosis
acgguggccgucucgucggc

SEQ ID NO: 873141 - RNA, 14 nt, Mycobacterium avium subsp. paratuberculosis
acgguggccucggc

SEQ ID NO: 873142 - RNA, 18 nt, Mycobacterium avium subsp. paratuberculosis
acgguggccucggcgcug

SEQ ID NO: 873143 - RNA, 21 nt, Mycobacterium avium subsp. paratuberculosis
acgguuuuggucugcgccggc

SEQ ID NO: 873144 - RNA, 23 nt, Mycobacterium avium subsp. paratuberculosis
acguaccagcugcccaccagcag

SEQ ID NO: 873145 - RNA, 17 nt, Mycobacterium avium subsp. paratuberculosis
acguacccccgcacgcc

SEQ ID NO: 873146 - RNA, 20 nt, Mycobacterium avium subsp. paratuberculosis
acguacccccgcacgccagc

SEQ ID NO: 873147 - RNA, 21 nt, Mycobacterium avium subsp. paratuberculosis
acguacaccgggaucggggug

SEQ ID NO: 873148 - RNA, 15 nt, Mycobacterium avium subsp. paratuberculosis
acguacagcggcggc

SEQ ID NO: 873149 - RNA, 13 nt, Mycobacterium avium subsp. paratuberculosis
acggugccgucac

SEQ ID NO: 873150 - RNA, 15 nt, Mycobacterium avium subsp. paratuberculosis
acggugcgcccgucg

SEQ ID NO: 873151 - RNA, 23 nt, Mycobacterium avium subsp. paratuberculosis
acggugcgcccgucgucgccgau

SEQ ID NO: 873152 - RNA, 12 nt, Mycobacterium avium subsp. paratuberculosis
acggugcgccgg

SEQ ID NO: 873153 - RNA, 15 nt, Mycobacterium avium subsp. paratuberculosis
acggugcgccggcag

SEQ ID NO: 873154 - RNA, 20 nt, Mycobacterium avium subsp. paratuberculosis
acggugcgccggcagcggcc

SEQ ID NO: 873155 - RNA, 21 nt, Mycobacterium avium subsp. paratuberculosis
acgguggccgccaccaacauc

SEQ ID NO: 873156 - RNA, 12 nt, Mycobacterium avium subsp. paratuberculosis
acgguggccgcg

SEQ ID NO: 873157 - RNA, 19 nt, Mycobacterium avium subsp. paratuberculosis
acggugcgcucgugaccgg

SEQ ID NO: 873158 - RNA, 15 nt, Mycobacterium avium subsp. paratuberculosis
acggugcggccucga

SEQ ID NO: 873159 - RNA, 18 nt, Mycobacterium avium subsp. paratuberculosis
acggugcgggugccgaac

SEQ ID NO: 873160 - RNA, 17 nt, Mycobacterium avium subsp. paratuberculosis
acggugcgugccagcag

SEQ ID NO: 873161 - RNA, 19 nt, Mycobacterium avium subsp. paratuberculosis
acggugcugccguugggca

SEQ ID NO: 873162 - RNA, 17 nt, Mycobacterium avium subsp. paratuberculosis
acggugcuggcgaugug

SEQ ID NO: 873163 - RNA, 17 nt, Mycobacterium avium subsp. paratuberculosis
acggugauuccggcacc

SEQ ID NO: 873164 - RNA, 21 nt, Mycobacterium avium subsp. paratuberculosis
acggugauuccggcacccgcc

SEQ ID NO: 873165 - RNA, 23 nt, Mycobacterium avium subsp. paratuberculosis
acggugauuccggcacccgccag

SEQ ID NO: 873166 - RNA, 14 nt, Mycobacterium avium subsp. paratuberculosis
acggugcacacgcc

SEQ ID NO: 873167 - RNA, 21 nt, Mycobacterium avium subsp. paratuberculosis
acggugcacacgccgaggcgg

SEQ ID NO: 873168 - RNA, 16 nt, Mycobacterium avium subsp. paratuberculosis
acggugcagcagcgcc

SEQ ID NO: 873169 - RNA, 18 nt, Mycobacterium avium subsp. paratuberculosis
acggugcagcagcgccgc

SEQ ID NO: 873170 - RNA, 15 nt, Mycobacterium avium subsp. paratuberculosis
acggugaucucgccg

SEQ ID NO: 873171 - RNA, 19 nt, Mycobacterium avium subsp. paratuberculosis
acggugaugucgccggcgg

SEQ ID NO: 873172 - RNA, 21 nt, Mycobacterium avium subsp. paratuberculosis
acggugaugucgccggcggcg

SEQ ID NO: 873173 - RNA, 16 nt, Mycobacterium avium subsp. paratuberculosis
acggugcaugcgcugg

SEQ ID NO: 873174 - RNA, 17 nt, Mycobacterium avium subsp. paratuberculosis
acggugcaugcgcuggc

SEQ ID NO: 873175 - RNA, 17 nt, Mycobacterium avium subsp. paratuberculosis
acggugcccgccgaucg

SEQ ID NO: 873176 - RNA, 17 nt, Mycobacterium avium subsp. paratuberculosis
acggugcccgccgcgac

SEQ ID NO: 873177 - RNA, 14 nt, Mycobacterium avium subsp. paratuberculosis
acggugcagccggg

SEQ ID NO: 873178 - RNA, 16 nt, Mycobacterium avium subsp. paratuberculosis
acggugccgccgugcg

SEQ ID NO: 873179 - RNA, 18 nt, Mycobacterium avium subsp. paratuberculosis
acggugaggacaccacga

SEQ ID NO: 873180 - RNA, 18 nt, Mycobacterium avium subsp. paratuberculosis
acggugagcaacaccggc

SEQ ID NO: 873181 - RNA, 22 nt, Mycobacterium avium subsp. paratuberculosis
acggugagcaacaccggcacga

SEQ ID NO: 873182 - RNA, 15 nt, Mycobacterium avium subsp. paratuberculosis
acggugagcaccgcc

SEQ ID NO: 873183 - RNA, 20 nt, Mycobacterium avium subsp. paratuberculosis
acggugagcaccgccguccc

SEQ ID NO: 873184 - RNA, 19 nt, Mycobacterium avium subsp. paratuberculosis
acggugaccucgucgggcg

SEQ ID NO: 873185 - RNA, 24 nt, Mycobacterium avium subsp. paratuberculosis
acggugaccucgucgggcgccagc

SEQ ID NO: 873186 - RNA, 15 nt, Mycobacterium avium subsp. paratuberculosis
acggugacgccggau

SEQ ID NO: 873187 - RNA, 21 nt, Mycobacterium avium subsp. paratuberculosis
acgggguggaauaggccgcgu

SEQ ID NO: 873188 - RNA, 19 nt, Mycobacterium avium subsp. paratuberculosis
acggugaccggcucgagca

SEQ ID NO: 873189 - RNA, 17 nt, Mycobacterium avium subsp. paratuberculosis
acgggggugccgaccgc

SEQ ID NO: 873190 - RNA, 21 nt, Mycobacterium avium subsp. paratuberculosis
acgggguucaguagcagcguc

SEQ ID NO: 873191 - RNA, 17 nt, Mycobacterium avium subsp. paratuberculosis
acggugaacgucgaucc

SEQ ID NO: 873192 - RNA, 21 nt, Mycobacterium avium subsp. paratuberculosis
acggugaacuucaccgucugc

SEQ ID NO: 873193 - RNA, 16 nt, Mycobacterium avium subsp. paratuberculosis
acgugcgccggcggug

SEQ ID NO: 873194 - RNA, 17 nt, Mycobacterium avium subsp. paratuberculosis
acgugcgccggcggugc

SEQ ID NO: 873195 - RNA, 20 nt, Mycobacterium avium subsp. paratuberculosis
acgugcgcgaagcuggggua

SEQ ID NO: 873196 - RNA, 17 nt, Mycobacterium avium subsp. paratuberculosis
acgugcgcgccgaccgc

SEQ ID NO: 873197 - RNA, 22 nt, Mycobacterium avium subsp. paratuberculosis
acgugcgcgccgaccgcgagca

SEQ ID NO: 873198 - RNA, 12 nt, Mycobacterium avium subsp. paratuberculosis
acgugcgcggcg

SEQ ID NO: 873199 - RNA, 14 nt, Mycobacterium avium subsp. paratuberculosis
acgugcgcggcgcg

SEQ ID NO: 873200 - RNA, 15 nt, Mycobacterium avium subsp. paratuberculosis
acgugcgcggcgcgc

SEQ ID NO: 873201 - RNA, 16 nt, Mycobacterium avium subsp. paratuberculosis
acgugcgcggcgcgcg

SEQ ID NO: 873202 - RNA, 17 nt, Mycobacterium avium subsp. paratuberculosis
acgugcgcggcgcgcga

SEQ ID NO: 873203 - RNA, 23 nt, Mycobacterium avium subsp. paratuberculosis
acgugcgcggcguucuccagcac

SEQ ID NO: 873204 - RNA, 19 nt, Mycobacterium avium subsp. paratuberculosis
acgugcggauggccccggc

SEQ ID NO: 873205 - RNA, 12 nt, Mycobacterium avium subsp. paratuberculosis
acgugccggcga

SEQ ID NO: 873206 - RNA, 13 nt, Mycobacterium avium subsp. paratuberculosis
acgugccggcggc

SEQ ID NO: 873207 - RNA, 20 nt, Mycobacterium avium subsp. paratuberculosis
acgugcccuuccccggcggc

SEQ ID NO: 873208 - RNA, 21 nt, Mycobacterium avium subsp. paratuberculosis
acgugcccuuccccggcggcc

SEQ ID NO: 873209 - RNA, 18 nt, Mycobacterium avium subsp. paratuberculosis
acgugccacuggcgccac

SEQ ID NO: 873210 - RNA, 15 nt, Mycobacterium avium subsp. paratuberculosis
acgugcccagcccgc

SEQ ID NO: 873211 - RNA, 17 nt, Mycobacterium avium subsp. paratuberculosis
acgugcccagcccgcgc

SEQ ID NO: 873212 - RNA, 23 nt, Mycobacterium avium subsp. paratuberculosis
acgugccccucgacccgaagcca

SEQ ID NO: 873213 - RNA, 12 nt, Mycobacterium avium subsp. paratuberculosis
acgucuugcgca

SEQ ID NO: 873214 - RNA, 17 nt, Mycobacterium avium subsp. paratuberculosis
acguguacucggcgucg

SEQ ID NO: 873215 - RNA, 12 nt, Mycobacterium avium subsp. paratuberculosis
acgugucgagca

SEQ ID NO: 873216 - RNA, 17 nt, Mycobacterium avium subsp. paratuberculosis
acgugucgagcacgucg

SEQ ID NO: 873217 - RNA, 21 nt, Mycobacterium avium subsp. paratuberculosis
acgugucgagcacgucgacgc

SEQ ID NO: 873218 - RNA, 22 nt, Mycobacterium avium subsp. paratuberculosis
acgugucgagcacgucgacgcc

SEQ ID NO: 873219 - RNA, 13 nt, Mycobacterium avium subsp. paratuberculosis
acgugucggcguc

SEQ ID NO: 873220 - RNA, 15 nt, Mycobacterium avium subsp. paratuberculosis
acguguggcacccgg

SEQ ID NO: 873221 - RNA, 17 nt, Mycobacterium avium subsp. paratuberculosis
acguguggcacccgggu

SEQ ID NO: 873222 - RNA, 22 nt, Mycobacterium avium subsp. paratuberculosis
acgugugggugagcaucgggcg

SEQ ID NO: 873223 - RNA, 16 nt, Mycobacterium avium subsp. paratuberculosis
acguguguaccauugc

SEQ ID NO: 873224 - RNA, 17 nt, Mycobacterium avium subsp. paratuberculosis
acguguguaccauugcg

SEQ ID NO: 873225 - RNA, 22 nt, Mycobacterium avium subsp. paratuberculosis
acguguguaccauugcgccggu

SEQ ID NO: 873226 - RNA, 16 nt, Mycobacterium avium subsp. paratuberculosis
acguguucaacgcgcc

SEQ ID NO: 873227 - RNA, 19 nt, Mycobacterium avium subsp. paratuberculosis
acguucuccccgccggaga

SEQ ID NO: 873228 - RNA, 20 nt, Mycobacterium avium subsp. paratuberculosis
acgugguugcguucgccggc

SEQ ID NO: 873229 - RNA, 17 nt, Mycobacterium avium subsp. paratuberculosis
acgugguggaugaugcc

SEQ ID NO: 873230 - RNA, 17 nt, Mycobacterium avium subsp. paratuberculosis
acguggucgggcaugcc

SEQ ID NO: 873231 - RNA, 21 nt, Mycobacterium avium subsp. paratuberculosis
acguggucgggcaugccggcc

SEQ ID NO: 873232 - RNA, 22 nt, Mycobacterium avium subsp. paratuberculosis
acguggucgggcaugccggccg

SEQ ID NO: 873233 - RNA, 23 nt, Mycobacterium avium subsp. paratuberculosis
acguggucgggcaugccggccgg

SEQ ID NO: 873234 - RNA, 15 nt, Mycobacterium avium subsp. paratuberculosis
acguggugcaccgcc

SEQ ID NO: 873235 - RNA, 21 nt, Mycobacterium avium subsp. paratuberculosis
acguggugcaccgccagcgcg

SEQ ID NO: 873236 - RNA, 23 nt, Mycobacterium avium subsp. paratuberculosis
acguggugcaccgccagcgcggc

SEQ ID NO: 873237 - RNA, 16 nt, Mycobacterium avium subsp. paratuberculosis
acgugcgacaccggcg

SEQ ID NO: 873238 - RNA, 21 nt, Mycobacterium avium subsp. paratuberculosis
acgugcggcugcgcguucggc

SEQ ID NO: 873239 - RNA, 20 nt, Mycobacterium avium subsp. paratuberculosis
acgugcggguuggcgccggu

SEQ ID NO: 873240 - RNA, 21 nt, Mycobacterium avium subsp. paratuberculosis
acgugggugguggugccgucg

SEQ ID NO: 873241 - RNA, 16 nt, Mycobacterium avium subsp. paratuberculosis
acguccuggacgucgu

SEQ ID NO: 873242 - RNA, 12 nt, Mycobacterium avium subsp. paratuberculosis
acguccuggcgc

SEQ ID NO: 873243 - RNA, 23 nt, Mycobacterium avium subsp. paratuberculosis
acgucgaacccgaaaagcaccag

SEQ ID NO: 873244 - RNA, 14 nt, Mycobacterium avium subsp. paratuberculosis
acgucgaacccgac

SEQ ID NO: 873245 - RNA, 15 nt, Mycobacterium avium subsp. paratuberculosis
acgucgaacccgacc

SEQ ID NO: 873246 - RNA, 16 nt, Mycobacterium avium subsp. paratuberculosis
acgucgaacccgaccc

SEQ ID NO: 873247 - RNA, 24 nt, Mycobacterium avium subsp. paratuberculosis
acgucgaacccgaccccggcgagc

SEQ ID NO: 873248 - RNA, 23 nt, Mycobacterium avium subsp. paratuberculosis
acgucgaacgcguacacggcccg

SEQ ID NO: 873249 - RNA, 16 nt, Mycobacterium avium subsp. paratuberculosis
acguccgggccgccuc

SEQ ID NO: 873250 - RNA, 17 nt, Mycobacterium avium subsp. paratuberculosis
acguccgggccgccucg

SEQ ID NO: 873251 - RNA, 18 nt, Mycobacterium avium subsp. paratuberculosis
acguccucgacgaucagc

SEQ ID NO: 873252 - RNA, 11 nt, Mycobacterium avium subsp. paratuberculosis
acgucgacgac

SEQ ID NO: 873253 - RNA, 14 nt, Mycobacterium avium subsp. paratuberculosis
acgucgacgccggu

SEQ ID NO: 873254 - RNA, 17 nt, Mycobacterium avium subsp. paratuberculosis
acgucgacggcagcgcu

SEQ ID NO: 873255 - RNA, 14 nt, Mycobacterium avium subsp. paratuberculosis
acgucgacggccgc

SEQ ID NO: 873256 - RNA, 19 nt, Mycobacterium avium subsp. paratuberculosis
acguccuugacccggccgc

SEQ ID NO: 873257 - RNA, 15 nt, Mycobacterium avium subsp. paratuberculosis
acguccuuggugacg

SEQ ID NO: 873258 - RNA, 19 nt, Mycobacterium avium subsp. paratuberculosis
acgucgacacgccggccgu

SEQ ID NO: 873259 - RNA, 14 nt, Mycobacterium avium subsp. paratuberculosis
acgucgaccgcgcc

SEQ ID NO: 873260 - RNA, 20 nt, Mycobacterium avium subsp. paratuberculosis
acgucgaccgcgccggggug

SEQ ID NO: 873261 - RNA, 21 nt, Mycobacterium avium subsp. paratuberculosis
acgucgacgcccugccacagc

SEQ ID NO: 873262 - RNA, 17 nt, Mycobacterium avium subsp. paratuberculosis
acgucgagaaaggccag

SEQ ID NO: 873263 - RNA, 18 nt, Mycobacterium avium subsp. paratuberculosis
acgucgagaaaggccagc

SEQ ID NO: 873264 - RNA, 19 nt, Mycobacterium avium subsp. paratuberculosis
acgucgagaaaggccagca

SEQ ID NO: 873265 - RNA, 16 nt, Mycobacterium avium subsp. paratuberculosis
acgucgagcaccgcgu

SEQ ID NO: 873266 - RNA, 15 nt, Mycobacterium avium subsp. paratuberculosis
acgucgagcaguugc

SEQ ID NO: 873267 - RNA, 17 nt, Mycobacterium avium subsp. paratuberculosis
acgucgagccagcgggc

SEQ ID NO: 873268 - RNA, 19 nt, Mycobacterium avium subsp. paratuberculosis
acgucgagccagcgggccg

SEQ ID NO: 873269 - RNA, 23 nt, Mycobacterium avium subsp. paratuberculosis
acgucgagccagcgggccgagcg

SEQ ID NO: 873270 - RNA, 14 nt, Mycobacterium avium subsp. paratuberculosis
acgucgagcgcggc

SEQ ID NO: 873271 - RNA, 15 nt, Mycobacterium avium subsp. paratuberculosis
acgucgagcgcggcc

SEQ ID NO: 873272 - RNA, 14 nt, Mycobacterium avium subsp. paratuberculosis
acgucgagcggccc

SEQ ID NO: 873273 - RNA, 15 nt, Mycobacterium avium subsp. paratuberculosis
acgucgagcggcccg

SEQ ID NO: 873274 - RNA, 15 nt, Mycobacterium avium subsp. paratuberculosis
acgucgagcggcgcc

SEQ ID NO: 873275 - RNA, 18 nt, Mycobacterium avium subsp. paratuberculosis
acgucgagcggcgccugg

SEQ ID NO: 873276 - RNA, 20 nt, Mycobacterium avium subsp. paratuberculosis
acgucgagcuccucggccag

SEQ ID NO: 873277 - RNA, 21 nt, Mycobacterium avium subsp. paratuberculosis
acgucgagcuccucggccagc

SEQ ID NO: 873278 - RNA, 22 nt, Mycobacterium avium subsp. paratuberculosis
acgucgagcuccucggccagcg

SEQ ID NO: 873279 - RNA, 17 nt, Mycobacterium avium subsp. paratuberculosis
acgucgagggcgccguu

SEQ ID NO: 873280 - RNA, 13 nt, Mycobacterium avium subsp. paratuberculosis
acgucgaggguga

SEQ ID NO: 873281 - RNA, 18 nt, Mycobacterium avium subsp. paratuberculosis
acgucgaggucggacgcc

SEQ ID NO: 873282 - RNA, 13 nt, Mycobacterium avium subsp. paratuberculosis
acgucgaucacgc

SEQ ID NO: 873283 - RNA, 16 nt, Mycobacterium avium subsp. paratuberculosis
acgucgaugccgaacc

SEQ ID NO: 873284 - RNA, 14 nt, Mycobacterium avium subsp. paratuberculosis
acgucgaugccggc

SEQ ID NO: 873285 - RNA, 15 nt, Mycobacterium avium subsp. paratuberculosis
acgucgaugccggcc

SEQ ID NO: 873286 - RNA, 14 nt, Mycobacterium avium subsp. paratuberculosis
acgucgcccacccg

SEQ ID NO: 873287 - RNA, 18 nt, Mycobacterium avium subsp. paratuberculosis
acgucgcccacccggggc

SEQ ID NO: 873288 - RNA, 14 nt, Mycobacterium avium subsp. paratuberculosis
acgucggccagcgc

SEQ ID NO: 873289 - RNA, 17 nt, Mycobacterium avium subsp. paratuberculosis
acgucggccagcgcgug

SEQ ID NO: 873290 - RNA, 18 nt, Mycobacterium avium subsp. paratuberculosis
acgucgccaccagaccgg

SEQ ID NO: 873291 - RNA, 14 nt, Mycobacterium avium subsp. paratuberculosis
acgucggccgccag

SEQ ID NO: 873292 - RNA, 16 nt, Mycobacterium avium subsp. paratuberculosis
acgucggccgccaggg

SEQ ID NO: 873293 - RNA, 15 nt, Mycobacterium avium subsp. paratuberculosis
acgucggccggcugc

SEQ ID NO: 873294 - RNA, 19 nt, Mycobacterium avium subsp. paratuberculosis
acgucggccggcugcagcc

SEQ ID NO: 873295 - RNA, 13 nt, Mycobacterium avium subsp. paratuberculosis
acgucggccgggu

SEQ ID NO: 873296 - RNA, 13 nt, Mycobacterium avium subsp. paratuberculosis
acgucggccugca

SEQ ID NO: 873297 - RNA, 20 nt, Mycobacterium avium subsp. paratuberculosis
acgucggccugcacgaaguc

SEQ ID NO: 873298 - RNA, 12 nt, Mycobacterium avium subsp. paratuberculosis
acgucggcgaug

SEQ ID NO: 873299 - RNA, 15 nt, Mycobacterium avium subsp. paratuberculosis
acgucggcgcgcagg

SEQ ID NO: 873300 - RNA, 17 nt, Mycobacterium avium subsp. paratuberculosis
acgucggcgcgcucggu

SEQ ID NO: 873301 - RNA, 14 nt, Mycobacterium avium subsp. paratuberculosis
acgucggcgcgguc

SEQ ID NO: 873302 - RNA, 15 nt, Mycobacterium avium subsp. paratuberculosis
acgucggcggccgcg

SEQ ID NO: 873303 - RNA, 20 nt, Mycobacterium avium subsp. paratuberculosis
acgucggcguacugcgcgac

SEQ ID NO: 873304 - RNA, 18 nt, Mycobacterium avium subsp. paratuberculosis
acgucggcgucaucgacu

SEQ ID NO: 873305 - RNA, 12 nt, Mycobacterium avium subsp. paratuberculosis
acgucugcucgg

SEQ ID NO: 873306 - RNA, 15 nt, Mycobacterium avium subsp. paratuberculosis
acgucugcucggcgg

SEQ ID NO: 873307 - RNA, 15 nt, Mycobacterium avium subsp. paratuberculosis
acgucuggccaccga

SEQ ID NO: 873308 - RNA, 19 nt, Mycobacterium avium subsp. paratuberculosis
acgucuggccaccgaagcc

SEQ ID NO: 873309 - RNA, 17 nt, Mycobacterium avium subsp. paratuberculosis
acgucugguuggccggc

SEQ ID NO: 873310 - RNA, 19 nt, Mycobacterium avium subsp. paratuberculosis
acgucugguuggccggcgg

SEQ ID NO: 873311 - RNA, 21 nt, Mycobacterium avium subsp. paratuberculosis
acgucugguuggccggcgggu

SEQ ID NO: 873312 - RNA, 22 nt, Mycobacterium avium subsp. paratuberculosis
acgucugguuggccggcggguu

SEQ ID NO: 873313 - RNA, 14 nt, Mycobacterium avium subsp. paratuberculosis
acgucucggugucg

SEQ ID NO: 873314 - RNA, 18 nt, Mycobacterium avium subsp. paratuberculosis
acgucucugucgucgacc

SEQ ID NO: 873315 - RNA, 17 nt, Mycobacterium avium subsp. paratuberculosis
acgucgggguggccggc

SEQ ID NO: 873316 - RNA, 19 nt, Mycobacterium avium subsp. paratuberculosis
acgucggguccgaccagca

SEQ ID NO: 873317 - RNA, 23 nt, Mycobacterium avium subsp. paratuberculosis
acgucggguccgaccagcacccg

SEQ ID NO: 873318 - RNA, 17 nt, Mycobacterium avium subsp. paratuberculosis
acgucggguucgccggu

SEQ ID NO: 873319 - RNA, 16 nt, Mycobacterium avium subsp. paratuberculosis
acgucggcuggcgugc

SEQ ID NO: 873320 - RNA, 22 nt, Mycobacterium avium subsp. paratuberculosis
acucaaaccgggccugcgcgcc

SEQ ID NO: 873321 - RNA, 22 nt, Mycobacterium avium subsp. paratuberculosis
acguugccgcacaccgcgcaga

SEQ ID NO: 873322 - RNA, 22 nt, Mycobacterium avium subsp. paratuberculosis
acguugcgggccaggucgagcg

SEQ ID NO: 873323 - RNA, 20 nt, Mycobacterium avium subsp. paratuberculosis
acguugaugccgcccagcag

SEQ ID NO: 873324 - RNA, 18 nt, Mycobacterium avium subsp. paratuberculosis
acguugaucaugucgaug

SEQ ID NO: 873325 - RNA, 12 nt, Mycobacterium avium subsp. paratuberculosis
acguugauccga

SEQ ID NO: 873326 - RNA, 13 nt, Mycobacterium avium subsp. paratuberculosis
acguugaucgcgc

SEQ ID NO: 873327 - RNA, 19 nt, Mycobacterium avium subsp. paratuberculosis
acguugaucgcgccgaucu

SEQ ID NO: 873328 - RNA, 18 nt, Mycobacterium avium subsp. paratuberculosis
acguugaucuugaucgcc

SEQ ID NO: 873329 - RNA, 13 nt, Mycobacterium avium subsp. paratuberculosis
acguugagcaccc

SEQ ID NO: 873330 - RNA, 20 nt, Mycobacterium avium subsp. paratuberculosis
acguugagcccggaccggcc

SEQ ID NO: 873331 - RNA, 22 nt, Mycobacterium avium subsp. paratuberculosis
acguugagcccggaccggccgu

SEQ ID NO: 873332 - RNA, 23 nt, Mycobacterium avium subsp. paratuberculosis
acguugcgcaucagcgccaccag

SEQ ID NO: 873333 - RNA, 14 nt, Mycobacterium avium subsp. paratuberculosis
acguugcgcccggc

SEQ ID NO: 873334 - RNA, 15 nt, Mycobacterium avium subsp. paratuberculosis
acguugcgcggccgc

SEQ ID NO: 873335 - RNA, 16 nt, Mycobacterium avium subsp. paratuberculosis
acguugcgcggccgca

SEQ ID NO: 873336 - RNA, 19 nt, Mycobacterium avium subsp. paratuberculosis
acucaccgguggccgcguc

SEQ ID NO: 873337 - RNA, 13 nt, Mycobacterium avium subsp. paratuberculosis
acucagcgcccag

SEQ ID NO: 873338 - RNA, 14 nt, Mycobacterium avium subsp. paratuberculosis
acucacuaucgaca

SEQ ID NO: 873339 - RNA, 14 nt, Mycobacterium avium subsp. paratuberculosis
acucagagcagcgc

SEQ ID NO: 873340 - RNA, 21 nt, Mycobacterium avium subsp. paratuberculosis
acucagagcagcgccugcugc

SEQ ID NO: 873341 - RNA, 21 nt, Mycobacterium avium subsp. paratuberculosis
acucacggcggcagcgcggcg

SEQ ID NO: 873342 - RNA, 14 nt, Mycobacterium avium subsp. paratuberculosis
acucaggcgcgcac

SEQ ID NO: 873343 - RNA, 15 nt, Mycobacterium avium subsp. paratuberculosis
acuccaauacggccc

SEQ ID NO: 873344 - RNA, 16 nt, Mycobacterium avium subsp. paratuberculosis
acuccaauacggcccg

SEQ ID NO: 873345 - RNA, 20 nt, Mycobacterium avium subsp. paratuberculosis
acuccaauacggcccggcga

SEQ ID NO: 873346 - RNA, 17 nt, Mycobacterium avium subsp. paratuberculosis
acuccaccaccggccgc

SEQ ID NO: 873347 - RNA, 18 nt, Mycobacterium avium subsp. paratuberculosis
acuccaccaccggccgcg

SEQ ID NO: 873348 - RNA, 13 nt, Mycobacterium avium subsp. paratuberculosis
acuccaccgccac

SEQ ID NO: 873349 - RNA, 15 nt, Mycobacterium avium subsp. paratuberculosis
acuccaccgccaccg

SEQ ID NO: 873350 - RNA, 22 nt, Mycobacterium avium subsp. paratuberculosis
acucaugggcccggcccgucag

SEQ ID NO: 873351 - RNA, 13 nt, Mycobacterium avium subsp. paratuberculosis
acuccagcggcgg

SEQ ID NO: 873352 - RNA, 14 nt, Mycobacterium avium subsp. paratuberculosis
acuccagcggcggc

SEQ ID NO: 873353 - RNA, 15 nt, Mycobacterium avium subsp. paratuberculosis
acuccagcggcggcc

SEQ ID NO: 873354 - RNA, 16 nt, Mycobacterium avium subsp. paratuberculosis
acuccagcaccggcgc

SEQ ID NO: 873355 - RNA, 13 nt, Mycobacterium avium subsp. paratuberculosis
acuccaguugacg

SEQ ID NO: 873356 - RNA, 13 nt, Mycobacterium avium subsp. paratuberculosis
acucccagccgcc

SEQ ID NO: 873357 - RNA, 17 nt, Mycobacterium avium subsp. paratuberculosis
acucccaggccgcggcc

SEQ ID NO: 873358 - RNA, 13 nt, Mycobacterium avium subsp. paratuberculosis
acuccagcgcgau

SEQ ID NO: 873359 - RNA, 15 nt, Mycobacterium avium subsp. paratuberculosis
acuccagcgcgauca

SEQ ID NO: 873360 - RNA, 17 nt, Mycobacterium avium subsp. paratuberculosis
acuccauccgccgucga

SEQ ID NO: 873361 - RNA, 16 nt, Mycobacterium avium subsp. paratuberculosis
acucccgcgccgcggc

SEQ ID NO: 873362 - RNA, 18 nt, Mycobacterium avium subsp. paratuberculosis
acuccgaggucagcgcgu

SEQ ID NO: 873363 - RNA, 17 nt, Mycobacterium avium subsp. paratuberculosis
acuccgagccgguggag

SEQ ID NO: 873364 - RNA, 21 nt, Mycobacterium avium subsp. paratuberculosis
acucgccucggaggccaccgc

SEQ ID NO: 873365 - RNA, 23 nt, Mycobacterium avium subsp. paratuberculosis
acucgcgcucccggcgccgccgu

SEQ ID NO: 873366 - RNA, 15 nt, Mycobacterium avium subsp. paratuberculosis
acucgcggcggguca

SEQ ID NO: 873367 - RNA, 19 nt, Mycobacterium avium subsp. paratuberculosis
acucgcgggacggcggcga

SEQ ID NO: 873368 - RNA, 19 nt, Mycobacterium avium subsp. paratuberculosis
acucgcgggcgagcagcgc

SEQ ID NO: 873369 - RNA, 20 nt, Mycobacterium avium subsp. paratuberculosis
acucgcgggcgagcagcgcc

SEQ ID NO: 873370 - RNA, 22 nt, Mycobacterium avium subsp. paratuberculosis
acucgcgggcgagcagcgcccg

SEQ ID NO: 873371 - RNA, 21 nt, Mycobacterium avium subsp. paratuberculosis
acucgcguccccgcgccgggc

SEQ ID NO: 873372 - RNA, 20 nt, Mycobacterium avium subsp. paratuberculosis
acucgccgcgaacgacgacc

SEQ ID NO: 873373 - RNA, 13 nt, Mycobacterium avium subsp. paratuberculosis
acucgccggcggc

SEQ ID NO: 873374 - RNA, 15 nt, Mycobacterium avium subsp. paratuberculosis
acucgccggcggcgc

SEQ ID NO: 873375 - RNA, 21 nt, Mycobacterium avium subsp. paratuberculosis
acucgcugcgauugguggccc

SEQ ID NO: 873376 - RNA, 23 nt, Mycobacterium avium subsp. paratuberculosis
acucggacagguggccgaucagc

SEQ ID NO: 873377 - RNA, 15 nt, Mycobacterium avium subsp. paratuberculosis
acucggacgccggca

SEQ ID NO: 873378 - RNA, 15 nt, Mycobacterium avium subsp. paratuberculosis
acucggccggcaccu

SEQ ID NO: 873379 - RNA, 22 nt, Mycobacterium avium subsp. paratuberculosis
acucggccaggaugaacacccg

SEQ ID NO: 873380 - RNA, 23 nt, Mycobacterium avium subsp. paratuberculosis
acucggcgaagucaucaccgggg

SEQ ID NO: 873381 - RNA, 18 nt, Mycobacterium avium subsp. paratuberculosis
acucggcgaugcgccguc

SEQ ID NO: 873382 - RNA, 13 nt, Mycobacterium avium subsp. paratuberculosis
acucggcgccgcc

SEQ ID NO: 873383 - RNA, 18 nt, Mycobacterium avium subsp. paratuberculosis
acucggcgccgccggucg

SEQ ID NO: 873384 - RNA, 19 nt, Mycobacterium avium subsp. paratuberculosis
acucggcgccgccggucgc

SEQ ID NO: 873385 - RNA, 20 nt, Mycobacterium avium subsp. paratuberculosis
acucgucgaucgacgccgac

SEQ ID NO: 873386 - RNA, 14 nt, Mycobacterium avium subsp. paratuberculosis
acucgugcggcgcc

SEQ ID NO: 873387 - RNA, 17 nt, Mycobacterium avium subsp. paratuberculosis
acucgugcggcgccgcc

SEQ ID NO: 873388 - RNA, 13 nt, Mycobacterium avium subsp. paratuberculosis
acucguccaccga

SEQ ID NO: 873389 - RNA, 16 nt, Mycobacterium avium subsp. paratuberculosis
acucgggcggccgcgg

SEQ ID NO: 873390 - RNA, 21 nt, Mycobacterium avium subsp. paratuberculosis
acucggugaugccggccagcc

SEQ ID NO: 873391 - RNA, 22 nt, Mycobacterium avium subsp. paratuberculosis
acucggugaugccggccagccg

SEQ ID NO: 873392 - RNA, 18 nt, Mycobacterium avium subsp. paratuberculosis
acucgguguagagcaccu

SEQ ID NO: 873393 - RNA, 21 nt, Mycobacterium avium subsp. paratuberculosis
acucgggguugacccggccgg

SEQ ID NO: 873394 - RNA, 22 nt, Mycobacterium avium subsp. paratuberculosis
acucgggguugacccggccggu

SEQ ID NO: 873395 - RNA, 18 nt, Mycobacterium avium subsp. paratuberculosis
acucgggcaacgcgccgg

SEQ ID NO: 873396 - RNA, 20 nt, Mycobacterium avium subsp. paratuberculosis
acucgggcaacgcgccggcg

SEQ ID NO: 873397 - RNA, 21 nt, Mycobacterium avium subsp. paratuberculosis
acucgggugaguaguccagca

SEQ ID NO: 873398 - RNA, 16 nt, Mycobacterium avium subsp. paratuberculosis
acucggucaccucguc

SEQ ID NO: 873399 - RNA, 12 nt, Mycobacterium avium subsp. paratuberculosis
acucggcggcgg

SEQ ID NO: 873400 - RNA, 16 nt, Mycobacterium avium subsp. paratuberculosis
acucggcgucgccgag

SEQ ID NO: 873401 - RNA, 17 nt, Mycobacterium avium subsp. paratuberculosis
acucggcuucgucgggu

SEQ ID NO: 873402 - RNA, 22 nt, Mycobacterium avium subsp. paratuberculosis
acucgaccuucgagccgccgcc

SEQ ID NO: 873403 - RNA, 20 nt, Mycobacterium avium subsp. paratuberculosis
acucgacggagugcguguca

SEQ ID NO: 873404 - RNA, 17 nt, Mycobacterium avium subsp. paratuberculosis
acucgaccgcgacuuuc

SEQ ID NO: 873405 - RNA, 16 nt, Mycobacterium avium subsp. paratuberculosis
acucgagcgugcccgc

SEQ ID NO: 873406 - RNA, 17 nt, Mycobacterium avium subsp. paratuberculosis
acucgaccccgcccagc

SEQ ID NO: 873407 - RNA, 15 nt, Mycobacterium avium subsp. paratuberculosis
acucgacguucggcg

SEQ ID NO: 873408 - RNA, 18 nt, Mycobacterium avium subsp. paratuberculosis
acucgacguucggcgggc

SEQ ID NO: 873409 - RNA, 20 nt, Mycobacterium avium subsp. paratuberculosis
acucgacguucggcgggcag

SEQ ID NO: 873410 - RNA, 14 nt, Mycobacterium avium subsp. paratuberculosis
acucgagcgcgcuc

SEQ ID NO: 873411 - RNA, 17 nt, Mycobacterium avium subsp. paratuberculosis
acucgaugcgcgugacg

SEQ ID NO: 873412 - RNA, 18 nt, Mycobacterium avium subsp. paratuberculosis
acucgaugcgcgugacgc

SEQ ID NO: 873413 - RNA, 15 nt, Mycobacterium avium subsp. paratuberculosis
acucgaucagcaccg

SEQ ID NO: 873414 - RNA, 17 nt, Mycobacterium avium subsp. paratuberculosis
acucgaucagcaccgcc

SEQ ID NO: 873415 - RNA, 23 nt, Mycobacterium avium subsp. paratuberculosis
acucgaucagcaccgccacgccg

SEQ ID NO: 873416 - RNA, 13 nt, Mycobacterium avium subsp. paratuberculosis
acucgaucgccac

SEQ ID NO: 873417 - RNA, 22 nt, Mycobacterium avium subsp. paratuberculosis
acucgcccagggcgugcgcggc

SEQ ID NO: 873418 - RNA, 14 nt, Mycobacterium avium subsp. paratuberculosis
acuccgcgcgcggc

SEQ ID NO: 873419 - RNA, 23 nt, Mycobacterium avium subsp. paratuberculosis
acuccgcucgggcccgcgcaccg

SEQ ID NO: 873420 - RNA, 13 nt, Mycobacterium avium subsp. paratuberculosis
acuccggcgccgg

SEQ ID NO: 873421 - RNA, 12 nt, Mycobacterium avium subsp. paratuberculosis
acuccggcgaca

SEQ ID NO: 873422 - RNA, 22 nt, Mycobacterium avium subsp. paratuberculosis
acuccgguaccacgccgucgac

SEQ ID NO: 873423 - RNA, 13 nt, Mycobacterium avium subsp. paratuberculosis
acuccugcgcgaa

SEQ ID NO: 873424 - RNA, 21 nt, Mycobacterium avium subsp. paratuberculosis
acuccugcgcgaaaggcccac

SEQ ID NO: 873425 - RNA, 13 nt, Mycobacterium avium subsp. paratuberculosis
acuccgucgcgau

SEQ ID NO: 873426 - RNA, 17 nt, Mycobacterium avium subsp. paratuberculosis
acuccgucucgccguac

SEQ ID NO: 873427 - RNA, 14 nt, Mycobacterium avium subsp. paratuberculosis
acuccuccggcccg

SEQ ID NO: 873428 - RNA, 17 nt, Mycobacterium avium subsp. paratuberculosis
acuccucgaucugggcc

SEQ ID NO: 873429 - RNA, 14 nt, Mycobacterium avium subsp. paratuberculosis
acuccucgcgaugg

SEQ ID NO: 873430 - RNA, 22 nt, Mycobacterium avium subsp. paratuberculosis
acuccucggugacgaacggcga

SEQ ID NO: 873431 - RNA, 17 nt, Mycobacterium avium subsp. paratuberculosis
acuugaccgggcuccag

SEQ ID NO: 873432 - RNA, 19 nt, Mycobacterium avium subsp. paratuberculosis
acuugcccagauugcggcc

SEQ ID NO: 873433 - RNA, 15 nt, Mycobacterium avium subsp. paratuberculosis
acuugccgaucaccu

SEQ ID NO: 873434 - RNA, 19 nt, Mycobacterium avium subsp. paratuberculosis
acuugaucagcucgcggau

SEQ ID NO: 873435 - RNA, 16 nt, Mycobacterium avium subsp. paratuberculosis
acuuguucgagaugcg

SEQ ID NO: 873436 - RNA, 16 nt, Mycobacterium avium subsp. paratuberculosis
acuugcguugcgcggc

SEQ ID NO: 873437 - RNA, 20 nt, Mycobacterium avium subsp. paratuberculosis
acuuggccucgggcgacgac

SEQ ID NO: 873438 - RNA, 19 nt, Mycobacterium avium subsp. paratuberculosis
acuugcggccgcgacgcgc

SEQ ID NO: 873439 - RNA, 18 nt, Mycobacterium avium subsp. paratuberculosis
acuucuccacgccgacga

SEQ ID NO: 873440 - RNA, 13 nt, Mycobacterium avium subsp. paratuberculosis
acuucguccaucg

SEQ ID NO: 873441 - RNA, 19 nt, Mycobacterium avium subsp. paratuberculosis
acuucgcgggcggcgcagu

SEQ ID NO: 873442 - RNA, 18 nt, Mycobacterium avium subsp. paratuberculosis
acuucaccgucugcuggc

SEQ ID NO: 873443 - RNA, 13 nt, Mycobacterium avium subsp. paratuberculosis
acuucacgcucgg

SEQ ID NO: 873444 - RNA, 14 nt, Mycobacterium avium subsp. paratuberculosis
acuucacgcucggc

SEQ ID NO: 873445 - RNA, 16 nt, Mycobacterium avium subsp. paratuberculosis
acuucacgcucggcga

SEQ ID NO: 873446 - RNA, 20 nt, Mycobacterium avium subsp. paratuberculosis
acuucgcuguaguagccggg

SEQ ID NO: 873447 - RNA, 17 nt, Mycobacterium avium subsp. paratuberculosis
acuucauguaccggucg

SEQ ID NO: 873448 - RNA, 20 nt, Mycobacterium avium subsp. paratuberculosis
acugucggcgccccgcccgc

SEQ ID NO: 873449 - RNA, 23 nt, Mycobacterium avium subsp. paratuberculosis
acugucggcgccccgcccgcgac

SEQ ID NO: 873450 - RNA, 17 nt, Mycobacterium avium subsp. paratuberculosis
acugucggcgcggacgu

SEQ ID NO: 873451 - RNA, 18 nt, Mycobacterium avium subsp. paratuberculosis
acugucggcucgcccgcg

SEQ ID NO: 873452 - RNA, 22 nt, Mycobacterium avium subsp. paratuberculosis
acugucggcucgccugcgagcg

SEQ ID NO: 873453 - RNA, 18 nt, Mycobacterium avium subsp. paratuberculosis
acuguccaggccgaggcu

SEQ ID NO: 873454 - RNA, 23 nt, Mycobacterium avium subsp. paratuberculosis
acuggacauucacgaggccgggc

SEQ ID NO: 873455 - RNA, 17 nt, Mycobacterium avium subsp. paratuberculosis
acuggagugcugcagac

SEQ ID NO: 873456 - RNA, 22 nt, Mycobacterium avium subsp. paratuberculosis
acugcuugggcgccucgccgac

SEQ ID NO: 873457 - RNA, 14 nt, Mycobacterium avium subsp. paratuberculosis
acugcuugccgucg

SEQ ID NO: 873458 - RNA, 15 nt, Mycobacterium avium subsp. paratuberculosis
acugcuugccgucga

SEQ ID NO: 873459 - RNA, 16 nt, Mycobacterium avium subsp. paratuberculosis
acugcuugccgucgac

SEQ ID NO: 873460 - RNA, 13 nt, Mycobacterium avium subsp. paratuberculosis
acugcugcccgcg

SEQ ID NO: 873461 - RNA, 17 nt, Mycobacterium avium subsp. paratuberculosis
acugcugcccgcgacgg

SEQ ID NO: 873462 - RNA, 13 nt, Mycobacterium avium subsp. paratuberculosis
acugcugcgggug

SEQ ID NO: 873463 - RNA, 21 nt, Mycobacterium avium subsp. paratuberculosis
acuggcggccggccgcgccca

SEQ ID NO: 873464 - RNA, 16 nt, Mycobacterium avium subsp. paratuberculosis
acuggcggcggcgguc

SEQ ID NO: 873465 - RNA, 15 nt, Mycobacterium avium subsp. paratuberculosis
acuggcuggucaccc

SEQ ID NO: 873466 - RNA, 20 nt, Mycobacterium avium subsp. paratuberculosis
acuggggugucagcgcgacc

SEQ ID NO: 873467 - RNA, 15 nt, Mycobacterium avium subsp. paratuberculosis
acuggugggcgucgu

SEQ ID NO: 873468 - RNA, 13 nt, Mycobacterium avium subsp. paratuberculosis
acugggcgucggc

SEQ ID NO: 873469 - RNA, 18 nt, Mycobacterium avium subsp. paratuberculosis
acugggcguggucgccgu

SEQ ID NO: 873470 - RNA, 16 nt, Mycobacterium avium subsp. paratuberculosis
acugggccgccgucgc

SEQ ID NO: 873471 - RNA, 13 nt, Mycobacterium avium subsp. paratuberculosis
acugggccgucgc

SEQ ID NO: 873472 - RNA, 16 nt, Mycobacterium avium subsp. paratuberculosis
acucguuggccggcuc

SEQ ID NO: 873473 - RNA, 17 nt, Mycobacterium avium subsp. paratuberculosis
acucguuggggccacca

SEQ ID NO: 873474 - RNA, 16 nt, Mycobacterium avium subsp. paratuberculosis
acugccugacccggcc

SEQ ID NO: 873475 - RNA, 17 nt, Mycobacterium avium subsp. paratuberculosis
acugccugacccggccg

SEQ ID NO: 873476 - RNA, 20 nt, Mycobacterium avium subsp. paratuberculosis
acugccugacccggccgugc

SEQ ID NO: 873477 - RNA, 20 nt, Mycobacterium avium subsp. paratuberculosis
acucuggcgugacgcucgac

SEQ ID NO: 873478 - RNA, 19 nt, Mycobacterium avium subsp. paratuberculosis
acucuggcgugacgcucgg

SEQ ID NO: 873479 - RNA, 20 nt, Mycobacterium avium subsp. paratuberculosis
acucuggcgugacgcucggc

SEQ ID NO: 873480 - RNA, 23 nt, Mycobacterium avium subsp. paratuberculosis
acucuggcgugacguucggccaa

SEQ ID NO: 873481 - RNA, 15 nt, Mycobacterium avium subsp. paratuberculosis
acugcgaucgccgac

SEQ ID NO: 873482 - RNA, 22 nt, Mycobacterium avium subsp. paratuberculosis
acugcgaugcuucccauuucgg

SEQ ID NO: 873483 - RNA, 16 nt, Mycobacterium avium subsp. paratuberculosis
acugcgcaaccacuga

SEQ ID NO: 873484 - RNA, 14 nt, Mycobacterium avium subsp. paratuberculosis
acugcgcaccgcca

SEQ ID NO: 873485 - RNA, 15 nt, Mycobacterium avium subsp. paratuberculosis
acugcgcaccgccag

SEQ ID NO: 873486 - RNA, 16 nt, Mycobacterium avium subsp. paratuberculosis
acugcgcaccgccagc

SEQ ID NO: 873487 - RNA, 20 nt, Mycobacterium avium subsp. paratuberculosis
acugcgccaauacacuucgg

SEQ ID NO: 873488 - RNA, 21 nt, Mycobacterium avium subsp. paratuberculosis
acugcgccaauacacuucggg

SEQ ID NO: 873489 - RNA, 13 nt, Mycobacterium avium subsp. paratuberculosis
acugcgacccacc

SEQ ID NO: 873490 - RNA, 18 nt, Mycobacterium avium subsp. paratuberculosis
acugcgacccaccgucga

SEQ ID NO: 873491 - RNA, 16 nt, Mycobacterium avium subsp. paratuberculosis
acugcucggcgcggcu

SEQ ID NO: 873492 - RNA, 18 nt, Mycobacterium avium subsp. paratuberculosis
acugcugccguccaacac

SEQ ID NO: 873493 - RNA, 18 nt, Mycobacterium avium subsp. paratuberculosis
acugcugcgcagacccgg

SEQ ID NO: 873494 - RNA, 20 nt, Mycobacterium avium subsp. paratuberculosis
acugcucgaccagcccccgc

SEQ ID NO: 873495 - RNA, 17 nt, Mycobacterium avium subsp. paratuberculosis
acugcucgaccagcgcc

SEQ ID NO: 873496 - RNA, 16 nt, Mycobacterium avium subsp. paratuberculosis
acugcguguggcgcac

SEQ ID NO: 873497 - RNA, 14 nt, Mycobacterium avium subsp. paratuberculosis
acccggaggcggcg

SEQ ID NO: 873498 - RNA, 15 nt, Mycobacterium avium subsp. paratuberculosis
acccggaggcggcgg

SEQ ID NO: 873499 - RNA, 22 nt, Mycobacterium avium subsp. paratuberculosis
acccggauacacgguggugacc

SEQ ID NO: 873500 - RNA, 21 nt, Mycobacterium avium subsp. paratuberculosis
acccggaucuugccgucggcc

SEQ ID NO: 873501 - RNA, 20 nt, Mycobacterium avium subsp. paratuberculosis
acccggauggucugcagcga

SEQ ID NO: 873502 - RNA, 20 nt, Mycobacterium avium subsp. paratuberculosis
acccggcaucccacccgggu

SEQ ID NO: 873503 - RNA, 15 nt, Mycobacterium avium subsp. paratuberculosis
acccgccggguggcc

SEQ ID NO: 873504 - RNA, 20 nt, Mycobacterium avium subsp. paratuberculosis
acccgccgacgccugcgcga

SEQ ID NO: 873505 - RNA, 12 nt, Mycobacterium avium subsp. paratuberculosis
acccgccgagcg

SEQ ID NO: 873506 - RNA, 20 nt, Mycobacterium avium subsp. paratuberculosis
acccgccgcaacagccggcc

SEQ ID NO: 873507 - RNA, 23 nt, Mycobacterium avium subsp. paratuberculosis
acccgccgcaacagccggcccga

SEQ ID NO: 873508 - RNA, 16 nt, Mycobacterium avium subsp. paratuberculosis
acccgccgcaccucgc

SEQ ID NO: 873509 - RNA, 14 nt, Mycobacterium avium subsp. paratuberculosis
acccgccgcagccc

SEQ ID NO: 873510 - RNA, 18 nt, Mycobacterium avium subsp. paratuberculosis
acccgccgcggcaacgcc

SEQ ID NO: 873511 - RNA, 13 nt, Mycobacterium avium subsp. paratuberculosis
acccgccgcggcc

SEQ ID NO: 873512 - RNA, 23 nt, Mycobacterium avium subsp. paratuberculosis
acccggcgauuaggucgguggcc

SEQ ID NO: 873513 - RNA, 19 nt, Mycobacterium avium subsp. paratuberculosis
acccggcgcccggccggug

SEQ ID NO: 873514 - RNA, 20 nt, Mycobacterium avium subsp. paratuberculosis
acccggcgcccggccggugc

SEQ ID NO: 873515 - RNA, 14 nt, Mycobacterium avium subsp. paratuberculosis
acccggcggacggu

SEQ ID NO: 873516 - RNA, 13 nt, Mycobacterium avium subsp. paratuberculosis
acccggcggcacc

SEQ ID NO: 873517 - RNA, 23 nt, Mycobacterium avium subsp. paratuberculosis
acccggcggcaccgcggcucggu

SEQ ID NO: 873518 - RNA, 16 nt, Mycobacterium avium subsp. paratuberculosis
acccggcggccccggu

SEQ ID NO: 873519 - RNA, 13 nt, Mycobacterium avium subsp. paratuberculosis
acccggccggcga

SEQ ID NO: 873520 - RNA, 19 nt, Mycobacterium avium subsp. paratuberculosis
acccggccguugggccagc

SEQ ID NO: 873521 - RNA, 21 nt, Mycobacterium avium subsp. paratuberculosis
acccggccguugggccagcgg

SEQ ID NO: 873522 - RNA, 23 nt, Mycobacterium avium subsp. paratuberculosis
acccggccguugggccagcggcg

SEQ ID NO: 873523 - RNA, 13 nt, Mycobacterium avium subsp. paratuberculosis
acccggccgugga

SEQ ID NO: 873524 - RNA, 20 nt, Mycobacterium avium subsp. paratuberculosis
acccggccguggacccgccc

SEQ ID NO: 873525 - RNA, 21 nt, Mycobacterium avium subsp. paratuberculosis
acccggccgcgauccagcgcu

SEQ ID NO: 873526 - RNA, 13 nt, Mycobacterium avium subsp. paratuberculosis
acccggccgagcg

SEQ ID NO: 873527 - RNA, 15 nt, Mycobacterium avium subsp. paratuberculosis
acccggccgagcgcg

SEQ ID NO: 873528 - RNA, 20 nt, Mycobacterium avium subsp. paratuberculosis
acccggccgagcgcgccgag

SEQ ID NO: 873529 - RNA, 17 nt, Mycobacterium avium subsp. paratuberculosis
acccggccgcacaccac

SEQ ID NO: 873530 - RNA, 19 nt, Mycobacterium avium subsp. paratuberculosis
acccggccgcacaccacca

SEQ ID NO: 873531 - RNA, 12 nt, Mycobacterium avium subsp. paratuberculosis
acccggcccauc

SEQ ID NO: 873532 - RNA, 20 nt, Mycobacterium avium subsp. paratuberculosis
acccggcccaucaccggacc

SEQ ID NO: 873533 - RNA, 23 nt, Mycobacterium avium subsp. paratuberculosis
acccggcccccugaggagacgau

SEQ ID NO: 873534 - RNA, 22 nt, Mycobacterium avium subsp. paratuberculosis
acccggcccggaacgcgucgcc

SEQ ID NO: 873535 - RNA, 19 nt, Mycobacterium avium subsp. paratuberculosis
acccggcccuauggcaucg

SEQ ID NO: 873536 - RNA, 21 nt, Mycobacterium avium subsp. paratuberculosis
acccggcccuauggcaucgcc

SEQ ID NO: 873537 - RNA, 12 nt, Mycobacterium avium subsp. paratuberculosis
acccggccaccg

SEQ ID NO: 873538 - RNA, 16 nt, Mycobacterium avium subsp. paratuberculosis
acccggccaccgccgc

SEQ ID NO: 873539 - RNA, 19 nt, Mycobacterium avium subsp. paratuberculosis
acccggccaccgccgccag

SEQ ID NO: 873540 - RNA, 16 nt, Mycobacterium avium subsp. paratuberculosis
acccggccacgccggg

SEQ ID NO: 873541 - RNA, 17 nt, Mycobacterium avium subsp. paratuberculosis
acccggccacgccgggu

SEQ ID NO: 873542 - RNA, 13 nt, Mycobacterium avium subsp. paratuberculosis
acccggccagcgg

SEQ ID NO: 873543 - RNA, 20 nt, Mycobacterium avium subsp. paratuberculosis
acccggccagcggcagcggc

SEQ ID NO: 873544 - RNA, 17 nt, Mycobacterium avium subsp. paratuberculosis
acccggcccaccaccgc

SEQ ID NO: 873545 - RNA, 20 nt, Mycobacterium avium subsp. paratuberculosis
acccggcccaccggcccggc

SEQ ID NO: 873546 - RNA, 14 nt, Mycobacterium avium subsp. paratuberculosis
acccggcccacgcc

SEQ ID NO: 873547 - RNA, 17 nt, Mycobacterium avium subsp. paratuberculosis
acccggcccacgccguc

SEQ ID NO: 873548 - RNA, 19 nt, Mycobacterium avium subsp. paratuberculosis
acccggcccacgccgucgu

SEQ ID NO: 873549 - RNA, 22 nt, Mycobacterium avium subsp. paratuberculosis
acccggcccacgccgucgucgu

SEQ ID NO: 873550 - RNA, 21 nt, Mycobacterium avium subsp. paratuberculosis
acccggcgugcuccagcaggc

SEQ ID NO: 873551 - RNA, 21 nt, Mycobacterium avium subsp. paratuberculosis
acccggcucuccaucuucggc

SEQ ID NO: 873552 - RNA, 15 nt, Mycobacterium avium subsp. paratuberculosis
acccggcgcgcggag

SEQ ID NO: 873553 - RNA, 20 nt, Mycobacterium avium subsp. paratuberculosis
acccggcgcggccgcccagc

SEQ ID NO: 873554 - RNA, 18 nt, Mycobacterium avium subsp. paratuberculosis
acccggcguaguucgucg

SEQ ID NO: 873555 - RNA, 16 nt, Mycobacterium avium subsp. paratuberculosis
acccggcuucgcugcg

SEQ ID NO: 873556 - RNA, 18 nt, Mycobacterium avium subsp. paratuberculosis
acccggcuucgcugcgcc

SEQ ID NO: 873557 - RNA, 22 nt, Mycobacterium avium subsp. paratuberculosis
acccggcuucgcugcgccggcg

SEQ ID NO: 873558 - RNA, 17 nt, Mycobacterium avium subsp. paratuberculosis
acccgggacccggaacc

SEQ ID NO: 873559 - RNA, 13 nt, Mycobacterium avium subsp. paratuberculosis
acccgggaugccg

SEQ ID NO: 873560 - RNA, 14 nt, Mycobacterium avium subsp. paratuberculosis
acccgggaugccga

SEQ ID NO: 873561 - RNA, 16 nt, Mycobacterium avium subsp. paratuberculosis
acccgggaugccgagg

SEQ ID NO: 873562 - RNA, 13 nt, Mycobacterium avium subsp. paratuberculosis
acccgggccagca

SEQ ID NO: 873563 - RNA, 22 nt, Mycobacterium avium subsp. paratuberculosis
acccgggccgccacggcgccau

SEQ ID NO: 873564 - RNA, 13 nt, Mycobacterium avium subsp. paratuberculosis
acccgggccggac

SEQ ID NO: 873565 - RNA, 14 nt, Mycobacterium avium subsp. paratuberculosis
acccgggcccgguc

SEQ ID NO: 873566 - RNA, 22 nt, Mycobacterium avium subsp. paratuberculosis
acccgggcccggucgucgccgg

SEQ ID NO: 873567 - RNA, 14 nt, Mycobacterium avium subsp. paratuberculosis
acccgggccugcgg

SEQ ID NO: 873568 - RNA, 19 nt, Mycobacterium avium subsp. paratuberculosis
acccgggccugcggcggcc

SEQ ID NO: 873569 - RNA, 20 nt, Mycobacterium avium subsp. paratuberculosis
acccgggccuugacggccug

SEQ ID NO: 873570 - RNA, 23 nt, Mycobacterium avium subsp. paratuberculosis
acccgggccuugacggccugggc

SEQ ID NO: 873571 - RNA, 13 nt, Mycobacterium avium subsp. paratuberculosis
acccggucgaugu

SEQ ID NO: 873572 - RNA, 23 nt, Mycobacterium avium subsp. paratuberculosis
acccggucgacgauggcccgggc

SEQ ID NO: 873573 - RNA, 14 nt, Mycobacterium avium subsp. paratuberculosis
acccggucgcggcc

SEQ ID NO: 873574 - RNA, 16 nt, Mycobacterium avium subsp. paratuberculosis
acccggucgcggccgu

SEQ ID NO: 873575 - RNA, 15 nt, Mycobacterium avium subsp. paratuberculosis
acccgguccggcccg

SEQ ID NO: 873576 - RNA, 13 nt, Mycobacterium avium subsp. paratuberculosis
acccgggucgagc

SEQ ID NO: 873577 - RNA, 14 nt, Mycobacterium avium subsp. paratuberculosis
acccggguggacac

SEQ ID NO: 873578 - RNA, 17 nt, Mycobacterium avium subsp. paratuberculosis
acccggguggcccgcac

SEQ ID NO: 873579 - RNA, 18 nt, Mycobacterium avium subsp. paratuberculosis
acccggguugcgugcagc

SEQ ID NO: 873580 - RNA, 15 nt, Mycobacterium avium subsp. paratuberculosis
acccgggcgauggug

SEQ ID NO: 873581 - RNA, 18 nt, Mycobacterium avium subsp. paratuberculosis
acccgggcgauggugccg

SEQ ID NO: 873582 - RNA, 21 nt, Mycobacterium avium subsp. paratuberculosis
acccgggcgauggugccgccg

SEQ ID NO: 873583 - RNA, 14 nt, Mycobacterium avium subsp. paratuberculosis
acccgggcgccauc

SEQ ID NO: 873584 - RNA, 11 nt, Mycobacterium avium subsp. paratuberculosis
acccgggcgcg

SEQ ID NO: 873585 - RNA, 14 nt, Mycobacterium avium subsp. paratuberculosis
acccgggcgcgacg

SEQ ID NO: 873586 - RNA, 16 nt, Mycobacterium avium subsp. paratuberculosis
acccgggcgcgacggu

SEQ ID NO: 873587 - RNA, 13 nt, Mycobacterium avium subsp. paratuberculosis
acccgggcgcgcc

SEQ ID NO: 873588 - RNA, 22 nt, Mycobacterium avium subsp. paratuberculosis
acccgggcgcgcccacccgcgc

SEQ ID NO: 873589 - RNA, 23 nt, Mycobacterium avium subsp. paratuberculosis
acccgggcgcgcccacccgcgcc

SEQ ID NO: 873590 - RNA, 14 nt, Mycobacterium avium subsp. paratuberculosis
acccgggcggccug

SEQ ID NO: 873591 - RNA, 22 nt, Mycobacterium avium subsp. paratuberculosis
acccggggguccagggugccga

SEQ ID NO: 873592 - RNA, 14 nt, Mycobacterium avium subsp. paratuberculosis
acccugcguccggc

SEQ ID NO: 873593 - RNA, 17 nt, Mycobacterium avium subsp. paratuberculosis
acccugcguccggcccg

SEQ ID NO: 873594 - RNA, 16 nt, Mycobacterium avium subsp. paratuberculosis
acccugcgcaccgcgg

SEQ ID NO: 873595 - RNA, 21 nt, Mycobacterium avium subsp. paratuberculosis
acccugccgucaccggccauc

SEQ ID NO: 873596 - RNA, 24 nt, Mycobacterium avium subsp. paratuberculosis
acccugccgucaccggccauccgc

SEQ ID NO: 873597 - RNA, 18 nt, Mycobacterium avium subsp. paratuberculosis
acccugccccacggcccg

SEQ ID NO: 873598 - RNA, 19 nt, Mycobacterium avium subsp. paratuberculosis
acccugccgaccugcgcga

SEQ ID NO: 873599 - RNA, 13 nt, Mycobacterium avium subsp. paratuberculosis
accgaaagccgac

SEQ ID NO: 873600 - RNA, 20 nt, Mycobacterium avium subsp. paratuberculosis
accgaaagccguagcgcaac

SEQ ID NO: 873601 - RNA, 15 nt, Mycobacterium avium subsp. paratuberculosis
acccuucggccggca

SEQ ID NO: 873602 - RNA, 16 nt, Mycobacterium avium subsp. paratuberculosis
acccuucgaacgcgac

SEQ ID NO: 873603 - RNA, 12 nt, Mycobacterium avium subsp. paratuberculosis
accgacgcgccg

SEQ ID NO: 873604 - RNA, 15 nt, Mycobacterium avium subsp. paratuberculosis
accgacggcgaccag

SEQ ID NO: 873605 - RNA, 13 nt, Mycobacterium avium subsp. paratuberculosis
accgacggccgca

SEQ ID NO: 873606 - RNA, 18 nt, Mycobacterium avium subsp. paratuberculosis
accgacggcaccucucgg

SEQ ID NO: 873607 - RNA, 13 nt, Mycobacterium avium subsp. paratuberculosis
accgacgcggcga

SEQ ID NO: 873608 - RNA, 19 nt, Mycobacterium avium subsp. paratuberculosis
accgacgcggucaccggcu

SEQ ID NO: 873609 - RNA, 15 nt, Mycobacterium avium subsp. paratuberculosis
accgacugcggcgcu

SEQ ID NO: 873610 - RNA, 18 nt, Mycobacterium avium subsp. paratuberculosis
accgacuccuccggcccg

SEQ ID NO: 873611 - RNA, 17 nt, Mycobacterium avium subsp. paratuberculosis
acccguaggagcugacg

SEQ ID NO: 873612 - RNA, 15 nt, Mycobacterium avium subsp. paratuberculosis
acccggugccggccg

SEQ ID NO: 873613 - RNA, 17 nt, Mycobacterium avium subsp. paratuberculosis
acccggugccggccggg

SEQ ID NO: 873614 - RNA, 21 nt, Mycobacterium avium subsp. paratuberculosis
acccggugccggccgggucga

SEQ ID NO: 873615 - RNA, 15 nt, Mycobacterium avium subsp. paratuberculosis
acccggugcgccggu

SEQ ID NO: 873616 - RNA, 16 nt, Mycobacterium avium subsp. paratuberculosis
acccgguucugggcgg

SEQ ID NO: 873617 - RNA, 19 nt, Mycobacterium avium subsp. paratuberculosis
acccgguucugggcgggcu

SEQ ID NO: 873618 - RNA, 19 nt, Mycobacterium avium subsp. paratuberculosis
acccgguugaaggccgcgc

SEQ ID NO: 873619 - RNA, 14 nt, Mycobacterium avium subsp. paratuberculosis
acccgguugauccg

SEQ ID NO: 873620 - RNA, 17 nt, Mycobacterium avium subsp. paratuberculosis
acccggugcccgagauc

SEQ ID NO: 873621 - RNA, 18 nt, Mycobacterium avium subsp. paratuberculosis
acccggucugaucgccca

SEQ ID NO: 873622 - RNA, 21 nt, Mycobacterium avium subsp. paratuberculosis
acccggucugaucgcccagca

SEQ ID NO: 873623 - RNA, 14 nt, Mycobacterium avium subsp. paratuberculosis
acccggucggccgc

SEQ ID NO: 873624 - RNA, 15 nt, Mycobacterium avium subsp. paratuberculosis
acccggucggccgcg

SEQ ID NO: 873625 - RNA, 18 nt, Mycobacterium avium subsp. paratuberculosis
acccgugggccgaccggc

SEQ ID NO: 873626 - RNA, 20 nt, Mycobacterium avium subsp. paratuberculosis
acccgugggccgaccggccg

SEQ ID NO: 873627 - RNA, 21 nt, Mycobacterium avium subsp. paratuberculosis
acccgugggccgaccggccgg

SEQ ID NO: 873628 - RNA, 15 nt, Mycobacterium avium subsp. paratuberculosis
acccgucgacucggc

SEQ ID NO: 873629 - RNA, 22 nt, Mycobacterium avium subsp. paratuberculosis
acccgucgcgggucagcgucgc

SEQ ID NO: 873630 - RNA, 14 nt, Mycobacterium avium subsp. paratuberculosis
acccguccagcgcg

SEQ ID NO: 873631 - RNA, 15 nt, Mycobacterium avium subsp. paratuberculosis
acccguccagcgcga

SEQ ID NO: 873632 - RNA, 16 nt, Mycobacterium avium subsp. paratuberculosis
acccguccagcgcgag

SEQ ID NO: 873633 - RNA, 20 nt, Mycobacterium avium subsp. paratuberculosis
acccguugcgccccacgguc

SEQ ID NO: 873634 - RNA, 16 nt, Mycobacterium avium subsp. paratuberculosis
acccguuccccggccg

SEQ ID NO: 873635 - RNA, 20 nt, Mycobacterium avium subsp. paratuberculosis
acccguuccccggccgacgu

SEQ ID NO: 873636 - RNA, 15 nt, Mycobacterium avium subsp. paratuberculosis
acccguuccggcgag

SEQ ID NO: 873637 - RNA, 17 nt, Mycobacterium avium subsp. paratuberculosis
acccguucggcgucgaa

SEQ ID NO: 873638 - RNA, 22 nt, Mycobacterium avium subsp. paratuberculosis
acccucagaccauggcgcggcg

SEQ ID NO: 873639 - RNA, 23 nt, Mycobacterium avium subsp. paratuberculosis
acccucagaccauggcgcggcgg

SEQ ID NO: 873640 - RNA, 14 nt, Mycobacterium avium subsp. paratuberculosis
acccucagcagggc

SEQ ID NO: 873641 - RNA, 16 nt, Mycobacterium avium subsp. paratuberculosis
acccuccucgcggcgg

SEQ ID NO: 873642 - RNA, 15 nt, Mycobacterium avium subsp. paratuberculosis
acccucgacgccggg

SEQ ID NO: 873643 - RNA, 14 nt, Mycobacterium avium subsp. paratuberculosis
acccucgccgccgc

SEQ ID NO: 873644 - RNA, 22 nt, Mycobacterium avium subsp. paratuberculosis
acccucguucgaauuguggcgg

SEQ ID NO: 873645 - RNA, 21 nt, Mycobacterium avium subsp. paratuberculosis
acccucgggguagccggcccg

SEQ ID NO: 873646 - RNA, 17 nt, Mycobacterium avium subsp. paratuberculosis
acccucggcccgccacc

SEQ ID NO: 873647 - RNA, 21 nt, Mycobacterium avium subsp. paratuberculosis
acccgaaaagguauucgcgca

SEQ ID NO: 873648 - RNA, 16 nt, Mycobacterium avium subsp. paratuberculosis
acccgaacccagcgcc

SEQ ID NO: 873649 - RNA, 17 nt, Mycobacterium avium subsp. paratuberculosis
acccgaacccagcgccu

SEQ ID NO: 873650 - RNA, 18 nt, Mycobacterium avium subsp. paratuberculosis
acccgaacccagcgccuc

SEQ ID NO: 873651 - RNA, 22 nt, Mycobacterium avium subsp. paratuberculosis
acccgaacggaccgggcgggcu

SEQ ID NO: 873652 - RNA, 19 nt, Mycobacterium avium subsp. paratuberculosis
accccugcacuaccccguc

SEQ ID NO: 873653 - RNA, 21 nt, Mycobacterium avium subsp. paratuberculosis
accccuggcggguacagccgc

SEQ ID NO: 873654 - RNA, 17 nt, Mycobacterium avium subsp. paratuberculosis
acccgaacuucagcgcg

SEQ ID NO: 873655 - RNA, 20 nt, Mycobacterium avium subsp. paratuberculosis
acccgaauuccgcuggggcc

SEQ ID NO: 873656 - RNA, 22 nt, Mycobacterium avium subsp. paratuberculosis
acccgaauuccgcuggggccca

SEQ ID NO: 873657 - RNA, 16 nt, Mycobacterium avium subsp. paratuberculosis
acccgaaggugguggc

SEQ ID NO: 873658 - RNA, 18 nt, Mycobacterium avium subsp. paratuberculosis
acccgaaggugguggcgu

SEQ ID NO: 873659 - RNA, 14 nt, Mycobacterium avium subsp. paratuberculosis
acccgaagucgacg

SEQ ID NO: 873660 - RNA, 15 nt, Mycobacterium avium subsp. paratuberculosis
acccgaagucgacgc

SEQ ID NO: 873661 - RNA, 13 nt, Mycobacterium avium subsp. paratuberculosis
acccgacacgccg

SEQ ID NO: 873662 - RNA, 14 nt, Mycobacterium avium subsp. paratuberculosis
acccgacacgccga

SEQ ID NO: 873663 - RNA, 17 nt, Mycobacterium avium subsp. paratuberculosis
acccgacacgccgaucg

SEQ ID NO: 873664 - RNA, 18 nt, Mycobacterium avium subsp. paratuberculosis
acccgacaguccgaccgc

SEQ ID NO: 873665 - RNA, 14 nt, Mycobacterium avium subsp. paratuberculosis
acccgaccagcacc

SEQ ID NO: 873666 - RNA, 15 nt, Mycobacterium avium subsp. paratuberculosis
acccgaccagcaccg

SEQ ID NO: 873667 - RNA, 18 nt, Mycobacterium avium subsp. paratuberculosis
acccgaccccggcgagcg

SEQ ID NO: 873668 - RNA, 12 nt, Mycobacterium avium subsp. paratuberculosis
acccgaccgcga

SEQ ID NO: 873669 - RNA, 14 nt, Mycobacterium avium subsp. paratuberculosis
acccgaccgcgaug

SEQ ID NO: 873670 - RNA, 16 nt, Mycobacterium avium subsp. paratuberculosis
acccgaccucgucgac

SEQ ID NO: 873671 - RNA, 17 nt, Mycobacterium avium subsp. paratuberculosis
acccgaccucgucgacg

SEQ ID NO: 873672 - RNA, 21 nt, Mycobacterium avium subsp. paratuberculosis
acccgaccucgucgacggcgg

SEQ ID NO: 873673 - RNA, 19 nt, Mycobacterium avium subsp. paratuberculosis
acccgaccuuuugcccggc

SEQ ID NO: 873674 - RNA, 21 nt, Mycobacterium avium subsp. paratuberculosis
acccgaccuuuugcccggcga

SEQ ID NO: 873675 - RNA, 15 nt, Mycobacterium avium subsp. paratuberculosis
acccgagagcugcug

SEQ ID NO: 873676 - RNA, 21 nt, Mycobacterium avium subsp. paratuberculosis
acccgacgggaacucggccag

SEQ ID NO: 873677 - RNA, 22 nt, Mycobacterium avium subsp. paratuberculosis
acccgacgggaacucggccagc

SEQ ID NO: 873678 - RNA, 19 nt, Mycobacterium avium subsp. paratuberculosis
acccgacggucgggcccag

SEQ ID NO: 873679 - RNA, 14 nt, Mycobacterium avium subsp. paratuberculosis
acccgacgucgacg

SEQ ID NO: 873680 - RNA, 22 nt, Mycobacterium avium subsp. paratuberculosis
acccgacgucgacgcgggcgac

SEQ ID NO: 873681 - RNA, 17 nt, Mycobacterium avium subsp. paratuberculosis
acccgacuucggcucgg

SEQ ID NO: 873682 - RNA, 19 nt, Mycobacterium avium subsp. paratuberculosis
acccgagcaccccggcggc

SEQ ID NO: 873683 - RNA, 20 nt, Mycobacterium avium subsp. paratuberculosis
acccgagcaccccggcggcc

SEQ ID NO: 873684 - RNA, 17 nt, Mycobacterium avium subsp. paratuberculosis
acccgagcaccgggccg

SEQ ID NO: 873685 - RNA, 16 nt, Mycobacterium avium subsp. paratuberculosis
acccgcacgcugucgg

SEQ ID NO: 873686 - RNA, 20 nt, Mycobacterium avium subsp. paratuberculosis
acccgcaccguguagccgac

SEQ ID NO: 873687 - RNA, 22 nt, Mycobacterium avium subsp. paratuberculosis
acccgcacgaaaugcgggcgau

SEQ ID NO: 873688 - RNA, 13 nt, Mycobacterium avium subsp. paratuberculosis
acccgaggccguu

SEQ ID NO: 873689 - RNA, 16 nt, Mycobacterium avium subsp. paratuberculosis
acccgcaccaccgccc

SEQ ID NO: 873690 - RNA, 14 nt, Mycobacterium avium subsp. paratuberculosis
acccgcagccgcga

SEQ ID NO: 873691 - RNA, 19 nt, Mycobacterium avium subsp. paratuberculosis
acccgcagccgcgagucga

SEQ ID NO: 873692 - RNA, 22 nt, Mycobacterium avium subsp. paratuberculosis
acccgcagccgcgagucgaggu

SEQ ID NO: 873693 - RNA, 18 nt, Mycobacterium avium subsp. paratuberculosis
acccgcacggucgcggug

SEQ ID NO: 873694 - RNA, 16 nt, Mycobacterium avium subsp. paratuberculosis
acccgcacgugcgcgc

SEQ ID NO: 873695 - RNA, 20 nt, Mycobacterium avium subsp. paratuberculosis
acccgcacgugcgcgccgac

SEQ ID NO: 873696 - RNA, 18 nt, Mycobacterium avium subsp. paratuberculosis
acccgcacgaugccgcgc

SEQ ID NO: 873697 - RNA, 15 nt, Mycobacterium avium subsp. paratuberculosis
acccgcacgcccggg

SEQ ID NO: 873698 - RNA, 15 nt, Mycobacterium avium subsp. paratuberculosis
acccgcagggcgccg

SEQ ID NO: 873699 - RNA, 17 nt, Mycobacterium avium subsp. paratuberculosis
acccgcagggcgccggu

SEQ ID NO: 873700 - RNA, 18 nt, Mycobacterium avium subsp. paratuberculosis
acccgcagggcgccggug

SEQ ID NO: 873701 - RNA, 23 nt, Mycobacterium avium subsp. paratuberculosis
acccgcaggccaugaucgaaagg

SEQ ID NO: 873702 - RNA, 15 nt, Mycobacterium avium subsp. paratuberculosis
acccgcagcgaccgc

SEQ ID NO: 873703 - RNA, 14 nt, Mycobacterium avium subsp. paratuberculosis
acccgcagcgcggc

SEQ ID NO: 873704 - RNA, 16 nt, Mycobacterium avium subsp. paratuberculosis
acccgcagcgcggcgg

SEQ ID NO: 873705 - RNA, 13 nt, Mycobacterium avium subsp. paratuberculosis
acccgcagcucca

SEQ ID NO: 873706 - RNA, 19 nt, Mycobacterium avium subsp. paratuberculosis
acccgcagcucgccgagcg

SEQ ID NO: 873707 - RNA, 22 nt, Mycobacterium avium subsp. paratuberculosis
acccgcagcucgccgguggcgg

SEQ ID NO: 873708 - RNA, 23 nt, Mycobacterium avium subsp. paratuberculosis
accccgcccacgaagaugaucag

SEQ ID NO: 873709 - RNA, 14 nt, Mycobacterium avium subsp. paratuberculosis
accccgcccagcgc

SEQ ID NO: 873710 - RNA, 15 nt, Mycobacterium avium subsp. paratuberculosis
accccgcccagcgca

SEQ ID NO: 873711 - RNA, 15 nt, Mycobacterium avium subsp. paratuberculosis
accccgaucagguca

SEQ ID NO: 873712 - RNA, 14 nt, Mycobacterium avium subsp. paratuberculosis
accccgaucggggc

SEQ ID NO: 873713 - RNA, 15 nt, Mycobacterium avium subsp. paratuberculosis
accccgaucggggcc

SEQ ID NO: 873714 - RNA, 16 nt, Mycobacterium avium subsp. paratuberculosis
accccgaugcgcucac

SEQ ID NO: 873715 - RNA, 16 nt, Mycobacterium avium subsp. paratuberculosis
accccgaugcgcucgc

SEQ ID NO: 873716 - RNA, 17 nt, Mycobacterium avium subsp. paratuberculosis
accccgaugcggugccg

SEQ ID NO: 873717 - RNA, 23 nt, Mycobacterium avium subsp. paratuberculosis
accccgaugcggugccgggccag

SEQ ID NO: 873718 - RNA, 20 nt, Mycobacterium avium subsp. paratuberculosis
accccgcagaacaccagcgc

SEQ ID NO: 873719 - RNA, 14 nt, Mycobacterium avium subsp. paratuberculosis
accccaucggccag

SEQ ID NO: 873720 - RNA, 19 nt, Mycobacterium avium subsp. paratuberculosis
acccccaauugccgggcca

SEQ ID NO: 873721 - RNA, 20 nt, Mycobacterium avium subsp. paratuberculosis
acccccaauugccgggccag

SEQ ID NO: 873722 - RNA, 14 nt, Mycobacterium avium subsp. paratuberculosis
acccccaccgcgac

SEQ ID NO: 873723 - RNA, 16 nt, Mycobacterium avium subsp. paratuberculosis
accccagcgugacguc

SEQ ID NO: 873724 - RNA, 18 nt, Mycobacterium avium subsp. paratuberculosis
accccagcgugacgucga

SEQ ID NO: 873725 - RNA, 15 nt, Mycobacterium avium subsp. paratuberculosis
accccagcuccgggu

SEQ ID NO: 873726 - RNA, 17 nt, Mycobacterium avium subsp. paratuberculosis
accccagcgcgaccagu

SEQ ID NO: 873727 - RNA, 24 nt, Mycobacterium avium subsp. paratuberculosis
accccaggcgaugccgccgacgau

SEQ ID NO: 873728 - RNA, 20 nt, Mycobacterium avium subsp. paratuberculosis
accccggucaccgguccggu

SEQ ID NO: 873729 - RNA, 14 nt, Mycobacterium avium subsp. paratuberculosis
accccgggcggcuc

SEQ ID NO: 873730 - RNA, 15 nt, Mycobacterium avium subsp. paratuberculosis
accccgguccaggcg

SEQ ID NO: 873731 - RNA, 21 nt, Mycobacterium avium subsp. paratuberculosis
accccgguccaggcgaccggc

SEQ ID NO: 873732 - RNA, 23 nt, Mycobacterium avium subsp. paratuberculosis
accccgguccaggcgaccggccc

SEQ ID NO: 873733 - RNA, 14 nt, Mycobacterium avium subsp. paratuberculosis
accccgcgccgggc

SEQ ID NO: 873734 - RNA, 15 nt, Mycobacterium avium subsp. paratuberculosis
accccgcgccgggcg

SEQ ID NO: 873735 - RNA, 13 nt, Mycobacterium avium subsp. paratuberculosis
accccgccggccc

SEQ ID NO: 873736 - RNA, 14 nt, Mycobacterium avium subsp. paratuberculosis
accccgccggcccg

SEQ ID NO: 873737 - RNA, 13 nt, Mycobacterium avium subsp. paratuberculosis
accccgccgucga

SEQ ID NO: 873738 - RNA, 14 nt, Mycobacterium avium subsp. paratuberculosis
accccgccgucgac

SEQ ID NO: 873739 - RNA, 16 nt, Mycobacterium avium subsp. paratuberculosis
accccgccgucgacgc

SEQ ID NO: 873740 - RNA, 14 nt, Mycobacterium avium subsp. paratuberculosis
accccuacgggcgc

SEQ ID NO: 873741 - RNA, 21 nt, Mycobacterium avium subsp. paratuberculosis
accccuacgggcgcaccgcgc

SEQ ID NO: 873742 - RNA, 13 nt, Mycobacterium avium subsp. paratuberculosis
accccguucgccg

SEQ ID NO: 873743 - RNA, 16 nt, Mycobacterium avium subsp. paratuberculosis
accccguucgccgaca

SEQ ID NO: 873744 - RNA, 23 nt, Mycobacterium avium subsp. paratuberculosis
accccguucgccgacagcagcuc

SEQ ID NO: 873745 - RNA, 17 nt, Mycobacterium avium subsp. paratuberculosis
accccucggcggccguc

SEQ ID NO: 873746 - RNA, 19 nt, Mycobacterium avium subsp. paratuberculosis
accccucggcggccgucgg

SEQ ID NO: 873747 - RNA, 15 nt, Mycobacterium avium subsp. paratuberculosis
accccguaccagcgc

SEQ ID NO: 873748 - RNA, 21 nt, Mycobacterium avium subsp. paratuberculosis
accccgucgagcagccgcaac

SEQ ID NO: 873749 - RNA, 18 nt, Mycobacterium avium subsp. paratuberculosis
accccgucgagguucaug

SEQ ID NO: 873750 - RNA, 14 nt, Mycobacterium avium subsp. paratuberculosis
accccgucgcggac

SEQ ID NO: 873751 - RNA, 23 nt, Mycobacterium avium subsp. paratuberculosis
accccgucgcggacccuggccag

SEQ ID NO: 873752 - RNA, 21 nt, Mycobacterium avium subsp. paratuberculosis
accccgugguagacgccggac

SEQ ID NO: 873753 - RNA, 15 nt, Mycobacterium avium subsp. paratuberculosis
accccggugccgcag

SEQ ID NO: 873754 - RNA, 16 nt, Mycobacterium avium subsp. paratuberculosis
accccggugccgcagu

SEQ ID NO: 873755 - RNA, 19 nt, Mycobacterium avium subsp. paratuberculosis
accccggugccgcagugcc

SEQ ID NO: 873756 - RNA, 14 nt, Mycobacterium avium subsp. paratuberculosis
accaggcccagcgg

SEQ ID NO: 873757 - RNA, 17 nt, Mycobacterium avium subsp. paratuberculosis
accaggcccucgccgcg

SEQ ID NO: 873758 - RNA, 23 nt, Mycobacterium avium subsp. paratuberculosis
accaggcccucgccgcggucauc

SEQ ID NO: 873759 - RNA, 16 nt, Mycobacterium avium subsp. paratuberculosis
accaggccgaagacga

SEQ ID NO: 873760 - RNA, 18 nt, Mycobacterium avium subsp. paratuberculosis
accaggcauuagcgcgug

SEQ ID NO: 873761 - RNA, 23 nt, Mycobacterium avium subsp. paratuberculosis
accaggaugucuccgcgcagcca

SEQ ID NO: 873762 - RNA, 17 nt, Mycobacterium avium subsp. paratuberculosis
accaggacgcgaccggc

SEQ ID NO: 873763 - RNA, 17 nt, Mycobacterium avium subsp. paratuberculosis
accaggagcaccugcgc

SEQ ID NO: 873764 - RNA, 18 nt, Mycobacterium avium subsp. paratuberculosis
accaggagcaccugcgcg

SEQ ID NO: 873765 - RNA, 20 nt, Mycobacterium avium subsp. paratuberculosis
accaggaaggucccggucag

SEQ ID NO: 873766 - RNA, 21 nt, Mycobacterium avium subsp. paratuberculosis
accaggaaguacaccaccgcg

SEQ ID NO: 873767 - RNA, 16 nt, Mycobacterium avium subsp. paratuberculosis
accaggaacacggcuc

SEQ ID NO: 873768 - RNA, 22 nt, Mycobacterium avium subsp. paratuberculosis
accaggaacacggcucgggggc

SEQ ID NO: 873769 - RNA, 23 nt, Mycobacterium avium subsp. paratuberculosis
accaggaacacggcucgggggcc

SEQ ID NO: 873770 - RNA, 20 nt, Mycobacterium avium subsp. paratuberculosis
accagcugcgaaucgucggc

SEQ ID NO: 873771 - RNA, 23 nt, Mycobacterium avium subsp. paratuberculosis
accagcugcggaaaugcccgcgc

SEQ ID NO: 873772 - RNA, 22 nt, Mycobacterium avium subsp. paratuberculosis
accagcuggauggcgcccagcc

SEQ ID NO: 873773 - RNA, 14 nt, Mycobacterium avium subsp. paratuberculosis
accagcugauucgc

SEQ ID NO: 873774 - RNA, 21 nt, Mycobacterium avium subsp. paratuberculosis
accagcugauucgcgguggcg

SEQ ID NO: 873775 - RNA, 22 nt, Mycobacterium avium subsp. paratuberculosis
accagcugauucgcgguggcga

SEQ ID NO: 873776 - RNA, 17 nt, Mycobacterium avium subsp. paratuberculosis
accagcugcccaccagc

SEQ ID NO: 873777 - RNA, 22 nt, Mycobacterium avium subsp. paratuberculosis
acccacacguugagcccggacc

SEQ ID NO: 873778 - RNA, 20 nt, Mycobacterium avium subsp. paratuberculosis
acccaacucaugggcccggc

SEQ ID NO: 873779 - RNA, 14 nt, Mycobacterium avium subsp. paratuberculosis
acccaccggcccag

SEQ ID NO: 873780 - RNA, 15 nt, Mycobacterium avium subsp. paratuberculosis
acccaccggcccagc

SEQ ID NO: 873781 - RNA, 19 nt, Mycobacterium avium subsp. paratuberculosis
acccaccggcccagccggc

SEQ ID NO: 873782 - RNA, 21 nt, Mycobacterium avium subsp. paratuberculosis
acccaccggcccagccggcgg

SEQ ID NO: 873783 - RNA, 15 nt, Mycobacterium avium subsp. paratuberculosis
acccaccggcgcagc

SEQ ID NO: 873784 - RNA, 16 nt, Mycobacterium avium subsp. paratuberculosis
acccacagcugccggc

SEQ ID NO: 873785 - RNA, 16 nt, Mycobacterium avium subsp. paratuberculosis
acccaggucggcguga

SEQ ID NO: 873786 - RNA, 22 nt, Mycobacterium avium subsp. paratuberculosis
acccaggucuucucguccgcgc

SEQ ID NO: 873787 - RNA, 18 nt, Mycobacterium avium subsp. paratuberculosis
acccaggaaaaccagcga

SEQ ID NO: 873788 - RNA, 20 nt, Mycobacterium avium subsp. paratuberculosis
acccaggaaaaccagcgacg

SEQ ID NO: 873789 - RNA, 14 nt, Mycobacterium avium subsp. paratuberculosis
acccaggccacccg

SEQ ID NO: 873790 - RNA, 19 nt, Mycobacterium avium subsp. paratuberculosis
acccaggccacccgggcgc

SEQ ID NO: 873791 - RNA, 14 nt, Mycobacterium avium subsp. paratuberculosis
acccaggccgccgc

SEQ ID NO: 873792 - RNA, 17 nt, Mycobacterium avium subsp. paratuberculosis
accccacagcgcgcccc

SEQ ID NO: 873793 - RNA, 14 nt, Mycobacterium avium subsp. paratuberculosis
accccacccgcgcg

SEQ ID NO: 873794 - RNA, 16 nt, Mycobacterium avium subsp. paratuberculosis
accccacccgcgcgac

SEQ ID NO: 873795 - RNA, 13 nt, Mycobacterium avium subsp. paratuberculosis
accccaccgagca

SEQ ID NO: 873796 - RNA, 16 nt, Mycobacterium avium subsp. paratuberculosis
accccaccgagcagcu

SEQ ID NO: 873797 - RNA, 14 nt, Mycobacterium avium subsp. paratuberculosis
accccacggccgca

SEQ ID NO: 873798 - RNA, 22 nt, Mycobacterium avium subsp. paratuberculosis
accccacggccgcaacggcggu

SEQ ID NO: 873799 - RNA, 15 nt, Mycobacterium avium subsp. paratuberculosis
acccacuggcggccg

SEQ ID NO: 873800 - RNA, 16 nt, Mycobacterium avium subsp. paratuberculosis
acccacuggcggccgg

SEQ ID NO: 873801 - RNA, 17 nt, Mycobacterium avium subsp. paratuberculosis
acccacuggcggccggc

SEQ ID NO: 873802 - RNA, 19 nt, Mycobacterium avium subsp. paratuberculosis
acccacuggcggccggccg

SEQ ID NO: 873803 - RNA, 20 nt, Mycobacterium avium subsp. paratuberculosis
acccacuggcggccggccgc

SEQ ID NO: 873804 - RNA, 21 nt, Mycobacterium avium subsp. paratuberculosis
acccacuggcggccggccgcg

SEQ ID NO: 873805 - RNA, 22 nt, Mycobacterium avium subsp. paratuberculosis
acccacuggcggccggccgcgc

SEQ ID NO: 873806 - RNA, 23 nt, Mycobacterium avium subsp. paratuberculosis
acccacuggcggccggccgcgcc

SEQ ID NO: 873807 - RNA, 17 nt, Mycobacterium avium subsp. paratuberculosis
acccacgccagccgggu

SEQ ID NO: 873808 - RNA, 19 nt, Mycobacterium avium subsp. paratuberculosis
acccacgccagccgggugg

SEQ ID NO: 873809 - RNA, 12 nt, Mycobacterium avium subsp. paratuberculosis
acccacggccac

SEQ ID NO: 873810 - RNA, 14 nt, Mycobacterium avium subsp. paratuberculosis
acccacucccagcc

SEQ ID NO: 873811 - RNA, 16 nt, Mycobacterium avium subsp. paratuberculosis
acccacucccagccgc

SEQ ID NO: 873812 - RNA, 17 nt, Mycobacterium avium subsp. paratuberculosis
acccacucccagccgcc

SEQ ID NO: 873813 - RNA, 23 nt, Mycobacterium avium subsp. paratuberculosis
acccacucccagccgccggccac

SEQ ID NO: 873814 - RNA, 18 nt, Mycobacterium avium subsp. paratuberculosis
acccagcagcggccggcg

SEQ ID NO: 873815 - RNA, 20 nt, Mycobacterium avium subsp. paratuberculosis
acccagcagcggccggcgca

SEQ ID NO: 873816 - RNA, 22 nt, Mycobacterium avium subsp. paratuberculosis
acccagcagcggccggcgcagc

SEQ ID NO: 873817 - RNA, 13 nt, Mycobacterium avium subsp. paratuberculosis
acccagcaucgcc

SEQ ID NO: 873818 - RNA, 18 nt, Mycobacterium avium subsp. paratuberculosis
acccagcaucgccgcggu

SEQ ID NO: 873819 - RNA, 19 nt, Mycobacterium avium subsp. paratuberculosis
acccagcaucgccgcggug

SEQ ID NO: 873820 - RNA, 22 nt, Mycobacterium avium subsp. paratuberculosis
acccagcaccaccacgcuggcc

SEQ ID NO: 873821 - RNA, 12 nt, Mycobacterium avium subsp. paratuberculosis
acccagcagcgg

SEQ ID NO: 873822 - RNA, 17 nt, Mycobacterium avium subsp. paratuberculosis
acccagaucgcccgggc

SEQ ID NO: 873823 - RNA, 20 nt, Mycobacterium avium subsp. paratuberculosis
acccagcacagcgaggcgac

SEQ ID NO: 873824 - RNA, 22 nt, Mycobacterium avium subsp. paratuberculosis
acccagcaccaacagcggcccg

SEQ ID NO: 873825 - RNA, 18 nt, Mycobacterium avium subsp. paratuberculosis
accgcuccccgagcacgu

SEQ ID NO: 873826 - RNA, 23 nt, Mycobacterium avium subsp. paratuberculosis
accgcuccccgagcacgucgagc

SEQ ID NO: 873827 - RNA, 20 nt, Mycobacterium avium subsp. paratuberculosis
accgcucggcgaucuggcgg

SEQ ID NO: 873828 - RNA, 19 nt, Mycobacterium avium subsp. paratuberculosis
accgcucggcggcgccguc

SEQ ID NO: 873829 - RNA, 12 nt, Mycobacterium avium subsp. paratuberculosis
accgcucggcga

SEQ ID NO: 873830 - RNA, 18 nt, Mycobacterium avium subsp. paratuberculosis
accgcucgaacacccggc

SEQ ID NO: 873831 - RNA, 19 nt, Mycobacterium avium subsp. paratuberculosis
accgcucgaacacccggcu

SEQ ID NO: 873832 - RNA, 17 nt, Mycobacterium avium subsp. paratuberculosis
accgcucgauggcgccg

SEQ ID NO: 873833 - RNA, 20 nt, Mycobacterium avium subsp. paratuberculosis
accgcucgauggcgccgauc

SEQ ID NO: 873834 - RNA, 22 nt, Mycobacterium avium subsp. paratuberculosis
accgcguccacgaccccggcgg

SEQ ID NO: 873835 - RNA, 23 nt, Mycobacterium avium subsp. paratuberculosis
accgcguccacgaccccggcggc

SEQ ID NO: 873836 - RNA, 13 nt, Mycobacterium avium subsp. paratuberculosis
accgcgucgacgg

SEQ ID NO: 873837 - RNA, 16 nt, Mycobacterium avium subsp. paratuberculosis
accgcgucgacggcgu

SEQ ID NO: 873838 - RNA, 17 nt, Mycobacterium avium subsp. paratuberculosis
accgcguagcgccgccc

SEQ ID NO: 873839 - RNA, 19 nt, Mycobacterium avium subsp. paratuberculosis
accgcguagcgccgcccgu

SEQ ID NO: 873840 - RNA, 16 nt, Mycobacterium avium subsp. paratuberculosis
accgcguccgaggcgg

SEQ ID NO: 873841 - RNA, 13 nt, Mycobacterium avium subsp. paratuberculosis
accgcguccgcgu

SEQ ID NO: 873842 - RNA, 14 nt, Mycobacterium avium subsp. paratuberculosis
accgcguccgcguc

SEQ ID NO: 873843 - RNA, 17 nt, Mycobacterium avium subsp. paratuberculosis
accgcguccgcgucguc

SEQ ID NO: 873844 - RNA, 18 nt, Mycobacterium avium subsp. paratuberculosis
accgcguccgcgucgucg

SEQ ID NO: 873845 - RNA, 21 nt, Mycobacterium avium subsp. paratuberculosis
accgcguccuucuccgccggg

SEQ ID NO: 873846 - RNA, 22 nt, Mycobacterium avium subsp. paratuberculosis
accgcguccuucuccgccgggc

SEQ ID NO: 873847 - RNA, 13 nt, Mycobacterium avium subsp. paratuberculosis
accgcgucgacca

SEQ ID NO: 873848 - RNA, 14 nt, Mycobacterium avium subsp. paratuberculosis
accgcgucgaccac

SEQ ID NO: 873849 - RNA, 17 nt, Mycobacterium avium subsp. paratuberculosis
accgcgucgaccaccgc

SEQ ID NO: 873850 - RNA, 18 nt, Mycobacterium avium subsp. paratuberculosis
accgcgucgaccaccgcc

SEQ ID NO: 873851 - RNA, 20 nt, Mycobacterium avium subsp. paratuberculosis
accgcgucgaccaccgccgg

SEQ ID NO: 873852 - RNA, 21 nt, Mycobacterium avium subsp. paratuberculosis
accgcgguguugagcgcguug

SEQ ID NO: 873853 - RNA, 20 nt, Mycobacterium avium subsp. paratuberculosis
accgcguacagggcgucgga

SEQ ID NO: 873854 - RNA, 16 nt, Mycobacterium avium subsp. paratuberculosis
accgcgggcacggcga

SEQ ID NO: 873855 - RNA, 19 nt, Mycobacterium avium subsp. paratuberculosis
accgcggcgaauccgagca

SEQ ID NO: 873856 - RNA, 18 nt, Mycobacterium avium subsp. paratuberculosis
accgcgggaauggccgcg

SEQ ID NO: 873857 - RNA, 20 nt, Mycobacterium avium subsp. paratuberculosis
accgcgggaauggccgcgcc

SEQ ID NO: 873858 - RNA, 22 nt, Mycobacterium avium subsp. paratuberculosis
accgcgggaauggccgcgccgu

SEQ ID NO: 873859 - RNA, 19 nt, Mycobacterium avium subsp. paratuberculosis
accgcgggcaucgccguca

SEQ ID NO: 873860 - RNA, 12 nt, Mycobacterium avium subsp. paratuberculosis
accgcgggccag

SEQ ID NO: 873861 - RNA, 18 nt, Mycobacterium avium subsp. paratuberculosis
accgcgggccaggcccac

SEQ ID NO: 873862 - RNA, 13 nt, Mycobacterium avium subsp. paratuberculosis
accgcgggcccgc

SEQ ID NO: 873863 - RNA, 12 nt, Mycobacterium avium subsp. paratuberculosis
accgcgggcgca

SEQ ID NO: 873864 - RNA, 20 nt, Mycobacterium avium subsp. paratuberculosis
accgcgguggcggugcgguc

SEQ ID NO: 873865 - RNA, 22 nt, Mycobacterium avium subsp. paratuberculosis
accgcgguggcggugcggucgc

SEQ ID NO: 873866 - RNA, 19 nt, Mycobacterium avium subsp. paratuberculosis
accgcggugggccagucga

SEQ ID NO: 873867 - RNA, 15 nt, Mycobacterium avium subsp. paratuberculosis
accgcggcggucgcc

SEQ ID NO: 873868 - RNA, 17 nt, Mycobacterium avium subsp. paratuberculosis
accgcggcggucgccac

SEQ ID NO: 873869 - RNA, 19 nt, Mycobacterium avium subsp. paratuberculosis
accgcggcggugucggcgc

SEQ ID NO: 873870 - RNA, 15 nt, Mycobacterium avium subsp. paratuberculosis
accgcggcgugcgcc

SEQ ID NO: 873871 - RNA, 16 nt, Mycobacterium avium subsp. paratuberculosis
accgcggcuccggccg

SEQ ID NO: 873872 - RNA, 17 nt, Mycobacterium avium subsp. paratuberculosis
accgcggcuccggccgc

SEQ ID NO: 873873 - RNA, 19 nt, Mycobacterium avium subsp. paratuberculosis
accgcggcuccggccgcgc

SEQ ID NO: 873874 - RNA, 18 nt, Mycobacterium avium subsp. paratuberculosis
accgcggcucggucgcga

SEQ ID NO: 873875 - RNA, 14 nt, Mycobacterium avium subsp. paratuberculosis
accgcggcgccguc

SEQ ID NO: 873876 - RNA, 16 nt, Mycobacterium avium subsp. paratuberculosis
accgcggcgccgucga

SEQ ID NO: 873877 - RNA, 15 nt, Mycobacterium avium subsp. paratuberculosis
accgcggcgcgcauc

SEQ ID NO: 873878 - RNA, 20 nt, Mycobacterium avium subsp. paratuberculosis
accgcggcgcgcaucgccgu

SEQ ID NO: 873879 - RNA, 12 nt, Mycobacterium avium subsp. paratuberculosis
accgcggcggcg

SEQ ID NO: 873880 - RNA, 17 nt, Mycobacterium avium subsp. paratuberculosis
accgcggcggcggcccg

SEQ ID NO: 873881 - RNA, 19 nt, Mycobacterium avium subsp. paratuberculosis
accgcggcggcggcccguc

SEQ ID NO: 873882 - RNA, 22 nt, Mycobacterium avium subsp. paratuberculosis
accgcggcggcggcccguccgc

SEQ ID NO: 873883 - RNA, 13 nt, Mycobacterium avium subsp. paratuberculosis
accgcggcggcgu

SEQ ID NO: 873884 - RNA, 14 nt, Mycobacterium avium subsp. paratuberculosis
accgcggcggcguc

SEQ ID NO: 873885 - RNA, 15 nt, Mycobacterium avium subsp. paratuberculosis
accgcggcggcgucg

SEQ ID NO: 873886 - RNA, 17 nt, Mycobacterium avium subsp. paratuberculosis
accgcggcggcgucggc

SEQ ID NO: 873887 - RNA, 12 nt, Mycobacterium avium subsp. paratuberculosis
accgcggcgaug

SEQ ID NO: 873888 - RNA, 13 nt, Mycobacterium avium subsp. paratuberculosis
accgcggcgauga

SEQ ID NO: 873889 - RNA, 19 nt, Mycobacterium avium subsp. paratuberculosis
accgcggcgaugaucacga

SEQ ID NO: 873890 - RNA, 14 nt, Mycobacterium avium subsp. paratuberculosis
accgcggcgacguc

SEQ ID NO: 873891 - RNA, 16 nt, Mycobacterium avium subsp. paratuberculosis
accgcggcgacgucgu

SEQ ID NO: 873892 - RNA, 14 nt, Mycobacterium avium subsp. paratuberculosis
accgcggccgucgc

SEQ ID NO: 873893 - RNA, 12 nt, Mycobacterium avium subsp. paratuberculosis
accgcggccucg

SEQ ID NO: 873894 - RNA, 19 nt, Mycobacterium avium subsp. paratuberculosis
accgcggccucggcgucga

SEQ ID NO: 873895 - RNA, 22 nt, Mycobacterium avium subsp. paratuberculosis
accgcggccucggcgucgaagc

SEQ ID NO: 873896 - RNA, 13 nt, Mycobacterium avium subsp. paratuberculosis
accgcggccucgu

SEQ ID NO: 873897 - RNA, 15 nt, Mycobacterium avium subsp. paratuberculosis
accgcggccugggug

SEQ ID NO: 873898 - RNA, 17 nt, Mycobacterium avium subsp. paratuberculosis
accgcgaaagcgucggc

SEQ ID NO: 873899 - RNA, 14 nt, Mycobacterium avium subsp. paratuberculosis
accgcgaacagcac

SEQ ID NO: 873900 - RNA, 16 nt, Mycobacterium avium subsp. paratuberculosis
accgcgaacagcacgu

SEQ ID NO: 873901 - RNA, 14 nt, Mycobacterium avium subsp. paratuberculosis
accgcgaacaucgc

SEQ ID NO: 873902 - RNA, 17 nt, Mycobacterium avium subsp. paratuberculosis
accgcgaacaucgccag

SEQ ID NO: 873903 - RNA, 18 nt, Mycobacterium avium subsp. paratuberculosis
accgcgaacaucgccagc

SEQ ID NO: 873904 - RNA, 19 nt, Mycobacterium avium subsp. paratuberculosis
accgcgaacaucgccagca

SEQ ID NO: 873905 - RNA, 16 nt, Mycobacterium avium subsp. paratuberculosis
accgcgaaaacagcga

SEQ ID NO: 873906 - RNA, 18 nt, Mycobacterium avium subsp. paratuberculosis
accgcgaacucgucgaug

SEQ ID NO: 873907 - RNA, 19 nt, Mycobacterium avium subsp. paratuberculosis
accgcgaacucgucgaugc

SEQ ID NO: 873908 - RNA, 19 nt, Mycobacterium avium subsp. paratuberculosis
accgcgaagguggcacgcc

SEQ ID NO: 873909 - RNA, 16 nt, Mycobacterium avium subsp. paratuberculosis
accgcgacacgucgac

SEQ ID NO: 873910 - RNA, 18 nt, Mycobacterium avium subsp. paratuberculosis
accgcgacacgucgacac

SEQ ID NO: 873911 - RNA, 20 nt, Mycobacterium avium subsp. paratuberculosis
accgcgacacgucgacacgc

SEQ ID NO: 873912 - RNA, 19 nt, Mycobacterium avium subsp. paratuberculosis
accgcgccgcgggugacga

SEQ ID NO: 873913 - RNA, 19 nt, Mycobacterium avium subsp. paratuberculosis
accgcgacgaucgcgacgg

SEQ ID NO: 873914 - RNA, 20 nt, Mycobacterium avium subsp. paratuberculosis
accgcgacgaucgcgacggc

SEQ ID NO: 873915 - RNA, 13 nt, Mycobacterium avium subsp. paratuberculosis
accgcgacgccca

SEQ ID NO: 873916 - RNA, 15 nt, Mycobacterium avium subsp. paratuberculosis
accgcgacgcgaucg

SEQ ID NO: 873917 - RNA, 13 nt, Mycobacterium avium subsp. paratuberculosis
accgcgacccggc

SEQ ID NO: 873918 - RNA, 18 nt, Mycobacterium avium subsp. paratuberculosis
accgcgaccaugcccggc

SEQ ID NO: 873919 - RNA, 19 nt, Mycobacterium avium subsp. paratuberculosis
accgcgacccaggccgccg

SEQ ID NO: 873920 - RNA, 20 nt, Mycobacterium avium subsp. paratuberculosis
accgcgacccaggccgccgc

SEQ ID NO: 873921 - RNA, 15 nt, Mycobacterium avium subsp. paratuberculosis
accgcgacccggccg

SEQ ID NO: 873922 - RNA, 17 nt, Mycobacterium avium subsp. paratuberculosis
accgcgacccggccgag

SEQ ID NO: 873923 - RNA, 14 nt, Mycobacterium avium subsp. paratuberculosis
accgcgaccgccuc

SEQ ID NO: 873924 - RNA, 17 nt, Mycobacterium avium subsp. paratuberculosis
accgcgaccgccucguc

SEQ ID NO: 873925 - RNA, 16 nt, Mycobacterium avium subsp. paratuberculosis
accgcgaccacgccgc

SEQ ID NO: 873926 - RNA, 18 nt, Mycobacterium avium subsp. paratuberculosis
accgcgaccacgccgcgg

SEQ ID NO: 873927 - RNA, 18 nt, Mycobacterium avium subsp. paratuberculosis
accgcgaccagcucgggc

SEQ ID NO: 873928 - RNA, 16 nt, Mycobacterium avium subsp. paratuberculosis
accgcggacuggccac

SEQ ID NO: 873929 - RNA, 14 nt, Mycobacterium avium subsp. paratuberculosis
accgcggaccaccg

SEQ ID NO: 873930 - RNA, 19 nt, Mycobacterium avium subsp. paratuberculosis
accgcggaccaccgcgugc

SEQ ID NO: 873931 - RNA, 15 nt, Mycobacterium avium subsp. paratuberculosis
accgcggagcgcaac

SEQ ID NO: 873932 - RNA, 21 nt, Mycobacterium avium subsp. paratuberculosis
accgcggaggaauucgccgac

SEQ ID NO: 873933 - RNA, 13 nt, Mycobacterium avium subsp. paratuberculosis
accgcggaugacg

SEQ ID NO: 873934 - RNA, 19 nt, Mycobacterium avium subsp. paratuberculosis
accgcggccaacccgggcg

SEQ ID NO: 873935 - RNA, 20 nt, Mycobacterium avium subsp. paratuberculosis
accgcggccaacccgggcgc

SEQ ID NO: 873936 - RNA, 23 nt, Mycobacterium avium subsp. paratuberculosis
accgcggccaacccgggcgccau

SEQ ID NO: 873937 - RNA, 14 nt, Mycobacterium avium subsp. paratuberculosis
accgcggccaccac

SEQ ID NO: 873938 - RNA, 17 nt, Mycobacterium avium subsp. paratuberculosis
accgcggccaccaccgc

SEQ ID NO: 873939 - RNA, 18 nt, Mycobacterium avium subsp. paratuberculosis
accgcggccaccaccgcc

SEQ ID NO: 873940 - RNA, 20 nt, Mycobacterium avium subsp. paratuberculosis
accgcggccaccaccgccac

SEQ ID NO: 873941 - RNA, 19 nt, Mycobacterium avium subsp. paratuberculosis
accgcggccaccugggcgg

SEQ ID NO: 873942 - RNA, 22 nt, Mycobacterium avium subsp. paratuberculosis
accgcggccaccugggcggggc

SEQ ID NO: 873943 - RNA, 14 nt, Mycobacterium avium subsp. paratuberculosis
accgcggccagcgc

SEQ ID NO: 873944 - RNA, 16 nt, Mycobacterium avium subsp. paratuberculosis
accgcggccagcgcgc

SEQ ID NO: 873945 - RNA, 20 nt, Mycobacterium avium subsp. paratuberculosis
accgcggccagcgcgcgggc

SEQ ID NO: 873946 - RNA, 13 nt, Mycobacterium avium subsp. paratuberculosis
accgcggccgcga

SEQ ID NO: 873947 - RNA, 15 nt, Mycobacterium avium subsp. paratuberculosis
accgcggccgcgacg

SEQ ID NO: 873948 - RNA, 14 nt, Mycobacterium avium subsp. paratuberculosis
accgcgcgcaggcc

SEQ ID NO: 873949 - RNA, 22 nt, Mycobacterium avium subsp. paratuberculosis
accgcgcgcaggccccggcgcg

SEQ ID NO: 873950 - RNA, 13 nt, Mycobacterium avium subsp. paratuberculosis
accgcgcgccggc

SEQ ID NO: 873951 - RNA, 16 nt, Mycobacterium avium subsp. paratuberculosis
accgcgcgccggccag

SEQ ID NO: 873952 - RNA, 12 nt, Mycobacterium avium subsp. paratuberculosis
accgcgccgucg

SEQ ID NO: 873953 - RNA, 15 nt, Mycobacterium avium subsp. paratuberculosis
accgcgccgucgucg

SEQ ID NO: 873954 - RNA, 12 nt, Mycobacterium avium subsp. paratuberculosis
accgcgccgucu

SEQ ID NO: 873955 - RNA, 21 nt, Mycobacterium avium subsp. paratuberculosis
accgcgccgucuuccgggcca

SEQ ID NO: 873956 - RNA, 12 nt, Mycobacterium avium subsp. paratuberculosis
accgcgccguga

SEQ ID NO: 873957 - RNA, 21 nt, Mycobacterium avium subsp. paratuberculosis
accgcgccgugggcgucacgc

SEQ ID NO: 873958 - RNA, 13 nt, Mycobacterium avium subsp. paratuberculosis
accgcgccuucga

SEQ ID NO: 873959 - RNA, 21 nt, Mycobacterium avium subsp. paratuberculosis
accgcgcgcaacgaggcggug

SEQ ID NO: 873960 - RNA, 14 nt, Mycobacterium avium subsp. paratuberculosis
accgcgcgcaccac

SEQ ID NO: 873961 - RNA, 12 nt, Mycobacterium avium subsp. paratuberculosis
accgcgccgggc

SEQ ID NO: 873962 - RNA, 13 nt, Mycobacterium avium subsp. paratuberculosis
accgcgccgggca

SEQ ID NO: 873963 - RNA, 17 nt, Mycobacterium avium subsp. paratuberculosis
accgcgccgggcaccac

SEQ ID NO: 873964 - RNA, 11 nt, Mycobacterium avium subsp. paratuberculosis
accgcgccggu

SEQ ID NO: 873965 - RNA, 15 nt, Mycobacterium avium subsp. paratuberculosis
accgcgccgguccgg

SEQ ID NO: 873966 - RNA, 19 nt, Mycobacterium avium subsp. paratuberculosis
accgcgccgguccggcccu

SEQ ID NO: 873967 - RNA, 20 nt, Mycobacterium avium subsp. paratuberculosis
accgcgccgguguucggcgc

SEQ ID NO: 873968 - RNA, 18 nt, Mycobacterium avium subsp. paratuberculosis
accgcgccgucgucgagc

SEQ ID NO: 873969 - RNA, 19 nt, Mycobacterium avium subsp. paratuberculosis
accgcgccgucgucgagca

SEQ ID NO: 873970 - RNA, 20 nt, Mycobacterium avium subsp. paratuberculosis
accgccgucccgucacggcu

SEQ ID NO: 873971 - RNA, 23 nt, Mycobacterium avium subsp. paratuberculosis
accgccgucccguccgacggcua

SEQ ID NO: 873972 - RNA, 21 nt, Mycobacterium avium subsp. paratuberculosis
accgccguggcguuacacccg

SEQ ID NO: 873973 - RNA, 20 nt, Mycobacterium avium subsp. paratuberculosis
accgccgucggggcgucggc

SEQ ID NO: 873974 - RNA, 22 nt, Mycobacterium avium subsp. paratuberculosis
accgccgucggggcgucggcgg

SEQ ID NO: 873975 - RNA, 17 nt, Mycobacterium avium subsp. paratuberculosis
accgccguggcagggcc

SEQ ID NO: 873976 - RNA, 19 nt, Mycobacterium avium subsp. paratuberculosis
accgccugcuugagguuga

SEQ ID NO: 873977 - RNA, 22 nt, Mycobacterium avium subsp. paratuberculosis
accgccugcuugagguugacgu

SEQ ID NO: 873978 - RNA, 23 nt, Mycobacterium avium subsp. paratuberculosis
accgccugcuugaugaugccggc

SEQ ID NO: 873979 - RNA, 23 nt, Mycobacterium avium subsp. paratuberculosis
accgccugggucucgggaucgcc

SEQ ID NO: 873980 - RNA, 15 nt, Mycobacterium avium subsp. paratuberculosis
accgccugugcgacg

SEQ ID NO: 873981 - RNA, 17 nt, Mycobacterium avium subsp. paratuberculosis
accgccugugcgacggc

SEQ ID NO: 873982 - RNA, 19 nt, Mycobacterium avium subsp. paratuberculosis
accgccugugcgacggcgu

SEQ ID NO: 873983 - RNA, 23 nt, Mycobacterium avium subsp. paratuberculosis
accgccugugcgacggcgucggc

SEQ ID NO: 873984 - RNA, 16 nt, Mycobacterium avium subsp. paratuberculosis
accgccuuggcgcgcu

SEQ ID NO: 873985 - RNA, 17 nt, Mycobacterium avium subsp. paratuberculosis
accgccuuggcgcgcuc

SEQ ID NO: 873986 - RNA, 19 nt, Mycobacterium avium subsp. paratuberculosis
accgccuuggcgcgcucgg

SEQ ID NO: 873987 - RNA, 21 nt, Mycobacterium avium subsp. paratuberculosis
accgccuuggcgcgcucggug

SEQ ID NO: 873988 - RNA, 16 nt, Mycobacterium avium subsp. paratuberculosis
accgccuugucggcga

SEQ ID NO: 873989 - RNA, 22 nt, Mycobacterium avium subsp. paratuberculosis
accgccugucaguuugcgcgac

SEQ ID NO: 873990 - RNA, 14 nt, Mycobacterium avium subsp. paratuberculosis
accgccuuggccac

SEQ ID NO: 873991 - RNA, 19 nt, Mycobacterium avium subsp. paratuberculosis
accgccuucgacggccggc

SEQ ID NO: 873992 - RNA, 13 nt, Mycobacterium avium subsp. paratuberculosis
accgccgcaccca

SEQ ID NO: 873993 - RNA, 16 nt, Mycobacterium avium subsp. paratuberculosis
accgccgcacccagcg

SEQ ID NO: 873994 - RNA, 18 nt, Mycobacterium avium subsp. paratuberculosis
accgccgcaccgucgugc

SEQ ID NO: 873995 - RNA, 17 nt, Mycobacterium avium subsp. paratuberculosis
accgccgaucgugacgc

SEQ ID NO: 873996 - RNA, 22 nt, Mycobacterium avium subsp. paratuberculosis
accgccgaugaugguggcggcc

SEQ ID NO: 873997 - RNA, 22 nt, Mycobacterium avium subsp. paratuberculosis
accgccgagagcucuugcgccc

SEQ ID NO: 873998 - RNA, 20 nt, Mycobacterium avium subsp. paratuberculosis
accgccgagccgcuccaccg

SEQ ID NO: 873999 - RNA, 14 nt, Mycobacterium avium subsp. paratuberculosis
accgccgagccguc

SEQ ID NO: 874000 - RNA, 16 nt, Mycobacterium avium subsp. paratuberculosis
accgccgagccgucgu

SEQ ID NO: 874001 - RNA, 20 nt, Mycobacterium avium subsp. paratuberculosis
accgccgagccgucgucgcu

SEQ ID NO: 874002 - RNA, 15 nt, Mycobacterium avium subsp. paratuberculosis
accgccgagggcccg

SEQ ID NO: 874003 - RNA, 16 nt, Mycobacterium avium subsp. paratuberculosis
accgccccgccgcgcc

SEQ ID NO: 874004 - RNA, 17 nt, Mycobacterium avium subsp. paratuberculosis
accgccccgccgcgccg

SEQ ID NO: 874005 - RNA, 21 nt, Mycobacterium avium subsp. paratuberculosis
accgccgggcauccgggccgc

SEQ ID NO: 874006 - RNA, 22 nt, Mycobacterium avium subsp. paratuberculosis
accgccggggugugcagcggga

SEQ ID NO: 874007 - RNA, 16 nt, Mycobacterium avium subsp. paratuberculosis
accgccgggcgggccg

SEQ ID NO: 874008 - RNA, 17 nt, Mycobacterium avium subsp. paratuberculosis
accgccgggcgggccgc

SEQ ID NO: 874009 - RNA, 18 nt, Mycobacterium avium subsp. paratuberculosis
accgccgggcgggccgca

SEQ ID NO: 874010 - RNA, 20 nt, Mycobacterium avium subsp. paratuberculosis
accgccgggcgggccgcagc

SEQ ID NO: 874011 - RNA, 21 nt, Mycobacterium avium subsp. paratuberculosis
accgccgggcgggccgcagca

SEQ ID NO: 874012 - RNA, 22 nt, Mycobacterium avium subsp. paratuberculosis
accgccgggcgggccgcagcac

SEQ ID NO: 874013 - RNA, 23 nt, Mycobacterium avium subsp. paratuberculosis
accgccgggcgggccgcagcacc

SEQ ID NO: 874014 - RNA, 12 nt, Mycobacterium avium subsp. paratuberculosis
accgccgccagc

SEQ ID NO: 874015 - RNA, 16 nt, Mycobacterium avium subsp. paratuberculosis
accgccgccagcagca

SEQ ID NO: 874016 - RNA, 13 nt, Mycobacterium avium subsp. paratuberculosis
accgagcggccgu

SEQ ID NO: 874017 - RNA, 14 nt, Mycobacterium avium subsp. paratuberculosis
accgagcggccguc

SEQ ID NO: 874018 - RNA, 15 nt, Mycobacterium avium subsp. paratuberculosis
accgagcggccgucc

SEQ ID NO: 874019 - RNA, 16 nt, Mycobacterium avium subsp. paratuberculosis
accgagcggccgucca

SEQ ID NO: 874020 - RNA, 14 nt, Mycobacterium avium subsp. paratuberculosis
accgagcggcgcug

SEQ ID NO: 874021 - RNA, 16 nt, Mycobacterium avium subsp. paratuberculosis
accgagcggcgcugca

SEQ ID NO: 874022 - RNA, 22 nt, Mycobacterium avium subsp. paratuberculosis
accgagcggcgcugcagcagcc

SEQ ID NO: 874023 - RNA, 16 nt, Mycobacterium avium subsp. paratuberculosis
accgcauucggccgcc

SEQ ID NO: 874024 - RNA, 17 nt, Mycobacterium avium subsp. paratuberculosis
accgcauucggccgcca

SEQ ID NO: 874025 - RNA, 22 nt, Mycobacterium avium subsp. paratuberculosis
accgcauucggccgccaccgag

SEQ ID NO: 874026 - RNA, 16 nt, Mycobacterium avium subsp. paratuberculosis
accgagcagcggggug

SEQ ID NO: 874027 - RNA, 19 nt, Mycobacterium avium subsp. paratuberculosis
accgagcagcggggugagc

SEQ ID NO: 874028 - RNA, 17 nt, Mycobacterium avium subsp. paratuberculosis
accgagaucaugccggc

SEQ ID NO: 874029 - RNA, 22 nt, Mycobacterium avium subsp. paratuberculosis
accgagaugaagacccggccgu

SEQ ID NO: 874030 - RNA, 16 nt, Mycobacterium avium subsp. paratuberculosis
accgagccggcggcgu

SEQ ID NO: 874031 - RNA, 15 nt, Mycobacterium avium subsp. paratuberculosis
accgagccggcgucg

SEQ ID NO: 874032 - RNA, 19 nt, Mycobacterium avium subsp. paratuberculosis
accgagccggcgucgccgc

SEQ ID NO: 874033 - RNA, 12 nt, Mycobacterium avium subsp. paratuberculosis
accgagccgggc

SEQ ID NO: 874034 - RNA, 15 nt, Mycobacterium avium subsp. paratuberculosis
accgagccgggcagc

SEQ ID NO: 874035 - RNA, 14 nt, Mycobacterium avium subsp. paratuberculosis
accgagccggggcu

SEQ ID NO: 874036 - RNA, 22 nt, Mycobacterium avium subsp. paratuberculosis
accgagccugggauugccgggc

SEQ ID NO: 874037 - RNA, 13 nt, Mycobacterium avium subsp. paratuberculosis
accgagcgagcgc

SEQ ID NO: 874038 - RNA, 17 nt, Mycobacterium avium subsp. paratuberculosis
accgagcgagcgcacca

SEQ ID NO: 874039 - RNA, 13 nt, Mycobacterium avium subsp. paratuberculosis
accgagccgcgcg

SEQ ID NO: 874040 - RNA, 15 nt, Mycobacterium avium subsp. paratuberculosis
accgagccgcgcgcc

SEQ ID NO: 874041 - RNA, 17 nt, Mycobacterium avium subsp. paratuberculosis
accgagccgcgcgccga

SEQ ID NO: 874042 - RNA, 18 nt, Mycobacterium avium subsp. paratuberculosis
accgagccgcgcgccgag

SEQ ID NO: 874043 - RNA, 22 nt, Mycobacterium avium subsp. paratuberculosis
accgccaccucgagcucaccga

SEQ ID NO: 874044 - RNA, 20 nt, Mycobacterium avium subsp. paratuberculosis
accgccacgacgcggcgauc

SEQ ID NO: 874045 - RNA, 21 nt, Mycobacterium avium subsp. paratuberculosis
accgccagucugagcccgggc

SEQ ID NO: 874046 - RNA, 13 nt, Mycobacterium avium subsp. paratuberculosis
accgccaccaggc

SEQ ID NO: 874047 - RNA, 19 nt, Mycobacterium avium subsp. paratuberculosis
accgccaccaggccguggu

SEQ ID NO: 874048 - RNA, 14 nt, Mycobacterium avium subsp. paratuberculosis
accgccaccgcccg

SEQ ID NO: 874049 - RNA, 13 nt, Mycobacterium avium subsp. paratuberculosis
accgccaccggcc

SEQ ID NO: 874050 - RNA, 14 nt, Mycobacterium avium subsp. paratuberculosis
accgccaccacccg

SEQ ID NO: 874051 - RNA, 18 nt, Mycobacterium avium subsp. paratuberculosis
accgccaccacccggcga

SEQ ID NO: 874052 - RNA, 20 nt, Mycobacterium avium subsp. paratuberculosis
accgccaccacccggcgauu

SEQ ID NO: 874053 - RNA, 15 nt, Mycobacterium avium subsp. paratuberculosis
accgccaccagaucg

SEQ ID NO: 874054 - RNA, 15 nt, Mycobacterium avium subsp. paratuberculosis
accgccaccagcgca

SEQ ID NO: 874055 - RNA, 17 nt, Mycobacterium avium subsp. paratuberculosis
accgcccacagcaacga

SEQ ID NO: 874056 - RNA, 23 nt, Mycobacterium avium subsp. paratuberculosis
accgcccacgaacgucaggccgu

SEQ ID NO: 874057 - RNA, 13 nt, Mycobacterium avium subsp. paratuberculosis
accgcccagcggc

SEQ ID NO: 874058 - RNA, 15 nt, Mycobacterium avium subsp. paratuberculosis
accgccccagccgac

SEQ ID NO: 874059 - RNA, 17 nt, Mycobacterium avium subsp. paratuberculosis
accgccccagccgacca

SEQ ID NO: 874060 - RNA, 19 nt, Mycobacterium avium subsp. paratuberculosis
accgcccaguugcacggug

SEQ ID NO: 874061 - RNA, 14 nt, Mycobacterium avium subsp. paratuberculosis
accgcccccgcggc

SEQ ID NO: 874062 - RNA, 16 nt, Mycobacterium avium subsp. paratuberculosis
accgcccccgcggcgg

SEQ ID NO: 874063 - RNA, 22 nt, Mycobacterium avium subsp. paratuberculosis
accgccaucggcaucgcgcgcg

SEQ ID NO: 874064 - RNA, 18 nt, Mycobacterium avium subsp. paratuberculosis
accgccaucucgggagug

SEQ ID NO: 874065 - RNA, 16 nt, Mycobacterium avium subsp. paratuberculosis
accggcgaugcagauc

SEQ ID NO: 874066 - RNA, 15 nt, Mycobacterium avium subsp. paratuberculosis
accggcgaugccagc

SEQ ID NO: 874067 - RNA, 20 nt, Mycobacterium avium subsp. paratuberculosis
accggcgaggugaaccgcga

SEQ ID NO: 874068 - RNA, 21 nt, Mycobacterium avium subsp. paratuberculosis
accggcgaggugaaccgcgac

SEQ ID NO: 874069 - RNA, 18 nt, Mycobacterium avium subsp. paratuberculosis
accggcgaguccgcggag

SEQ ID NO: 874070 - RNA, 19 nt, Mycobacterium avium subsp. paratuberculosis
accggcgacggcgguucga

SEQ ID NO: 874071 - RNA, 22 nt, Mycobacterium avium subsp. paratuberculosis
accggcgaauccgaguuggccg

SEQ ID NO: 874072 - RNA, 21 nt, Mycobacterium avium subsp. paratuberculosis
accggcgccgaagcccgcagc

SEQ ID NO: 874073 - RNA, 17 nt, Mycobacterium avium subsp. paratuberculosis
accggcgcagcgcgucg

SEQ ID NO: 874074 - RNA, 23 nt, Mycobacterium avium subsp. paratuberculosis
accggcgcagcgcgucgcgcccg

SEQ ID NO: 874075 - RNA, 16 nt, Mycobacterium avium subsp. paratuberculosis
accggcgccaggccgg

SEQ ID NO: 874076 - RNA, 17 nt, Mycobacterium avium subsp. paratuberculosis
accggcgccaggccggc

SEQ ID NO: 874077 - RNA, 21 nt, Mycobacterium avium subsp. paratuberculosis
accggcgccaggccggcgacg

SEQ ID NO: 874078 - RNA, 22 nt, Mycobacterium avium subsp. paratuberculosis
accggcgccaggccggcgacgc

SEQ ID NO: 874079 - RNA, 21 nt, Mycobacterium avium subsp. paratuberculosis
accggcgccccgggcagcgaa

SEQ ID NO: 874080 - RNA, 19 nt, Mycobacterium avium subsp. paratuberculosis
accggcgccgggcagcccg

SEQ ID NO: 874081 - RNA, 13 nt, Mycobacterium avium subsp. paratuberculosis
accggcgccgggu

SEQ ID NO: 874082 - RNA, 13 nt, Mycobacterium avium subsp. paratuberculosis
accggcgccucga

SEQ ID NO: 874083 - RNA, 21 nt, Mycobacterium avium subsp. paratuberculosis
accggcgccucgaugcgggug

SEQ ID NO: 874084 - RNA, 13 nt, Mycobacterium avium subsp. paratuberculosis
accggcgccucgu

SEQ ID NO: 874085 - RNA, 16 nt, Mycobacterium avium subsp. paratuberculosis
accggcgcgacggcgg

SEQ ID NO: 874086 - RNA, 14 nt, Mycobacterium avium subsp. paratuberculosis
accggcgcgcagca

SEQ ID NO: 874087 - RNA, 13 nt, Mycobacterium avium subsp. paratuberculosis
accggcgcgcccg

SEQ ID NO: 874088 - RNA, 13 nt, Mycobacterium avium subsp. paratuberculosis
accggcgcgccgc

SEQ ID NO: 874089 - RNA, 15 nt, Mycobacterium avium subsp. paratuberculosis
accggcgcgccgcgu

SEQ ID NO: 874090 - RNA, 14 nt, Mycobacterium avium subsp. paratuberculosis
accggcgccgccac

SEQ ID NO: 874091 - RNA, 17 nt, Mycobacterium avium subsp. paratuberculosis
accggcgccgccaccac

SEQ ID NO: 874092 - RNA, 12 nt, Mycobacterium avium subsp. paratuberculosis
accggcgccggc

SEQ ID NO: 874093 - RNA, 14 nt, Mycobacterium avium subsp. paratuberculosis
accggcgccggccg

SEQ ID NO: 874094 - RNA, 15 nt, Mycobacterium avium subsp. paratuberculosis
accggcgccggccgc

SEQ ID NO: 874095 - RNA, 20 nt, Mycobacterium avium subsp. paratuberculosis
accggcguacgacaucucga

SEQ ID NO: 874096 - RNA, 21 nt, Mycobacterium avium subsp. paratuberculosis
accggcgucauggugcgcggg

SEQ ID NO: 874097 - RNA, 15 nt, Mycobacterium avium subsp. paratuberculosis
accggcggugccggc

SEQ ID NO: 874098 - RNA, 17 nt, Mycobacterium avium subsp. paratuberculosis
accggcggugccggcca

SEQ ID NO: 874099 - RNA, 22 nt, Mycobacterium avium subsp. paratuberculosis
accggcggugccggccagaucg

SEQ ID NO: 874100 - RNA, 15 nt, Mycobacterium avium subsp. paratuberculosis
accggcggugcggac

SEQ ID NO: 874101 - RNA, 18 nt, Mycobacterium avium subsp. paratuberculosis
accggcggugcggacccg

SEQ ID NO: 874102 - RNA, 23 nt, Mycobacterium avium subsp. paratuberculosis
accggcggugucggugccgagca

SEQ ID NO: 874103 - RNA, 13 nt, Mycobacterium avium subsp. paratuberculosis
accggcggcgauc

SEQ ID NO: 874104 - RNA, 15 nt, Mycobacterium avium subsp. paratuberculosis
accggcggcgaucgg

SEQ ID NO: 874105 - RNA, 16 nt, Mycobacterium avium subsp. paratuberculosis
accggcggcgaucggc

SEQ ID NO: 874106 - RNA, 18 nt, Mycobacterium avium subsp. paratuberculosis
accggcggcgacggcacc

SEQ ID NO: 874107 - RNA, 13 nt, Mycobacterium avium subsp. paratuberculosis
accggcggcggcc

SEQ ID NO: 874108 - RNA, 14 nt, Mycobacterium avium subsp. paratuberculosis
accggcggcugggc

SEQ ID NO: 874109 - RNA, 20 nt, Mycobacterium avium subsp. paratuberculosis
accggcggcugggcagccgc

SEQ ID NO: 874110 - RNA, 21 nt, Mycobacterium avium subsp. paratuberculosis
accggcggcugggcagccgcg

SEQ ID NO: 874111 - RNA, 16 nt, Mycobacterium avium subsp. paratuberculosis
accggcgggcggcggc

SEQ ID NO: 874112 - RNA, 17 nt, Mycobacterium avium subsp. paratuberculosis
accggcgggcggcggcg

SEQ ID NO: 874113 - RNA, 15 nt, Mycobacterium avium subsp. paratuberculosis
accggcgcguuggcc

SEQ ID NO: 874114 - RNA, 14 nt, Mycobacterium avium subsp. paratuberculosis
accggcggcagcga

SEQ ID NO: 874115 - RNA, 15 nt, Mycobacterium avium subsp. paratuberculosis
accggcggcagcgac

SEQ ID NO: 874116 - RNA, 13 nt, Mycobacterium avium subsp. paratuberculosis
accggcggccagc

SEQ ID NO: 874117 - RNA, 15 nt, Mycobacterium avium subsp. paratuberculosis
accggcggccagcga

SEQ ID NO: 874118 - RNA, 16 nt, Mycobacterium avium subsp. paratuberculosis
accggcggccgccauc

SEQ ID NO: 874119 - RNA, 14 nt, Mycobacterium avium subsp. paratuberculosis
accggcgcgccguc

SEQ ID NO: 874120 - RNA, 15 nt, Mycobacterium avium subsp. paratuberculosis
accggcgcgccgucc

SEQ ID NO: 874121 - RNA, 15 nt, Mycobacterium avium subsp. paratuberculosis
accggcgcugcccgc

SEQ ID NO: 874122 - RNA, 17 nt, Mycobacterium avium subsp. paratuberculosis
accggcgcugcccgcga

SEQ ID NO: 874123 - RNA, 21 nt, Mycobacterium avium subsp. paratuberculosis
accggcggaaguagcccggag

SEQ ID NO: 874124 - RNA, 18 nt, Mycobacterium avium subsp. paratuberculosis
accgggaacagccaggcg

SEQ ID NO: 874125 - RNA, 16 nt, Mycobacterium avium subsp. paratuberculosis
accgggaagccgagcu

SEQ ID NO: 874126 - RNA, 22 nt, Mycobacterium avium subsp. paratuberculosis
accgggaaggugucggccggga

SEQ ID NO: 874127 - RNA, 20 nt, Mycobacterium avium subsp. paratuberculosis
accgggaaguagggcagccc

SEQ ID NO: 874128 - RNA, 16 nt, Mycobacterium avium subsp. paratuberculosis
accgggacagccgcgc

SEQ ID NO: 874129 - RNA, 17 nt, Mycobacterium avium subsp. paratuberculosis
accgggacagccgcgcc

SEQ ID NO: 874130 - RNA, 19 nt, Mycobacterium avium subsp. paratuberculosis
accgggacagccgcgccga

SEQ ID NO: 874131 - RNA, 16 nt, Mycobacterium avium subsp. paratuberculosis
accgggacaucgucgc

SEQ ID NO: 874132 - RNA, 20 nt, Mycobacterium avium subsp. paratuberculosis
accgggaccagcgcggugcc

SEQ ID NO: 874133 - RNA, 18 nt, Mycobacterium avium subsp. paratuberculosis
accgggacgacggcgccg

SEQ ID NO: 874134 - RNA, 19 nt, Mycobacterium avium subsp. paratuberculosis
accgggacgacggcgccgc

SEQ ID NO: 874135 - RNA, 20 nt, Mycobacterium avium subsp. paratuberculosis
accgggacgggggugccgac

SEQ ID NO: 874136 - RNA, 16 nt, Mycobacterium avium subsp. paratuberculosis
accgggauaccgcgac

SEQ ID NO: 874137 - RNA, 16 nt, Mycobacterium avium subsp. paratuberculosis
accggcuuggccacga

SEQ ID NO: 874138 - RNA, 18 nt, Mycobacterium avium subsp. paratuberculosis
accgggaucacccucggc

SEQ ID NO: 874139 - RNA, 19 nt, Mycobacterium avium subsp. paratuberculosis
accgggauccggcgcgccg

SEQ ID NO: 874140 - RNA, 20 nt, Mycobacterium avium subsp. paratuberculosis
accgggauccggcgcgccgc

SEQ ID NO: 874141 - RNA, 14 nt, Mycobacterium avium subsp. paratuberculosis
accgggaucgacag

SEQ ID NO: 874142 - RNA, 20 nt, Mycobacterium avium subsp. paratuberculosis
accgggaugacaaccaucga

SEQ ID NO: 874143 - RNA, 22 nt, Mycobacterium avium subsp. paratuberculosis
accgggauggugaccagcgccc

SEQ ID NO: 874144 - RNA, 15 nt, Mycobacterium avium subsp. paratuberculosis
accggcuggccgagc

SEQ ID NO: 874145 - RNA, 17 nt, Mycobacterium avium subsp. paratuberculosis
accggcuggccgagcgg

SEQ ID NO: 874146 - RNA, 13 nt, Mycobacterium avium subsp. paratuberculosis
accggcuggugca

SEQ ID NO: 874147 - RNA, 18 nt, Mycobacterium avium subsp. paratuberculosis
accggcuggugcagcagc

SEQ ID NO: 874148 - RNA, 14 nt, Mycobacterium avium subsp. paratuberculosis
accggcugccccag

SEQ ID NO: 874149 - RNA, 14 nt, Mycobacterium avium subsp. paratuberculosis
accggcugcccgac

SEQ ID NO: 874150 - RNA, 15 nt, Mycobacterium avium subsp. paratuberculosis
accggcugcccgacc

SEQ ID NO: 874151 - RNA, 18 nt, Mycobacterium avium subsp. paratuberculosis
accggcucucagccggaa

SEQ ID NO: 874152 - RNA, 19 nt, Mycobacterium avium subsp. paratuberculosis
accggcuucgggaucagcg

SEQ ID NO: 874153 - RNA, 15 nt, Mycobacterium avium subsp. paratuberculosis
accggcuuggcggug

SEQ ID NO: 874154 - RNA, 13 nt, Mycobacterium avium subsp. paratuberculosis
accggcuggccgg

SEQ ID NO: 874155 - RNA, 14 nt, Mycobacterium avium subsp. paratuberculosis
accggcggauucuc

SEQ ID NO: 874156 - RNA, 19 nt, Mycobacterium avium subsp. paratuberculosis
accggcgucgacagccggu

SEQ ID NO: 874157 - RNA, 21 nt, Mycobacterium avium subsp. paratuberculosis
accggcgucgacagccggucg

SEQ ID NO: 874158 - RNA, 21 nt, Mycobacterium avium subsp. paratuberculosis
accggcucgggaacggucagc

SEQ ID NO: 874159 - RNA, 18 nt, Mycobacterium avium subsp. paratuberculosis
accggcucgccggcgcgc

SEQ ID NO: 874160 - RNA, 19 nt, Mycobacterium avium subsp. paratuberculosis
accggcucgccggcgcgca

SEQ ID NO: 874161 - RNA, 14 nt, Mycobacterium avium subsp. paratuberculosis
accggcucgcgggg

SEQ ID NO: 874162 - RNA, 15 nt, Mycobacterium avium subsp. paratuberculosis
accggcucggcccgg

SEQ ID NO: 874163 - RNA, 13 nt, Mycobacterium avium subsp. paratuberculosis
accggcugaccgg

SEQ ID NO: 874164 - RNA, 17 nt, Mycobacterium avium subsp. paratuberculosis
accggcugaccggcggu

SEQ ID NO: 874165 - RNA, 20 nt, Mycobacterium avium subsp. paratuberculosis
accggcugaccggcggugcc

SEQ ID NO: 874166 - RNA, 18 nt, Mycobacterium avium subsp. paratuberculosis
accggcucagcccggcgc

SEQ ID NO: 874167 - RNA, 18 nt, Mycobacterium avium subsp. paratuberculosis
accggcuccuugcgccgc

SEQ ID NO: 874168 - RNA, 13 nt, Mycobacterium avium subsp. paratuberculosis
accggcucgccgg

SEQ ID NO: 874169 - RNA, 15 nt, Mycobacterium avium subsp. paratuberculosis
accggcucgccggcg

SEQ ID NO: 874170 - RNA, 16 nt, Mycobacterium avium subsp. paratuberculosis
accggcucgccggcgc

SEQ ID NO: 874171 - RNA, 17 nt, Mycobacterium avium subsp. paratuberculosis
accggcucgccggcgcg

SEQ ID NO: 874172 - RNA, 21 nt, Mycobacterium avium subsp. paratuberculosis
accggccugagacgacgccac

SEQ ID NO: 874173 - RNA, 18 nt, Mycobacterium avium subsp. paratuberculosis
accggccugcagcgcggu

SEQ ID NO: 874174 - RNA, 22 nt, Mycobacterium avium subsp. paratuberculosis
accggccugcagcgcggucauc

SEQ ID NO: 874175 - RNA, 14 nt, Mycobacterium avium subsp. paratuberculosis
accggccggcgcgc

SEQ ID NO: 874176 - RNA, 16 nt, Mycobacterium avium subsp. paratuberculosis
accggccggcgcggcg

SEQ ID NO: 874177 - RNA, 20 nt, Mycobacterium avium subsp. paratuberculosis
accggccggcgcggcggcga

SEQ ID NO: 874178 - RNA, 15 nt, Mycobacterium avium subsp. paratuberculosis
accggccggggcgcc

SEQ ID NO: 874179 - RNA, 17 nt, Mycobacterium avium subsp. paratuberculosis
accggccggggcgccac

SEQ ID NO: 874180 - RNA, 14 nt, Mycobacterium avium subsp. paratuberculosis
accggccggccgcc

SEQ ID NO: 874181 - RNA, 19 nt, Mycobacterium avium subsp. paratuberculosis
accggccggccgccuggac

SEQ ID NO: 874182 - RNA, 12 nt, Mycobacterium avium subsp. paratuberculosis
accggccgcgcg

SEQ ID NO: 874183 - RNA, 19 nt, Mycobacterium avium subsp. paratuberculosis
accggccgcgcguagauca

SEQ ID NO: 874184 - RNA, 21 nt, Mycobacterium avium subsp. paratuberculosis
accggccgcccggcgagcagc

SEQ ID NO: 874185 - RNA, 21 nt, Mycobacterium avium subsp. paratuberculosis
accggccgaccggucucgacc

SEQ ID NO: 874186 - RNA, 15 nt, Mycobacterium avium subsp. paratuberculosis
accggccgagccgau

SEQ ID NO: 874187 - RNA, 23 nt, Mycobacterium avium subsp. paratuberculosis
accggccgauggcccaggccgcg

SEQ ID NO: 874188 - RNA, 14 nt, Mycobacterium avium subsp. paratuberculosis
accggcccggccgg

SEQ ID NO: 874189 - RNA, 18 nt, Mycobacterium avium subsp. paratuberculosis
accggcccggccggcgcg

SEQ ID NO: 874190 - RNA, 19 nt, Mycobacterium avium subsp. paratuberculosis
accggcccggccggcgcga

SEQ ID NO: 874191 - RNA, 21 nt, Mycobacterium avium subsp. paratuberculosis
accggcccggccggcgcgacc

SEQ ID NO: 874192 - RNA, 14 nt, Mycobacterium avium subsp. paratuberculosis
accggcccggcggc

SEQ ID NO: 874193 - RNA, 21 nt, Mycobacterium avium subsp. paratuberculosis
accggcccggcggccggccgc

SEQ ID NO: 874194 - RNA, 23 nt, Mycobacterium avium subsp. paratuberculosis
accggcccggcggccggccgcgc

SEQ ID NO: 874195 - RNA, 17 nt, Mycobacterium avium subsp. paratuberculosis
accggcccggcgggcau

SEQ ID NO: 874196 - RNA, 20 nt, Mycobacterium avium subsp. paratuberculosis
accggccccgagcgucacgc

SEQ ID NO: 874197 - RNA, 17 nt, Mycobacterium avium subsp. paratuberculosis
accggcccagcagcguc

SEQ ID NO: 874198 - RNA, 14 nt, Mycobacterium avium subsp. paratuberculosis
accggcccagccgg

SEQ ID NO: 874199 - RNA, 17 nt, Mycobacterium avium subsp. paratuberculosis
accggcccagccggcgg

SEQ ID NO: 874200 - RNA, 13 nt, Mycobacterium avium subsp. paratuberculosis
accggcccagcgc

SEQ ID NO: 874201 - RNA, 14 nt, Mycobacterium avium subsp. paratuberculosis
accggcccagcgcg

SEQ ID NO: 874202 - RNA, 15 nt, Mycobacterium avium subsp. paratuberculosis
accggcccagcgcgg

SEQ ID NO: 874203 - RNA, 22 nt, Mycobacterium avium subsp. paratuberculosis
accggccccaacggcgugcagc

SEQ ID NO: 874204 - RNA, 16 nt, Mycobacterium avium subsp. paratuberculosis
accggccagggccgcc

SEQ ID NO: 874205 - RNA, 18 nt, Mycobacterium avium subsp. paratuberculosis
accggccagggccgccgc

SEQ ID NO: 874206 - RNA, 13 nt, Mycobacterium avium subsp. paratuberculosis
accggccauccgc

SEQ ID NO: 874207 - RNA, 18 nt, Mycobacterium avium subsp. paratuberculosis
accggccauccgcugcgc

SEQ ID NO: 874208 - RNA, 21 nt, Mycobacterium avium subsp. paratuberculosis
accggccaccacgugcgcguu

SEQ ID NO: 874209 - RNA, 22 nt, Mycobacterium avium subsp. paratuberculosis
accggccaccacgugcgcguug

SEQ ID NO: 874210 - RNA, 13 nt, Mycobacterium avium subsp. paratuberculosis
accggccagcacg

SEQ ID NO: 874211 - RNA, 13 nt, Mycobacterium avium subsp. paratuberculosis
accggccagcagc

SEQ ID NO: 874212 - RNA, 16 nt, Mycobacterium avium subsp. paratuberculosis
accggccagcagcagc

SEQ ID NO: 874213 - RNA, 20 nt, Mycobacterium avium subsp. paratuberculosis
accggccagcagcagcccgc

SEQ ID NO: 874214 - RNA, 22 nt, Mycobacterium avium subsp. paratuberculosis
accggccagcagcagcccgccg

SEQ ID NO: 874215 - RNA, 16 nt, Mycobacterium avium subsp. paratuberculosis
accggccagcagccgc

SEQ ID NO: 874216 - RNA, 15 nt, Mycobacterium avium subsp. paratuberculosis
accggcaucgguggc

SEQ ID NO: 874217 - RNA, 22 nt, Mycobacterium avium subsp. paratuberculosis
accggcaucgguggcaccccgc

SEQ ID NO: 874218 - RNA, 15 nt, Mycobacterium avium subsp. paratuberculosis
accggcaugugccac

SEQ ID NO: 874219 - RNA, 23 nt, Mycobacterium avium subsp. paratuberculosis
accggcaggacgggggccggugc

SEQ ID NO: 874220 - RNA, 16 nt, Mycobacterium avium subsp. paratuberculosis
accggcagcagcgcgu

SEQ ID NO: 874221 - RNA, 13 nt, Mycobacterium avium subsp. paratuberculosis
accggcagcgcca

SEQ ID NO: 874222 - RNA, 14 nt, Mycobacterium avium subsp. paratuberculosis
accggcagcgccac

SEQ ID NO: 874223 - RNA, 18 nt, Mycobacterium avium subsp. paratuberculosis
accggcagcgccaccagc

SEQ ID NO: 874224 - RNA, 19 nt, Mycobacterium avium subsp. paratuberculosis
accggcagcgccaccagcu

SEQ ID NO: 874225 - RNA, 13 nt, Mycobacterium avium subsp. paratuberculosis
accggcagcagcg

SEQ ID NO: 874226 - RNA, 14 nt, Mycobacterium avium subsp. paratuberculosis
accggcagcaggug

SEQ ID NO: 874227 - RNA, 20 nt, Mycobacterium avium subsp. paratuberculosis
accggcagcaggugcaccac

SEQ ID NO: 874228 - RNA, 21 nt, Mycobacterium avium subsp. paratuberculosis
accggcagcaggugcaccacc

SEQ ID NO: 874229 - RNA, 13 nt, Mycobacterium avium subsp. paratuberculosis
accggcagccgca

SEQ ID NO: 874230 - RNA, 14 nt, Mycobacterium avium subsp. paratuberculosis
accggcagccgcag

SEQ ID NO: 874231 - RNA, 17 nt, Mycobacterium avium subsp. paratuberculosis
accggcagccgcagcga

SEQ ID NO: 874232 - RNA, 15 nt, Mycobacterium avium subsp. paratuberculosis
accggcagccgcgcc

SEQ ID NO: 874233 - RNA, 16 nt, Mycobacterium avium subsp. paratuberculosis
accggcagccgcgccc

SEQ ID NO: 874234 - RNA, 12 nt, Mycobacterium avium subsp. paratuberculosis
accggcagccgg

SEQ ID NO: 874235 - RNA, 14 nt, Mycobacterium avium subsp. paratuberculosis
accggcagccggcg

SEQ ID NO: 874236 - RNA, 18 nt, Mycobacterium avium subsp. paratuberculosis
accggaauggcagcagcc

SEQ ID NO: 874237 - RNA, 22 nt, Mycobacterium avium subsp. paratuberculosis
accggaauggcagcagccggaa

SEQ ID NO: 874238 - RNA, 16 nt, Mycobacterium avium subsp. paratuberculosis
accggacagcugggcg

SEQ ID NO: 874239 - RNA, 14 nt, Mycobacterium avium subsp. paratuberculosis
accggaccgccgag

SEQ ID NO: 874240 - RNA, 13 nt, Mycobacterium avium subsp. paratuberculosis
accggaccgccgc

SEQ ID NO: 874241 - RNA, 14 nt, Mycobacterium avium subsp. paratuberculosis
accggaccgccgcg

SEQ ID NO: 874242 - RNA, 23 nt, Mycobacterium avium subsp. paratuberculosis
accggaccgccgcggcgcccggc

SEQ ID NO: 874243 - RNA, 17 nt, Mycobacterium avium subsp. paratuberculosis
accggaccggccagcag

SEQ ID NO: 874244 - RNA, 15 nt, Mycobacterium avium subsp. paratuberculosis
accggcagcaaccgc

SEQ ID NO: 874245 - RNA, 16 nt, Mycobacterium avium subsp. paratuberculosis
accggcagcaaccgcg

SEQ ID NO: 874246 - RNA, 14 nt, Mycobacterium avium subsp. paratuberculosis
accggcagcaccgc

SEQ ID NO: 874247 - RNA, 17 nt, Mycobacterium avium subsp. paratuberculosis
accggcagcaccgccga

SEQ ID NO: 874248 - RNA, 18 nt, Mycobacterium avium subsp. paratuberculosis
accggcagcaccgccgag

SEQ ID NO: 874249 - RNA, 13 nt, Mycobacterium avium subsp. paratuberculosis
accggcacggcac

SEQ ID NO: 874250 - RNA, 16 nt, Mycobacterium avium subsp. paratuberculosis
accggcacggcaccgc

SEQ ID NO: 874251 - RNA, 19 nt, Mycobacterium avium subsp. paratuberculosis
accggcacggcaccgcgag

SEQ ID NO: 874252 - RNA, 22 nt, Mycobacterium avium subsp. paratuberculosis
accggcacggugcacacgccga

SEQ ID NO: 874253 - RNA, 13 nt, Mycobacterium avium subsp. paratuberculosis
accggcacgucga

SEQ ID NO: 874254 - RNA, 17 nt, Mycobacterium avium subsp. paratuberculosis
accggcacgucggccac

SEQ ID NO: 874255 - RNA, 17 nt, Mycobacterium avium subsp. paratuberculosis
accggcacgugcggguu

SEQ ID NO: 874256 - RNA, 16 nt, Mycobacterium avium subsp. paratuberculosis
accggaagcgcgcauc

SEQ ID NO: 874257 - RNA, 19 nt, Mycobacterium avium subsp. paratuberculosis
accggaagcgcgcaucgcg

SEQ ID NO: 874258 - RNA, 21 nt, Mycobacterium avium subsp. paratuberculosis
accgcuuugaauugagcgccg

SEQ ID NO: 874259 - RNA, 23 nt, Mycobacterium avium subsp. paratuberculosis
accgcuuugaauugagcgccggg

SEQ ID NO: 874260 - RNA, 16 nt, Mycobacterium avium subsp. paratuberculosis
accgcucgucgggaac

SEQ ID NO: 874261 - RNA, 22 nt, Mycobacterium avium subsp. paratuberculosis
accgcuuugugaggcgcgccgg

SEQ ID NO: 874262 - RNA, 23 nt, Mycobacterium avium subsp. paratuberculosis
accgcuuugugaggcgcgccggu

SEQ ID NO: 874263 - RNA, 16 nt, Mycobacterium avium subsp. paratuberculosis
accaagacggugggcc

SEQ ID NO: 874264 - RNA, 14 nt, Mycobacterium avium subsp. paratuberculosis
accaagcaccagau

SEQ ID NO: 874265 - RNA, 20 nt, Mycobacterium avium subsp. paratuberculosis
accaagcgcgacaagcagau

SEQ ID NO: 874266 - RNA, 22 nt, Mycobacterium avium subsp. paratuberculosis
accaaggcaaucaggcggucga

SEQ ID NO: 874267 - RNA, 17 nt, Mycobacterium avium subsp. paratuberculosis
accaacgcggcgccggu

SEQ ID NO: 874268 - RNA, 18 nt, Mycobacterium avium subsp. paratuberculosis
accaacggcucgccgcgc

SEQ ID NO: 874269 - RNA, 12 nt, Mycobacterium avium subsp. paratuberculosis
accaacucgcga

SEQ ID NO: 874270 - RNA, 17 nt, Mycobacterium avium subsp. paratuberculosis
accaacuccaccgcccg

SEQ ID NO: 874271 - RNA, 19 nt, Mycobacterium avium subsp. paratuberculosis
accaacacccccgcgcugc

SEQ ID NO: 874272 - RNA, 13 nt, Mycobacterium avium subsp. paratuberculosis
accaacagcagcg

SEQ ID NO: 874273 - RNA, 18 nt, Mycobacterium avium subsp. paratuberculosis
accaacccgaucggcccg

SEQ ID NO: 874274 - RNA, 15 nt, Mycobacterium avium subsp. paratuberculosis
accaacacgucgagu

SEQ ID NO: 874275 - RNA, 16 nt, Mycobacterium avium subsp. paratuberculosis
acauuggcgaccgcgg

SEQ ID NO: 874276 - RNA, 21 nt, Mycobacterium avium subsp. paratuberculosis
acaugguggucgaacuggcgc

SEQ ID NO: 874277 - RNA, 14 nt, Mycobacterium avium subsp. paratuberculosis
acaugugagguggc

SEQ ID NO: 874278 - RNA, 20 nt, Mycobacterium avium subsp. paratuberculosis
acauccugguccggcgcccg

SEQ ID NO: 874279 - RNA, 24 nt, Mycobacterium avium subsp. paratuberculosis
acauccugguccggcgcccgaucg

SEQ ID NO: 874280 - RNA, 16 nt, Mycobacterium avium subsp. paratuberculosis
acaucccggagccguc

SEQ ID NO: 874281 - RNA, 16 nt, Mycobacterium avium subsp. paratuberculosis
acaucgagcccaccgc

SEQ ID NO: 874282 - RNA, 18 nt, Mycobacterium avium subsp. paratuberculosis
acaucgacgcgaccggcc

SEQ ID NO: 874283 - RNA, 20 nt, Mycobacterium avium subsp. paratuberculosis
acaucgacgcgaccggcccg

SEQ ID NO: 874284 - RNA, 14 nt, Mycobacterium avium subsp. paratuberculosis
acaucccgccgggc

SEQ ID NO: 874285 - RNA, 14 nt, Mycobacterium avium subsp. paratuberculosis
acaucccggacagg

SEQ ID NO: 874286 - RNA, 16 nt, Mycobacterium avium subsp. paratuberculosis
acauccauugggccgc

SEQ ID NO: 874287 - RNA, 18 nt, Mycobacterium avium subsp. paratuberculosis
acauccauugggccgcgg

SEQ ID NO: 874288 - RNA, 19 nt, Mycobacterium avium subsp. paratuberculosis
acauccauugggccgcggc

SEQ ID NO: 874289 - RNA, 21 nt, Mycobacterium avium subsp. paratuberculosis
acauccauugggccgcggcgu

SEQ ID NO: 874290 - RNA, 18 nt, Mycobacterium avium subsp. paratuberculosis
acauccaggaccgcgcgc

SEQ ID NO: 874291 - RNA, 23 nt, Mycobacterium avium subsp. paratuberculosis
acauccaggaccgcgcgccggcc

SEQ ID NO: 874292 - RNA, 22 nt, Mycobacterium avium subsp. paratuberculosis
acaucggagagcuugccgcgga

SEQ ID NO: 874293 - RNA, 17 nt, Mycobacterium avium subsp. paratuberculosis
acaucggcacacgcgga

SEQ ID NO: 874294 - RNA, 12 nt, Mycobacterium avium subsp. paratuberculosis
acaucggccggg

SEQ ID NO: 874295 - RNA, 22 nt, Mycobacterium avium subsp. paratuberculosis
acaucgccaucagcagcgccuc

SEQ ID NO: 874296 - RNA, 15 nt, Mycobacterium avium subsp. paratuberculosis
acaucgccgagacga

SEQ ID NO: 874297 - RNA, 13 nt, Mycobacterium avium subsp. paratuberculosis
acaucgccgcggc

SEQ ID NO: 874298 - RNA, 15 nt, Mycobacterium avium subsp. paratuberculosis
acaucgccgcggccg

SEQ ID NO: 874299 - RNA, 16 nt, Mycobacterium avium subsp. paratuberculosis
acaucgccgcggccgg

SEQ ID NO: 874300 - RNA, 14 nt, Mycobacterium avium subsp. paratuberculosis
acaucgccggcgac

SEQ ID NO: 874301 - RNA, 14 nt, Mycobacterium avium subsp. paratuberculosis
acaucgccucggcc

SEQ ID NO: 874302 - RNA, 15 nt, Mycobacterium avium subsp. paratuberculosis
acaucgccucggcgu

SEQ ID NO: 874303 - RNA, 14 nt, Mycobacterium avium subsp. paratuberculosis
acaucgucggcucg

SEQ ID NO: 874304 - RNA, 22 nt, Mycobacterium avium subsp. paratuberculosis
acaucguucccugcgcggcgau

SEQ ID NO: 874305 - RNA, 20 nt, Mycobacterium avium subsp. paratuberculosis
acaucgguugcuccggcguc

SEQ ID NO: 874306 - RNA, 18 nt, Mycobacterium avium subsp. paratuberculosis
acaucggcgccgacgggg

SEQ ID NO: 874307 - RNA, 22 nt, Mycobacterium avium subsp. paratuberculosis
acaucggugaccgucgccgacc

SEQ ID NO: 874308 - RNA, 13 nt, Mycobacterium avium subsp. paratuberculosis
acaugcccggcga

SEQ ID NO: 874309 - RNA, 14 nt, Mycobacterium avium subsp. paratuberculosis
acaugcccggcgac

SEQ ID NO: 874310 - RNA, 15 nt, Mycobacterium avium subsp. paratuberculosis
acaugcccggcgacg

SEQ ID NO: 874311 - RNA, 19 nt, Mycobacterium avium subsp. paratuberculosis
acaugccgagcagcaccgc

SEQ ID NO: 874312 - RNA, 23 nt, Mycobacterium avium subsp. paratuberculosis
acaugccguugccaggccgcgag

SEQ ID NO: 874313 - RNA, 21 nt, Mycobacterium avium subsp. paratuberculosis
acauggccuugaacucggcca

SEQ ID NO: 874314 - RNA, 22 nt, Mycobacterium avium subsp. paratuberculosis
acauggccuugaacucggccag

SEQ ID NO: 874315 - RNA, 21 nt, Mycobacterium avium subsp. paratuberculosis
acauggcgcagaacaccacgg

SEQ ID NO: 874316 - RNA, 16 nt, Mycobacterium avium subsp. paratuberculosis
acauggccagcaccau

SEQ ID NO: 874317 - RNA, 22 nt, Mycobacterium avium subsp. paratuberculosis
acaugcuguuccagacgucggc

SEQ ID NO: 874318 - RNA, 16 nt, Mycobacterium avium subsp. paratuberculosis
acaugcugccgccggc

SEQ ID NO: 874319 - RNA, 17 nt, Mycobacterium avium subsp. paratuberculosis
acaugcugccgccggcg

SEQ ID NO: 874320 - RNA, 18 nt, Mycobacterium avium subsp. paratuberculosis
acaugcugccgccggcga

SEQ ID NO: 874321 - RNA, 15 nt, Mycobacterium avium subsp. paratuberculosis
acauggcggccagcc

SEQ ID NO: 874322 - RNA, 14 nt, Mycobacterium avium subsp. paratuberculosis
acaucuccagcgcg

SEQ ID NO: 874323 - RNA, 16 nt, Mycobacterium avium subsp. paratuberculosis
acaucuccagcgcggu

SEQ ID NO: 874324 - RNA, 12 nt, Mycobacterium avium subsp. paratuberculosis
acaucucgacgg

SEQ ID NO: 874325 - RNA, 13 nt, Mycobacterium avium subsp. paratuberculosis
acaucucgacggu

SEQ ID NO: 874326 - RNA, 16 nt, Mycobacterium avium subsp. paratuberculosis
acaucugccgggcggc

SEQ ID NO: 874327 - RNA, 20 nt, Mycobacterium avium subsp. paratuberculosis
acaucuuggucagccgcggc

SEQ ID NO: 874328 - RNA, 21 nt, Mycobacterium avium subsp. paratuberculosis
acaucuuggucagccgcggcg

SEQ ID NO: 874329 - RNA, 14 nt, Mycobacterium avium subsp. paratuberculosis
acaugaagcccccg

SEQ ID NO: 874330 - RNA, 16 nt, Mycobacterium avium subsp. paratuberculosis
acaugaccaccgcguc

SEQ ID NO: 874331 - RNA, 15 nt, Mycobacterium avium subsp. paratuberculosis
acaugcagccgccgc

SEQ ID NO: 874332 - RNA, 17 nt, Mycobacterium avium subsp. paratuberculosis
acaugcagccgccgcgg

SEQ ID NO: 874333 - RNA, 13 nt, Mycobacterium avium subsp. paratuberculosis
acaaacagcgcgg

SEQ ID NO: 874334 - RNA, 21 nt, Mycobacterium avium subsp. paratuberculosis
acagccaaagccuacggcgcc

SEQ ID NO: 874335 - RNA, 22 nt, Mycobacterium avium subsp. paratuberculosis
acagccaaagccuacggcgccg

SEQ ID NO: 874336 - RNA, 23 nt, Mycobacterium avium subsp. paratuberculosis
acagccaaagccuacggcgccgg

SEQ ID NO: 874337 - RNA, 15 nt, Mycobacterium avium subsp. paratuberculosis
acagccacuccaucc

SEQ ID NO: 874338 - RNA, 14 nt, Mycobacterium avium subsp. paratuberculosis
acagccaccgugcc

SEQ ID NO: 874339 - RNA, 22 nt, Mycobacterium avium subsp. paratuberculosis
acagccagucgaagaccacgaa

SEQ ID NO: 874340 - RNA, 13 nt, Mycobacterium avium subsp. paratuberculosis
acagcccccgcag

SEQ ID NO: 874341 - RNA, 20 nt, Mycobacterium avium subsp. paratuberculosis
acagcccccacgcucggcgc

SEQ ID NO: 874342 - RNA, 14 nt, Mycobacterium avium subsp. paratuberculosis
acagcgcgcccgac

SEQ ID NO: 874343 - RNA, 15 nt, Mycobacterium avium subsp. paratuberculosis
acagcgcgcccgacg

SEQ ID NO: 874344 - RNA, 23 nt, Mycobacterium avium subsp. paratuberculosis
acagcgcgccgaacaccugcggc

SEQ ID NO: 874345 - RNA, 10 nt, Mycobacterium avium subsp. paratuberculosis
acagcgcgac

SEQ ID NO: 874346 - RNA, 11 nt, Mycobacterium avium subsp. paratuberculosis
acagcgcgacg

SEQ ID NO: 874347 - RNA, 22 nt, Mycobacterium avium subsp. paratuberculosis
acagcgcgacgcacgccggcgg

SEQ ID NO: 874348 - RNA, 13 nt, Mycobacterium avium subsp. paratuberculosis
acagcgcggccgg

SEQ ID NO: 874349 - RNA, 15 nt, Mycobacterium avium subsp. paratuberculosis
acagcgcgccggccg

SEQ ID NO: 874350 - RNA, 17 nt, Mycobacterium avium subsp. paratuberculosis
acagcgcgccggccggc

SEQ ID NO: 874351 - RNA, 13 nt, Mycobacterium avium subsp. paratuberculosis
acagcgucgccga

SEQ ID NO: 874352 - RNA, 14 nt, Mycobacterium avium subsp. paratuberculosis
acagcgucgccgac

SEQ ID NO: 874353 - RNA, 15 nt, Mycobacterium avium subsp. paratuberculosis
acagcgucgccgacg

SEQ ID NO: 874354 - RNA, 20 nt, Mycobacterium avium subsp. paratuberculosis
acagcgucguccaugcccgc

SEQ ID NO: 874355 - RNA, 20 nt, Mycobacterium avium subsp. paratuberculosis
acagcgucucgacggcgccg

SEQ ID NO: 874356 - RNA, 12 nt, Mycobacterium avium subsp. paratuberculosis
acagcgcgguga

SEQ ID NO: 874357 - RNA, 13 nt, Mycobacterium avium subsp. paratuberculosis
acagcgcggugau

SEQ ID NO: 874358 - RNA, 19 nt, Mycobacterium avium subsp. paratuberculosis
acagcgcggugauguuguc

SEQ ID NO: 874359 - RNA, 16 nt, Mycobacterium avium subsp. paratuberculosis
acagcgcgucggccag

SEQ ID NO: 874360 - RNA, 15 nt, Mycobacterium avium subsp. paratuberculosis
acagcucaccgggcu

SEQ ID NO: 874361 - RNA, 15 nt, Mycobacterium avium subsp. paratuberculosis
acagcguggucgcgc

SEQ ID NO: 874362 - RNA, 18 nt, Mycobacterium avium subsp. paratuberculosis
acagcguggucgcgcagc

SEQ ID NO: 874363 - RNA, 22 nt, Mycobacterium avium subsp. paratuberculosis
acagcuaggccagcagcgcggc

SEQ ID NO: 874364 - RNA, 22 nt, Mycobacterium avium subsp. paratuberculosis
acagcuaggucguggcgccgag

SEQ ID NO: 874365 - RNA, 19 nt, Mycobacterium avium subsp. paratuberculosis
acagcucgaccagccgggu

SEQ ID NO: 874366 - RNA, 21 nt, Mycobacterium avium subsp. paratuberculosis
acagcucgacgaacuccgcgc

SEQ ID NO: 874367 - RNA, 15 nt, Mycobacterium avium subsp. paratuberculosis
acagcccgaacagcu

SEQ ID NO: 874368 - RNA, 14 nt, Mycobacterium avium subsp. paratuberculosis
acagccgcaccaga

SEQ ID NO: 874369 - RNA, 13 nt, Mycobacterium avium subsp. paratuberculosis
acagccgcaccgg

SEQ ID NO: 874370 - RNA, 20 nt, Mycobacterium avium subsp. paratuberculosis
acagccgcaccggcgccgcc

SEQ ID NO: 874371 - RNA, 20 nt, Mycobacterium avium subsp. paratuberculosis
acagccgcagcagccgcgcc

SEQ ID NO: 874372 - RNA, 23 nt, Mycobacterium avium subsp. paratuberculosis
acagccgcauguugugcccgacg

SEQ ID NO: 874373 - RNA, 13 nt, Mycobacterium avium subsp. paratuberculosis
acagccgcgccga

SEQ ID NO: 874374 - RNA, 14 nt, Mycobacterium avium subsp. paratuberculosis
acagccgcgccgac

SEQ ID NO: 874375 - RNA, 22 nt, Mycobacterium avium subsp. paratuberculosis
acagccgcgccgacagaugcgg

SEQ ID NO: 874376 - RNA, 17 nt, Mycobacterium avium subsp. paratuberculosis
acagccggacgaacgag

SEQ ID NO: 874377 - RNA, 21 nt, Mycobacterium avium subsp. paratuberculosis
acagccggacgggaucggcgc

SEQ ID NO: 874378 - RNA, 22 nt, Mycobacterium avium subsp. paratuberculosis
acagccggacgggaucggcgcg

SEQ ID NO: 874379 - RNA, 23 nt, Mycobacterium avium subsp. paratuberculosis
acagccggaucagcguuccggcg

SEQ ID NO: 874380 - RNA, 17 nt, Mycobacterium avium subsp. paratuberculosis
acagccgggugaacccg

SEQ ID NO: 874381 - RNA, 21 nt, Mycobacterium avium subsp. paratuberculosis
acagccggucauaggccgcgc

SEQ ID NO: 874382 - RNA, 16 nt, Mycobacterium avium subsp. paratuberculosis
acagccggucgacgaa

SEQ ID NO: 874383 - RNA, 16 nt, Mycobacterium avium subsp. paratuberculosis
acagccggcccgagcc

SEQ ID NO: 874384 - RNA, 12 nt, Mycobacterium avium subsp. paratuberculosis
acagccggcggc

SEQ ID NO: 874385 - RNA, 15 nt, Mycobacterium avium subsp. paratuberculosis
acagccggcggcggc

SEQ ID NO: 874386 - RNA, 13 nt, Mycobacterium avium subsp. paratuberculosis
acagccggcggcu

SEQ ID NO: 874387 - RNA, 23 nt, Mycobacterium avium subsp. paratuberculosis
acagcgccagggugccccgcacc

SEQ ID NO: 874388 - RNA, 12 nt, Mycobacterium avium subsp. paratuberculosis
acagcgccagca

SEQ ID NO: 874389 - RNA, 16 nt, Mycobacterium avium subsp. paratuberculosis
acagcgccagcacggc

SEQ ID NO: 874390 - RNA, 21 nt, Mycobacterium avium subsp. paratuberculosis
acagcgcccggaugucgggcg

SEQ ID NO: 874391 - RNA, 13 nt, Mycobacterium avium subsp. paratuberculosis
acagcgccgcggc

SEQ ID NO: 874392 - RNA, 17 nt, Mycobacterium avium subsp. paratuberculosis
acagcgccgcggccagc

SEQ ID NO: 874393 - RNA, 20 nt, Mycobacterium avium subsp. paratuberculosis
acagcgccgcguugucggcg

SEQ ID NO: 874394 - RNA, 14 nt, Mycobacterium avium subsp. paratuberculosis
acagcgccggaccg

SEQ ID NO: 874395 - RNA, 20 nt, Mycobacterium avium subsp. paratuberculosis
acagcgccucgcggucgacg

SEQ ID NO: 874396 - RNA, 15 nt, Mycobacterium avium subsp. paratuberculosis
acagcgccucgucga

SEQ ID NO: 874397 - RNA, 22 nt, Mycobacterium avium subsp. paratuberculosis
acagcgccucgucgagccgggc

SEQ ID NO: 874398 - RNA, 20 nt, Mycobacterium avium subsp. paratuberculosis
acagggcggcgggcccggcg

SEQ ID NO: 874399 - RNA, 16 nt, Mycobacterium avium subsp. paratuberculosis
acagggagccgacgaa

SEQ ID NO: 874400 - RNA, 17 nt, Mycobacterium avium subsp. paratuberculosis
acagggaggacagcacc

SEQ ID NO: 874401 - RNA, 20 nt, Mycobacterium avium subsp. paratuberculosis
acagggaggacagcaccgcc

SEQ ID NO: 874402 - RNA, 14 nt, Mycobacterium avium subsp. paratuberculosis
acagggccagcgcc

SEQ ID NO: 874403 - RNA, 12 nt, Mycobacterium avium subsp. paratuberculosis
acagggccgcgc

SEQ ID NO: 874404 - RNA, 18 nt, Mycobacterium avium subsp. paratuberculosis
acagggcgacggcggcga

SEQ ID NO: 874405 - RNA, 20 nt, Mycobacterium avium subsp. paratuberculosis
acagggcgacggcggcgacg

SEQ ID NO: 874406 - RNA, 20 nt, Mycobacterium avium subsp. paratuberculosis
acagggcggcgacacgccga

SEQ ID NO: 874407 - RNA, 12 nt, Mycobacterium avium subsp. paratuberculosis
acaguaggcggc

SEQ ID NO: 874408 - RNA, 16 nt, Mycobacterium avium subsp. paratuberculosis
acagucgaccucgcgc

SEQ ID NO: 874409 - RNA, 20 nt, Mycobacterium avium subsp. paratuberculosis
acagucgaccucgcgcguca

SEQ ID NO: 874410 - RNA, 21 nt, Mycobacterium avium subsp. paratuberculosis
acagucgcgggcagccggcgc

SEQ ID NO: 874411 - RNA, 20 nt, Mycobacterium avium subsp. paratuberculosis
acagucgcgggcgagccgac

SEQ ID NO: 874412 - RNA, 13 nt, Mycobacterium avium subsp. paratuberculosis
acagucggccggc

SEQ ID NO: 874413 - RNA, 14 nt, Mycobacterium avium subsp. paratuberculosis
acagucggccggcg

SEQ ID NO: 874414 - RNA, 14 nt, Mycobacterium avium subsp. paratuberculosis
acagguagcgcagc

SEQ ID NO: 874415 - RNA, 15 nt, Mycobacterium avium subsp. paratuberculosis
acagguagcgcauca

SEQ ID NO: 874416 - RNA, 13 nt, Mycobacterium avium subsp. paratuberculosis
acagguaggcggc

SEQ ID NO: 874417 - RNA, 15 nt, Mycobacterium avium subsp. paratuberculosis
acagguaggcggcgc

SEQ ID NO: 874418 - RNA, 17 nt, Mycobacterium avium subsp. paratuberculosis
acaggcagcccggcugc

SEQ ID NO: 874419 - RNA, 22 nt, Mycobacterium avium subsp. paratuberculosis
acaggcagcccggcugcgcagc

SEQ ID NO: 874420 - RNA, 20 nt, Mycobacterium avium subsp. paratuberculosis
acaggcacucgcccagggcg

SEQ ID NO: 874421 - RNA, 18 nt, Mycobacterium avium subsp. paratuberculosis
acaggaugcagccggcca

SEQ ID NO: 874422 - RNA, 18 nt, Mycobacterium avium subsp. paratuberculosis
acaggaugcgggugaugc

SEQ ID NO: 874423 - RNA, 22 nt, Mycobacterium avium subsp. paratuberculosis
acaggaugcuggggucggccag

SEQ ID NO: 874424 - RNA, 18 nt, Mycobacterium avium subsp. paratuberculosis
acaggcuggccagcucgg

SEQ ID NO: 874425 - RNA, 20 nt, Mycobacterium avium subsp. paratuberculosis
acaggccccacgcgcucagc

SEQ ID NO: 874426 - RNA, 21 nt, Mycobacterium avium subsp. paratuberculosis
acaggccccacgcgcucagcg

SEQ ID NO: 874427 - RNA, 13 nt, Mycobacterium avium subsp. paratuberculosis
acaggcccagcgg

SEQ ID NO: 874428 - RNA, 14 nt, Mycobacterium avium subsp. paratuberculosis
acaggcccagcggc

SEQ ID NO: 874429 - RNA, 23 nt, Mycobacterium avium subsp. paratuberculosis
acaggcccacccacucggacagg

SEQ ID NO: 874430 - RNA, 22 nt, Mycobacterium avium subsp. paratuberculosis
acaggcccagcagcgcaccggc

SEQ ID NO: 874431 - RNA, 19 nt, Mycobacterium avium subsp. paratuberculosis
acaucaccaaccgcucggc

SEQ ID NO: 874432 - RNA, 20 nt, Mycobacterium avium subsp. paratuberculosis
acaucaccaccgccggggug

SEQ ID NO: 874433 - RNA, 14 nt, Mycobacterium avium subsp. paratuberculosis
acaucacccggcgg

SEQ ID NO: 874434 - RNA, 15 nt, Mycobacterium avium subsp. paratuberculosis
acaucacccggcggc

SEQ ID NO: 874435 - RNA, 16 nt, Mycobacterium avium subsp. paratuberculosis
acaucacccggcggca

SEQ ID NO: 874436 - RNA, 19 nt, Mycobacterium avium subsp. paratuberculosis
acaucacgguggccgccac

SEQ ID NO: 874437 - RNA, 20 nt, Mycobacterium avium subsp. paratuberculosis
acaucaggcccuugccccac

SEQ ID NO: 874438 - RNA, 17 nt, Mycobacterium avium subsp. paratuberculosis
acaucagaucgccgacg

SEQ ID NO: 874439 - RNA, 21 nt, Mycobacterium avium subsp. paratuberculosis
acaucagaucgccgacgacga

SEQ ID NO: 874440 - RNA, 16 nt, Mycobacterium avium subsp. paratuberculosis
acaucagcucggcggc

SEQ ID NO: 874441 - RNA, 17 nt, Mycobacterium avium subsp. paratuberculosis
acaucagcucggcggcc

SEQ ID NO: 874442 - RNA, 20 nt, Mycobacterium avium subsp. paratuberculosis
acaucagcucggcggccucg

SEQ ID NO: 874443 - RNA, 16 nt, Mycobacterium avium subsp. paratuberculosis
acagugcgcaggcggc

SEQ ID NO: 874444 - RNA, 18 nt, Mycobacterium avium subsp. paratuberculosis
acagugcgcaggcggcgc

SEQ ID NO: 874445 - RNA, 21 nt, Mycobacterium avium subsp. paratuberculosis
acagugcgcaggcggcgcgca

SEQ ID NO: 874446 - RNA, 22 nt, Mycobacterium avium subsp. paratuberculosis
acagugcgcaggcggcgcgcag

SEQ ID NO: 874447 - RNA, 13 nt, Mycobacterium avium subsp. paratuberculosis
acagugcgggcuc

SEQ ID NO: 874448 - RNA, 21 nt, Mycobacterium avium subsp. paratuberculosis
acauacgcggcggccugcgcg

SEQ ID NO: 874449 - RNA, 22 nt, Mycobacterium avium subsp. paratuberculosis
acauaccgggacaucgucgcgc

SEQ ID NO: 874450 - RNA, 19 nt, Mycobacterium avium subsp. paratuberculosis
accagcgugucgccggggc

SEQ ID NO: 874451 - RNA, 20 nt, Mycobacterium avium subsp. paratuberculosis
accagcgugucgccggggcg

SEQ ID NO: 874452 - RNA, 17 nt, Mycobacterium avium subsp. paratuberculosis
accagcguuccagcacc

SEQ ID NO: 874453 - RNA, 22 nt, Mycobacterium avium subsp. paratuberculosis
accagcguuccagcacccggcc

SEQ ID NO: 874454 - RNA, 20 nt, Mycobacterium avium subsp. paratuberculosis
accagcguucgucgccggug

SEQ ID NO: 874455 - RNA, 13 nt, Mycobacterium avium subsp. paratuberculosis
accagcgugacgc

SEQ ID NO: 874456 - RNA, 18 nt, Mycobacterium avium subsp. paratuberculosis
accagcgugcugccggac

SEQ ID NO: 874457 - RNA, 15 nt, Mycobacterium avium subsp. paratuberculosis
accagcguggccggc

SEQ ID NO: 874458 - RNA, 17 nt, Mycobacterium avium subsp. paratuberculosis
accagcguggccggcag

SEQ ID NO: 874459 - RNA, 15 nt, Mycobacterium avium subsp. paratuberculosis
accagcguggugcgc

SEQ ID NO: 874460 - RNA, 17 nt, Mycobacterium avium subsp. paratuberculosis
accagcguggugcgccc

SEQ ID NO: 874461 - RNA, 21 nt, Mycobacterium avium subsp. paratuberculosis
accagcguggugcgcccgucg

SEQ ID NO: 874462 - RNA, 16 nt, Mycobacterium avium subsp. paratuberculosis
accagcucgccgaugu

SEQ ID NO: 874463 - RNA, 15 nt, Mycobacterium avium subsp. paratuberculosis
accagcucggcgcug

SEQ ID NO: 874464 - RNA, 18 nt, Mycobacterium avium subsp. paratuberculosis
accagcucggcgcugucg

SEQ ID NO: 874465 - RNA, 19 nt, Mycobacterium avium subsp. paratuberculosis
accagcucggcgcugucgg

SEQ ID NO: 874466 - RNA, 16 nt, Mycobacterium avium subsp. paratuberculosis
accagcucgucgccga

SEQ ID NO: 874467 - RNA, 17 nt, Mycobacterium avium subsp. paratuberculosis
accagcucgucgccgac

SEQ ID NO: 874468 - RNA, 14 nt, Mycobacterium avium subsp. paratuberculosis
accagcgucgacgc

SEQ ID NO: 874469 - RNA, 19 nt, Mycobacterium avium subsp. paratuberculosis
accagcggcugcagcagau

SEQ ID NO: 874470 - RNA, 22 nt, Mycobacterium avium subsp. paratuberculosis
accagcgggccgacagcacgcc

SEQ ID NO: 874471 - RNA, 16 nt, Mycobacterium avium subsp. paratuberculosis
accagcgggcugucgg

SEQ ID NO: 874472 - RNA, 19 nt, Mycobacterium avium subsp. paratuberculosis
accagcgggcugugccggc

SEQ ID NO: 874473 - RNA, 21 nt, Mycobacterium avium subsp. paratuberculosis
accagcgggcugugccggcgg

SEQ ID NO: 874474 - RNA, 22 nt, Mycobacterium avium subsp. paratuberculosis
accagcgggcugugccggcggg

SEQ ID NO: 874475 - RNA, 23 nt, Mycobacterium avium subsp. paratuberculosis
accagcgggguguucaccgcgcc

SEQ ID NO: 874476 - RNA, 12 nt, Mycobacterium avium subsp. paratuberculosis
accagcggcagc

SEQ ID NO: 874477 - RNA, 15 nt, Mycobacterium avium subsp. paratuberculosis
accagcggcaucgcc

SEQ ID NO: 874478 - RNA, 22 nt, Mycobacterium avium subsp. paratuberculosis
accagcggaucggcggucccgu

SEQ ID NO: 874479 - RNA, 13 nt, Mycobacterium avium subsp. paratuberculosis
accagcggccgga

SEQ ID NO: 874480 - RNA, 14 nt, Mycobacterium avium subsp. paratuberculosis
accagcggccgucg

SEQ ID NO: 874481 - RNA, 12 nt, Mycobacterium avium subsp. paratuberculosis
accagcggcgcg

SEQ ID NO: 874482 - RNA, 12 nt, Mycobacterium avium subsp. paratuberculosis
accagcgcuggu

SEQ ID NO: 874483 - RNA, 21 nt, Mycobacterium avium subsp. paratuberculosis
accagcgcuuucgcgcacgcc

SEQ ID NO: 874484 - RNA, 18 nt, Mycobacterium avium subsp. paratuberculosis
accagcgcgccgcccagc

SEQ ID NO: 874485 - RNA, 22 nt, Mycobacterium avium subsp. paratuberculosis
accagcgcgccgcccagcggcc

SEQ ID NO: 874486 - RNA, 13 nt, Mycobacterium avium subsp. paratuberculosis
accagcgcgcggg

SEQ ID NO: 874487 - RNA, 14 nt, Mycobacterium avium subsp. paratuberculosis
accagcgcgccggc

SEQ ID NO: 874488 - RNA, 18 nt, Mycobacterium avium subsp. paratuberculosis
accagcgcgccggccagc

SEQ ID NO: 874489 - RNA, 12 nt, Mycobacterium avium subsp. paratuberculosis
accagcgccucg

SEQ ID NO: 874490 - RNA, 17 nt, Mycobacterium avium subsp. paratuberculosis
accagcgccucgcgggu

SEQ ID NO: 874491 - RNA, 18 nt, Mycobacterium avium subsp. paratuberculosis
accagcgccucggccugc

SEQ ID NO: 874492 - RNA, 20 nt, Mycobacterium avium subsp. paratuberculosis
accagcgcgaacagcgcggc

SEQ ID NO: 874493 - RNA, 12 nt, Mycobacterium avium subsp. paratuberculosis
accagcgcgacg

SEQ ID NO: 874494 - RNA, 15 nt, Mycobacterium avium subsp. paratuberculosis
accagcgcgacggug

SEQ ID NO: 874495 - RNA, 12 nt, Mycobacterium avium subsp. paratuberculosis
accagcgcgcac

SEQ ID NO: 874496 - RNA, 19 nt, Mycobacterium avium subsp. paratuberculosis
accagccacaccgccgcgg

SEQ ID NO: 874497 - RNA, 23 nt, Mycobacterium avium subsp. paratuberculosis
accagcccccgcgggucgucgac

SEQ ID NO: 874498 - RNA, 19 nt, Mycobacterium avium subsp. paratuberculosis
accagccccucgaccaccu

SEQ ID NO: 874499 - RNA, 21 nt, Mycobacterium avium subsp. paratuberculosis
accagccgcggacggccagcc

SEQ ID NO: 874500 - RNA, 14 nt, Mycobacterium avium subsp. paratuberculosis
accagccggccggc

SEQ ID NO: 874501 - RNA, 16 nt, Mycobacterium avium subsp. paratuberculosis
accagccggccggcga

SEQ ID NO: 874502 - RNA, 19 nt, Mycobacterium avium subsp. paratuberculosis
accagccggccggcgaagc

SEQ ID NO: 874503 - RNA, 15 nt, Mycobacterium avium subsp. paratuberculosis
accagcccgccgucg

SEQ ID NO: 874504 - RNA, 20 nt, Mycobacterium avium subsp. paratuberculosis
accagcccggcccgucgagc

SEQ ID NO: 874505 - RNA, 12 nt, Mycobacterium avium subsp. paratuberculosis
accagcccgucg

SEQ ID NO: 874506 - RNA, 14 nt, Mycobacterium avium subsp. paratuberculosis
accagcccgucggc

SEQ ID NO: 874507 - RNA, 23 nt, Mycobacterium avium subsp. paratuberculosis
accagcccgucggccuccagccg

SEQ ID NO: 874508 - RNA, 15 nt, Mycobacterium avium subsp. paratuberculosis
accagcccgucgucc

SEQ ID NO: 874509 - RNA, 22 nt, Mycobacterium avium subsp. paratuberculosis
accagccgagaucgacccgcuc

SEQ ID NO: 874510 - RNA, 16 nt, Mycobacterium avium subsp. paratuberculosis
accagccgaggcgcuc

SEQ ID NO: 874511 - RNA, 20 nt, Mycobacterium avium subsp. paratuberculosis
accagcccgaugccgccgag

SEQ ID NO: 874512 - RNA, 18 nt, Mycobacterium avium subsp. paratuberculosis
accagcgauucccgccgg

SEQ ID NO: 874513 - RNA, 16 nt, Mycobacterium avium subsp. paratuberculosis
accagcgcaaccgcgg

SEQ ID NO: 874514 - RNA, 17 nt, Mycobacterium avium subsp. paratuberculosis
accagcgcaaccgcggc

SEQ ID NO: 874515 - RNA, 18 nt, Mycobacterium avium subsp. paratuberculosis
accagcgcaaccgcggcg

SEQ ID NO: 874516 - RNA, 20 nt, Mycobacterium avium subsp. paratuberculosis
accagcgcaaccgcggcggc

SEQ ID NO: 874517 - RNA, 12 nt, Mycobacterium avium subsp. paratuberculosis
accagcgacgcc

SEQ ID NO: 874518 - RNA, 14 nt, Mycobacterium avium subsp. paratuberculosis
accagcgacgccag

SEQ ID NO: 874519 - RNA, 12 nt, Mycobacterium avium subsp. paratuberculosis
accagcgccgcg

SEQ ID NO: 874520 - RNA, 13 nt, Mycobacterium avium subsp. paratuberculosis
accagcgcccgcc

SEQ ID NO: 874521 - RNA, 14 nt, Mycobacterium avium subsp. paratuberculosis
accagcgcccgccc

SEQ ID NO: 874522 - RNA, 23 nt, Mycobacterium avium subsp. paratuberculosis
accagcgcccgcccggacacccc

SEQ ID NO: 874523 - RNA, 21 nt, Mycobacterium avium subsp. paratuberculosis
accagcgccacggguugagcc

SEQ ID NO: 874524 - RNA, 15 nt, Mycobacterium avium subsp. paratuberculosis
accacugcgccguca

SEQ ID NO: 874525 - RNA, 23 nt, Mycobacterium avium subsp. paratuberculosis
accacugcgccgucaucgacacc

SEQ ID NO: 874526 - RNA, 15 nt, Mycobacterium avium subsp. paratuberculosis
accacugcgcgcccg

SEQ ID NO: 874527 - RNA, 16 nt, Mycobacterium avium subsp. paratuberculosis
accacugcgcgcccga

SEQ ID NO: 874528 - RNA, 19 nt, Mycobacterium avium subsp. paratuberculosis
accacguugcacggcagca

SEQ ID NO: 874529 - RNA, 16 nt, Mycobacterium avium subsp. paratuberculosis
accacguugcgcccgg

SEQ ID NO: 874530 - RNA, 17 nt, Mycobacterium avium subsp. paratuberculosis
accacguugcgcggccg

SEQ ID NO: 874531 - RNA, 19 nt, Mycobacterium avium subsp. paratuberculosis
accacguugcgcggccgca

SEQ ID NO: 874532 - RNA, 22 nt, Mycobacterium avium subsp. paratuberculosis
accacguccagcugggcugcca

SEQ ID NO: 874533 - RNA, 15 nt, Mycobacterium avium subsp. paratuberculosis
accacguccccgggc

SEQ ID NO: 874534 - RNA, 18 nt, Mycobacterium avium subsp. paratuberculosis
accacguccgcggugagc

SEQ ID NO: 874535 - RNA, 14 nt, Mycobacterium avium subsp. paratuberculosis
accacgugccccuc

SEQ ID NO: 874536 - RNA, 16 nt, Mycobacterium avium subsp. paratuberculosis
accagaccggcgaagc

SEQ ID NO: 874537 - RNA, 14 nt, Mycobacterium avium subsp. paratuberculosis
accagagcgccgga

SEQ ID NO: 874538 - RNA, 18 nt, Mycobacterium avium subsp. paratuberculosis
accagagcgccggacucg

SEQ ID NO: 874539 - RNA, 13 nt, Mycobacterium avium subsp. paratuberculosis
accagaucgagcu

SEQ ID NO: 874540 - RNA, 18 nt, Mycobacterium avium subsp. paratuberculosis
accagauaggccagcgcg

SEQ ID NO: 874541 - RNA, 18 nt, Mycobacterium avium subsp. paratuberculosis
accacuuccagcaccggc

SEQ ID NO: 874542 - RNA, 12 nt, Mycobacterium avium subsp. paratuberculosis
accagcagcgcg

SEQ ID NO: 874543 - RNA, 14 nt, Mycobacterium avium subsp. paratuberculosis
accagcagcgcgac

SEQ ID NO: 874544 - RNA, 16 nt, Mycobacterium avium subsp. paratuberculosis
accagcagcgcgacgc

SEQ ID NO: 874545 - RNA, 17 nt, Mycobacterium avium subsp. paratuberculosis
accagcagcgcgacgcc

SEQ ID NO: 874546 - RNA, 18 nt, Mycobacterium avium subsp. paratuberculosis
accagcagcgcgacgccg

SEQ ID NO: 874547 - RNA, 20 nt, Mycobacterium avium subsp. paratuberculosis
accagcagcgcgacgccgac

SEQ ID NO: 874548 - RNA, 15 nt, Mycobacterium avium subsp. paratuberculosis
accagcagccgcagc

SEQ ID NO: 874549 - RNA, 17 nt, Mycobacterium avium subsp. paratuberculosis
accagcagccgcagcgc

SEQ ID NO: 874550 - RNA, 20 nt, Mycobacterium avium subsp. paratuberculosis
accagcagccgcagcgcgcg

SEQ ID NO: 874551 - RNA, 12 nt, Mycobacterium avium subsp. paratuberculosis
accagcagccgg

SEQ ID NO: 874552 - RNA, 13 nt, Mycobacterium avium subsp. paratuberculosis
accagcagccggu

SEQ ID NO: 874553 - RNA, 19 nt, Mycobacterium avium subsp. paratuberculosis
accagcagccggucgaggu

SEQ ID NO: 874554 - RNA, 18 nt, Mycobacterium avium subsp. paratuberculosis
accagcagcgagaccggc

SEQ ID NO: 874555 - RNA, 22 nt, Mycobacterium avium subsp. paratuberculosis
accagcagcgagaccggcacgg

SEQ ID NO: 874556 - RNA, 13 nt, Mycobacterium avium subsp. paratuberculosis
accagcagcgcca

SEQ ID NO: 874557 - RNA, 18 nt, Mycobacterium avium subsp. paratuberculosis
accagcaggacgcgcccg

SEQ ID NO: 874558 - RNA, 23 nt, Mycobacterium avium subsp. paratuberculosis
accagcaggacgcgcccggcgac

SEQ ID NO: 874559 - RNA, 16 nt, Mycobacterium avium subsp. paratuberculosis
accagcaggucgagca

SEQ ID NO: 874560 - RNA, 22 nt, Mycobacterium avium subsp. paratuberculosis
accagcaggucgagcaugcguc

SEQ ID NO: 874561 - RNA, 12 nt, Mycobacterium avium subsp. paratuberculosis
accagcaggucg

SEQ ID NO: 874562 - RNA, 18 nt, Mycobacterium avium subsp. paratuberculosis
accagcauggcgaucacc

SEQ ID NO: 874563 - RNA, 12 nt, Mycobacterium avium subsp. paratuberculosis
accagcacggcg

SEQ ID NO: 874564 - RNA, 19 nt, Mycobacterium avium subsp. paratuberculosis
accagcagacccgacggga

SEQ ID NO: 874565 - RNA, 20 nt, Mycobacterium avium subsp. paratuberculosis
accagcacgacaccgacgac

SEQ ID NO: 874566 - RNA, 14 nt, Mycobacterium avium subsp. paratuberculosis
accagcacggcgac

SEQ ID NO: 874567 - RNA, 17 nt, Mycobacterium avium subsp. paratuberculosis
accagcacggcggcgcu

SEQ ID NO: 874568 - RNA, 18 nt, Mycobacterium avium subsp. paratuberculosis
accagcacggcggcgcug

SEQ ID NO: 874569 - RNA, 14 nt, Mycobacterium avium subsp. paratuberculosis
accagcaccgccgc

SEQ ID NO: 874570 - RNA, 14 nt, Mycobacterium avium subsp. paratuberculosis
accagcaccccgcc

SEQ ID NO: 874571 - RNA, 16 nt, Mycobacterium avium subsp. paratuberculosis
accagcaccccgccgc

SEQ ID NO: 874572 - RNA, 19 nt, Mycobacterium avium subsp. paratuberculosis
accagcaccccgccgcagc

SEQ ID NO: 874573 - RNA, 21 nt, Mycobacterium avium subsp. paratuberculosis
accagcaccccgccgcagccc

SEQ ID NO: 874574 - RNA, 14 nt, Mycobacterium avium subsp. paratuberculosis
accagcacccgggc

SEQ ID NO: 874575 - RNA, 15 nt, Mycobacterium avium subsp. paratuberculosis
accagcaccgccgcg

SEQ ID NO: 874576 - RNA, 20 nt, Mycobacterium avium subsp. paratuberculosis
accagcaccgccgcggccgc

SEQ ID NO: 874577 - RNA, 12 nt, Mycobacterium avium subsp. paratuberculosis
accagcaccgcg

SEQ ID NO: 874578 - RNA, 13 nt, Mycobacterium avium subsp. paratuberculosis
accagcaccgcgg

SEQ ID NO: 874579 - RNA, 18 nt, Mycobacterium avium subsp. paratuberculosis
accagcaccggcaccgcc

SEQ ID NO: 874580 - RNA, 23 nt, Mycobacterium avium subsp. paratuberculosis
accagcaccggcaccgccagcca

SEQ ID NO: 874581 - RNA, 23 nt, Mycobacterium avium subsp. paratuberculosis
accagcacccagcacagcgaggc

SEQ ID NO: 874582 - RNA, 14 nt, Mycobacterium avium subsp. paratuberculosis
accagcaccaccgu

SEQ ID NO: 874583 - RNA, 16 nt, Mycobacterium avium subsp. paratuberculosis
accagaugcaccucgc

SEQ ID NO: 874584 - RNA, 17 nt, Mycobacterium avium subsp. paratuberculosis
accagaucggcgggugc

SEQ ID NO: 874585 - RNA, 18 nt, Mycobacterium avium subsp. paratuberculosis
accagaucgucgggcacc

SEQ ID NO: 874586 - RNA, 22 nt, Mycobacterium avium subsp. paratuberculosis
accagaucguguccgcgccggc

SEQ ID NO: 874587 - RNA, 23 nt, Mycobacterium avium subsp. paratuberculosis
accagauugcggcaccagucgcg

SEQ ID NO: 874588 - RNA, 23 nt, Mycobacterium avium subsp. paratuberculosis
accagcaacaccuuucggccgcg

SEQ ID NO: 874589 - RNA, 22 nt, Mycobacterium avium subsp. paratuberculosis
accaccgagccggcgucgccgc

SEQ ID NO: 874590 - RNA, 17 nt, Mycobacterium avium subsp. paratuberculosis
accaccgagccgggcag

SEQ ID NO: 874591 - RNA, 23 nt, Mycobacterium avium subsp. paratuberculosis
accaccgagccgggcagcgcgac

SEQ ID NO: 874592 - RNA, 14 nt, Mycobacterium avium subsp. paratuberculosis
accaccgagccggu

SEQ ID NO: 874593 - RNA, 18 nt, Mycobacterium avium subsp. paratuberculosis
accaccgagccggugccg

SEQ ID NO: 874594 - RNA, 14 nt, Mycobacterium avium subsp. paratuberculosis
accaccgccgccga

SEQ ID NO: 874595 - RNA, 15 nt, Mycobacterium avium subsp. paratuberculosis
accaccgccgccgac

SEQ ID NO: 874596 - RNA, 13 nt, Mycobacterium avium subsp. paratuberculosis
accaccgccgggg

SEQ ID NO: 874597 - RNA, 14 nt, Mycobacterium avium subsp. paratuberculosis
accaccgccggggu

SEQ ID NO: 874598 - RNA, 13 nt, Mycobacterium avium subsp. paratuberculosis
accaccgccguca

SEQ ID NO: 874599 - RNA, 14 nt, Mycobacterium avium subsp. paratuberculosis
accaccgccucgac

SEQ ID NO: 874600 - RNA, 15 nt, Mycobacterium avium subsp. paratuberculosis
accaccgcggugagc

SEQ ID NO: 874601 - RNA, 12 nt, Mycobacterium avium subsp. paratuberculosis
accaccgcgccc

SEQ ID NO: 874602 - RNA, 18 nt, Mycobacterium avium subsp. paratuberculosis
accaccgcgccgucgucg

SEQ ID NO: 874603 - RNA, 13 nt, Mycobacterium avium subsp. paratuberculosis
accaccgcgcgca

SEQ ID NO: 874604 - RNA, 13 nt, Mycobacterium avium subsp. paratuberculosis
accaccgcgcugc

SEQ ID NO: 874605 - RNA, 13 nt, Mycobacterium avium subsp. paratuberculosis
accaccgcggcgc

SEQ ID NO: 874606 - RNA, 14 nt, Mycobacterium avium subsp. paratuberculosis
accaccgcggcgcc

SEQ ID NO: 874607 - RNA, 21 nt, Mycobacterium avium subsp. paratuberculosis
accaccgcuguggacaggucg

SEQ ID NO: 874608 - RNA, 18 nt, Mycobacterium avium subsp. paratuberculosis
accaccggagcggcggua

SEQ ID NO: 874609 - RNA, 21 nt, Mycobacterium avium subsp. paratuberculosis
accaccggcaaccgccacgac

SEQ ID NO: 874610 - RNA, 12 nt, Mycobacterium avium subsp. paratuberculosis
accaccggcacc

SEQ ID NO: 874611 - RNA, 14 nt, Mycobacterium avium subsp. paratuberculosis
accaccggccgccc

SEQ ID NO: 874612 - RNA, 13 nt, Mycobacterium avium subsp. paratuberculosis
accaccggccgcg

SEQ ID NO: 874613 - RNA, 12 nt, Mycobacterium avium subsp. paratuberculosis
accacccaggcc

SEQ ID NO: 874614 - RNA, 17 nt, Mycobacterium avium subsp. paratuberculosis
accacccaggccacccg

SEQ ID NO: 874615 - RNA, 13 nt, Mycobacterium avium subsp. paratuberculosis
accacccagcccu

SEQ ID NO: 874616 - RNA, 21 nt, Mycobacterium avium subsp. paratuberculosis
accaccaggagcaccugcgcg

SEQ ID NO: 874617 - RNA, 23 nt, Mycobacterium avium subsp. paratuberculosis
accaccaggagcaccugcgcgac

SEQ ID NO: 874618 - RNA, 14 nt, Mycobacterium avium subsp. paratuberculosis
accaccaggcccac

SEQ ID NO: 874619 - RNA, 15 nt, Mycobacterium avium subsp. paratuberculosis
accaccagucggcgc

SEQ ID NO: 874620 - RNA, 17 nt, Mycobacterium avium subsp. paratuberculosis
accaccagucggcgcgu

SEQ ID NO: 874621 - RNA, 17 nt, Mycobacterium avium subsp. paratuberculosis
accaccaguuccaccag

SEQ ID NO: 874622 - RNA, 16 nt, Mycobacterium avium subsp. paratuberculosis
accaccgacgcgucgc

SEQ ID NO: 874623 - RNA, 12 nt, Mycobacterium avium subsp. paratuberculosis
accacccggcgg

SEQ ID NO: 874624 - RNA, 16 nt, Mycobacterium avium subsp. paratuberculosis
accacccggucgacga

SEQ ID NO: 874625 - RNA, 16 nt, Mycobacterium avium subsp. paratuberculosis
accacccucggucagg

SEQ ID NO: 874626 - RNA, 14 nt, Mycobacterium avium subsp. paratuberculosis
accacccgcagcga

SEQ ID NO: 874627 - RNA, 16 nt, Mycobacterium avium subsp. paratuberculosis
accacccgcagcgcgg

SEQ ID NO: 874628 - RNA, 14 nt, Mycobacterium avium subsp. paratuberculosis
accacccgcagcuc

SEQ ID NO: 874629 - RNA, 14 nt, Mycobacterium avium subsp. paratuberculosis
accacccgcggccg

SEQ ID NO: 874630 - RNA, 16 nt, Mycobacterium avium subsp. paratuberculosis
accacccgcggccggc

SEQ ID NO: 874631 - RNA, 21 nt, Mycobacterium avium subsp. paratuberculosis
accacccggacgaugacccag

SEQ ID NO: 874632 - RNA, 22 nt, Mycobacterium avium subsp. paratuberculosis
accacccccagcccgccgggcu

SEQ ID NO: 874633 - RNA, 23 nt, Mycobacterium avium subsp. paratuberculosis
accacccccgacccgaagcccau

SEQ ID NO: 874634 - RNA, 15 nt, Mycobacterium avium subsp. paratuberculosis
accaccccggugccg

SEQ ID NO: 874635 - RNA, 22 nt, Mycobacterium avium subsp. paratuberculosis
accacccgcaccucgcccggcu

SEQ ID NO: 874636 - RNA, 17 nt, Mycobacterium avium subsp. paratuberculosis
accaccaacagcagcga

SEQ ID NO: 874637 - RNA, 16 nt, Mycobacterium avium subsp. paratuberculosis
accaccacacccagcg

SEQ ID NO: 874638 - RNA, 19 nt, Mycobacterium avium subsp. paratuberculosis
accaccacacccagcgcca

SEQ ID NO: 874639 - RNA, 14 nt, Mycobacterium avium subsp. paratuberculosis
accaccacacccgc

SEQ ID NO: 874640 - RNA, 18 nt, Mycobacterium avium subsp. paratuberculosis
accacauuggcgaccgcg

SEQ ID NO: 874641 - RNA, 19 nt, Mycobacterium avium subsp. paratuberculosis
accacauuggcgaccgcgg

SEQ ID NO: 874642 - RNA, 22 nt, Mycobacterium avium subsp. paratuberculosis
accacauuggcgaccgcggccg

SEQ ID NO: 874643 - RNA, 23 nt, Mycobacterium avium subsp. paratuberculosis
accacauuggcgaccgcggccgc

SEQ ID NO: 874644 - RNA, 13 nt, Mycobacterium avium subsp. paratuberculosis
accaccaccgagc

SEQ ID NO: 874645 - RNA, 14 nt, Mycobacterium avium subsp. paratuberculosis
accaccaccgagcc

SEQ ID NO: 874646 - RNA, 12 nt, Mycobacterium avium subsp. paratuberculosis
accaccaccgcc

SEQ ID NO: 874647 - RNA, 15 nt, Mycobacterium avium subsp. paratuberculosis
accaccaccagucgg

SEQ ID NO: 874648 - RNA, 18 nt, Mycobacterium avium subsp. paratuberculosis
accacaucggauucgucg

SEQ ID NO: 874649 - RNA, 24 nt, Mycobacterium avium subsp. paratuberculosis
accacaucgguugcuccggcgucg

SEQ ID NO: 874650 - RNA, 19 nt, Mycobacterium avium subsp. paratuberculosis
accacauucccgccgccgc

SEQ ID NO: 874651 - RNA, 14 nt, Mycobacterium avium subsp. paratuberculosis
accaccacgaccag

SEQ ID NO: 874652 - RNA, 15 nt, Mycobacterium avium subsp. paratuberculosis
accaccacgaccagu

SEQ ID NO: 874653 - RNA, 15 nt, Mycobacterium avium subsp. paratuberculosis
accaccaccgccguc

SEQ ID NO: 874654 - RNA, 15 nt, Mycobacterium avium subsp. paratuberculosis
accaccacggccgca

SEQ ID NO: 874655 - RNA, 17 nt, Mycobacterium avium subsp. paratuberculosis
accaccacggccgccga

SEQ ID NO: 874656 - RNA, 20 nt, Mycobacterium avium subsp. paratuberculosis
accaccacggccgccgaggc

SEQ ID NO: 874657 - RNA, 21 nt, Mycobacterium avium subsp. paratuberculosis
accaccacguugcacggcagc

SEQ ID NO: 874658 - RNA, 16 nt, Mycobacterium avium subsp. paratuberculosis
accaccagcguguggc

SEQ ID NO: 874659 - RNA, 21 nt, Mycobacterium avium subsp. paratuberculosis
accaccagcguguggcccugc

SEQ ID NO: 874660 - RNA, 17 nt, Mycobacterium avium subsp. paratuberculosis
accaccagcucgucgcc

SEQ ID NO: 874661 - RNA, 20 nt, Mycobacterium avium subsp. paratuberculosis
accaccagcucgucgccgac

SEQ ID NO: 874662 - RNA, 13 nt, Mycobacterium avium subsp. paratuberculosis
accaccacggcca

SEQ ID NO: 874663 - RNA, 14 nt, Mycobacterium avium subsp. paratuberculosis
accaccacggccag

SEQ ID NO: 874664 - RNA, 18 nt, Mycobacterium avium subsp. paratuberculosis
accaaugcccugaccccg

SEQ ID NO: 874665 - RNA, 14 nt, Mycobacterium avium subsp. paratuberculosis
accaaugcgccggc

SEQ ID NO: 874666 - RNA, 15 nt, Mycobacterium avium subsp. paratuberculosis
accaaugcgccggcg

SEQ ID NO: 874667 - RNA, 18 nt, Mycobacterium avium subsp. paratuberculosis
accaaugcgccggcggcc

SEQ ID NO: 874668 - RNA, 20 nt, Mycobacterium avium subsp. paratuberculosis
accaaugcgccggcggccgc

SEQ ID NO: 874669 - RNA, 13 nt, Mycobacterium avium subsp. paratuberculosis
accacaccggcgc

SEQ ID NO: 874670 - RNA, 14 nt, Mycobacterium avium subsp. paratuberculosis
accacaccggcgcu

SEQ ID NO: 874671 - RNA, 15 nt, Mycobacterium avium subsp. paratuberculosis
accacaccggcgcug

SEQ ID NO: 874672 - RNA, 16 nt, Mycobacterium avium subsp. paratuberculosis
accacaccgucgacga

SEQ ID NO: 874673 - RNA, 15 nt, Mycobacterium avium subsp. paratuberculosis
accacacccagcgcc

SEQ ID NO: 874674 - RNA, 14 nt, Mycobacterium avium subsp. paratuberculosis
accacaccccggcc

SEQ ID NO: 874675 - RNA, 17 nt, Mycobacterium avium subsp. paratuberculosis
accacacccgcggccgc

SEQ ID NO: 874676 - RNA, 13 nt, Mycobacterium avium subsp. paratuberculosis
accacagcgccuc

SEQ ID NO: 874677 - RNA, 12 nt, Mycobacterium avium subsp. paratuberculosis
accacagcggcg

SEQ ID NO: 874678 - RNA, 14 nt, Mycobacterium avium subsp. paratuberculosis
accacagcggcgca

SEQ ID NO: 874679 - RNA, 21 nt, Mycobacterium avium subsp. paratuberculosis
accacagcggcgcaugaccga

SEQ ID NO: 874680 - RNA, 13 nt, Mycobacterium avium subsp. paratuberculosis
accacaccgccgg

SEQ ID NO: 874681 - RNA, 19 nt, Mycobacterium avium subsp. paratuberculosis
accacagcugcuggcugcg

SEQ ID NO: 874682 - RNA, 21 nt, Mycobacterium avium subsp. paratuberculosis
accacagcugcuggcugcggc

SEQ ID NO: 874683 - RNA, 14 nt, Mycobacterium avium subsp. paratuberculosis
accacgcggcggcg

SEQ ID NO: 874684 - RNA, 18 nt, Mycobacterium avium subsp. paratuberculosis
accacgcgaucagguccg

SEQ ID NO: 874685 - RNA, 15 nt, Mycobacterium avium subsp. paratuberculosis
accacgccgcggucg

SEQ ID NO: 874686 - RNA, 12 nt, Mycobacterium avium subsp. paratuberculosis
accacgccgucg

SEQ ID NO: 874687 - RNA, 12 nt, Mycobacterium avium subsp. paratuberculosis
accacgccgacg

SEQ ID NO: 874688 - RNA, 14 nt, Mycobacterium avium subsp. paratuberculosis
accacggcaccgcc

SEQ ID NO: 874689 - RNA, 17 nt, Mycobacterium avium subsp. paratuberculosis
accacggcaccgccgcg

SEQ ID NO: 874690 - RNA, 19 nt, Mycobacterium avium subsp. paratuberculosis
accacggcaccgccgcgcg

SEQ ID NO: 874691 - RNA, 24 nt, Mycobacterium avium subsp. paratuberculosis
accacggccaggaagccggcgacg

SEQ ID NO: 874692 - RNA, 12 nt, Mycobacterium avium subsp. paratuberculosis
accacggccaug

SEQ ID NO: 874693 - RNA, 13 nt, Mycobacterium avium subsp. paratuberculosis
accacggccaugc

SEQ ID NO: 874694 - RNA, 14 nt, Mycobacterium avium subsp. paratuberculosis
accacggccccagc

SEQ ID NO: 874695 - RNA, 17 nt, Mycobacterium avium subsp. paratuberculosis
accacggccccagccgc

SEQ ID NO: 874696 - RNA, 18 nt, Mycobacterium avium subsp. paratuberculosis
accacggccccagccgcc

SEQ ID NO: 874697 - RNA, 20 nt, Mycobacterium avium subsp. paratuberculosis
accacggccccagccgccgc

SEQ ID NO: 874698 - RNA, 21 nt, Mycobacterium avium subsp. paratuberculosis
accacggccccagccgccgcg

SEQ ID NO: 874699 - RNA, 14 nt, Mycobacterium avium subsp. paratuberculosis
accacggccgcagc

SEQ ID NO: 874700 - RNA, 18 nt, Mycobacterium avium subsp. paratuberculosis
accacggccgcagcggca

SEQ ID NO: 874701 - RNA, 19 nt, Mycobacterium avium subsp. paratuberculosis
accacggccgcagcggcag

SEQ ID NO: 874702 - RNA, 15 nt, Mycobacterium avium subsp. paratuberculosis
accacggccgccgag

SEQ ID NO: 874703 - RNA, 21 nt, Mycobacterium avium subsp. paratuberculosis
accacgcugagcaaccgccga

SEQ ID NO: 874704 - RNA, 15 nt, Mycobacterium avium subsp. paratuberculosis
accacggagcgcccg

SEQ ID NO: 874705 - RNA, 16 nt, Mycobacterium avium subsp. paratuberculosis
accacggagcgcccgg

SEQ ID NO: 874706 - RNA, 20 nt, Mycobacterium avium subsp. paratuberculosis
accacggagcgcccggccag

SEQ ID NO: 874707 - RNA, 13 nt, Mycobacterium avium subsp. paratuberculosis
accacggccggca

SEQ ID NO: 874708 - RNA, 14 nt, Mycobacterium avium subsp. paratuberculosis
accacggccggcaa

SEQ ID NO: 874709 - RNA, 12 nt, Mycobacterium avium subsp. paratuberculosis
accacggcggca

SEQ ID NO: 874710 - RNA, 20 nt, Mycobacterium avium subsp. paratuberculosis
accacgggucggucggcccg

SEQ ID NO: 874711 - RNA, 22 nt, Mycobacterium avium subsp. paratuberculosis
accacgggucggucggcccgcu

SEQ ID NO: 874712 - RNA, 20 nt, Mycobacterium avium subsp. paratuberculosis
accacggucacagccgcgau

SEQ ID NO: 874713 - RNA, 17 nt, Mycobacterium avium subsp. paratuberculosis
accacggucaccccgag

SEQ ID NO: 874714 - RNA, 15 nt, Mycobacterium avium subsp. paratuberculosis
accacgguccccgcg

SEQ ID NO: 874715 - RNA, 22 nt, Mycobacterium avium subsp. paratuberculosis
accacgguccccgcgcccgccg

SEQ ID NO: 874716 - RNA, 14 nt, Mycobacterium avium subsp. paratuberculosis
accacggucgccgc

SEQ ID NO: 874717 - RNA, 16 nt, Mycobacterium avium subsp. paratuberculosis
accacggucgccgcgc

SEQ ID NO: 874718 - RNA, 17 nt, Mycobacterium avium subsp. paratuberculosis
accacggucgccgcgcc

SEQ ID NO: 874719 - RNA, 19 nt, Mycobacterium avium subsp. paratuberculosis
accacggucgccgcgccgc

SEQ ID NO: 874720 - RNA, 14 nt, Mycobacterium avium subsp. paratuberculosis
accacggucggcgg

SEQ ID NO: 874721 - RNA, 15 nt, Mycobacterium avium subsp. paratuberculosis
accacggucggcggg

SEQ ID NO: 874722 - RNA, 16 nt, Mycobacterium avium subsp. paratuberculosis
accacggucggcgggu

SEQ ID NO: 874723 - RNA, 15 nt, Mycobacterium avium subsp. paratuberculosis
accacggcgcccucg

SEQ ID NO: 874724 - RNA, 14 nt, Mycobacterium avium subsp. paratuberculosis
accacgguggccgc

SEQ ID NO: 874725 - RNA, 12 nt, Mycobacterium avium subsp. paratuberculosis
accacgguggcg

SEQ ID NO: 874726 - RNA, 16 nt, Mycobacterium avium subsp. paratuberculosis
accacgguggcgccgc

SEQ ID NO: 874727 - RNA, 18 nt, Mycobacterium avium subsp. paratuberculosis
accacgguggcgccgcgc

SEQ ID NO: 874728 - RNA, 22 nt, Mycobacterium avium subsp. paratuberculosis
accacgguggcguccagcgggu

SEQ ID NO: 874729 - RNA, 15 nt, Mycobacterium avium subsp. paratuberculosis
accacgguguagcgg

SEQ ID NO: 874730 - RNA, 20 nt, Mycobacterium avium subsp. paratuberculosis
accacgguguagcggcggcu

SEQ ID NO: 874731 - RNA, 21 nt, Mycobacterium avium subsp. paratuberculosis
accacgucggguucgccggug

SEQ ID NO: 874732 - RNA, 13 nt, Mycobacterium avium subsp. paratuberculosis
accacgucggugc

SEQ ID NO: 874733 - RNA, 16 nt, Mycobacterium avium subsp. paratuberculosis
accacgucggugccgc

SEQ ID NO: 874734 - RNA, 18 nt, Mycobacterium avium subsp. paratuberculosis
accacgucggugccgcgu

SEQ ID NO: 874735 - RNA, 18 nt, Mycobacterium avium subsp. paratuberculosis
accacguacuccugcgcg

SEQ ID NO: 874736 - RNA, 14 nt, Mycobacterium avium subsp. paratuberculosis
accacguagccgac

SEQ ID NO: 874737 - RNA, 15 nt, Mycobacterium avium subsp. paratuberculosis
accacguagccgacc

SEQ ID NO: 874738 - RNA, 16 nt, Mycobacterium avium subsp. paratuberculosis
accacguagccgaccu

SEQ ID NO: 874739 - RNA, 21 nt, Mycobacterium avium subsp. paratuberculosis
accacguaggcgaucagcgcg

SEQ ID NO: 874740 - RNA, 20 nt, Mycobacterium avium subsp. paratuberculosis
accacgcccgacgacgacgu

SEQ ID NO: 874741 - RNA, 15 nt, Mycobacterium avium subsp. paratuberculosis
accacgcacaccacc

SEQ ID NO: 874742 - RNA, 16 nt, Mycobacterium avium subsp. paratuberculosis
accacgaugaagccgu

SEQ ID NO: 874743 - RNA, 18 nt, Mycobacterium avium subsp. paratuberculosis
accacgaugaagccgugc

SEQ ID NO: 874744 - RNA, 20 nt, Mycobacterium avium subsp. paratuberculosis
accacgaggcugugggccag

SEQ ID NO: 874745 - RNA, 14 nt, Mycobacterium avium subsp. paratuberculosis
accacgagcagccg

SEQ ID NO: 874746 - RNA, 16 nt, Mycobacterium avium subsp. paratuberculosis
accacgagcagccgau

SEQ ID NO: 874747 - RNA, 17 nt, Mycobacterium avium subsp. paratuberculosis
accacgaucagcgcguc

SEQ ID NO: 874748 - RNA, 18 nt, Mycobacterium avium subsp. paratuberculosis
accacgaucagcgcgucg

SEQ ID NO: 874749 - RNA, 24 nt, Mycobacterium avium subsp. paratuberculosis
accacgaucagcgcgucgaggucg

SEQ ID NO: 874750 - RNA, 16 nt, Mycobacterium avium subsp. paratuberculosis
accacgacgccgggcg

SEQ ID NO: 874751 - RNA, 17 nt, Mycobacterium avium subsp. paratuberculosis
accacgacgccgggcgc

SEQ ID NO: 874752 - RNA, 20 nt, Mycobacterium avium subsp. paratuberculosis
accaccuucaucgccgucgc

SEQ ID NO: 874753 - RNA, 20 nt, Mycobacterium avium subsp. paratuberculosis
accacgaccuccgugccgau

SEQ ID NO: 874754 - RNA, 14 nt, Mycobacterium avium subsp. paratuberculosis
accacgaagcgggc

SEQ ID NO: 874755 - RNA, 17 nt, Mycobacterium avium subsp. paratuberculosis
accacgaagcgggcggc

SEQ ID NO: 874756 - RNA, 19 nt, Mycobacterium avium subsp. paratuberculosis
accacgaagcgggcggcga

SEQ ID NO: 874757 - RNA, 18 nt, Mycobacterium avium subsp. paratuberculosis
accacgaagggcgccagc

SEQ ID NO: 874758 - RNA, 23 nt, Mycobacterium avium subsp. paratuberculosis
accacgaagggcgccagcaccuc

SEQ ID NO: 874759 - RNA, 19 nt, Mycobacterium avium subsp. paratuberculosis
accacgaccagugcccggc

SEQ ID NO: 874760 - RNA, 21 nt, Mycobacterium avium subsp. paratuberculosis
accacgaccagugcccggcca

SEQ ID NO: 874761 - RNA, 23 nt, Mycobacterium avium subsp. paratuberculosis
accaccuugcgcagcagcagguc

SEQ ID NO: 874762 - RNA, 17 nt, Mycobacterium avium subsp. paratuberculosis
accaccuuggccggugc

SEQ ID NO: 874763 - RNA, 20 nt, Mycobacterium avium subsp. paratuberculosis
accaccuuggccggugcgcc

SEQ ID NO: 874764 - RNA, 22 nt, Mycobacterium avium subsp. paratuberculosis
accaccuuggccggugcgccga

SEQ ID NO: 874765 - RNA, 23 nt, Mycobacterium avium subsp. paratuberculosis
accaccuuggccggugcgccgac

SEQ ID NO: 874766 - RNA, 19 nt, Mycobacterium avium subsp. paratuberculosis
accaccuugguggccgcgg

SEQ ID NO: 874767 - RNA, 20 nt, Mycobacterium avium subsp. paratuberculosis
accaccuugguggccgcggc

SEQ ID NO: 874768 - RNA, 16 nt, Mycobacterium avium subsp. paratuberculosis
accaccuugucaccga

SEQ ID NO: 874769 - RNA, 17 nt, Mycobacterium avium subsp. paratuberculosis
accaccuugucaccgaa

SEQ ID NO: 874770 - RNA, 16 nt, Mycobacterium avium subsp. paratuberculosis
accacgaacaccggcg

SEQ ID NO: 874771 - RNA, 17 nt, Mycobacterium avium subsp. paratuberculosis
accacgaaccaggcgcc

SEQ ID NO: 874772 - RNA, 22 nt, Mycobacterium avium subsp. paratuberculosis
accacgaaccaggcgccggcca

SEQ ID NO: 874773 - RNA, 23 nt, Mycobacterium avium subsp. paratuberculosis
accacgaaccaggcgccggccag

SEQ ID NO: 874774 - RNA, 16 nt, Mycobacterium avium subsp. paratuberculosis
accacgaacgcgccgc

SEQ ID NO: 874775 - RNA, 17 nt, Mycobacterium avium subsp. paratuberculosis
accacgaacgcgccgcc

SEQ ID NO: 874776 - RNA, 16 nt, Mycobacterium avium subsp. paratuberculosis
accacgaacucccccg

SEQ ID NO: 874777 - RNA, 17 nt, Mycobacterium avium subsp. paratuberculosis
accaccugggcgucguc

SEQ ID NO: 874778 - RNA, 15 nt, Mycobacterium avium subsp. paratuberculosis
accaccuggccggcc

SEQ ID NO: 874779 - RNA, 15 nt, Mycobacterium avium subsp. paratuberculosis
accaccugaccgcgg

SEQ ID NO: 874780 - RNA, 23 nt, Mycobacterium avium subsp. paratuberculosis
accaccugcacggggacgucguc

SEQ ID NO: 874781 - RNA, 22 nt, Mycobacterium avium subsp. paratuberculosis
accaccugccgcaacgggccgc

SEQ ID NO: 874782 - RNA, 13 nt, Mycobacterium avium subsp. paratuberculosis
accaccuccccgc

SEQ ID NO: 874783 - RNA, 14 nt, Mycobacterium avium subsp. paratuberculosis
accaccuccccgcg

SEQ ID NO: 874784 - RNA, 19 nt, Mycobacterium avium subsp. paratuberculosis
accaccucgcgcggggcgg

SEQ ID NO: 874785 - RNA, 13 nt, Mycobacterium avium subsp. paratuberculosis
accaccucggcga

SEQ ID NO: 874786 - RNA, 17 nt, Mycobacterium avium subsp. paratuberculosis
accaccucggcgacgau

SEQ ID NO: 874787 - RNA, 14 nt, Mycobacterium avium subsp. paratuberculosis
accaccucggcgau

SEQ ID NO: 874788 - RNA, 20 nt, Mycobacterium avium subsp. paratuberculosis
accaccucgguggacgccgc

SEQ ID NO: 874789 - RNA, 21 nt, Mycobacterium avium subsp. paratuberculosis
accaccggguagcccgcgugc

SEQ ID NO: 874790 - RNA, 15 nt, Mycobacterium avium subsp. paratuberculosis
accaccgggucgucg

SEQ ID NO: 874791 - RNA, 21 nt, Mycobacterium avium subsp. paratuberculosis
accaccggugacgaccggcag

SEQ ID NO: 874792 - RNA, 19 nt, Mycobacterium avium subsp. paratuberculosis
accaccgucuugccguuga

SEQ ID NO: 874793 - RNA, 17 nt, Mycobacterium avium subsp. paratuberculosis
accaccgugccgucgcg

SEQ ID NO: 874794 - RNA, 16 nt, Mycobacterium avium subsp. paratuberculosis
accaccguggccccag

SEQ ID NO: 874795 - RNA, 17 nt, Mycobacterium avium subsp. paratuberculosis
accaccguggccccagc

SEQ ID NO: 874796 - RNA, 18 nt, Mycobacterium avium subsp. paratuberculosis
accaccguggccccagcc

SEQ ID NO: 874797 - RNA, 15 nt, Mycobacterium avium subsp. paratuberculosis
accaccucaccugcg

SEQ ID NO: 874798 - RNA, 17 nt, Mycobacterium avium subsp. paratuberculosis
aauagccgcgccgcggu

SEQ ID NO: 874799 - RNA, 16 nt, Mycobacterium avium subsp. paratuberculosis
aauagccgucggcggc

SEQ ID NO: 874800 - RNA, 21 nt, Mycobacterium avium subsp. paratuberculosis
aauccaaggagaaggccgcgc

SEQ ID NO: 874801 - RNA, 14 nt, Mycobacterium avium subsp. paratuberculosis
aaucgggacgccac

SEQ ID NO: 874802 - RNA, 15 nt, Mycobacterium avium subsp. paratuberculosis
aaucgguucggccag

SEQ ID NO: 874803 - RNA, 16 nt, Mycobacterium avium subsp. paratuberculosis
aaucggacccagcccg

SEQ ID NO: 874804 - RNA, 19 nt, Mycobacterium avium subsp. paratuberculosis
aaucgcugcgagcccggcc

SEQ ID NO: 874805 - RNA, 15 nt, Mycobacterium avium subsp. paratuberculosis
aaucguugagcacca

SEQ ID NO: 874806 - RNA, 16 nt, Mycobacterium avium subsp. paratuberculosis
aaucgucgggcaccag

SEQ ID NO: 874807 - RNA, 21 nt, Mycobacterium avium subsp. paratuberculosis
aaucgaccggguuggcgcgca

SEQ ID NO: 874808 - RNA, 15 nt, Mycobacterium avium subsp. paratuberculosis
aaucgagggcgcgca

SEQ ID NO: 874809 - RNA, 18 nt, Mycobacterium avium subsp. paratuberculosis
aaucgacaccgcacggcc

SEQ ID NO: 874810 - RNA, 12 nt, Mycobacterium avium subsp. paratuberculosis
aauccuggccga

SEQ ID NO: 874811 - RNA, 14 nt, Mycobacterium avium subsp. paratuberculosis
aauccucgccgagc

SEQ ID NO: 874812 - RNA, 17 nt, Mycobacterium avium subsp. paratuberculosis
aauccucgccgagcaga

SEQ ID NO: 874813 - RNA, 11 nt, Mycobacterium avium subsp. paratuberculosis
aauccggcggc

SEQ ID NO: 874814 - RNA, 20 nt, Mycobacterium avium subsp. paratuberculosis
aauccggccggagaccgccg

SEQ ID NO: 874815 - RNA, 15 nt, Mycobacterium avium subsp. paratuberculosis
aauccgggugucgac

SEQ ID NO: 874816 - RNA, 14 nt, Mycobacterium avium subsp. paratuberculosis
aauugaacgccgcc

SEQ ID NO: 874817 - RNA, 18 nt, Mycobacterium avium subsp. paratuberculosis
aauucuguugucggcucg

SEQ ID NO: 874818 - RNA, 19 nt, Mycobacterium avium subsp. paratuberculosis
aaugucgcgcagcauccgc

SEQ ID NO: 874819 - RNA, 21 nt, Mycobacterium avium subsp. paratuberculosis
aaugucgcgcagcauccgcac

SEQ ID NO: 874820 - RNA, 23 nt, Mycobacterium avium subsp. paratuberculosis
aaugucgcccuggauauccagcc

SEQ ID NO: 874821 - RNA, 18 nt, Mycobacterium avium subsp. paratuberculosis
aaugauggucagccgcac

SEQ ID NO: 874822 - RNA, 13 nt, Mycobacterium avium subsp. paratuberculosis
aaugccgccgcga

SEQ ID NO: 874823 - RNA, 16 nt, Mycobacterium avium subsp. paratuberculosis
aaugucgaccaccggg

SEQ ID NO: 874824 - RNA, 16 nt, Mycobacterium avium subsp. paratuberculosis
aaugccgugccagccg

SEQ ID NO: 874825 - RNA, 20 nt, Mycobacterium avium subsp. paratuberculosis
aaugccgugccagccggccg

SEQ ID NO: 874826 - RNA, 21 nt, Mycobacterium avium subsp. paratuberculosis
aaugccgugccagccggccgc

SEQ ID NO: 874827 - RNA, 16 nt, Mycobacterium avium subsp. paratuberculosis
aaugccuuggcggcgu

SEQ ID NO: 874828 - RNA, 17 nt, Mycobacterium avium subsp. paratuberculosis
aaugccuuggcggcgug

SEQ ID NO: 874829 - RNA, 13 nt, Mycobacterium avium subsp. paratuberculosis
aauaacgccggcc

SEQ ID NO: 874830 - RNA, 18 nt, Mycobacterium avium subsp. paratuberculosis
aagucgaucccgggugcg

SEQ ID NO: 874831 - RNA, 15 nt, Mycobacterium avium subsp. paratuberculosis
aagucgaugccgccc

SEQ ID NO: 874832 - RNA, 14 nt, Mycobacterium avium subsp. paratuberculosis
aagucgaccggggc

SEQ ID NO: 874833 - RNA, 12 nt, Mycobacterium avium subsp. paratuberculosis
aagucgagcagg

SEQ ID NO: 874834 - RNA, 14 nt, Mycobacterium avium subsp. paratuberculosis
aagucagcgcguga

SEQ ID NO: 874835 - RNA, 19 nt, Mycobacterium avium subsp. paratuberculosis
aaguccgaaacaucaaacg

SEQ ID NO: 874836 - RNA, 21 nt, Mycobacterium avium subsp. paratuberculosis
aaguccggcggucgcugcagc

SEQ ID NO: 874837 - RNA, 13 nt, Mycobacterium avium subsp. paratuberculosis
aauaccgccggcc

SEQ ID NO: 874838 - RNA, 14 nt, Mycobacterium avium subsp. paratuberculosis
aauaccgccggccg

SEQ ID NO: 874839 - RNA, 17 nt, Mycobacterium avium subsp. paratuberculosis
aauaccgccggccgcgc

SEQ ID NO: 874840 - RNA, 22 nt, Mycobacterium avium subsp. paratuberculosis
aagggcuccccggacagccacu

SEQ ID NO: 874841 - RNA, 23 nt, Mycobacterium avium subsp. paratuberculosis
aagggcuugggcgcgaucggcag

SEQ ID NO: 874842 - RNA, 16 nt, Mycobacterium avium subsp. paratuberculosis
aagggcuuuagaaggc

SEQ ID NO: 874843 - RNA, 19 nt, Mycobacterium avium subsp. paratuberculosis
aagggcuuuagaaggccgc

SEQ ID NO: 874844 - RNA, 20 nt, Mycobacterium avium subsp. paratuberculosis
aaggggucguaccaccacca

SEQ ID NO: 874845 - RNA, 12 nt, Mycobacterium avium subsp. paratuberculosis
aaggguuuugcg

SEQ ID NO: 874846 - RNA, 18 nt, Mycobacterium avium subsp. paratuberculosis
aaggacuccaguugacgg

SEQ ID NO: 874847 - RNA, 21 nt, Mycobacterium avium subsp. paratuberculosis
aaggacuggcccacgcagccg

SEQ ID NO: 874848 - RNA, 16 nt, Mycobacterium avium subsp. paratuberculosis
aaggacgucaggccgg

SEQ ID NO: 874849 - RNA, 14 nt, Mycobacterium avium subsp. paratuberculosis
aagcugucgccgag

SEQ ID NO: 874850 - RNA, 20 nt, Mycobacterium avium subsp. paratuberculosis
aagggccccggcaucgacau

SEQ ID NO: 874851 - RNA, 19 nt, Mycobacterium avium subsp. paratuberculosis
aaggcggccaccgcggcca

SEQ ID NO: 874852 - RNA, 14 nt, Mycobacterium avium subsp. paratuberculosis
aaggcggccgcgaa

SEQ ID NO: 874853 - RNA, 14 nt, Mycobacterium avium subsp. paratuberculosis
aaggcggccgcgag

SEQ ID NO: 874854 - RNA, 21 nt, Mycobacterium avium subsp. paratuberculosis
aaggcggccgcgagcccggcg

SEQ ID NO: 874855 - RNA, 13 nt, Mycobacterium avium subsp. paratuberculosis
aaggcggcgccgg

SEQ ID NO: 874856 - RNA, 14 nt, Mycobacterium avium subsp. paratuberculosis
aaggcggcgucgau

SEQ ID NO: 874857 - RNA, 14 nt, Mycobacterium avium subsp. paratuberculosis
aaggcgccggcgcg

SEQ ID NO: 874858 - RNA, 15 nt, Mycobacterium avium subsp. paratuberculosis
aagaugggcgccgag

SEQ ID NO: 874859 - RNA, 22 nt, Mycobacterium avium subsp. paratuberculosis
aagaugaucagcgcgcccaggc

SEQ ID NO: 874860 - RNA, 12 nt, Mycobacterium avium subsp. paratuberculosis
aagauugggcca

SEQ ID NO: 874861 - RNA, 22 nt, Mycobacterium avium subsp. paratuberculosis
aacuacgcacccgacacgccga

SEQ ID NO: 874862 - RNA, 16 nt, Mycobacterium avium subsp. paratuberculosis
aacgugauacgccgac

SEQ ID NO: 874863 - RNA, 17 nt, Mycobacterium avium subsp. paratuberculosis
aacgugauagcggccgc

SEQ ID NO: 874864 - RNA, 16 nt, Mycobacterium avium subsp. paratuberculosis
aacgugaugagcgcgu

SEQ ID NO: 874865 - RNA, 20 nt, Mycobacterium avium subsp. paratuberculosis
aacgugccacaggccgaaca

SEQ ID NO: 874866 - RNA, 16 nt, Mycobacterium avium subsp. paratuberculosis
aagaggugcucgacgg

SEQ ID NO: 874867 - RNA, 20 nt, Mycobacterium avium subsp. paratuberculosis
aagagggccauccggccggc

SEQ ID NO: 874868 - RNA, 15 nt, Mycobacterium avium subsp. paratuberculosis
aagauaccggccggc

SEQ ID NO: 874869 - RNA, 19 nt, Mycobacterium avium subsp. paratuberculosis
aacuagcuucacgcucggc

SEQ ID NO: 874870 - RNA, 19 nt, Mycobacterium avium subsp. paratuberculosis
aacuagcuucacguucggc

SEQ ID NO: 874871 - RNA, 14 nt, Mycobacterium avium subsp. paratuberculosis
aagcuccacgccgc

SEQ ID NO: 874872 - RNA, 22 nt, Mycobacterium avium subsp. paratuberculosis
aagcuagcuucacgcucggcgc

SEQ ID NO: 874873 - RNA, 21 nt, Mycobacterium avium subsp. paratuberculosis
aagcgcgaugcggcucaccag

SEQ ID NO: 874874 - RNA, 16 nt, Mycobacterium avium subsp. paratuberculosis
aagcgcuuucgccgaa

SEQ ID NO: 874875 - RNA, 12 nt, Mycobacterium avium subsp. paratuberculosis
aagcccgccgcc

SEQ ID NO: 874876 - RNA, 17 nt, Mycobacterium avium subsp. paratuberculosis
aagcgaccagcgcgccg

SEQ ID NO: 874877 - RNA, 23 nt, Mycobacterium avium subsp. paratuberculosis
aagcccgugccgaugccggccug

SEQ ID NO: 874878 - RNA, 20 nt, Mycobacterium avium subsp. paratuberculosis
aagcccggguauuucgagca

SEQ ID NO: 874879 - RNA, 12 nt, Mycobacterium avium subsp. paratuberculosis
aagcccaggccc

SEQ ID NO: 874880 - RNA, 22 nt, Mycobacterium avium subsp. paratuberculosis
aagcccaccgcggugaccgccc

SEQ ID NO: 874881 - RNA, 21 nt, Mycobacterium avium subsp. paratuberculosis
aacgcaaaacggugcggccuc

SEQ ID NO: 874882 - RNA, 18 nt, Mycobacterium avium subsp. paratuberculosis
aacgcaaugcgucgcggc

SEQ ID NO: 874883 - RNA, 21 nt, Mycobacterium avium subsp. paratuberculosis
aacgcaaugcgucgcggcggc

SEQ ID NO: 874884 - RNA, 14 nt, Mycobacterium avium subsp. paratuberculosis
aacgcaccaccgcg

SEQ ID NO: 874885 - RNA, 19 nt, Mycobacterium avium subsp. paratuberculosis
aacgccgccgacagcaccu

SEQ ID NO: 874886 - RNA, 20 nt, Mycobacterium avium subsp. paratuberculosis
aacgccgccguguaggccgc

SEQ ID NO: 874887 - RNA, 22 nt, Mycobacterium avium subsp. paratuberculosis
aacgccgccguguaggccgcgc

SEQ ID NO: 874888 - RNA, 23 nt, Mycobacterium avium subsp. paratuberculosis
aacgccggauuggcgucgguggc

SEQ ID NO: 874889 - RNA, 20 nt, Mycobacterium avium subsp. paratuberculosis
aacgccgggucgacgccgag

SEQ ID NO: 874890 - RNA, 22 nt, Mycobacterium avium subsp. paratuberculosis
aacgccggcgugcacaggccgc

SEQ ID NO: 874891 - RNA, 14 nt, Mycobacterium avium subsp. paratuberculosis
aacgaaucgagccg

SEQ ID NO: 874892 - RNA, 13 nt, Mycobacterium avium subsp. paratuberculosis
aacgacagcgacg

SEQ ID NO: 874893 - RNA, 21 nt, Mycobacterium avium subsp. paratuberculosis
aacgacacguggaccgagcgc

SEQ ID NO: 874894 - RNA, 22 nt, Mycobacterium avium subsp. paratuberculosis
aacgacaucaccaccgccgggg

SEQ ID NO: 874895 - RNA, 13 nt, Mycobacterium avium subsp. paratuberculosis
aaccgcggcggca

SEQ ID NO: 874896 - RNA, 18 nt, Mycobacterium avium subsp. paratuberculosis
aaccgcucgauggcgccg

SEQ ID NO: 874897 - RNA, 13 nt, Mycobacterium avium subsp. paratuberculosis
aaccgcucggcgg

SEQ ID NO: 874898 - RNA, 17 nt, Mycobacterium avium subsp. paratuberculosis
aaccgcugcaugccguc

SEQ ID NO: 874899 - RNA, 14 nt, Mycobacterium avium subsp. paratuberculosis
aaccgccgcaccca

SEQ ID NO: 874900 - RNA, 14 nt, Mycobacterium avium subsp. paratuberculosis
aaccgcccagcggc

SEQ ID NO: 874901 - RNA, 15 nt, Mycobacterium avium subsp. paratuberculosis
aaccgcccggcgccg

SEQ ID NO: 874902 - RNA, 23 nt, Mycobacterium avium subsp. paratuberculosis
aaccgcgccuucgacccgguggc

SEQ ID NO: 874903 - RNA, 22 nt, Mycobacterium avium subsp. paratuberculosis
aaccgcgcggcgcccccgcgac

SEQ ID NO: 874904 - RNA, 21 nt, Mycobacterium avium subsp. paratuberculosis
aaccgcggacuggccaccgcg

SEQ ID NO: 874905 - RNA, 19 nt, Mycobacterium avium subsp. paratuberculosis
aacgguacgugcgccggcg

SEQ ID NO: 874906 - RNA, 21 nt, Mycobacterium avium subsp. paratuberculosis
aacgguacgugcgccggcggu

SEQ ID NO: 874907 - RNA, 16 nt, Mycobacterium avium subsp. paratuberculosis
aacggucagccgcggc

SEQ ID NO: 874908 - RNA, 13 nt, Mycobacterium avium subsp. paratuberculosis
aacgguucggccg

SEQ ID NO: 874909 - RNA, 16 nt, Mycobacterium avium subsp. paratuberculosis
aacggugcccgccgau

SEQ ID NO: 874910 - RNA, 17 nt, Mycobacterium avium subsp. paratuberculosis
aacggucggggcggcgg

SEQ ID NO: 874911 - RNA, 20 nt, Mycobacterium avium subsp. paratuberculosis
aacggguccuugccggcggc

SEQ ID NO: 874912 - RNA, 22 nt, Mycobacterium avium subsp. paratuberculosis
aacggguccuugccggcggcgg

SEQ ID NO: 874913 - RNA, 18 nt, Mycobacterium avium subsp. paratuberculosis
aacgggucgaucucggcg

SEQ ID NO: 874914 - RNA, 19 nt, Mycobacterium avium subsp. paratuberculosis
aacgggucgaucucggcgc

SEQ ID NO: 874915 - RNA, 22 nt, Mycobacterium avium subsp. paratuberculosis
aacgggaugaacucgugcggcg

SEQ ID NO: 874916 - RNA, 20 nt, Mycobacterium avium subsp. paratuberculosis
aacgggccgggcaccgcgcc

SEQ ID NO: 874917 - RNA, 17 nt, Mycobacterium avium subsp. paratuberculosis
aacgggccgcagccgcg

SEQ ID NO: 874918 - RNA, 21 nt, Mycobacterium avium subsp. paratuberculosis
aacgggccgcagccgcgcggc

SEQ ID NO: 874919 - RNA, 22 nt, Mycobacterium avium subsp. paratuberculosis
aacgggcggcggaucagcaccg

SEQ ID NO: 874920 - RNA, 16 nt, Mycobacterium avium subsp. paratuberculosis
aacgggcuggccaggc

SEQ ID NO: 874921 - RNA, 20 nt, Mycobacterium avium subsp. paratuberculosis
aacgucgacuuguugcguga

SEQ ID NO: 874922 - RNA, 14 nt, Mycobacterium avium subsp. paratuberculosis
aacgguucggccgc

SEQ ID NO: 874923 - RNA, 19 nt, Mycobacterium avium subsp. paratuberculosis
aacgguucggccgcucggg

SEQ ID NO: 874924 - RNA, 22 nt, Mycobacterium avium subsp. paratuberculosis
aacgguucgggaaccuggccgu

SEQ ID NO: 874925 - RNA, 19 nt, Mycobacterium avium subsp. paratuberculosis
aacgguuuuucccagcggc

SEQ ID NO: 874926 - RNA, 17 nt, Mycobacterium avium subsp. paratuberculosis
aacgccgcgcgcagcac

SEQ ID NO: 874927 - RNA, 23 nt, Mycobacterium avium subsp. paratuberculosis
aacgcgaccgucgggacggccag

SEQ ID NO: 874928 - RNA, 13 nt, Mycobacterium avium subsp. paratuberculosis
aacgcgacggccc

SEQ ID NO: 874929 - RNA, 23 nt, Mycobacterium avium subsp. paratuberculosis
aacgcgaugugccacuucgacgg

SEQ ID NO: 874930 - RNA, 20 nt, Mycobacterium avium subsp. paratuberculosis
aacgcgauucucgcugcggc

SEQ ID NO: 874931 - RNA, 13 nt, Mycobacterium avium subsp. paratuberculosis
aacgcgccgccca

SEQ ID NO: 874932 - RNA, 16 nt, Mycobacterium avium subsp. paratuberculosis
aacgcgccgccgagca

SEQ ID NO: 874933 - RNA, 13 nt, Mycobacterium avium subsp. paratuberculosis
aacgcgccccgcc

SEQ ID NO: 874934 - RNA, 12 nt, Mycobacterium avium subsp. paratuberculosis
aacgcgccggcg

SEQ ID NO: 874935 - RNA, 13 nt, Mycobacterium avium subsp. paratuberculosis
aacgcgccggcgc

SEQ ID NO: 874936 - RNA, 14 nt, Mycobacterium avium subsp. paratuberculosis
aacgcgccggcggu

SEQ ID NO: 874937 - RNA, 14 nt, Mycobacterium avium subsp. paratuberculosis
aacgcgccgggcaa

SEQ ID NO: 874938 - RNA, 15 nt, Mycobacterium avium subsp. paratuberculosis
aacgcgccgggcaac

SEQ ID NO: 874939 - RNA, 11 nt, Mycobacterium avium subsp. paratuberculosis
aacgcgccguc

SEQ ID NO: 874940 - RNA, 17 nt, Mycobacterium avium subsp. paratuberculosis
aacgcuuucgggucgac

SEQ ID NO: 874941 - RNA, 16 nt, Mycobacterium avium subsp. paratuberculosis
aacggaauucgggugc

SEQ ID NO: 874942 - RNA, 22 nt, Mycobacterium avium subsp. paratuberculosis
aacgcgccgucgucggacacca

SEQ ID NO: 874943 - RNA, 12 nt, Mycobacterium avium subsp. paratuberculosis
aacgcgcgcgac

SEQ ID NO: 874944 - RNA, 15 nt, Mycobacterium avium subsp. paratuberculosis
aacggcaacggcggc

SEQ ID NO: 874945 - RNA, 17 nt, Mycobacterium avium subsp. paratuberculosis
aacggcggcagcgaggc

SEQ ID NO: 874946 - RNA, 17 nt, Mycobacterium avium subsp. paratuberculosis
aacggauucagcgucgc

SEQ ID NO: 874947 - RNA, 21 nt, Mycobacterium avium subsp. paratuberculosis
aacggauagcguccgcccacu

SEQ ID NO: 874948 - RNA, 19 nt, Mycobacterium avium subsp. paratuberculosis
aacggaucgagcgcaccgc

SEQ ID NO: 874949 - RNA, 13 nt, Mycobacterium avium subsp. paratuberculosis
aacggcuggcgca

SEQ ID NO: 874950 - RNA, 20 nt, Mycobacterium avium subsp. paratuberculosis
aacggcuugcgcucggccgg

SEQ ID NO: 874951 - RNA, 14 nt, Mycobacterium avium subsp. paratuberculosis
aacggcucgccgcg

SEQ ID NO: 874952 - RNA, 17 nt, Mycobacterium avium subsp. paratuberculosis
aacggcggaccggcggc

SEQ ID NO: 874953 - RNA, 19 nt, Mycobacterium avium subsp. paratuberculosis
aacggcggaccggcggccg

SEQ ID NO: 874954 - RNA, 20 nt, Mycobacterium avium subsp. paratuberculosis
aacggcggaccggcggccgc

SEQ ID NO: 874955 - RNA, 20 nt, Mycobacterium avium subsp. paratuberculosis
aacggcaccccgcggucggc

SEQ ID NO: 874956 - RNA, 21 nt, Mycobacterium avium subsp. paratuberculosis
aacggcaccccgcggucggcg

SEQ ID NO: 874957 - RNA, 22 nt, Mycobacterium avium subsp. paratuberculosis
aacggcgggcccgucgccggcg

SEQ ID NO: 874958 - RNA, 19 nt, Mycobacterium avium subsp. paratuberculosis
aacaucuuggucagccgcg

SEQ ID NO: 874959 - RNA, 21 nt, Mycobacterium avium subsp. paratuberculosis
aacaucuuggucagccgcggc

SEQ ID NO: 874960 - RNA, 14 nt, Mycobacterium avium subsp. paratuberculosis
aacaugaucggcgc

SEQ ID NO: 874961 - RNA, 15 nt, Mycobacterium avium subsp. paratuberculosis
aacaugaucggcgcg

SEQ ID NO: 874962 - RNA, 18 nt, Mycobacterium avium subsp. paratuberculosis
aacauccugguccggcgc

SEQ ID NO: 874963 - RNA, 13 nt, Mycobacterium avium subsp. paratuberculosis
aacaucgccggug

SEQ ID NO: 874964 - RNA, 14 nt, Mycobacterium avium subsp. paratuberculosis
aacaucgccucggc

SEQ ID NO: 874965 - RNA, 18 nt, Mycobacterium avium subsp. paratuberculosis
aacaucgccucggccgcg

SEQ ID NO: 874966 - RNA, 17 nt, Mycobacterium avium subsp. paratuberculosis
aacagugcgcaggcggc

SEQ ID NO: 874967 - RNA, 13 nt, Mycobacterium avium subsp. paratuberculosis
aacaguucgacgu

SEQ ID NO: 874968 - RNA, 21 nt, Mycobacterium avium subsp. paratuberculosis
aacaguucggugcacggcgcc

SEQ ID NO: 874969 - RNA, 17 nt, Mycobacterium avium subsp. paratuberculosis
aacaugcugccgccggc

SEQ ID NO: 874970 - RNA, 16 nt, Mycobacterium avium subsp. paratuberculosis
aaccagcagcgccaca

SEQ ID NO: 874971 - RNA, 15 nt, Mycobacterium avium subsp. paratuberculosis
aaccagcccggcccg

SEQ ID NO: 874972 - RNA, 19 nt, Mycobacterium avium subsp. paratuberculosis
aaccagcaccggcaccgcc

SEQ ID NO: 874973 - RNA, 12 nt, Mycobacterium avium subsp. paratuberculosis
aaccaccgcgcc

SEQ ID NO: 874974 - RNA, 14 nt, Mycobacterium avium subsp. paratuberculosis
aaccacgcggcggc

SEQ ID NO: 874975 - RNA, 17 nt, Mycobacterium avium subsp. paratuberculosis
aaccacgcggcggcggu

SEQ ID NO: 874976 - RNA, 15 nt, Mycobacterium avium subsp. paratuberculosis
aaccacaccccggcc

SEQ ID NO: 874977 - RNA, 16 nt, Mycobacterium avium subsp. paratuberculosis
aacccuccggcgccug

SEQ ID NO: 874978 - RNA, 14 nt, Mycobacterium avium subsp. paratuberculosis
aacccucgacgccg

SEQ ID NO: 874979 - RNA, 17 nt, Mycobacterium avium subsp. paratuberculosis
aacccucgacgccgggc

SEQ ID NO: 874980 - RNA, 18 nt, Mycobacterium avium subsp. paratuberculosis
aacccucagaccauggcg

SEQ ID NO: 874981 - RNA, 15 nt, Mycobacterium avium subsp. paratuberculosis
aaccgaaucggucga

SEQ ID NO: 874982 - RNA, 18 nt, Mycobacterium avium subsp. paratuberculosis
aaccgaaucggucgacca

SEQ ID NO: 874983 - RNA, 20 nt, Mycobacterium avium subsp. paratuberculosis
aacccgcucaggucggccgc

SEQ ID NO: 874984 - RNA, 14 nt, Mycobacterium avium subsp. paratuberculosis
aacccggaucggcc

SEQ ID NO: 874985 - RNA, 19 nt, Mycobacterium avium subsp. paratuberculosis
aacccggcgcccggccggu

SEQ ID NO: 874986 - RNA, 15 nt, Mycobacterium avium subsp. paratuberculosis
aacccggcggacggu

SEQ ID NO: 874987 - RNA, 16 nt, Mycobacterium avium subsp. paratuberculosis
aaccgcauucggccgc

SEQ ID NO: 874988 - RNA, 14 nt, Mycobacterium avium subsp. paratuberculosis
aaccgccagcagcg

SEQ ID NO: 874989 - RNA, 18 nt, Mycobacterium avium subsp. paratuberculosis
aaccgacauaggucaggu

SEQ ID NO: 874990 - RNA, 15 nt, Mycobacterium avium subsp. paratuberculosis
aaccgaccgccgcgg

SEQ ID NO: 874991 - RNA, 16 nt, Mycobacterium avium subsp. paratuberculosis
aaccgaccgccgcggc

SEQ ID NO: 874992 - RNA, 17 nt, Mycobacterium avium subsp. paratuberculosis
aaccgaucaccggcagc

SEQ ID NO: 874993 - RNA, 14 nt, Mycobacterium avium subsp. paratuberculosis
aaccauugcaccgc

SEQ ID NO: 874994 - RNA, 15 nt, Mycobacterium avium subsp. paratuberculosis
aaccauugcaccgca

SEQ ID NO: 874995 - RNA, 12 nt, Mycobacterium avium subsp. paratuberculosis
aaccaggccgcg

SEQ ID NO: 874996 - RNA, 15 nt, Mycobacterium avium subsp. paratuberculosis
aaccaggcgccggcc

SEQ ID NO: 874997 - RNA, 19 nt, Mycobacterium avium subsp. paratuberculosis
aaccagcgauucccgccgg

SEQ ID NO: 874998 - RNA, 14 nt, Mycobacterium avium subsp. paratuberculosis
aaccagcuccggca

SEQ ID NO: 874999 - RNA, 23 nt, Mycobacterium avium subsp. paratuberculosis
aaccagcuccggcaacgaggcca

SEQ ID NO: 875000 - RNA, 16 nt, Mycobacterium avium subsp. paratuberculosis
aaccaguucgccacca

SEQ ID NO: 875001 - RNA, 15 nt, Mycobacterium avium subsp. paratuberculosis
aaccaggucgcggcg

SEQ ID NO: 875002 - RNA, 13 nt, Mycobacterium avium subsp. paratuberculosis
aaccagcgcccgc

SEQ ID NO: 875003 - RNA, 15 nt, Mycobacterium avium subsp. paratuberculosis
aacccgaaaagcacc

SEQ ID NO: 875004 - RNA, 17 nt, Mycobacterium avium subsp. paratuberculosis
aacccgaacgcgucguc

SEQ ID NO: 875005 - RNA, 13 nt, Mycobacterium avium subsp. paratuberculosis
aacccgccgcggc

SEQ ID NO: 875006 - RNA, 17 nt, Mycobacterium avium subsp. paratuberculosis
aacccgaucggcccggc

SEQ ID NO: 875007 - RNA, 21 nt, Mycobacterium avium subsp. paratuberculosis
aacccgccagggcgacgccgc

SEQ ID NO: 875008 - RNA, 13 nt, Mycobacterium avium subsp. paratuberculosis
aacccagcgccuc

SEQ ID NO: 875009 - RNA, 17 nt, Mycobacterium avium subsp. paratuberculosis
aacccagcaccaacagc

SEQ ID NO: 875010 - RNA, 23 nt, Mycobacterium avium subsp. paratuberculosis
aacccagcaccaacagcggcccg

SEQ ID NO: 875011 - RNA, 23 nt, Mycobacterium avium subsp. paratuberculosis
aaccccacguaggcgaugucgac

SEQ ID NO: 875012 - RNA, 13 nt, Mycobacterium avium subsp. paratuberculosis
aaaaccuguccgg

SEQ ID NO: 875013 - RNA, 21 nt, Mycobacterium avium subsp. paratuberculosis
aacaaucgcugcgagcccggc

SEQ ID NO: 875014 - RNA, 19 nt, Mycobacterium avium subsp. paratuberculosis
aacagagcgggaucccgca

SEQ ID NO: 875015 - RNA, 19 nt, Mycobacterium avium subsp. paratuberculosis
aacagcaccagcaccaccg

SEQ ID NO: 875016 - RNA, 17 nt, Mycobacterium avium subsp. paratuberculosis
aacagcaccgccacggc

SEQ ID NO: 875017 - RNA, 21 nt, Mycobacterium avium subsp. paratuberculosis
aacagcaccucgucgcccggc

SEQ ID NO: 875018 - RNA, 19 nt, Mycobacterium avium subsp. paratuberculosis
aacagcacgaacagcagcg

SEQ ID NO: 875019 - RNA, 20 nt, Mycobacterium avium subsp. paratuberculosis
aacagcagcgccgcggccgg

SEQ ID NO: 875020 - RNA, 12 nt, Mycobacterium avium subsp. paratuberculosis
aacagcagcgcg

SEQ ID NO: 875021 - RNA, 19 nt, Mycobacterium avium subsp. paratuberculosis
aacagcagcgcgccgacca

SEQ ID NO: 875022 - RNA, 16 nt, Mycobacterium avium subsp. paratuberculosis
aacaacuacgagcagc

SEQ ID NO: 875023 - RNA, 18 nt, Mycobacterium avium subsp. paratuberculosis
aacagcucgaccagccgg

SEQ ID NO: 875024 - RNA, 16 nt, Mycobacterium avium subsp. paratuberculosis
aacagcgucucgacgg

SEQ ID NO: 875025 - RNA, 14 nt, Mycobacterium avium subsp. paratuberculosis
aacagccgggcggc

SEQ ID NO: 875026 - RNA, 19 nt, Mycobacterium avium subsp. paratuberculosis
aacagccgggugaacccga

SEQ ID NO: 875027 - RNA, 22 nt, Mycobacterium avium subsp. paratuberculosis
aacagccagucgaagaccacga

SEQ ID NO: 875028 - RNA, 18 nt, Mycobacterium avium subsp. paratuberculosis
aacagcauuucgcgcggc

SEQ ID NO: 875029 - RNA, 13 nt, Mycobacterium avium subsp. paratuberculosis
aacagcacgccgg

SEQ ID NO: 875030 - RNA, 18 nt, Mycobacterium avium subsp. paratuberculosis
aacagcacgccggccggc

SEQ ID NO: 875031 - RNA, 14 nt, Mycobacterium avium subsp. paratuberculosis
aacaggucggcgug

SEQ ID NO: 875032 - RNA, 21 nt, Mycobacterium avium subsp. paratuberculosis
aacaggugcuuggucagcgcg

SEQ ID NO: 875033 - RNA, 15 nt, Mycobacterium avium subsp. paratuberculosis
aacagggccaccgcg

SEQ ID NO: 875034 - RNA, 19 nt, Mycobacterium avium subsp. paratuberculosis
aacagggcgacggcggcga

SEQ ID NO: 875035 - RNA, 19 nt, Mycobacterium avium subsp. paratuberculosis
aacagguuucgcucgucgg

SEQ ID NO: 875036 - RNA, 16 nt, Mycobacterium avium subsp. paratuberculosis
aacaggcccagcagcg

SEQ ID NO: 875037 - RNA, 19 nt, Mycobacterium avium subsp. paratuberculosis
aacaggaugcagccggcca

SEQ ID NO: 875038 - RNA, 17 nt, Mycobacterium avium subsp. paratuberculosis
aaacgacgucgccacca

SEQ ID NO: 875039 - RNA, 12 nt, Mycobacterium avium subsp. paratuberculosis
aaacgcagcguc

SEQ ID NO: 875040 - RNA, 21 nt, Mycobacterium avium subsp. paratuberculosis
aaagauguaucaggaucugcg

SEQ ID NO: 875041 - RNA, 14 nt, Mycobacterium avium subsp. paratuberculosis
aaaggaugucgccg

SEQ ID NO: 875042 - RNA, 16 nt, Mycobacterium avium subsp. paratuberculosis
uucuuggcgggcgccu

SEQ ID NO: 875043 - RNA, 22 nt, Mycobacterium avium subsp. paratuberculosis
uuggcgcccuugccgaugccgg

SEQ ID NO: 875044 - RNA, 19 nt, Mycobacterium avium subsp. paratuberculosis
uuggcgccggucgacgcgg

SEQ ID NO: 875045 - RNA, 18 nt, Mycobacterium avium subsp. paratuberculosis
uuggcgccguccgcggcg

SEQ ID NO: 875046 - RNA, 16 nt, Mycobacterium avium subsp. paratuberculosis
uuggcgcgcucggugg

SEQ ID NO: 875047 - RNA, 17 nt, Mycobacterium avium subsp. paratuberculosis
uuggcggucugcgcccg

SEQ ID NO: 875048 - RNA, 20 nt, Mycobacterium avium subsp. paratuberculosis
uuggcguagugggucggcgg

SEQ ID NO: 875049 - RNA, 13 nt, Mycobacterium avium subsp. paratuberculosis
uuggcggccagcg

SEQ ID NO: 875050 - RNA, 13 nt, Mycobacterium avium subsp. paratuberculosis
uuggcggccugcg

SEQ ID NO: 875051 - RNA, 20 nt, Mycobacterium avium subsp. paratuberculosis
uuggcggcgucgucgccgug

SEQ ID NO: 875052 - RNA, 12 nt, Mycobacterium avium subsp. paratuberculosis
uuggcggcgugg

SEQ ID NO: 875053 - RNA, 15 nt, Mycobacterium avium subsp. paratuberculosis
uugggcagcucggcg

SEQ ID NO: 875054 - RNA, 15 nt, Mycobacterium avium subsp. paratuberculosis
uugggcgccagcagc

SEQ ID NO: 875055 - RNA, 22 nt, Mycobacterium avium subsp. paratuberculosis
uugggcacgguguagcugcggg

SEQ ID NO: 875056 - RNA, 16 nt, Mycobacterium avium subsp. paratuberculosis
uuguagcaggcggugg

SEQ ID NO: 875057 - RNA, 22 nt, Mycobacterium avium subsp. paratuberculosis
uuguccugcaccgacugcggcg

SEQ ID NO: 875058 - RNA, 16 nt, Mycobacterium avium subsp. paratuberculosis
uugucggcgacggcgg

SEQ ID NO: 875059 - RNA, 12 nt, Mycobacterium avium subsp. paratuberculosis
uugucggcgugg

SEQ ID NO: 875060 - RNA, 23 nt, Mycobacterium avium subsp. paratuberculosis
uugucgggccgcgggcccaccgc

SEQ ID NO: 875061 - RNA, 13 nt, Mycobacterium avium subsp. paratuberculosis
uugucgccgugcg

SEQ ID NO: 875062 - RNA, 18 nt, Mycobacterium avium subsp. paratuberculosis
uugucgcgcaccgcggcg

SEQ ID NO: 875063 - RNA, 19 nt, Mycobacterium avium subsp. paratuberculosis
uugucgcucagaggcgggc

SEQ ID NO: 875064 - RNA, 16 nt, Mycobacterium avium subsp. paratuberculosis
uugucgcuggcguacg

SEQ ID NO: 875065 - RNA, 11 nt, Mycobacterium avium subsp. paratuberculosis
uugucggccaa

SEQ ID NO: 875066 - RNA, 21 nt, Mycobacterium avium subsp. paratuberculosis
uuguuccacgugucggcgucg

SEQ ID NO: 875067 - RNA, 14 nt, Mycobacterium avium subsp. paratuberculosis
uugucggcggucug

SEQ ID NO: 875068 - RNA, 15 nt, Mycobacterium avium subsp. paratuberculosis
uugucgucgggcacc

SEQ ID NO: 875069 - RNA, 21 nt, Mycobacterium avium subsp. paratuberculosis
uugucgucggggcuggcggcg

SEQ ID NO: 875070 - RNA, 15 nt, Mycobacterium avium subsp. paratuberculosis
uuucaccgugcgcgc

SEQ ID NO: 875071 - RNA, 21 nt, Mycobacterium avium subsp. paratuberculosis
uuucagcagcgcguaggugcg

SEQ ID NO: 875072 - RNA, 18 nt, Mycobacterium avium subsp. paratuberculosis
uuucccgucgucgaugcg

SEQ ID NO: 875073 - RNA, 22 nt, Mycobacterium avium subsp. paratuberculosis
uuuccacgugcacggcgccgug

SEQ ID NO: 875074 - RNA, 22 nt, Mycobacterium avium subsp. paratuberculosis
uuugauugcgcggcgccggaug

SEQ ID NO: 875075 - RNA, 16 nt, Mycobacterium avium subsp. paratuberculosis
uuuggaccagggcggu

SEQ ID NO: 875076 - RNA, 22 nt, Mycobacterium avium subsp. paratuberculosis
uucgagacacgcgccggcgcgg

SEQ ID NO: 875077 - RNA, 22 nt, Mycobacterium avium subsp. paratuberculosis
uucgagaguuugcccucgucga

SEQ ID NO: 875078 - RNA, 13 nt, Mycobacterium avium subsp. paratuberculosis
uucgacgccucgg

SEQ ID NO: 875079 - RNA, 15 nt, Mycobacterium avium subsp. paratuberculosis
uucgacggccggccc

SEQ ID NO: 875080 - RNA, 20 nt, Mycobacterium avium subsp. paratuberculosis
uucgacggugaugucgccgg

SEQ ID NO: 875081 - RNA, 18 nt, Mycobacterium avium subsp. paratuberculosis
uucgaggugcucgcgcag

SEQ ID NO: 875082 - RNA, 19 nt, Mycobacterium avium subsp. paratuberculosis
uucgaggugcucgcgcagg

SEQ ID NO: 875083 - RNA, 16 nt, Mycobacterium avium subsp. paratuberculosis
uucgagccgccgccgg

SEQ ID NO: 875084 - RNA, 13 nt, Mycobacterium avium subsp. paratuberculosis
uucgagcgccgcg

SEQ ID NO: 875085 - RNA, 17 nt, Mycobacterium avium subsp. paratuberculosis
uucgaugucggccagcg

SEQ ID NO: 875086 - RNA, 16 nt, Mycobacterium avium subsp. paratuberculosis
uucgaugcgcucggcg

SEQ ID NO: 875087 - RNA, 17 nt, Mycobacterium avium subsp. paratuberculosis
uucgaugcgcucggcga

SEQ ID NO: 875088 - RNA, 16 nt, Mycobacterium avium subsp. paratuberculosis
uucgaucaggcgcagc

SEQ ID NO: 875089 - RNA, 17 nt, Mycobacterium avium subsp. paratuberculosis
uucgaucagcagcucgg

SEQ ID NO: 875090 - RNA, 20 nt, Mycobacterium avium subsp. paratuberculosis
uucgaucagcagcucggugg

SEQ ID NO: 875091 - RNA, 17 nt, Mycobacterium avium subsp. paratuberculosis
uucgaucaucuccaccc

SEQ ID NO: 875092 - RNA, 17 nt, Mycobacterium avium subsp. paratuberculosis
uucgaucuccucggcgu

SEQ ID NO: 875093 - RNA, 24 nt, Mycobacterium avium subsp. paratuberculosis
uucgaagaacacgcaggugcgccg

SEQ ID NO: 875094 - RNA, 23 nt, Mycobacterium avium subsp. paratuberculosis
uucgaagcccgugccgaugccgg

SEQ ID NO: 875095 - RNA, 20 nt, Mycobacterium avium subsp. paratuberculosis
uucgacccgcauccgccggg

SEQ ID NO: 875096 - RNA, 12 nt, Mycobacterium avium subsp. paratuberculosis
uucgacccggug

SEQ ID NO: 875097 - RNA, 13 nt, Mycobacterium avium subsp. paratuberculosis
uucgaccggcguc

SEQ ID NO: 875098 - RNA, 14 nt, Mycobacterium avium subsp. paratuberculosis
uucgaccuccacga

SEQ ID NO: 875099 - RNA, 23 nt, Mycobacterium avium subsp. paratuberculosis
uucgacgauguuggcgacgacgg

SEQ ID NO: 875100 - RNA, 14 nt, Mycobacterium avium subsp. paratuberculosis
uucccugcgcggcg

SEQ ID NO: 875101 - RNA, 23 nt, Mycobacterium avium subsp. paratuberculosis
uuccugcgcgugcuugccgaugu

SEQ ID NO: 875102 - RNA, 16 nt, Mycobacterium avium subsp. paratuberculosis
uuccugcgaccgccgc

SEQ ID NO: 875103 - RNA, 16 nt, Mycobacterium avium subsp. paratuberculosis
uuccgccgcgcccguc

SEQ ID NO: 875104 - RNA, 21 nt, Mycobacterium avium subsp. paratuberculosis
uuccgccgcgcccgucgagcg

SEQ ID NO: 875105 - RNA, 17 nt, Mycobacterium avium subsp. paratuberculosis
uucgcccgcagcacgcc

SEQ ID NO: 875106 - RNA, 18 nt, Mycobacterium avium subsp. paratuberculosis
uucgccagugccgcgcgg

SEQ ID NO: 875107 - RNA, 19 nt, Mycobacterium avium subsp. paratuberculosis
uucgcccggcugcgccgcg

SEQ ID NO: 875108 - RNA, 19 nt, Mycobacterium avium subsp. paratuberculosis
uucgcccuccccggccagc

SEQ ID NO: 875109 - RNA, 20 nt, Mycobacterium avium subsp. paratuberculosis
uucgcccuccccggccagca

SEQ ID NO: 875110 - RNA, 22 nt, Mycobacterium avium subsp. paratuberculosis
uucgccgcagccuucuuggcgg

SEQ ID NO: 875111 - RNA, 16 nt, Mycobacterium avium subsp. paratuberculosis
uucgccggacagccgg

SEQ ID NO: 875112 - RNA, 18 nt, Mycobacterium avium subsp. paratuberculosis
uucgccggccagcacgcc

SEQ ID NO: 875113 - RNA, 20 nt, Mycobacterium avium subsp. paratuberculosis
uucgccggcgacggccagcg

SEQ ID NO: 875114 - RNA, 20 nt, Mycobacterium avium subsp. paratuberculosis
uucgcgcaccaccucggcga

SEQ ID NO: 875115 - RNA, 22 nt, Mycobacterium avium subsp. paratuberculosis
uucgcgcacgccaucgccucgg

SEQ ID NO: 875116 - RNA, 16 nt, Mycobacterium avium subsp. paratuberculosis
uucgcgcacgucgagg

SEQ ID NO: 875117 - RNA, 22 nt, Mycobacterium avium subsp. paratuberculosis
uucgcgaucacguucucggcga

SEQ ID NO: 875118 - RNA, 17 nt, Mycobacterium avium subsp. paratuberculosis
uucgcucgucggcgcgg

SEQ ID NO: 875119 - RNA, 22 nt, Mycobacterium avium subsp. paratuberculosis
uucgcgccucgguucugcagcg

SEQ ID NO: 875120 - RNA, 17 nt, Mycobacterium avium subsp. paratuberculosis
uucgcgucugcucgcgg

SEQ ID NO: 875121 - RNA, 17 nt, Mycobacterium avium subsp. paratuberculosis
uucgcgugugcccagca

SEQ ID NO: 875122 - RNA, 16 nt, Mycobacterium avium subsp. paratuberculosis
uucgcggcuggccgcg

SEQ ID NO: 875123 - RNA, 22 nt, Mycobacterium avium subsp. paratuberculosis
uucgcgggugccuucuuggcgg

SEQ ID NO: 875124 - RNA, 13 nt, Mycobacterium avium subsp. paratuberculosis
uucgcgcgcggcg

SEQ ID NO: 875125 - RNA, 12 nt, Mycobacterium avium subsp. paratuberculosis
uucgcgcggcau

SEQ ID NO: 875126 - RNA, 14 nt, Mycobacterium avium subsp. paratuberculosis
uucgcgcuguucgg

SEQ ID NO: 875127 - RNA, 12 nt, Mycobacterium avium subsp. paratuberculosis
uucgcggcggcg

SEQ ID NO: 875128 - RNA, 18 nt, Mycobacterium avium subsp. paratuberculosis
uucgcggauccgggccgc

SEQ ID NO: 875129 - RNA, 22 nt, Mycobacterium avium subsp. paratuberculosis
uucgcggcaaagggcuagguga

SEQ ID NO: 875130 - RNA, 15 nt, Mycobacterium avium subsp. paratuberculosis
uucggaguccaccgg

SEQ ID NO: 875131 - RNA, 16 nt, Mycobacterium avium subsp. paratuberculosis
uucggaguccaccggc

SEQ ID NO: 875132 - RNA, 16 nt, Mycobacterium avium subsp. paratuberculosis
uucggaggucagcagg

SEQ ID NO: 875133 - RNA, 19 nt, Mycobacterium avium subsp. paratuberculosis
uucggaugaccaagccccg

SEQ ID NO: 875134 - RNA, 23 nt, Mycobacterium avium subsp. paratuberculosis
uucgcuggacagccacagcucgg

SEQ ID NO: 875135 - RNA, 17 nt, Mycobacterium avium subsp. paratuberculosis
uucgcugcccucggucg

SEQ ID NO: 875136 - RNA, 17 nt, Mycobacterium avium subsp. paratuberculosis
uucgcuggcggccagcg

SEQ ID NO: 875137 - RNA, 14 nt, Mycobacterium avium subsp. paratuberculosis
uucgcuggcggggc

SEQ ID NO: 875138 - RNA, 17 nt, Mycobacterium avium subsp. paratuberculosis
uucgcguuccgccacgg

SEQ ID NO: 875139 - RNA, 15 nt, Mycobacterium avium subsp. paratuberculosis
uucgcuuucgccggg

SEQ ID NO: 875140 - RNA, 17 nt, Mycobacterium avium subsp. paratuberculosis
uucgucaacgccccggu

SEQ ID NO: 875141 - RNA, 22 nt, Mycobacterium avium subsp. paratuberculosis
uucgucaaugauggucagccgc

SEQ ID NO: 875142 - RNA, 12 nt, Mycobacterium avium subsp. paratuberculosis
uucgucagcagc

SEQ ID NO: 875143 - RNA, 16 nt, Mycobacterium avium subsp. paratuberculosis
uucgguugucgcggug

SEQ ID NO: 875144 - RNA, 15 nt, Mycobacterium avium subsp. paratuberculosis
uucguagaucacggc

SEQ ID NO: 875145 - RNA, 18 nt, Mycobacterium avium subsp. paratuberculosis
uucguagggacugcgccg

SEQ ID NO: 875146 - RNA, 21 nt, Mycobacterium avium subsp. paratuberculosis
uucguaccuagggcccacgcu

SEQ ID NO: 875147 - RNA, 19 nt, Mycobacterium avium subsp. paratuberculosis
uucgucgucggccucggcg

SEQ ID NO: 875148 - RNA, 20 nt, Mycobacterium avium subsp. paratuberculosis
uucgucgucggccucggcgg

SEQ ID NO: 875149 - RNA, 20 nt, Mycobacterium avium subsp. paratuberculosis
uucgucggcggucuuggcgg

SEQ ID NO: 875150 - RNA, 14 nt, Mycobacterium avium subsp. paratuberculosis
uucgucggcggugg

SEQ ID NO: 875151 - RNA, 13 nt, Mycobacterium avium subsp. paratuberculosis
uucgucgaucagc

SEQ ID NO: 875152 - RNA, 19 nt, Mycobacterium avium subsp. paratuberculosis
uucgugucaccgcccacga

SEQ ID NO: 875153 - RNA, 17 nt, Mycobacterium avium subsp. paratuberculosis
uucguguggcgcacgcu

SEQ ID NO: 875154 - RNA, 23 nt, Mycobacterium avium subsp. paratuberculosis
uucgggcagauggucgccgacgg

SEQ ID NO: 875155 - RNA, 12 nt, Mycobacterium avium subsp. paratuberculosis
uucgggccagcc

SEQ ID NO: 875156 - RNA, 20 nt, Mycobacterium avium subsp. paratuberculosis
uucgggcgcgcgcgccacga

SEQ ID NO: 875157 - RNA, 13 nt, Mycobacterium avium subsp. paratuberculosis
uucgggccugacc

SEQ ID NO: 875158 - RNA, 13 nt, Mycobacterium avium subsp. paratuberculosis
uucggcucggcga

SEQ ID NO: 875159 - RNA, 15 nt, Mycobacterium avium subsp. paratuberculosis
uucggcguggcggug

SEQ ID NO: 875160 - RNA, 20 nt, Mycobacterium avium subsp. paratuberculosis
uucggcggcgauccggccgg

SEQ ID NO: 875161 - RNA, 21 nt, Mycobacterium avium subsp. paratuberculosis
uucggcguccucgacgccgcg

SEQ ID NO: 875162 - RNA, 22 nt, Mycobacterium avium subsp. paratuberculosis
uucggcgucgccuuccugcgcg

SEQ ID NO: 875163 - RNA, 13 nt, Mycobacterium avium subsp. paratuberculosis
uucgggucgacga

SEQ ID NO: 875164 - RNA, 14 nt, Mycobacterium avium subsp. paratuberculosis
uucgggucgacgag

SEQ ID NO: 875165 - RNA, 23 nt, Mycobacterium avium subsp. paratuberculosis
uucggggguaaaccgccagcagc

SEQ ID NO: 875166 - RNA, 17 nt, Mycobacterium avium subsp. paratuberculosis
uucggggguggccagcu

SEQ ID NO: 875167 - RNA, 21 nt, Mycobacterium avium subsp. paratuberculosis
uucggggugacuucgagccgg

SEQ ID NO: 875168 - RNA, 17 nt, Mycobacterium avium subsp. paratuberculosis
uucgggguggucaccgg

SEQ ID NO: 875169 - RNA, 11 nt, Mycobacterium avium subsp. paratuberculosis
uucgggcggcc

SEQ ID NO: 875170 - RNA, 21 nt, Mycobacterium avium subsp. paratuberculosis
uucggguggcgucgccgccgg

SEQ ID NO: 875171 - RNA, 17 nt, Mycobacterium avium subsp. paratuberculosis
uucggccagcgcgucgg

SEQ ID NO: 875172 - RNA, 19 nt, Mycobacterium avium subsp. paratuberculosis
uucggccagcgcgucggcc

SEQ ID NO: 875173 - RNA, 23 nt, Mycobacterium avium subsp. paratuberculosis
uucggccgcucgggugucgccga

SEQ ID NO: 875174 - RNA, 17 nt, Mycobacterium avium subsp. paratuberculosis
uucggcccggcucaaug

SEQ ID NO: 875175 - RNA, 19 nt, Mycobacterium avium subsp. paratuberculosis
uucggccuugucgugucga

SEQ ID NO: 875176 - RNA, 16 nt, Mycobacterium avium subsp. paratuberculosis
uucggccggccccgcc

SEQ ID NO: 875177 - RNA, 19 nt, Mycobacterium avium subsp. paratuberculosis
uucggccggccccgcccgg

SEQ ID NO: 875178 - RNA, 22 nt, Mycobacterium avium subsp. paratuberculosis
uucggccggccccgcccggcgc

SEQ ID NO: 875179 - RNA, 18 nt, Mycobacterium avium subsp. paratuberculosis
uucggccaccgcgcggcg

SEQ ID NO: 875180 - RNA, 19 nt, Mycobacterium avium subsp. paratuberculosis
uucggccaccgcgcggcgg

SEQ ID NO: 875181 - RNA, 15 nt, Mycobacterium avium subsp. paratuberculosis
uucggcgccagccgc

SEQ ID NO: 875182 - RNA, 24 nt, Mycobacterium avium subsp. paratuberculosis
uucggcgccgcgaccccggaccgc

SEQ ID NO: 875183 - RNA, 23 nt, Mycobacterium avium subsp. paratuberculosis
uucggcgccaacaacucgacgcu

SEQ ID NO: 875184 - RNA, 15 nt, Mycobacterium avium subsp. paratuberculosis
uucggcgccaccccg

SEQ ID NO: 875185 - RNA, 18 nt, Mycobacterium avium subsp. paratuberculosis
uucggcgauccgggcacg

SEQ ID NO: 875186 - RNA, 19 nt, Mycobacterium avium subsp. paratuberculosis
uucggcgaucucgucgcgg

SEQ ID NO: 875187 - RNA, 12 nt, Mycobacterium avium subsp. paratuberculosis
uucugcgcccga

SEQ ID NO: 875188 - RNA, 11 nt, Mycobacterium avium subsp. paratuberculosis
uucugcgccgg

SEQ ID NO: 875189 - RNA, 18 nt, Mycobacterium avium subsp. paratuberculosis
uucucgggggcgggcacc

SEQ ID NO: 875190 - RNA, 18 nt, Mycobacterium avium subsp. paratuberculosis
uucucggugucgucgacc

SEQ ID NO: 875191 - RNA, 22 nt, Mycobacterium avium subsp. paratuberculosis
uucuacggcgggccggcgccgg

SEQ ID NO: 875192 - RNA, 21 nt, Mycobacterium avium subsp. paratuberculosis
uucucagcagcgggccgaaga

SEQ ID NO: 875193 - RNA, 22 nt, Mycobacterium avium subsp. paratuberculosis
uucucgaagcgcagcagcucgu

SEQ ID NO: 875194 - RNA, 22 nt, Mycobacterium avium subsp. paratuberculosis
uucuccucgucgcgggcgaagg

SEQ ID NO: 875195 - RNA, 18 nt, Mycobacterium avium subsp. paratuberculosis
uucuccauccgggcggcc

SEQ ID NO: 875196 - RNA, 19 nt, Mycobacterium avium subsp. paratuberculosis
uucuccccgccucgguuga

SEQ ID NO: 875197 - RNA, 15 nt, Mycobacterium avium subsp. paratuberculosis
uucuccggcccgcuc

SEQ ID NO: 875198 - RNA, 17 nt, Mycobacterium avium subsp. paratuberculosis
uucuccaccgcgcgcgg

SEQ ID NO: 875199 - RNA, 13 nt, Mycobacterium avium subsp. paratuberculosis
uucuccagcacga

SEQ ID NO: 875200 - RNA, 12 nt, Mycobacterium avium subsp. paratuberculosis
uucuucgccgca

SEQ ID NO: 875201 - RNA, 16 nt, Mycobacterium avium subsp. paratuberculosis
uucugcgcgccgucgg

SEQ ID NO: 875202 - RNA, 18 nt, Mycobacterium avium subsp. paratuberculosis
uucuggaugcggucgucg

SEQ ID NO: 875203 - RNA, 19 nt, Mycobacterium avium subsp. paratuberculosis
uucuggcgcugcucggagg

SEQ ID NO: 875204 - RNA, 19 nt, Mycobacterium avium subsp. paratuberculosis
uucuggccgaccgccgcca

SEQ ID NO: 875205 - RNA, 16 nt, Mycobacterium avium subsp. paratuberculosis
uucuggccguggucgg

SEQ ID NO: 875206 - RNA, 13 nt, Mycobacterium avium subsp. paratuberculosis
uuagcccggccgc

SEQ ID NO: 875207 - RNA, 15 nt, Mycobacterium avium subsp. paratuberculosis
uuaccggccggccgc

SEQ ID NO: 875208 - RNA, 16 nt, Mycobacterium avium subsp. paratuberculosis
uuaccggcgggcggcg

SEQ ID NO: 875209 - RNA, 19 nt, Mycobacterium avium subsp. paratuberculosis
uuacggcgugaccggcugc

SEQ ID NO: 875210 - RNA, 23 nt, Mycobacterium avium subsp. paratuberculosis
uuacggaccugggaugucuagcc

SEQ ID NO: 875211 - RNA, 11 nt, Mycobacterium avium subsp. paratuberculosis
uuacgcccgau

SEQ ID NO: 875212 - RNA, 13 nt, Mycobacterium avium subsp. paratuberculosis
uuacgcugcggcg

SEQ ID NO: 875213 - RNA, 16 nt, Mycobacterium avium subsp. paratuberculosis
uguuguugccggucgg

SEQ ID NO: 875214 - RNA, 14 nt, Mycobacterium avium subsp. paratuberculosis
uguggaccgcgcag

SEQ ID NO: 875215 - RNA, 16 nt, Mycobacterium avium subsp. paratuberculosis
uguggccgcggcggcc

SEQ ID NO: 875216 - RNA, 15 nt, Mycobacterium avium subsp. paratuberculosis
ugugcgggucggugg

SEQ ID NO: 875217 - RNA, 23 nt, Mycobacterium avium subsp. paratuberculosis
ugugcgugguggggccgaugacc

SEQ ID NO: 875218 - RNA, 19 nt, Mycobacterium avium subsp. paratuberculosis
ugugcucgagcucggcgag

SEQ ID NO: 875219 - RNA, 14 nt, Mycobacterium avium subsp. paratuberculosis
ugugcucggcggcg

SEQ ID NO: 875220 - RNA, 13 nt, Mycobacterium avium subsp. paratuberculosis
uucacgaggccgg

SEQ ID NO: 875221 - RNA, 22 nt, Mycobacterium avium subsp. paratuberculosis
uucagcaacccgaaagccccca

SEQ ID NO: 875222 - RNA, 23 nt, Mycobacterium avium subsp. paratuberculosis
uucacccuggcgaaccgcggcgg

SEQ ID NO: 875223 - RNA, 13 nt, Mycobacterium avium subsp. paratuberculosis
uucaccgcgccgg

SEQ ID NO: 875224 - RNA, 15 nt, Mycobacterium avium subsp. paratuberculosis
uucaccgcgccgguc

SEQ ID NO: 875225 - RNA, 21 nt, Mycobacterium avium subsp. paratuberculosis
uucaccgcgccgguccggccc

SEQ ID NO: 875226 - RNA, 19 nt, Mycobacterium avium subsp. paratuberculosis
uucaagguggacgagcagc

SEQ ID NO: 875227 - RNA, 21 nt, Mycobacterium avium subsp. paratuberculosis
uucaagauaggagacagccga

SEQ ID NO: 875228 - RNA, 19 nt, Mycobacterium avium subsp. paratuberculosis
uuccaaccaggcgcucguc

SEQ ID NO: 875229 - RNA, 22 nt, Mycobacterium avium subsp. paratuberculosis
uuccaguggcugucgggugccg

SEQ ID NO: 875230 - RNA, 14 nt, Mycobacterium avium subsp. paratuberculosis
uuccaguccggcgc

SEQ ID NO: 875231 - RNA, 22 nt, Mycobacterium avium subsp. paratuberculosis
uuccagguguaggcguggcagg

SEQ ID NO: 875232 - RNA, 16 nt, Mycobacterium avium subsp. paratuberculosis
uuccaugucgacgacg

SEQ ID NO: 875233 - RNA, 17 nt, Mycobacterium avium subsp. paratuberculosis
uuccaucgggcccagca

SEQ ID NO: 875234 - RNA, 17 nt, Mycobacterium avium subsp. paratuberculosis
uucccaguccggccagc

SEQ ID NO: 875235 - RNA, 18 nt, Mycobacterium avium subsp. paratuberculosis
uucccaguccggccagcg

SEQ ID NO: 875236 - RNA, 21 nt, Mycobacterium avium subsp. paratuberculosis
uucaggcccucaucgucgacc

SEQ ID NO: 875237 - RNA, 19 nt, Mycobacterium avium subsp. paratuberculosis
uucagcugcagccggccgg

SEQ ID NO: 875238 - RNA, 22 nt, Mycobacterium avium subsp. paratuberculosis
uucagcugcagccggccggcgg

SEQ ID NO: 875239 - RNA, 22 nt, Mycobacterium avium subsp. paratuberculosis
uucagcuugaccgugacggugc

SEQ ID NO: 875240 - RNA, 16 nt, Mycobacterium avium subsp. paratuberculosis
uucagcgggcgguugc

SEQ ID NO: 875241 - RNA, 15 nt, Mycobacterium avium subsp. paratuberculosis
uucagccccucgggg

SEQ ID NO: 875242 - RNA, 13 nt, Mycobacterium avium subsp. paratuberculosis
uucagcccggcgc

SEQ ID NO: 875243 - RNA, 15 nt, Mycobacterium avium subsp. paratuberculosis
uucagcccucgagcc

SEQ ID NO: 875244 - RNA, 19 nt, Mycobacterium avium subsp. paratuberculosis
uucagcgacuugccgccgg

SEQ ID NO: 875245 - RNA, 15 nt, Mycobacterium avium subsp. paratuberculosis
uucagccggcgguuc

SEQ ID NO: 875246 - RNA, 18 nt, Mycobacterium avium subsp. paratuberculosis
ugucugaccucgcgccgc

SEQ ID NO: 875247 - RNA, 20 nt, Mycobacterium avium subsp. paratuberculosis
ugugcggcagcucggcggcc

SEQ ID NO: 875248 - RNA, 17 nt, Mycobacterium avium subsp. paratuberculosis
ugugcggcgcggcggug

SEQ ID NO: 875249 - RNA, 12 nt, Mycobacterium avium subsp. paratuberculosis
ugugcggcggcu

SEQ ID NO: 875250 - RNA, 18 nt, Mycobacterium avium subsp. paratuberculosis
ugugccuggcuccccggc

SEQ ID NO: 875251 - RNA, 15 nt, Mycobacterium avium subsp. paratuberculosis
ugugcgacggcgucg

SEQ ID NO: 875252 - RNA, 20 nt, Mycobacterium avium subsp. paratuberculosis
ugugccgcugguaggcggcg

SEQ ID NO: 875253 - RNA, 19 nt, Mycobacterium avium subsp. paratuberculosis
ugugccggaagcggcggua

SEQ ID NO: 875254 - RNA, 14 nt, Mycobacterium avium subsp. paratuberculosis
ugugcccgacggcg

SEQ ID NO: 875255 - RNA, 16 nt, Mycobacterium avium subsp. paratuberculosis
ugucugaucgcguagc

SEQ ID NO: 875256 - RNA, 16 nt, Mycobacterium avium subsp. paratuberculosis
ugucuagccgccgagc

SEQ ID NO: 875257 - RNA, 23 nt, Mycobacterium avium subsp. paratuberculosis
ugucucacgccucgucgagcagc

SEQ ID NO: 875258 - RNA, 14 nt, Mycobacterium avium subsp. paratuberculosis
ugucuccgcgcagc

SEQ ID NO: 875259 - RNA, 20 nt, Mycobacterium avium subsp. paratuberculosis
ugucgucggcggacuggcug

SEQ ID NO: 875260 - RNA, 14 nt, Mycobacterium avium subsp. paratuberculosis
ugucgucgggccgc

SEQ ID NO: 875261 - RNA, 17 nt, Mycobacterium avium subsp. paratuberculosis
ugucgucgggcgcggug

SEQ ID NO: 875262 - RNA, 20 nt, Mycobacterium avium subsp. paratuberculosis
ugucgucgucgccgccggug

SEQ ID NO: 875263 - RNA, 23 nt, Mycobacterium avium subsp. paratuberculosis
ugucgucgucgccgccggugaag

SEQ ID NO: 875264 - RNA, 14 nt, Mycobacterium avium subsp. paratuberculosis
ugucgucgaccucg

SEQ ID NO: 875265 - RNA, 13 nt, Mycobacterium avium subsp. paratuberculosis
ugucgucgacgcu

SEQ ID NO: 875266 - RNA, 14 nt, Mycobacterium avium subsp. paratuberculosis
ugucgucgccggug

SEQ ID NO: 875267 - RNA, 18 nt, Mycobacterium avium subsp. paratuberculosis
ugucggaucgcuugacca

SEQ ID NO: 875268 - RNA, 14 nt, Mycobacterium avium subsp. paratuberculosis
ugucggccgcccgu

SEQ ID NO: 875269 - RNA, 17 nt, Mycobacterium avium subsp. paratuberculosis
ugucggccgcccguccg

SEQ ID NO: 875270 - RNA, 14 nt, Mycobacterium avium subsp. paratuberculosis
ugucggccgguccg

SEQ ID NO: 875271 - RNA, 16 nt, Mycobacterium avium subsp. paratuberculosis
ugucggcgacccgcac

SEQ ID NO: 875272 - RNA, 16 nt, Mycobacterium avium subsp. paratuberculosis
ugucggcgauccacgc

SEQ ID NO: 875273 - RNA, 21 nt, Mycobacterium avium subsp. paratuberculosis
ugucggcgauccacgccuccg

SEQ ID NO: 875274 - RNA, 21 nt, Mycobacterium avium subsp. paratuberculosis
ugucgcccagcugggccagcg

SEQ ID NO: 875275 - RNA, 16 nt, Mycobacterium avium subsp. paratuberculosis
ugucgcccggcgcggc

SEQ ID NO: 875276 - RNA, 17 nt, Mycobacterium avium subsp. paratuberculosis
ugucgcccggcgcggca

SEQ ID NO: 875277 - RNA, 18 nt, Mycobacterium avium subsp. paratuberculosis
ugucgcccggcgcggcau

SEQ ID NO: 875278 - RNA, 21 nt, Mycobacterium avium subsp. paratuberculosis
ugucgcccucgaucgcgacca

SEQ ID NO: 875279 - RNA, 23 nt, Mycobacterium avium subsp. paratuberculosis
ugucgcccucgaucgcgaccacc

SEQ ID NO: 875280 - RNA, 13 nt, Mycobacterium avium subsp. paratuberculosis
ugucgccgaccag

SEQ ID NO: 875281 - RNA, 23 nt, Mycobacterium avium subsp. paratuberculosis
ugucgccggugcuggucaugccg

SEQ ID NO: 875282 - RNA, 22 nt, Mycobacterium avium subsp. paratuberculosis
ugucguagacgacgucgaccgc

SEQ ID NO: 875283 - RNA, 15 nt, Mycobacterium avium subsp. paratuberculosis
ugucguagcggcgcc

SEQ ID NO: 875284 - RNA, 18 nt, Mycobacterium avium subsp. paratuberculosis
ugucggugaaugucguga

SEQ ID NO: 875285 - RNA, 16 nt, Mycobacterium avium subsp. paratuberculosis
ugucgguggcgcgcag

SEQ ID NO: 875286 - RNA, 17 nt, Mycobacterium avium subsp. paratuberculosis
ugucgguggcgcgcagu

SEQ ID NO: 875287 - RNA, 15 nt, Mycobacterium avium subsp. paratuberculosis
ugucguccagugacg

SEQ ID NO: 875288 - RNA, 16 nt, Mycobacterium avium subsp. paratuberculosis
ugucguaggcgcgguc

SEQ ID NO: 875289 - RNA, 20 nt, Mycobacterium avium subsp. paratuberculosis
ugucgucgccggccgcggug

SEQ ID NO: 875290 - RNA, 14 nt, Mycobacterium avium subsp. paratuberculosis
ugucgucgcugacg

SEQ ID NO: 875291 - RNA, 22 nt, Mycobacterium avium subsp. paratuberculosis
ugucgggugcuuucgcgucugc

SEQ ID NO: 875292 - RNA, 21 nt, Mycobacterium avium subsp. paratuberculosis
ugucggucaggcacucgauca

SEQ ID NO: 875293 - RNA, 15 nt, Mycobacterium avium subsp. paratuberculosis
ugucggggucggcgc

SEQ ID NO: 875294 - RNA, 11 nt, Mycobacterium avium subsp. paratuberculosis
ugucggcgggg

SEQ ID NO: 875295 - RNA, 17 nt, Mycobacterium avium subsp. paratuberculosis
ugucggcggggccggug

SEQ ID NO: 875296 - RNA, 20 nt, Mycobacterium avium subsp. paratuberculosis
ugucggcggggccggugaug

SEQ ID NO: 875297 - RNA, 13 nt, Mycobacterium avium subsp. paratuberculosis
ugucgggcaccug

SEQ ID NO: 875298 - RNA, 17 nt, Mycobacterium avium subsp. paratuberculosis
ugucgggcaggccggug

SEQ ID NO: 875299 - RNA, 13 nt, Mycobacterium avium subsp. paratuberculosis
uguccccgaccau

SEQ ID NO: 875300 - RNA, 15 nt, Mycobacterium avium subsp. paratuberculosis
uguccgucgccggag

SEQ ID NO: 875301 - RNA, 13 nt, Mycobacterium avium subsp. paratuberculosis
ugucgcacugcuu

SEQ ID NO: 875302 - RNA, 15 nt, Mycobacterium avium subsp. paratuberculosis
ugucgaugucgacgc

SEQ ID NO: 875303 - RNA, 13 nt, Mycobacterium avium subsp. paratuberculosis
ugucgaagcugcg

SEQ ID NO: 875304 - RNA, 17 nt, Mycobacterium avium subsp. paratuberculosis
ugucgaagcugcgcagc

SEQ ID NO: 875305 - RNA, 21 nt, Mycobacterium avium subsp. paratuberculosis
ugucgaagcugcgcagccgug

SEQ ID NO: 875306 - RNA, 17 nt, Mycobacterium avium subsp. paratuberculosis
ugucgaagucgaucccg

SEQ ID NO: 875307 - RNA, 22 nt, Mycobacterium avium subsp. paratuberculosis
ugucgaccaccggguagcccgc

SEQ ID NO: 875308 - RNA, 17 nt, Mycobacterium avium subsp. paratuberculosis
ugucgaacaccgugccg

SEQ ID NO: 875309 - RNA, 22 nt, Mycobacterium avium subsp. paratuberculosis
ugucgaagaccggugcgcgcac

SEQ ID NO: 875310 - RNA, 17 nt, Mycobacterium avium subsp. paratuberculosis
ugucgaagacggcgagg

SEQ ID NO: 875311 - RNA, 16 nt, Mycobacterium avium subsp. paratuberculosis
uguccuccugcgccgg

SEQ ID NO: 875312 - RNA, 14 nt, Mycobacterium avium subsp. paratuberculosis
uguccucgucgggg

SEQ ID NO: 875313 - RNA, 11 nt, Mycobacterium avium subsp. paratuberculosis
uguaggugauc

SEQ ID NO: 875314 - RNA, 18 nt, Mycobacterium avium subsp. paratuberculosis
uggucaacucgacccgca

SEQ ID NO: 875315 - RNA, 19 nt, Mycobacterium avium subsp. paratuberculosis
uggucaccaccaacgccac

SEQ ID NO: 875316 - RNA, 19 nt, Mycobacterium avium subsp. paratuberculosis
uggucaccgugucggcggg

SEQ ID NO: 875317 - RNA, 21 nt, Mycobacterium avium subsp. paratuberculosis
uggucaccgugucggcgggcg

SEQ ID NO: 875318 - RNA, 19 nt, Mycobacterium avium subsp. paratuberculosis
uggucagccgcaccagguu

SEQ ID NO: 875319 - RNA, 16 nt, Mycobacterium avium subsp. paratuberculosis
uggucagcagcagcgc

SEQ ID NO: 875320 - RNA, 18 nt, Mycobacterium avium subsp. paratuberculosis
uggucagcaccggcgugg

SEQ ID NO: 875321 - RNA, 15 nt, Mycobacterium avium subsp. paratuberculosis
ugguccaccgcggcg

SEQ ID NO: 875322 - RNA, 17 nt, Mycobacterium avium subsp. paratuberculosis
ugguccaccgcggcggc

SEQ ID NO: 875323 - RNA, 20 nt, Mycobacterium avium subsp. paratuberculosis
ugguccaccgcggcggccag

SEQ ID NO: 875324 - RNA, 15 nt, Mycobacterium avium subsp. paratuberculosis
ugguccaccgggcag

SEQ ID NO: 875325 - RNA, 16 nt, Mycobacterium avium subsp. paratuberculosis
uggucaugaacgccgg

SEQ ID NO: 875326 - RNA, 17 nt, Mycobacterium avium subsp. paratuberculosis
uggucaugaacgccggg

SEQ ID NO: 875327 - RNA, 15 nt, Mycobacterium avium subsp. paratuberculosis
ugguccagccggucg

SEQ ID NO: 875328 - RNA, 20 nt, Mycobacterium avium subsp. paratuberculosis
ugguccaggcguucgacccc

SEQ ID NO: 875329 - RNA, 18 nt, Mycobacterium avium subsp. paratuberculosis
ugguccccgggcccagca

SEQ ID NO: 875330 - RNA, 13 nt, Mycobacterium avium subsp. paratuberculosis
uggucccgaucac

SEQ ID NO: 875331 - RNA, 17 nt, Mycobacterium avium subsp. paratuberculosis
uggucagcucccggcag

SEQ ID NO: 875332 - RNA, 16 nt, Mycobacterium avium subsp. paratuberculosis
uggucagcugccgcac

SEQ ID NO: 875333 - RNA, 16 nt, Mycobacterium avium subsp. paratuberculosis
uggucagcgcggucag

SEQ ID NO: 875334 - RNA, 20 nt, Mycobacterium avium subsp. paratuberculosis
uggucagcgucucgccgggg

SEQ ID NO: 875335 - RNA, 21 nt, Mycobacterium avium subsp. paratuberculosis
uggucagguaggcgucgaacg

SEQ ID NO: 875336 - RNA, 16 nt, Mycobacterium avium subsp. paratuberculosis
uggucgaacagcacgc

SEQ ID NO: 875337 - RNA, 23 nt, Mycobacterium avium subsp. paratuberculosis
uggucgaaccgcgagcgcgcggu

SEQ ID NO: 875338 - RNA, 24 nt, Mycobacterium avium subsp. paratuberculosis
uggucgaaccgcgagcgcgcggug

SEQ ID NO: 875339 - RNA, 23 nt, Mycobacterium avium subsp. paratuberculosis
uggucgaacgccaccuucaccgc

SEQ ID NO: 875340 - RNA, 15 nt, Mycobacterium avium subsp. paratuberculosis
uggucgacgcgccgc

SEQ ID NO: 875341 - RNA, 23 nt, Mycobacterium avium subsp. paratuberculosis
ugguccuccaacggcaccaccac

SEQ ID NO: 875342 - RNA, 15 nt, Mycobacterium avium subsp. paratuberculosis
ugguccugcaccgag

SEQ ID NO: 875343 - RNA, 18 nt, Mycobacterium avium subsp. paratuberculosis
ugguccuuaaucgggacg

SEQ ID NO: 875344 - RNA, 15 nt, Mycobacterium avium subsp. paratuberculosis
uggucgaugcccgcg

SEQ ID NO: 875345 - RNA, 21 nt, Mycobacterium avium subsp. paratuberculosis
uggucgagggcguucgcggug

SEQ ID NO: 875346 - RNA, 22 nt, Mycobacterium avium subsp. paratuberculosis
uggucgauccacucccgcgcgc

SEQ ID NO: 875347 - RNA, 17 nt, Mycobacterium avium subsp. paratuberculosis
uggucgaucccgccggc

SEQ ID NO: 875348 - RNA, 18 nt, Mycobacterium avium subsp. paratuberculosis
uggucgaucccgccggcg

SEQ ID NO: 875349 - RNA, 16 nt, Mycobacterium avium subsp. paratuberculosis
uggucgagccgcaguc

SEQ ID NO: 875350 - RNA, 23 nt, Mycobacterium avium subsp. paratuberculosis
uggucgaggcccucgacaccggu

SEQ ID NO: 875351 - RNA, 15 nt, Mycobacterium avium subsp. paratuberculosis
uggucgaacagcgcg

SEQ ID NO: 875352 - RNA, 23 nt, Mycobacterium avium subsp. paratuberculosis
uggucgcggccuucuuggccgga

SEQ ID NO: 875353 - RNA, 17 nt, Mycobacterium avium subsp. paratuberculosis
uggucgcccacaccgga

SEQ ID NO: 875354 - RNA, 13 nt, Mycobacterium avium subsp. paratuberculosis
uggucgccgacgg

SEQ ID NO: 875355 - RNA, 16 nt, Mycobacterium avium subsp. paratuberculosis
uggucgccagcaccac

SEQ ID NO: 875356 - RNA, 15 nt, Mycobacterium avium subsp. paratuberculosis
uggucggcgacgccg

SEQ ID NO: 875357 - RNA, 16 nt, Mycobacterium avium subsp. paratuberculosis
uggucggccagcgcgc

SEQ ID NO: 875358 - RNA, 14 nt, Mycobacterium avium subsp. paratuberculosis
uggucggccagggc

SEQ ID NO: 875359 - RNA, 16 nt, Mycobacterium avium subsp. paratuberculosis
uggucggccggcaggc

SEQ ID NO: 875360 - RNA, 11 nt, Mycobacterium avium subsp. paratuberculosis
uggucggcagc

SEQ ID NO: 875361 - RNA, 16 nt, Mycobacterium avium subsp. paratuberculosis
uggucggcagcaccgg

SEQ ID NO: 875362 - RNA, 18 nt, Mycobacterium avium subsp. paratuberculosis
uggucggagccgucggug

SEQ ID NO: 875363 - RNA, 15 nt, Mycobacterium avium subsp. paratuberculosis
uggugucggcgagcu

SEQ ID NO: 875364 - RNA, 14 nt, Mycobacterium avium subsp. paratuberculosis
ugguucaccgccac

SEQ ID NO: 875365 - RNA, 20 nt, Mycobacterium avium subsp. paratuberculosis
ugguguuccaccagcggccg

SEQ ID NO: 875366 - RNA, 13 nt, Mycobacterium avium subsp. paratuberculosis
uggugucggagau

SEQ ID NO: 875367 - RNA, 16 nt, Mycobacterium avium subsp. paratuberculosis
ugguguccacccgcgc

SEQ ID NO: 875368 - RNA, 23 nt, Mycobacterium avium subsp. paratuberculosis
uggugccggaaguucucgccgug

SEQ ID NO: 875369 - RNA, 16 nt, Mycobacterium avium subsp. paratuberculosis
uggugcgcagccgucg

SEQ ID NO: 875370 - RNA, 23 nt, Mycobacterium avium subsp. paratuberculosis
uggugcgcgccggcgucgguguc

SEQ ID NO: 875371 - RNA, 12 nt, Mycobacterium avium subsp. paratuberculosis
uggugcgcgcgc

SEQ ID NO: 875372 - RNA, 18 nt, Mycobacterium avium subsp. paratuberculosis
uggugccgaagcgccgca

SEQ ID NO: 875373 - RNA, 13 nt, Mycobacterium avium subsp. paratuberculosis
uggugccgccggc

SEQ ID NO: 875374 - RNA, 14 nt, Mycobacterium avium subsp. paratuberculosis
uggugccgccggug

SEQ ID NO: 875375 - RNA, 15 nt, Mycobacterium avium subsp. paratuberculosis
uggugccgccguugc

SEQ ID NO: 875376 - RNA, 15 nt, Mycobacterium avium subsp. paratuberculosis
uggugccggccucgu

SEQ ID NO: 875377 - RNA, 20 nt, Mycobacterium avium subsp. paratuberculosis
uggugccggccucgucggcg

SEQ ID NO: 875378 - RNA, 22 nt, Mycobacterium avium subsp. paratuberculosis
uggugccggccucgucggcgag

SEQ ID NO: 875379 - RNA, 17 nt, Mycobacterium avium subsp. paratuberculosis
uggugcccccgcccggc

SEQ ID NO: 875380 - RNA, 21 nt, Mycobacterium avium subsp. paratuberculosis
uggugcccccgcccggccggu

SEQ ID NO: 875381 - RNA, 21 nt, Mycobacterium avium subsp. paratuberculosis
uggugcccucgugguggacgg

SEQ ID NO: 875382 - RNA, 14 nt, Mycobacterium avium subsp. paratuberculosis
uggugcaccaggua

SEQ ID NO: 875383 - RNA, 12 nt, Mycobacterium avium subsp. paratuberculosis
uggugcaccgcc

SEQ ID NO: 875384 - RNA, 13 nt, Mycobacterium avium subsp. paratuberculosis
uggugcaccgcca

SEQ ID NO: 875385 - RNA, 21 nt, Mycobacterium avium subsp. paratuberculosis
uggugcaccgccagcgcggcg

SEQ ID NO: 875386 - RNA, 17 nt, Mycobacterium avium subsp. paratuberculosis
uggugcaggugcccguc

SEQ ID NO: 875387 - RNA, 17 nt, Mycobacterium avium subsp. paratuberculosis
uggugagcaccgcgauc

SEQ ID NO: 875388 - RNA, 18 nt, Mycobacterium avium subsp. paratuberculosis
uggugauagaucaucccg

SEQ ID NO: 875389 - RNA, 22 nt, Mycobacterium avium subsp. paratuberculosis
uggugauagaucaucccggcca

SEQ ID NO: 875390 - RNA, 23 nt, Mycobacterium avium subsp. paratuberculosis
uggugauagaucaucccggccac

SEQ ID NO: 875391 - RNA, 18 nt, Mycobacterium avium subsp. paratuberculosis
uggugacgggcgucggcg

SEQ ID NO: 875392 - RNA, 16 nt, Mycobacterium avium subsp. paratuberculosis
uggugacggugccgcc

SEQ ID NO: 875393 - RNA, 15 nt, Mycobacterium avium subsp. paratuberculosis
uggugaaggcgaaca

SEQ ID NO: 875394 - RNA, 15 nt, Mycobacterium avium subsp. paratuberculosis
uggugaucgccgacg

SEQ ID NO: 875395 - RNA, 14 nt, Mycobacterium avium subsp. paratuberculosis
uggugaucgccgcg

SEQ ID NO: 875396 - RNA, 14 nt, Mycobacterium avium subsp. paratuberculosis
uggugaucgcggcg

SEQ ID NO: 875397 - RNA, 14 nt, Mycobacterium avium subsp. paratuberculosis
uggugaucggccag

SEQ ID NO: 875398 - RNA, 18 nt, Mycobacterium avium subsp. paratuberculosis
uggugauccucgucuccg

SEQ ID NO: 875399 - RNA, 21 nt, Mycobacterium avium subsp. paratuberculosis
uggugauccucgucuccggcg

SEQ ID NO: 875400 - RNA, 14 nt, Mycobacterium avium subsp. paratuberculosis
uggugaugaucccg

SEQ ID NO: 875401 - RNA, 17 nt, Mycobacterium avium subsp. paratuberculosis
uggugaugugcggcgcg

SEQ ID NO: 875402 - RNA, 20 nt, Mycobacterium avium subsp. paratuberculosis
uggugaugugcggcgcggcg

SEQ ID NO: 875403 - RNA, 17 nt, Mycobacterium avium subsp. paratuberculosis
uggugauuguaggugug

SEQ ID NO: 875404 - RNA, 17 nt, Mycobacterium avium subsp. paratuberculosis
uggugcaacaccgaaag

SEQ ID NO: 875405 - RNA, 18 nt, Mycobacterium avium subsp. paratuberculosis
uggucgggcaugccggcc

SEQ ID NO: 875406 - RNA, 17 nt, Mycobacterium avium subsp. paratuberculosis
uggucggcgcggcgacg

SEQ ID NO: 875407 - RNA, 16 nt, Mycobacterium avium subsp. paratuberculosis
uggucggggucgaaca

SEQ ID NO: 875408 - RNA, 17 nt, Mycobacterium avium subsp. paratuberculosis
uggucggguucgcccuc

SEQ ID NO: 875409 - RNA, 12 nt, Mycobacterium avium subsp. paratuberculosis
uggucgucgacg

SEQ ID NO: 875410 - RNA, 14 nt, Mycobacterium avium subsp. paratuberculosis
uggucgucgacgag

SEQ ID NO: 875411 - RNA, 16 nt, Mycobacterium avium subsp. paratuberculosis
uggucgucgucgaagg

SEQ ID NO: 875412 - RNA, 18 nt, Mycobacterium avium subsp. paratuberculosis
uggucgucguggugacgg

SEQ ID NO: 875413 - RNA, 18 nt, Mycobacterium avium subsp. paratuberculosis
uggugaagccguagacgg

SEQ ID NO: 875414 - RNA, 22 nt, Mycobacterium avium subsp. paratuberculosis
uggugaagccgugcacgccguc

SEQ ID NO: 875415 - RNA, 22 nt, Mycobacterium avium subsp. paratuberculosis
uggugaacagguaggcggcgcc

SEQ ID NO: 875416 - RNA, 16 nt, Mycobacterium avium subsp. paratuberculosis
uggugaaccacuucug

SEQ ID NO: 875417 - RNA, 17 nt, Mycobacterium avium subsp. paratuberculosis
uggucuugccgugcagc

SEQ ID NO: 875418 - RNA, 18 nt, Mycobacterium avium subsp. paratuberculosis
uggucucccgggcggucg

SEQ ID NO: 875419 - RNA, 15 nt, Mycobacterium avium subsp. paratuberculosis
uggucuccuggccgc

SEQ ID NO: 875420 - RNA, 19 nt, Mycobacterium avium subsp. paratuberculosis
uggucuccuggccgccgug

SEQ ID NO: 875421 - RNA, 13 nt, Mycobacterium avium subsp. paratuberculosis
uggucucguugug

SEQ ID NO: 875422 - RNA, 17 nt, Mycobacterium avium subsp. paratuberculosis
uggucugaaagugacgg

SEQ ID NO: 875423 - RNA, 20 nt, Mycobacterium avium subsp. paratuberculosis
uggucugaccccccgacgcc

SEQ ID NO: 875424 - RNA, 21 nt, Mycobacterium avium subsp. paratuberculosis
uggucugaccccccgacgccg

SEQ ID NO: 875425 - RNA, 16 nt, Mycobacterium avium subsp. paratuberculosis
uggucuggugggugug

SEQ ID NO: 875426 - RNA, 14 nt, Mycobacterium avium subsp. paratuberculosis
uggucuucgguguc

SEQ ID NO: 875427 - RNA, 16 nt, Mycobacterium avium subsp. paratuberculosis
ugcuuuuugaccaccg

SEQ ID NO: 875428 - RNA, 14 nt, Mycobacterium avium subsp. paratuberculosis
ugcuuuuugcggac

SEQ ID NO: 875429 - RNA, 21 nt, Mycobacterium avium subsp. paratuberculosis
uggccgcgcagcgugucgggg

SEQ ID NO: 875430 - RNA, 17 nt, Mycobacterium avium subsp. paratuberculosis
uggccgcgccgccgccc

SEQ ID NO: 875431 - RNA, 17 nt, Mycobacterium avium subsp. paratuberculosis
uggccgcggccgccucc

SEQ ID NO: 875432 - RNA, 15 nt, Mycobacterium avium subsp. paratuberculosis
uggccgcgucgacca

SEQ ID NO: 875433 - RNA, 22 nt, Mycobacterium avium subsp. paratuberculosis
uggccgcggaguaggcgccgcc

SEQ ID NO: 875434 - RNA, 23 nt, Mycobacterium avium subsp. paratuberculosis
uggccgcggaguaggcgccgccg

SEQ ID NO: 875435 - RNA, 15 nt, Mycobacterium avium subsp. paratuberculosis
uggccgcgccacagc

SEQ ID NO: 875436 - RNA, 18 nt, Mycobacterium avium subsp. paratuberculosis
uggccgcgcgcaggcgcu

SEQ ID NO: 875437 - RNA, 16 nt, Mycobacterium avium subsp. paratuberculosis
uggccgggucgccguc

SEQ ID NO: 875438 - RNA, 17 nt, Mycobacterium avium subsp. paratuberculosis
uggccgggucgccgucg

SEQ ID NO: 875439 - RNA, 22 nt, Mycobacterium avium subsp. paratuberculosis
uggccggugggcggcgcccgac

SEQ ID NO: 875440 - RNA, 15 nt, Mycobacterium avium subsp. paratuberculosis
uggccggguuccggu

SEQ ID NO: 875441 - RNA, 19 nt, Mycobacterium avium subsp. paratuberculosis
uggccgguauuggccacgc

SEQ ID NO: 875442 - RNA, 14 nt, Mycobacterium avium subsp. paratuberculosis
uggccggacggguc

SEQ ID NO: 875443 - RNA, 21 nt, Mycobacterium avium subsp. paratuberculosis
uggccggacgggucgaccgcc

SEQ ID NO: 875444 - RNA, 20 nt, Mycobacterium avium subsp. paratuberculosis
uggccggagcggugcggcuc

SEQ ID NO: 875445 - RNA, 21 nt, Mycobacterium avium subsp. paratuberculosis
uggcgacgaagucgacggcgg

SEQ ID NO: 875446 - RNA, 15 nt, Mycobacterium avium subsp. paratuberculosis
uggcgacgacggcgg

SEQ ID NO: 875447 - RNA, 18 nt, Mycobacterium avium subsp. paratuberculosis
uggcgacggcgacgaccg

SEQ ID NO: 875448 - RNA, 14 nt, Mycobacterium avium subsp. paratuberculosis
uggcgacggggugg

SEQ ID NO: 875449 - RNA, 20 nt, Mycobacterium avium subsp. paratuberculosis
uggcgacggucugccgggac

SEQ ID NO: 875450 - RNA, 22 nt, Mycobacterium avium subsp. paratuberculosis
uggcgacggucugccgggacag

SEQ ID NO: 875451 - RNA, 16 nt, Mycobacterium avium subsp. paratuberculosis
uggcgaccgcgacggu

SEQ ID NO: 875452 - RNA, 23 nt, Mycobacterium avium subsp. paratuberculosis
uggcgaccgcgacgguggacccg

SEQ ID NO: 875453 - RNA, 20 nt, Mycobacterium avium subsp. paratuberculosis
uggcgaccgcgcaggcggcg

SEQ ID NO: 875454 - RNA, 15 nt, Mycobacterium avium subsp. paratuberculosis
uggcgaccgcggccg

SEQ ID NO: 875455 - RNA, 22 nt, Mycobacterium avium subsp. paratuberculosis
uggcgaccgcggccgcgacggu

SEQ ID NO: 875456 - RNA, 20 nt, Mycobacterium avium subsp. paratuberculosis
uggcgaaguucggcaucccg

SEQ ID NO: 875457 - RNA, 18 nt, Mycobacterium avium subsp. paratuberculosis
uggccucgggcgacgacg

SEQ ID NO: 875458 - RNA, 23 nt, Mycobacterium avium subsp. paratuberculosis
uggccugcaacuggucgugcagc

SEQ ID NO: 875459 - RNA, 13 nt, Mycobacterium avium subsp. paratuberculosis
uggccugcacggu

SEQ ID NO: 875460 - RNA, 20 nt, Mycobacterium avium subsp. paratuberculosis
uggccugcacggugcgccgg

SEQ ID NO: 875461 - RNA, 22 nt, Mycobacterium avium subsp. paratuberculosis
uggccugcacggugcgccggca

SEQ ID NO: 875462 - RNA, 18 nt, Mycobacterium avium subsp. paratuberculosis
uggccucgcgcaaugccg

SEQ ID NO: 875463 - RNA, 20 nt, Mycobacterium avium subsp. paratuberculosis
uggccuccggagugacgucg

SEQ ID NO: 875464 - RNA, 18 nt, Mycobacterium avium subsp. paratuberculosis
uggccuccgugcuggccg

SEQ ID NO: 875465 - RNA, 15 nt, Mycobacterium avium subsp. paratuberculosis
uggccuccaccggca

SEQ ID NO: 875466 - RNA, 17 nt, Mycobacterium avium subsp. paratuberculosis
uggccucccccuugccg

SEQ ID NO: 875467 - RNA, 22 nt, Mycobacterium avium subsp. paratuberculosis
uggccucccgguagaucgccgg

SEQ ID NO: 875468 - RNA, 16 nt, Mycobacterium avium subsp. paratuberculosis
uggccgugcaccgucg

SEQ ID NO: 875469 - RNA, 14 nt, Mycobacterium avium subsp. paratuberculosis
uggccguggucggc

SEQ ID NO: 875470 - RNA, 15 nt, Mycobacterium avium subsp. paratuberculosis
uggccguggucggcg

SEQ ID NO: 875471 - RNA, 21 nt, Mycobacterium avium subsp. paratuberculosis
uggccgugugcgcaucggcga

SEQ ID NO: 875472 - RNA, 13 nt, Mycobacterium avium subsp. paratuberculosis
uggccgucgccga

SEQ ID NO: 875473 - RNA, 19 nt, Mycobacterium avium subsp. paratuberculosis
uggccgucggccugcgcug

SEQ ID NO: 875474 - RNA, 15 nt, Mycobacterium avium subsp. paratuberculosis
uggccguccggauag

SEQ ID NO: 875475 - RNA, 15 nt, Mycobacterium avium subsp. paratuberculosis
uggcgcggccggccg

SEQ ID NO: 875476 - RNA, 12 nt, Mycobacterium avium subsp. paratuberculosis
uggcgcggcggc

SEQ ID NO: 875477 - RNA, 22 nt, Mycobacterium avium subsp. paratuberculosis
uggcgccgguuucgucggucug

SEQ ID NO: 875478 - RNA, 14 nt, Mycobacterium avium subsp. paratuberculosis
uggcgccgucgagg

SEQ ID NO: 875479 - RNA, 18 nt, Mycobacterium avium subsp. paratuberculosis
uggcggccgccgcgauca

SEQ ID NO: 875480 - RNA, 21 nt, Mycobacterium avium subsp. paratuberculosis
uggcggccgccgcgaucaggg

SEQ ID NO: 875481 - RNA, 22 nt, Mycobacterium avium subsp. paratuberculosis
uggcgcuccagccacuccacca

SEQ ID NO: 875482 - RNA, 21 nt, Mycobacterium avium subsp. paratuberculosis
uggcggcgaugaagccccgga

SEQ ID NO: 875483 - RNA, 12 nt, Mycobacterium avium subsp. paratuberculosis
uggcggcgcgcu

SEQ ID NO: 875484 - RNA, 14 nt, Mycobacterium avium subsp. paratuberculosis
uggcggcgcgcucg

SEQ ID NO: 875485 - RNA, 21 nt, Mycobacterium avium subsp. paratuberculosis
uggcggcgcgcucgucgucgg

SEQ ID NO: 875486 - RNA, 23 nt, Mycobacterium avium subsp. paratuberculosis
uggcggcgcgcucgucgucggug

SEQ ID NO: 875487 - RNA, 11 nt, Mycobacterium avium subsp. paratuberculosis
uggcggcggcc

SEQ ID NO: 875488 - RNA, 14 nt, Mycobacterium avium subsp. paratuberculosis
uggcggcggcccgc

SEQ ID NO: 875489 - RNA, 18 nt, Mycobacterium avium subsp. paratuberculosis
uggcggcgucgucgccgu

SEQ ID NO: 875490 - RNA, 22 nt, Mycobacterium avium subsp. paratuberculosis
uggcggcgugcuuaacacaugc

SEQ ID NO: 875491 - RNA, 22 nt, Mycobacterium avium subsp. paratuberculosis
uggcggcggcugccucgacgau

SEQ ID NO: 875492 - RNA, 18 nt, Mycobacterium avium subsp. paratuberculosis
uggcggcgggccagcucg

SEQ ID NO: 875493 - RNA, 17 nt, Mycobacterium avium subsp. paratuberculosis
uggcggcggugaucucg

SEQ ID NO: 875494 - RNA, 18 nt, Mycobacterium avium subsp. paratuberculosis
uggcggcgaacgcgcggu

SEQ ID NO: 875495 - RNA, 19 nt, Mycobacterium avium subsp. paratuberculosis
uggcggcgaggaacucagc

SEQ ID NO: 875496 - RNA, 15 nt, Mycobacterium avium subsp. paratuberculosis
uggcggcgacaucga

SEQ ID NO: 875497 - RNA, 14 nt, Mycobacterium avium subsp. paratuberculosis
uggcggcgacccgg

SEQ ID NO: 875498 - RNA, 17 nt, Mycobacterium avium subsp. paratuberculosis
uggcggcgaucaccgcc

SEQ ID NO: 875499 - RNA, 19 nt, Mycobacterium avium subsp. paratuberculosis
uggcggcgaugucgucgac

SEQ ID NO: 875500 - RNA, 24 nt, Mycobacterium avium subsp. paratuberculosis
uggcggcgaugucgucgacgcugc

SEQ ID NO: 875501 - RNA, 20 nt, Mycobacterium avium subsp. paratuberculosis
uggcgauggccugcucgcga

SEQ ID NO: 875502 - RNA, 22 nt, Mycobacterium avium subsp. paratuberculosis
uggcgaugggcaauaccggcag

SEQ ID NO: 875503 - RNA, 15 nt, Mycobacterium avium subsp. paratuberculosis
uggcgauggugccga

SEQ ID NO: 875504 - RNA, 14 nt, Mycobacterium avium subsp. paratuberculosis
uggcgccgaaugcc

SEQ ID NO: 875505 - RNA, 17 nt, Mycobacterium avium subsp. paratuberculosis
uggcgccuccgcccggg

SEQ ID NO: 875506 - RNA, 16 nt, Mycobacterium avium subsp. paratuberculosis
uggcgccggggcgggc

SEQ ID NO: 875507 - RNA, 15 nt, Mycobacterium avium subsp. paratuberculosis
uggcgccggucgacg

SEQ ID NO: 875508 - RNA, 20 nt, Mycobacterium avium subsp. paratuberculosis
uggcgccggucgacgcgggg

SEQ ID NO: 875509 - RNA, 21 nt, Mycobacterium avium subsp. paratuberculosis
uggcgccggcguccagcgccg

SEQ ID NO: 875510 - RNA, 13 nt, Mycobacterium avium subsp. paratuberculosis
uggcgccggccag

SEQ ID NO: 875511 - RNA, 15 nt, Mycobacterium avium subsp. paratuberculosis
uggcgccggccagca

SEQ ID NO: 875512 - RNA, 20 nt, Mycobacterium avium subsp. paratuberculosis
uggcgccggcaucgaccgcc

SEQ ID NO: 875513 - RNA, 19 nt, Mycobacterium avium subsp. paratuberculosis
uggcgaucaccccggcgac

SEQ ID NO: 875514 - RNA, 20 nt, Mycobacterium avium subsp. paratuberculosis
uggcgaucaccccggcgacg

SEQ ID NO: 875515 - RNA, 22 nt, Mycobacterium avium subsp. paratuberculosis
uggcgaucaccuugcggccggc

SEQ ID NO: 875516 - RNA, 16 nt, Mycobacterium avium subsp. paratuberculosis
uggcgaucagggcggc

SEQ ID NO: 875517 - RNA, 17 nt, Mycobacterium avium subsp. paratuberculosis
uggcgaucagggcggcg

SEQ ID NO: 875518 - RNA, 19 nt, Mycobacterium avium subsp. paratuberculosis
uggcgaucagggcggcgcc

SEQ ID NO: 875519 - RNA, 22 nt, Mycobacterium avium subsp. paratuberculosis
uggcgaugacgucgucgcggcg

SEQ ID NO: 875520 - RNA, 12 nt, Mycobacterium avium subsp. paratuberculosis
uggcgaucucga

SEQ ID NO: 875521 - RNA, 23 nt, Mycobacterium avium subsp. paratuberculosis
uggcgaucgaugcccagcgcgcg

SEQ ID NO: 875522 - RNA, 12 nt, Mycobacterium avium subsp. paratuberculosis
uggcgaucauca

SEQ ID NO: 875523 - RNA, 16 nt, Mycobacterium avium subsp. paratuberculosis
uggcgaucaucgucgu

SEQ ID NO: 875524 - RNA, 15 nt, Mycobacterium avium subsp. paratuberculosis
ugguagucgucgugg

SEQ ID NO: 875525 - RNA, 14 nt, Mycobacterium avium subsp. paratuberculosis
ugguagggccgcuu

SEQ ID NO: 875526 - RNA, 15 nt, Mycobacterium avium subsp. paratuberculosis
ugguagggcuccgcg

SEQ ID NO: 875527 - RNA, 13 nt, Mycobacterium avium subsp. paratuberculosis
ugguagacgccgg

SEQ ID NO: 875528 - RNA, 20 nt, Mycobacterium avium subsp. paratuberculosis
ugguagccgccguucucgcg

SEQ ID NO: 875529 - RNA, 15 nt, Mycobacterium avium subsp. paratuberculosis
ugguacgcgccgucg

SEQ ID NO: 875530 - RNA, 23 nt, Mycobacterium avium subsp. paratuberculosis
ugggucaucaccuugucgcugac

SEQ ID NO: 875531 - RNA, 21 nt, Mycobacterium avium subsp. paratuberculosis
uggguccgauuucccgacucc

SEQ ID NO: 875532 - RNA, 22 nt, Mycobacterium avium subsp. paratuberculosis
ugggucacgcugaacggugccg

SEQ ID NO: 875533 - RNA, 14 nt, Mycobacterium avium subsp. paratuberculosis
ugggguuuggcgac

SEQ ID NO: 875534 - RNA, 18 nt, Mycobacterium avium subsp. paratuberculosis
ugggguuuggcgacgucc

SEQ ID NO: 875535 - RNA, 15 nt, Mycobacterium avium subsp. paratuberculosis
uggguauccgccgcc

SEQ ID NO: 875536 - RNA, 20 nt, Mycobacterium avium subsp. paratuberculosis
uggggcagcaccucgcgcgc

SEQ ID NO: 875537 - RNA, 13 nt, Mycobacterium avium subsp. paratuberculosis
uggggccggcgaa

SEQ ID NO: 875538 - RNA, 21 nt, Mycobacterium avium subsp. paratuberculosis
uggggaucaggaugacgccgc

SEQ ID NO: 875539 - RNA, 15 nt, Mycobacterium avium subsp. paratuberculosis
uggggacgacgccga

SEQ ID NO: 875540 - RNA, 16 nt, Mycobacterium avium subsp. paratuberculosis
uggggcaguagcgacg

SEQ ID NO: 875541 - RNA, 18 nt, Mycobacterium avium subsp. paratuberculosis
uggggccgaagccgacac

SEQ ID NO: 875542 - RNA, 14 nt, Mycobacterium avium subsp. paratuberculosis
ugggcugggucacc

SEQ ID NO: 875543 - RNA, 19 nt, Mycobacterium avium subsp. paratuberculosis
ugggcugggucaccacggu

SEQ ID NO: 875544 - RNA, 16 nt, Mycobacterium avium subsp. paratuberculosis
ugggcucggcgcggga

SEQ ID NO: 875545 - RNA, 14 nt, Mycobacterium avium subsp. paratuberculosis
ugggcucgcccggg

SEQ ID NO: 875546 - RNA, 19 nt, Mycobacterium avium subsp. paratuberculosis
ugggcucgagugccggcag

SEQ ID NO: 875547 - RNA, 20 nt, Mycobacterium avium subsp. paratuberculosis
ugggcucgagugccggcagc

SEQ ID NO: 875548 - RNA, 16 nt, Mycobacterium avium subsp. paratuberculosis
ugggcggccugcaccc

SEQ ID NO: 875549 - RNA, 20 nt, Mycobacterium avium subsp. paratuberculosis
ugggcugcgcgucgagcagc

SEQ ID NO: 875550 - RNA, 15 nt, Mycobacterium avium subsp. paratuberculosis
uggggacgucgacgu

SEQ ID NO: 875551 - RNA, 20 nt, Mycobacterium avium subsp. paratuberculosis
uggggacgugcacgcguucg

SEQ ID NO: 875552 - RNA, 19 nt, Mycobacterium avium subsp. paratuberculosis
ugggccgccgcggcggcaa

SEQ ID NO: 875553 - RNA, 15 nt, Mycobacterium avium subsp. paratuberculosis
ugggccgccggccgc

SEQ ID NO: 875554 - RNA, 22 nt, Mycobacterium avium subsp. paratuberculosis
ugggccgccgucgccaccaccg

SEQ ID NO: 875555 - RNA, 15 nt, Mycobacterium avium subsp. paratuberculosis
ugggccggcgcccgu

SEQ ID NO: 875556 - RNA, 18 nt, Mycobacterium avium subsp. paratuberculosis
ugggccggcgcccgucac

SEQ ID NO: 875557 - RNA, 15 nt, Mycobacterium avium subsp. paratuberculosis
ugggcgccggcguca

SEQ ID NO: 875558 - RNA, 15 nt, Mycobacterium avium subsp. paratuberculosis
ugggcgccgucgccg

SEQ ID NO: 875559 - RNA, 17 nt, Mycobacterium avium subsp. paratuberculosis
ugggcgccgucgccgcc

SEQ ID NO: 875560 - RNA, 11 nt, Mycobacterium avium subsp. paratuberculosis
ugggcgccgag

SEQ ID NO: 875561 - RNA, 16 nt, Mycobacterium avium subsp. paratuberculosis
ugggccuccggcggca

SEQ ID NO: 875562 - RNA, 13 nt, Mycobacterium avium subsp. paratuberculosis
ugggcggauccgc

SEQ ID NO: 875563 - RNA, 23 nt, Mycobacterium avium subsp. paratuberculosis
ugggcggauuggugccgaucacc

SEQ ID NO: 875564 - RNA, 14 nt, Mycobacterium avium subsp. paratuberculosis
ugggcgcgggccgc

SEQ ID NO: 875565 - RNA, 17 nt, Mycobacterium avium subsp. paratuberculosis
ugggcgcgaucggcagg

SEQ ID NO: 875566 - RNA, 13 nt, Mycobacterium avium subsp. paratuberculosis
ugggcaacgcggc

SEQ ID NO: 875567 - RNA, 17 nt, Mycobacterium avium subsp. paratuberculosis
ugggcaauggccgcgac

SEQ ID NO: 875568 - RNA, 22 nt, Mycobacterium avium subsp. paratuberculosis
ugggcaccagcagcgcgacgcc

SEQ ID NO: 875569 - RNA, 16 nt, Mycobacterium avium subsp. paratuberculosis
ugggcaccccgaucag

SEQ ID NO: 875570 - RNA, 16 nt, Mycobacterium avium subsp. paratuberculosis
ugggcaccggcaccgc

SEQ ID NO: 875571 - RNA, 16 nt, Mycobacterium avium subsp. paratuberculosis
ugggccgcggcgccgu

SEQ ID NO: 875572 - RNA, 16 nt, Mycobacterium avium subsp. paratuberculosis
ugggccgcaccuggca

SEQ ID NO: 875573 - RNA, 20 nt, Mycobacterium avium subsp. paratuberculosis
ugggccgcagcgcggcgaca

SEQ ID NO: 875574 - RNA, 17 nt, Mycobacterium avium subsp. paratuberculosis
ugggccaucccggggac

SEQ ID NO: 875575 - RNA, 21 nt, Mycobacterium avium subsp. paratuberculosis
ugggccaucccggggacaccg

SEQ ID NO: 875576 - RNA, 23 nt, Mycobacterium avium subsp. paratuberculosis
ugggccagcggcgccgggucacc

SEQ ID NO: 875577 - RNA, 19 nt, Mycobacterium avium subsp. paratuberculosis
ugggccagguccucgcugg

SEQ ID NO: 875578 - RNA, 17 nt, Mycobacterium avium subsp. paratuberculosis
uggcuggcggcaacggc

SEQ ID NO: 875579 - RNA, 15 nt, Mycobacterium avium subsp. paratuberculosis
uggcugucgcgcuga

SEQ ID NO: 875580 - RNA, 12 nt, Mycobacterium avium subsp. paratuberculosis
uggcgggcgcgc

SEQ ID NO: 875581 - RNA, 12 nt, Mycobacterium avium subsp. paratuberculosis
uggcggguacag

SEQ ID NO: 875582 - RNA, 13 nt, Mycobacterium avium subsp. paratuberculosis
uggcggguggcga

SEQ ID NO: 875583 - RNA, 20 nt, Mycobacterium avium subsp. paratuberculosis
uggcggugcggucgcgcagc

SEQ ID NO: 875584 - RNA, 21 nt, Mycobacterium avium subsp. paratuberculosis
uggcggugccgcggcggcgcc

SEQ ID NO: 875585 - RNA, 21 nt, Mycobacterium avium subsp. paratuberculosis
uggcgguggcggcgaaaucgc

SEQ ID NO: 875586 - RNA, 19 nt, Mycobacterium avium subsp. paratuberculosis
uggcuagcgggcgcgcagc

SEQ ID NO: 875587 - RNA, 18 nt, Mycobacterium avium subsp. paratuberculosis
uggcucucguccucgaac

SEQ ID NO: 875588 - RNA, 23 nt, Mycobacterium avium subsp. paratuberculosis
uggcucggcaccagagcgccgga

SEQ ID NO: 875589 - RNA, 16 nt, Mycobacterium avium subsp. paratuberculosis
ugcguuugccgucgag

SEQ ID NO: 875590 - RNA, 16 nt, Mycobacterium avium subsp. paratuberculosis
ugcucagccuagccuu

SEQ ID NO: 875591 - RNA, 16 nt, Mycobacterium avium subsp. paratuberculosis
ugcucaccccggccag

SEQ ID NO: 875592 - RNA, 22 nt, Mycobacterium avium subsp. paratuberculosis
ugcucaggaugauuucggcgug

SEQ ID NO: 875593 - RNA, 19 nt, Mycobacterium avium subsp. paratuberculosis
ugcuccgggggcaccgcca

SEQ ID NO: 875594 - RNA, 22 nt, Mycobacterium avium subsp. paratuberculosis
ugcuccggugaaccgcugacca

SEQ ID NO: 875595 - RNA, 23 nt, Mycobacterium avium subsp. paratuberculosis
ugcuccggugaaccgcugaccag

SEQ ID NO: 875596 - RNA, 19 nt, Mycobacterium avium subsp. paratuberculosis
ugcucccaggcgucgucgu

SEQ ID NO: 875597 - RNA, 23 nt, Mycobacterium avium subsp. paratuberculosis
ugcucgaaccgcgagacccgguc

SEQ ID NO: 875598 - RNA, 15 nt, Mycobacterium avium subsp. paratuberculosis
ugcucgaacgcgccg

SEQ ID NO: 875599 - RNA, 16 nt, Mycobacterium avium subsp. paratuberculosis
ugcucgaccagcgccg

SEQ ID NO: 875600 - RNA, 16 nt, Mycobacterium avium subsp. paratuberculosis
ugcucgaccucggcga

SEQ ID NO: 875601 - RNA, 11 nt, Mycobacterium avium subsp. paratuberculosis
ugcucgacgua

SEQ ID NO: 875602 - RNA, 23 nt, Mycobacterium avium subsp. paratuberculosis
ugcucgccguagaauccgccguu

SEQ ID NO: 875603 - RNA, 21 nt, Mycobacterium avium subsp. paratuberculosis
ugcucggaguaguccagcacc

SEQ ID NO: 875604 - RNA, 18 nt, Mycobacterium avium subsp. paratuberculosis
ugcucgcgccgggcggcc

SEQ ID NO: 875605 - RNA, 16 nt, Mycobacterium avium subsp. paratuberculosis
ugcucgcuguggcgga

SEQ ID NO: 875606 - RNA, 22 nt, Mycobacterium avium subsp. paratuberculosis
ugcucgcuugccagccgggccg

SEQ ID NO: 875607 - RNA, 17 nt, Mycobacterium avium subsp. paratuberculosis
ugcucgaugcgcaccug

SEQ ID NO: 875608 - RNA, 21 nt, Mycobacterium avium subsp. paratuberculosis
ugcucgagcaucuccagccgg

SEQ ID NO: 875609 - RNA, 21 nt, Mycobacterium avium subsp. paratuberculosis
ugcucgagcaucucggugccg

SEQ ID NO: 875610 - RNA, 19 nt, Mycobacterium avium subsp. paratuberculosis
ugcucgagggccuccacca

SEQ ID NO: 875611 - RNA, 15 nt, Mycobacterium avium subsp. paratuberculosis
ugcucgaucggcgcg

SEQ ID NO: 875612 - RNA, 18 nt, Mycobacterium avium subsp. paratuberculosis
ugcucgaucggcgcgccg

SEQ ID NO: 875613 - RNA, 19 nt, Mycobacterium avium subsp. paratuberculosis
ugcucgaucggcgcgccga

SEQ ID NO: 875614 - RNA, 16 nt, Mycobacterium avium subsp. paratuberculosis
ugcucgaucucggcca

SEQ ID NO: 875615 - RNA, 14 nt, Mycobacterium avium subsp. paratuberculosis
ugcucgaugcgcgc

SEQ ID NO: 875616 - RNA, 17 nt, Mycobacterium avium subsp. paratuberculosis
ugcucgaugcggcccug

SEQ ID NO: 875617 - RNA, 15 nt, Mycobacterium avium subsp. paratuberculosis
ugcguagcggcccga

SEQ ID NO: 875618 - RNA, 12 nt, Mycobacterium avium subsp. paratuberculosis
ugcguccaggac

SEQ ID NO: 875619 - RNA, 14 nt, Mycobacterium avium subsp. paratuberculosis
ugcgucccgcgccg

SEQ ID NO: 875620 - RNA, 15 nt, Mycobacterium avium subsp. paratuberculosis
ugcgucccgcgccgg

SEQ ID NO: 875621 - RNA, 20 nt, Mycobacterium avium subsp. paratuberculosis
ugcgucccguuggcgccggu

SEQ ID NO: 875622 - RNA, 16 nt, Mycobacterium avium subsp. paratuberculosis
ugcguccgauaccagc

SEQ ID NO: 875623 - RNA, 21 nt, Mycobacterium avium subsp. paratuberculosis
ugcguccgauaccagccgcgg

SEQ ID NO: 875624 - RNA, 24 nt, Mycobacterium avium subsp. paratuberculosis
ugcgguuggcccgcggcgcccgga

SEQ ID NO: 875625 - RNA, 17 nt, Mycobacterium avium subsp. paratuberculosis
ugcgguuggccggaauc

SEQ ID NO: 875626 - RNA, 18 nt, Mycobacterium avium subsp. paratuberculosis
ugcguacuucgcguuccg

SEQ ID NO: 875627 - RNA, 17 nt, Mycobacterium avium subsp. paratuberculosis
ugcgguggucggcguca

SEQ ID NO: 875628 - RNA, 14 nt, Mycobacterium avium subsp. paratuberculosis
ugcggugcgccgca

SEQ ID NO: 875629 - RNA, 13 nt, Mycobacterium avium subsp. paratuberculosis
ugcggugccgggc

SEQ ID NO: 875630 - RNA, 15 nt, Mycobacterium avium subsp. paratuberculosis
ugcggugccgggcca

SEQ ID NO: 875631 - RNA, 19 nt, Mycobacterium avium subsp. paratuberculosis
ugcggugccgggugcugaa

SEQ ID NO: 875632 - RNA, 15 nt, Mycobacterium avium subsp. paratuberculosis
ugcggugcggccgcg

SEQ ID NO: 875633 - RNA, 20 nt, Mycobacterium avium subsp. paratuberculosis
ugcggugcggccgcgcagcu

SEQ ID NO: 875634 - RNA, 22 nt, Mycobacterium avium subsp. paratuberculosis
ugcggugcggccgcgcagcucg

SEQ ID NO: 875635 - RNA, 13 nt, Mycobacterium avium subsp. paratuberculosis
ugcgguccaggau

SEQ ID NO: 875636 - RNA, 20 nt, Mycobacterium avium subsp. paratuberculosis
ugcgguccaggauccgcacc

SEQ ID NO: 875637 - RNA, 21 nt, Mycobacterium avium subsp. paratuberculosis
ugcgguccucgagcuggccgu

SEQ ID NO: 875638 - RNA, 14 nt, Mycobacterium avium subsp. paratuberculosis
ugcgguccccggag

SEQ ID NO: 875639 - RNA, 14 nt, Mycobacterium avium subsp. paratuberculosis
ugcggugaaaucuc

SEQ ID NO: 875640 - RNA, 14 nt, Mycobacterium avium subsp. paratuberculosis
ugcggucgcgcagc

SEQ ID NO: 875641 - RNA, 19 nt, Mycobacterium avium subsp. paratuberculosis
ugcggucgcgcagccgggc

SEQ ID NO: 875642 - RNA, 20 nt, Mycobacterium avium subsp. paratuberculosis
ugcggucgcgcagccgggcg

SEQ ID NO: 875643 - RNA, 15 nt, Mycobacterium avium subsp. paratuberculosis
ugcggugaugcgcgg

SEQ ID NO: 875644 - RNA, 13 nt, Mycobacterium avium subsp. paratuberculosis
ugcggugcaccgc

SEQ ID NO: 875645 - RNA, 19 nt, Mycobacterium avium subsp. paratuberculosis
ugcggugcaccgcggcgcg

SEQ ID NO: 875646 - RNA, 14 nt, Mycobacterium avium subsp. paratuberculosis
ugcgugguggggcc

SEQ ID NO: 875647 - RNA, 20 nt, Mycobacterium avium subsp. paratuberculosis
ugcgugguggggccgaugac

SEQ ID NO: 875648 - RNA, 16 nt, Mycobacterium avium subsp. paratuberculosis
ugcgugcgcucgaccu

SEQ ID NO: 875649 - RNA, 21 nt, Mycobacterium avium subsp. paratuberculosis
ugcgugcgggucgcgcggcua

SEQ ID NO: 875650 - RNA, 13 nt, Mycobacterium avium subsp. paratuberculosis
ugcguugcggcac

SEQ ID NO: 875651 - RNA, 14 nt, Mycobacterium avium subsp. paratuberculosis
ugcguucggccgca

SEQ ID NO: 875652 - RNA, 18 nt, Mycobacterium avium subsp. paratuberculosis
ugcguuccucgacggcga

SEQ ID NO: 875653 - RNA, 18 nt, Mycobacterium avium subsp. paratuberculosis
ugcgucggcaaugaccgg

SEQ ID NO: 875654 - RNA, 11 nt, Mycobacterium avium subsp. paratuberculosis
ugcgucgcggc

SEQ ID NO: 875655 - RNA, 12 nt, Mycobacterium avium subsp. paratuberculosis
ugcgucgcggcg

SEQ ID NO: 875656 - RNA, 15 nt, Mycobacterium avium subsp. paratuberculosis
ugcgugcccggccag

SEQ ID NO: 875657 - RNA, 18 nt, Mycobacterium avium subsp. paratuberculosis
ugcgugaccugcugggcg

SEQ ID NO: 875658 - RNA, 23 nt, Mycobacterium avium subsp. paratuberculosis
ugcgugaugaccagggccucguc

SEQ ID NO: 875659 - RNA, 14 nt, Mycobacterium avium subsp. paratuberculosis
ugcgugcagccgca

SEQ ID NO: 875660 - RNA, 15 nt, Mycobacterium avium subsp. paratuberculosis
ugcgugcagccgcaa

SEQ ID NO: 875661 - RNA, 15 nt, Mycobacterium avium subsp. paratuberculosis
ugcugcaugcgcugc

SEQ ID NO: 875662 - RNA, 20 nt, Mycobacterium avium subsp. paratuberculosis
ugcugcacgucgccggcgac

SEQ ID NO: 875663 - RNA, 18 nt, Mycobacterium avium subsp. paratuberculosis
ugcugccccucgacgaac

SEQ ID NO: 875664 - RNA, 12 nt, Mycobacterium avium subsp. paratuberculosis
ugcugcccgcgg

SEQ ID NO: 875665 - RNA, 15 nt, Mycobacterium avium subsp. paratuberculosis
ugcugcccgcggccg

SEQ ID NO: 875666 - RNA, 16 nt, Mycobacterium avium subsp. paratuberculosis
ugcugcccggcgcgga

SEQ ID NO: 875667 - RNA, 23 nt, Mycobacterium avium subsp. paratuberculosis
ugcugcaacggcuggcgcaggug

SEQ ID NO: 875668 - RNA, 22 nt, Mycobacterium avium subsp. paratuberculosis
ugcugcacgacgaccgcgacgg

SEQ ID NO: 875669 - RNA, 22 nt, Mycobacterium avium subsp. paratuberculosis
ugcugcagaccgaacgucacgg

SEQ ID NO: 875670 - RNA, 23 nt, Mycobacterium avium subsp. paratuberculosis
ugcugcagaccgaacgucacggc

SEQ ID NO: 875671 - RNA, 16 nt, Mycobacterium avium subsp. paratuberculosis
ugcugcguucggcgau

SEQ ID NO: 875672 - RNA, 22 nt, Mycobacterium avium subsp. paratuberculosis
ugcuggacggcccgacgacgcc

SEQ ID NO: 875673 - RNA, 13 nt, Mycobacterium avium subsp. paratuberculosis
ugcugccggacac

SEQ ID NO: 875674 - RNA, 19 nt, Mycobacterium avium subsp. paratuberculosis
ugcugccggacaccccggc

SEQ ID NO: 875675 - RNA, 21 nt, Mycobacterium avium subsp. paratuberculosis
ugcugcgcaacaccucggcga

SEQ ID NO: 875676 - RNA, 15 nt, Mycobacterium avium subsp. paratuberculosis
ugcugcgcggcacgg

SEQ ID NO: 875677 - RNA, 21 nt, Mycobacterium avium subsp. paratuberculosis
ugcucguccuggcgcuggugc

SEQ ID NO: 875678 - RNA, 23 nt, Mycobacterium avium subsp. paratuberculosis
ugcucgugcaaaccggaccgccg

SEQ ID NO: 875679 - RNA, 20 nt, Mycobacterium avium subsp. paratuberculosis
ugcucuccugcuugaccgug

SEQ ID NO: 875680 - RNA, 21 nt, Mycobacterium avium subsp. paratuberculosis
ugcucgugguucuccgcgaca

SEQ ID NO: 875681 - RNA, 14 nt, Mycobacterium avium subsp. paratuberculosis
ugcucggugucgau

SEQ ID NO: 875682 - RNA, 23 nt, Mycobacterium avium subsp. paratuberculosis
ugcucggugaugccgagcgccgc

SEQ ID NO: 875683 - RNA, 17 nt, Mycobacterium avium subsp. paratuberculosis
ugcucggucaacccgau

SEQ ID NO: 875684 - RNA, 16 nt, Mycobacterium avium subsp. paratuberculosis
ugcucggcggcgcagg

SEQ ID NO: 875685 - RNA, 15 nt, Mycobacterium avium subsp. paratuberculosis
ugcucuugacggccg

SEQ ID NO: 875686 - RNA, 19 nt, Mycobacterium avium subsp. paratuberculosis
ugcucuugacggccgcggc

SEQ ID NO: 875687 - RNA, 23 nt, Mycobacterium avium subsp. paratuberculosis
ugcugaacgccugccggcgccgg

SEQ ID NO: 875688 - RNA, 18 nt, Mycobacterium avium subsp. paratuberculosis
ugcugaaugaacgaccug

SEQ ID NO: 875689 - RNA, 14 nt, Mycobacterium avium subsp. paratuberculosis
ugcugagccgccga

SEQ ID NO: 875690 - RNA, 20 nt, Mycobacterium avium subsp. paratuberculosis
ugcugagcgggucggccggc

SEQ ID NO: 875691 - RNA, 15 nt, Mycobacterium avium subsp. paratuberculosis
ugcugacgucgucgc

SEQ ID NO: 875692 - RNA, 18 nt, Mycobacterium avium subsp. paratuberculosis
ugcugacgucgucgccca

SEQ ID NO: 875693 - RNA, 14 nt, Mycobacterium avium subsp. paratuberculosis
ugcugaccaaggcc

SEQ ID NO: 875694 - RNA, 15 nt, Mycobacterium avium subsp. paratuberculosis
ugcugaccaaggccg

SEQ ID NO: 875695 - RNA, 13 nt, Mycobacterium avium subsp. paratuberculosis
ugcuguucgucga

SEQ ID NO: 875696 - RNA, 14 nt, Mycobacterium avium subsp. paratuberculosis
ugcuguucgucgag

SEQ ID NO: 875697 - RNA, 15 nt, Mycobacterium avium subsp. paratuberculosis
ugcuucgucgccggg

SEQ ID NO: 875698 - RNA, 14 nt, Mycobacterium avium subsp. paratuberculosis
ugcuugaccgccag

SEQ ID NO: 875699 - RNA, 12 nt, Mycobacterium avium subsp. paratuberculosis
ugcuugccgccg

SEQ ID NO: 875700 - RNA, 14 nt, Mycobacterium avium subsp. paratuberculosis
ugcuguacgacaac

SEQ ID NO: 875701 - RNA, 14 nt, Mycobacterium avium subsp. paratuberculosis
ugcuggugccgccg

SEQ ID NO: 875702 - RNA, 17 nt, Mycobacterium avium subsp. paratuberculosis
ugcuggugccgccgaug

SEQ ID NO: 875703 - RNA, 20 nt, Mycobacterium avium subsp. paratuberculosis
ugcuguggaagggccccggc

SEQ ID NO: 875704 - RNA, 17 nt, Mycobacterium avium subsp. paratuberculosis
ugcuggcuucgcggauc

SEQ ID NO: 875705 - RNA, 15 nt, Mycobacterium avium subsp. paratuberculosis
ugcugggcggcacca

SEQ ID NO: 875706 - RNA, 21 nt, Mycobacterium avium subsp. paratuberculosis
ugcuggggguggcgucgacgg

SEQ ID NO: 875707 - RNA, 18 nt, Mycobacterium avium subsp. paratuberculosis
ugcuggccagcaccagcg

SEQ ID NO: 875708 - RNA, 16 nt, Mycobacterium avium subsp. paratuberculosis
ugcuggccaucgccga

SEQ ID NO: 875709 - RNA, 19 nt, Mycobacterium avium subsp. paratuberculosis
ugcuggcgcgauagccggu

SEQ ID NO: 875710 - RNA, 19 nt, Mycobacterium avium subsp. paratuberculosis
ugcuggcgaugugaucgcg

SEQ ID NO: 875711 - RNA, 20 nt, Mycobacterium avium subsp. paratuberculosis
ugcuggccggguuggcaucc

SEQ ID NO: 875712 - RNA, 14 nt, Mycobacterium avium subsp. paratuberculosis
ugcgcaagcaccgg

SEQ ID NO: 875713 - RNA, 21 nt, Mycobacterium avium subsp. paratuberculosis
ugcgcacccgcgggucgucgg

SEQ ID NO: 875714 - RNA, 17 nt, Mycobacterium avium subsp. paratuberculosis
ugcgcacccgguccggc

SEQ ID NO: 875715 - RNA, 21 nt, Mycobacterium avium subsp. paratuberculosis
ugcgcaccacgcccgacgacg

SEQ ID NO: 875716 - RNA, 13 nt, Mycobacterium avium subsp. paratuberculosis
ugcgcaccacguc

SEQ ID NO: 875717 - RNA, 15 nt, Mycobacterium avium subsp. paratuberculosis
ugcgcaccugcggcc

SEQ ID NO: 875718 - RNA, 13 nt, Mycobacterium avium subsp. paratuberculosis
ugcgcaccgccag

SEQ ID NO: 875719 - RNA, 21 nt, Mycobacterium avium subsp. paratuberculosis
ugcgcaccgccagcaccgacg

SEQ ID NO: 875720 - RNA, 14 nt, Mycobacterium avium subsp. paratuberculosis
ugcgcaccgugccg

SEQ ID NO: 875721 - RNA, 20 nt, Mycobacterium avium subsp. paratuberculosis
ugcgcaccgugccgcccguc

SEQ ID NO: 875722 - RNA, 13 nt, Mycobacterium avium subsp. paratuberculosis
ugcgaucauuccg

SEQ ID NO: 875723 - RNA, 15 nt, Mycobacterium avium subsp. paratuberculosis
ugcgagucaucgcca

SEQ ID NO: 875724 - RNA, 19 nt, Mycobacterium avium subsp. paratuberculosis
ugcgaaucaucguggcgcg

SEQ ID NO: 875725 - RNA, 18 nt, Mycobacterium avium subsp. paratuberculosis
ugcgagccaccucgauca

SEQ ID NO: 875726 - RNA, 17 nt, Mycobacterium avium subsp. paratuberculosis
ugcgagccagcugcgcg

SEQ ID NO: 875727 - RNA, 19 nt, Mycobacterium avium subsp. paratuberculosis
ugcgaauacccgcccagca

SEQ ID NO: 875728 - RNA, 19 nt, Mycobacterium avium subsp. paratuberculosis
ugcgagccgagcacgcagc

SEQ ID NO: 875729 - RNA, 12 nt, Mycobacterium avium subsp. paratuberculosis
ugcgagccgcug

SEQ ID NO: 875730 - RNA, 22 nt, Mycobacterium avium subsp. paratuberculosis
ugcgagccggucugggcgacca

SEQ ID NO: 875731 - RNA, 13 nt, Mycobacterium avium subsp. paratuberculosis
ugcgccaccgaca

SEQ ID NO: 875732 - RNA, 14 nt, Mycobacterium avium subsp. paratuberculosis
ugcgccaccgacac

SEQ ID NO: 875733 - RNA, 18 nt, Mycobacterium avium subsp. paratuberculosis
ugcgcagccgggcgguga

SEQ ID NO: 875734 - RNA, 15 nt, Mycobacterium avium subsp. paratuberculosis
ugcgcagccgugccc

SEQ ID NO: 875735 - RNA, 23 nt, Mycobacterium avium subsp. paratuberculosis
ugcgcagcagcaggucggccagc

SEQ ID NO: 875736 - RNA, 17 nt, Mycobacterium avium subsp. paratuberculosis
ugcgcagcagcgccagc

SEQ ID NO: 875737 - RNA, 12 nt, Mycobacterium avium subsp. paratuberculosis
ugcgcagcagca

SEQ ID NO: 875738 - RNA, 13 nt, Mycobacterium avium subsp. paratuberculosis
ugcgcagcaccuu

SEQ ID NO: 875739 - RNA, 16 nt, Mycobacterium avium subsp. paratuberculosis
ugcgcacguaccggua

SEQ ID NO: 875740 - RNA, 12 nt, Mycobacterium avium subsp. paratuberculosis
ugcgccaacgcu

SEQ ID NO: 875741 - RNA, 14 nt, Mycobacterium avium subsp. paratuberculosis
ugcgccagaucagc

SEQ ID NO: 875742 - RNA, 16 nt, Mycobacterium avium subsp. paratuberculosis
ugcgccagcaccgaca

SEQ ID NO: 875743 - RNA, 23 nt, Mycobacterium avium subsp. paratuberculosis
ugcgcccagcgcgcgaucgccgg

SEQ ID NO: 875744 - RNA, 19 nt, Mycobacterium avium subsp. paratuberculosis
ugcgcccauccggcgccgc

SEQ ID NO: 875745 - RNA, 20 nt, Mycobacterium avium subsp. paratuberculosis
ugcgcccauccggcgccgcg

SEQ ID NO: 875746 - RNA, 24 nt, Mycobacterium avium subsp. paratuberculosis
ugcgccaucuucacgugcgcggcg

SEQ ID NO: 875747 - RNA, 19 nt, Mycobacterium avium subsp. paratuberculosis
ugcgcccacgugccaucgc

SEQ ID NO: 875748 - RNA, 13 nt, Mycobacterium avium subsp. paratuberculosis
ugccuuggcggcg

SEQ ID NO: 875749 - RNA, 17 nt, Mycobacterium avium subsp. paratuberculosis
ugccuugcugacgccgc

SEQ ID NO: 875750 - RNA, 18 nt, Mycobacterium avium subsp. paratuberculosis
ugcgaaacucaccgcguc

SEQ ID NO: 875751 - RNA, 20 nt, Mycobacterium avium subsp. paratuberculosis
ugcgaaacucaccgcgucag

SEQ ID NO: 875752 - RNA, 20 nt, Mycobacterium avium subsp. paratuberculosis
ugcgaaagcccaggcccggc

SEQ ID NO: 875753 - RNA, 13 nt, Mycobacterium avium subsp. paratuberculosis
ugccguuggugac

SEQ ID NO: 875754 - RNA, 18 nt, Mycobacterium avium subsp. paratuberculosis
ugccuacaggugccggcg

SEQ ID NO: 875755 - RNA, 17 nt, Mycobacterium avium subsp. paratuberculosis
ugccuacuugcggccgc

SEQ ID NO: 875756 - RNA, 15 nt, Mycobacterium avium subsp. paratuberculosis
ugccguucgcgccgu

SEQ ID NO: 875757 - RNA, 16 nt, Mycobacterium avium subsp. paratuberculosis
ugccguucgcgccgua

SEQ ID NO: 875758 - RNA, 19 nt, Mycobacterium avium subsp. paratuberculosis
ugccguugaucagggcggc

SEQ ID NO: 875759 - RNA, 20 nt, Mycobacterium avium subsp. paratuberculosis
ugccguugaucagggcggcg

SEQ ID NO: 875760 - RNA, 22 nt, Mycobacterium avium subsp. paratuberculosis
ugccguugaucagggcggcgcg

SEQ ID NO: 875761 - RNA, 14 nt, Mycobacterium avium subsp. paratuberculosis
ugccguugccaggc

SEQ ID NO: 875762 - RNA, 17 nt, Mycobacterium avium subsp. paratuberculosis
ugccguugccaggccgc

SEQ ID NO: 875763 - RNA, 13 nt, Mycobacterium avium subsp. paratuberculosis
ugccguagcgguc

SEQ ID NO: 875764 - RNA, 14 nt, Mycobacterium avium subsp. paratuberculosis
ugccguagcggucg

SEQ ID NO: 875765 - RNA, 15 nt, Mycobacterium avium subsp. paratuberculosis
ugccguagcggucgc

SEQ ID NO: 875766 - RNA, 23 nt, Mycobacterium avium subsp. paratuberculosis
ugccguaggacaggaacgggccg

SEQ ID NO: 875767 - RNA, 22 nt, Mycobacterium avium subsp. paratuberculosis
ugccguagagccguuuggcgcc

SEQ ID NO: 875768 - RNA, 20 nt, Mycobacterium avium subsp. paratuberculosis
ugccguagaucucgcgccgc

SEQ ID NO: 875769 - RNA, 21 nt, Mycobacterium avium subsp. paratuberculosis
ugccguagaucucgcgccgcg

SEQ ID NO: 875770 - RNA, 17 nt, Mycobacterium avium subsp. paratuberculosis
ugccguagcgcugggug

SEQ ID NO: 875771 - RNA, 16 nt, Mycobacterium avium subsp. paratuberculosis
ugccguacauggugac

SEQ ID NO: 875772 - RNA, 21 nt, Mycobacterium avium subsp. paratuberculosis
ugccguacauggugaccagcg

SEQ ID NO: 875773 - RNA, 18 nt, Mycobacterium avium subsp. paratuberculosis
ugccgcggugcggcccgc

SEQ ID NO: 875774 - RNA, 12 nt, Mycobacterium avium subsp. paratuberculosis
ugccgcggcgca

SEQ ID NO: 875775 - RNA, 18 nt, Mycobacterium avium subsp. paratuberculosis
ugccgcggcgcaccccga

SEQ ID NO: 875776 - RNA, 13 nt, Mycobacterium avium subsp. paratuberculosis
ugccgcggccgcg

SEQ ID NO: 875777 - RNA, 16 nt, Mycobacterium avium subsp. paratuberculosis
ugccgcggaucagcag

SEQ ID NO: 875778 - RNA, 15 nt, Mycobacterium avium subsp. paratuberculosis
ugccgucaccggcca

SEQ ID NO: 875779 - RNA, 22 nt, Mycobacterium avium subsp. paratuberculosis
ugccgucaccggccauccgcug

SEQ ID NO: 875780 - RNA, 15 nt, Mycobacterium avium subsp. paratuberculosis
ugccgucacgcccgu

SEQ ID NO: 875781 - RNA, 21 nt, Mycobacterium avium subsp. paratuberculosis
ugccgucacguucaccaccgg

SEQ ID NO: 875782 - RNA, 17 nt, Mycobacterium avium subsp. paratuberculosis
ugccgucacugucggcg

SEQ ID NO: 875783 - RNA, 18 nt, Mycobacterium avium subsp. paratuberculosis
ugccgucacugucggcgc

SEQ ID NO: 875784 - RNA, 20 nt, Mycobacterium avium subsp. paratuberculosis
ugccguccagcaacgccgac

SEQ ID NO: 875785 - RNA, 14 nt, Mycobacterium avium subsp. paratuberculosis
ugccgucguugacg

SEQ ID NO: 875786 - RNA, 17 nt, Mycobacterium avium subsp. paratuberculosis
ugccgucguugacgccc

SEQ ID NO: 875787 - RNA, 13 nt, Mycobacterium avium subsp. paratuberculosis
ugccguggucggc

SEQ ID NO: 875788 - RNA, 13 nt, Mycobacterium avium subsp. paratuberculosis
ugccguggucggu

SEQ ID NO: 875789 - RNA, 16 nt, Mycobacterium avium subsp. paratuberculosis
ugccguggucggugcc

SEQ ID NO: 875790 - RNA, 14 nt, Mycobacterium avium subsp. paratuberculosis
ugccguucagcgcg

SEQ ID NO: 875791 - RNA, 15 nt, Mycobacterium avium subsp. paratuberculosis
ugccguuccagccgg

SEQ ID NO: 875792 - RNA, 13 nt, Mycobacterium avium subsp. paratuberculosis
ugccgugcgcgcu

SEQ ID NO: 875793 - RNA, 18 nt, Mycobacterium avium subsp. paratuberculosis
ugccgugccagccggccg

SEQ ID NO: 875794 - RNA, 16 nt, Mycobacterium avium subsp. paratuberculosis
ugccgugcucggcggc

SEQ ID NO: 875795 - RNA, 20 nt, Mycobacterium avium subsp. paratuberculosis
ugccgugcucggcggcgggg

SEQ ID NO: 875796 - RNA, 19 nt, Mycobacterium avium subsp. paratuberculosis
ugccgugcugggacagcga

SEQ ID NO: 875797 - RNA, 13 nt, Mycobacterium avium subsp. paratuberculosis
ugccguggcggcg

SEQ ID NO: 875798 - RNA, 23 nt, Mycobacterium avium subsp. paratuberculosis
ugccguggcggcggugucgccca

SEQ ID NO: 875799 - RNA, 16 nt, Mycobacterium avium subsp. paratuberculosis
ugcgguaugccaagcc

SEQ ID NO: 875800 - RNA, 20 nt, Mycobacterium avium subsp. paratuberculosis
ugcgguacacguggccgauc

SEQ ID NO: 875801 - RNA, 22 nt, Mycobacterium avium subsp. paratuberculosis
ugcgguacacguggccgaucag

SEQ ID NO: 875802 - RNA, 21 nt, Mycobacterium avium subsp. paratuberculosis
ugcgguacaucccgccgggca

SEQ ID NO: 875803 - RNA, 21 nt, Mycobacterium avium subsp. paratuberculosis
ugcgggugguguggcgucggc

SEQ ID NO: 875804 - RNA, 15 nt, Mycobacterium avium subsp. paratuberculosis
ugcggguugcgggcc

SEQ ID NO: 875805 - RNA, 15 nt, Mycobacterium avium subsp. paratuberculosis
ugcgggugucgccgg

SEQ ID NO: 875806 - RNA, 16 nt, Mycobacterium avium subsp. paratuberculosis
ugcgggugucgccggu

SEQ ID NO: 875807 - RNA, 20 nt, Mycobacterium avium subsp. paratuberculosis
ugcggguguugcgcagcguc

SEQ ID NO: 875808 - RNA, 14 nt, Mycobacterium avium subsp. paratuberculosis
ugcgggcaucgcug

SEQ ID NO: 875809 - RNA, 19 nt, Mycobacterium avium subsp. paratuberculosis
ugcgggccaccgucccggu

SEQ ID NO: 875810 - RNA, 15 nt, Mycobacterium avium subsp. paratuberculosis
ugcgggaugccgagc

SEQ ID NO: 875811 - RNA, 16 nt, Mycobacterium avium subsp. paratuberculosis
ugcgggccagcacgac

SEQ ID NO: 875812 - RNA, 11 nt, Mycobacterium avium subsp. paratuberculosis
ugcgggcccag

SEQ ID NO: 875813 - RNA, 13 nt, Mycobacterium avium subsp. paratuberculosis
ugcgggcccagcu

SEQ ID NO: 875814 - RNA, 12 nt, Mycobacterium avium subsp. paratuberculosis
ugcgggccgaac

SEQ ID NO: 875815 - RNA, 16 nt, Mycobacterium avium subsp. paratuberculosis
ugcgggucacacccuc

SEQ ID NO: 875816 - RNA, 14 nt, Mycobacterium avium subsp. paratuberculosis
ugcgggucagcagc

SEQ ID NO: 875817 - RNA, 16 nt, Mycobacterium avium subsp. paratuberculosis
ugcggcugcgcguucg

SEQ ID NO: 875818 - RNA, 14 nt, Mycobacterium avium subsp. paratuberculosis
ugcggccgucggga

SEQ ID NO: 875819 - RNA, 16 nt, Mycobacterium avium subsp. paratuberculosis
ugcggcgcuucgggug

SEQ ID NO: 875820 - RNA, 14 nt, Mycobacterium avium subsp. paratuberculosis
ugcggcugggugga

SEQ ID NO: 875821 - RNA, 14 nt, Mycobacterium avium subsp. paratuberculosis
ugcggcgcaccccg

SEQ ID NO: 875822 - RNA, 19 nt, Mycobacterium avium subsp. paratuberculosis
ugcggcgcaccccguccag

SEQ ID NO: 875823 - RNA, 20 nt, Mycobacterium avium subsp. paratuberculosis
ugcggcgcaccccguccagg

SEQ ID NO: 875824 - RNA, 11 nt, Mycobacterium avium subsp. paratuberculosis
ugcggcgcagc

SEQ ID NO: 875825 - RNA, 18 nt, Mycobacterium avium subsp. paratuberculosis
ugcggcgcagccagcucg

SEQ ID NO: 875826 - RNA, 22 nt, Mycobacterium avium subsp. paratuberculosis
ugcggcgcagcgucucgaucga

SEQ ID NO: 875827 - RNA, 16 nt, Mycobacterium avium subsp. paratuberculosis
ugcggcgcccuucccg

SEQ ID NO: 875828 - RNA, 14 nt, Mycobacterium avium subsp. paratuberculosis
ugcggcgcggucgc

SEQ ID NO: 875829 - RNA, 21 nt, Mycobacterium avium subsp. paratuberculosis
ugcggcgcggugcgccgacag

SEQ ID NO: 875830 - RNA, 15 nt, Mycobacterium avium subsp. paratuberculosis
ugcggcgaacgcguc

SEQ ID NO: 875831 - RNA, 17 nt, Mycobacterium avium subsp. paratuberculosis
ugcggccguccagcguc

SEQ ID NO: 875832 - RNA, 24 nt, Mycobacterium avium subsp. paratuberculosis
ugcggccguccagcgucuggcagc

SEQ ID NO: 875833 - RNA, 21 nt, Mycobacterium avium subsp. paratuberculosis
ugcggccucggcaccgugccg

SEQ ID NO: 875834 - RNA, 18 nt, Mycobacterium avium subsp. paratuberculosis
ugcggccgcagcgcccgg

SEQ ID NO: 875835 - RNA, 22 nt, Mycobacterium avium subsp. paratuberculosis
ugcggccgcagcgcccggcagc

SEQ ID NO: 875836 - RNA, 14 nt, Mycobacterium avium subsp. paratuberculosis
ugcggccgccgauc

SEQ ID NO: 875837 - RNA, 19 nt, Mycobacterium avium subsp. paratuberculosis
ugcggccgcgacugcaccc

SEQ ID NO: 875838 - RNA, 13 nt, Mycobacterium avium subsp. paratuberculosis
ugcggccgcgauc

SEQ ID NO: 875839 - RNA, 14 nt, Mycobacterium avium subsp. paratuberculosis
ugcggccgcgcagc

SEQ ID NO: 875840 - RNA, 22 nt, Mycobacterium avium subsp. paratuberculosis
ugcggccgcgcagcucgacgac

SEQ ID NO: 875841 - RNA, 13 nt, Mycobacterium avium subsp. paratuberculosis
ugcggccggacca

SEQ ID NO: 875842 - RNA, 15 nt, Mycobacterium avium subsp. paratuberculosis
ugcggccggccauga

SEQ ID NO: 875843 - RNA, 16 nt, Mycobacterium avium subsp. paratuberculosis
ugcggccggcgccggc

SEQ ID NO: 875844 - RNA, 13 nt, Mycobacterium avium subsp. paratuberculosis
ugcggccggcggc

SEQ ID NO: 875845 - RNA, 17 nt, Mycobacterium avium subsp. paratuberculosis
ugcggccggcggugucg

SEQ ID NO: 875846 - RNA, 21 nt, Mycobacterium avium subsp. paratuberculosis
ugcggaaucacuuccgcggca

SEQ ID NO: 875847 - RNA, 20 nt, Mycobacterium avium subsp. paratuberculosis
ugcggacccaggcagcgcga

SEQ ID NO: 875848 - RNA, 17 nt, Mycobacterium avium subsp. paratuberculosis
ugcggacggucgccgac

SEQ ID NO: 875849 - RNA, 16 nt, Mycobacterium avium subsp. paratuberculosis
ugcggcccgacccggu

SEQ ID NO: 875850 - RNA, 14 nt, Mycobacterium avium subsp. paratuberculosis
ugcggcccgccggg

SEQ ID NO: 875851 - RNA, 15 nt, Mycobacterium avium subsp. paratuberculosis
ugcggcccgcggcau

SEQ ID NO: 875852 - RNA, 23 nt, Mycobacterium avium subsp. paratuberculosis
ugcggcccggccacucgccgcga

SEQ ID NO: 875853 - RNA, 17 nt, Mycobacterium avium subsp. paratuberculosis
ugcggcccuggcgggcg

SEQ ID NO: 875854 - RNA, 17 nt, Mycobacterium avium subsp. paratuberculosis
ugcggcccuugcggccg

SEQ ID NO: 875855 - RNA, 23 nt, Mycobacterium avium subsp. paratuberculosis
ugcggcccuugcggccgaucacc

SEQ ID NO: 875856 - RNA, 15 nt, Mycobacterium avium subsp. paratuberculosis
ugcgcuugcggcgca

SEQ ID NO: 875857 - RNA, 17 nt, Mycobacterium avium subsp. paratuberculosis
ugcgcuugcggcgcagc

SEQ ID NO: 875858 - RNA, 17 nt, Mycobacterium avium subsp. paratuberculosis
ugcgcuugggucgccgg

SEQ ID NO: 875859 - RNA, 14 nt, Mycobacterium avium subsp. paratuberculosis
ugcggaacaccgcc

SEQ ID NO: 875860 - RNA, 15 nt, Mycobacterium avium subsp. paratuberculosis
ugcgcuugucagcgg

SEQ ID NO: 875861 - RNA, 13 nt, Mycobacterium avium subsp. paratuberculosis
ugcgcgacgccgu

SEQ ID NO: 875862 - RNA, 21 nt, Mycobacterium avium subsp. paratuberculosis
ugcgcgacgcugauggcgagg

SEQ ID NO: 875863 - RNA, 13 nt, Mycobacterium avium subsp. paratuberculosis
ugcgcgacggccu

SEQ ID NO: 875864 - RNA, 20 nt, Mycobacterium avium subsp. paratuberculosis
ugcgcgacggccucgccguc

SEQ ID NO: 875865 - RNA, 21 nt, Mycobacterium avium subsp. paratuberculosis
ugcgcgaccucuucgcuggac

SEQ ID NO: 875866 - RNA, 15 nt, Mycobacterium avium subsp. paratuberculosis
ugcgcgagauggcga

SEQ ID NO: 875867 - RNA, 19 nt, Mycobacterium avium subsp. paratuberculosis
ugcgcgagauggcgaucag

SEQ ID NO: 875868 - RNA, 18 nt, Mycobacterium avium subsp. paratuberculosis
ugcgcgagcagcucgaca

SEQ ID NO: 875869 - RNA, 13 nt, Mycobacterium avium subsp. paratuberculosis
ugcgcgccaccag

SEQ ID NO: 875870 - RNA, 14 nt, Mycobacterium avium subsp. paratuberculosis
ugcgcgccaccagg

SEQ ID NO: 875871 - RNA, 17 nt, Mycobacterium avium subsp. paratuberculosis
ugcgcgccagcagcgcg

SEQ ID NO: 875872 - RNA, 20 nt, Mycobacterium avium subsp. paratuberculosis
ugcgcgccagcagcgcgccg

SEQ ID NO: 875873 - RNA, 17 nt, Mycobacterium avium subsp. paratuberculosis
ugcgcgaugucgacggu

SEQ ID NO: 875874 - RNA, 14 nt, Mycobacterium avium subsp. paratuberculosis
ugcgcgcaccaggc

SEQ ID NO: 875875 - RNA, 23 nt, Mycobacterium avium subsp. paratuberculosis
ugcgcgcaccaggccgacgcugg

SEQ ID NO: 875876 - RNA, 14 nt, Mycobacterium avium subsp. paratuberculosis
ugcgcgaucgccgg

SEQ ID NO: 875877 - RNA, 15 nt, Mycobacterium avium subsp. paratuberculosis
ugcgcgaucgccgga

SEQ ID NO: 875878 - RNA, 22 nt, Mycobacterium avium subsp. paratuberculosis
ugcgcccugguugauccagcgg

SEQ ID NO: 875879 - RNA, 13 nt, Mycobacterium avium subsp. paratuberculosis
ugcgccgaccgcg

SEQ ID NO: 875880 - RNA, 19 nt, Mycobacterium avium subsp. paratuberculosis
ugcgccgacuugaucgcgg

SEQ ID NO: 875881 - RNA, 14 nt, Mycobacterium avium subsp. paratuberculosis
ugcgcccgcugcgg

SEQ ID NO: 875882 - RNA, 16 nt, Mycobacterium avium subsp. paratuberculosis
ugcgcccgcugcggcg

SEQ ID NO: 875883 - RNA, 13 nt, Mycobacterium avium subsp. paratuberculosis
ugcgcccggucac

SEQ ID NO: 875884 - RNA, 19 nt, Mycobacterium avium subsp. paratuberculosis
ugcgcccgccgccaccacg

SEQ ID NO: 875885 - RNA, 14 nt, Mycobacterium avium subsp. paratuberculosis
ugcgcccgacgccg

SEQ ID NO: 875886 - RNA, 22 nt, Mycobacterium avium subsp. paratuberculosis
ugcgcccgacgccggaccccac

SEQ ID NO: 875887 - RNA, 17 nt, Mycobacterium avium subsp. paratuberculosis
ugcgcccgaucggcgug

SEQ ID NO: 875888 - RNA, 16 nt, Mycobacterium avium subsp. paratuberculosis
ugcgccccggcgggcg

SEQ ID NO: 875889 - RNA, 20 nt, Mycobacterium avium subsp. paratuberculosis
ugcgccccggcgucgaugac

SEQ ID NO: 875890 - RNA, 14 nt, Mycobacterium avium subsp. paratuberculosis
ugcgcgggcgcgga

SEQ ID NO: 875891 - RNA, 16 nt, Mycobacterium avium subsp. paratuberculosis
ugcgcgggcgcggaca

SEQ ID NO: 875892 - RNA, 16 nt, Mycobacterium avium subsp. paratuberculosis
ugcgcgggguggcgcc

SEQ ID NO: 875893 - RNA, 18 nt, Mycobacterium avium subsp. paratuberculosis
ugcgcgggguggcgccgg

SEQ ID NO: 875894 - RNA, 20 nt, Mycobacterium avium subsp. paratuberculosis
ugcgcgggaacgaucggcuc

SEQ ID NO: 875895 - RNA, 14 nt, Mycobacterium avium subsp. paratuberculosis
ugcgcugcaaccgg

SEQ ID NO: 875896 - RNA, 16 nt, Mycobacterium avium subsp. paratuberculosis
ugcgcugcaaccgguc

SEQ ID NO: 875897 - RNA, 14 nt, Mycobacterium avium subsp. paratuberculosis
ugcgcuggcgaaca

SEQ ID NO: 875898 - RNA, 15 nt, Mycobacterium avium subsp. paratuberculosis
ugcgcuguggugacg

SEQ ID NO: 875899 - RNA, 18 nt, Mycobacterium avium subsp. paratuberculosis
ugcgcgccgcgacgucgg

SEQ ID NO: 875900 - RNA, 22 nt, Mycobacterium avium subsp. paratuberculosis
ugcgcgccgcgacgucggugua

SEQ ID NO: 875901 - RNA, 13 nt, Mycobacterium avium subsp. paratuberculosis
ugcgcgccggcgg

SEQ ID NO: 875902 - RNA, 14 nt, Mycobacterium avium subsp. paratuberculosis
ugcgcgccgugacg

SEQ ID NO: 875903 - RNA, 17 nt, Mycobacterium avium subsp. paratuberculosis
ugcgcgccgugacgccg

SEQ ID NO: 875904 - RNA, 14 nt, Mycobacterium avium subsp. paratuberculosis
ugcgcgccuccgac

SEQ ID NO: 875905 - RNA, 21 nt, Mycobacterium avium subsp. paratuberculosis
ugcgcgccgcccucgccgaac

SEQ ID NO: 875906 - RNA, 23 nt, Mycobacterium avium subsp. paratuberculosis
ugcgcgccgcccucgccgaaccg

SEQ ID NO: 875907 - RNA, 11 nt, Mycobacterium avium subsp. paratuberculosis
ugcgcgccgau

SEQ ID NO: 875908 - RNA, 12 nt, Mycobacterium avium subsp. paratuberculosis
ugcgcgccgaug

SEQ ID NO: 875909 - RNA, 13 nt, Mycobacterium avium subsp. paratuberculosis
ugcgcggcgccgg

SEQ ID NO: 875910 - RNA, 17 nt, Mycobacterium avium subsp. paratuberculosis
ugcgcgggcaaucgcug

SEQ ID NO: 875911 - RNA, 21 nt, Mycobacterium avium subsp. paratuberculosis
ugcgcggcguccucgaugacg

SEQ ID NO: 875912 - RNA, 18 nt, Mycobacterium avium subsp. paratuberculosis
ugcgcggcggcggcgcgg

SEQ ID NO: 875913 - RNA, 16 nt, Mycobacterium avium subsp. paratuberculosis
ugcgcggcggcguccg

SEQ ID NO: 875914 - RNA, 22 nt, Mycobacterium avium subsp. paratuberculosis
ugcgcggcggcguccgcggccg

SEQ ID NO: 875915 - RNA, 20 nt, Mycobacterium avium subsp. paratuberculosis
ugcgcggcgaccaccucggc

SEQ ID NO: 875916 - RNA, 21 nt, Mycobacterium avium subsp. paratuberculosis
ugcgcggcgaccaccucggcg

SEQ ID NO: 875917 - RNA, 23 nt, Mycobacterium avium subsp. paratuberculosis
ugcgcggcgaccaccucggcgac

SEQ ID NO: 875918 - RNA, 15 nt, Mycobacterium avium subsp. paratuberculosis
ugcgcggccgcgucg

SEQ ID NO: 875919 - RNA, 19 nt, Mycobacterium avium subsp. paratuberculosis
ugcgcggccgcgucggcgg

SEQ ID NO: 875920 - RNA, 22 nt, Mycobacterium avium subsp. paratuberculosis
ugcgcggcccguugagcaccgc

SEQ ID NO: 875921 - RNA, 16 nt, Mycobacterium avium subsp. paratuberculosis
ugcgcggccgcccagu

SEQ ID NO: 875922 - RNA, 17 nt, Mycobacterium avium subsp. paratuberculosis
ugcgcgccgucggcgau

SEQ ID NO: 875923 - RNA, 14 nt, Mycobacterium avium subsp. paratuberculosis
ugccgccggccucg

SEQ ID NO: 875924 - RNA, 17 nt, Mycobacterium avium subsp. paratuberculosis
ugccgccggccucgggg

SEQ ID NO: 875925 - RNA, 12 nt, Mycobacterium avium subsp. paratuberculosis
ugccgccggcgc

SEQ ID NO: 875926 - RNA, 13 nt, Mycobacterium avium subsp. paratuberculosis
ugccgccggcgca

SEQ ID NO: 875927 - RNA, 15 nt, Mycobacterium avium subsp. paratuberculosis
ugccgccggcgcagu

SEQ ID NO: 875928 - RNA, 17 nt, Mycobacterium avium subsp. paratuberculosis
ugccgcgcacuggagug

SEQ ID NO: 875929 - RNA, 20 nt, Mycobacterium avium subsp. paratuberculosis
ugccgcgcacuggagugcug

SEQ ID NO: 875930 - RNA, 12 nt, Mycobacterium avium subsp. paratuberculosis
ugccgcgcacca

SEQ ID NO: 875931 - RNA, 22 nt, Mycobacterium avium subsp. paratuberculosis
ugccgcgccaacgaggcacggc

SEQ ID NO: 875932 - RNA, 16 nt, Mycobacterium avium subsp. paratuberculosis
ugccgcgccccgagca

SEQ ID NO: 875933 - RNA, 20 nt, Mycobacterium avium subsp. paratuberculosis
ugccgcgccccgagcagcgg

SEQ ID NO: 875934 - RNA, 21 nt, Mycobacterium avium subsp. paratuberculosis
ugccgcgccccgagcagcggg

SEQ ID NO: 875935 - RNA, 13 nt, Mycobacterium avium subsp. paratuberculosis
ugccgcgccgggg

SEQ ID NO: 875936 - RNA, 15 nt, Mycobacterium avium subsp. paratuberculosis
ugccgcgcucgucga

SEQ ID NO: 875937 - RNA, 16 nt, Mycobacterium avium subsp. paratuberculosis
ugccgcgcugcgccgg

SEQ ID NO: 875938 - RNA, 14 nt, Mycobacterium avium subsp. paratuberculosis
ugccgcgcggacgc

SEQ ID NO: 875939 - RNA, 14 nt, Mycobacterium avium subsp. paratuberculosis
ugccgcgcggcgau

SEQ ID NO: 875940 - RNA, 13 nt, Mycobacterium avium subsp. paratuberculosis
ugccgcgcggcgc

SEQ ID NO: 875941 - RNA, 14 nt, Mycobacterium avium subsp. paratuberculosis
ugccgcgcggcggu

SEQ ID NO: 875942 - RNA, 12 nt, Mycobacterium avium subsp. paratuberculosis
ugccgcgcgccg

SEQ ID NO: 875943 - RNA, 13 nt, Mycobacterium avium subsp. paratuberculosis
ugccgcgcgccga

SEQ ID NO: 875944 - RNA, 14 nt, Mycobacterium avium subsp. paratuberculosis
ugccgcgcgccgac

SEQ ID NO: 875945 - RNA, 15 nt, Mycobacterium avium subsp. paratuberculosis
ugccgcgcgccgaca

SEQ ID NO: 875946 - RNA, 16 nt, Mycobacterium avium subsp. paratuberculosis
ugccgccgccagcgcg

SEQ ID NO: 875947 - RNA, 18 nt, Mycobacterium avium subsp. paratuberculosis
ugccgccgcccaggccga

SEQ ID NO: 875948 - RNA, 19 nt, Mycobacterium avium subsp. paratuberculosis
ugccgcccaacgacgucgg

SEQ ID NO: 875949 - RNA, 16 nt, Mycobacterium avium subsp. paratuberculosis
ugccgcccaccaccgg

SEQ ID NO: 875950 - RNA, 13 nt, Mycobacterium avium subsp. paratuberculosis
ugccgccgacgau

SEQ ID NO: 875951 - RNA, 15 nt, Mycobacterium avium subsp. paratuberculosis
ugccgccgcgcgcgg

SEQ ID NO: 875952 - RNA, 17 nt, Mycobacterium avium subsp. paratuberculosis
ugccgccgcgcgcggcc

SEQ ID NO: 875953 - RNA, 18 nt, Mycobacterium avium subsp. paratuberculosis
ugccgccgcgcgcggcca

SEQ ID NO: 875954 - RNA, 20 nt, Mycobacterium avium subsp. paratuberculosis
ugccgccgcgacgaugccgg

SEQ ID NO: 875955 - RNA, 20 nt, Mycobacterium avium subsp. paratuberculosis
ugccgaugcugagcgggucg

SEQ ID NO: 875956 - RNA, 16 nt, Mycobacterium avium subsp. paratuberculosis
ugccgauggccaccgg

SEQ ID NO: 875957 - RNA, 13 nt, Mycobacterium avium subsp. paratuberculosis
ugccgauggcggu

SEQ ID NO: 875958 - RNA, 23 nt, Mycobacterium avium subsp. paratuberculosis
ugccgauggcgguccaccaccac

SEQ ID NO: 875959 - RNA, 14 nt, Mycobacterium avium subsp. paratuberculosis
ugccgaugccggcg

SEQ ID NO: 875960 - RNA, 15 nt, Mycobacterium avium subsp. paratuberculosis
ugccgaucuggucca

SEQ ID NO: 875961 - RNA, 15 nt, Mycobacterium avium subsp. paratuberculosis
ugccgaucgccgcgg

SEQ ID NO: 875962 - RNA, 17 nt, Mycobacterium avium subsp. paratuberculosis
ugccgaucgccgcggcg

SEQ ID NO: 875963 - RNA, 23 nt, Mycobacterium avium subsp. paratuberculosis
ugccgaacugguuguagucgucg

SEQ ID NO: 875964 - RNA, 16 nt, Mycobacterium avium subsp. paratuberculosis
ugccgaagggcaaccg

SEQ ID NO: 875965 - RNA, 17 nt, Mycobacterium avium subsp. paratuberculosis
ugccgacccgcugcagc

SEQ ID NO: 875966 - RNA, 16 nt, Mycobacterium avium subsp. paratuberculosis
ugccgaucccggccag

SEQ ID NO: 875967 - RNA, 17 nt, Mycobacterium avium subsp. paratuberculosis
ugccgaucccggccagc

SEQ ID NO: 875968 - RNA, 17 nt, Mycobacterium avium subsp. paratuberculosis
ugccgauccgcaccgga

SEQ ID NO: 875969 - RNA, 19 nt, Mycobacterium avium subsp. paratuberculosis
ugccgauccgcaccggacg

SEQ ID NO: 875970 - RNA, 13 nt, Mycobacterium avium subsp. paratuberculosis
ugccgaucgagac

SEQ ID NO: 875971 - RNA, 14 nt, Mycobacterium avium subsp. paratuberculosis
ugccgaucgagacc

SEQ ID NO: 875972 - RNA, 15 nt, Mycobacterium avium subsp. paratuberculosis
ugccgaucgagacca

SEQ ID NO: 875973 - RNA, 21 nt, Mycobacterium avium subsp. paratuberculosis
ugccgaccgacagccgcacca

SEQ ID NO: 875974 - RNA, 14 nt, Mycobacterium avium subsp. paratuberculosis
ugccgacaccccac

SEQ ID NO: 875975 - RNA, 14 nt, Mycobacterium avium subsp. paratuberculosis
ugccgaagccguug

SEQ ID NO: 875976 - RNA, 23 nt, Mycobacterium avium subsp. paratuberculosis
ugccgaagccguugacgguguuc

SEQ ID NO: 875977 - RNA, 17 nt, Mycobacterium avium subsp. paratuberculosis
ugccgaagcgccgcaug

SEQ ID NO: 875978 - RNA, 15 nt, Mycobacterium avium subsp. paratuberculosis
ugcccuuggccagca

SEQ ID NO: 875979 - RNA, 16 nt, Mycobacterium avium subsp. paratuberculosis
ugccgaacgcgaucca

SEQ ID NO: 875980 - RNA, 14 nt, Mycobacterium avium subsp. paratuberculosis
ugccgaacggcgcu

SEQ ID NO: 875981 - RNA, 17 nt, Mycobacterium avium subsp. paratuberculosis
ugcccgagaucaccggc

SEQ ID NO: 875982 - RNA, 23 nt, Mycobacterium avium subsp. paratuberculosis
ugcccgagcaccugaacggccgc

SEQ ID NO: 875983 - RNA, 18 nt, Mycobacterium avium subsp. paratuberculosis
ugcccgaggucauaucga

SEQ ID NO: 875984 - RNA, 21 nt, Mycobacterium avium subsp. paratuberculosis
ugcccgaggucauaucgacgg

SEQ ID NO: 875985 - RNA, 20 nt, Mycobacterium avium subsp. paratuberculosis
ugcccgagcugaucgcggcc

SEQ ID NO: 875986 - RNA, 23 nt, Mycobacterium avium subsp. paratuberculosis
ugcccgacggcgcgcccgacgau

SEQ ID NO: 875987 - RNA, 15 nt, Mycobacterium avium subsp. paratuberculosis
ugcccgacuccucac

SEQ ID NO: 875988 - RNA, 20 nt, Mycobacterium avium subsp. paratuberculosis
ugcccgauggugaagccgug

SEQ ID NO: 875989 - RNA, 22 nt, Mycobacterium avium subsp. paratuberculosis
ugcccgauuggaagagggccau

SEQ ID NO: 875990 - RNA, 15 nt, Mycobacterium avium subsp. paratuberculosis
ugcccgaucagccgg

SEQ ID NO: 875991 - RNA, 15 nt, Mycobacterium avium subsp. paratuberculosis
ugcccgcaucgccga

SEQ ID NO: 875992 - RNA, 17 nt, Mycobacterium avium subsp. paratuberculosis
ugcccgcaucgccgaac

SEQ ID NO: 875993 - RNA, 23 nt, Mycobacterium avium subsp. paratuberculosis
ugcccgcccacgggucgccgauc

SEQ ID NO: 875994 - RNA, 22 nt, Mycobacterium avium subsp. paratuberculosis
ugcccgcccgagaguccgccgc

SEQ ID NO: 875995 - RNA, 19 nt, Mycobacterium avium subsp. paratuberculosis
ugcccgcccuugucgaucc

SEQ ID NO: 875996 - RNA, 16 nt, Mycobacterium avium subsp. paratuberculosis
ugcccgccgacgccca

SEQ ID NO: 875997 - RNA, 15 nt, Mycobacterium avium subsp. paratuberculosis
ugcccgccgccgaug

SEQ ID NO: 875998 - RNA, 15 nt, Mycobacterium avium subsp. paratuberculosis
ugcccgccgcgaccg

SEQ ID NO: 875999 - RNA, 16 nt, Mycobacterium avium subsp. paratuberculosis
ugcccgccgcggccgc

SEQ ID NO: 876000 - RNA, 21 nt, Mycobacterium avium subsp. paratuberculosis
ugcccgccgcggcgagccggc

SEQ ID NO: 876001 - RNA, 22 nt, Mycobacterium avium subsp. paratuberculosis
ugcccgccgcguacagcagcug

SEQ ID NO: 876002 - RNA, 23 nt, Mycobacterium avium subsp. paratuberculosis
ugcccggggucugacccaugccc

SEQ ID NO: 876003 - RNA, 13 nt, Mycobacterium avium subsp. paratuberculosis
ugcccuagcggug

SEQ ID NO: 876004 - RNA, 16 nt, Mycobacterium avium subsp. paratuberculosis
ugcccuccucgccgga

SEQ ID NO: 876005 - RNA, 18 nt, Mycobacterium avium subsp. paratuberculosis
ugcccugaagcugggcgc

SEQ ID NO: 876006 - RNA, 16 nt, Mycobacterium avium subsp. paratuberculosis
ugcccucggucgccga

SEQ ID NO: 876007 - RNA, 17 nt, Mycobacterium avium subsp. paratuberculosis
ugcccucguagcggccg

SEQ ID NO: 876008 - RNA, 20 nt, Mycobacterium avium subsp. paratuberculosis
ugcccucguagcggccgcac

SEQ ID NO: 876009 - RNA, 13 nt, Mycobacterium avium subsp. paratuberculosis
ugcccucgucgac

SEQ ID NO: 876010 - RNA, 17 nt, Mycobacterium avium subsp. paratuberculosis
ugcccugguacgcgccg

SEQ ID NO: 876011 - RNA, 19 nt, Mycobacterium avium subsp. paratuberculosis
ugcccugguacgcgccguc

SEQ ID NO: 876012 - RNA, 17 nt, Mycobacterium avium subsp. paratuberculosis
ugcccuuccccggcggc

SEQ ID NO: 876013 - RNA, 19 nt, Mycobacterium avium subsp. paratuberculosis
ugcccgugaucgccacggc

SEQ ID NO: 876014 - RNA, 20 nt, Mycobacterium avium subsp. paratuberculosis
ugcccgucgggcgcggcggc

SEQ ID NO: 876015 - RNA, 18 nt, Mycobacterium avium subsp. paratuberculosis
ugcccggucugcggccgc

SEQ ID NO: 876016 - RNA, 17 nt, Mycobacterium avium subsp. paratuberculosis
ugcccgguuccgcgaca

SEQ ID NO: 876017 - RNA, 18 nt, Mycobacterium avium subsp. paratuberculosis
ugcccguagucggcggcg

SEQ ID NO: 876018 - RNA, 16 nt, Mycobacterium avium subsp. paratuberculosis
ugcccgggguccaccg

SEQ ID NO: 876019 - RNA, 17 nt, Mycobacterium avium subsp. paratuberculosis
ugcccggaacggcgggc

SEQ ID NO: 876020 - RNA, 15 nt, Mycobacterium avium subsp. paratuberculosis
ugcccggaagccgca

SEQ ID NO: 876021 - RNA, 20 nt, Mycobacterium avium subsp. paratuberculosis
ugcccggacgaugccgcggc

SEQ ID NO: 876022 - RNA, 21 nt, Mycobacterium avium subsp. paratuberculosis
ugcccgcguccugcagcgccg

SEQ ID NO: 876023 - RNA, 16 nt, Mycobacterium avium subsp. paratuberculosis
ugcccgccgugcgccc

SEQ ID NO: 876024 - RNA, 13 nt, Mycobacterium avium subsp. paratuberculosis
ugcccgcggccgc

SEQ ID NO: 876025 - RNA, 16 nt, Mycobacterium avium subsp. paratuberculosis
ugcccgcggccgccgc

SEQ ID NO: 876026 - RNA, 17 nt, Mycobacterium avium subsp. paratuberculosis
ugcccgcgggacacggc

SEQ ID NO: 876027 - RNA, 20 nt, Mycobacterium avium subsp. paratuberculosis
ugcccgcgggacacggcggc

SEQ ID NO: 876028 - RNA, 21 nt, Mycobacterium avium subsp. paratuberculosis
ugcccgcgggccagacugcgc

SEQ ID NO: 876029 - RNA, 19 nt, Mycobacterium avium subsp. paratuberculosis
ugcccgccucacagcgaca

SEQ ID NO: 876030 - RNA, 17 nt, Mycobacterium avium subsp. paratuberculosis
ugcccgccucgcagcga

SEQ ID NO: 876031 - RNA, 15 nt, Mycobacterium avium subsp. paratuberculosis
ugcagccccgcacug

SEQ ID NO: 876032 - RNA, 12 nt, Mycobacterium avium subsp. paratuberculosis
ugcagcccgauc

SEQ ID NO: 876033 - RNA, 14 nt, Mycobacterium avium subsp. paratuberculosis
ugcagccgcacuug

SEQ ID NO: 876034 - RNA, 15 nt, Mycobacterium avium subsp. paratuberculosis
ugcagcccgcgucca

SEQ ID NO: 876035 - RNA, 17 nt, Mycobacterium avium subsp. paratuberculosis
ugcagcccgcugaccag

SEQ ID NO: 876036 - RNA, 21 nt, Mycobacterium avium subsp. paratuberculosis
ugcagcauuuccgagcgacga

SEQ ID NO: 876037 - RNA, 18 nt, Mycobacterium avium subsp. paratuberculosis
ugcagccacccgucggug

SEQ ID NO: 876038 - RNA, 21 nt, Mycobacterium avium subsp. paratuberculosis
ugcagccgccgcgccaccgag

SEQ ID NO: 876039 - RNA, 13 nt, Mycobacterium avium subsp. paratuberculosis
ugcagccggcgcg

SEQ ID NO: 876040 - RNA, 16 nt, Mycobacterium avium subsp. paratuberculosis
ugcagccgggcggcgc

SEQ ID NO: 876041 - RNA, 17 nt, Mycobacterium avium subsp. paratuberculosis
ugcagccgggcggcgcc

SEQ ID NO: 876042 - RNA, 20 nt, Mycobacterium avium subsp. paratuberculosis
ugcagccgggcggcgccgaa

SEQ ID NO: 876043 - RNA, 14 nt, Mycobacterium avium subsp. paratuberculosis
ugcagcgcggcgau

SEQ ID NO: 876044 - RNA, 16 nt, Mycobacterium avium subsp. paratuberculosis
ugcagcgcggcgauca

SEQ ID NO: 876045 - RNA, 20 nt, Mycobacterium avium subsp. paratuberculosis
ugcagcgcggcgaucagcug

SEQ ID NO: 876046 - RNA, 16 nt, Mycobacterium avium subsp. paratuberculosis
ugcagcgcggcgauga

SEQ ID NO: 876047 - RNA, 14 nt, Mycobacterium avium subsp. paratuberculosis
ugcagcgcccagcc

SEQ ID NO: 876048 - RNA, 16 nt, Mycobacterium avium subsp. paratuberculosis
ugcagcgcccgggcca

SEQ ID NO: 876049 - RNA, 12 nt, Mycobacterium avium subsp. paratuberculosis
ugcagcgccgag

SEQ ID NO: 876050 - RNA, 18 nt, Mycobacterium avium subsp. paratuberculosis
ugcagcgccgaggccagc

SEQ ID NO: 876051 - RNA, 18 nt, Mycobacterium avium subsp. paratuberculosis
ugcagccgggggcggugc

SEQ ID NO: 876052 - RNA, 15 nt, Mycobacterium avium subsp. paratuberculosis
ugcagcgccgcccgc

SEQ ID NO: 876053 - RNA, 18 nt, Mycobacterium avium subsp. paratuberculosis
ugcagauccagaugccgg

SEQ ID NO: 876054 - RNA, 19 nt, Mycobacterium avium subsp. paratuberculosis
ugcagauccgcucgccguc

SEQ ID NO: 876055 - RNA, 20 nt, Mycobacterium avium subsp. paratuberculosis
ugcagauccgcucgccgucg

SEQ ID NO: 876056 - RNA, 14 nt, Mycobacterium avium subsp. paratuberculosis
ugcagcacgccgcg

SEQ ID NO: 876057 - RNA, 19 nt, Mycobacterium avium subsp. paratuberculosis
ugcagcacagcgggauccc

SEQ ID NO: 876058 - RNA, 12 nt, Mycobacterium avium subsp. paratuberculosis
ugcagcaccagg

SEQ ID NO: 876059 - RNA, 14 nt, Mycobacterium avium subsp. paratuberculosis
ugcagcagcccgau

SEQ ID NO: 876060 - RNA, 15 nt, Mycobacterium avium subsp. paratuberculosis
ugcagcagcccgauc

SEQ ID NO: 876061 - RNA, 13 nt, Mycobacterium avium subsp. paratuberculosis
ugcagcagcgccg

SEQ ID NO: 876062 - RNA, 16 nt, Mycobacterium avium subsp. paratuberculosis
ugcagcagcgccgcga

SEQ ID NO: 876063 - RNA, 22 nt, Mycobacterium avium subsp. paratuberculosis
ugcagcaggaacucccgcgccg

SEQ ID NO: 876064 - RNA, 13 nt, Mycobacterium avium subsp. paratuberculosis
ugcagcagcucgg

SEQ ID NO: 876065 - RNA, 19 nt, Mycobacterium avium subsp. paratuberculosis
ugcagcagucccucgauca

SEQ ID NO: 876066 - RNA, 18 nt, Mycobacterium avium subsp. paratuberculosis
ugcaggcugacgcgaccg

SEQ ID NO: 876067 - RNA, 18 nt, Mycobacterium avium subsp. paratuberculosis
ugcaggcgaucucgccga

SEQ ID NO: 876068 - RNA, 23 nt, Mycobacterium avium subsp. paratuberculosis
ugcaggcagccguuguccacgau

SEQ ID NO: 876069 - RNA, 14 nt, Mycobacterium avium subsp. paratuberculosis
ugcaggcaggccgg

SEQ ID NO: 876070 - RNA, 23 nt, Mycobacterium avium subsp. paratuberculosis
ugcaggcccgggcggcgaguccg

SEQ ID NO: 876071 - RNA, 17 nt, Mycobacterium avium subsp. paratuberculosis
ugcaggcccucgacgua

SEQ ID NO: 876072 - RNA, 13 nt, Mycobacterium avium subsp. paratuberculosis
ugcaggccgagcc

SEQ ID NO: 876073 - RNA, 16 nt, Mycobacterium avium subsp. paratuberculosis
ugcagcuccucggcgg

SEQ ID NO: 876074 - RNA, 21 nt, Mycobacterium avium subsp. paratuberculosis
ugcagcucgccggcgcgcagc

SEQ ID NO: 876075 - RNA, 16 nt, Mycobacterium avium subsp. paratuberculosis
ugcagcggcggccagu

SEQ ID NO: 876076 - RNA, 19 nt, Mycobacterium avium subsp. paratuberculosis
ugcagcggaaacgacgucg

SEQ ID NO: 876077 - RNA, 20 nt, Mycobacterium avium subsp. paratuberculosis
ugcagcggaaugaacgcggc

SEQ ID NO: 876078 - RNA, 22 nt, Mycobacterium avium subsp. paratuberculosis
ugcagcggaaugaacgcggcca

SEQ ID NO: 876079 - RNA, 16 nt, Mycobacterium avium subsp. paratuberculosis
ugcaggaucgcgguga

SEQ ID NO: 876080 - RNA, 14 nt, Mycobacterium avium subsp. paratuberculosis
ugcaggaucggcuu

SEQ ID NO: 876081 - RNA, 22 nt, Mycobacterium avium subsp. paratuberculosis
ugcagcuuccgaaccgcacgag

SEQ ID NO: 876082 - RNA, 23 nt, Mycobacterium avium subsp. paratuberculosis
ugcagcucggugcagaccccggc

SEQ ID NO: 876083 - RNA, 13 nt, Mycobacterium avium subsp. paratuberculosis
ugcagcugcucgu

SEQ ID NO: 876084 - RNA, 14 nt, Mycobacterium avium subsp. paratuberculosis
ugcagcugcucguc

SEQ ID NO: 876085 - RNA, 21 nt, Mycobacterium avium subsp. paratuberculosis
ugccaacacggcggcgcgcac

SEQ ID NO: 876086 - RNA, 19 nt, Mycobacterium avium subsp. paratuberculosis
ugccaagacguccgcgucg

SEQ ID NO: 876087 - RNA, 19 nt, Mycobacterium avium subsp. paratuberculosis
ugccacggucaggcgcagc

SEQ ID NO: 876088 - RNA, 19 nt, Mycobacterium avium subsp. paratuberculosis
ugcauguagguggcgacca

SEQ ID NO: 876089 - RNA, 21 nt, Mycobacterium avium subsp. paratuberculosis
ugcagguagguggccagccgg

SEQ ID NO: 876090 - RNA, 15 nt, Mycobacterium avium subsp. paratuberculosis
ugcaugugcucggcg

SEQ ID NO: 876091 - RNA, 16 nt, Mycobacterium avium subsp. paratuberculosis
ugcaugugcucggcga

SEQ ID NO: 876092 - RNA, 16 nt, Mycobacterium avium subsp. paratuberculosis
ugcauguucaaucccg

SEQ ID NO: 876093 - RNA, 19 nt, Mycobacterium avium subsp. paratuberculosis
ugcaggguuuccucgagca

SEQ ID NO: 876094 - RNA, 20 nt, Mycobacterium avium subsp. paratuberculosis
ugcagggucagcagcacccg

SEQ ID NO: 876095 - RNA, 23 nt, Mycobacterium avium subsp. paratuberculosis
ugcagggucagcagcacccgguc

SEQ ID NO: 876096 - RNA, 17 nt, Mycobacterium avium subsp. paratuberculosis
ugcaggguccgccgucg

SEQ ID NO: 876097 - RNA, 16 nt, Mycobacterium avium subsp. paratuberculosis
ugccacguacaccggg

SEQ ID NO: 876098 - RNA, 14 nt, Mycobacterium avium subsp. paratuberculosis
ugccacugagcgca

SEQ ID NO: 876099 - RNA, 23 nt, Mycobacterium avium subsp. paratuberculosis
ugccagaccacaagggccaccgg

SEQ ID NO: 876100 - RNA, 18 nt, Mycobacterium avium subsp. paratuberculosis
ugccagaacggcggcagc

SEQ ID NO: 876101 - RNA, 20 nt, Mycobacterium avium subsp. paratuberculosis
ugccagacgcgcaccgccac

SEQ ID NO: 876102 - RNA, 23 nt, Mycobacterium avium subsp. paratuberculosis
ugccagggcagcgcgaccagccc

SEQ ID NO: 876103 - RNA, 17 nt, Mycobacterium avium subsp. paratuberculosis
ugauagcccgccgcggc

SEQ ID NO: 876104 - RNA, 15 nt, Mycobacterium avium subsp. paratuberculosis
ugauagccgcccugc

SEQ ID NO: 876105 - RNA, 16 nt, Mycobacterium avium subsp. paratuberculosis
ugauaguggucgucgu

SEQ ID NO: 876106 - RNA, 16 nt, Mycobacterium avium subsp. paratuberculosis
ugauaggggucggcga

SEQ ID NO: 876107 - RNA, 16 nt, Mycobacterium avium subsp. paratuberculosis
ugagguuuccgcugau

SEQ ID NO: 876108 - RNA, 21 nt, Mycobacterium avium subsp. paratuberculosis
ugagguugacgugcaccggcg

SEQ ID NO: 876109 - RNA, 15 nt, Mycobacterium avium subsp. paratuberculosis
ugaggcgcgccggua

SEQ ID NO: 876110 - RNA, 22 nt, Mycobacterium avium subsp. paratuberculosis
ugagucccucggcgagcgaggc

SEQ ID NO: 876111 - RNA, 15 nt, Mycobacterium avium subsp. paratuberculosis
ugaggccgccccggc

SEQ ID NO: 876112 - RNA, 15 nt, Mycobacterium avium subsp. paratuberculosis
ugaggaugacgacgg

SEQ ID NO: 876113 - RNA, 14 nt, Mycobacterium avium subsp. paratuberculosis
ugaggacgaggcga

SEQ ID NO: 876114 - RNA, 17 nt, Mycobacterium avium subsp. paratuberculosis
ugaggacgcccggcgag

SEQ ID NO: 876115 - RNA, 21 nt, Mycobacterium avium subsp. paratuberculosis
ugaggagacgaucucgccguc

SEQ ID NO: 876116 - RNA, 22 nt, Mycobacterium avium subsp. paratuberculosis
ugagcuuuucgucggugcgcgc

SEQ ID NO: 876117 - RNA, 17 nt, Mycobacterium avium subsp. paratuberculosis
ugaggaacgcgaccguc

SEQ ID NO: 876118 - RNA, 14 nt, Mycobacterium avium subsp. paratuberculosis
ugaggcgagccgau

SEQ ID NO: 876119 - RNA, 21 nt, Mycobacterium avium subsp. paratuberculosis
ugaggcccacguugagcacgc

SEQ ID NO: 876120 - RNA, 16 nt, Mycobacterium avium subsp. paratuberculosis
ugaggaugucgacgau

SEQ ID NO: 876121 - RNA, 17 nt, Mycobacterium avium subsp. paratuberculosis
ugagccuaugaggcgac

SEQ ID NO: 876122 - RNA, 20 nt, Mycobacterium avium subsp. paratuberculosis
ugagccucagggcgcgcugu

SEQ ID NO: 876123 - RNA, 23 nt, Mycobacterium avium subsp. paratuberculosis
ugagccggauguccuacggcggg

SEQ ID NO: 876124 - RNA, 14 nt, Mycobacterium avium subsp. paratuberculosis
ugagcgacaccagg

SEQ ID NO: 876125 - RNA, 17 nt, Mycobacterium avium subsp. paratuberculosis
ugagcaauucggugacg

SEQ ID NO: 876126 - RNA, 20 nt, Mycobacterium avium subsp. paratuberculosis
ugagcaacgccagcgcgacc

SEQ ID NO: 876127 - RNA, 20 nt, Mycobacterium avium subsp. paratuberculosis
ugagcaagucggcggugaug

SEQ ID NO: 876128 - RNA, 19 nt, Mycobacterium avium subsp. paratuberculosis
ugagcccgaugcuggccau

SEQ ID NO: 876129 - RNA, 15 nt, Mycobacterium avium subsp. paratuberculosis
ugagccgccgagccg

SEQ ID NO: 876130 - RNA, 21 nt, Mycobacterium avium subsp. paratuberculosis
ugagccgccgagccggcacgg

SEQ ID NO: 876131 - RNA, 17 nt, Mycobacterium avium subsp. paratuberculosis
ugagccgcucgccgggg

SEQ ID NO: 876132 - RNA, 20 nt, Mycobacterium avium subsp. paratuberculosis
ugagccgcucgccggggacg

SEQ ID NO: 876133 - RNA, 15 nt, Mycobacterium avium subsp. paratuberculosis
ugagccgcucgucga

SEQ ID NO: 876134 - RNA, 23 nt, Mycobacterium avium subsp. paratuberculosis
ugagccgcuggauguccaggccg

SEQ ID NO: 876135 - RNA, 16 nt, Mycobacterium avium subsp. paratuberculosis
ugagcaccagcccggc

SEQ ID NO: 876136 - RNA, 21 nt, Mycobacterium avium subsp. paratuberculosis
ugagcaccagcccggccagcg

SEQ ID NO: 876137 - RNA, 13 nt, Mycobacterium avium subsp. paratuberculosis
ugagcaccgcgac

SEQ ID NO: 876138 - RNA, 16 nt, Mycobacterium avium subsp. paratuberculosis
ugagcaccgcgaccag

SEQ ID NO: 876139 - RNA, 17 nt, Mycobacterium avium subsp. paratuberculosis
ugagcaccgcgaccagc

SEQ ID NO: 876140 - RNA, 13 nt, Mycobacterium avium subsp. paratuberculosis
ugagcaccgcguc

SEQ ID NO: 876141 - RNA, 19 nt, Mycobacterium avium subsp. paratuberculosis
ugagcacaaagccggucac

SEQ ID NO: 876142 - RNA, 17 nt, Mycobacterium avium subsp. paratuberculosis
ugagcaccacgaggcug

SEQ ID NO: 876143 - RNA, 21 nt, Mycobacterium avium subsp. paratuberculosis
ugagcccccaccugaucgcgg

SEQ ID NO: 876144 - RNA, 23 nt, Mycobacterium avium subsp. paratuberculosis
ugagcccccaccugaucgcggcg

SEQ ID NO: 876145 - RNA, 16 nt, Mycobacterium avium subsp. paratuberculosis
ugagcccggaccggcc

SEQ ID NO: 876146 - RNA, 20 nt, Mycobacterium avium subsp. paratuberculosis
ugagcccggaccggccgugc

SEQ ID NO: 876147 - RNA, 15 nt, Mycobacterium avium subsp. paratuberculosis
ugagcccggcgacga

SEQ ID NO: 876148 - RNA, 13 nt, Mycobacterium avium subsp. paratuberculosis
ugagcccgggcag

SEQ ID NO: 876149 - RNA, 22 nt, Mycobacterium avium subsp. paratuberculosis
ugagcccgggcaggcggcgcgc

SEQ ID NO: 876150 - RNA, 18 nt, Mycobacterium avium subsp. paratuberculosis
ugagaaaagcgaccagcg

SEQ ID NO: 876151 - RNA, 17 nt, Mycobacterium avium subsp. paratuberculosis
ugacuaccgcgcccagg

SEQ ID NO: 876152 - RNA, 23 nt, Mycobacterium avium subsp. paratuberculosis
ugacuaauccccccgcgccgccc

SEQ ID NO: 876153 - RNA, 14 nt, Mycobacterium avium subsp. paratuberculosis
ugacguugaucgcg

SEQ ID NO: 876154 - RNA, 15 nt, Mycobacterium avium subsp. paratuberculosis
ugacguugcgcgcca

SEQ ID NO: 876155 - RNA, 18 nt, Mycobacterium avium subsp. paratuberculosis
ugacguuggugaucgccg

SEQ ID NO: 876156 - RNA, 17 nt, Mycobacterium avium subsp. paratuberculosis
ugaagccguugccgccg

SEQ ID NO: 876157 - RNA, 13 nt, Mycobacterium avium subsp. paratuberculosis
ugaagccggugag

SEQ ID NO: 876158 - RNA, 22 nt, Mycobacterium avium subsp. paratuberculosis
ugacgucggucagcaucgggua

SEQ ID NO: 876159 - RNA, 16 nt, Mycobacterium avium subsp. paratuberculosis
ugacgucgguguagcc

SEQ ID NO: 876160 - RNA, 12 nt, Mycobacterium avium subsp. paratuberculosis
ugacgucgucgc

SEQ ID NO: 876161 - RNA, 15 nt, Mycobacterium avium subsp. paratuberculosis
ugacgucgucgcggc

SEQ ID NO: 876162 - RNA, 17 nt, Mycobacterium avium subsp. paratuberculosis
ugacgucgaugccggcc

SEQ ID NO: 876163 - RNA, 14 nt, Mycobacterium avium subsp. paratuberculosis
ugacgucgcgcugc

SEQ ID NO: 876164 - RNA, 22 nt, Mycobacterium avium subsp. paratuberculosis
ugacgugauaucccuugccgcc

SEQ ID NO: 876165 - RNA, 21 nt, Mycobacterium avium subsp. paratuberculosis
ugacguggaaauugcugacca

SEQ ID NO: 876166 - RNA, 21 nt, Mycobacterium avium subsp. paratuberculosis
ugaagccccggaccggagacg

SEQ ID NO: 876167 - RNA, 20 nt, Mycobacterium avium subsp. paratuberculosis
ugaagcccugcucggugaug

SEQ ID NO: 876168 - RNA, 13 nt, Mycobacterium avium subsp. paratuberculosis
ugaagccgacgcc

SEQ ID NO: 876169 - RNA, 14 nt, Mycobacterium avium subsp. paratuberculosis
ugaagccgacgccg

SEQ ID NO: 876170 - RNA, 13 nt, Mycobacterium avium subsp. paratuberculosis
ugaagaucgacgc

SEQ ID NO: 876171 - RNA, 19 nt, Mycobacterium avium subsp. paratuberculosis
ugaagaucagcgcgucggu

SEQ ID NO: 876172 - RNA, 17 nt, Mycobacterium avium subsp. paratuberculosis
ugaacgggcagccacgc

SEQ ID NO: 876173 - RNA, 15 nt, Mycobacterium avium subsp. paratuberculosis
ugaacgccgccaaca

SEQ ID NO: 876174 - RNA, 23 nt, Mycobacterium avium subsp. paratuberculosis
ugaacgcguugaccagaccgaag

SEQ ID NO: 876175 - RNA, 19 nt, Mycobacterium avium subsp. paratuberculosis
ugaacggcaccccgcgguc

SEQ ID NO: 876176 - RNA, 22 nt, Mycobacterium avium subsp. paratuberculosis
ugauuucggcguggcgguggcg

SEQ ID NO: 876177 - RNA, 16 nt, Mycobacterium avium subsp. paratuberculosis
ugauugcgugcccggc

SEQ ID NO: 876178 - RNA, 18 nt, Mycobacterium avium subsp. paratuberculosis
ugauuguugacggugacc

SEQ ID NO: 876179 - RNA, 19 nt, Mycobacterium avium subsp. paratuberculosis
ugauugcgcccgccgaaca

SEQ ID NO: 876180 - RNA, 18 nt, Mycobacterium avium subsp. paratuberculosis
ugcaacaccgaacgccga

SEQ ID NO: 876181 - RNA, 18 nt, Mycobacterium avium subsp. paratuberculosis
ugcaacacucgagcgcgc

SEQ ID NO: 876182 - RNA, 20 nt, Mycobacterium avium subsp. paratuberculosis
ugcaaccgguccgccgucgg

SEQ ID NO: 876183 - RNA, 17 nt, Mycobacterium avium subsp. paratuberculosis
ugcaacgccgccgacag

SEQ ID NO: 876184 - RNA, 18 nt, Mycobacterium avium subsp. paratuberculosis
ugcaacggcuggcgcagg

SEQ ID NO: 876185 - RNA, 13 nt, Mycobacterium avium subsp. paratuberculosis
ugcaacucccgcg

SEQ ID NO: 876186 - RNA, 16 nt, Mycobacterium avium subsp. paratuberculosis
ugcaacucccgcgccg

SEQ ID NO: 876187 - RNA, 17 nt, Mycobacterium avium subsp. paratuberculosis
ugcaacucccgcgccgc

SEQ ID NO: 876188 - RNA, 18 nt, Mycobacterium avium subsp. paratuberculosis
ugcaccaacacgucgagu

SEQ ID NO: 876189 - RNA, 19 nt, Mycobacterium avium subsp. paratuberculosis
ugcaccaacacgucgaguu

SEQ ID NO: 876190 - RNA, 22 nt, Mycobacterium avium subsp. paratuberculosis
ugcaccaccacacccagcgcca

SEQ ID NO: 876191 - RNA, 21 nt, Mycobacterium avium subsp. paratuberculosis
ugcaccaccgugccgucgcgg

SEQ ID NO: 876192 - RNA, 18 nt, Mycobacterium avium subsp. paratuberculosis
ugcaccacgaagcgggcg

SEQ ID NO: 876193 - RNA, 20 nt, Mycobacterium avium subsp. paratuberculosis
ugcaccagcacgacaccgac

SEQ ID NO: 876194 - RNA, 18 nt, Mycobacterium avium subsp. paratuberculosis
ugcaccaggacgcgaccg

SEQ ID NO: 876195 - RNA, 20 nt, Mycobacterium avium subsp. paratuberculosis
ugcaccaggacgcgaccggc

SEQ ID NO: 876196 - RNA, 13 nt, Mycobacterium avium subsp. paratuberculosis
ugcaccagcgcgg

SEQ ID NO: 876197 - RNA, 23 nt, Mycobacterium avium subsp. paratuberculosis
ugcaccagcguggugcgcccguc

SEQ ID NO: 876198 - RNA, 13 nt, Mycobacterium avium subsp. paratuberculosis
ugcaccagcgauc

SEQ ID NO: 876199 - RNA, 19 nt, Mycobacterium avium subsp. paratuberculosis
ugcaccagcgauccggcgc

SEQ ID NO: 876200 - RNA, 17 nt, Mycobacterium avium subsp. paratuberculosis
ugcacucagagcagcgc

SEQ ID NO: 876201 - RNA, 21 nt, Mycobacterium avium subsp. paratuberculosis
ugcacuuucgcggucagccgg

SEQ ID NO: 876202 - RNA, 16 nt, Mycobacterium avium subsp. paratuberculosis
ugcacgugcaccgcgg

SEQ ID NO: 876203 - RNA, 15 nt, Mycobacterium avium subsp. paratuberculosis
ugcacucucgcggca

SEQ ID NO: 876204 - RNA, 14 nt, Mycobacterium avium subsp. paratuberculosis
ugcagaacgcgcgg

SEQ ID NO: 876205 - RNA, 16 nt, Mycobacterium avium subsp. paratuberculosis
ugcacguaggcggcga

SEQ ID NO: 876206 - RNA, 19 nt, Mycobacterium avium subsp. paratuberculosis
ugcacgucacgggccaggc

SEQ ID NO: 876207 - RNA, 18 nt, Mycobacterium avium subsp. paratuberculosis
ugcacgguguagacgcgg

SEQ ID NO: 876208 - RNA, 13 nt, Mycobacterium avium subsp. paratuberculosis
ugcacguggugac

SEQ ID NO: 876209 - RNA, 16 nt, Mycobacterium avium subsp. paratuberculosis
ugcacguccucgucgg

SEQ ID NO: 876210 - RNA, 18 nt, Mycobacterium avium subsp. paratuberculosis
ugcacggcgccgugccgc

SEQ ID NO: 876211 - RNA, 16 nt, Mycobacterium avium subsp. paratuberculosis
ugcacggucagcucgc

SEQ ID NO: 876212 - RNA, 19 nt, Mycobacterium avium subsp. paratuberculosis
ugcacgcguugcagcgccg

SEQ ID NO: 876213 - RNA, 19 nt, Mycobacterium avium subsp. paratuberculosis
ugcacgcuguuggaaccgg

SEQ ID NO: 876214 - RNA, 18 nt, Mycobacterium avium subsp. paratuberculosis
ugcacggccucggucacg

SEQ ID NO: 876215 - RNA, 18 nt, Mycobacterium avium subsp. paratuberculosis
ugaucaacacgucgucgu

SEQ ID NO: 876216 - RNA, 17 nt, Mycobacterium avium subsp. paratuberculosis
ugaucaccgcgcucggc

SEQ ID NO: 876217 - RNA, 17 nt, Mycobacterium avium subsp. paratuberculosis
ugaucaccgugaucgcc

SEQ ID NO: 876218 - RNA, 17 nt, Mycobacterium avium subsp. paratuberculosis
ugaucaccucggugaug

SEQ ID NO: 876219 - RNA, 22 nt, Mycobacterium avium subsp. paratuberculosis
ugaucacgggcacaccgucguc

SEQ ID NO: 876220 - RNA, 19 nt, Mycobacterium avium subsp. paratuberculosis
ugaucacguugucgcggcc

SEQ ID NO: 876221 - RNA, 20 nt, Mycobacterium avium subsp. paratuberculosis
ugaucaccgccagcgcgccg

SEQ ID NO: 876222 - RNA, 20 nt, Mycobacterium avium subsp. paratuberculosis
ugaucagcauccgcaacgug

SEQ ID NO: 876223 - RNA, 19 nt, Mycobacterium avium subsp. paratuberculosis
ugaucagcccgacccggcu

SEQ ID NO: 876224 - RNA, 15 nt, Mycobacterium avium subsp. paratuberculosis
ugaucagccggcgag

SEQ ID NO: 876225 - RNA, 18 nt, Mycobacterium avium subsp. paratuberculosis
ugaucagggcggcgcgcg

SEQ ID NO: 876226 - RNA, 12 nt, Mycobacterium avium subsp. paratuberculosis
ugaucagcucgc

SEQ ID NO: 876227 - RNA, 20 nt, Mycobacterium avium subsp. paratuberculosis
ugaucaggcccucgucggcg

SEQ ID NO: 876228 - RNA, 22 nt, Mycobacterium avium subsp. paratuberculosis
ugaugaagaugaucucgccgag

SEQ ID NO: 876229 - RNA, 16 nt, Mycobacterium avium subsp. paratuberculosis
ugaugaagccgccgac

SEQ ID NO: 876230 - RNA, 20 nt, Mycobacterium avium subsp. paratuberculosis
ugaugaagccgccgacggug

SEQ ID NO: 876231 - RNA, 14 nt, Mycobacterium avium subsp. paratuberculosis
ugaugaacgcgccg

SEQ ID NO: 876232 - RNA, 16 nt, Mycobacterium avium subsp. paratuberculosis
ugaugaacgcgccguc

SEQ ID NO: 876233 - RNA, 21 nt, Mycobacterium avium subsp. paratuberculosis
ugaugaacgcgccgucgucgg

SEQ ID NO: 876234 - RNA, 13 nt, Mycobacterium avium subsp. paratuberculosis
ugaugacggggcg

SEQ ID NO: 876235 - RNA, 24 nt, Mycobacterium avium subsp. paratuberculosis
ugaugacguuggugaucgccgacg

SEQ ID NO: 876236 - RNA, 20 nt, Mycobacterium avium subsp. paratuberculosis
ugaugagcaagucggcggug

SEQ ID NO: 876237 - RNA, 16 nt, Mycobacterium avium subsp. paratuberculosis
ugaugaggucgcgacc

SEQ ID NO: 876238 - RNA, 13 nt, Mycobacterium avium subsp. paratuberculosis
ugaugagcgagga

SEQ ID NO: 876239 - RNA, 18 nt, Mycobacterium avium subsp. paratuberculosis
ugaugcccaggcccacca

SEQ ID NO: 876240 - RNA, 15 nt, Mycobacterium avium subsp. paratuberculosis
ugaugaugucggcgg

SEQ ID NO: 876241 - RNA, 17 nt, Mycobacterium avium subsp. paratuberculosis
ugaugaugucggcggcc

SEQ ID NO: 876242 - RNA, 19 nt, Mycobacterium avium subsp. paratuberculosis
ugauguaagcgaauaccau

SEQ ID NO: 876243 - RNA, 17 nt, Mycobacterium avium subsp. paratuberculosis
ugaugugcggcgcggcg

SEQ ID NO: 876244 - RNA, 14 nt, Mycobacterium avium subsp. paratuberculosis
ugauggugaucucg

SEQ ID NO: 876245 - RNA, 21 nt, Mycobacterium avium subsp. paratuberculosis
ugauggugaucucgccgcggu

SEQ ID NO: 876246 - RNA, 20 nt, Mycobacterium avium subsp. paratuberculosis
ugaugucggccaggaucgcg

SEQ ID NO: 876247 - RNA, 14 nt, Mycobacterium avium subsp. paratuberculosis
ugaugucggcgggc

SEQ ID NO: 876248 - RNA, 13 nt, Mycobacterium avium subsp. paratuberculosis
ugaugucggugag

SEQ ID NO: 876249 - RNA, 15 nt, Mycobacterium avium subsp. paratuberculosis
ugaugccggcggaca

SEQ ID NO: 876250 - RNA, 21 nt, Mycobacterium avium subsp. paratuberculosis
ugaugccgggcaaccacagcg

SEQ ID NO: 876251 - RNA, 24 nt, Mycobacterium avium subsp. paratuberculosis
ugaugccgggcaaccacagcggcg

SEQ ID NO: 876252 - RNA, 14 nt, Mycobacterium avium subsp. paratuberculosis
ugaugccgcccagc

SEQ ID NO: 876253 - RNA, 16 nt, Mycobacterium avium subsp. paratuberculosis
ugaugcccuugcggaa

SEQ ID NO: 876254 - RNA, 14 nt, Mycobacterium avium subsp. paratuberculosis
ugaugccgacgucg

SEQ ID NO: 876255 - RNA, 15 nt, Mycobacterium avium subsp. paratuberculosis
ugaugcccucgccgg

SEQ ID NO: 876256 - RNA, 15 nt, Mycobacterium avium subsp. paratuberculosis
ugauggcacccucgg

SEQ ID NO: 876257 - RNA, 14 nt, Mycobacterium avium subsp. paratuberculosis
ugauggccgcgccg

SEQ ID NO: 876258 - RNA, 18 nt, Mycobacterium avium subsp. paratuberculosis
ugauggccgcgccgccgc

SEQ ID NO: 876259 - RNA, 20 nt, Mycobacterium avium subsp. paratuberculosis
ugaugcgaugggugaucgcg

SEQ ID NO: 876260 - RNA, 13 nt, Mycobacterium avium subsp. paratuberculosis
ugauggucgucgu

SEQ ID NO: 876261 - RNA, 21 nt, Mycobacterium avium subsp. paratuberculosis
ugaugccguggucggcgaacg

SEQ ID NO: 876262 - RNA, 20 nt, Mycobacterium avium subsp. paratuberculosis
ugauggcggcggcccgccgc

SEQ ID NO: 876263 - RNA, 20 nt, Mycobacterium avium subsp. paratuberculosis
ugauggcgaaccagcgcccg

SEQ ID NO: 876264 - RNA, 15 nt, Mycobacterium avium subsp. paratuberculosis
ugaaaaccgggcccu

SEQ ID NO: 876265 - RNA, 17 nt, Mycobacterium avium subsp. paratuberculosis
ugaaaaccgggcccucg

SEQ ID NO: 876266 - RNA, 15 nt, Mycobacterium avium subsp. paratuberculosis
ugaacgccgcguccu

SEQ ID NO: 876267 - RNA, 21 nt, Mycobacterium avium subsp. paratuberculosis
ugaacgccgcguccucgucga

SEQ ID NO: 876268 - RNA, 19 nt, Mycobacterium avium subsp. paratuberculosis
ugaacgccugccggcgccg

SEQ ID NO: 876269 - RNA, 22 nt, Mycobacterium avium subsp. paratuberculosis
ugaacgcggugggcaccagcag

SEQ ID NO: 876270 - RNA, 21 nt, Mycobacterium avium subsp. paratuberculosis
ugaacgcguacagcgcccgga

SEQ ID NO: 876271 - RNA, 18 nt, Mycobacterium avium subsp. paratuberculosis
ugaacagcacgugcccgc

SEQ ID NO: 876272 - RNA, 12 nt, Mycobacterium avium subsp. paratuberculosis
ugaacagcagcc

SEQ ID NO: 876273 - RNA, 15 nt, Mycobacterium avium subsp. paratuberculosis
ugaacagcgcccggc

SEQ ID NO: 876274 - RNA, 17 nt, Mycobacterium avium subsp. paratuberculosis
ugaacagcgcccggccg

SEQ ID NO: 876275 - RNA, 18 nt, Mycobacterium avium subsp. paratuberculosis
ucuuggcgagcugaccgg

SEQ ID NO: 876276 - RNA, 22 nt, Mycobacterium avium subsp. paratuberculosis
ucuuggcgagcugaccggccac

SEQ ID NO: 876277 - RNA, 14 nt, Mycobacterium avium subsp. paratuberculosis
ucuuggcggccugc

SEQ ID NO: 876278 - RNA, 23 nt, Mycobacterium avium subsp. paratuberculosis
ucuugucggggaagggcgcgucg

SEQ ID NO: 876279 - RNA, 17 nt, Mycobacterium avium subsp. paratuberculosis
ucuugaucucggcggcg

SEQ ID NO: 876280 - RNA, 16 nt, Mycobacterium avium subsp. paratuberculosis
ucuugaugucggggcg

SEQ ID NO: 876281 - RNA, 17 nt, Mycobacterium avium subsp. paratuberculosis
ucuugaccgucgcggag

SEQ ID NO: 876282 - RNA, 14 nt, Mycobacterium avium subsp. paratuberculosis
ucuucugcgcgaug

SEQ ID NO: 876283 - RNA, 14 nt, Mycobacterium avium subsp. paratuberculosis
ucuugcgggcggca

SEQ ID NO: 876284 - RNA, 14 nt, Mycobacterium avium subsp. paratuberculosis
ucuugcgcggcgcg

SEQ ID NO: 876285 - RNA, 17 nt, Mycobacterium avium subsp. paratuberculosis
ucuugcgaaagcgcggg

SEQ ID NO: 876286 - RNA, 17 nt, Mycobacterium avium subsp. paratuberculosis
ucuugcccagcggggcg

SEQ ID NO: 876287 - RNA, 12 nt, Mycobacterium avium subsp. paratuberculosis
ucuucggcgccg

SEQ ID NO: 876288 - RNA, 13 nt, Mycobacterium avium subsp. paratuberculosis
ucuucucgacgua

SEQ ID NO: 876289 - RNA, 16 nt, Mycobacterium avium subsp. paratuberculosis
ucuucgaucaggcgca

SEQ ID NO: 876290 - RNA, 18 nt, Mycobacterium avium subsp. paratuberculosis
ucuucgcgcgcggcgugg

SEQ ID NO: 876291 - RNA, 21 nt, Mycobacterium avium subsp. paratuberculosis
ucuucggggauguagccgccg

SEQ ID NO: 876292 - RNA, 15 nt, Mycobacterium avium subsp. paratuberculosis
ucuucggggccgccg

SEQ ID NO: 876293 - RNA, 18 nt, Mycobacterium avium subsp. paratuberculosis
ucuucggggccgccgucg

SEQ ID NO: 876294 - RNA, 14 nt, Mycobacterium avium subsp. paratuberculosis
ucuucgccggacag

SEQ ID NO: 876295 - RNA, 13 nt, Mycobacterium avium subsp. paratuberculosis
ucuucgacccgca

SEQ ID NO: 876296 - RNA, 22 nt, Mycobacterium avium subsp. paratuberculosis
ucuucgacccgcauccgccggg

SEQ ID NO: 876297 - RNA, 17 nt, Mycobacterium avium subsp. paratuberculosis
ucuucacgugcgcggcg

SEQ ID NO: 876298 - RNA, 20 nt, Mycobacterium avium subsp. paratuberculosis
ucuucauaccgaaacggcag

SEQ ID NO: 876299 - RNA, 16 nt, Mycobacterium avium subsp. paratuberculosis
ucuucagggcggugcg

SEQ ID NO: 876300 - RNA, 13 nt, Mycobacterium avium subsp. paratuberculosis
ucugugaccacgg

SEQ ID NO: 876301 - RNA, 17 nt, Mycobacterium avium subsp. paratuberculosis
ucugguugacgccgaug

SEQ ID NO: 876302 - RNA, 16 nt, Mycobacterium avium subsp. paratuberculosis
ucugggccgccgagca

SEQ ID NO: 876303 - RNA, 11 nt, Mycobacterium avium subsp. paratuberculosis
ucugggcgcgc

SEQ ID NO: 876304 - RNA, 14 nt, Mycobacterium avium subsp. paratuberculosis
ucugggcggcggga

SEQ ID NO: 876305 - RNA, 15 nt, Mycobacterium avium subsp. paratuberculosis
ucuggucggccagcg

SEQ ID NO: 876306 - RNA, 23 nt, Mycobacterium avium subsp. paratuberculosis
ucuggucaugaaggcgacgucgg

SEQ ID NO: 876307 - RNA, 22 nt, Mycobacterium avium subsp. paratuberculosis
ucuggaugcggcccuggcgggc

SEQ ID NO: 876308 - RNA, 13 nt, Mycobacterium avium subsp. paratuberculosis
ucuggccaccgaa

SEQ ID NO: 876309 - RNA, 14 nt, Mycobacterium avium subsp. paratuberculosis
ucuggcagccggcc

SEQ ID NO: 876310 - RNA, 15 nt, Mycobacterium avium subsp. paratuberculosis
ucuggcagccggccg

SEQ ID NO: 876311 - RNA, 18 nt, Mycobacterium avium subsp. paratuberculosis
ucuggccuugcagcccgc

SEQ ID NO: 876312 - RNA, 21 nt, Mycobacterium avium subsp. paratuberculosis
ucuggcccuggcaggugagcc

SEQ ID NO: 876313 - RNA, 15 nt, Mycobacterium avium subsp. paratuberculosis
ucuggccgaccgccg

SEQ ID NO: 876314 - RNA, 22 nt, Mycobacterium avium subsp. paratuberculosis
ucuggccgaccgccgccauccg

SEQ ID NO: 876315 - RNA, 21 nt, Mycobacterium avium subsp. paratuberculosis
ucugggccaggaucucgucgg

SEQ ID NO: 876316 - RNA, 23 nt, Mycobacterium avium subsp. paratuberculosis
ucugggccaggaucucgucggga

SEQ ID NO: 876317 - RNA, 16 nt, Mycobacterium avium subsp. paratuberculosis
ucuggcgugacgcucg

SEQ ID NO: 876318 - RNA, 17 nt, Mycobacterium avium subsp. paratuberculosis
ucuggcgugacgcucgg

SEQ ID NO: 876319 - RNA, 17 nt, Mycobacterium avium subsp. paratuberculosis
ucuggcgugacguucgg

SEQ ID NO: 876320 - RNA, 19 nt, Mycobacterium avium subsp. paratuberculosis
ucuggcggacccgcucccg

SEQ ID NO: 876321 - RNA, 20 nt, Mycobacterium avium subsp. paratuberculosis
ucuggcgcagcgucaacggc

SEQ ID NO: 876322 - RNA, 20 nt, Mycobacterium avium subsp. paratuberculosis
ucuggcgcaucagcggggcg

SEQ ID NO: 876323 - RNA, 22 nt, Mycobacterium avium subsp. paratuberculosis
ucugcucgccgucacaccgcgg

SEQ ID NO: 876324 - RNA, 14 nt, Mycobacterium avium subsp. paratuberculosis
ucugcucggcggcu

SEQ ID NO: 876325 - RNA, 13 nt, Mycobacterium avium subsp. paratuberculosis
ucugcucggcggg

SEQ ID NO: 876326 - RNA, 12 nt, Mycobacterium avium subsp. paratuberculosis
ucugcucggcgu

SEQ ID NO: 876327 - RNA, 22 nt, Mycobacterium avium subsp. paratuberculosis
ucugcucgugcaaaccggaccg

SEQ ID NO: 876328 - RNA, 21 nt, Mycobacterium avium subsp. paratuberculosis
ucugcuccucggucagcggcg

SEQ ID NO: 876329 - RNA, 12 nt, Mycobacterium avium subsp. paratuberculosis
ucugcucgccgg

SEQ ID NO: 876330 - RNA, 21 nt, Mycobacterium avium subsp. paratuberculosis
ucugcucgccagacucacggc

SEQ ID NO: 876331 - RNA, 23 nt, Mycobacterium avium subsp. paratuberculosis
ucugcucgccagacucacggcgg

SEQ ID NO: 876332 - RNA, 22 nt, Mycobacterium avium subsp. paratuberculosis
ucugcggaccaucuacgaccuc

SEQ ID NO: 876333 - RNA, 20 nt, Mycobacterium avium subsp. paratuberculosis
ucugcucccaggacggcgcg

SEQ ID NO: 876334 - RNA, 22 nt, Mycobacterium avium subsp. paratuberculosis
ucuggaagccuggcacgacgcc

SEQ ID NO: 876335 - RNA, 23 nt, Mycobacterium avium subsp. paratuberculosis
ucugcuugaugaugucggcggcc

SEQ ID NO: 876336 - RNA, 14 nt, Mycobacterium avium subsp. paratuberculosis
ucugaauucggcca

SEQ ID NO: 876337 - RNA, 15 nt, Mycobacterium avium subsp. paratuberculosis
ucugaauucggccac

SEQ ID NO: 876338 - RNA, 18 nt, Mycobacterium avium subsp. paratuberculosis
ucugaccgagcagcgggg

SEQ ID NO: 876339 - RNA, 20 nt, Mycobacterium avium subsp. paratuberculosis
ucugaccucgcgccgcgauc

SEQ ID NO: 876340 - RNA, 18 nt, Mycobacterium avium subsp. paratuberculosis
ucugcacagcuucggcgc

SEQ ID NO: 876341 - RNA, 20 nt, Mycobacterium avium subsp. paratuberculosis
ucugcacagcuucggcgccg

SEQ ID NO: 876342 - RNA, 14 nt, Mycobacterium avium subsp. paratuberculosis
ucugcacgucggcg

SEQ ID NO: 876343 - RNA, 15 nt, Mycobacterium avium subsp. paratuberculosis
ucugcacguggugac

SEQ ID NO: 876344 - RNA, 23 nt, Mycobacterium avium subsp. paratuberculosis
ucugcagcgacggaucggccgcg

SEQ ID NO: 876345 - RNA, 21 nt, Mycobacterium avium subsp. paratuberculosis
ucugcacgaugccgaccaaca

SEQ ID NO: 876346 - RNA, 15 nt, Mycobacterium avium subsp. paratuberculosis
ucugcaccagcgugg

SEQ ID NO: 876347 - RNA, 21 nt, Mycobacterium avium subsp. paratuberculosis
ucugacggcucuucggcgccg

SEQ ID NO: 876348 - RNA, 17 nt, Mycobacterium avium subsp. paratuberculosis
ucugcaggccgaggcug

SEQ ID NO: 876349 - RNA, 18 nt, Mycobacterium avium subsp. paratuberculosis
ucugccagaacggcggca

SEQ ID NO: 876350 - RNA, 13 nt, Mycobacterium avium subsp. paratuberculosis
ucugccacgccca

SEQ ID NO: 876351 - RNA, 14 nt, Mycobacterium avium subsp. paratuberculosis
ucugccacggcgga

SEQ ID NO: 876352 - RNA, 14 nt, Mycobacterium avium subsp. paratuberculosis
ucugccggccgccg

SEQ ID NO: 876353 - RNA, 14 nt, Mycobacterium avium subsp. paratuberculosis
ucugccgggcggcg

SEQ ID NO: 876354 - RNA, 15 nt, Mycobacterium avium subsp. paratuberculosis
ucugcccggccagca

SEQ ID NO: 876355 - RNA, 20 nt, Mycobacterium avium subsp. paratuberculosis
ucugccuugcugacgccgcg

SEQ ID NO: 876356 - RNA, 17 nt, Mycobacterium avium subsp. paratuberculosis
ucugcgaccacccggac

SEQ ID NO: 876357 - RNA, 20 nt, Mycobacterium avium subsp. paratuberculosis
ucugcgccagcuccagcagc

SEQ ID NO: 876358 - RNA, 22 nt, Mycobacterium avium subsp. paratuberculosis
ucugcgccagcuggguggucac

SEQ ID NO: 876359 - RNA, 16 nt, Mycobacterium avium subsp. paratuberculosis
ucugcgccccggcguc

SEQ ID NO: 876360 - RNA, 15 nt, Mycobacterium avium subsp. paratuberculosis
ucugcgccggcggug

SEQ ID NO: 876361 - RNA, 19 nt, Mycobacterium avium subsp. paratuberculosis
ucugcgccucgaucagcgc

SEQ ID NO: 876362 - RNA, 17 nt, Mycobacterium avium subsp. paratuberculosis
ucugcggcucggcgcug

SEQ ID NO: 876363 - RNA, 14 nt, Mycobacterium avium subsp. paratuberculosis
ucugcgcgccgucg

SEQ ID NO: 876364 - RNA, 21 nt, Mycobacterium avium subsp. paratuberculosis
ucugcggugagcguagcccua

SEQ ID NO: 876365 - RNA, 15 nt, Mycobacterium avium subsp. paratuberculosis
ucguugccggcggcc

SEQ ID NO: 876366 - RNA, 20 nt, Mycobacterium avium subsp. paratuberculosis
ucguugccggugccgacgau

SEQ ID NO: 876367 - RNA, 18 nt, Mycobacterium avium subsp. paratuberculosis
ucguugaucaggugcagc

SEQ ID NO: 876368 - RNA, 19 nt, Mycobacterium avium subsp. paratuberculosis
ucguugaugccgucgauca

SEQ ID NO: 876369 - RNA, 15 nt, Mycobacterium avium subsp. paratuberculosis
ucguugagugcgcug

SEQ ID NO: 876370 - RNA, 16 nt, Mycobacterium avium subsp. paratuberculosis
ucguugcacaccacca

SEQ ID NO: 876371 - RNA, 16 nt, Mycobacterium avium subsp. paratuberculosis
ucguugcacacccggu

SEQ ID NO: 876372 - RNA, 16 nt, Mycobacterium avium subsp. paratuberculosis
ucguugaccgaggcga

SEQ ID NO: 876373 - RNA, 24 nt, Mycobacterium avium subsp. paratuberculosis
ucguugaccugcuugagcccgucg

SEQ ID NO: 876374 - RNA, 15 nt, Mycobacterium avium subsp. paratuberculosis
ucguugacgcugggc

SEQ ID NO: 876375 - RNA, 19 nt, Mycobacterium avium subsp. paratuberculosis
ucguugacgcugggcggcg

SEQ ID NO: 876376 - RNA, 21 nt, Mycobacterium avium subsp. paratuberculosis
ucguugagcacacacaggucg

SEQ ID NO: 876377 - RNA, 22 nt, Mycobacterium avium subsp. paratuberculosis
ucguugagcacacccagcgagc

SEQ ID NO: 876378 - RNA, 14 nt, Mycobacterium avium subsp. paratuberculosis
ucguugagcaccac

SEQ ID NO: 876379 - RNA, 17 nt, Mycobacterium avium subsp. paratuberculosis
ucguugagcaccacgag

SEQ ID NO: 876380 - RNA, 13 nt, Mycobacterium avium subsp. paratuberculosis
ucguugagcaggc

SEQ ID NO: 876381 - RNA, 14 nt, Mycobacterium avium subsp. paratuberculosis
ucuacgaccucgaa

SEQ ID NO: 876382 - RNA, 16 nt, Mycobacterium avium subsp. paratuberculosis
ucuacgucgucgccgg

SEQ ID NO: 876383 - RNA, 15 nt, Mycobacterium avium subsp. paratuberculosis
ucuacuuggccagcu

SEQ ID NO: 876384 - RNA, 19 nt, Mycobacterium avium subsp. paratuberculosis
ucguucucgggggcgggca

SEQ ID NO: 876385 - RNA, 17 nt, Mycobacterium avium subsp. paratuberculosis
ucguucggccagcacca

SEQ ID NO: 876386 - RNA, 13 nt, Mycobacterium avium subsp. paratuberculosis
ucguucgacgccg

SEQ ID NO: 876387 - RNA, 19 nt, Mycobacterium avium subsp. paratuberculosis
ucguucagcugcagccggc

SEQ ID NO: 876388 - RNA, 17 nt, Mycobacterium avium subsp. paratuberculosis
ucguucccugcgcggcg

SEQ ID NO: 876389 - RNA, 22 nt, Mycobacterium avium subsp. paratuberculosis
ucguucccugcgcggcgaugcg

SEQ ID NO: 876390 - RNA, 20 nt, Mycobacterium avium subsp. paratuberculosis
ucguggucucgcaccugccg

SEQ ID NO: 876391 - RNA, 18 nt, Mycobacterium avium subsp. paratuberculosis
ucguggugacgggcgucg

SEQ ID NO: 876392 - RNA, 15 nt, Mycobacterium avium subsp. paratuberculosis
ucgugguggccgcga

SEQ ID NO: 876393 - RNA, 17 nt, Mycobacterium avium subsp. paratuberculosis
ucgucgucgagcacgaa

SEQ ID NO: 876394 - RNA, 18 nt, Mycobacterium avium subsp. paratuberculosis
ucgucgucgagccgcucg

SEQ ID NO: 876395 - RNA, 14 nt, Mycobacterium avium subsp. paratuberculosis
ucgucgucgcagug

SEQ ID NO: 876396 - RNA, 14 nt, Mycobacterium avium subsp. paratuberculosis
ucguggucgacgcc

SEQ ID NO: 876397 - RNA, 16 nt, Mycobacterium avium subsp. paratuberculosis
ucguguccgcgccggc

SEQ ID NO: 876398 - RNA, 17 nt, Mycobacterium avium subsp. paratuberculosis
ucguguccgcgccggcg

SEQ ID NO: 876399 - RNA, 17 nt, Mycobacterium avium subsp. paratuberculosis
ucguguggcgcacgcug

SEQ ID NO: 876400 - RNA, 16 nt, Mycobacterium avium subsp. paratuberculosis
ucgugugggcgcccgc

SEQ ID NO: 876401 - RNA, 23 nt, Mycobacterium avium subsp. paratuberculosis
ucgugugguacagcgccagcggc

SEQ ID NO: 876402 - RNA, 14 nt, Mycobacterium avium subsp. paratuberculosis
ucgugucccggcgc

SEQ ID NO: 876403 - RNA, 17 nt, Mycobacterium avium subsp. paratuberculosis
ucgugucccggcgcccu

SEQ ID NO: 876404 - RNA, 15 nt, Mycobacterium avium subsp. paratuberculosis
ucgugguucuccgcg

SEQ ID NO: 876405 - RNA, 14 nt, Mycobacterium avium subsp. paratuberculosis
ucgucgucaccucg

SEQ ID NO: 876406 - RNA, 18 nt, Mycobacterium avium subsp. paratuberculosis
ucgucguccgcaaccgcc

SEQ ID NO: 876407 - RNA, 23 nt, Mycobacterium avium subsp. paratuberculosis
ucgucguccgcaaccgccggcag

SEQ ID NO: 876408 - RNA, 14 nt, Mycobacterium avium subsp. paratuberculosis
ucgucgucgaccgu

SEQ ID NO: 876409 - RNA, 14 nt, Mycobacterium avium subsp. paratuberculosis
ucgucgucgacgcu

SEQ ID NO: 876410 - RNA, 20 nt, Mycobacterium avium subsp. paratuberculosis
ucgucggucucuucgacccg

SEQ ID NO: 876411 - RNA, 17 nt, Mycobacterium avium subsp. paratuberculosis
ucgucggugacggugug

SEQ ID NO: 876412 - RNA, 17 nt, Mycobacterium avium subsp. paratuberculosis
ucgucguagucgaggcc

SEQ ID NO: 876413 - RNA, 12 nt, Mycobacterium avium subsp. paratuberculosis
ucucacggcgaa

SEQ ID NO: 876414 - RNA, 15 nt, Mycobacterium avium subsp. paratuberculosis
ucuccgagucggcgu

SEQ ID NO: 876415 - RNA, 19 nt, Mycobacterium avium subsp. paratuberculosis
ucuccgagucggcgucgga

SEQ ID NO: 876416 - RNA, 20 nt, Mycobacterium avium subsp. paratuberculosis
ucuccggccccgagccgacg

SEQ ID NO: 876417 - RNA, 18 nt, Mycobacterium avium subsp. paratuberculosis
ucuccgcgacaucggcgc

SEQ ID NO: 876418 - RNA, 13 nt, Mycobacterium avium subsp. paratuberculosis
ucuccgccggcag

SEQ ID NO: 876419 - RNA, 15 nt, Mycobacterium avium subsp. paratuberculosis
ucuccguggacggcg

SEQ ID NO: 876420 - RNA, 17 nt, Mycobacterium avium subsp. paratuberculosis
ucuccguggacggcgag

SEQ ID NO: 876421 - RNA, 12 nt, Mycobacterium avium subsp. paratuberculosis
ucuccggcgggc

SEQ ID NO: 876422 - RNA, 13 nt, Mycobacterium avium subsp. paratuberculosis
ucuccggcgggcu

SEQ ID NO: 876423 - RNA, 20 nt, Mycobacterium avium subsp. paratuberculosis
ucucgaaccgggcggugacc

SEQ ID NO: 876424 - RNA, 18 nt, Mycobacterium avium subsp. paratuberculosis
ucucgaagaaggcgugcg

SEQ ID NO: 876425 - RNA, 23 nt, Mycobacterium avium subsp. paratuberculosis
ucucgaagcgcagcagcucgucg

SEQ ID NO: 876426 - RNA, 11 nt, Mycobacterium avium subsp. paratuberculosis
ucucgaccgcg

SEQ ID NO: 876427 - RNA, 14 nt, Mycobacterium avium subsp. paratuberculosis
ucucgaccgcggcg

SEQ ID NO: 876428 - RNA, 17 nt, Mycobacterium avium subsp. paratuberculosis
ucucgaccaggccguug

SEQ ID NO: 876429 - RNA, 20 nt, Mycobacterium avium subsp. paratuberculosis
ucucgaccucgucggcggcg

SEQ ID NO: 876430 - RNA, 20 nt, Mycobacterium avium subsp. paratuberculosis
ucucgaucgacgacgccagc

SEQ ID NO: 876431 - RNA, 17 nt, Mycobacterium avium subsp. paratuberculosis
ucucgaucuccaucccg

SEQ ID NO: 876432 - RNA, 20 nt, Mycobacterium avium subsp. paratuberculosis
ucucgaugaccucgcgggug

SEQ ID NO: 876433 - RNA, 13 nt, Mycobacterium avium subsp. paratuberculosis
ucucgcacccggu

SEQ ID NO: 876434 - RNA, 14 nt, Mycobacterium avium subsp. paratuberculosis
ucucgcacccgguc

SEQ ID NO: 876435 - RNA, 16 nt, Mycobacterium avium subsp. paratuberculosis
ucuccuuguugacgau

SEQ ID NO: 876436 - RNA, 17 nt, Mycobacterium avium subsp. paratuberculosis
ucucgauggacgcggug

SEQ ID NO: 876437 - RNA, 20 nt, Mycobacterium avium subsp. paratuberculosis
ucucgauggacgcgguggug

SEQ ID NO: 876438 - RNA, 19 nt, Mycobacterium avium subsp. paratuberculosis
ucucgauggccucgucgau

SEQ ID NO: 876439 - RNA, 17 nt, Mycobacterium avium subsp. paratuberculosis
ucucgauggucgccuug

SEQ ID NO: 876440 - RNA, 14 nt, Mycobacterium avium subsp. paratuberculosis
ucucgacggcgccg

SEQ ID NO: 876441 - RNA, 16 nt, Mycobacterium avium subsp. paratuberculosis
ucucgacggugaccgg

SEQ ID NO: 876442 - RNA, 17 nt, Mycobacterium avium subsp. paratuberculosis
ucucgacgguggccucg

SEQ ID NO: 876443 - RNA, 15 nt, Mycobacterium avium subsp. paratuberculosis
ucucguugucgucgg

SEQ ID NO: 876444 - RNA, 13 nt, Mycobacterium avium subsp. paratuberculosis
ucucgucgacgau

SEQ ID NO: 876445 - RNA, 17 nt, Mycobacterium avium subsp. paratuberculosis
ucucgucgaugggcucg

SEQ ID NO: 876446 - RNA, 13 nt, Mycobacterium avium subsp. paratuberculosis
ucucgucgcgcag

SEQ ID NO: 876447 - RNA, 20 nt, Mycobacterium avium subsp. paratuberculosis
ucucguagaagcucagcugc

SEQ ID NO: 876448 - RNA, 15 nt, Mycobacterium avium subsp. paratuberculosis
ucucggucgccagca

SEQ ID NO: 876449 - RNA, 17 nt, Mycobacterium avium subsp. paratuberculosis
ucucggucgccagcacc

SEQ ID NO: 876450 - RNA, 20 nt, Mycobacterium avium subsp. paratuberculosis
ucucggucgccagcaccgug

SEQ ID NO: 876451 - RNA, 16 nt, Mycobacterium avium subsp. paratuberculosis
ucucgguuuccacguc

SEQ ID NO: 876452 - RNA, 18 nt, Mycobacterium avium subsp. paratuberculosis
ucucgguuuccacgucgc

SEQ ID NO: 876453 - RNA, 21 nt, Mycobacterium avium subsp. paratuberculosis
ucucgguuuccacgucgcgau

SEQ ID NO: 876454 - RNA, 20 nt, Mycobacterium avium subsp. paratuberculosis
ucucgggaucgccgaagcgg

SEQ ID NO: 876455 - RNA, 20 nt, Mycobacterium avium subsp. paratuberculosis
ucucgggcagcagcaccagc

SEQ ID NO: 876456 - RNA, 16 nt, Mycobacterium avium subsp. paratuberculosis
ucucggugagccgcug

SEQ ID NO: 876457 - RNA, 14 nt, Mycobacterium avium subsp. paratuberculosis
ucucggugccgucg

SEQ ID NO: 876458 - RNA, 14 nt, Mycobacterium avium subsp. paratuberculosis
ucucgcgcaccgcg

SEQ ID NO: 876459 - RNA, 13 nt, Mycobacterium avium subsp. paratuberculosis
ucucgccccggcc

SEQ ID NO: 876460 - RNA, 17 nt, Mycobacterium avium subsp. paratuberculosis
ucucgccaauaaagcgg

SEQ ID NO: 876461 - RNA, 20 nt, Mycobacterium avium subsp. paratuberculosis
ucucgccgagcacaccgucg

SEQ ID NO: 876462 - RNA, 21 nt, Mycobacterium avium subsp. paratuberculosis
ucucgccgagcacaccgucgc

SEQ ID NO: 876463 - RNA, 17 nt, Mycobacterium avium subsp. paratuberculosis
ucucgccggggaacacc

SEQ ID NO: 876464 - RNA, 21 nt, Mycobacterium avium subsp. paratuberculosis
ucucgccguacuugacgugcg

SEQ ID NO: 876465 - RNA, 21 nt, Mycobacterium avium subsp. paratuberculosis
ucucgcguucgcuuucgccgg

SEQ ID NO: 876466 - RNA, 18 nt, Mycobacterium avium subsp. paratuberculosis
ucucgcugaucucgacgg

SEQ ID NO: 876467 - RNA, 22 nt, Mycobacterium avium subsp. paratuberculosis
ucucggcgaaggucugaaaugc

SEQ ID NO: 876468 - RNA, 22 nt, Mycobacterium avium subsp. paratuberculosis
ucucggcgccguccagcucgcg

SEQ ID NO: 876469 - RNA, 16 nt, Mycobacterium avium subsp. paratuberculosis
ucucggcggacaucgc

SEQ ID NO: 876470 - RNA, 13 nt, Mycobacterium avium subsp. paratuberculosis
ucucggcggcgcc

SEQ ID NO: 876471 - RNA, 18 nt, Mycobacterium avium subsp. paratuberculosis
ucucggcguacagcccgc

SEQ ID NO: 876472 - RNA, 12 nt, Mycobacterium avium subsp. paratuberculosis
ucucggccaggc

SEQ ID NO: 876473 - RNA, 12 nt, Mycobacterium avium subsp. paratuberculosis
ucucggccagcg

SEQ ID NO: 876474 - RNA, 12 nt, Mycobacterium avium subsp. paratuberculosis
ucucggccaacc

SEQ ID NO: 876475 - RNA, 17 nt, Mycobacterium avium subsp. paratuberculosis
ucguacggcccgggaag

SEQ ID NO: 876476 - RNA, 18 nt, Mycobacterium avium subsp. paratuberculosis
ucguacgggcgcagcgcc

SEQ ID NO: 876477 - RNA, 17 nt, Mycobacterium avium subsp. paratuberculosis
ucguacgucuugcgcac

SEQ ID NO: 876478 - RNA, 12 nt, Mycobacterium avium subsp. paratuberculosis
ucguagaccgcu

SEQ ID NO: 876479 - RNA, 15 nt, Mycobacterium avium subsp. paratuberculosis
ucguagacgacgucg

SEQ ID NO: 876480 - RNA, 21 nt, Mycobacterium avium subsp. paratuberculosis
ucguagacgacgucgaccgcg

SEQ ID NO: 876481 - RNA, 17 nt, Mycobacterium avium subsp. paratuberculosis
ucguacucgaccgcgac

SEQ ID NO: 876482 - RNA, 17 nt, Mycobacterium avium subsp. paratuberculosis
ucguacaaggugauggc

SEQ ID NO: 876483 - RNA, 22 nt, Mycobacterium avium subsp. paratuberculosis
ucguaacacccucggucgggcg

SEQ ID NO: 876484 - RNA, 19 nt, Mycobacterium avium subsp. paratuberculosis
ucguaacgccacggcggcc

SEQ ID NO: 876485 - RNA, 15 nt, Mycobacterium avium subsp. paratuberculosis
ucgguguccagccgc

SEQ ID NO: 876486 - RNA, 20 nt, Mycobacterium avium subsp. paratuberculosis
ucgguggugucaaccagguc

SEQ ID NO: 876487 - RNA, 20 nt, Mycobacterium avium subsp. paratuberculosis
ucggugguguggcagguggc

SEQ ID NO: 876488 - RNA, 18 nt, Mycobacterium avium subsp. paratuberculosis
ucggugguggggccggcg

SEQ ID NO: 876489 - RNA, 16 nt, Mycobacterium avium subsp. paratuberculosis
ucgguguagcccggug

SEQ ID NO: 876490 - RNA, 20 nt, Mycobacterium avium subsp. paratuberculosis
ucgguguagucggcgaucgg

SEQ ID NO: 876491 - RNA, 14 nt, Mycobacterium avium subsp. paratuberculosis
ucgucgagcagcgc

SEQ ID NO: 876492 - RNA, 20 nt, Mycobacterium avium subsp. paratuberculosis
ucgucgagcagcgcccggcg

SEQ ID NO: 876493 - RNA, 23 nt, Mycobacterium avium subsp. paratuberculosis
ucgucgagcauccggcgcacggc

SEQ ID NO: 876494 - RNA, 19 nt, Mycobacterium avium subsp. paratuberculosis
ucgucgagcaccacccggg

SEQ ID NO: 876495 - RNA, 15 nt, Mycobacterium avium subsp. paratuberculosis
ucgucgagcaccggc

SEQ ID NO: 876496 - RNA, 17 nt, Mycobacterium avium subsp. paratuberculosis
ucgucgagcaccggcag

SEQ ID NO: 876497 - RNA, 16 nt, Mycobacterium avium subsp. paratuberculosis
ucgucgacguccacgu

SEQ ID NO: 876498 - RNA, 14 nt, Mycobacterium avium subsp. paratuberculosis
ucgucgacguccuc

SEQ ID NO: 876499 - RNA, 22 nt, Mycobacterium avium subsp. paratuberculosis
ucgucgacgucggacgcggccg

SEQ ID NO: 876500 - RNA, 15 nt, Mycobacterium avium subsp. paratuberculosis
ucgucgacguucgag

SEQ ID NO: 876501 - RNA, 17 nt, Mycobacterium avium subsp. paratuberculosis
ucguccggcgccacgac

SEQ ID NO: 876502 - RNA, 21 nt, Mycobacterium avium subsp. paratuberculosis
ucguccgugcugccggccggc

SEQ ID NO: 876503 - RNA, 15 nt, Mycobacterium avium subsp. paratuberculosis
ucguccucgaucacc

SEQ ID NO: 876504 - RNA, 20 nt, Mycobacterium avium subsp. paratuberculosis
ucguccucgaucaccgacag

SEQ ID NO: 876505 - RNA, 21 nt, Mycobacterium avium subsp. paratuberculosis
ucguccucgaucaccgacagc

SEQ ID NO: 876506 - RNA, 14 nt, Mycobacterium avium subsp. paratuberculosis
ucguccgcggcggc

SEQ ID NO: 876507 - RNA, 15 nt, Mycobacterium avium subsp. paratuberculosis
ucgucccgucggcgc

SEQ ID NO: 876508 - RNA, 19 nt, Mycobacterium avium subsp. paratuberculosis
ucguccgcaaccgccggca

SEQ ID NO: 876509 - RNA, 21 nt, Mycobacterium avium subsp. paratuberculosis
ucguccaugcuggugccgccg

SEQ ID NO: 876510 - RNA, 20 nt, Mycobacterium avium subsp. paratuberculosis
ucguccauaccccccacgcu

SEQ ID NO: 876511 - RNA, 15 nt, Mycobacterium avium subsp. paratuberculosis
ucgucggcagcgacg

SEQ ID NO: 876512 - RNA, 23 nt, Mycobacterium avium subsp. paratuberculosis
ucgucgcugcaguagccggccag

SEQ ID NO: 876513 - RNA, 15 nt, Mycobacterium avium subsp. paratuberculosis
ucgucggacagcagc

SEQ ID NO: 876514 - RNA, 20 nt, Mycobacterium avium subsp. paratuberculosis
ucgucggacagcagcaccgg

SEQ ID NO: 876515 - RNA, 13 nt, Mycobacterium avium subsp. paratuberculosis
ucgucgcuggcca

SEQ ID NO: 876516 - RNA, 17 nt, Mycobacterium avium subsp. paratuberculosis
ucgucgcugaucgcgau

SEQ ID NO: 876517 - RNA, 20 nt, Mycobacterium avium subsp. paratuberculosis
ucgucgcugaucgcgauccg

SEQ ID NO: 876518 - RNA, 16 nt, Mycobacterium avium subsp. paratuberculosis
ucgucggccacgcucg

SEQ ID NO: 876519 - RNA, 20 nt, Mycobacterium avium subsp. paratuberculosis
ucgucggggaucagcgucgc

SEQ ID NO: 876520 - RNA, 18 nt, Mycobacterium avium subsp. paratuberculosis
ucgucggggcagccgucg

SEQ ID NO: 876521 - RNA, 12 nt, Mycobacterium avium subsp. paratuberculosis
ucgucgcgggcg

SEQ ID NO: 876522 - RNA, 17 nt, Mycobacterium avium subsp. paratuberculosis
ucgucgcgggcgccgag

SEQ ID NO: 876523 - RNA, 21 nt, Mycobacterium avium subsp. paratuberculosis
ucgucgcgguccacgccggcg

SEQ ID NO: 876524 - RNA, 16 nt, Mycobacterium avium subsp. paratuberculosis
ucgucgcggcgcugcc

SEQ ID NO: 876525 - RNA, 14 nt, Mycobacterium avium subsp. paratuberculosis
ucgucgcggcggcc

SEQ ID NO: 876526 - RNA, 14 nt, Mycobacterium avium subsp. paratuberculosis
ucgucgccgaccag

SEQ ID NO: 876527 - RNA, 12 nt, Mycobacterium avium subsp. paratuberculosis
ucgucgccgcgg

SEQ ID NO: 876528 - RNA, 14 nt, Mycobacterium avium subsp. paratuberculosis
ucgucgccgcggua

SEQ ID NO: 876529 - RNA, 13 nt, Mycobacterium avium subsp. paratuberculosis
ucgucgccggccg

SEQ ID NO: 876530 - RNA, 15 nt, Mycobacterium avium subsp. paratuberculosis
ucgucgccggccgcg

SEQ ID NO: 876531 - RNA, 14 nt, Mycobacterium avium subsp. paratuberculosis
ucgucgccggugag

SEQ ID NO: 876532 - RNA, 18 nt, Mycobacterium avium subsp. paratuberculosis
ucgucgccgguggccgcc

SEQ ID NO: 876533 - RNA, 15 nt, Mycobacterium avium subsp. paratuberculosis
ucgucgccgucgggg

SEQ ID NO: 876534 - RNA, 15 nt, Mycobacterium avium subsp. paratuberculosis
ucgucgcccacccgc

SEQ ID NO: 876535 - RNA, 20 nt, Mycobacterium avium subsp. paratuberculosis
ucgucgcccacccgccagcc

SEQ ID NO: 876536 - RNA, 23 nt, Mycobacterium avium subsp. paratuberculosis
ucgucgcccacccgccagcccgc

SEQ ID NO: 876537 - RNA, 20 nt, Mycobacterium avium subsp. paratuberculosis
ucgucgcccaccgacgcggc

SEQ ID NO: 876538 - RNA, 21 nt, Mycobacterium avium subsp. paratuberculosis
ucgucgcccaccgacgcggcg

SEQ ID NO: 876539 - RNA, 22 nt, Mycobacterium avium subsp. paratuberculosis
ucgucgcccaccgacgcggcgg

SEQ ID NO: 876540 - RNA, 20 nt, Mycobacterium avium subsp. paratuberculosis
ucgucgcagugcccgcccag

SEQ ID NO: 876541 - RNA, 18 nt, Mycobacterium avium subsp. paratuberculosis
ucgucgaucuucgcggcg

SEQ ID NO: 876542 - RNA, 12 nt, Mycobacterium avium subsp. paratuberculosis
ucgucgcccggc

SEQ ID NO: 876543 - RNA, 15 nt, Mycobacterium avium subsp. paratuberculosis
ucgucgcccggcguc

SEQ ID NO: 876544 - RNA, 23 nt, Mycobacterium avium subsp. paratuberculosis
ucgucgaugcccuagcgguggcg

SEQ ID NO: 876545 - RNA, 14 nt, Mycobacterium avium subsp. paratuberculosis
ucgucgaugccgau

SEQ ID NO: 876546 - RNA, 16 nt, Mycobacterium avium subsp. paratuberculosis
ucgucgaugccgaucg

SEQ ID NO: 876547 - RNA, 17 nt, Mycobacterium avium subsp. paratuberculosis
ucgucgaugccgaucgg

SEQ ID NO: 876548 - RNA, 22 nt, Mycobacterium avium subsp. paratuberculosis
ucgucgaugccguagaccagca

SEQ ID NO: 876549 - RNA, 17 nt, Mycobacterium avium subsp. paratuberculosis
ucgucgaugcgcagcag

SEQ ID NO: 876550 - RNA, 20 nt, Mycobacterium avium subsp. paratuberculosis
ucgucgaugaagucggugag

SEQ ID NO: 876551 - RNA, 22 nt, Mycobacterium avium subsp. paratuberculosis
ucgucgaugaagucggugagca

SEQ ID NO: 876552 - RNA, 20 nt, Mycobacterium avium subsp. paratuberculosis
ucgucgaugacguccaccag

SEQ ID NO: 876553 - RNA, 15 nt, Mycobacterium avium subsp. paratuberculosis
ucgucgaugucggcg

SEQ ID NO: 876554 - RNA, 17 nt, Mycobacterium avium subsp. paratuberculosis
ucgucgaugucggcggc

SEQ ID NO: 876555 - RNA, 18 nt, Mycobacterium avium subsp. paratuberculosis
ucgucgaugucggcggcc

SEQ ID NO: 876556 - RNA, 16 nt, Mycobacterium avium subsp. paratuberculosis
ucgucgaucgacgccg

SEQ ID NO: 876557 - RNA, 15 nt, Mycobacterium avium subsp. paratuberculosis
ucgucgaucgcggcg

SEQ ID NO: 876558 - RNA, 20 nt, Mycobacterium avium subsp. paratuberculosis
ucgucgagggccaccggcuc

SEQ ID NO: 876559 - RNA, 17 nt, Mycobacterium avium subsp. paratuberculosis
ucgucgaguucgcggcg

SEQ ID NO: 876560 - RNA, 19 nt, Mycobacterium avium subsp. paratuberculosis
ucgucgaguucgcggcgca

SEQ ID NO: 876561 - RNA, 12 nt, Mycobacterium avium subsp. paratuberculosis
ucgucgagccgg

SEQ ID NO: 876562 - RNA, 17 nt, Mycobacterium avium subsp. paratuberculosis
ucgucgagccggccgga

SEQ ID NO: 876563 - RNA, 14 nt, Mycobacterium avium subsp. paratuberculosis
ucgucgagcgcucg

SEQ ID NO: 876564 - RNA, 22 nt, Mycobacterium avium subsp. paratuberculosis
ucgucgagcugacacccgacga

SEQ ID NO: 876565 - RNA, 20 nt, Mycobacterium avium subsp. paratuberculosis
ucggugcagaccccggcguc

SEQ ID NO: 876566 - RNA, 16 nt, Mycobacterium avium subsp. paratuberculosis
ucggugaggugggcgg

SEQ ID NO: 876567 - RNA, 17 nt, Mycobacterium avium subsp. paratuberculosis
ucggugaugucgacguc

SEQ ID NO: 876568 - RNA, 17 nt, Mycobacterium avium subsp. paratuberculosis
ucggugaugaucgccgg

SEQ ID NO: 876569 - RNA, 16 nt, Mycobacterium avium subsp. paratuberculosis
ucggugaugccgagcg

SEQ ID NO: 876570 - RNA, 19 nt, Mycobacterium avium subsp. paratuberculosis
ucggugccaucgugggcgc

SEQ ID NO: 876571 - RNA, 22 nt, Mycobacterium avium subsp. paratuberculosis
ucggugcccagcaccgccggcg

SEQ ID NO: 876572 - RNA, 23 nt, Mycobacterium avium subsp. paratuberculosis
ucggugcccgcggguagcccguc

SEQ ID NO: 876573 - RNA, 18 nt, Mycobacterium avium subsp. paratuberculosis
ucggugcccugugaggcg

SEQ ID NO: 876574 - RNA, 20 nt, Mycobacterium avium subsp. paratuberculosis
ucggugcccuugguguaggc

SEQ ID NO: 876575 - RNA, 22 nt, Mycobacterium avium subsp. paratuberculosis
ucggugcccgggguccaccggc

SEQ ID NO: 876576 - RNA, 13 nt, Mycobacterium avium subsp. paratuberculosis
ucggugccggccc

SEQ ID NO: 876577 - RNA, 21 nt, Mycobacterium avium subsp. paratuberculosis
ucggugccgucgaucgcccgc

SEQ ID NO: 876578 - RNA, 15 nt, Mycobacterium avium subsp. paratuberculosis
ucgguggucgacgag

SEQ ID NO: 876579 - RNA, 21 nt, Mycobacterium avium subsp. paratuberculosis
ucgguggggugaggcacccgc

SEQ ID NO: 876580 - RNA, 16 nt, Mycobacterium avium subsp. paratuberculosis
ucggugggcagcucgu

SEQ ID NO: 876581 - RNA, 16 nt, Mycobacterium avium subsp. paratuberculosis
ucggugggccgcaccu

SEQ ID NO: 876582 - RNA, 19 nt, Mycobacterium avium subsp. paratuberculosis
ucggugggccgcaccuggc

SEQ ID NO: 876583 - RNA, 22 nt, Mycobacterium avium subsp. paratuberculosis
ucggugggccgccgcggcggca

SEQ ID NO: 876584 - RNA, 20 nt, Mycobacterium avium subsp. paratuberculosis
ucgguggcggcggcgacgau

SEQ ID NO: 876585 - RNA, 22 nt, Mycobacterium avium subsp. paratuberculosis
ucgguggggacgugcacgcguu

SEQ ID NO: 876586 - RNA, 13 nt, Mycobacterium avium subsp. paratuberculosis
ucgguggcggugc

SEQ ID NO: 876587 - RNA, 19 nt, Mycobacterium avium subsp. paratuberculosis
ucgguggcggugccgcggc

SEQ ID NO: 876588 - RNA, 23 nt, Mycobacterium avium subsp. paratuberculosis
ucgguggcggugccgcggcggcg

SEQ ID NO: 876589 - RNA, 12 nt, Mycobacterium avium subsp. paratuberculosis
ucgguggcgucg

SEQ ID NO: 876590 - RNA, 18 nt, Mycobacterium avium subsp. paratuberculosis
ucgguggcgucggcggcc

SEQ ID NO: 876591 - RNA, 16 nt, Mycobacterium avium subsp. paratuberculosis
ucgguggcgauggugc

SEQ ID NO: 876592 - RNA, 17 nt, Mycobacterium avium subsp. paratuberculosis
ucggugaucucaccggc

SEQ ID NO: 876593 - RNA, 18 nt, Mycobacterium avium subsp. paratuberculosis
ucggugaucucaccggcg

SEQ ID NO: 876594 - RNA, 18 nt, Mycobacterium avium subsp. paratuberculosis
ucggugauccacgcggug

SEQ ID NO: 876595 - RNA, 15 nt, Mycobacterium avium subsp. paratuberculosis
ucggugacgaggagg

SEQ ID NO: 876596 - RNA, 22 nt, Mycobacterium avium subsp. paratuberculosis
ucggugacgcccuuguccucga

SEQ ID NO: 876597 - RNA, 13 nt, Mycobacterium avium subsp. paratuberculosis
ucggugagacgac

SEQ ID NO: 876598 - RNA, 23 nt, Mycobacterium avium subsp. paratuberculosis
ucggugagcaccguugugacccg

SEQ ID NO: 876599 - RNA, 13 nt, Mycobacterium avium subsp. paratuberculosis
ucggucugcaggu

SEQ ID NO: 876600 - RNA, 16 nt, Mycobacterium avium subsp. paratuberculosis
ucggucucgccccggc

SEQ ID NO: 876601 - RNA, 19 nt, Mycobacterium avium subsp. paratuberculosis
ucggucucggcggcgccca

SEQ ID NO: 876602 - RNA, 13 nt, Mycobacterium avium subsp. paratuberculosis
ucggucucgucca

SEQ ID NO: 876603 - RNA, 13 nt, Mycobacterium avium subsp. paratuberculosis
ucggucagcggcg

SEQ ID NO: 876604 - RNA, 17 nt, Mycobacterium avium subsp. paratuberculosis
ucggucagcggcgugcu

SEQ ID NO: 876605 - RNA, 17 nt, Mycobacterium avium subsp. paratuberculosis
ucggucagcgucgccgc

SEQ ID NO: 876606 - RNA, 15 nt, Mycobacterium avium subsp. paratuberculosis
ucggucagcucgggg

SEQ ID NO: 876607 - RNA, 15 nt, Mycobacterium avium subsp. paratuberculosis
ucggucaggcacucg

SEQ ID NO: 876608 - RNA, 17 nt, Mycobacterium avium subsp. paratuberculosis
ucggucaggccggcgcc

SEQ ID NO: 876609 - RNA, 15 nt, Mycobacterium avium subsp. paratuberculosis
ucggugaagccgacg

SEQ ID NO: 876610 - RNA, 14 nt, Mycobacterium avium subsp. paratuberculosis
ucggugaagccgcg

SEQ ID NO: 876611 - RNA, 17 nt, Mycobacterium avium subsp. paratuberculosis
ucggugaagccgcggac

SEQ ID NO: 876612 - RNA, 21 nt, Mycobacterium avium subsp. paratuberculosis
ucggugaagccgcggacggcg

SEQ ID NO: 876613 - RNA, 18 nt, Mycobacterium avium subsp. paratuberculosis
ucggugaaguuggcggcg

SEQ ID NO: 876614 - RNA, 18 nt, Mycobacterium avium subsp. paratuberculosis
ucggugaaugucgugacc

SEQ ID NO: 876615 - RNA, 18 nt, Mycobacterium avium subsp. paratuberculosis
ucggugaacccgccggcg

SEQ ID NO: 876616 - RNA, 19 nt, Mycobacterium avium subsp. paratuberculosis
ucggugaccacggucggcg

SEQ ID NO: 876617 - RNA, 16 nt, Mycobacterium avium subsp. paratuberculosis
ucggugaccgucgccg

SEQ ID NO: 876618 - RNA, 13 nt, Mycobacterium avium subsp. paratuberculosis
ucggcgucgccga

SEQ ID NO: 876619 - RNA, 16 nt, Mycobacterium avium subsp. paratuberculosis
ucggcgucgccgagcu

SEQ ID NO: 876620 - RNA, 15 nt, Mycobacterium avium subsp. paratuberculosis
ucggcguggucgagg

SEQ ID NO: 876621 - RNA, 14 nt, Mycobacterium avium subsp. paratuberculosis
ucggcgucgcggcg

SEQ ID NO: 876622 - RNA, 15 nt, Mycobacterium avium subsp. paratuberculosis
ucggcgucgcggcgc

SEQ ID NO: 876623 - RNA, 16 nt, Mycobacterium avium subsp. paratuberculosis
ucggcgucgcggcgca

SEQ ID NO: 876624 - RNA, 16 nt, Mycobacterium avium subsp. paratuberculosis
ucggcguggccguccg

SEQ ID NO: 876625 - RNA, 20 nt, Mycobacterium avium subsp. paratuberculosis
ucggcguggcgcucagcggc

SEQ ID NO: 876626 - RNA, 17 nt, Mycobacterium avium subsp. paratuberculosis
ucggcguggcgguggcg

SEQ ID NO: 876627 - RNA, 20 nt, Mycobacterium avium subsp. paratuberculosis
ucggcguggcgguggcggcg

SEQ ID NO: 876628 - RNA, 21 nt, Mycobacterium avium subsp. paratuberculosis
ucggcguucgauugccggacg

SEQ ID NO: 876629 - RNA, 20 nt, Mycobacterium avium subsp. paratuberculosis
ucggcguugagccggcgcac

SEQ ID NO: 876630 - RNA, 15 nt, Mycobacterium avium subsp. paratuberculosis
ucggcguuggcggcg

SEQ ID NO: 876631 - RNA, 18 nt, Mycobacterium avium subsp. paratuberculosis
ucggcguucagcggcacc

SEQ ID NO: 876632 - RNA, 21 nt, Mycobacterium avium subsp. paratuberculosis
ucggcguucagcggcaccguc

SEQ ID NO: 876633 - RNA, 18 nt, Mycobacterium avium subsp. paratuberculosis
ucggcguucaucgugccg

SEQ ID NO: 876634 - RNA, 23 nt, Mycobacterium avium subsp. paratuberculosis
ucggcguucaucgugccgaacgu

SEQ ID NO: 876635 - RNA, 18 nt, Mycobacterium avium subsp. paratuberculosis
ucgggguugacccggccg

SEQ ID NO: 876636 - RNA, 21 nt, Mycobacterium avium subsp. paratuberculosis
ucgggguuuugaucagcccgg

SEQ ID NO: 876637 - RNA, 19 nt, Mycobacterium avium subsp. paratuberculosis
ucggguaacccuccggcgc

SEQ ID NO: 876638 - RNA, 18 nt, Mycobacterium avium subsp. paratuberculosis
ucggguacaccgagccgg

SEQ ID NO: 876639 - RNA, 16 nt, Mycobacterium avium subsp. paratuberculosis
ucggggugcgccaggc

SEQ ID NO: 876640 - RNA, 14 nt, Mycobacterium avium subsp. paratuberculosis
ucgggguggaucgc

SEQ ID NO: 876641 - RNA, 23 nt, Mycobacterium avium subsp. paratuberculosis
ucgggguggccggccagcacacc

SEQ ID NO: 876642 - RNA, 21 nt, Mycobacterium avium subsp. paratuberculosis
ucgggguggggacgacgccga

SEQ ID NO: 876643 - RNA, 16 nt, Mycobacterium avium subsp. paratuberculosis
ucgggguggugggcgc

SEQ ID NO: 876644 - RNA, 15 nt, Mycobacterium avium subsp. paratuberculosis
ucgggucggcgagca

SEQ ID NO: 876645 - RNA, 20 nt, Mycobacterium avium subsp. paratuberculosis
ucgggucgaagugcucgagc

SEQ ID NO: 876646 - RNA, 13 nt, Mycobacterium avium subsp. paratuberculosis
ucgggucgacgag

SEQ ID NO: 876647 - RNA, 20 nt, Mycobacterium avium subsp. paratuberculosis
ucgggucgagacugcacagu

SEQ ID NO: 876648 - RNA, 15 nt, Mycobacterium avium subsp. paratuberculosis
ucgggucccggcaac

SEQ ID NO: 876649 - RNA, 12 nt, Mycobacterium avium subsp. paratuberculosis
ucgggucgccgg

SEQ ID NO: 876650 - RNA, 15 nt, Mycobacterium avium subsp. paratuberculosis
ucggguagggcgccg

SEQ ID NO: 876651 - RNA, 14 nt, Mycobacterium avium subsp. paratuberculosis
ucgggucagaccgc

SEQ ID NO: 876652 - RNA, 22 nt, Mycobacterium avium subsp. paratuberculosis
ucgggucagaccgcggcggucg

SEQ ID NO: 876653 - RNA, 13 nt, Mycobacterium avium subsp. paratuberculosis
ucggguccagcgc

SEQ ID NO: 876654 - RNA, 23 nt, Mycobacterium avium subsp. paratuberculosis
ucggguccagcgccgagcacggc

SEQ ID NO: 876655 - RNA, 18 nt, Mycobacterium avium subsp. paratuberculosis
ucggguccgaccagcacc

SEQ ID NO: 876656 - RNA, 22 nt, Mycobacterium avium subsp. paratuberculosis
ucggguccgaccagcacccggg

SEQ ID NO: 876657 - RNA, 13 nt, Mycobacterium avium subsp. paratuberculosis
ucggguccgcggu

SEQ ID NO: 876658 - RNA, 18 nt, Mycobacterium avium subsp. paratuberculosis
ucggucaacccgaucgag

SEQ ID NO: 876659 - RNA, 15 nt, Mycobacterium avium subsp. paratuberculosis
ucggucaagccggcc

SEQ ID NO: 876660 - RNA, 17 nt, Mycobacterium avium subsp. paratuberculosis
ucggucaagccggccag

SEQ ID NO: 876661 - RNA, 18 nt, Mycobacterium avium subsp. paratuberculosis
ucggucaagccggccagc

SEQ ID NO: 876662 - RNA, 19 nt, Mycobacterium avium subsp. paratuberculosis
ucggucaagccggccagca

SEQ ID NO: 876663 - RNA, 17 nt, Mycobacterium avium subsp. paratuberculosis
ucggucaccagcggccc

SEQ ID NO: 876664 - RNA, 13 nt, Mycobacterium avium subsp. paratuberculosis
ucggucaccggug

SEQ ID NO: 876665 - RNA, 20 nt, Mycobacterium avium subsp. paratuberculosis
ucggucaccggugucacgcu

SEQ ID NO: 876666 - RNA, 19 nt, Mycobacterium avium subsp. paratuberculosis
ucggucacggacagccggc

SEQ ID NO: 876667 - RNA, 12 nt, Mycobacterium avium subsp. paratuberculosis
ucggucagcacc

SEQ ID NO: 876668 - RNA, 22 nt, Mycobacterium avium subsp. paratuberculosis
ucggucagcgagcgguuggcga

SEQ ID NO: 876669 - RNA, 13 nt, Mycobacterium avium subsp. paratuberculosis
ucggucagcgcca

SEQ ID NO: 876670 - RNA, 12 nt, Mycobacterium avium subsp. paratuberculosis
ucgcucggcggc

SEQ ID NO: 876671 - RNA, 16 nt, Mycobacterium avium subsp. paratuberculosis
ucgcucugccgggccg

SEQ ID NO: 876672 - RNA, 14 nt, Mycobacterium avium subsp. paratuberculosis
ucgcucgucggcgc

SEQ ID NO: 876673 - RNA, 17 nt, Mycobacterium avium subsp. paratuberculosis
ucgcucccgcgcgggca

SEQ ID NO: 876674 - RNA, 12 nt, Mycobacterium avium subsp. paratuberculosis
ucgcuggucgcg

SEQ ID NO: 876675 - RNA, 18 nt, Mycobacterium avium subsp. paratuberculosis
ucgcugacccgccgcaac

SEQ ID NO: 876676 - RNA, 12 nt, Mycobacterium avium subsp. paratuberculosis
ucgcugacccgg

SEQ ID NO: 876677 - RNA, 16 nt, Mycobacterium avium subsp. paratuberculosis
ucgcuggcggcgcggu

SEQ ID NO: 876678 - RNA, 16 nt, Mycobacterium avium subsp. paratuberculosis
ucgcugaacgcgucgu

SEQ ID NO: 876679 - RNA, 17 nt, Mycobacterium avium subsp. paratuberculosis
ucgcguucgcucucgcg

SEQ ID NO: 876680 - RNA, 21 nt, Mycobacterium avium subsp. paratuberculosis
ucgcguucgcuuucgccgggc

SEQ ID NO: 876681 - RNA, 15 nt, Mycobacterium avium subsp. paratuberculosis
ucgcguucgggcagc

SEQ ID NO: 876682 - RNA, 18 nt, Mycobacterium avium subsp. paratuberculosis
ucgcguucgggcagcgcc

SEQ ID NO: 876683 - RNA, 20 nt, Mycobacterium avium subsp. paratuberculosis
ucgcguucgggcagcgccuc

SEQ ID NO: 876684 - RNA, 19 nt, Mycobacterium avium subsp. paratuberculosis
ucgcguucgggcccggccg

SEQ ID NO: 876685 - RNA, 15 nt, Mycobacterium avium subsp. paratuberculosis
ucgcgugcuuuugcg

SEQ ID NO: 876686 - RNA, 20 nt, Mycobacterium avium subsp. paratuberculosis
ucgcgugugcccagcacgac

SEQ ID NO: 876687 - RNA, 21 nt, Mycobacterium avium subsp. paratuberculosis
ucgcgugugcccagcacgacg

SEQ ID NO: 876688 - RNA, 22 nt, Mycobacterium avium subsp. paratuberculosis
ucgcgugugcccagcacgacgc

SEQ ID NO: 876689 - RNA, 15 nt, Mycobacterium avium subsp. paratuberculosis
ucgcguucugcacca

SEQ ID NO: 876690 - RNA, 18 nt, Mycobacterium avium subsp. paratuberculosis
ucgcguucugcaccagcu

SEQ ID NO: 876691 - RNA, 15 nt, Mycobacterium avium subsp. paratuberculosis
ucgcguugagcgucg

SEQ ID NO: 876692 - RNA, 22 nt, Mycobacterium avium subsp. paratuberculosis
ucgcguugagcgucgccaccac

SEQ ID NO: 876693 - RNA, 16 nt, Mycobacterium avium subsp. paratuberculosis
ucgcuaaucgccgcgc

SEQ ID NO: 876694 - RNA, 17 nt, Mycobacterium avium subsp. paratuberculosis
ucgcguuccgccacggc

SEQ ID NO: 876695 - RNA, 15 nt, Mycobacterium avium subsp. paratuberculosis
ucgcgguugcgggug

SEQ ID NO: 876696 - RNA, 20 nt, Mycobacterium avium subsp. paratuberculosis
ucgcgguugcggguggcggc

SEQ ID NO: 876697 - RNA, 21 nt, Mycobacterium avium subsp. paratuberculosis
ucgcgguugcggguggcggcc

SEQ ID NO: 876698 - RNA, 18 nt, Mycobacterium avium subsp. paratuberculosis
ucgcgguugggccgccgg

SEQ ID NO: 876699 - RNA, 18 nt, Mycobacterium avium subsp. paratuberculosis
ucgcgguugggccggcgc

SEQ ID NO: 876700 - RNA, 15 nt, Mycobacterium avium subsp. paratuberculosis
ucgcguagcgccggu

SEQ ID NO: 876701 - RNA, 19 nt, Mycobacterium avium subsp. paratuberculosis
ucgcguaguccagcacggc

SEQ ID NO: 876702 - RNA, 20 nt, Mycobacterium avium subsp. paratuberculosis
ucgcguaguggugccggaag

SEQ ID NO: 876703 - RNA, 15 nt, Mycobacterium avium subsp. paratuberculosis
ucgcgucaaccaccg

SEQ ID NO: 876704 - RNA, 16 nt, Mycobacterium avium subsp. paratuberculosis
ucgcgucaaccaccgg

SEQ ID NO: 876705 - RNA, 17 nt, Mycobacterium avium subsp. paratuberculosis
ucgcgucaaccaccggc

SEQ ID NO: 876706 - RNA, 22 nt, Mycobacterium avium subsp. paratuberculosis
ucgcggugggcucggcgccgac

SEQ ID NO: 876707 - RNA, 18 nt, Mycobacterium avium subsp. paratuberculosis
ucgcggugggcucgucga

SEQ ID NO: 876708 - RNA, 16 nt, Mycobacterium avium subsp. paratuberculosis
ucgcggugugcggcag

SEQ ID NO: 876709 - RNA, 20 nt, Mycobacterium avium subsp. paratuberculosis
ucgcggugugcggcagcucg

SEQ ID NO: 876710 - RNA, 18 nt, Mycobacterium avium subsp. paratuberculosis
ucgcggugcgcgcgcgcu

SEQ ID NO: 876711 - RNA, 17 nt, Mycobacterium avium subsp. paratuberculosis
ucgcgguggagcacagc

SEQ ID NO: 876712 - RNA, 17 nt, Mycobacterium avium subsp. paratuberculosis
ucgcggugacgcgccgg

SEQ ID NO: 876713 - RNA, 21 nt, Mycobacterium avium subsp. paratuberculosis
ucgcgguggcgaacugcacca

SEQ ID NO: 876714 - RNA, 15 nt, Mycobacterium avium subsp. paratuberculosis
ucgcggugcccagcc

SEQ ID NO: 876715 - RNA, 17 nt, Mycobacterium avium subsp. paratuberculosis
ucgcggugcccagccgc

SEQ ID NO: 876716 - RNA, 18 nt, Mycobacterium avium subsp. paratuberculosis
ucgcggugcccagccgca

SEQ ID NO: 876717 - RNA, 19 nt, Mycobacterium avium subsp. paratuberculosis
ucgcggugaaguugccgcc

SEQ ID NO: 876718 - RNA, 20 nt, Mycobacterium avium subsp. paratuberculosis
ucgcggugaaguugccgccg

SEQ ID NO: 876719 - RNA, 22 nt, Mycobacterium avium subsp. paratuberculosis
ucgcggugaaguugccgccgcc

SEQ ID NO: 876720 - RNA, 21 nt, Mycobacterium avium subsp. paratuberculosis
ucgcggucccaggugcugggc

SEQ ID NO: 876721 - RNA, 18 nt, Mycobacterium avium subsp. paratuberculosis
ucgcggucggcaacccga

SEQ ID NO: 876722 - RNA, 18 nt, Mycobacterium avium subsp. paratuberculosis
ucgcggucggcgcccggc

SEQ ID NO: 876723 - RNA, 13 nt, Mycobacterium avium subsp. paratuberculosis
ucgcguccgagca

SEQ ID NO: 876724 - RNA, 14 nt, Mycobacterium avium subsp. paratuberculosis
ucgcguccgcgauc

SEQ ID NO: 876725 - RNA, 20 nt, Mycobacterium avium subsp. paratuberculosis
ucgcguccagcaugcccacg

SEQ ID NO: 876726 - RNA, 20 nt, Mycobacterium avium subsp. paratuberculosis
ucgcguccccgcgccgggca

SEQ ID NO: 876727 - RNA, 21 nt, Mycobacterium avium subsp. paratuberculosis
ucgcguccccgcgccgggcaa

SEQ ID NO: 876728 - RNA, 22 nt, Mycobacterium avium subsp. paratuberculosis
ucgcguccccgcgccgggcaau

SEQ ID NO: 876729 - RNA, 18 nt, Mycobacterium avium subsp. paratuberculosis
ucgcgucccuggcgauga

SEQ ID NO: 876730 - RNA, 14 nt, Mycobacterium avium subsp. paratuberculosis
ucgcgucgacgucg

SEQ ID NO: 876731 - RNA, 21 nt, Mycobacterium avium subsp. paratuberculosis
ucgcgucgaaugcgcucaucg

SEQ ID NO: 876732 - RNA, 15 nt, Mycobacterium avium subsp. paratuberculosis
ucgcgucgacggcgc

SEQ ID NO: 876733 - RNA, 17 nt, Mycobacterium avium subsp. paratuberculosis
ucgcgucgacggcgccg

SEQ ID NO: 876734 - RNA, 18 nt, Mycobacterium avium subsp. paratuberculosis
ucgcgucgacggcgccgg

SEQ ID NO: 876735 - RNA, 17 nt, Mycobacterium avium subsp. paratuberculosis
ucgcgucgaugccggcg

SEQ ID NO: 876736 - RNA, 13 nt, Mycobacterium avium subsp. paratuberculosis
ucgcgucgguguc

SEQ ID NO: 876737 - RNA, 16 nt, Mycobacterium avium subsp. paratuberculosis
ucgcgucggugucgcc

SEQ ID NO: 876738 - RNA, 16 nt, Mycobacterium avium subsp. paratuberculosis
ucgcgucgucggcggg

SEQ ID NO: 876739 - RNA, 18 nt, Mycobacterium avium subsp. paratuberculosis
ucgcgucgugcggccggc

SEQ ID NO: 876740 - RNA, 16 nt, Mycobacterium avium subsp. paratuberculosis
ucgcgugcgucacgcu

SEQ ID NO: 876741 - RNA, 23 nt, Mycobacterium avium subsp. paratuberculosis
ucgcgugcgucacgcuggugacg

SEQ ID NO: 876742 - RNA, 19 nt, Mycobacterium avium subsp. paratuberculosis
ucgcuugccagccgggccg

SEQ ID NO: 876743 - RNA, 20 nt, Mycobacterium avium subsp. paratuberculosis
ucgcuugccagccgggccga

SEQ ID NO: 876744 - RNA, 18 nt, Mycobacterium avium subsp. paratuberculosis
ucgcuugcgccgcagcgg

SEQ ID NO: 876745 - RNA, 20 nt, Mycobacterium avium subsp. paratuberculosis
ucgcuucggccagcgcgucg

SEQ ID NO: 876746 - RNA, 15 nt, Mycobacterium avium subsp. paratuberculosis
ucgcuguuggcgacg

SEQ ID NO: 876747 - RNA, 23 nt, Mycobacterium avium subsp. paratuberculosis
ucgcuguuggcgacggugcaugc

SEQ ID NO: 876748 - RNA, 13 nt, Mycobacterium avium subsp. paratuberculosis
ucgcugucggcga

SEQ ID NO: 876749 - RNA, 16 nt, Mycobacterium avium subsp. paratuberculosis
ucgcuguaggccagcc

SEQ ID NO: 876750 - RNA, 20 nt, Mycobacterium avium subsp. paratuberculosis
ucgcuguaggccagcccggc

SEQ ID NO: 876751 - RNA, 13 nt, Mycobacterium avium subsp. paratuberculosis
ucgcuguccucga

SEQ ID NO: 876752 - RNA, 15 nt, Mycobacterium avium subsp. paratuberculosis
ucggauucggguggc

SEQ ID NO: 876753 - RNA, 20 nt, Mycobacterium avium subsp. paratuberculosis
ucggauuugguugcggcacc

SEQ ID NO: 876754 - RNA, 21 nt, Mycobacterium avium subsp. paratuberculosis
ucggauuugguugcggcaccg

SEQ ID NO: 876755 - RNA, 22 nt, Mycobacterium avium subsp. paratuberculosis
ucggauggugcccaccgggcag

SEQ ID NO: 876756 - RNA, 22 nt, Mycobacterium avium subsp. paratuberculosis
ucggaguugcgcagccgggcgg

SEQ ID NO: 876757 - RNA, 15 nt, Mycobacterium avium subsp. paratuberculosis
ucggaaucggcgccg

SEQ ID NO: 876758 - RNA, 13 nt, Mycobacterium avium subsp. paratuberculosis
ucggcaacccgac

SEQ ID NO: 876759 - RNA, 21 nt, Mycobacterium avium subsp. paratuberculosis
ucggcaacccgaccucgucga

SEQ ID NO: 876760 - RNA, 23 nt, Mycobacterium avium subsp. paratuberculosis
ucggcaacccgaccucgucgacg

SEQ ID NO: 876761 - RNA, 13 nt, Mycobacterium avium subsp. paratuberculosis
ucggcaacgccgg

SEQ ID NO: 876762 - RNA, 15 nt, Mycobacterium avium subsp. paratuberculosis
ucggcaccagcggca

SEQ ID NO: 876763 - RNA, 17 nt, Mycobacterium avium subsp. paratuberculosis
ucggcaaugaccggcac

SEQ ID NO: 876764 - RNA, 18 nt, Mycobacterium avium subsp. paratuberculosis
ucggcaaugaccggcacc

SEQ ID NO: 876765 - RNA, 21 nt, Mycobacterium avium subsp. paratuberculosis
ucggcacaccagguaggcggu

SEQ ID NO: 876766 - RNA, 15 nt, Mycobacterium avium subsp. paratuberculosis
ucggcagcgccaaca

SEQ ID NO: 876767 - RNA, 15 nt, Mycobacterium avium subsp. paratuberculosis
ucggcacccgcaaca

SEQ ID NO: 876768 - RNA, 17 nt, Mycobacterium avium subsp. paratuberculosis
ucggcagcccggaggcg

SEQ ID NO: 876769 - RNA, 21 nt, Mycobacterium avium subsp. paratuberculosis
ucggcagcccggaggcgaugc

SEQ ID NO: 876770 - RNA, 21 nt, Mycobacterium avium subsp. paratuberculosis
ucggcaggauccggacgaccu

SEQ ID NO: 876771 - RNA, 22 nt, Mycobacterium avium subsp. paratuberculosis
ucggcaggauccggacgaccug

SEQ ID NO: 876772 - RNA, 21 nt, Mycobacterium avium subsp. paratuberculosis
ucggcaggauccggucgauca

SEQ ID NO: 876773 - RNA, 15 nt, Mycobacterium avium subsp. paratuberculosis
ucggcagcgacgcgg

SEQ ID NO: 876774 - RNA, 17 nt, Mycobacterium avium subsp. paratuberculosis
ucggcaguccgcgccgg

SEQ ID NO: 876775 - RNA, 14 nt, Mycobacterium avium subsp. paratuberculosis
ucggcaggucgucg

SEQ ID NO: 876776 - RNA, 18 nt, Mycobacterium avium subsp. paratuberculosis
ucggcaggucgucgacgu

SEQ ID NO: 876777 - RNA, 19 nt, Mycobacterium avium subsp. paratuberculosis
ucggcaggucgucgacguc

SEQ ID NO: 876778 - RNA, 19 nt, Mycobacterium avium subsp. paratuberculosis
ucggccaccaccucgcggg

SEQ ID NO: 876779 - RNA, 22 nt, Mycobacterium avium subsp. paratuberculosis
ucggccaccagcgcccgcccgg

SEQ ID NO: 876780 - RNA, 21 nt, Mycobacterium avium subsp. paratuberculosis
ucggccaccaugucggcgucg

SEQ ID NO: 876781 - RNA, 13 nt, Mycobacterium avium subsp. paratuberculosis
ucggccaccgacu

SEQ ID NO: 876782 - RNA, 18 nt, Mycobacterium avium subsp. paratuberculosis
ucggccaccgacugcgac

SEQ ID NO: 876783 - RNA, 19 nt, Mycobacterium avium subsp. paratuberculosis
ucggccaccgcgcggcggu

SEQ ID NO: 876784 - RNA, 14 nt, Mycobacterium avium subsp. paratuberculosis
ucggccaccgcggu

SEQ ID NO: 876785 - RNA, 16 nt, Mycobacterium avium subsp. paratuberculosis
ucggccaaccgggcag

SEQ ID NO: 876786 - RNA, 19 nt, Mycobacterium avium subsp. paratuberculosis
ucggcggcgcaggcgcgca

SEQ ID NO: 876787 - RNA, 22 nt, Mycobacterium avium subsp. paratuberculosis
ucggcggcgcaggcgcgcacca

SEQ ID NO: 876788 - RNA, 24 nt, Mycobacterium avium subsp. paratuberculosis
ucggcggcgaggacgucgucgacg

SEQ ID NO: 876789 - RNA, 23 nt, Mycobacterium avium subsp. paratuberculosis
ucggcggcgauccggccggcggc

SEQ ID NO: 876790 - RNA, 14 nt, Mycobacterium avium subsp. paratuberculosis
ucggcggcgacggc

SEQ ID NO: 876791 - RNA, 17 nt, Mycobacterium avium subsp. paratuberculosis
ucggcggcgacggcgac

SEQ ID NO: 876792 - RNA, 14 nt, Mycobacterium avium subsp. paratuberculosis
ucggcggcgacgug

SEQ ID NO: 876793 - RNA, 19 nt, Mycobacterium avium subsp. paratuberculosis
ucggcggacuggcugagca

SEQ ID NO: 876794 - RNA, 21 nt, Mycobacterium avium subsp. paratuberculosis
ucggcggaggucauggcgacc

SEQ ID NO: 876795 - RNA, 23 nt, Mycobacterium avium subsp. paratuberculosis
ucggcggcaaagcguugccgcgc

SEQ ID NO: 876796 - RNA, 23 nt, Mycobacterium avium subsp. paratuberculosis
ucggcggcgcgcaggcgcgcggc

SEQ ID NO: 876797 - RNA, 19 nt, Mycobacterium avium subsp. paratuberculosis
ucggcggcgcgcugcaggc

SEQ ID NO: 876798 - RNA, 12 nt, Mycobacterium avium subsp. paratuberculosis
ucggcggcggcg

SEQ ID NO: 876799 - RNA, 17 nt, Mycobacterium avium subsp. paratuberculosis
ucggcggcggcggccgc

SEQ ID NO: 876800 - RNA, 19 nt, Mycobacterium avium subsp. paratuberculosis
ucggcggcggcggccgcgu

SEQ ID NO: 876801 - RNA, 20 nt, Mycobacterium avium subsp. paratuberculosis
ucggcggcggcggccgcguc

SEQ ID NO: 876802 - RNA, 14 nt, Mycobacterium avium subsp. paratuberculosis
ucggcggcgcgcag

SEQ ID NO: 876803 - RNA, 21 nt, Mycobacterium avium subsp. paratuberculosis
ucggcggccaccagccggccg

SEQ ID NO: 876804 - RNA, 14 nt, Mycobacterium avium subsp. paratuberculosis
ucggcggcgggcag

SEQ ID NO: 876805 - RNA, 23 nt, Mycobacterium avium subsp. paratuberculosis
ucggcggcggggugggcugcauc

SEQ ID NO: 876806 - RNA, 18 nt, Mycobacterium avium subsp. paratuberculosis
ucggcggaacggucgggg

SEQ ID NO: 876807 - RNA, 21 nt, Mycobacterium avium subsp. paratuberculosis
ucggcggaacggucggggcgg

SEQ ID NO: 876808 - RNA, 15 nt, Mycobacterium avium subsp. paratuberculosis
ucggcgcugucggcg

SEQ ID NO: 876809 - RNA, 17 nt, Mycobacterium avium subsp. paratuberculosis
ucggcgcugucggcggg

SEQ ID NO: 876810 - RNA, 14 nt, Mycobacterium avium subsp. paratuberculosis
ucggcgccgcgccg

SEQ ID NO: 876811 - RNA, 15 nt, Mycobacterium avium subsp. paratuberculosis
ucggcgccgcgccgg

SEQ ID NO: 876812 - RNA, 16 nt, Mycobacterium avium subsp. paratuberculosis
ucggcgccgcgccggc

SEQ ID NO: 876813 - RNA, 21 nt, Mycobacterium avium subsp. paratuberculosis
ucggcgcugcccgccgcggug

SEQ ID NO: 876814 - RNA, 16 nt, Mycobacterium avium subsp. paratuberculosis
ucggcgcuggccagcg

SEQ ID NO: 876815 - RNA, 17 nt, Mycobacterium avium subsp. paratuberculosis
ucggcgcuggccagcgc

SEQ ID NO: 876816 - RNA, 19 nt, Mycobacterium avium subsp. paratuberculosis
ucggcgccgagcgucacgc

SEQ ID NO: 876817 - RNA, 20 nt, Mycobacterium avium subsp. paratuberculosis
ucggcgccgagcgucacgcu

SEQ ID NO: 876818 - RNA, 12 nt, Mycobacterium avium subsp. paratuberculosis
ucggcgccgauc

SEQ ID NO: 876819 - RNA, 11 nt, Mycobacterium avium subsp. paratuberculosis
ucggcgccgcc

SEQ ID NO: 876820 - RNA, 19 nt, Mycobacterium avium subsp. paratuberculosis
ucggcgccgccgagccgcg

SEQ ID NO: 876821 - RNA, 15 nt, Mycobacterium avium subsp. paratuberculosis
ucggcgccgcgaccc

SEQ ID NO: 876822 - RNA, 17 nt, Mycobacterium avium subsp. paratuberculosis
ucggcgccgcgaccccg

SEQ ID NO: 876823 - RNA, 12 nt, Mycobacterium avium subsp. paratuberculosis
ucggcgccgcgc

SEQ ID NO: 876824 - RNA, 18 nt, Mycobacterium avium subsp. paratuberculosis
ucggcgcccucgccgacc

SEQ ID NO: 876825 - RNA, 19 nt, Mycobacterium avium subsp. paratuberculosis
ucggcgcccucgccgaccu

SEQ ID NO: 876826 - RNA, 14 nt, Mycobacterium avium subsp. paratuberculosis
ucggcgcccucggc

SEQ ID NO: 876827 - RNA, 18 nt, Mycobacterium avium subsp. paratuberculosis
ucggcgcccucggcgauc

SEQ ID NO: 876828 - RNA, 14 nt, Mycobacterium avium subsp. paratuberculosis
ucggcgcccggcac

SEQ ID NO: 876829 - RNA, 15 nt, Mycobacterium avium subsp. paratuberculosis
ucggcgcccggcacc

SEQ ID NO: 876830 - RNA, 18 nt, Mycobacterium avium subsp. paratuberculosis
ucggcgcccggcccagcc

SEQ ID NO: 876831 - RNA, 15 nt, Mycobacterium avium subsp. paratuberculosis
ucggcgccgaccucg

SEQ ID NO: 876832 - RNA, 17 nt, Mycobacterium avium subsp. paratuberculosis
ucggcgccgaccucggc

SEQ ID NO: 876833 - RNA, 18 nt, Mycobacterium avium subsp. paratuberculosis
ucggcgccgaccucggcc

SEQ ID NO: 876834 - RNA, 19 nt, Mycobacterium avium subsp. paratuberculosis
ucggcgccgaccucggcca

SEQ ID NO: 876835 - RNA, 20 nt, Mycobacterium avium subsp. paratuberculosis
ucggcgccgaccucggccag

SEQ ID NO: 876836 - RNA, 22 nt, Mycobacterium avium subsp. paratuberculosis
ucggcgccgaccucggccagcg

SEQ ID NO: 876837 - RNA, 19 nt, Mycobacterium avium subsp. paratuberculosis
ucggcgccgacggccagca

SEQ ID NO: 876838 - RNA, 22 nt, Mycobacterium avium subsp. paratuberculosis
ucggcggcguauucccggggga

SEQ ID NO: 876839 - RNA, 13 nt, Mycobacterium avium subsp. paratuberculosis
ucggcggcgucgu

SEQ ID NO: 876840 - RNA, 18 nt, Mycobacterium avium subsp. paratuberculosis
ucggcggcugaaccaccg

SEQ ID NO: 876841 - RNA, 19 nt, Mycobacterium avium subsp. paratuberculosis
ucggcgggacccgcgaccc

SEQ ID NO: 876842 - RNA, 14 nt, Mycobacterium avium subsp. paratuberculosis
ucggcgggcgggcg

SEQ ID NO: 876843 - RNA, 16 nt, Mycobacterium avium subsp. paratuberculosis
ucggcgggagccggcg

SEQ ID NO: 876844 - RNA, 22 nt, Mycobacterium avium subsp. paratuberculosis
ucggcgggaucggaccgcacca

SEQ ID NO: 876845 - RNA, 21 nt, Mycobacterium avium subsp. paratuberculosis
ucggcgggauggguggucacc

SEQ ID NO: 876846 - RNA, 20 nt, Mycobacterium avium subsp. paratuberculosis
ucggcgggauguggcaucac

SEQ ID NO: 876847 - RNA, 17 nt, Mycobacterium avium subsp. paratuberculosis
ucggcgggcaccucggc

SEQ ID NO: 876848 - RNA, 19 nt, Mycobacterium avium subsp. paratuberculosis
ucggcgggcaccucggcca

SEQ ID NO: 876849 - RNA, 20 nt, Mycobacterium avium subsp. paratuberculosis
ucggcgggcaccucggccag

SEQ ID NO: 876850 - RNA, 17 nt, Mycobacterium avium subsp. paratuberculosis
ucggcgggccgcccggc

SEQ ID NO: 876851 - RNA, 23 nt, Mycobacterium avium subsp. paratuberculosis
ucggcgggccuucuucucgacgu

SEQ ID NO: 876852 - RNA, 22 nt, Mycobacterium avium subsp. paratuberculosis
ucggcggguugcugagccgccg

SEQ ID NO: 876853 - RNA, 22 nt, Mycobacterium avium subsp. paratuberculosis
ucggcggucaacacgaagccgg

SEQ ID NO: 876854 - RNA, 16 nt, Mycobacterium avium subsp. paratuberculosis
ucggcgggucguagcc

SEQ ID NO: 876855 - RNA, 20 nt, Mycobacterium avium subsp. paratuberculosis
ucggcgggucguagccgucg

SEQ ID NO: 876856 - RNA, 12 nt, Mycobacterium avium subsp. paratuberculosis
ucggcgggugcg

SEQ ID NO: 876857 - RNA, 19 nt, Mycobacterium avium subsp. paratuberculosis
ucggcgggugcgggcgcug

SEQ ID NO: 876858 - RNA, 21 nt, Mycobacterium avium subsp. paratuberculosis
ucggcggggaaggugcgggcg

SEQ ID NO: 876859 - RNA, 23 nt, Mycobacterium avium subsp. paratuberculosis
ucggcggggggagaggcgcggcg

SEQ ID NO: 876860 - RNA, 23 nt, Mycobacterium avium subsp. paratuberculosis
ucggcggguagaaccagcccggc

SEQ ID NO: 876861 - RNA, 18 nt, Mycobacterium avium subsp. paratuberculosis
ucggcggguaugucggcg

SEQ ID NO: 876862 - RNA, 14 nt, Mycobacterium avium subsp. paratuberculosis
ucggcgucgacgac

SEQ ID NO: 876863 - RNA, 21 nt, Mycobacterium avium subsp. paratuberculosis
ucggcgucgacgacggcgccg

SEQ ID NO: 876864 - RNA, 19 nt, Mycobacterium avium subsp. paratuberculosis
ucggcgucgaugucgucgu

SEQ ID NO: 876865 - RNA, 18 nt, Mycobacterium avium subsp. paratuberculosis
ucggcguccuugcccgag

SEQ ID NO: 876866 - RNA, 14 nt, Mycobacterium avium subsp. paratuberculosis
ucggcgucgaacgg

SEQ ID NO: 876867 - RNA, 18 nt, Mycobacterium avium subsp. paratuberculosis
ucggcguacaggccgucg

SEQ ID NO: 876868 - RNA, 22 nt, Mycobacterium avium subsp. paratuberculosis
ucggcguagggcagcccgagca

SEQ ID NO: 876869 - RNA, 23 nt, Mycobacterium avium subsp. paratuberculosis
ucggcguccaugcucuugcgggc

SEQ ID NO: 876870 - RNA, 16 nt, Mycobacterium avium subsp. paratuberculosis
ucggcgucccgcgcca

SEQ ID NO: 876871 - RNA, 15 nt, Mycobacterium avium subsp. paratuberculosis
ucggcguccgugccg

SEQ ID NO: 876872 - RNA, 18 nt, Mycobacterium avium subsp. paratuberculosis
ucggcguccucgacgccg

SEQ ID NO: 876873 - RNA, 21 nt, Mycobacterium avium subsp. paratuberculosis
ucggcgucaccaggcugcucg

SEQ ID NO: 876874 - RNA, 21 nt, Mycobacterium avium subsp. paratuberculosis
ucggcgucaccccaccgagca

SEQ ID NO: 876875 - RNA, 22 nt, Mycobacterium avium subsp. paratuberculosis
ucggcgucacucuggcgugacg

SEQ ID NO: 876876 - RNA, 14 nt, Mycobacterium avium subsp. paratuberculosis
ucggcgucacugcc

SEQ ID NO: 876877 - RNA, 19 nt, Mycobacterium avium subsp. paratuberculosis
ucggcguacugcgcgacca

SEQ ID NO: 876878 - RNA, 16 nt, Mycobacterium avium subsp. paratuberculosis
ucggcguagaggugca

SEQ ID NO: 876879 - RNA, 23 nt, Mycobacterium avium subsp. paratuberculosis
ucggcgguuucggugccggccca

SEQ ID NO: 876880 - RNA, 23 nt, Mycobacterium avium subsp. paratuberculosis
ucggcggugccguccucggccgc

SEQ ID NO: 876881 - RNA, 22 nt, Mycobacterium avium subsp. paratuberculosis
ucggcgguucggaguccaccgg

SEQ ID NO: 876882 - RNA, 17 nt, Mycobacterium avium subsp. paratuberculosis
ucggcggugguccgcgc

SEQ ID NO: 876883 - RNA, 21 nt, Mycobacterium avium subsp. paratuberculosis
ucggcgguucgauaccguccg

SEQ ID NO: 876884 - RNA, 16 nt, Mycobacterium avium subsp. paratuberculosis
ucggcggucccgugcg

SEQ ID NO: 876885 - RNA, 21 nt, Mycobacterium avium subsp. paratuberculosis
ucggcggucccgugcgccgcc

SEQ ID NO: 876886 - RNA, 17 nt, Mycobacterium avium subsp. paratuberculosis
ucggcgguccgccgcag

SEQ ID NO: 876887 - RNA, 15 nt, Mycobacterium avium subsp. paratuberculosis
ucggcggucgcggug

SEQ ID NO: 876888 - RNA, 19 nt, Mycobacterium avium subsp. paratuberculosis
ucggcggucgcggugccca

SEQ ID NO: 876889 - RNA, 15 nt, Mycobacterium avium subsp. paratuberculosis
ucggcggucugagcc

SEQ ID NO: 876890 - RNA, 17 nt, Mycobacterium avium subsp. paratuberculosis
ucggcggucugucgcgc

SEQ ID NO: 876891 - RNA, 23 nt, Mycobacterium avium subsp. paratuberculosis
ucggcggucuuugccaucccggu

SEQ ID NO: 876892 - RNA, 13 nt, Mycobacterium avium subsp. paratuberculosis
ucggcggucgcgg

SEQ ID NO: 876893 - RNA, 21 nt, Mycobacterium avium subsp. paratuberculosis
ucggcggugaugcgcgccgac

SEQ ID NO: 876894 - RNA, 18 nt, Mycobacterium avium subsp. paratuberculosis
ucggccgcgacgaccgcc

SEQ ID NO: 876895 - RNA, 18 nt, Mycobacterium avium subsp. paratuberculosis
ucggccgcucagcgggcg

SEQ ID NO: 876896 - RNA, 14 nt, Mycobacterium avium subsp. paratuberculosis
ucggccgcucgggu

SEQ ID NO: 876897 - RNA, 23 nt, Mycobacterium avium subsp. paratuberculosis
ucggccgcugcccgggcaucccg

SEQ ID NO: 876898 - RNA, 15 nt, Mycobacterium avium subsp. paratuberculosis
ucggccgcgucgggc

SEQ ID NO: 876899 - RNA, 15 nt, Mycobacterium avium subsp. paratuberculosis
ucggccggauucucg

SEQ ID NO: 876900 - RNA, 21 nt, Mycobacterium avium subsp. paratuberculosis
ucggccggauucucgcccggc

SEQ ID NO: 876901 - RNA, 20 nt, Mycobacterium avium subsp. paratuberculosis
ucggccgcgcgugcccgcgg

SEQ ID NO: 876902 - RNA, 23 nt, Mycobacterium avium subsp. paratuberculosis
ucggccgcggauggugacggccg

SEQ ID NO: 876903 - RNA, 15 nt, Mycobacterium avium subsp. paratuberculosis
ucggccgcggccggc

SEQ ID NO: 876904 - RNA, 16 nt, Mycobacterium avium subsp. paratuberculosis
ucggccgcggccggcg

SEQ ID NO: 876905 - RNA, 18 nt, Mycobacterium avium subsp. paratuberculosis
ucggccgcggccggcggc

SEQ ID NO: 876906 - RNA, 20 nt, Mycobacterium avium subsp. paratuberculosis
ucggccgcggccggcggcag

SEQ ID NO: 876907 - RNA, 20 nt, Mycobacterium avium subsp. paratuberculosis
ucggccgcggucucgaccga

SEQ ID NO: 876908 - RNA, 15 nt, Mycobacterium avium subsp. paratuberculosis
ucggccgccgugcug

SEQ ID NO: 876909 - RNA, 22 nt, Mycobacterium avium subsp. paratuberculosis
ucggccgcccguccgggccggc

SEQ ID NO: 876910 - RNA, 14 nt, Mycobacterium avium subsp. paratuberculosis
ucggccgccgacac

SEQ ID NO: 876911 - RNA, 17 nt, Mycobacterium avium subsp. paratuberculosis
ucggccgccgacaccac

SEQ ID NO: 876912 - RNA, 18 nt, Mycobacterium avium subsp. paratuberculosis
ucggccgccgacugugcg

SEQ ID NO: 876913 - RNA, 23 nt, Mycobacterium avium subsp. paratuberculosis
ucggccuccuccucgcugccggc

SEQ ID NO: 876914 - RNA, 16 nt, Mycobacterium avium subsp. paratuberculosis
ucggccguggccguca

SEQ ID NO: 876915 - RNA, 17 nt, Mycobacterium avium subsp. paratuberculosis
ucggccguggccgucac

SEQ ID NO: 876916 - RNA, 16 nt, Mycobacterium avium subsp. paratuberculosis
ucggccucaggcgucg

SEQ ID NO: 876917 - RNA, 18 nt, Mycobacterium avium subsp. paratuberculosis
ucggccucaggcgucggu

SEQ ID NO: 876918 - RNA, 14 nt, Mycobacterium avium subsp. paratuberculosis
ucggccgucggcgc

SEQ ID NO: 876919 - RNA, 19 nt, Mycobacterium avium subsp. paratuberculosis
ucggccgucggcgccgccg

SEQ ID NO: 876920 - RNA, 18 nt, Mycobacterium avium subsp. paratuberculosis
ucggccgguccgugcacg

SEQ ID NO: 876921 - RNA, 20 nt, Mycobacterium avium subsp. paratuberculosis
ucggccgguccgugcacggc

SEQ ID NO: 876922 - RNA, 18 nt, Mycobacterium avium subsp. paratuberculosis
ucggccguaccggcguac

SEQ ID NO: 876923 - RNA, 23 nt, Mycobacterium avium subsp. paratuberculosis
ucggccgggcugcccaccaccag

SEQ ID NO: 876924 - RNA, 16 nt, Mycobacterium avium subsp. paratuberculosis
ucggccggcucgaccu

SEQ ID NO: 876925 - RNA, 18 nt, Mycobacterium avium subsp. paratuberculosis
ucggccgggaaacccucg

SEQ ID NO: 876926 - RNA, 19 nt, Mycobacterium avium subsp. paratuberculosis
ucggccgggccggcgguga

SEQ ID NO: 876927 - RNA, 13 nt, Mycobacterium avium subsp. paratuberculosis
ucggccggcgggg

SEQ ID NO: 876928 - RNA, 14 nt, Mycobacterium avium subsp. paratuberculosis
ucggccggccccgc

SEQ ID NO: 876929 - RNA, 19 nt, Mycobacterium avium subsp. paratuberculosis
ucggccggccccgcccggc

SEQ ID NO: 876930 - RNA, 19 nt, Mycobacterium avium subsp. paratuberculosis
ucggccggcgaggugggca

SEQ ID NO: 876931 - RNA, 12 nt, Mycobacterium avium subsp. paratuberculosis
ucggccggcagc

SEQ ID NO: 876932 - RNA, 20 nt, Mycobacterium avium subsp. paratuberculosis
ucggccaguucgccggugac

SEQ ID NO: 876933 - RNA, 14 nt, Mycobacterium avium subsp. paratuberculosis
ucggccagggugac

SEQ ID NO: 876934 - RNA, 17 nt, Mycobacterium avium subsp. paratuberculosis
ucggccagggugacggu

SEQ ID NO: 876935 - RNA, 12 nt, Mycobacterium avium subsp. paratuberculosis
ucggccacgcuc

SEQ ID NO: 876936 - RNA, 15 nt, Mycobacterium avium subsp. paratuberculosis
ucggccagcggcagc

SEQ ID NO: 876937 - RNA, 18 nt, Mycobacterium avium subsp. paratuberculosis
ucggccaggcgcccagca

SEQ ID NO: 876938 - RNA, 23 nt, Mycobacterium avium subsp. paratuberculosis
ucggccaggaugaacacccgggu

SEQ ID NO: 876939 - RNA, 17 nt, Mycobacterium avium subsp. paratuberculosis
ucggccaggaaccaccg

SEQ ID NO: 876940 - RNA, 13 nt, Mycobacterium avium subsp. paratuberculosis
ucggccacguugc

SEQ ID NO: 876941 - RNA, 20 nt, Mycobacterium avium subsp. paratuberculosis
ucggccagcgcgucggccag

SEQ ID NO: 876942 - RNA, 14 nt, Mycobacterium avium subsp. paratuberculosis
ucggccagcgggcg

SEQ ID NO: 876943 - RNA, 16 nt, Mycobacterium avium subsp. paratuberculosis
ucggccagcgggcggc

SEQ ID NO: 876944 - RNA, 17 nt, Mycobacterium avium subsp. paratuberculosis
ucggccacgcucgccag

SEQ ID NO: 876945 - RNA, 16 nt, Mycobacterium avium subsp. paratuberculosis
ucggccacgacgcgcc

SEQ ID NO: 876946 - RNA, 15 nt, Mycobacterium avium subsp. paratuberculosis
ucggccacgacgcgg

SEQ ID NO: 876947 - RNA, 17 nt, Mycobacterium avium subsp. paratuberculosis
ucggccacgacgcggcg

SEQ ID NO: 876948 - RNA, 21 nt, Mycobacterium avium subsp. paratuberculosis
ucggccacgacgcggcgcgcg

SEQ ID NO: 876949 - RNA, 14 nt, Mycobacterium avium subsp. paratuberculosis
ucggccacgccggg

SEQ ID NO: 876950 - RNA, 17 nt, Mycobacterium avium subsp. paratuberculosis
ucggcgcccgcuccggc

SEQ ID NO: 876951 - RNA, 21 nt, Mycobacterium avium subsp. paratuberculosis
ucggcgagugaggccgaggcg

SEQ ID NO: 876952 - RNA, 12 nt, Mycobacterium avium subsp. paratuberculosis
ucggcgaggcgc

SEQ ID NO: 876953 - RNA, 15 nt, Mycobacterium avium subsp. paratuberculosis
ucggcgaggcgcucc

SEQ ID NO: 876954 - RNA, 19 nt, Mycobacterium avium subsp. paratuberculosis
ucggcgagguagaccgccg

SEQ ID NO: 876955 - RNA, 19 nt, Mycobacterium avium subsp. paratuberculosis
ucggcgaggucgucgaggg

SEQ ID NO: 876956 - RNA, 15 nt, Mycobacterium avium subsp. paratuberculosis
ucggcgagcugcggg

SEQ ID NO: 876957 - RNA, 17 nt, Mycobacterium avium subsp. paratuberculosis
ucggcgagcugcgggug

SEQ ID NO: 876958 - RNA, 16 nt, Mycobacterium avium subsp. paratuberculosis
ucggcgagcuuggcgg

SEQ ID NO: 876959 - RNA, 17 nt, Mycobacterium avium subsp. paratuberculosis
ucggcgagcuuggcggg

SEQ ID NO: 876960 - RNA, 21 nt, Mycobacterium avium subsp. paratuberculosis
ucggcgagccgggaccgugcg

SEQ ID NO: 876961 - RNA, 14 nt, Mycobacterium avium subsp. paratuberculosis
ucggcgagcgaggc

SEQ ID NO: 876962 - RNA, 13 nt, Mycobacterium avium subsp. paratuberculosis
ucggcgaccgcgc

SEQ ID NO: 876963 - RNA, 19 nt, Mycobacterium avium subsp. paratuberculosis
ucggcgaccgcccggggcg

SEQ ID NO: 876964 - RNA, 14 nt, Mycobacterium avium subsp. paratuberculosis
ucggcgagccgcuc

SEQ ID NO: 876965 - RNA, 13 nt, Mycobacterium avium subsp. paratuberculosis
ucggcgaccgccg

SEQ ID NO: 876966 - RNA, 14 nt, Mycobacterium avium subsp. paratuberculosis
ucggcgaccgccgg

SEQ ID NO: 876967 - RNA, 18 nt, Mycobacterium avium subsp. paratuberculosis
ucggcgaccagcgacggc

SEQ ID NO: 876968 - RNA, 17 nt, Mycobacterium avium subsp. paratuberculosis
ucggcgacccgcacgau

SEQ ID NO: 876969 - RNA, 17 nt, Mycobacterium avium subsp. paratuberculosis
ucggcgaaggcgcgcag

SEQ ID NO: 876970 - RNA, 19 nt, Mycobacterium avium subsp. paratuberculosis
ucggcgaaggugccccgcu

SEQ ID NO: 876971 - RNA, 20 nt, Mycobacterium avium subsp. paratuberculosis
ucggcgaagucaucaccggg

SEQ ID NO: 876972 - RNA, 21 nt, Mycobacterium avium subsp. paratuberculosis
ucggcgaacggccaguccagg

SEQ ID NO: 876973 - RNA, 22 nt, Mycobacterium avium subsp. paratuberculosis
ucggcgaacggccaguccaggc

SEQ ID NO: 876974 - RNA, 16 nt, Mycobacterium avium subsp. paratuberculosis
ucggcgacaacagcgc

SEQ ID NO: 876975 - RNA, 15 nt, Mycobacterium avium subsp. paratuberculosis
ucggcgaccaauugc

SEQ ID NO: 876976 - RNA, 20 nt, Mycobacterium avium subsp. paratuberculosis
ucggcgaccaauugcgagca

SEQ ID NO: 876977 - RNA, 16 nt, Mycobacterium avium subsp. paratuberculosis
ucggccugcgcccggc

SEQ ID NO: 876978 - RNA, 16 nt, Mycobacterium avium subsp. paratuberculosis
ucggccugcgcugcgg

SEQ ID NO: 876979 - RNA, 17 nt, Mycobacterium avium subsp. paratuberculosis
ucggccugcccgcgggu

SEQ ID NO: 876980 - RNA, 18 nt, Mycobacterium avium subsp. paratuberculosis
ucggccugcacgucggcg

SEQ ID NO: 876981 - RNA, 21 nt, Mycobacterium avium subsp. paratuberculosis
ucggccugcacgucggcgcgc

SEQ ID NO: 876982 - RNA, 16 nt, Mycobacterium avium subsp. paratuberculosis
ucggccucgucgacgu

SEQ ID NO: 876983 - RNA, 17 nt, Mycobacterium avium subsp. paratuberculosis
ucggccucgucgacguc

SEQ ID NO: 876984 - RNA, 21 nt, Mycobacterium avium subsp. paratuberculosis
ucggccucgucgacgucgggg

SEQ ID NO: 876985 - RNA, 21 nt, Mycobacterium avium subsp. paratuberculosis
ucggccucccgguaggcggcg

SEQ ID NO: 876986 - RNA, 15 nt, Mycobacterium avium subsp. paratuberculosis
ucggccucggcggcc

SEQ ID NO: 876987 - RNA, 14 nt, Mycobacterium avium subsp. paratuberculosis
ucggccucggcggu

SEQ ID NO: 876988 - RNA, 16 nt, Mycobacterium avium subsp. paratuberculosis
ucgcccacaccggaug

SEQ ID NO: 876989 - RNA, 13 nt, Mycobacterium avium subsp. paratuberculosis
ucgcccaccccgg

SEQ ID NO: 876990 - RNA, 13 nt, Mycobacterium avium subsp. paratuberculosis
ucgcccacccgca

SEQ ID NO: 876991 - RNA, 20 nt, Mycobacterium avium subsp. paratuberculosis
ucgcccacccgcacgcccgg

SEQ ID NO: 876992 - RNA, 15 nt, Mycobacterium avium subsp. paratuberculosis
ucgcccacccgccag

SEQ ID NO: 876993 - RNA, 20 nt, Mycobacterium avium subsp. paratuberculosis
ucgcccaccgacgcggcggc

SEQ ID NO: 876994 - RNA, 13 nt, Mycobacterium avium subsp. paratuberculosis
ucgcccaccacga

SEQ ID NO: 876995 - RNA, 13 nt, Mycobacterium avium subsp. paratuberculosis
ucgcccacgccgg

SEQ ID NO: 876996 - RNA, 17 nt, Mycobacterium avium subsp. paratuberculosis
ucgcccacgccgguggg

SEQ ID NO: 876997 - RNA, 23 nt, Mycobacterium avium subsp. paratuberculosis
ucgcccacgccgguggggucggu

SEQ ID NO: 876998 - RNA, 20 nt, Mycobacterium avium subsp. paratuberculosis
ucgcccaccuuggcgucgau

SEQ ID NO: 876999 - RNA, 14 nt, Mycobacterium avium subsp. paratuberculosis
ucgcccagcaccgc

SEQ ID NO: 877000 - RNA, 22 nt, Mycobacterium avium subsp. paratuberculosis
ucgcccagcaccgcgacgaucg

SEQ ID NO: 877001 - RNA, 14 nt, Mycobacterium avium subsp. paratuberculosis
ucgcccagcaccgu

SEQ ID NO: 877002 - RNA, 13 nt, Mycobacterium avium subsp. paratuberculosis
ucgcccagccggc

SEQ ID NO: 877003 - RNA, 20 nt, Mycobacterium avium subsp. paratuberculosis
ucgcccagcagcccggccag

SEQ ID NO: 877004 - RNA, 19 nt, Mycobacterium avium subsp. paratuberculosis
ucgcccaacaacucgacgu

SEQ ID NO: 877005 - RNA, 20 nt, Mycobacterium avium subsp. paratuberculosis
ucgcccaacaacucgacguu

SEQ ID NO: 877006 - RNA, 22 nt, Mycobacterium avium subsp. paratuberculosis
ucgcccaacaacucgacguucg

SEQ ID NO: 877007 - RNA, 16 nt, Mycobacterium avium subsp. paratuberculosis
ucgccaugcuggcacu

SEQ ID NO: 877008 - RNA, 14 nt, Mycobacterium avium subsp. paratuberculosis
ucgccaugccgucg

SEQ ID NO: 877009 - RNA, 15 nt, Mycobacterium avium subsp. paratuberculosis
ucgacgauggcgucc

SEQ ID NO: 877010 - RNA, 16 nt, Mycobacterium avium subsp. paratuberculosis
ucgacgaugucgacgc

SEQ ID NO: 877011 - RNA, 18 nt, Mycobacterium avium subsp. paratuberculosis
ucgacgauguuggcgacg

SEQ ID NO: 877012 - RNA, 19 nt, Mycobacterium avium subsp. paratuberculosis
ucgacgauguuggcgacga

SEQ ID NO: 877013 - RNA, 20 nt, Mycobacterium avium subsp. paratuberculosis
ucgacgccgacaucgcggcg

SEQ ID NO: 877014 - RNA, 23 nt, Mycobacterium avium subsp. paratuberculosis
ucgacgccgacaucgcggcgauc

SEQ ID NO: 877015 - RNA, 17 nt, Mycobacterium avium subsp. paratuberculosis
ucgacgccgaccgcggu

SEQ ID NO: 877016 - RNA, 18 nt, Mycobacterium avium subsp. paratuberculosis
ucgacgccgaccgcgguc

SEQ ID NO: 877017 - RNA, 22 nt, Mycobacterium avium subsp. paratuberculosis
ucgacgcccuuggcgcccagcg

SEQ ID NO: 877018 - RNA, 12 nt, Mycobacterium avium subsp. paratuberculosis
ucgacgccgaug

SEQ ID NO: 877019 - RNA, 19 nt, Mycobacterium avium subsp. paratuberculosis
ucgacgccgauggugaccu

SEQ ID NO: 877020 - RNA, 21 nt, Mycobacterium avium subsp. paratuberculosis
ucgacgccgauggugaccucg

SEQ ID NO: 877021 - RNA, 14 nt, Mycobacterium avium subsp. paratuberculosis
ucgacgccgggcag

SEQ ID NO: 877022 - RNA, 17 nt, Mycobacterium avium subsp. paratuberculosis
ucgacgccgggcagcgc

SEQ ID NO: 877023 - RNA, 16 nt, Mycobacterium avium subsp. paratuberculosis
ucgacgccgggcucgc

SEQ ID NO: 877024 - RNA, 22 nt, Mycobacterium avium subsp. paratuberculosis
ucgacgccggugaaaccggcgc

SEQ ID NO: 877025 - RNA, 14 nt, Mycobacterium avium subsp. paratuberculosis
ucgacgccgugcug

SEQ ID NO: 877026 - RNA, 18 nt, Mycobacterium avium subsp. paratuberculosis
ucgacgcgcacccgggac

SEQ ID NO: 877027 - RNA, 12 nt, Mycobacterium avium subsp. paratuberculosis
ucgacgccgcgg

SEQ ID NO: 877028 - RNA, 20 nt, Mycobacterium avium subsp. paratuberculosis
ucgcccggcgcccggccggc

SEQ ID NO: 877029 - RNA, 13 nt, Mycobacterium avium subsp. paratuberculosis
ucgcccggcgcgg

SEQ ID NO: 877030 - RNA, 14 nt, Mycobacterium avium subsp. paratuberculosis
ucgcccggcgcggc

SEQ ID NO: 877031 - RNA, 16 nt, Mycobacterium avium subsp. paratuberculosis
ucgcccggcgcggcau

SEQ ID NO: 877032 - RNA, 21 nt, Mycobacterium avium subsp. paratuberculosis
ucgcccugggggucggugacc

SEQ ID NO: 877033 - RNA, 12 nt, Mycobacterium avium subsp. paratuberculosis
ucgcccuggccg

SEQ ID NO: 877034 - RNA, 14 nt, Mycobacterium avium subsp. paratuberculosis
ucgcccuggccgcg

SEQ ID NO: 877035 - RNA, 22 nt, Mycobacterium avium subsp. paratuberculosis
ucgccgaaaugccgugccagcc

SEQ ID NO: 877036 - RNA, 14 nt, Mycobacterium avium subsp. paratuberculosis
ucgccgaacgugcg

SEQ ID NO: 877037 - RNA, 16 nt, Mycobacterium avium subsp. paratuberculosis
ucgccgaaccgggcgc

SEQ ID NO: 877038 - RNA, 20 nt, Mycobacterium avium subsp. paratuberculosis
ucgccgaaccgggcgcgcag

SEQ ID NO: 877039 - RNA, 15 nt, Mycobacterium avium subsp. paratuberculosis
ucgccgaaccggggc

SEQ ID NO: 877040 - RNA, 20 nt, Mycobacterium avium subsp. paratuberculosis
ucgccgaaccggggccgcac

SEQ ID NO: 877041 - RNA, 20 nt, Mycobacterium avium subsp. paratuberculosis
ucgccgaacgccaccaccuc

SEQ ID NO: 877042 - RNA, 18 nt, Mycobacterium avium subsp. paratuberculosis
ucgccgaacgccucgauc

SEQ ID NO: 877043 - RNA, 15 nt, Mycobacterium avium subsp. paratuberculosis
ucgcccgcgugggca

SEQ ID NO: 877044 - RNA, 17 nt, Mycobacterium avium subsp. paratuberculosis
ucgcccgcguugcggcg

SEQ ID NO: 877045 - RNA, 18 nt, Mycobacterium avium subsp. paratuberculosis
ucgcccgcguugcggcgc

SEQ ID NO: 877046 - RNA, 20 nt, Mycobacterium avium subsp. paratuberculosis
ucgcccgcguugcggcgcag

SEQ ID NO: 877047 - RNA, 23 nt, Mycobacterium avium subsp. paratuberculosis
ucgcccgcguugcggcgcagcgu

SEQ ID NO: 877048 - RNA, 15 nt, Mycobacterium avium subsp. paratuberculosis
ucgcccgcuccgcgg

SEQ ID NO: 877049 - RNA, 19 nt, Mycobacterium avium subsp. paratuberculosis
ucgcccgcuccgcgggcag

SEQ ID NO: 877050 - RNA, 18 nt, Mycobacterium avium subsp. paratuberculosis
ucgcccgcuccgcggugc

SEQ ID NO: 877051 - RNA, 22 nt, Mycobacterium avium subsp. paratuberculosis
ucgcccgcgacugucggcucgc

SEQ ID NO: 877052 - RNA, 15 nt, Mycobacterium avium subsp. paratuberculosis
ucgcccgccgacggc

SEQ ID NO: 877053 - RNA, 14 nt, Mycobacterium avium subsp. paratuberculosis
ucgcccgccgcgag

SEQ ID NO: 877054 - RNA, 21 nt, Mycobacterium avium subsp. paratuberculosis
ucgcccgccgcgagccgccca

SEQ ID NO: 877055 - RNA, 17 nt, Mycobacterium avium subsp. paratuberculosis
ucgcccgcagcacgccc

SEQ ID NO: 877056 - RNA, 20 nt, Mycobacterium avium subsp. paratuberculosis
ucgcccgcagcacgcccgua

SEQ ID NO: 877057 - RNA, 13 nt, Mycobacterium avium subsp. paratuberculosis
ucgcccagcggca

SEQ ID NO: 877058 - RNA, 22 nt, Mycobacterium avium subsp. paratuberculosis
ucgcccagcgcagcgccucggc

SEQ ID NO: 877059 - RNA, 16 nt, Mycobacterium avium subsp. paratuberculosis
ucgcccagcgcggcgg

SEQ ID NO: 877060 - RNA, 22 nt, Mycobacterium avium subsp. paratuberculosis
ucgccggaauggcaaggccagc

SEQ ID NO: 877061 - RNA, 23 nt, Mycobacterium avium subsp. paratuberculosis
ucgccggaauggcaaggccagca

SEQ ID NO: 877062 - RNA, 21 nt, Mycobacterium avium subsp. paratuberculosis
ucgccgcuugcagcuuggcgg

SEQ ID NO: 877063 - RNA, 20 nt, Mycobacterium avium subsp. paratuberculosis
ucgccggacagccggggcag

SEQ ID NO: 877064 - RNA, 21 nt, Mycobacterium avium subsp. paratuberculosis
ucgccggacagcgggccgacc

SEQ ID NO: 877065 - RNA, 23 nt, Mycobacterium avium subsp. paratuberculosis
ucgccggacagcgggccgacccg

SEQ ID NO: 877066 - RNA, 20 nt, Mycobacterium avium subsp. paratuberculosis
ucgccggaggcgaucaggug

SEQ ID NO: 877067 - RNA, 13 nt, Mycobacterium avium subsp. paratuberculosis
ucgccggaucgcc

SEQ ID NO: 877068 - RNA, 17 nt, Mycobacterium avium subsp. paratuberculosis
ucgccggaucgccgagg

SEQ ID NO: 877069 - RNA, 15 nt, Mycobacterium avium subsp. paratuberculosis
ucgccggcgaccgcc

SEQ ID NO: 877070 - RNA, 23 nt, Mycobacterium avium subsp. paratuberculosis
ucgccggcgaccgugcccaccag

SEQ ID NO: 877071 - RNA, 17 nt, Mycobacterium avium subsp. paratuberculosis
ucgccggcgacggccag

SEQ ID NO: 877072 - RNA, 18 nt, Mycobacterium avium subsp. paratuberculosis
ucgccggcgacggccagc

SEQ ID NO: 877073 - RNA, 23 nt, Mycobacterium avium subsp. paratuberculosis
ucgccggcgacggccagcgcggc

SEQ ID NO: 877074 - RNA, 12 nt, Mycobacterium avium subsp. paratuberculosis
ucgccggcgggg

SEQ ID NO: 877075 - RNA, 22 nt, Mycobacterium avium subsp. paratuberculosis
ucgccggcggggcgucgcccgc

SEQ ID NO: 877076 - RNA, 15 nt, Mycobacterium avium subsp. paratuberculosis
ucgccggcgcgcuga

SEQ ID NO: 877077 - RNA, 22 nt, Mycobacterium avium subsp. paratuberculosis
ucgccggcgcggaacagcgucg

SEQ ID NO: 877078 - RNA, 12 nt, Mycobacterium avium subsp. paratuberculosis
ucgccggcggcc

SEQ ID NO: 877079 - RNA, 17 nt, Mycobacterium avium subsp. paratuberculosis
ucgccggcggccgacag

SEQ ID NO: 877080 - RNA, 19 nt, Mycobacterium avium subsp. paratuberculosis
ucgccggcggccgccacgc

SEQ ID NO: 877081 - RNA, 20 nt, Mycobacterium avium subsp. paratuberculosis
ucgccggcggccgccacgcu

SEQ ID NO: 877082 - RNA, 14 nt, Mycobacterium avium subsp. paratuberculosis
ucgccggcggcgau

SEQ ID NO: 877083 - RNA, 17 nt, Mycobacterium avium subsp. paratuberculosis
ucgccggcggcgaucgc

SEQ ID NO: 877084 - RNA, 19 nt, Mycobacterium avium subsp. paratuberculosis
ucgccggcggcgaucgccg

SEQ ID NO: 877085 - RNA, 13 nt, Mycobacterium avium subsp. paratuberculosis
ucgccggcggcgc

SEQ ID NO: 877086 - RNA, 18 nt, Mycobacterium avium subsp. paratuberculosis
ucgccggcggcgcccgcg

SEQ ID NO: 877087 - RNA, 14 nt, Mycobacterium avium subsp. paratuberculosis
ucgccggcgcgcag

SEQ ID NO: 877088 - RNA, 15 nt, Mycobacterium avium subsp. paratuberculosis
ucgccggcgcgcagc

SEQ ID NO: 877089 - RNA, 14 nt, Mycobacterium avium subsp. paratuberculosis
ucgccggcgccgga

SEQ ID NO: 877090 - RNA, 19 nt, Mycobacterium avium subsp. paratuberculosis
ucgccggcgaugcgcgccu

SEQ ID NO: 877091 - RNA, 23 nt, Mycobacterium avium subsp. paratuberculosis
ucgccgcuggugaacucgccgau

SEQ ID NO: 877092 - RNA, 22 nt, Mycobacterium avium subsp. paratuberculosis
ucgccgcucguaacgccacggc

SEQ ID NO: 877093 - RNA, 18 nt, Mycobacterium avium subsp. paratuberculosis
ucgccgcucuucgacgac

SEQ ID NO: 877094 - RNA, 14 nt, Mycobacterium avium subsp. paratuberculosis
ucgccgcgggccag

SEQ ID NO: 877095 - RNA, 18 nt, Mycobacterium avium subsp. paratuberculosis
ucgccgcgguagacaccg

SEQ ID NO: 877096 - RNA, 21 nt, Mycobacterium avium subsp. paratuberculosis
ucgccgcgguagacaccgccg

SEQ ID NO: 877097 - RNA, 17 nt, Mycobacterium avium subsp. paratuberculosis
ucgccgcggucaucgag

SEQ ID NO: 877098 - RNA, 21 nt, Mycobacterium avium subsp. paratuberculosis
ucgccgcggucaucgagccgg

SEQ ID NO: 877099 - RNA, 16 nt, Mycobacterium avium subsp. paratuberculosis
ucgccgcggugcgcga

SEQ ID NO: 877100 - RNA, 14 nt, Mycobacterium avium subsp. paratuberculosis
ucgccgcgguggug

SEQ ID NO: 877101 - RNA, 19 nt, Mycobacterium avium subsp. paratuberculosis
ucgccgcgguggugggcgc

SEQ ID NO: 877102 - RNA, 17 nt, Mycobacterium avium subsp. paratuberculosis
ucgccgcguacgccgcc

SEQ ID NO: 877103 - RNA, 15 nt, Mycobacterium avium subsp. paratuberculosis
ucgccgcggccacgc

SEQ ID NO: 877104 - RNA, 17 nt, Mycobacterium avium subsp. paratuberculosis
ucgccgcggccacgcuc

SEQ ID NO: 877105 - RNA, 14 nt, Mycobacterium avium subsp. paratuberculosis
ucgccgcggccgga

SEQ ID NO: 877106 - RNA, 21 nt, Mycobacterium avium subsp. paratuberculosis
ucgccgcgcucaacccgggcc

SEQ ID NO: 877107 - RNA, 13 nt, Mycobacterium avium subsp. paratuberculosis
ucgccgcggcgau

SEQ ID NO: 877108 - RNA, 16 nt, Mycobacterium avium subsp. paratuberculosis
ucgccgcgcggcccgc

SEQ ID NO: 877109 - RNA, 23 nt, Mycobacterium avium subsp. paratuberculosis
ucgccgcgcggcccgcgacgucg

SEQ ID NO: 877110 - RNA, 20 nt, Mycobacterium avium subsp. paratuberculosis
ucgccgcgcuugcgaccgcc

SEQ ID NO: 877111 - RNA, 21 nt, Mycobacterium avium subsp. paratuberculosis
ucgccgcgcuugcgaccgccg

SEQ ID NO: 877112 - RNA, 15 nt, Mycobacterium avium subsp. paratuberculosis
ucgccgcggacccca

SEQ ID NO: 877113 - RNA, 16 nt, Mycobacterium avium subsp. paratuberculosis
ucgccgcggaccccag

SEQ ID NO: 877114 - RNA, 22 nt, Mycobacterium avium subsp. paratuberculosis
ucgccgcgcgcgucgacguucg

SEQ ID NO: 877115 - RNA, 17 nt, Mycobacterium avium subsp. paratuberculosis
ucgccgcgcccgccggc

SEQ ID NO: 877116 - RNA, 19 nt, Mycobacterium avium subsp. paratuberculosis
ucgccgcgcccgccggccc

SEQ ID NO: 877117 - RNA, 12 nt, Mycobacterium avium subsp. paratuberculosis
ucgccgcgcauc

SEQ ID NO: 877118 - RNA, 21 nt, Mycobacterium avium subsp. paratuberculosis
ucgccgcgcaucaucgcccag

SEQ ID NO: 877119 - RNA, 22 nt, Mycobacterium avium subsp. paratuberculosis
ucgccgcgcaucaucgcccagc

SEQ ID NO: 877120 - RNA, 21 nt, Mycobacterium avium subsp. paratuberculosis
ucgccgcgcauucaccagcug

SEQ ID NO: 877121 - RNA, 14 nt, Mycobacterium avium subsp. paratuberculosis
ucgccgcgccagca

SEQ ID NO: 877122 - RNA, 14 nt, Mycobacterium avium subsp. paratuberculosis
ucgccgcgccagcc

SEQ ID NO: 877123 - RNA, 16 nt, Mycobacterium avium subsp. paratuberculosis
ucgccgcgccagccgc

SEQ ID NO: 877124 - RNA, 22 nt, Mycobacterium avium subsp. paratuberculosis
ucgccgcgccagccgccgccga

SEQ ID NO: 877125 - RNA, 17 nt, Mycobacterium avium subsp. paratuberculosis
ucgccgcgcagcaccgc

SEQ ID NO: 877126 - RNA, 20 nt, Mycobacterium avium subsp. paratuberculosis
ucgccgcgcagcaccgcguc

SEQ ID NO: 877127 - RNA, 13 nt, Mycobacterium avium subsp. paratuberculosis
ucgccgcgcaccc

SEQ ID NO: 877128 - RNA, 16 nt, Mycobacterium avium subsp. paratuberculosis
ucgccgcgcacccggc

SEQ ID NO: 877129 - RNA, 17 nt, Mycobacterium avium subsp. paratuberculosis
ucgccgcgcacccggcc

SEQ ID NO: 877130 - RNA, 19 nt, Mycobacterium avium subsp. paratuberculosis
ucgccgcgcacccggccac

SEQ ID NO: 877131 - RNA, 17 nt, Mycobacterium avium subsp. paratuberculosis
ucgccgcgaacgacgac

SEQ ID NO: 877132 - RNA, 14 nt, Mycobacterium avium subsp. paratuberculosis
ucgccgaugacguu

SEQ ID NO: 877133 - RNA, 16 nt, Mycobacterium avium subsp. paratuberculosis
ucgccgaugcgccgca

SEQ ID NO: 877134 - RNA, 21 nt, Mycobacterium avium subsp. paratuberculosis
ucgccgauguggcgggcgucc

SEQ ID NO: 877135 - RNA, 15 nt, Mycobacterium avium subsp. paratuberculosis
ucgccgauggcguuc

SEQ ID NO: 877136 - RNA, 20 nt, Mycobacterium avium subsp. paratuberculosis
ucgccgauggugacggugcc

SEQ ID NO: 877137 - RNA, 21 nt, Mycobacterium avium subsp. paratuberculosis
ucgccgauggugacggugccg

SEQ ID NO: 877138 - RNA, 21 nt, Mycobacterium avium subsp. paratuberculosis
ucgccgauguaguccagccca

SEQ ID NO: 877139 - RNA, 22 nt, Mycobacterium avium subsp. paratuberculosis
ucgccgccggugaagaucagcg

SEQ ID NO: 877140 - RNA, 18 nt, Mycobacterium avium subsp. paratuberculosis
ucgccgccggugccgacg

SEQ ID NO: 877141 - RNA, 19 nt, Mycobacterium avium subsp. paratuberculosis
ucgccgaucgggaccguca

SEQ ID NO: 877142 - RNA, 17 nt, Mycobacterium avium subsp. paratuberculosis
ucgccgauccagccguc

SEQ ID NO: 877143 - RNA, 18 nt, Mycobacterium avium subsp. paratuberculosis
ucgccgauccagccgucg

SEQ ID NO: 877144 - RNA, 17 nt, Mycobacterium avium subsp. paratuberculosis
ucgccgauccgcgggua

SEQ ID NO: 877145 - RNA, 17 nt, Mycobacterium avium subsp. paratuberculosis
ucgccgauccggcgccg

SEQ ID NO: 877146 - RNA, 20 nt, Mycobacterium avium subsp. paratuberculosis
ucgccgauccggcgccgcgg

SEQ ID NO: 877147 - RNA, 18 nt, Mycobacterium avium subsp. paratuberculosis
ucgccgauccgggcggca

SEQ ID NO: 877148 - RNA, 19 nt, Mycobacterium avium subsp. paratuberculosis
ucgccgauccgggcggcag

SEQ ID NO: 877149 - RNA, 15 nt, Mycobacterium avium subsp. paratuberculosis
ucgccgaucagcacc

SEQ ID NO: 877150 - RNA, 16 nt, Mycobacterium avium subsp. paratuberculosis
ucgccgaucucggcca

SEQ ID NO: 877151 - RNA, 19 nt, Mycobacterium avium subsp. paratuberculosis
ucgccgaucuggcgcagcg

SEQ ID NO: 877152 - RNA, 17 nt, Mycobacterium avium subsp. paratuberculosis
ucgccgaucugucgcgc

SEQ ID NO: 877153 - RNA, 19 nt, Mycobacterium avium subsp. paratuberculosis
ucgccgaucugucgcgcuc

SEQ ID NO: 877154 - RNA, 16 nt, Mycobacterium avium subsp. paratuberculosis
ucgccgaugaccaccc

SEQ ID NO: 877155 - RNA, 19 nt, Mycobacterium avium subsp. paratuberculosis
ucgccgacggugagcaccg

SEQ ID NO: 877156 - RNA, 20 nt, Mycobacterium avium subsp. paratuberculosis
ucgccgacggugagcaccgc

SEQ ID NO: 877157 - RNA, 13 nt, Mycobacterium avium subsp. paratuberculosis
ucgccgaccagca

SEQ ID NO: 877158 - RNA, 22 nt, Mycobacterium avium subsp. paratuberculosis
ucgccgacgccgaagaucagcg

SEQ ID NO: 877159 - RNA, 15 nt, Mycobacterium avium subsp. paratuberculosis
ucgccgacgccagca

SEQ ID NO: 877160 - RNA, 23 nt, Mycobacterium avium subsp. paratuberculosis
ucgccgaccaguucggccaccgc

SEQ ID NO: 877161 - RNA, 14 nt, Mycobacterium avium subsp. paratuberculosis
ucgccgacccgguu

SEQ ID NO: 877162 - RNA, 21 nt, Mycobacterium avium subsp. paratuberculosis
ucgccgacccgguugauccgg

SEQ ID NO: 877163 - RNA, 15 nt, Mycobacterium avium subsp. paratuberculosis
ucgccgacagcgucg

SEQ ID NO: 877164 - RNA, 22 nt, Mycobacterium avium subsp. paratuberculosis
ucgccgaauuguucggccaccg

SEQ ID NO: 877165 - RNA, 23 nt, Mycobacterium avium subsp. paratuberculosis
ucgccgaauuguucggccaccgc

SEQ ID NO: 877166 - RNA, 21 nt, Mycobacterium avium subsp. paratuberculosis
ucgccgaaguuccagccgauc

SEQ ID NO: 877167 - RNA, 23 nt, Mycobacterium avium subsp. paratuberculosis
ucgccgaaguuccagccgaucgc

SEQ ID NO: 877168 - RNA, 12 nt, Mycobacterium avium subsp. paratuberculosis
ucgcgccgagac

SEQ ID NO: 877169 - RNA, 14 nt, Mycobacterium avium subsp. paratuberculosis
ucgcgccgaggugg

SEQ ID NO: 877170 - RNA, 14 nt, Mycobacterium avium subsp. paratuberculosis
ucgcgcccggcguc

SEQ ID NO: 877171 - RNA, 16 nt, Mycobacterium avium subsp. paratuberculosis
ucgcgcccggcgucgg

SEQ ID NO: 877172 - RNA, 21 nt, Mycobacterium avium subsp. paratuberculosis
ucgcgcccuaacgugcccggc

SEQ ID NO: 877173 - RNA, 14 nt, Mycobacterium avium subsp. paratuberculosis
ucgcgccagcgguc

SEQ ID NO: 877174 - RNA, 17 nt, Mycobacterium avium subsp. paratuberculosis
ucgcgccaggaccagcg

SEQ ID NO: 877175 - RNA, 14 nt, Mycobacterium avium subsp. paratuberculosis
ucgcgccagacguc

SEQ ID NO: 877176 - RNA, 23 nt, Mycobacterium avium subsp. paratuberculosis
ucgcgccagacguccagcgccgc

SEQ ID NO: 877177 - RNA, 21 nt, Mycobacterium avium subsp. paratuberculosis
ucgcgcaucgccucggcggcc

SEQ ID NO: 877178 - RNA, 17 nt, Mycobacterium avium subsp. paratuberculosis
ucgcgcagcccccggac

SEQ ID NO: 877179 - RNA, 16 nt, Mycobacterium avium subsp. paratuberculosis
ucgcgcagcccgaucg

SEQ ID NO: 877180 - RNA, 12 nt, Mycobacterium avium subsp. paratuberculosis
ucgcgcagccgc

SEQ ID NO: 877181 - RNA, 13 nt, Mycobacterium avium subsp. paratuberculosis
ucgcgcagccgcc

SEQ ID NO: 877182 - RNA, 15 nt, Mycobacterium avium subsp. paratuberculosis
ucgcgcagccgccgg

SEQ ID NO: 877183 - RNA, 19 nt, Mycobacterium avium subsp. paratuberculosis
ucgcgcagccgcgguggcg

SEQ ID NO: 877184 - RNA, 15 nt, Mycobacterium avium subsp. paratuberculosis
ucgcgcagccggccg

SEQ ID NO: 877185 - RNA, 16 nt, Mycobacterium avium subsp. paratuberculosis
ucgcgcagccggccga

SEQ ID NO: 877186 - RNA, 19 nt, Mycobacterium avium subsp. paratuberculosis
ucgcgcagccggccgaccg

SEQ ID NO: 877187 - RNA, 18 nt, Mycobacterium avium subsp. paratuberculosis
ucgcgcagccgggcggcg

SEQ ID NO: 877188 - RNA, 14 nt, Mycobacterium avium subsp. paratuberculosis
ucgcgcagcgaagc

SEQ ID NO: 877189 - RNA, 19 nt, Mycobacterium avium subsp. paratuberculosis
ucgcgcagcgaagcgaggc

SEQ ID NO: 877190 - RNA, 23 nt, Mycobacterium avium subsp. paratuberculosis
ucgcgcagcauccgcaccaggua

SEQ ID NO: 877191 - RNA, 14 nt, Mycobacterium avium subsp. paratuberculosis
ucgcgcagcaccga

SEQ ID NO: 877192 - RNA, 22 nt, Mycobacterium avium subsp. paratuberculosis
ucgcgcagcaccgaugccagac

SEQ ID NO: 877193 - RNA, 14 nt, Mycobacterium avium subsp. paratuberculosis
ucgcgcagcaccuc

SEQ ID NO: 877194 - RNA, 21 nt, Mycobacterium avium subsp. paratuberculosis
ucgcgcagcagcugcacccgc

SEQ ID NO: 877195 - RNA, 20 nt, Mycobacterium avium subsp. paratuberculosis
ucgcgcacuucgcgggcggc

SEQ ID NO: 877196 - RNA, 21 nt, Mycobacterium avium subsp. paratuberculosis
ucgcgcacuucgcgggcggcg

SEQ ID NO: 877197 - RNA, 23 nt, Mycobacterium avium subsp. paratuberculosis
ucgcgcacuucgcgggcggcgca

SEQ ID NO: 877198 - RNA, 20 nt, Mycobacterium avium subsp. paratuberculosis
ucgcgaugcccaagccggcc

SEQ ID NO: 877199 - RNA, 21 nt, Mycobacterium avium subsp. paratuberculosis
ucgcgaugcccaagccggcca

SEQ ID NO: 877200 - RNA, 22 nt, Mycobacterium avium subsp. paratuberculosis
ucgcgaugcccaagccggccag

SEQ ID NO: 877201 - RNA, 23 nt, Mycobacterium avium subsp. paratuberculosis
ucgcgauggaggucccgaggagg

SEQ ID NO: 877202 - RNA, 16 nt, Mycobacterium avium subsp. paratuberculosis
ucgcgaucgccgaucc

SEQ ID NO: 877203 - RNA, 18 nt, Mycobacterium avium subsp. paratuberculosis
ucgcgacgagcgggccga

SEQ ID NO: 877204 - RNA, 12 nt, Mycobacterium avium subsp. paratuberculosis
ucgcgacgcggc

SEQ ID NO: 877205 - RNA, 16 nt, Mycobacterium avium subsp. paratuberculosis
ucgcgacgcggcucgc

SEQ ID NO: 877206 - RNA, 14 nt, Mycobacterium avium subsp. paratuberculosis
ucgcgacggccggg

SEQ ID NO: 877207 - RNA, 21 nt, Mycobacterium avium subsp. paratuberculosis
ucgcgacggccggggccagca

SEQ ID NO: 877208 - RNA, 12 nt, Mycobacterium avium subsp. paratuberculosis
ucgcgaccgccg

SEQ ID NO: 877209 - RNA, 18 nt, Mycobacterium avium subsp. paratuberculosis
ucgcgaccgccggacacc

SEQ ID NO: 877210 - RNA, 14 nt, Mycobacterium avium subsp. paratuberculosis
ucgcgauccgggcg

SEQ ID NO: 877211 - RNA, 18 nt, Mycobacterium avium subsp. paratuberculosis
ucgcgauccgggcgccgg

SEQ ID NO: 877212 - RNA, 19 nt, Mycobacterium avium subsp. paratuberculosis
ucgcgauccgggcgccggc

SEQ ID NO: 877213 - RNA, 24 nt, Mycobacterium avium subsp. paratuberculosis
ucgcgauccgggcgccggccggcg

SEQ ID NO: 877214 - RNA, 19 nt, Mycobacterium avium subsp. paratuberculosis
ucgcgaucaacugaucgag

SEQ ID NO: 877215 - RNA, 18 nt, Mycobacterium avium subsp. paratuberculosis
ucgcgaucaccgcggcca

SEQ ID NO: 877216 - RNA, 19 nt, Mycobacterium avium subsp. paratuberculosis
ucgcgagggcgggccagcu

SEQ ID NO: 877217 - RNA, 21 nt, Mycobacterium avium subsp. paratuberculosis
ucgcgauagggccggccggac

SEQ ID NO: 877218 - RNA, 22 nt, Mycobacterium avium subsp. paratuberculosis
ucgccgucacaccgcggccagc

SEQ ID NO: 877219 - RNA, 14 nt, Mycobacterium avium subsp. paratuberculosis
ucgccgucaccucg

SEQ ID NO: 877220 - RNA, 17 nt, Mycobacterium avium subsp. paratuberculosis
ucgccguccccaccgau

SEQ ID NO: 877221 - RNA, 20 nt, Mycobacterium avium subsp. paratuberculosis
ucgccguccccaccgaucag

SEQ ID NO: 877222 - RNA, 14 nt, Mycobacterium avium subsp. paratuberculosis
ucgccguccacggg

SEQ ID NO: 877223 - RNA, 22 nt, Mycobacterium avium subsp. paratuberculosis
ucgccguccacgggucgccgug

SEQ ID NO: 877224 - RNA, 23 nt, Mycobacterium avium subsp. paratuberculosis
ucgccguccacgggucgccgugg

SEQ ID NO: 877225 - RNA, 16 nt, Mycobacterium avium subsp. paratuberculosis
ucgccguccucgcguc

SEQ ID NO: 877226 - RNA, 20 nt, Mycobacterium avium subsp. paratuberculosis
ucgccguccucgcgucgcgc

SEQ ID NO: 877227 - RNA, 15 nt, Mycobacterium avium subsp. paratuberculosis
ucgcgaccaccggcc

SEQ ID NO: 877228 - RNA, 18 nt, Mycobacterium avium subsp. paratuberculosis
ucgccggcugacugccgg

SEQ ID NO: 877229 - RNA, 22 nt, Mycobacterium avium subsp. paratuberculosis
ucgccggcugacugccggcgac

SEQ ID NO: 877230 - RNA, 20 nt, Mycobacterium avium subsp. paratuberculosis
ucgccggcuuaccgaccucg

SEQ ID NO: 877231 - RNA, 21 nt, Mycobacterium avium subsp. paratuberculosis
ucgccgggcagguggucggcg

SEQ ID NO: 877232 - RNA, 16 nt, Mycobacterium avium subsp. paratuberculosis
ucgccggugaccgcgc

SEQ ID NO: 877233 - RNA, 13 nt, Mycobacterium avium subsp. paratuberculosis
ucgccggugaccu

SEQ ID NO: 877234 - RNA, 16 nt, Mycobacterium avium subsp. paratuberculosis
ucgccggugaccugca

SEQ ID NO: 877235 - RNA, 21 nt, Mycobacterium avium subsp. paratuberculosis
ucgccggugaccugcagcgcc

SEQ ID NO: 877236 - RNA, 17 nt, Mycobacterium avium subsp. paratuberculosis
ucgccggcuaccggcgc

SEQ ID NO: 877237 - RNA, 18 nt, Mycobacterium avium subsp. paratuberculosis
ucgccggcuaccggcgcu

SEQ ID NO: 877238 - RNA, 15 nt, Mycobacterium avium subsp. paratuberculosis
ucgccgguggcggcg

SEQ ID NO: 877239 - RNA, 12 nt, Mycobacterium avium subsp. paratuberculosis
ucgccgguggug

SEQ ID NO: 877240 - RNA, 22 nt, Mycobacterium avium subsp. paratuberculosis
ucgccggugugaucgagcacca

SEQ ID NO: 877241 - RNA, 19 nt, Mycobacterium avium subsp. paratuberculosis
ucgccggugugcagccacc

SEQ ID NO: 877242 - RNA, 16 nt, Mycobacterium avium subsp. paratuberculosis
ucgccggugcgggcug

SEQ ID NO: 877243 - RNA, 23 nt, Mycobacterium avium subsp. paratuberculosis
ucgccguacagcugguccggccg

SEQ ID NO: 877244 - RNA, 16 nt, Mycobacterium avium subsp. paratuberculosis
ucgccguacgcgccgg

SEQ ID NO: 877245 - RNA, 20 nt, Mycobacterium avium subsp. paratuberculosis
ucgccguacgcgccggccag

SEQ ID NO: 877246 - RNA, 22 nt, Mycobacterium avium subsp. paratuberculosis
ucgccguacgcgccggccagcc

SEQ ID NO: 877247 - RNA, 17 nt, Mycobacterium avium subsp. paratuberculosis
ucgccguacuugacgug

SEQ ID NO: 877248 - RNA, 21 nt, Mycobacterium avium subsp. paratuberculosis
ucgccguacuugacgugcgac

SEQ ID NO: 877249 - RNA, 13 nt, Mycobacterium avium subsp. paratuberculosis
ucgcggcaggcga

SEQ ID NO: 877250 - RNA, 15 nt, Mycobacterium avium subsp. paratuberculosis
ucgcggccacgcccu

SEQ ID NO: 877251 - RNA, 18 nt, Mycobacterium avium subsp. paratuberculosis
ucgcggccacgcccuggc

SEQ ID NO: 877252 - RNA, 13 nt, Mycobacterium avium subsp. paratuberculosis
ucgcggccgccgg

SEQ ID NO: 877253 - RNA, 12 nt, Mycobacterium avium subsp. paratuberculosis
ucgcggcccgcg

SEQ ID NO: 877254 - RNA, 17 nt, Mycobacterium avium subsp. paratuberculosis
ucgcggcccgcggggcg

SEQ ID NO: 877255 - RNA, 15 nt, Mycobacterium avium subsp. paratuberculosis
ucgcggcccagcacc

SEQ ID NO: 877256 - RNA, 17 nt, Mycobacterium avium subsp. paratuberculosis
ucgcggcccagcaccac

SEQ ID NO: 877257 - RNA, 15 nt, Mycobacterium avium subsp. paratuberculosis
ucgcggcccacccgc

SEQ ID NO: 877258 - RNA, 21 nt, Mycobacterium avium subsp. paratuberculosis
ucgcggcccacccgcagggcg

SEQ ID NO: 877259 - RNA, 15 nt, Mycobacterium avium subsp. paratuberculosis
ucgcggcccaccgcg

SEQ ID NO: 877260 - RNA, 16 nt, Mycobacterium avium subsp. paratuberculosis
ucgcggcgagcagcgc

SEQ ID NO: 877261 - RNA, 19 nt, Mycobacterium avium subsp. paratuberculosis
ucgcggcgagcucaacagc

SEQ ID NO: 877262 - RNA, 22 nt, Mycobacterium avium subsp. paratuberculosis
ucgcggcgcacggugcccgucg

SEQ ID NO: 877263 - RNA, 14 nt, Mycobacterium avium subsp. paratuberculosis
ucgcggcgcagcuc

SEQ ID NO: 877264 - RNA, 14 nt, Mycobacterium avium subsp. paratuberculosis
ucgcggcgccgguu

SEQ ID NO: 877265 - RNA, 13 nt, Mycobacterium avium subsp. paratuberculosis
ucgcggcgaucag

SEQ ID NO: 877266 - RNA, 18 nt, Mycobacterium avium subsp. paratuberculosis
ucgcggcgaucagcccgg

SEQ ID NO: 877267 - RNA, 19 nt, Mycobacterium avium subsp. paratuberculosis
ucgcggcgaucagcccggc

SEQ ID NO: 877268 - RNA, 16 nt, Mycobacterium avium subsp. paratuberculosis
ucgcggccugcgggcg

SEQ ID NO: 877269 - RNA, 20 nt, Mycobacterium avium subsp. paratuberculosis
ucgcggccugcgggcgccgg

SEQ ID NO: 877270 - RNA, 14 nt, Mycobacterium avium subsp. paratuberculosis
ucgcggcgaaccag

SEQ ID NO: 877271 - RNA, 14 nt, Mycobacterium avium subsp. paratuberculosis
ucgcgcggcaucgu

SEQ ID NO: 877272 - RNA, 22 nt, Mycobacterium avium subsp. paratuberculosis
ucgcgcggcaucgucaccucga

SEQ ID NO: 877273 - RNA, 14 nt, Mycobacterium avium subsp. paratuberculosis
ucgcgcggcgccca

SEQ ID NO: 877274 - RNA, 16 nt, Mycobacterium avium subsp. paratuberculosis
ucgcgcgggucgagca

SEQ ID NO: 877275 - RNA, 17 nt, Mycobacterium avium subsp. paratuberculosis
ucgcgcggggcggccgc

SEQ ID NO: 877276 - RNA, 19 nt, Mycobacterium avium subsp. paratuberculosis
ucgcgcggggucgggccgg

SEQ ID NO: 877277 - RNA, 20 nt, Mycobacterium avium subsp. paratuberculosis
ucgcgcggggugacgcccgu

SEQ ID NO: 877278 - RNA, 13 nt, Mycobacterium avium subsp. paratuberculosis
ucgcgcggcacca

SEQ ID NO: 877279 - RNA, 17 nt, Mycobacterium avium subsp. paratuberculosis
ucgcgcggcaccaccag

SEQ ID NO: 877280 - RNA, 20 nt, Mycobacterium avium subsp. paratuberculosis
ucgcgcgccggcgcagcggc

SEQ ID NO: 877281 - RNA, 17 nt, Mycobacterium avium subsp. paratuberculosis
ucgcgcgcggcgacggu

SEQ ID NO: 877282 - RNA, 15 nt, Mycobacterium avium subsp. paratuberculosis
ucgcgcgcggcggcc

SEQ ID NO: 877283 - RNA, 16 nt, Mycobacterium avium subsp. paratuberculosis
ucgcgcgcggcguggu

SEQ ID NO: 877284 - RNA, 17 nt, Mycobacterium avium subsp. paratuberculosis
ucgcggauguccgaccg

SEQ ID NO: 877285 - RNA, 19 nt, Mycobacterium avium subsp. paratuberculosis
ucgcggaucucggugagca

SEQ ID NO: 877286 - RNA, 16 nt, Mycobacterium avium subsp. paratuberculosis
ucgcggaucucgucgg

SEQ ID NO: 877287 - RNA, 15 nt, Mycobacterium avium subsp. paratuberculosis
ucgcggagcggguca

SEQ ID NO: 877288 - RNA, 16 nt, Mycobacterium avium subsp. paratuberculosis
ucgcggaggaugccgg

SEQ ID NO: 877289 - RNA, 20 nt, Mycobacterium avium subsp. paratuberculosis
ucgcggaggaugccggccag

SEQ ID NO: 877290 - RNA, 17 nt, Mycobacterium avium subsp. paratuberculosis
ucgcggauacgcccggc

SEQ ID NO: 877291 - RNA, 20 nt, Mycobacterium avium subsp. paratuberculosis
ucgcggauacgcccggccac

SEQ ID NO: 877292 - RNA, 16 nt, Mycobacterium avium subsp. paratuberculosis
ucgcggauccgggccg

SEQ ID NO: 877293 - RNA, 18 nt, Mycobacterium avium subsp. paratuberculosis
ucgcggauccgggccgcc

SEQ ID NO: 877294 - RNA, 18 nt, Mycobacterium avium subsp. paratuberculosis
ucgcggauccgggccggc

SEQ ID NO: 877295 - RNA, 19 nt, Mycobacterium avium subsp. paratuberculosis
ucgcggaucgaacagggcg

SEQ ID NO: 877296 - RNA, 20 nt, Mycobacterium avium subsp. paratuberculosis
ucgcggaucgaacagggcgg

SEQ ID NO: 877297 - RNA, 12 nt, Mycobacterium avium subsp. paratuberculosis
ucgcgguccagg

SEQ ID NO: 877298 - RNA, 15 nt, Mycobacterium avium subsp. paratuberculosis
ucgcggucagccggc

SEQ ID NO: 877299 - RNA, 21 nt, Mycobacterium avium subsp. paratuberculosis
ucgcggucagcgucuggcggg

SEQ ID NO: 877300 - RNA, 14 nt, Mycobacterium avium subsp. paratuberculosis
ucgcggucagcucg

SEQ ID NO: 877301 - RNA, 12 nt, Mycobacterium avium subsp. paratuberculosis
ucgcgguccacc

SEQ ID NO: 877302 - RNA, 16 nt, Mycobacterium avium subsp. paratuberculosis
ucgcgguccacgccgg

SEQ ID NO: 877303 - RNA, 17 nt, Mycobacterium avium subsp. paratuberculosis
ucgcgguccacgccggc

SEQ ID NO: 877304 - RNA, 20 nt, Mycobacterium avium subsp. paratuberculosis
ucgcgguccacgccggcgau

SEQ ID NO: 877305 - RNA, 17 nt, Mycobacterium avium subsp. paratuberculosis
ucgcgggugaccggcgc

SEQ ID NO: 877306 - RNA, 17 nt, Mycobacterium avium subsp. paratuberculosis
ucgcgggugcgcugcag

SEQ ID NO: 877307 - RNA, 14 nt, Mycobacterium avium subsp. paratuberculosis
ucgcgggugcggcg

SEQ ID NO: 877308 - RNA, 15 nt, Mycobacterium avium subsp. paratuberculosis
ucgcgggugcggcgc

SEQ ID NO: 877309 - RNA, 16 nt, Mycobacterium avium subsp. paratuberculosis
ucgcgggugcugggcg

SEQ ID NO: 877310 - RNA, 18 nt, Mycobacterium avium subsp. paratuberculosis
ucgcgguagcgcucgguc

SEQ ID NO: 877311 - RNA, 22 nt, Mycobacterium avium subsp. paratuberculosis
ucgcgguagcgcucggucaggc

SEQ ID NO: 877312 - RNA, 20 nt, Mycobacterium avium subsp. paratuberculosis
ucgcgguagucgggauaggg

SEQ ID NO: 877313 - RNA, 14 nt, Mycobacterium avium subsp. paratuberculosis
ucgcgggcggcgca

SEQ ID NO: 877314 - RNA, 15 nt, Mycobacterium avium subsp. paratuberculosis
ucgcgggcggcgcag

SEQ ID NO: 877315 - RNA, 15 nt, Mycobacterium avium subsp. paratuberculosis
ucgcgggcgaugcgg

SEQ ID NO: 877316 - RNA, 21 nt, Mycobacterium avium subsp. paratuberculosis
ucgcgggcgaugcggcccggc

SEQ ID NO: 877317 - RNA, 14 nt, Mycobacterium avium subsp. paratuberculosis
ucgcgggcgccgag

SEQ ID NO: 877318 - RNA, 13 nt, Mycobacterium avium subsp. paratuberculosis
ucgcgggcccgcg

SEQ ID NO: 877319 - RNA, 22 nt, Mycobacterium avium subsp. paratuberculosis
ucgcgggcccgcgccgcgucgu

SEQ ID NO: 877320 - RNA, 19 nt, Mycobacterium avium subsp. paratuberculosis
ucgcgggcccgcgcggcgg

SEQ ID NO: 877321 - RNA, 17 nt, Mycobacterium avium subsp. paratuberculosis
ucgcgggcgagcagcgc

SEQ ID NO: 877322 - RNA, 13 nt, Mycobacterium avium subsp. paratuberculosis
ucgcgggcgagcc

SEQ ID NO: 877323 - RNA, 14 nt, Mycobacterium avium subsp. paratuberculosis
ucgcgggcgucggg

SEQ ID NO: 877324 - RNA, 19 nt, Mycobacterium avium subsp. paratuberculosis
ucgcgggcgucgggcagca

SEQ ID NO: 877325 - RNA, 20 nt, Mycobacterium avium subsp. paratuberculosis
ucgcgggcggggcgccgaca

SEQ ID NO: 877326 - RNA, 20 nt, Mycobacterium avium subsp. paratuberculosis
ucgcgggggccgcgaugagg

SEQ ID NO: 877327 - RNA, 15 nt, Mycobacterium avium subsp. paratuberculosis
ucgcgggucagcguc

SEQ ID NO: 877328 - RNA, 16 nt, Mycobacterium avium subsp. paratuberculosis
ucgcgggucagcgucg

SEQ ID NO: 877329 - RNA, 16 nt, Mycobacterium avium subsp. paratuberculosis
ucgcgggcccgggcca

SEQ ID NO: 877330 - RNA, 21 nt, Mycobacterium avium subsp. paratuberculosis
ucgcgggcccgggccacccgc

SEQ ID NO: 877331 - RNA, 20 nt, Mycobacterium avium subsp. paratuberculosis
ucgcgggccacagcggcgac

SEQ ID NO: 877332 - RNA, 17 nt, Mycobacterium avium subsp. paratuberculosis
ucgcgggccaccgcggc

SEQ ID NO: 877333 - RNA, 14 nt, Mycobacterium avium subsp. paratuberculosis
ucgcgggccaccgg

SEQ ID NO: 877334 - RNA, 15 nt, Mycobacterium avium subsp. paratuberculosis
ucgcgggccaccggc

SEQ ID NO: 877335 - RNA, 17 nt, Mycobacterium avium subsp. paratuberculosis
ucgcgggccaccggcgc

SEQ ID NO: 877336 - RNA, 14 nt, Mycobacterium avium subsp. paratuberculosis
ucgcgggacggcgg

SEQ ID NO: 877337 - RNA, 18 nt, Mycobacterium avium subsp. paratuberculosis
ucgcgggaggacagcgcg

SEQ ID NO: 877338 - RNA, 20 nt, Mycobacterium avium subsp. paratuberculosis
ucgcgggaggacagcgcggu

SEQ ID NO: 877339 - RNA, 17 nt, Mycobacterium avium subsp. paratuberculosis
ucgcgggaucggccggc

SEQ ID NO: 877340 - RNA, 18 nt, Mycobacterium avium subsp. paratuberculosis
ucgcggcuggugccgccg

SEQ ID NO: 877341 - RNA, 19 nt, Mycobacterium avium subsp. paratuberculosis
ucgcggcuggugccgccgg

SEQ ID NO: 877342 - RNA, 15 nt, Mycobacterium avium subsp. paratuberculosis
ucgcgggacaacacc

SEQ ID NO: 877343 - RNA, 17 nt, Mycobacterium avium subsp. paratuberculosis
ucgcggcuggccgcggc

SEQ ID NO: 877344 - RNA, 18 nt, Mycobacterium avium subsp. paratuberculosis
ucgcggcuggccgcggcg

SEQ ID NO: 877345 - RNA, 20 nt, Mycobacterium avium subsp. paratuberculosis
ucgcggcuggccgcggcgau

SEQ ID NO: 877346 - RNA, 23 nt, Mycobacterium avium subsp. paratuberculosis
ucgcggcuggccgcggcgaucgg

SEQ ID NO: 877347 - RNA, 16 nt, Mycobacterium avium subsp. paratuberculosis
ucgcggcgucgcggua

SEQ ID NO: 877348 - RNA, 19 nt, Mycobacterium avium subsp. paratuberculosis
ucgcggcgcggaccccagu

SEQ ID NO: 877349 - RNA, 18 nt, Mycobacterium avium subsp. paratuberculosis
ucgcggcguaggugggca

SEQ ID NO: 877350 - RNA, 17 nt, Mycobacterium avium subsp. paratuberculosis
ucgcggcggcgcugguc

SEQ ID NO: 877351 - RNA, 20 nt, Mycobacterium avium subsp. paratuberculosis
ucgcggcggcgcuggucggc

SEQ ID NO: 877352 - RNA, 16 nt, Mycobacterium avium subsp. paratuberculosis
ucgcggcggcccgucg

SEQ ID NO: 877353 - RNA, 20 nt, Mycobacterium avium subsp. paratuberculosis
ucgcggcggccgacgcgccg

SEQ ID NO: 877354 - RNA, 21 nt, Mycobacterium avium subsp. paratuberculosis
ucgcggcggccgacgcgccgu

SEQ ID NO: 877355 - RNA, 16 nt, Mycobacterium avium subsp. paratuberculosis
ucgcggcggccggcgc

SEQ ID NO: 877356 - RNA, 18 nt, Mycobacterium avium subsp. paratuberculosis
ucgcggcgcugccgccgg

SEQ ID NO: 877357 - RNA, 22 nt, Mycobacterium avium subsp. paratuberculosis
ucgcggcggcgccgcagcacgc

SEQ ID NO: 877358 - RNA, 13 nt, Mycobacterium avium subsp. paratuberculosis
ucgcggcggcgcu

SEQ ID NO: 877359 - RNA, 19 nt, Mycobacterium avium subsp. paratuberculosis
uccugguccggcgcccgau

SEQ ID NO: 877360 - RNA, 18 nt, Mycobacterium avium subsp. paratuberculosis
uccuugaacuucagcugc

SEQ ID NO: 877361 - RNA, 22 nt, Mycobacterium avium subsp. paratuberculosis
uccuugagguagucgcgcagcu

SEQ ID NO: 877362 - RNA, 17 nt, Mycobacterium avium subsp. paratuberculosis
uccuugcccagcgcggu

SEQ ID NO: 877363 - RNA, 20 nt, Mycobacterium avium subsp. paratuberculosis
uccuucuugaacagcgccgg

SEQ ID NO: 877364 - RNA, 18 nt, Mycobacterium avium subsp. paratuberculosis
uccuugagccgccgcggc

SEQ ID NO: 877365 - RNA, 20 nt, Mycobacterium avium subsp. paratuberculosis
uccuugagccgccgcggcac

SEQ ID NO: 877366 - RNA, 15 nt, Mycobacterium avium subsp. paratuberculosis
uccuggacgucgucg

SEQ ID NO: 877367 - RNA, 19 nt, Mycobacterium avium subsp. paratuberculosis
uccuggcggguggcgauga

SEQ ID NO: 877368 - RNA, 14 nt, Mycobacterium avium subsp. paratuberculosis
uccugggccagauc

SEQ ID NO: 877369 - RNA, 16 nt, Mycobacterium avium subsp. paratuberculosis
uccugggccgggauga

SEQ ID NO: 877370 - RNA, 11 nt, Mycobacterium avium subsp. paratuberculosis
uccuggucgcu

SEQ ID NO: 877371 - RNA, 21 nt, Mycobacterium avium subsp. paratuberculosis
uccuggccaacucgaccugcc

SEQ ID NO: 877372 - RNA, 22 nt, Mycobacterium avium subsp. paratuberculosis
ucgaaacccagcuugaccaccc

SEQ ID NO: 877373 - RNA, 20 nt, Mycobacterium avium subsp. paratuberculosis
ucgaaaccgucuccggcgcg

SEQ ID NO: 877374 - RNA, 18 nt, Mycobacterium avium subsp. paratuberculosis
uccuuggccgccagcacc

SEQ ID NO: 877375 - RNA, 17 nt, Mycobacterium avium subsp. paratuberculosis
uccuugcggccgccgau

SEQ ID NO: 877376 - RNA, 15 nt, Mycobacterium avium subsp. paratuberculosis
uccuugauccggccg

SEQ ID NO: 877377 - RNA, 12 nt, Mycobacterium avium subsp. paratuberculosis
uccuugcgccgc

SEQ ID NO: 877378 - RNA, 21 nt, Mycobacterium avium subsp. paratuberculosis
uccuugcgcgccgcgacgucg

SEQ ID NO: 877379 - RNA, 22 nt, Mycobacterium avium subsp. paratuberculosis
uccuuggggcugaccucgccgc

SEQ ID NO: 877380 - RNA, 15 nt, Mycobacterium avium subsp. paratuberculosis
ucgaaccacgcggcg

SEQ ID NO: 877381 - RNA, 16 nt, Mycobacterium avium subsp. paratuberculosis
ucgaaccacgcggcgg

SEQ ID NO: 877382 - RNA, 19 nt, Mycobacterium avium subsp. paratuberculosis
ucgaacaucacccggcggc

SEQ ID NO: 877383 - RNA, 16 nt, Mycobacterium avium subsp. paratuberculosis
ucgaacaucggcacgu

SEQ ID NO: 877384 - RNA, 13 nt, Mycobacterium avium subsp. paratuberculosis
ucgaaccgccgcg

SEQ ID NO: 877385 - RNA, 19 nt, Mycobacterium avium subsp. paratuberculosis
ucgaaccgcgagcgcgcgg

SEQ ID NO: 877386 - RNA, 18 nt, Mycobacterium avium subsp. paratuberculosis
ucgaaccgcuugcccagc

SEQ ID NO: 877387 - RNA, 14 nt, Mycobacterium avium subsp. paratuberculosis
ucgaaccgggcggu

SEQ ID NO: 877388 - RNA, 16 nt, Mycobacterium avium subsp. paratuberculosis
ucgaaccgggcgguga

SEQ ID NO: 877389 - RNA, 18 nt, Mycobacterium avium subsp. paratuberculosis
ucgaacagggcggcgggc

SEQ ID NO: 877390 - RNA, 20 nt, Mycobacterium avium subsp. paratuberculosis
ucgaacagcaggcccaggcc

SEQ ID NO: 877391 - RNA, 21 nt, Mycobacterium avium subsp. paratuberculosis
ucgaacagccgggccgcccgc

SEQ ID NO: 877392 - RNA, 13 nt, Mycobacterium avium subsp. paratuberculosis
ucgaacagcgcgc

SEQ ID NO: 877393 - RNA, 18 nt, Mycobacterium avium subsp. paratuberculosis
ucgaacagcacgccggcc

SEQ ID NO: 877394 - RNA, 22 nt, Mycobacterium avium subsp. paratuberculosis
ucgaacagcacgccggccggcg

SEQ ID NO: 877395 - RNA, 21 nt, Mycobacterium avium subsp. paratuberculosis
ucgaacaacccggccgcgauc

SEQ ID NO: 877396 - RNA, 18 nt, Mycobacterium avium subsp. paratuberculosis
ucgaacaacgcggugacc

SEQ ID NO: 877397 - RNA, 20 nt, Mycobacterium avium subsp. paratuberculosis
ucgaacacgccgucgugggu

SEQ ID NO: 877398 - RNA, 16 nt, Mycobacterium avium subsp. paratuberculosis
ucgaaauagcggcgca

SEQ ID NO: 877399 - RNA, 12 nt, Mycobacterium avium subsp. paratuberculosis
uccucugcgcgc

SEQ ID NO: 877400 - RNA, 15 nt, Mycobacterium avium subsp. paratuberculosis
uccucucggcgccgu

SEQ ID NO: 877401 - RNA, 13 nt, Mycobacterium avium subsp. paratuberculosis
uccucggcgaugu

SEQ ID NO: 877402 - RNA, 17 nt, Mycobacterium avium subsp. paratuberculosis
uccucggugaccucgaa

SEQ ID NO: 877403 - RNA, 16 nt, Mycobacterium avium subsp. paratuberculosis
uccucggugagcgugg

SEQ ID NO: 877404 - RNA, 14 nt, Mycobacterium avium subsp. paratuberculosis
uccucggcgcggau

SEQ ID NO: 877405 - RNA, 18 nt, Mycobacterium avium subsp. paratuberculosis
uccucggcgcucgccgcg

SEQ ID NO: 877406 - RNA, 17 nt, Mycobacterium avium subsp. paratuberculosis
uccucggccgccaccgc

SEQ ID NO: 877407 - RNA, 15 nt, Mycobacterium avium subsp. paratuberculosis
uccucggccagcacc

SEQ ID NO: 877408 - RNA, 18 nt, Mycobacterium avium subsp. paratuberculosis
uccucggccagcaccagc

SEQ ID NO: 877409 - RNA, 23 nt, Mycobacterium avium subsp. paratuberculosis
uccucggccagccccaccaccgc

SEQ ID NO: 877410 - RNA, 19 nt, Mycobacterium avium subsp. paratuberculosis
uccucggccagcucaccgg

SEQ ID NO: 877411 - RNA, 17 nt, Mycobacterium avium subsp. paratuberculosis
uccucgcgccgccacgc

SEQ ID NO: 877412 - RNA, 19 nt, Mycobacterium avium subsp. paratuberculosis
uccucgcgccgccacgcgg

SEQ ID NO: 877413 - RNA, 14 nt, Mycobacterium avium subsp. paratuberculosis
uccucgcgcggcac

SEQ ID NO: 877414 - RNA, 21 nt, Mycobacterium avium subsp. paratuberculosis
uccucgccggagagcccgucg

SEQ ID NO: 877415 - RNA, 16 nt, Mycobacterium avium subsp. paratuberculosis
uccucgccgcgccagc

SEQ ID NO: 877416 - RNA, 15 nt, Mycobacterium avium subsp. paratuberculosis
uccucgccgcgggcc

SEQ ID NO: 877417 - RNA, 20 nt, Mycobacterium avium subsp. paratuberculosis
uccucgaucaucgcgucggu

SEQ ID NO: 877418 - RNA, 15 nt, Mycobacterium avium subsp. paratuberculosis
uccucgaugacgccg

SEQ ID NO: 877419 - RNA, 22 nt, Mycobacterium avium subsp. paratuberculosis
uccucgagagucgcuggcgcgc

SEQ ID NO: 877420 - RNA, 14 nt, Mycobacterium avium subsp. paratuberculosis
uccucgagcaucuc

SEQ ID NO: 877421 - RNA, 13 nt, Mycobacterium avium subsp. paratuberculosis
uccucgagcgcgu

SEQ ID NO: 877422 - RNA, 13 nt, Mycobacterium avium subsp. paratuberculosis
uccucgagcuggc

SEQ ID NO: 877423 - RNA, 23 nt, Mycobacterium avium subsp. paratuberculosis
uccucgacggcgaagccggcguc

SEQ ID NO: 877424 - RNA, 19 nt, Mycobacterium avium subsp. paratuberculosis
uccucgacgguggagcggc

SEQ ID NO: 877425 - RNA, 19 nt, Mycobacterium avium subsp. paratuberculosis
uccugcaccgacugcggcg

SEQ ID NO: 877426 - RNA, 14 nt, Mycobacterium avium subsp. paratuberculosis
uccugcagcgcggc

SEQ ID NO: 877427 - RNA, 15 nt, Mycobacterium avium subsp. paratuberculosis
uccugcagcgcggcg

SEQ ID NO: 877428 - RNA, 16 nt, Mycobacterium avium subsp. paratuberculosis
uccugcacgcgcgggu

SEQ ID NO: 877429 - RNA, 14 nt, Mycobacterium avium subsp. paratuberculosis
uccugcaugccggg

SEQ ID NO: 877430 - RNA, 16 nt, Mycobacterium avium subsp. paratuberculosis
uccugcaugccgggca

SEQ ID NO: 877431 - RNA, 17 nt, Mycobacterium avium subsp. paratuberculosis
uccugcaggaucagcac

SEQ ID NO: 877432 - RNA, 16 nt, Mycobacterium avium subsp. paratuberculosis
uccugcagcucgccgg

SEQ ID NO: 877433 - RNA, 18 nt, Mycobacterium avium subsp. paratuberculosis
uccugcagcucgccggcg

SEQ ID NO: 877434 - RNA, 21 nt, Mycobacterium avium subsp. paratuberculosis
uccugcagcucgccggcgcgc

SEQ ID NO: 877435 - RNA, 18 nt, Mycobacterium avium subsp. paratuberculosis
uccugagguauucgucga

SEQ ID NO: 877436 - RNA, 21 nt, Mycobacterium avium subsp. paratuberculosis
uccugcccggucugcggccgc

SEQ ID NO: 877437 - RNA, 16 nt, Mycobacterium avium subsp. paratuberculosis
uccugcgccgcggugc

SEQ ID NO: 877438 - RNA, 12 nt, Mycobacterium avium subsp. paratuberculosis
uccugcgcgugc

SEQ ID NO: 877439 - RNA, 23 nt, Mycobacterium avium subsp. paratuberculosis
uccugccguucggccagcgccgc

SEQ ID NO: 877440 - RNA, 14 nt, Mycobacterium avium subsp. paratuberculosis
uccugcgaccgccg

SEQ ID NO: 877441 - RNA, 15 nt, Mycobacterium avium subsp. paratuberculosis
uccugcucggcgacg

SEQ ID NO: 877442 - RNA, 12 nt, Mycobacterium avium subsp. paratuberculosis
uccugcuggccg

SEQ ID NO: 877443 - RNA, 14 nt, Mycobacterium avium subsp. paratuberculosis
uccugcuggcgcug

SEQ ID NO: 877444 - RNA, 15 nt, Mycobacterium avium subsp. paratuberculosis
uccugcuggcgcugc

SEQ ID NO: 877445 - RNA, 18 nt, Mycobacterium avium subsp. paratuberculosis
ucgaagaggugcucgacg

SEQ ID NO: 877446 - RNA, 19 nt, Mycobacterium avium subsp. paratuberculosis
ucgaagaggugcucgacgg

SEQ ID NO: 877447 - RNA, 17 nt, Mycobacterium avium subsp. paratuberculosis
ucgaagacgccccaguu

SEQ ID NO: 877448 - RNA, 13 nt, Mycobacterium avium subsp. paratuberculosis
ucgaagaccacga

SEQ ID NO: 877449 - RNA, 14 nt, Mycobacterium avium subsp. paratuberculosis
ucgaagaccacgaa

SEQ ID NO: 877450 - RNA, 15 nt, Mycobacterium avium subsp. paratuberculosis
ucgaacgggccgggc

SEQ ID NO: 877451 - RNA, 20 nt, Mycobacterium avium subsp. paratuberculosis
ucgaacgggccgggcaccgc

SEQ ID NO: 877452 - RNA, 17 nt, Mycobacterium avium subsp. paratuberculosis
ucgaacugcagccggcc

SEQ ID NO: 877453 - RNA, 18 nt, Mycobacterium avium subsp. paratuberculosis
ucgaacgagaaggcggcg

SEQ ID NO: 877454 - RNA, 15 nt, Mycobacterium avium subsp. paratuberculosis
ucgaacgccagcgcc

SEQ ID NO: 877455 - RNA, 17 nt, Mycobacterium avium subsp. paratuberculosis
ucgaacgcggcgccgac

SEQ ID NO: 877456 - RNA, 18 nt, Mycobacterium avium subsp. paratuberculosis
ucgaacgcggcgccgacg

SEQ ID NO: 877457 - RNA, 21 nt, Mycobacterium avium subsp. paratuberculosis
ucgaacgcggcgccgacgucc

SEQ ID NO: 877458 - RNA, 21 nt, Mycobacterium avium subsp. paratuberculosis
ucgaacgcguacacggcccgc

SEQ ID NO: 877459 - RNA, 16 nt, Mycobacterium avium subsp. paratuberculosis
ucgaacggcccggacg

SEQ ID NO: 877460 - RNA, 19 nt, Mycobacterium avium subsp. paratuberculosis
ucgaacggcaccucgauca

SEQ ID NO: 877461 - RNA, 20 nt, Mycobacterium avium subsp. paratuberculosis
ucgaacgcgacgaagcgguc

SEQ ID NO: 877462 - RNA, 19 nt, Mycobacterium avium subsp. paratuberculosis
ucgaagauggucgcgccgc

SEQ ID NO: 877463 - RNA, 21 nt, Mycobacterium avium subsp. paratuberculosis
ucgaagauggucgcgccgcgg

SEQ ID NO: 877464 - RNA, 15 nt, Mycobacterium avium subsp. paratuberculosis
ucgaagcccgugccg

SEQ ID NO: 877465 - RNA, 20 nt, Mycobacterium avium subsp. paratuberculosis
ucgaagcccuucaccucggc

SEQ ID NO: 877466 - RNA, 12 nt, Mycobacterium avium subsp. paratuberculosis
ucgaagccgacg

SEQ ID NO: 877467 - RNA, 14 nt, Mycobacterium avium subsp. paratuberculosis
ucgaagccgaucac

SEQ ID NO: 877468 - RNA, 16 nt, Mycobacterium avium subsp. paratuberculosis
ucgaagccguggcagg

SEQ ID NO: 877469 - RNA, 21 nt, Mycobacterium avium subsp. paratuberculosis
ucgaagcggugcaccaccgug

SEQ ID NO: 877470 - RNA, 14 nt, Mycobacterium avium subsp. paratuberculosis
ucgaaggccgggcu

SEQ ID NO: 877471 - RNA, 16 nt, Mycobacterium avium subsp. paratuberculosis
ucgaaggcgugcucga

SEQ ID NO: 877472 - RNA, 12 nt, Mycobacterium avium subsp. paratuberculosis
ucgaaggccagg

SEQ ID NO: 877473 - RNA, 16 nt, Mycobacterium avium subsp. paratuberculosis
ucgaaggcggccgcga

SEQ ID NO: 877474 - RNA, 18 nt, Mycobacterium avium subsp. paratuberculosis
ucgaaggcggccgcgagc

SEQ ID NO: 877475 - RNA, 16 nt, Mycobacterium avium subsp. paratuberculosis
ucgaaguagagccgcu

SEQ ID NO: 877476 - RNA, 13 nt, Mycobacterium avium subsp. paratuberculosis
ucgaagucgaucc

SEQ ID NO: 877477 - RNA, 13 nt, Mycobacterium avium subsp. paratuberculosis
ucgaagucgccgg

SEQ ID NO: 877478 - RNA, 21 nt, Mycobacterium avium subsp. paratuberculosis
ucgaauccggcggcgcucagc

SEQ ID NO: 877479 - RNA, 16 nt, Mycobacterium avium subsp. paratuberculosis
ucgaaugcgcucaucg

SEQ ID NO: 877480 - RNA, 17 nt, Mycobacterium avium subsp. paratuberculosis
ucgacaggcagcccggc

SEQ ID NO: 877481 - RNA, 18 nt, Mycobacterium avium subsp. paratuberculosis
ucgacagguucuuggcgg

SEQ ID NO: 877482 - RNA, 20 nt, Mycobacterium avium subsp. paratuberculosis
ucgacagguucuuggcggcc

SEQ ID NO: 877483 - RNA, 17 nt, Mycobacterium avium subsp. paratuberculosis
ucgacaccccgcucggc

SEQ ID NO: 877484 - RNA, 20 nt, Mycobacterium avium subsp. paratuberculosis
ucgacaccccgcucggccag

SEQ ID NO: 877485 - RNA, 21 nt, Mycobacterium avium subsp. paratuberculosis
ucgacaccccgcucggccagc

SEQ ID NO: 877486 - RNA, 13 nt, Mycobacterium avium subsp. paratuberculosis
ucgacacgccggc

SEQ ID NO: 877487 - RNA, 18 nt, Mycobacterium avium subsp. paratuberculosis
ucgacacgggccgcgccg

SEQ ID NO: 877488 - RNA, 20 nt, Mycobacterium avium subsp. paratuberculosis
ucgacacgggccgcgccgag

SEQ ID NO: 877489 - RNA, 21 nt, Mycobacterium avium subsp. paratuberculosis
ucgacacgggccgcgccgagg

SEQ ID NO: 877490 - RNA, 17 nt, Mycobacterium avium subsp. paratuberculosis
ucgacaccggcggucac

SEQ ID NO: 877491 - RNA, 15 nt, Mycobacterium avium subsp. paratuberculosis
ucgacaccgguggcg

SEQ ID NO: 877492 - RNA, 22 nt, Mycobacterium avium subsp. paratuberculosis
ucgaccaacuccaccgcccgga

SEQ ID NO: 877493 - RNA, 21 nt, Mycobacterium avium subsp. paratuberculosis
ucgaccaccggguagcccgcg

SEQ ID NO: 877494 - RNA, 21 nt, Mycobacterium avium subsp. paratuberculosis
ucgaccaccgccggcccggcg

SEQ ID NO: 877495 - RNA, 20 nt, Mycobacterium avium subsp. paratuberculosis
ucgaccacccgcagcucgcc

SEQ ID NO: 877496 - RNA, 13 nt, Mycobacterium avium subsp. paratuberculosis
ucgaccacccgcu

SEQ ID NO: 877497 - RNA, 16 nt, Mycobacterium avium subsp. paratuberculosis
ucgaccaccgccggcc

SEQ ID NO: 877498 - RNA, 23 nt, Mycobacterium avium subsp. paratuberculosis
ucgacaugcccggcgacggcgcc

SEQ ID NO: 877499 - RNA, 20 nt, Mycobacterium avium subsp. paratuberculosis
ucgaccaccucuucgcgguc

SEQ ID NO: 877500 - RNA, 18 nt, Mycobacterium avium subsp. paratuberculosis
ucgaccacggccgguccg

SEQ ID NO: 877501 - RNA, 22 nt, Mycobacterium avium subsp. paratuberculosis
ucgaccacgcacaccaccgacg

SEQ ID NO: 877502 - RNA, 14 nt, Mycobacterium avium subsp. paratuberculosis
ucgaccacgcgcca

SEQ ID NO: 877503 - RNA, 18 nt, Mycobacterium avium subsp. paratuberculosis
ucgaccagauugcggcac

SEQ ID NO: 877504 - RNA, 19 nt, Mycobacterium avium subsp. paratuberculosis
ucgaccagauugcggcacc

SEQ ID NO: 877505 - RNA, 24 nt, Mycobacterium avium subsp. paratuberculosis
ucgaccagauugcggcaccagucg

SEQ ID NO: 877506 - RNA, 19 nt, Mycobacterium avium subsp. paratuberculosis
ucgaccagcaccgcauccc

SEQ ID NO: 877507 - RNA, 15 nt, Mycobacterium avium subsp. paratuberculosis
ucgaccagcgccgag

SEQ ID NO: 877508 - RNA, 16 nt, Mycobacterium avium subsp. paratuberculosis
ucgaccagcgccgagg

SEQ ID NO: 877509 - RNA, 16 nt, Mycobacterium avium subsp. paratuberculosis
ucgaccaggacgucgg

SEQ ID NO: 877510 - RNA, 23 nt, Mycobacterium avium subsp. paratuberculosis
ucgaccaggacgucggccggcug

SEQ ID NO: 877511 - RNA, 15 nt, Mycobacterium avium subsp. paratuberculosis
ucgaccagccgcauc

SEQ ID NO: 877512 - RNA, 17 nt, Mycobacterium avium subsp. paratuberculosis
ucgaccagccggguccg

SEQ ID NO: 877513 - RNA, 14 nt, Mycobacterium avium subsp. paratuberculosis
ucgaccagccggua

SEQ ID NO: 877514 - RNA, 13 nt, Mycobacterium avium subsp. paratuberculosis
ucgaccagcgggc

SEQ ID NO: 877515 - RNA, 16 nt, Mycobacterium avium subsp. paratuberculosis
ucgaccagcgggcugu

SEQ ID NO: 877516 - RNA, 21 nt, Mycobacterium avium subsp. paratuberculosis
ucgaccaggcuuggcccgccg

SEQ ID NO: 877517 - RNA, 22 nt, Mycobacterium avium subsp. paratuberculosis
ucgaccagggcgaucaccgcgg

SEQ ID NO: 877518 - RNA, 16 nt, Mycobacterium avium subsp. paratuberculosis
ucgaccaucugccggc

SEQ ID NO: 877519 - RNA, 17 nt, Mycobacterium avium subsp. paratuberculosis
ucgacccccaccgcgac

SEQ ID NO: 877520 - RNA, 18 nt, Mycobacterium avium subsp. paratuberculosis
ucgacccccaccgcgaca

SEQ ID NO: 877521 - RNA, 16 nt, Mycobacterium avium subsp. paratuberculosis
ucgaccccgccggccc

SEQ ID NO: 877522 - RNA, 13 nt, Mycobacterium avium subsp. paratuberculosis
ucgaccgccccgc

SEQ ID NO: 877523 - RNA, 14 nt, Mycobacterium avium subsp. paratuberculosis
ucgaccgccccgcc

SEQ ID NO: 877524 - RNA, 19 nt, Mycobacterium avium subsp. paratuberculosis
ucgacccgcggcgccgcgg

SEQ ID NO: 877525 - RNA, 18 nt, Mycobacterium avium subsp. paratuberculosis
ucgacccgcuccccgauc

SEQ ID NO: 877526 - RNA, 16 nt, Mycobacterium avium subsp. paratuberculosis
ucgacccgcuccgacg

SEQ ID NO: 877527 - RNA, 19 nt, Mycobacterium avium subsp. paratuberculosis
ucgacccgcuccgacgcgg

SEQ ID NO: 877528 - RNA, 20 nt, Mycobacterium avium subsp. paratuberculosis
ucgacccgcuccgacgcggu

SEQ ID NO: 877529 - RNA, 21 nt, Mycobacterium avium subsp. paratuberculosis
ucgacccguuccccggccgac

SEQ ID NO: 877530 - RNA, 15 nt, Mycobacterium avium subsp. paratuberculosis
ucgacccggccgcgc

SEQ ID NO: 877531 - RNA, 16 nt, Mycobacterium avium subsp. paratuberculosis
ucgacccgggccaggu

SEQ ID NO: 877532 - RNA, 12 nt, Mycobacterium avium subsp. paratuberculosis
ucgacccgcauc

SEQ ID NO: 877533 - RNA, 16 nt, Mycobacterium avium subsp. paratuberculosis
ucgacccgcauccgcc

SEQ ID NO: 877534 - RNA, 20 nt, Mycobacterium avium subsp. paratuberculosis
ucgacccgcauccgccgggc

SEQ ID NO: 877535 - RNA, 18 nt, Mycobacterium avium subsp. paratuberculosis
ucgaccgugaggcccggc

SEQ ID NO: 877536 - RNA, 18 nt, Mycobacterium avium subsp. paratuberculosis
ucgaccuccucgaccccg

SEQ ID NO: 877537 - RNA, 19 nt, Mycobacterium avium subsp. paratuberculosis
ucgaccucgcgcgucacgc

SEQ ID NO: 877538 - RNA, 12 nt, Mycobacterium avium subsp. paratuberculosis
ucgaccucggcg

SEQ ID NO: 877539 - RNA, 15 nt, Mycobacterium avium subsp. paratuberculosis
ucgaccucggcgacc

SEQ ID NO: 877540 - RNA, 13 nt, Mycobacterium avium subsp. paratuberculosis
ucgaccucggcgg

SEQ ID NO: 877541 - RNA, 13 nt, Mycobacterium avium subsp. paratuberculosis
ucgaccucgucgg

SEQ ID NO: 877542 - RNA, 15 nt, Mycobacterium avium subsp. paratuberculosis
ucgaccugcccgggc

SEQ ID NO: 877543 - RNA, 21 nt, Mycobacterium avium subsp. paratuberculosis
ucgaccugcccgggcccgaug

SEQ ID NO: 877544 - RNA, 16 nt, Mycobacterium avium subsp. paratuberculosis
ucgaccucgucggcgg

SEQ ID NO: 877545 - RNA, 19 nt, Mycobacterium avium subsp. paratuberculosis
ucgaccucgucggcggcga

SEQ ID NO: 877546 - RNA, 14 nt, Mycobacterium avium subsp. paratuberculosis
ucgaccgcgguggc

SEQ ID NO: 877547 - RNA, 15 nt, Mycobacterium avium subsp. paratuberculosis
ucgaccgcgguggcg

SEQ ID NO: 877548 - RNA, 18 nt, Mycobacterium avium subsp. paratuberculosis
ucgaccgcgguggcggug

SEQ ID NO: 877549 - RNA, 12 nt, Mycobacterium avium subsp. paratuberculosis
ucgaccggggcg

SEQ ID NO: 877550 - RNA, 13 nt, Mycobacterium avium subsp. paratuberculosis
ucgaccggguccg

SEQ ID NO: 877551 - RNA, 16 nt, Mycobacterium avium subsp. paratuberculosis
ucgaccggguuggcgc

SEQ ID NO: 877552 - RNA, 19 nt, Mycobacterium avium subsp. paratuberculosis
ucgaccggguuggcgcgca

SEQ ID NO: 877553 - RNA, 22 nt, Mycobacterium avium subsp. paratuberculosis
ucgaccggguuggcgcgcacca

SEQ ID NO: 877554 - RNA, 22 nt, Mycobacterium avium subsp. paratuberculosis
ucgaccgcgacgaccucgcccg

SEQ ID NO: 877555 - RNA, 16 nt, Mycobacterium avium subsp. paratuberculosis
ucgaccgcgcaccggc

SEQ ID NO: 877556 - RNA, 17 nt, Mycobacterium avium subsp. paratuberculosis
ucgaccgcgcaccggcg

SEQ ID NO: 877557 - RNA, 12 nt, Mycobacterium avium subsp. paratuberculosis
ucgaccgccgcg

SEQ ID NO: 877558 - RNA, 15 nt, Mycobacterium avium subsp. paratuberculosis
ucgaccgccgcgaac

SEQ ID NO: 877559 - RNA, 14 nt, Mycobacterium avium subsp. paratuberculosis
ucgaccgccgcguc

SEQ ID NO: 877560 - RNA, 14 nt, Mycobacterium avium subsp. paratuberculosis
ucgaccgcgccggg

SEQ ID NO: 877561 - RNA, 13 nt, Mycobacterium avium subsp. paratuberculosis
ucgaccgccacca

SEQ ID NO: 877562 - RNA, 14 nt, Mycobacterium avium subsp. paratuberculosis
ucgaccgcggcgcc

SEQ ID NO: 877563 - RNA, 21 nt, Mycobacterium avium subsp. paratuberculosis
ucgaccgcggcuccggccgcg

SEQ ID NO: 877564 - RNA, 14 nt, Mycobacterium avium subsp. paratuberculosis
ucgacgaugcgcug

SEQ ID NO: 877565 - RNA, 19 nt, Mycobacterium avium subsp. paratuberculosis
ucgacgaugcgcugcuguu

SEQ ID NO: 877566 - RNA, 16 nt, Mycobacterium avium subsp. paratuberculosis
ucgacgaugcguucgg

SEQ ID NO: 877567 - RNA, 23 nt, Mycobacterium avium subsp. paratuberculosis
ucgacgaucucgugggucagcuu

SEQ ID NO: 877568 - RNA, 20 nt, Mycobacterium avium subsp. paratuberculosis
ucgacgaucuugccgaacag

SEQ ID NO: 877569 - RNA, 24 nt, Mycobacterium avium subsp. paratuberculosis
ucgacgaucuugccgaacaggcgc

SEQ ID NO: 877570 - RNA, 19 nt, Mycobacterium avium subsp. paratuberculosis
ucgacgaugaaauccggga

SEQ ID NO: 877571 - RNA, 16 nt, Mycobacterium avium subsp. paratuberculosis
ucgacgaucagcacgu

SEQ ID NO: 877572 - RNA, 15 nt, Mycobacterium avium subsp. paratuberculosis
ucgacgagcccgccg

SEQ ID NO: 877573 - RNA, 17 nt, Mycobacterium avium subsp. paratuberculosis
ucgacgagcccgccggc

SEQ ID NO: 877574 - RNA, 15 nt, Mycobacterium avium subsp. paratuberculosis
ucgacgagcccgcgc

SEQ ID NO: 877575 - RNA, 19 nt, Mycobacterium avium subsp. paratuberculosis
ucgacgagcccgcgcccau

SEQ ID NO: 877576 - RNA, 12 nt, Mycobacterium avium subsp. paratuberculosis
ucgacgagccgg

SEQ ID NO: 877577 - RNA, 15 nt, Mycobacterium avium subsp. paratuberculosis
ucgacgagccgggcc

SEQ ID NO: 877578 - RNA, 15 nt, Mycobacterium avium subsp. paratuberculosis
ucgacgaggcgggcg

SEQ ID NO: 877579 - RNA, 19 nt, Mycobacterium avium subsp. paratuberculosis
ucgacgacggcgccgcguc

SEQ ID NO: 877580 - RNA, 22 nt, Mycobacterium avium subsp. paratuberculosis
ucgacgacggcgccgcgucgga

SEQ ID NO: 877581 - RNA, 14 nt, Mycobacterium avium subsp. paratuberculosis
ucgacgacguugcg

SEQ ID NO: 877582 - RNA, 19 nt, Mycobacterium avium subsp. paratuberculosis
ucgacgacccguaggagcu

SEQ ID NO: 877583 - RNA, 22 nt, Mycobacterium avium subsp. paratuberculosis
ucgacgacgaaucccgccucgg

SEQ ID NO: 877584 - RNA, 13 nt, Mycobacterium avium subsp. paratuberculosis
ucgacgacgccag

SEQ ID NO: 877585 - RNA, 21 nt, Mycobacterium avium subsp. paratuberculosis
ucgaccuuggggucaccgucc

SEQ ID NO: 877586 - RNA, 17 nt, Mycobacterium avium subsp. paratuberculosis
ucgacgaagaaggacgc

SEQ ID NO: 877587 - RNA, 20 nt, Mycobacterium avium subsp. paratuberculosis
ucgacgaagaaggacgccuc

SEQ ID NO: 877588 - RNA, 15 nt, Mycobacterium avium subsp. paratuberculosis
ucgacgaacgcggcg

SEQ ID NO: 877589 - RNA, 16 nt, Mycobacterium avium subsp. paratuberculosis
ucgacgaacgcggcgg

SEQ ID NO: 877590 - RNA, 16 nt, Mycobacterium avium subsp. paratuberculosis
ucgaccuucgagccgc

SEQ ID NO: 877591 - RNA, 23 nt, Mycobacterium avium subsp. paratuberculosis
ucgaccuucgagccgccgccggc

SEQ ID NO: 877592 - RNA, 21 nt, Mycobacterium avium subsp. paratuberculosis
uccgcuguucggguagacgau

SEQ ID NO: 877593 - RNA, 17 nt, Mycobacterium avium subsp. paratuberculosis
uccgcuggugcgcgccg

SEQ ID NO: 877594 - RNA, 17 nt, Mycobacterium avium subsp. paratuberculosis
uccgcuggggcccagcu

SEQ ID NO: 877595 - RNA, 17 nt, Mycobacterium avium subsp. paratuberculosis
uccgcgauggccuccga

SEQ ID NO: 877596 - RNA, 16 nt, Mycobacterium avium subsp. paratuberculosis
uccggaagccgucggu

SEQ ID NO: 877597 - RNA, 13 nt, Mycobacterium avium subsp. paratuberculosis
uccggaaccgggc

SEQ ID NO: 877598 - RNA, 22 nt, Mycobacterium avium subsp. paratuberculosis
uccggcacugaaggcgcgggca

SEQ ID NO: 877599 - RNA, 15 nt, Mycobacterium avium subsp. paratuberculosis
uccggcacccgccag

SEQ ID NO: 877600 - RNA, 13 nt, Mycobacterium avium subsp. paratuberculosis
uccggcaggccgc

SEQ ID NO: 877601 - RNA, 23 nt, Mycobacterium avium subsp. paratuberculosis
uccggcagcagcgagucgaagcc

SEQ ID NO: 877602 - RNA, 15 nt, Mycobacterium avium subsp. paratuberculosis
uccgggaggccagca

SEQ ID NO: 877603 - RNA, 14 nt, Mycobacterium avium subsp. paratuberculosis
uccgggcccaccag

SEQ ID NO: 877604 - RNA, 16 nt, Mycobacterium avium subsp. paratuberculosis
uccgggaugacaccgc

SEQ ID NO: 877605 - RNA, 13 nt, Mycobacterium avium subsp. paratuberculosis
uccgggccgccgc

SEQ ID NO: 877606 - RNA, 18 nt, Mycobacterium avium subsp. paratuberculosis
uccgggccgccucgaagu

SEQ ID NO: 877607 - RNA, 21 nt, Mycobacterium avium subsp. paratuberculosis
uccgguaggccggccgcagcu

SEQ ID NO: 877608 - RNA, 20 nt, Mycobacterium avium subsp. paratuberculosis
uccggcuucaccgucagggu

SEQ ID NO: 877609 - RNA, 14 nt, Mycobacterium avium subsp. paratuberculosis
uccggcugagcagc

SEQ ID NO: 877610 - RNA, 16 nt, Mycobacterium avium subsp. paratuberculosis
uccggcugagcgucgg

SEQ ID NO: 877611 - RNA, 20 nt, Mycobacterium avium subsp. paratuberculosis
uccggcggacccagcuccuc

SEQ ID NO: 877612 - RNA, 18 nt, Mycobacterium avium subsp. paratuberculosis
uccggcggcaccacccgc

SEQ ID NO: 877613 - RNA, 12 nt, Mycobacterium avium subsp. paratuberculosis
uccggcggcagc

SEQ ID NO: 877614 - RNA, 17 nt, Mycobacterium avium subsp. paratuberculosis
uccggcggcagccaggc

SEQ ID NO: 877615 - RNA, 19 nt, Mycobacterium avium subsp. paratuberculosis
uccggcggcagguggucgg

SEQ ID NO: 877616 - RNA, 22 nt, Mycobacterium avium subsp. paratuberculosis
uccggcgcgcagcaauugacgc

SEQ ID NO: 877617 - RNA, 14 nt, Mycobacterium avium subsp. paratuberculosis
uccggcgcgccgcg

SEQ ID NO: 877618 - RNA, 15 nt, Mycobacterium avium subsp. paratuberculosis
uccggcgcgccgcga

SEQ ID NO: 877619 - RNA, 14 nt, Mycobacterium avium subsp. paratuberculosis
uccggcgcgaccag

SEQ ID NO: 877620 - RNA, 21 nt, Mycobacterium avium subsp. paratuberculosis
uccggcgcgaccagguucucg

SEQ ID NO: 877621 - RNA, 14 nt, Mycobacterium avium subsp. paratuberculosis
uccggcgcccgauc

SEQ ID NO: 877622 - RNA, 23 nt, Mycobacterium avium subsp. paratuberculosis
uccggcgcccggcuccccgacca

SEQ ID NO: 877623 - RNA, 16 nt, Mycobacterium avium subsp. paratuberculosis
uccggcgccgaccccc

SEQ ID NO: 877624 - RNA, 19 nt, Mycobacterium avium subsp. paratuberculosis
uccggcgccgcgggcgccg

SEQ ID NO: 877625 - RNA, 13 nt, Mycobacterium avium subsp. paratuberculosis
uccggcgccgguc

SEQ ID NO: 877626 - RNA, 19 nt, Mycobacterium avium subsp. paratuberculosis
uccggcgccggucagcggc

SEQ ID NO: 877627 - RNA, 15 nt, Mycobacterium avium subsp. paratuberculosis
uccggcgccagcccg

SEQ ID NO: 877628 - RNA, 16 nt, Mycobacterium avium subsp. paratuberculosis
uccggcccuggucggc

SEQ ID NO: 877629 - RNA, 12 nt, Mycobacterium avium subsp. paratuberculosis
uccggccccgag

SEQ ID NO: 877630 - RNA, 20 nt, Mycobacterium avium subsp. paratuberculosis
uccggccccgagccgacgau

SEQ ID NO: 877631 - RNA, 22 nt, Mycobacterium avium subsp. paratuberculosis
uccggccccgagccgacgauga

SEQ ID NO: 877632 - RNA, 20 nt, Mycobacterium avium subsp. paratuberculosis
uccggccccgcugccguccg

SEQ ID NO: 877633 - RNA, 20 nt, Mycobacterium avium subsp. paratuberculosis
uccggcccgagcaccaccag

SEQ ID NO: 877634 - RNA, 22 nt, Mycobacterium avium subsp. paratuberculosis
uccggcccgaucgcggcgagcu

SEQ ID NO: 877635 - RNA, 14 nt, Mycobacterium avium subsp. paratuberculosis
uccggcccggcguc

SEQ ID NO: 877636 - RNA, 16 nt, Mycobacterium avium subsp. paratuberculosis
uccggcccggcguccg

SEQ ID NO: 877637 - RNA, 15 nt, Mycobacterium avium subsp. paratuberculosis
uccggcccggcgucg

SEQ ID NO: 877638 - RNA, 14 nt, Mycobacterium avium subsp. paratuberculosis
uccggcccggggac

SEQ ID NO: 877639 - RNA, 20 nt, Mycobacterium avium subsp. paratuberculosis
uccggcccggggacacccuc

SEQ ID NO: 877640 - RNA, 21 nt, Mycobacterium avium subsp. paratuberculosis
uccggcccggggacacccucg

SEQ ID NO: 877641 - RNA, 19 nt, Mycobacterium avium subsp. paratuberculosis
uccguugugccaccgccga

SEQ ID NO: 877642 - RNA, 17 nt, Mycobacterium avium subsp. paratuberculosis
uccgugcuugcccgacg

SEQ ID NO: 877643 - RNA, 17 nt, Mycobacterium avium subsp. paratuberculosis
uccguggacggcgagcg

SEQ ID NO: 877644 - RNA, 21 nt, Mycobacterium avium subsp. paratuberculosis
uccuacggcgggugcgacggc

SEQ ID NO: 877645 - RNA, 19 nt, Mycobacterium avium subsp. paratuberculosis
uccuccccgcuggcgccgg

SEQ ID NO: 877646 - RNA, 13 nt, Mycobacterium avium subsp. paratuberculosis
uccuccaaagcgg

SEQ ID NO: 877647 - RNA, 19 nt, Mycobacterium avium subsp. paratuberculosis
uccucccagcccucgucga

SEQ ID NO: 877648 - RNA, 19 nt, Mycobacterium avium subsp. paratuberculosis
uccucgaccagcgcgccgc

SEQ ID NO: 877649 - RNA, 14 nt, Mycobacterium avium subsp. paratuberculosis
uccucgaccccgaa

SEQ ID NO: 877650 - RNA, 19 nt, Mycobacterium avium subsp. paratuberculosis
uccucgaaccucgcggcgg

SEQ ID NO: 877651 - RNA, 18 nt, Mycobacterium avium subsp. paratuberculosis
uccucgaauccgcgggcg

SEQ ID NO: 877652 - RNA, 23 nt, Mycobacterium avium subsp. paratuberculosis
uccucgaccacgcacaccaccga

SEQ ID NO: 877653 - RNA, 16 nt, Mycobacterium avium subsp. paratuberculosis
uccucgaaagccgcug

SEQ ID NO: 877654 - RNA, 14 nt, Mycobacterium avium subsp. paratuberculosis
uccucgaacaccgc

SEQ ID NO: 877655 - RNA, 16 nt, Mycobacterium avium subsp. paratuberculosis
uccuccucggccagcc

SEQ ID NO: 877656 - RNA, 17 nt, Mycobacterium avium subsp. paratuberculosis
uccuccucggcgcggau

SEQ ID NO: 877657 - RNA, 18 nt, Mycobacterium avium subsp. paratuberculosis
uccuccgggcugaccucg

SEQ ID NO: 877658 - RNA, 17 nt, Mycobacterium avium subsp. paratuberculosis
uccguagugcucggcgu

SEQ ID NO: 877659 - RNA, 15 nt, Mycobacterium avium subsp. paratuberculosis
uccgucagcgccgcc

SEQ ID NO: 877660 - RNA, 18 nt, Mycobacterium avium subsp. paratuberculosis
uccgucagcgccgcccgc

SEQ ID NO: 877661 - RNA, 19 nt, Mycobacterium avium subsp. paratuberculosis
uccgucuuguuggucagcc

SEQ ID NO: 877662 - RNA, 22 nt, Mycobacterium avium subsp. paratuberculosis
uccgucgagucggccaccgcgg

SEQ ID NO: 877663 - RNA, 23 nt, Mycobacterium avium subsp. paratuberculosis
uccgucgagucggccaccgcggu

SEQ ID NO: 877664 - RNA, 13 nt, Mycobacterium avium subsp. paratuberculosis
uccgugccacggc

SEQ ID NO: 877665 - RNA, 21 nt, Mycobacterium avium subsp. paratuberculosis
uccgugagggaccuccagcgg

SEQ ID NO: 877666 - RNA, 13 nt, Mycobacterium avium subsp. paratuberculosis
uccgugaccccgg

SEQ ID NO: 877667 - RNA, 14 nt, Mycobacterium avium subsp. paratuberculosis
uccggugccacgcg

SEQ ID NO: 877668 - RNA, 16 nt, Mycobacterium avium subsp. paratuberculosis
uccggugccacgcggc

SEQ ID NO: 877669 - RNA, 17 nt, Mycobacterium avium subsp. paratuberculosis
uccggugccgagcgcgc

SEQ ID NO: 877670 - RNA, 18 nt, Mycobacterium avium subsp. paratuberculosis
uccggugccgagcgcgcu

SEQ ID NO: 877671 - RNA, 23 nt, Mycobacterium avium subsp. paratuberculosis
uccggugaccgccucgucgaagg

SEQ ID NO: 877672 - RNA, 20 nt, Mycobacterium avium subsp. paratuberculosis
uccgguggacuccagcacca

SEQ ID NO: 877673 - RNA, 14 nt, Mycobacterium avium subsp. paratuberculosis
uccgguugcaccgc

SEQ ID NO: 877674 - RNA, 15 nt, Mycobacterium avium subsp. paratuberculosis
uccgguugcggcagc

SEQ ID NO: 877675 - RNA, 16 nt, Mycobacterium avium subsp. paratuberculosis
uccgguugcggcagca

SEQ ID NO: 877676 - RNA, 17 nt, Mycobacterium avium subsp. paratuberculosis
uccggucgaucaccucg

SEQ ID NO: 877677 - RNA, 19 nt, Mycobacterium avium subsp. paratuberculosis
uccggucgaugaauuccgg

SEQ ID NO: 877678 - RNA, 19 nt, Mycobacterium avium subsp. paratuberculosis
uccggucucggucgcggcg

SEQ ID NO: 877679 - RNA, 19 nt, Mycobacterium avium subsp. paratuberculosis
uccggugaaccgcugacca

SEQ ID NO: 877680 - RNA, 14 nt, Mycobacterium avium subsp. paratuberculosis
uccggucacgcccg

SEQ ID NO: 877681 - RNA, 16 nt, Mycobacterium avium subsp. paratuberculosis
uccggucacgcccggg

SEQ ID NO: 877682 - RNA, 15 nt, Mycobacterium avium subsp. paratuberculosis
uccggucagaccuuc

SEQ ID NO: 877683 - RNA, 12 nt, Mycobacterium avium subsp. paratuberculosis
uccggucagcac

SEQ ID NO: 877684 - RNA, 15 nt, Mycobacterium avium subsp. paratuberculosis
uccggucagcaccgc

SEQ ID NO: 877685 - RNA, 19 nt, Mycobacterium avium subsp. paratuberculosis
uccggucagcguggcgucg

SEQ ID NO: 877686 - RNA, 15 nt, Mycobacterium avium subsp. paratuberculosis
uccggucagggcucg

SEQ ID NO: 877687 - RNA, 20 nt, Mycobacterium avium subsp. paratuberculosis
uccgguccagaucggcgcgc

SEQ ID NO: 877688 - RNA, 21 nt, Mycobacterium avium subsp. paratuberculosis
uccgguccagaucggcgcgcg

SEQ ID NO: 877689 - RNA, 14 nt, Mycobacterium avium subsp. paratuberculosis
uccgguccagcccg

SEQ ID NO: 877690 - RNA, 20 nt, Mycobacterium avium subsp. paratuberculosis
uccaugcuggugccgccgau

SEQ ID NO: 877691 - RNA, 23 nt, Mycobacterium avium subsp. paratuberculosis
uccaugucgcaacggucgggauc

SEQ ID NO: 877692 - RNA, 19 nt, Mycobacterium avium subsp. paratuberculosis
uccauggccuugacgucgg

SEQ ID NO: 877693 - RNA, 13 nt, Mycobacterium avium subsp. paratuberculosis
uccauggucgagc

SEQ ID NO: 877694 - RNA, 18 nt, Mycobacterium avium subsp. paratuberculosis
ucccgccgucucgaccac

SEQ ID NO: 877695 - RNA, 17 nt, Mycobacterium avium subsp. paratuberculosis
ucccgccggcgaucgac

SEQ ID NO: 877696 - RNA, 19 nt, Mycobacterium avium subsp. paratuberculosis
ucccgccggcgaucgacgu

SEQ ID NO: 877697 - RNA, 16 nt, Mycobacterium avium subsp. paratuberculosis
ucccgccgggcaucuc

SEQ ID NO: 877698 - RNA, 16 nt, Mycobacterium avium subsp. paratuberculosis
ucccgccgccgaacag

SEQ ID NO: 877699 - RNA, 17 nt, Mycobacterium avium subsp. paratuberculosis
ucccgccgccgaacagc

SEQ ID NO: 877700 - RNA, 13 nt, Mycobacterium avium subsp. paratuberculosis
ucccgcagccgcg

SEQ ID NO: 877701 - RNA, 17 nt, Mycobacterium avium subsp. paratuberculosis
ucccgcagccgcgacgg

SEQ ID NO: 877702 - RNA, 22 nt, Mycobacterium avium subsp. paratuberculosis
ucccgcagcgccagcgcgcccg

SEQ ID NO: 877703 - RNA, 15 nt, Mycobacterium avium subsp. paratuberculosis
ucccgccgaacccgc

SEQ ID NO: 877704 - RNA, 19 nt, Mycobacterium avium subsp. paratuberculosis
ucccgcccggcgccggccg

SEQ ID NO: 877705 - RNA, 22 nt, Mycobacterium avium subsp. paratuberculosis
ucccgccgacggagacgaccag

SEQ ID NO: 877706 - RNA, 16 nt, Mycobacterium avium subsp. paratuberculosis
ucccuccggcaggccg

SEQ ID NO: 877707 - RNA, 21 nt, Mycobacterium avium subsp. paratuberculosis
ucccuagcgugccguccagcu

SEQ ID NO: 877708 - RNA, 14 nt, Mycobacterium avium subsp. paratuberculosis
ucccguuggcgccg

SEQ ID NO: 877709 - RNA, 16 nt, Mycobacterium avium subsp. paratuberculosis
ucccguuggcgccggu

SEQ ID NO: 877710 - RNA, 15 nt, Mycobacterium avium subsp. paratuberculosis
ucccgugcuggccau

SEQ ID NO: 877711 - RNA, 15 nt, Mycobacterium avium subsp. paratuberculosis
ucccgugcgccgccc

SEQ ID NO: 877712 - RNA, 15 nt, Mycobacterium avium subsp. paratuberculosis
ucccgucgucggcgc

SEQ ID NO: 877713 - RNA, 22 nt, Mycobacterium avium subsp. paratuberculosis
ucccgucgucggcgccgcgccg

SEQ ID NO: 877714 - RNA, 12 nt, Mycobacterium avium subsp. paratuberculosis
ucccgucguuga

SEQ ID NO: 877715 - RNA, 12 nt, Mycobacterium avium subsp. paratuberculosis
ucccgucgcgac

SEQ ID NO: 877716 - RNA, 15 nt, Mycobacterium avium subsp. paratuberculosis
ucccgucgcgacgag

SEQ ID NO: 877717 - RNA, 19 nt, Mycobacterium avium subsp. paratuberculosis
ucccgucggccaucagccg

SEQ ID NO: 877718 - RNA, 21 nt, Mycobacterium avium subsp. paratuberculosis
ucccgucggccaucagccgcc

SEQ ID NO: 877719 - RNA, 14 nt, Mycobacterium avium subsp. paratuberculosis
ucccgucaggucgc

SEQ ID NO: 877720 - RNA, 18 nt, Mycobacterium avium subsp. paratuberculosis
ucccgucaggucgcggua

SEQ ID NO: 877721 - RNA, 14 nt, Mycobacterium avium subsp. paratuberculosis
ucccgucacggcug

SEQ ID NO: 877722 - RNA, 20 nt, Mycobacterium avium subsp. paratuberculosis
ucccgucacggcugccgacc

SEQ ID NO: 877723 - RNA, 19 nt, Mycobacterium avium subsp. paratuberculosis
ucccguccaucgccgcgca

SEQ ID NO: 877724 - RNA, 13 nt, Mycobacterium avium subsp. paratuberculosis
ucccggccacguc

SEQ ID NO: 877725 - RNA, 14 nt, Mycobacterium avium subsp. paratuberculosis
ucccggccacgucg

SEQ ID NO: 877726 - RNA, 19 nt, Mycobacterium avium subsp. paratuberculosis
ucccggccacgucgaugcc

SEQ ID NO: 877727 - RNA, 16 nt, Mycobacterium avium subsp. paratuberculosis
ucccggccagcacccg

SEQ ID NO: 877728 - RNA, 19 nt, Mycobacterium avium subsp. paratuberculosis
ucccggccagcacccgcug

SEQ ID NO: 877729 - RNA, 21 nt, Mycobacterium avium subsp. paratuberculosis
ucccggcagaacgacgccagu

SEQ ID NO: 877730 - RNA, 16 nt, Mycobacterium avium subsp. paratuberculosis
ucccggccagcgcagu

SEQ ID NO: 877731 - RNA, 17 nt, Mycobacterium avium subsp. paratuberculosis
ucccggccagcgcagug

SEQ ID NO: 877732 - RNA, 21 nt, Mycobacterium avium subsp. paratuberculosis
ucccggcagaucgcggcccgc

SEQ ID NO: 877733 - RNA, 23 nt, Mycobacterium avium subsp. paratuberculosis
ucccggcagaucgcggcccgccg

SEQ ID NO: 877734 - RNA, 22 nt, Mycobacterium avium subsp. paratuberculosis
ucccgcgcgcaggcacucgcgc

SEQ ID NO: 877735 - RNA, 12 nt, Mycobacterium avium subsp. paratuberculosis
ucccgcgccgcg

SEQ ID NO: 877736 - RNA, 16 nt, Mycobacterium avium subsp. paratuberculosis
ucccggcggucgccga

SEQ ID NO: 877737 - RNA, 23 nt, Mycobacterium avium subsp. paratuberculosis
ucccggcggacccggaggcggcg

SEQ ID NO: 877738 - RNA, 13 nt, Mycobacterium avium subsp. paratuberculosis
ucccggccgacga

SEQ ID NO: 877739 - RNA, 19 nt, Mycobacterium avium subsp. paratuberculosis
ucccggcccauggcgaaca

SEQ ID NO: 877740 - RNA, 20 nt, Mycobacterium avium subsp. paratuberculosis
ucccggcgagcacgccgccg

SEQ ID NO: 877741 - RNA, 13 nt, Mycobacterium avium subsp. paratuberculosis
ucccggcgcagca

SEQ ID NO: 877742 - RNA, 21 nt, Mycobacterium avium subsp. paratuberculosis
ucccggcgccacgccgcgauc

SEQ ID NO: 877743 - RNA, 14 nt, Mycobacterium avium subsp. paratuberculosis
ucccggcgccgccg

SEQ ID NO: 877744 - RNA, 15 nt, Mycobacterium avium subsp. paratuberculosis
ucccggcgccgccgu

SEQ ID NO: 877745 - RNA, 15 nt, Mycobacterium avium subsp. paratuberculosis
uccgcgacgacacca

SEQ ID NO: 877746 - RNA, 20 nt, Mycobacterium avium subsp. paratuberculosis
uccgcgacgacaccaccgug

SEQ ID NO: 877747 - RNA, 15 nt, Mycobacterium avium subsp. paratuberculosis
uccgcgacgccaaca

SEQ ID NO: 877748 - RNA, 17 nt, Mycobacterium avium subsp. paratuberculosis
uccgcgacaaggucgac

SEQ ID NO: 877749 - RNA, 21 nt, Mycobacterium avium subsp. paratuberculosis
uccgcgacaaggucgaccgcg

SEQ ID NO: 877750 - RNA, 22 nt, Mycobacterium avium subsp. paratuberculosis
uccgcgacaaggucgaccgcgc

SEQ ID NO: 877751 - RNA, 20 nt, Mycobacterium avium subsp. paratuberculosis
uccgcgacaucggcgccgac

SEQ ID NO: 877752 - RNA, 22 nt, Mycobacterium avium subsp. paratuberculosis
uccgcgacaucggugaccgucg

SEQ ID NO: 877753 - RNA, 22 nt, Mycobacterium avium subsp. paratuberculosis
uccgcgacgcugagcgccaggc

SEQ ID NO: 877754 - RNA, 15 nt, Mycobacterium avium subsp. paratuberculosis
uccgcgagccgagcc

SEQ ID NO: 877755 - RNA, 17 nt, Mycobacterium avium subsp. paratuberculosis
uccgcgagccgagccgg

SEQ ID NO: 877756 - RNA, 19 nt, Mycobacterium avium subsp. paratuberculosis
uccgcgaucagcucguggc

SEQ ID NO: 877757 - RNA, 21 nt, Mycobacterium avium subsp. paratuberculosis
uccgcgaucagcucguggcgg

SEQ ID NO: 877758 - RNA, 19 nt, Mycobacterium avium subsp. paratuberculosis
uccgccugcccuugaagcg

SEQ ID NO: 877759 - RNA, 16 nt, Mycobacterium avium subsp. paratuberculosis
uccgccugcgcgggcg

SEQ ID NO: 877760 - RNA, 12 nt, Mycobacterium avium subsp. paratuberculosis
uccgccgcgccc

SEQ ID NO: 877761 - RNA, 13 nt, Mycobacterium avium subsp. paratuberculosis
uccgccgcgcccg

SEQ ID NO: 877762 - RNA, 16 nt, Mycobacterium avium subsp. paratuberculosis
uccgccgcgcccgucg

SEQ ID NO: 877763 - RNA, 20 nt, Mycobacterium avium subsp. paratuberculosis
uccgccgccgucccaccggc

SEQ ID NO: 877764 - RNA, 14 nt, Mycobacterium avium subsp. paratuberculosis
uccgccgccggcgg

SEQ ID NO: 877765 - RNA, 23 nt, Mycobacterium avium subsp. paratuberculosis
uccgccgccgggccuguccagcc

SEQ ID NO: 877766 - RNA, 21 nt, Mycobacterium avium subsp. paratuberculosis
uccgccgaaccgaucaccggc

SEQ ID NO: 877767 - RNA, 16 nt, Mycobacterium avium subsp. paratuberculosis
uccgccgacagcggga

SEQ ID NO: 877768 - RNA, 19 nt, Mycobacterium avium subsp. paratuberculosis
uccgccgagacggcguggc

SEQ ID NO: 877769 - RNA, 13 nt, Mycobacterium avium subsp. paratuberculosis
uccgccgagucgc

SEQ ID NO: 877770 - RNA, 19 nt, Mycobacterium avium subsp. paratuberculosis
uccgccgagucgcgccgcg

SEQ ID NO: 877771 - RNA, 19 nt, Mycobacterium avium subsp. paratuberculosis
uccgcagauagaucgacgc

SEQ ID NO: 877772 - RNA, 15 nt, Mycobacterium avium subsp. paratuberculosis
uccgcacccgggccc

SEQ ID NO: 877773 - RNA, 23 nt, Mycobacterium avium subsp. paratuberculosis
uccgcaccgagaccaugccgccg

SEQ ID NO: 877774 - RNA, 14 nt, Mycobacterium avium subsp. paratuberculosis
uccgcagcccgucg

SEQ ID NO: 877775 - RNA, 17 nt, Mycobacterium avium subsp. paratuberculosis
uccgcagcccgucgauc

SEQ ID NO: 877776 - RNA, 20 nt, Mycobacterium avium subsp. paratuberculosis
uccgcagcccgucgaucccg

SEQ ID NO: 877777 - RNA, 16 nt, Mycobacterium avium subsp. paratuberculosis
uccgcagcaccagggu

SEQ ID NO: 877778 - RNA, 13 nt, Mycobacterium avium subsp. paratuberculosis
uccgcagccgcug

SEQ ID NO: 877779 - RNA, 18 nt, Mycobacterium avium subsp. paratuberculosis
uccgcaggccgucgccgg

SEQ ID NO: 877780 - RNA, 18 nt, Mycobacterium avium subsp. paratuberculosis
uccgcaugcccgggcgac

SEQ ID NO: 877781 - RNA, 23 nt, Mycobacterium avium subsp. paratuberculosis
uccgccccgagaucccagcggga

SEQ ID NO: 877782 - RNA, 22 nt, Mycobacterium avium subsp. paratuberculosis
uccgccccgcugccggaccucg

SEQ ID NO: 877783 - RNA, 20 nt, Mycobacterium avium subsp. paratuberculosis
uccgcccggaccaggguggc

SEQ ID NO: 877784 - RNA, 15 nt, Mycobacterium avium subsp. paratuberculosis
uccgcccggcccgca

SEQ ID NO: 877785 - RNA, 15 nt, Mycobacterium avium subsp. paratuberculosis
uccgcccggcgagca

SEQ ID NO: 877786 - RNA, 23 nt, Mycobacterium avium subsp. paratuberculosis
uccgcccgggugcaggcccagcu

SEQ ID NO: 877787 - RNA, 16 nt, Mycobacterium avium subsp. paratuberculosis
uccgaggucagcgcgu

SEQ ID NO: 877788 - RNA, 24 nt, Mycobacterium avium subsp. paratuberculosis
uccgaggcgguuccgguggcgcga

SEQ ID NO: 877789 - RNA, 14 nt, Mycobacterium avium subsp. paratuberculosis
uccgaggcgucagg

SEQ ID NO: 877790 - RNA, 15 nt, Mycobacterium avium subsp. paratuberculosis
uccgagcggcgcagg

SEQ ID NO: 877791 - RNA, 18 nt, Mycobacterium avium subsp. paratuberculosis
uccgaggccccgccagau

SEQ ID NO: 877792 - RNA, 14 nt, Mycobacterium avium subsp. paratuberculosis
uccgaggccgcuga

SEQ ID NO: 877793 - RNA, 21 nt, Mycobacterium avium subsp. paratuberculosis
uccgagcagcagccgcagcgg

SEQ ID NO: 877794 - RNA, 12 nt, Mycobacterium avium subsp. paratuberculosis
uccgagccgccc

SEQ ID NO: 877795 - RNA, 14 nt, Mycobacterium avium subsp. paratuberculosis
uccgacgugccgug

SEQ ID NO: 877796 - RNA, 15 nt, Mycobacterium avium subsp. paratuberculosis
uccgagccgguggag

SEQ ID NO: 877797 - RNA, 15 nt, Mycobacterium avium subsp. paratuberculosis
uccgaauacgccauc

SEQ ID NO: 877798 - RNA, 15 nt, Mycobacterium avium subsp. paratuberculosis
uccgaauccagcgcg

SEQ ID NO: 877799 - RNA, 19 nt, Mycobacterium avium subsp. paratuberculosis
uccgacggcuggguggcga

SEQ ID NO: 877800 - RNA, 13 nt, Mycobacterium avium subsp. paratuberculosis
ucccuugccgccg

SEQ ID NO: 877801 - RNA, 17 nt, Mycobacterium avium subsp. paratuberculosis
ucccuguucgcgccggu

SEQ ID NO: 877802 - RNA, 15 nt, Mycobacterium avium subsp. paratuberculosis
ucccuggugaccgac

SEQ ID NO: 877803 - RNA, 21 nt, Mycobacterium avium subsp. paratuberculosis
ucccucgucgcuaccucacca

SEQ ID NO: 877804 - RNA, 13 nt, Mycobacterium avium subsp. paratuberculosis
ucccugcgcggcg

SEQ ID NO: 877805 - RNA, 17 nt, Mycobacterium avium subsp. paratuberculosis
ucccugcgcggcgaugc

SEQ ID NO: 877806 - RNA, 13 nt, Mycobacterium avium subsp. paratuberculosis
ucccugcggcugc

SEQ ID NO: 877807 - RNA, 14 nt, Mycobacterium avium subsp. paratuberculosis
uccagcucagcgcg

SEQ ID NO: 877808 - RNA, 16 nt, Mycobacterium avium subsp. paratuberculosis
uccaggccagcaccug

SEQ ID NO: 877809 - RNA, 14 nt, Mycobacterium avium subsp. paratuberculosis
uccagcuccgccga

SEQ ID NO: 877810 - RNA, 15 nt, Mycobacterium avium subsp. paratuberculosis
uccagcuccgccgac

SEQ ID NO: 877811 - RNA, 17 nt, Mycobacterium avium subsp. paratuberculosis
uccaggccgcgccgggc

SEQ ID NO: 877812 - RNA, 18 nt, Mycobacterium avium subsp. paratuberculosis
uccagcgggcggcggugg

SEQ ID NO: 877813 - RNA, 13 nt, Mycobacterium avium subsp. paratuberculosis
uccagcguccggg

SEQ ID NO: 877814 - RNA, 23 nt, Mycobacterium avium subsp. paratuberculosis
uccagcgucuggcagccggccgg

SEQ ID NO: 877815 - RNA, 18 nt, Mycobacterium avium subsp. paratuberculosis
uccagcggguccagccgc

SEQ ID NO: 877816 - RNA, 19 nt, Mycobacterium avium subsp. paratuberculosis
uccagcaccccgucgaggu

SEQ ID NO: 877817 - RNA, 14 nt, Mycobacterium avium subsp. paratuberculosis
uccagcacccggcc

SEQ ID NO: 877818 - RNA, 13 nt, Mycobacterium avium subsp. paratuberculosis
uccagcaccggcg

SEQ ID NO: 877819 - RNA, 21 nt, Mycobacterium avium subsp. paratuberculosis
uccagcaccugaccgucggcc

SEQ ID NO: 877820 - RNA, 15 nt, Mycobacterium avium subsp. paratuberculosis
uccagccagcgcgcg

SEQ ID NO: 877821 - RNA, 17 nt, Mycobacterium avium subsp. paratuberculosis
uccagccauucgucggg

SEQ ID NO: 877822 - RNA, 16 nt, Mycobacterium avium subsp. paratuberculosis
uccagcccggcgauga

SEQ ID NO: 877823 - RNA, 22 nt, Mycobacterium avium subsp. paratuberculosis
uccagcccugcucggccagcgg

SEQ ID NO: 877824 - RNA, 14 nt, Mycobacterium avium subsp. paratuberculosis
uccagcggccgcag

SEQ ID NO: 877825 - RNA, 19 nt, Mycobacterium avium subsp. paratuberculosis
uccaugaaccacugcggca

SEQ ID NO: 877826 - RNA, 19 nt, Mycobacterium avium subsp. paratuberculosis
uccaugaacggcagcucgu

SEQ ID NO: 877827 - RNA, 19 nt, Mycobacterium avium subsp. paratuberculosis
uccaucgggaccgcgggcg

SEQ ID NO: 877828 - RNA, 20 nt, Mycobacterium avium subsp. paratuberculosis
uccaucgccucgaccagcac

SEQ ID NO: 877829 - RNA, 19 nt, Mycobacterium avium subsp. paratuberculosis
uccaucgccgcgcacccgg

SEQ ID NO: 877830 - RNA, 20 nt, Mycobacterium avium subsp. paratuberculosis
uccaggugaaugcucagcgg

SEQ ID NO: 877831 - RNA, 19 nt, Mycobacterium avium subsp. paratuberculosis
uccaggugcacccgcggcg

SEQ ID NO: 877832 - RNA, 22 nt, Mycobacterium avium subsp. paratuberculosis
uccaggugcacccgcggcgcga

SEQ ID NO: 877833 - RNA, 18 nt, Mycobacterium avium subsp. paratuberculosis
uccagguggggcacgggc

SEQ ID NO: 877834 - RNA, 22 nt, Mycobacterium avium subsp. paratuberculosis
uccaucagcgcccgcgcgggcu

SEQ ID NO: 877835 - RNA, 22 nt, Mycobacterium avium subsp. paratuberculosis
uccauccgccagaucgccuggc

SEQ ID NO: 877836 - RNA, 16 nt, Mycobacterium avium subsp. paratuberculosis
uccaucauggcgcugc

SEQ ID NO: 877837 - RNA, 22 nt, Mycobacterium avium subsp. paratuberculosis
uccaucauggcgcugcgcgaca

SEQ ID NO: 877838 - RNA, 16 nt, Mycobacterium avium subsp. paratuberculosis
uccaggcgaccggccc

SEQ ID NO: 877839 - RNA, 13 nt, Mycobacterium avium subsp. paratuberculosis
uccaggcgcaccg

SEQ ID NO: 877840 - RNA, 17 nt, Mycobacterium avium subsp. paratuberculosis
uccaggcgcaccgccac

SEQ ID NO: 877841 - RNA, 14 nt, Mycobacterium avium subsp. paratuberculosis
uccaggcgccgggu

SEQ ID NO: 877842 - RNA, 16 nt, Mycobacterium avium subsp. paratuberculosis
uccagggugucgucgu

SEQ ID NO: 877843 - RNA, 14 nt, Mycobacterium avium subsp. paratuberculosis
uccagguacgcgac

SEQ ID NO: 877844 - RNA, 19 nt, Mycobacterium avium subsp. paratuberculosis
uccacagcccguugcugcg

SEQ ID NO: 877845 - RNA, 16 nt, Mycobacterium avium subsp. paratuberculosis
uccacagccggcggcu

SEQ ID NO: 877846 - RNA, 13 nt, Mycobacterium avium subsp. paratuberculosis
uccaccaccggcc

SEQ ID NO: 877847 - RNA, 15 nt, Mycobacterium avium subsp. paratuberculosis
uccaccaccggccgc

SEQ ID NO: 877848 - RNA, 16 nt, Mycobacterium avium subsp. paratuberculosis
uccaccaccggccgcg

SEQ ID NO: 877849 - RNA, 18 nt, Mycobacterium avium subsp. paratuberculosis
uccaccaauucgcgcugc

SEQ ID NO: 877850 - RNA, 15 nt, Mycobacterium avium subsp. paratuberculosis
uccacagcugcaggc

SEQ ID NO: 877851 - RNA, 23 nt, Mycobacterium avium subsp. paratuberculosis
uccaccaccacacccgcggccgc

SEQ ID NO: 877852 - RNA, 14 nt, Mycobacterium avium subsp. paratuberculosis
uccacacggcaggc

SEQ ID NO: 877853 - RNA, 22 nt, Mycobacterium avium subsp. paratuberculosis
uccaacaugccuuucagcucga

SEQ ID NO: 877854 - RNA, 15 nt, Mycobacterium avium subsp. paratuberculosis
uccacgccggugacc

SEQ ID NO: 877855 - RNA, 10 nt, Mycobacterium avium subsp. paratuberculosis
uccacgccgu

SEQ ID NO: 877856 - RNA, 23 nt, Mycobacterium avium subsp. paratuberculosis
uccaccggauggcgcccggcagc

SEQ ID NO: 877857 - RNA, 15 nt, Mycobacterium avium subsp. paratuberculosis
uccaccggcaaucgg

SEQ ID NO: 877858 - RNA, 23 nt, Mycobacterium avium subsp. paratuberculosis
uccaccggcaaucgggacgccac

SEQ ID NO: 877859 - RNA, 11 nt, Mycobacterium avium subsp. paratuberculosis
uccaccggccg

SEQ ID NO: 877860 - RNA, 13 nt, Mycobacterium avium subsp. paratuberculosis
uccaccggccgau

SEQ ID NO: 877861 - RNA, 13 nt, Mycobacterium avium subsp. paratuberculosis
uccaccagcacgc

SEQ ID NO: 877862 - RNA, 16 nt, Mycobacterium avium subsp. paratuberculosis
uccaccgacaggucga

SEQ ID NO: 877863 - RNA, 18 nt, Mycobacterium avium subsp. paratuberculosis
uccaccagaaguggucga

SEQ ID NO: 877864 - RNA, 15 nt, Mycobacterium avium subsp. paratuberculosis
uccaccagaucgccc

SEQ ID NO: 877865 - RNA, 16 nt, Mycobacterium avium subsp. paratuberculosis
uccaccgagugcggcg

SEQ ID NO: 877866 - RNA, 19 nt, Mycobacterium avium subsp. paratuberculosis
uccaccgagugcggcgcgg

SEQ ID NO: 877867 - RNA, 20 nt, Mycobacterium avium subsp. paratuberculosis
uccaccgagugcggcgcggu

SEQ ID NO: 877868 - RNA, 22 nt, Mycobacterium avium subsp. paratuberculosis
uccaccgcccggaugccggcgc

SEQ ID NO: 877869 - RNA, 16 nt, Mycobacterium avium subsp. paratuberculosis
uccaccgcgccggcgg

SEQ ID NO: 877870 - RNA, 16 nt, Mycobacterium avium subsp. paratuberculosis
uccaccgcgcgcgggu

SEQ ID NO: 877871 - RNA, 13 nt, Mycobacterium avium subsp. paratuberculosis
uccaccgcguccu

SEQ ID NO: 877872 - RNA, 19 nt, Mycobacterium avium subsp. paratuberculosis
uccacgugcacggcgccgu

SEQ ID NO: 877873 - RNA, 14 nt, Mycobacterium avium subsp. paratuberculosis
uccagcaccagcac

SEQ ID NO: 877874 - RNA, 15 nt, Mycobacterium avium subsp. paratuberculosis
uccagaugcccagca

SEQ ID NO: 877875 - RNA, 16 nt, Mycobacterium avium subsp. paratuberculosis
uccagaugcccagcag

SEQ ID NO: 877876 - RNA, 18 nt, Mycobacterium avium subsp. paratuberculosis
uccagaucgccgcccauc

SEQ ID NO: 877877 - RNA, 16 nt, Mycobacterium avium subsp. paratuberculosis
uccacguugaugccgc

SEQ ID NO: 877878 - RNA, 17 nt, Mycobacterium avium subsp. paratuberculosis
uccacuccagcaccgga

SEQ ID NO: 877879 - RNA, 15 nt, Mycobacterium avium subsp. paratuberculosis
uccacgugucggcgu

SEQ ID NO: 877880 - RNA, 16 nt, Mycobacterium avium subsp. paratuberculosis
uccacggucagcgcgu

SEQ ID NO: 877881 - RNA, 13 nt, Mycobacterium avium subsp. paratuberculosis
uccacggugcgca

SEQ ID NO: 877882 - RNA, 16 nt, Mycobacterium avium subsp. paratuberculosis
uccacggugcgcaccg

SEQ ID NO: 877883 - RNA, 17 nt, Mycobacterium avium subsp. paratuberculosis
uccacgcguagccgacc

SEQ ID NO: 877884 - RNA, 18 nt, Mycobacterium avium subsp. paratuberculosis
uccacgcguagccgacca

SEQ ID NO: 877885 - RNA, 12 nt, Mycobacterium avium subsp. paratuberculosis
uccacggccggu

SEQ ID NO: 877886 - RNA, 12 nt, Mycobacterium avium subsp. paratuberculosis
uccacgcuggcg

SEQ ID NO: 877887 - RNA, 13 nt, Mycobacterium avium subsp. paratuberculosis
uccacgcuggcgg

SEQ ID NO: 877888 - RNA, 23 nt, Mycobacterium avium subsp. paratuberculosis
uccaccggucggaaaaguggguc

SEQ ID NO: 877889 - RNA, 15 nt, Mycobacterium avium subsp. paratuberculosis
ucagugaggccagca

SEQ ID NO: 877890 - RNA, 17 nt, Mycobacterium avium subsp. paratuberculosis
ucagugaggccagcacc

SEQ ID NO: 877891 - RNA, 14 nt, Mycobacterium avium subsp. paratuberculosis
ucagucgcgccgcc

SEQ ID NO: 877892 - RNA, 14 nt, Mycobacterium avium subsp. paratuberculosis
ucagucggccaccg

SEQ ID NO: 877893 - RNA, 16 nt, Mycobacterium avium subsp. paratuberculosis
ucagugcacgcucggc

SEQ ID NO: 877894 - RNA, 21 nt, Mycobacterium avium subsp. paratuberculosis
ucagugccgcgccaacgaggc

SEQ ID NO: 877895 - RNA, 20 nt, Mycobacterium avium subsp. paratuberculosis
ucagugcgcauucggcgacg

SEQ ID NO: 877896 - RNA, 15 nt, Mycobacterium avium subsp. paratuberculosis
ucagugcgggcaucg

SEQ ID NO: 877897 - RNA, 20 nt, Mycobacterium avium subsp. paratuberculosis
ucagucgaucuugcgccaga

SEQ ID NO: 877898 - RNA, 20 nt, Mycobacterium avium subsp. paratuberculosis
ucaguccgacgcgacggucg

SEQ ID NO: 877899 - RNA, 23 nt, Mycobacterium avium subsp. paratuberculosis
ucaggucgccgauccagccgucg

SEQ ID NO: 877900 - RNA, 16 nt, Mycobacterium avium subsp. paratuberculosis
ucaggucggccgcggc

SEQ ID NO: 877901 - RNA, 21 nt, Mycobacterium avium subsp. paratuberculosis
ucaggucggccgcggccggcg

SEQ ID NO: 877902 - RNA, 13 nt, Mycobacterium avium subsp. paratuberculosis
ucaggucggcgau

SEQ ID NO: 877903 - RNA, 24 nt, Mycobacterium avium subsp. paratuberculosis
ucaggucuccguugucgaggucgg

SEQ ID NO: 877904 - RNA, 21 nt, Mycobacterium avium subsp. paratuberculosis
ucagguccuugcgcgccgcga

SEQ ID NO: 877905 - RNA, 22 nt, Mycobacterium avium subsp. paratuberculosis
ucagguccuugcgcgccgcgac

SEQ ID NO: 877906 - RNA, 18 nt, Mycobacterium avium subsp. paratuberculosis
ucaggucgaagcccgccg

SEQ ID NO: 877907 - RNA, 14 nt, Mycobacterium avium subsp. paratuberculosis
ucagguaggcgucg

SEQ ID NO: 877908 - RNA, 15 nt, Mycobacterium avium subsp. paratuberculosis
ucagguaggcgucga

SEQ ID NO: 877909 - RNA, 19 nt, Mycobacterium avium subsp. paratuberculosis
ucaggccggucagcgacga

SEQ ID NO: 877910 - RNA, 17 nt, Mycobacterium avium subsp. paratuberculosis
ucaggcgagcacccgga

SEQ ID NO: 877911 - RNA, 20 nt, Mycobacterium avium subsp. paratuberculosis
ucaggccucgaggaucgcgg

SEQ ID NO: 877912 - RNA, 14 nt, Mycobacterium avium subsp. paratuberculosis
ucaggccggcgccg

SEQ ID NO: 877913 - RNA, 22 nt, Mycobacterium avium subsp. paratuberculosis
ucaggccgggaaugucgcgcag

SEQ ID NO: 877914 - RNA, 14 nt, Mycobacterium avium subsp. paratuberculosis
ucaggccguagcgg

SEQ ID NO: 877915 - RNA, 19 nt, Mycobacterium avium subsp. paratuberculosis
ucaggccguagcggcucgc

SEQ ID NO: 877916 - RNA, 15 nt, Mycobacterium avium subsp. paratuberculosis
ucaggccgugaucgg

SEQ ID NO: 877917 - RNA, 23 nt, Mycobacterium avium subsp. paratuberculosis
ucaggccgugcacgaacagggug

SEQ ID NO: 877918 - RNA, 11 nt, Mycobacterium avium subsp. paratuberculosis
ucaucaccggc

SEQ ID NO: 877919 - RNA, 16 nt, Mycobacterium avium subsp. paratuberculosis
ucaucaccaccgccgc

SEQ ID NO: 877920 - RNA, 18 nt, Mycobacterium avium subsp. paratuberculosis
ucaucaccacgaacuccc

SEQ ID NO: 877921 - RNA, 14 nt, Mycobacterium avium subsp. paratuberculosis
ucaucaccggcgcg

SEQ ID NO: 877922 - RNA, 13 nt, Mycobacterium avium subsp. paratuberculosis
ucaucagcgacgu

SEQ ID NO: 877923 - RNA, 21 nt, Mycobacterium avium subsp. paratuberculosis
ucaucagcgacgucaggucga

SEQ ID NO: 877924 - RNA, 16 nt, Mycobacterium avium subsp. paratuberculosis
ucaucaggcggccggc

SEQ ID NO: 877925 - RNA, 14 nt, Mycobacterium avium subsp. paratuberculosis
ucaugauccggaag

SEQ ID NO: 877926 - RNA, 20 nt, Mycobacterium avium subsp. paratuberculosis
ucaucgggcccgacgacgau

SEQ ID NO: 877927 - RNA, 19 nt, Mycobacterium avium subsp. paratuberculosis
ucaucgguuugaccacggc

SEQ ID NO: 877928 - RNA, 19 nt, Mycobacterium avium subsp. paratuberculosis
ucaucgugacgcgaagucg

SEQ ID NO: 877929 - RNA, 15 nt, Mycobacterium avium subsp. paratuberculosis
ucaucguguccagca

SEQ ID NO: 877930 - RNA, 13 nt, Mycobacterium avium subsp. paratuberculosis
ucaucgucgucac

SEQ ID NO: 877931 - RNA, 14 nt, Mycobacterium avium subsp. paratuberculosis
ucaucgucgacccg

SEQ ID NO: 877932 - RNA, 14 nt, Mycobacterium avium subsp. paratuberculosis
ucaugaaggcgacg

SEQ ID NO: 877933 - RNA, 16 nt, Mycobacterium avium subsp. paratuberculosis
ucauccacucggccac

SEQ ID NO: 877934 - RNA, 12 nt, Mycobacterium avium subsp. paratuberculosis
ucaucgcgcacc

SEQ ID NO: 877935 - RNA, 21 nt, Mycobacterium avium subsp. paratuberculosis
ucaugucguccucccggccga

SEQ ID NO: 877936 - RNA, 23 nt, Mycobacterium avium subsp. paratuberculosis
ucaugucgaugccgagccggccg

SEQ ID NO: 877937 - RNA, 21 nt, Mycobacterium avium subsp. paratuberculosis
ucaugguguuccaccagcggc

SEQ ID NO: 877938 - RNA, 16 nt, Mycobacterium avium subsp. paratuberculosis
ucauggucgucgucga

SEQ ID NO: 877939 - RNA, 16 nt, Mycobacterium avium subsp. paratuberculosis
ucauguaccggucgua

SEQ ID NO: 877940 - RNA, 18 nt, Mycobacterium avium subsp. paratuberculosis
ucauguaccggucguaga

SEQ ID NO: 877941 - RNA, 17 nt, Mycobacterium avium subsp. paratuberculosis
ucauguagcagcgcggc

SEQ ID NO: 877942 - RNA, 17 nt, Mycobacterium avium subsp. paratuberculosis
ucaugcccgccacggcc

SEQ ID NO: 877943 - RNA, 13 nt, Mycobacterium avium subsp. paratuberculosis
ucaugggcccggc

SEQ ID NO: 877944 - RNA, 19 nt, Mycobacterium avium subsp. paratuberculosis
ucauuccgccgcgcccguc

SEQ ID NO: 877945 - RNA, 15 nt, Mycobacterium avium subsp. paratuberculosis
ucacgagcuccagcu

SEQ ID NO: 877946 - RNA, 16 nt, Mycobacterium avium subsp. paratuberculosis
ucacgacgcgaccgag

SEQ ID NO: 877947 - RNA, 13 nt, Mycobacterium avium subsp. paratuberculosis
ucacgaccggcag

SEQ ID NO: 877948 - RNA, 15 nt, Mycobacterium avium subsp. paratuberculosis
ucacgaccggcagca

SEQ ID NO: 877949 - RNA, 23 nt, Mycobacterium avium subsp. paratuberculosis
ucacgaagugcccggcgccggac

SEQ ID NO: 877950 - RNA, 14 nt, Mycobacterium avium subsp. paratuberculosis
ucacgaacuccuug

SEQ ID NO: 877951 - RNA, 19 nt, Mycobacterium avium subsp. paratuberculosis
ucacgaacuccuugacccg

SEQ ID NO: 877952 - RNA, 21 nt, Mycobacterium avium subsp. paratuberculosis
ucacgaacuccuugacccggc

SEQ ID NO: 877953 - RNA, 20 nt, Mycobacterium avium subsp. paratuberculosis
ucaccggagagcaacaccuc

SEQ ID NO: 877954 - RNA, 16 nt, Mycobacterium avium subsp. paratuberculosis
ucaccggaccggccag

SEQ ID NO: 877955 - RNA, 18 nt, Mycobacterium avium subsp. paratuberculosis
ucaccggaccggccagca

SEQ ID NO: 877956 - RNA, 19 nt, Mycobacterium avium subsp. paratuberculosis
ucaccggaccggccagcag

SEQ ID NO: 877957 - RNA, 23 nt, Mycobacterium avium subsp. paratuberculosis
ucaccggaccggccagcagccgc

SEQ ID NO: 877958 - RNA, 17 nt, Mycobacterium avium subsp. paratuberculosis
ucaccggaugcaccggc

SEQ ID NO: 877959 - RNA, 18 nt, Mycobacterium avium subsp. paratuberculosis
ucaccggaugcaccggca

SEQ ID NO: 877960 - RNA, 20 nt, Mycobacterium avium subsp. paratuberculosis
ucaccggaugcaccggcagc

SEQ ID NO: 877961 - RNA, 20 nt, Mycobacterium avium subsp. paratuberculosis
ucaccggcagcagcgcgucg

SEQ ID NO: 877962 - RNA, 19 nt, Mycobacterium avium subsp. paratuberculosis
ucaccggccagggccgccg

SEQ ID NO: 877963 - RNA, 21 nt, Mycobacterium avium subsp. paratuberculosis
ucaccggccagggccgccgca

SEQ ID NO: 877964 - RNA, 11 nt, Mycobacterium avium subsp. paratuberculosis
ucaccggccga

SEQ ID NO: 877965 - RNA, 17 nt, Mycobacterium avium subsp. paratuberculosis
ucaccggccgagccgau

SEQ ID NO: 877966 - RNA, 14 nt, Mycobacterium avium subsp. paratuberculosis
ucaccggcguggug

SEQ ID NO: 877967 - RNA, 17 nt, Mycobacterium avium subsp. paratuberculosis
ucaccggcugcccgacc

SEQ ID NO: 877968 - RNA, 22 nt, Mycobacterium avium subsp. paratuberculosis
ucaccggcugcccgacccgcac

SEQ ID NO: 877969 - RNA, 17 nt, Mycobacterium avium subsp. paratuberculosis
ucaccggcuuggcggug

SEQ ID NO: 877970 - RNA, 21 nt, Mycobacterium avium subsp. paratuberculosis
ucaccgggacaccgcuggccg

SEQ ID NO: 877971 - RNA, 21 nt, Mycobacterium avium subsp. paratuberculosis
ucaccgggauggugaccagcg

SEQ ID NO: 877972 - RNA, 22 nt, Mycobacterium avium subsp. paratuberculosis
ucaccgggcggccguggucgau

SEQ ID NO: 877973 - RNA, 21 nt, Mycobacterium avium subsp. paratuberculosis
ucaccugcggcccgucgccgu

SEQ ID NO: 877974 - RNA, 13 nt, Mycobacterium avium subsp. paratuberculosis
ucaccugcgggcg

SEQ ID NO: 877975 - RNA, 18 nt, Mycobacterium avium subsp. paratuberculosis
ucaccugcguugcggcac

SEQ ID NO: 877976 - RNA, 20 nt, Mycobacterium avium subsp. paratuberculosis
ucaccuggugcucgcgcucg

SEQ ID NO: 877977 - RNA, 21 nt, Mycobacterium avium subsp. paratuberculosis
ucaccuucugcgcgccgucgg

SEQ ID NO: 877978 - RNA, 16 nt, Mycobacterium avium subsp. paratuberculosis
ucaccuucugcgucgg

SEQ ID NO: 877979 - RNA, 17 nt, Mycobacterium avium subsp. paratuberculosis
ucaccuucugcgucggc

SEQ ID NO: 877980 - RNA, 18 nt, Mycobacterium avium subsp. paratuberculosis
ucaccuucugcgucggcu

SEQ ID NO: 877981 - RNA, 16 nt, Mycobacterium avium subsp. paratuberculosis
ucaccuugcggccggc

SEQ ID NO: 877982 - RNA, 23 nt, Mycobacterium avium subsp. paratuberculosis
ucaccuugcggccggcggcgucg

SEQ ID NO: 877983 - RNA, 16 nt, Mycobacterium avium subsp. paratuberculosis
ucaccuuggccggauc

SEQ ID NO: 877984 - RNA, 17 nt, Mycobacterium avium subsp. paratuberculosis
ucaccuuguugcgggcg

SEQ ID NO: 877985 - RNA, 16 nt, Mycobacterium avium subsp. paratuberculosis
ucaccgacgccagcgg

SEQ ID NO: 877986 - RNA, 18 nt, Mycobacterium avium subsp. paratuberculosis
ucaccgacgccagcgggc

SEQ ID NO: 877987 - RNA, 22 nt, Mycobacterium avium subsp. paratuberculosis
ucaccgaccccucggcggccgu

SEQ ID NO: 877988 - RNA, 15 nt, Mycobacterium avium subsp. paratuberculosis
ucaccgacgaccucg

SEQ ID NO: 877989 - RNA, 18 nt, Mycobacterium avium subsp. paratuberculosis
ucaccgagauggccacca

SEQ ID NO: 877990 - RNA, 15 nt, Mycobacterium avium subsp. paratuberculosis
ucaccgagaugguga

SEQ ID NO: 877991 - RNA, 15 nt, Mycobacterium avium subsp. paratuberculosis
ucaccgagcggccgu

SEQ ID NO: 877992 - RNA, 16 nt, Mycobacterium avium subsp. paratuberculosis
ucaccgagcggccguc

SEQ ID NO: 877993 - RNA, 15 nt, Mycobacterium avium subsp. paratuberculosis
ucaccgagcggggug

SEQ ID NO: 877994 - RNA, 16 nt, Mycobacterium avium subsp. paratuberculosis
ucaccgagcugggccg

SEQ ID NO: 877995 - RNA, 20 nt, Mycobacterium avium subsp. paratuberculosis
ucaccgagcugggccggcgc

SEQ ID NO: 877996 - RNA, 12 nt, Mycobacterium avium subsp. paratuberculosis
ucaccgaggcga

SEQ ID NO: 877997 - RNA, 14 nt, Mycobacterium avium subsp. paratuberculosis
ucaccgcaccgacg

SEQ ID NO: 877998 - RNA, 20 nt, Mycobacterium avium subsp. paratuberculosis
ucaccgcaucgaaccgccgc

SEQ ID NO: 877999 - RNA, 16 nt, Mycobacterium avium subsp. paratuberculosis
ucaccgcugaugccgc

SEQ ID NO: 878000 - RNA, 18 nt, Mycobacterium avium subsp. paratuberculosis
ucaccgcugaugccgccg

SEQ ID NO: 878001 - RNA, 19 nt, Mycobacterium avium subsp. paratuberculosis
ucaccgcguucucggcgga

SEQ ID NO: 878002 - RNA, 18 nt, Mycobacterium avium subsp. paratuberculosis
ucaccgcguugucggcga

SEQ ID NO: 878003 - RNA, 23 nt, Mycobacterium avium subsp. paratuberculosis
ucaccgcguugucggcgacggcg

SEQ ID NO: 878004 - RNA, 15 nt, Mycobacterium avium subsp. paratuberculosis
ucaccgccagcgcgc

SEQ ID NO: 878005 - RNA, 18 nt, Mycobacterium avium subsp. paratuberculosis
ucaccgccaggaccaccc

SEQ ID NO: 878006 - RNA, 12 nt, Mycobacterium avium subsp. paratuberculosis
ucaccgcgucgg

SEQ ID NO: 878007 - RNA, 14 nt, Mycobacterium avium subsp. paratuberculosis
ucaccgcgucggcc

SEQ ID NO: 878008 - RNA, 19 nt, Mycobacterium avium subsp. paratuberculosis
ucaccgcgucggcccagac

SEQ ID NO: 878009 - RNA, 20 nt, Mycobacterium avium subsp. paratuberculosis
ucacucuggcgugacgcucg

SEQ ID NO: 878010 - RNA, 17 nt, Mycobacterium avium subsp. paratuberculosis
ucacucuggcgugacgu

SEQ ID NO: 878011 - RNA, 20 nt, Mycobacterium avium subsp. paratuberculosis
ucacucuggcgugacguucg

SEQ ID NO: 878012 - RNA, 16 nt, Mycobacterium avium subsp. paratuberculosis
ucacugcacgcacggc

SEQ ID NO: 878013 - RNA, 13 nt, Mycobacterium avium subsp. paratuberculosis
ucagacugccgag

SEQ ID NO: 878014 - RNA, 15 nt, Mycobacterium avium subsp. paratuberculosis
ucagaccgcggcggu

SEQ ID NO: 878015 - RNA, 22 nt, Mycobacterium avium subsp. paratuberculosis
ucagaccccguaccagcgcucg

SEQ ID NO: 878016 - RNA, 19 nt, Mycobacterium avium subsp. paratuberculosis
ucagaccauggcgcggcgg

SEQ ID NO: 878017 - RNA, 19 nt, Mycobacterium avium subsp. paratuberculosis
ucacgguguuguucaccgg

SEQ ID NO: 878018 - RNA, 15 nt, Mycobacterium avium subsp. paratuberculosis
ucacggccgccagca

SEQ ID NO: 878019 - RNA, 18 nt, Mycobacterium avium subsp. paratuberculosis
ucacggauacccgcggcc

SEQ ID NO: 878020 - RNA, 15 nt, Mycobacterium avium subsp. paratuberculosis
ucacggacagccggc

SEQ ID NO: 878021 - RNA, 20 nt, Mycobacterium avium subsp. paratuberculosis
ucacgcuggccuccagcuuu

SEQ ID NO: 878022 - RNA, 20 nt, Mycobacterium avium subsp. paratuberculosis
ucacgcuggcgugacacucg

SEQ ID NO: 878023 - RNA, 21 nt, Mycobacterium avium subsp. paratuberculosis
ucacgcuggcgugacacucgg

SEQ ID NO: 878024 - RNA, 20 nt, Mycobacterium avium subsp. paratuberculosis
ucacgcuggcgugacgcucg

SEQ ID NO: 878025 - RNA, 21 nt, Mycobacterium avium subsp. paratuberculosis
ucacgcuggcgugacgcucgc

SEQ ID NO: 878026 - RNA, 20 nt, Mycobacterium avium subsp. paratuberculosis
ucacgcuggcgugacguucg

SEQ ID NO: 878027 - RNA, 21 nt, Mycobacterium avium subsp. paratuberculosis
ucacgcuggcguggcacccgg

SEQ ID NO: 878028 - RNA, 22 nt, Mycobacterium avium subsp. paratuberculosis
ucacgcugggcuccgaccguga

SEQ ID NO: 878029 - RNA, 13 nt, Mycobacterium avium subsp. paratuberculosis
ucacgucgagcgg

SEQ ID NO: 878030 - RNA, 19 nt, Mycobacterium avium subsp. paratuberculosis
ucacgucgaucacgccgcc

SEQ ID NO: 878031 - RNA, 20 nt, Mycobacterium avium subsp. paratuberculosis
ucacgucgaucacgccgccg

SEQ ID NO: 878032 - RNA, 15 nt, Mycobacterium avium subsp. paratuberculosis
ucacgucggccugca

SEQ ID NO: 878033 - RNA, 19 nt, Mycobacterium avium subsp. paratuberculosis
ucacgucggcgagcuuggc

SEQ ID NO: 878034 - RNA, 15 nt, Mycobacterium avium subsp. paratuberculosis
ucacgucggcgaugg

SEQ ID NO: 878035 - RNA, 16 nt, Mycobacterium avium subsp. paratuberculosis
ucacgucggcgauggc

SEQ ID NO: 878036 - RNA, 16 nt, Mycobacterium avium subsp. paratuberculosis
ucacgucggcguagcg

SEQ ID NO: 878037 - RNA, 12 nt, Mycobacterium avium subsp. paratuberculosis
ucacgugcgcgg

SEQ ID NO: 878038 - RNA, 22 nt, Mycobacterium avium subsp. paratuberculosis
ucacgugcuggcgcuugcguuc

SEQ ID NO: 878039 - RNA, 20 nt, Mycobacterium avium subsp. paratuberculosis
ucacguccaucauggcgcug

SEQ ID NO: 878040 - RNA, 17 nt, Mycobacterium avium subsp. paratuberculosis
ucacguccuuggugacg

SEQ ID NO: 878041 - RNA, 19 nt, Mycobacterium avium subsp. paratuberculosis
ucacguccuuggugacggc

SEQ ID NO: 878042 - RNA, 12 nt, Mycobacterium avium subsp. paratuberculosis
ucacgucgacgg

SEQ ID NO: 878043 - RNA, 23 nt, Mycobacterium avium subsp. paratuberculosis
ucacguagugcuucuugaagaac

SEQ ID NO: 878044 - RNA, 15 nt, Mycobacterium avium subsp. paratuberculosis
ucacgccagcgugac

SEQ ID NO: 878045 - RNA, 20 nt, Mycobacterium avium subsp. paratuberculosis
ucacgccagcgugacgcccg

SEQ ID NO: 878046 - RNA, 21 nt, Mycobacterium avium subsp. paratuberculosis
ucacgccagcgugacgcccgg

SEQ ID NO: 878047 - RNA, 22 nt, Mycobacterium avium subsp. paratuberculosis
ucacgccagcgugacgcccggc

SEQ ID NO: 878048 - RNA, 23 nt, Mycobacterium avium subsp. paratuberculosis
ucacgccagcgugacgcccggcg

SEQ ID NO: 878049 - RNA, 19 nt, Mycobacterium avium subsp. paratuberculosis
ucacgccagcgugacgccg

SEQ ID NO: 878050 - RNA, 22 nt, Mycobacterium avium subsp. paratuberculosis
ucacgccagcgugacgccgggc

SEQ ID NO: 878051 - RNA, 20 nt, Mycobacterium avium subsp. paratuberculosis
ucacgccagcgugacgcucg

SEQ ID NO: 878052 - RNA, 23 nt, Mycobacterium avium subsp. paratuberculosis
ucacgccaguguggccgcggcgg

SEQ ID NO: 878053 - RNA, 19 nt, Mycobacterium avium subsp. paratuberculosis
ucacgccccagguuccggu

SEQ ID NO: 878054 - RNA, 19 nt, Mycobacterium avium subsp. paratuberculosis
ucacgcccguugacgccca

SEQ ID NO: 878055 - RNA, 21 nt, Mycobacterium avium subsp. paratuberculosis
ucacgcccggggugaugccgg

SEQ ID NO: 878056 - RNA, 13 nt, Mycobacterium avium subsp. paratuberculosis
ucacgcucggcga

SEQ ID NO: 878057 - RNA, 17 nt, Mycobacterium avium subsp. paratuberculosis
ucacgcucggcgccgag

SEQ ID NO: 878058 - RNA, 14 nt, Mycobacterium avium subsp. paratuberculosis
ucacgcucggcggg

SEQ ID NO: 878059 - RNA, 18 nt, Mycobacterium avium subsp. paratuberculosis
ucacgcugaacggugccg

SEQ ID NO: 878060 - RNA, 22 nt, Mycobacterium avium subsp. paratuberculosis
ucacgcugaacggugccgucac

SEQ ID NO: 878061 - RNA, 21 nt, Mycobacterium avium subsp. paratuberculosis
ucacgcucggccagggugacg

SEQ ID NO: 878062 - RNA, 16 nt, Mycobacterium avium subsp. paratuberculosis
ucacgcugcgcgccga

SEQ ID NO: 878063 - RNA, 20 nt, Mycobacterium avium subsp. paratuberculosis
ucagcucaggaacggccgga

SEQ ID NO: 878064 - RNA, 15 nt, Mycobacterium avium subsp. paratuberculosis
ucagcuccaccugcg

SEQ ID NO: 878065 - RNA, 19 nt, Mycobacterium avium subsp. paratuberculosis
ucagcucgaucgccgcgcc

SEQ ID NO: 878066 - RNA, 15 nt, Mycobacterium avium subsp. paratuberculosis
ucagcucgccguccg

SEQ ID NO: 878067 - RNA, 19 nt, Mycobacterium avium subsp. paratuberculosis
ucagcucccccgucgggcc

SEQ ID NO: 878068 - RNA, 21 nt, Mycobacterium avium subsp. paratuberculosis
ucagcuccuccugcggugggc

SEQ ID NO: 878069 - RNA, 19 nt, Mycobacterium avium subsp. paratuberculosis
ucagcucgaaggugcccgc

SEQ ID NO: 878070 - RNA, 16 nt, Mycobacterium avium subsp. paratuberculosis
ucagcugcagccggcc

SEQ ID NO: 878071 - RNA, 19 nt, Mycobacterium avium subsp. paratuberculosis
ucagcugcagccggccggc

SEQ ID NO: 878072 - RNA, 12 nt, Mycobacterium avium subsp. paratuberculosis
ucagcucggcgg

SEQ ID NO: 878073 - RNA, 14 nt, Mycobacterium avium subsp. paratuberculosis
ucagcucggcggcc

SEQ ID NO: 878074 - RNA, 16 nt, Mycobacterium avium subsp. paratuberculosis
ucagcucguggcgggc

SEQ ID NO: 878075 - RNA, 23 nt, Mycobacterium avium subsp. paratuberculosis
ucagcugaacggugcccgccgau

SEQ ID NO: 878076 - RNA, 19 nt, Mycobacterium avium subsp. paratuberculosis
ucagcugaccggcgaucgu

SEQ ID NO: 878077 - RNA, 18 nt, Mycobacterium avium subsp. paratuberculosis
ucagcgggcuguccgcgu

SEQ ID NO: 878078 - RNA, 13 nt, Mycobacterium avium subsp. paratuberculosis
ucagcgggcgcag

SEQ ID NO: 878079 - RNA, 21 nt, Mycobacterium avium subsp. paratuberculosis
ucagcgggcgcagcucgucgu

SEQ ID NO: 878080 - RNA, 15 nt, Mycobacterium avium subsp. paratuberculosis
ucagcggccagccca

SEQ ID NO: 878081 - RNA, 19 nt, Mycobacterium avium subsp. paratuberculosis
ucagcgucucggcgaucag

SEQ ID NO: 878082 - RNA, 13 nt, Mycobacterium avium subsp. paratuberculosis
ucagcgucgaugu

SEQ ID NO: 878083 - RNA, 23 nt, Mycobacterium avium subsp. paratuberculosis
ucagcgucgaugugggccgcagc

SEQ ID NO: 878084 - RNA, 17 nt, Mycobacterium avium subsp. paratuberculosis
ucagcgucgccaugccg

SEQ ID NO: 878085 - RNA, 18 nt, Mycobacterium avium subsp. paratuberculosis
ucagcgucagcaccgcga

SEQ ID NO: 878086 - RNA, 13 nt, Mycobacterium avium subsp. paratuberculosis
ucagcguccacga

SEQ ID NO: 878087 - RNA, 18 nt, Mycobacterium avium subsp. paratuberculosis
ucagcguccaguccggcg

SEQ ID NO: 878088 - RNA, 15 nt, Mycobacterium avium subsp. paratuberculosis
ucagcguggcgucgg

SEQ ID NO: 878089 - RNA, 18 nt, Mycobacterium avium subsp. paratuberculosis
ucagcguguuggacgccc

SEQ ID NO: 878090 - RNA, 19 nt, Mycobacterium avium subsp. paratuberculosis
ucagcguguuggacgcccg

SEQ ID NO: 878091 - RNA, 21 nt, Mycobacterium avium subsp. paratuberculosis
ucagcguguuggacgcccgcu

SEQ ID NO: 878092 - RNA, 23 nt, Mycobacterium avium subsp. paratuberculosis
ucagcguguuggacgcccgcucg

SEQ ID NO: 878093 - RNA, 19 nt, Mycobacterium avium subsp. paratuberculosis
ucagcguucacgucgauca

SEQ ID NO: 878094 - RNA, 20 nt, Mycobacterium avium subsp. paratuberculosis
ucagcguuccggcggccggc

SEQ ID NO: 878095 - RNA, 19 nt, Mycobacterium avium subsp. paratuberculosis
ucagcgucuuggaaagcgc

SEQ ID NO: 878096 - RNA, 22 nt, Mycobacterium avium subsp. paratuberculosis
ucaggccacgcagguccaggau

SEQ ID NO: 878097 - RNA, 16 nt, Mycobacterium avium subsp. paratuberculosis
ucaggcagcgcacgau

SEQ ID NO: 878098 - RNA, 19 nt, Mycobacterium avium subsp. paratuberculosis
ucaggcacucgaucagcac

SEQ ID NO: 878099 - RNA, 18 nt, Mycobacterium avium subsp. paratuberculosis
ucaggcccuugccccacc

SEQ ID NO: 878100 - RNA, 21 nt, Mycobacterium avium subsp. paratuberculosis
ucaggcccgcgccgacggccg

SEQ ID NO: 878101 - RNA, 18 nt, Mycobacterium avium subsp. paratuberculosis
ucaggcccagcgaggcgg

SEQ ID NO: 878102 - RNA, 19 nt, Mycobacterium avium subsp. paratuberculosis
ucaggcccaggcgaccucg

SEQ ID NO: 878103 - RNA, 14 nt, Mycobacterium avium subsp. paratuberculosis
ucaggaucagcagc

SEQ ID NO: 878104 - RNA, 15 nt, Mycobacterium avium subsp. paratuberculosis
ucaggaucagcagcc

SEQ ID NO: 878105 - RNA, 17 nt, Mycobacterium avium subsp. paratuberculosis
ucaggaucgacgucgac

SEQ ID NO: 878106 - RNA, 21 nt, Mycobacterium avium subsp. paratuberculosis
ucaggaucgacuccgggugga

SEQ ID NO: 878107 - RNA, 18 nt, Mycobacterium avium subsp. paratuberculosis
ucaggaacaccgagccgg

SEQ ID NO: 878108 - RNA, 13 nt, Mycobacterium avium subsp. paratuberculosis
ucaggaacccggc

SEQ ID NO: 878109 - RNA, 15 nt, Mycobacterium avium subsp. paratuberculosis
ucaggaacgccggcu

SEQ ID NO: 878110 - RNA, 21 nt, Mycobacterium avium subsp. paratuberculosis
ucagcuuggagccgagcaccg

SEQ ID NO: 878111 - RNA, 17 nt, Mycobacterium avium subsp. paratuberculosis
ucagccgaagccggcgc

SEQ ID NO: 878112 - RNA, 21 nt, Mycobacterium avium subsp. paratuberculosis
ucagccgauacaugugccgau

SEQ ID NO: 878113 - RNA, 22 nt, Mycobacterium avium subsp. paratuberculosis
ucagccgauacaugugccgaug

SEQ ID NO: 878114 - RNA, 22 nt, Mycobacterium avium subsp. paratuberculosis
ucagcccgggauggaucgaguu

SEQ ID NO: 878115 - RNA, 14 nt, Mycobacterium avium subsp. paratuberculosis
ucagcccggugacg

SEQ ID NO: 878116 - RNA, 19 nt, Mycobacterium avium subsp. paratuberculosis
ucagccgcgacagccgccc

SEQ ID NO: 878117 - RNA, 14 nt, Mycobacterium avium subsp. paratuberculosis
ucagccgcccgauc

SEQ ID NO: 878118 - RNA, 14 nt, Mycobacterium avium subsp. paratuberculosis
ucagccgcaccagg

SEQ ID NO: 878119 - RNA, 16 nt, Mycobacterium avium subsp. paratuberculosis
ucagccgcaccagguu

SEQ ID NO: 878120 - RNA, 18 nt, Mycobacterium avium subsp. paratuberculosis
ucagccggcgggcgcucg

SEQ ID NO: 878121 - RNA, 14 nt, Mycobacterium avium subsp. paratuberculosis
ucagccggcucggu

SEQ ID NO: 878122 - RNA, 15 nt, Mycobacterium avium subsp. paratuberculosis
ucagccgggcggccu

SEQ ID NO: 878123 - RNA, 17 nt, Mycobacterium avium subsp. paratuberculosis
ucagccgcggcggcagc

SEQ ID NO: 878124 - RNA, 22 nt, Mycobacterium avium subsp. paratuberculosis
ucagccgcggcggcagcacccg

SEQ ID NO: 878125 - RNA, 13 nt, Mycobacterium avium subsp. paratuberculosis
ucagcaccaggug

SEQ ID NO: 878126 - RNA, 14 nt, Mycobacterium avium subsp. paratuberculosis
ucagccacgccggc

SEQ ID NO: 878127 - RNA, 15 nt, Mycobacterium avium subsp. paratuberculosis
ucagccacgccggca

SEQ ID NO: 878128 - RNA, 17 nt, Mycobacterium avium subsp. paratuberculosis
ucagccacgccggcaca

SEQ ID NO: 878129 - RNA, 18 nt, Mycobacterium avium subsp. paratuberculosis
ucagccacgccggcacac

SEQ ID NO: 878130 - RNA, 13 nt, Mycobacterium avium subsp. paratuberculosis
ucagccacgggcg

SEQ ID NO: 878131 - RNA, 15 nt, Mycobacterium avium subsp. paratuberculosis
ucagccacaccgccg

SEQ ID NO: 878132 - RNA, 16 nt, Mycobacterium avium subsp. paratuberculosis
ucagccacaccgccgg

SEQ ID NO: 878133 - RNA, 17 nt, Mycobacterium avium subsp. paratuberculosis
ucagccacaccgccggc

SEQ ID NO: 878134 - RNA, 22 nt, Mycobacterium avium subsp. paratuberculosis
ucagccacaccgccggcgcgga

SEQ ID NO: 878135 - RNA, 12 nt, Mycobacterium avium subsp. paratuberculosis
ucagccacucgc

SEQ ID NO: 878136 - RNA, 18 nt, Mycobacterium avium subsp. paratuberculosis
ucagccacgggcggucgg

SEQ ID NO: 878137 - RNA, 22 nt, Mycobacterium avium subsp. paratuberculosis
ucagcccggcgcucaccgcgau

SEQ ID NO: 878138 - RNA, 14 nt, Mycobacterium avium subsp. paratuberculosis
ucagcccggcgcug

SEQ ID NO: 878139 - RNA, 22 nt, Mycobacterium avium subsp. paratuberculosis
ucagccagaucgaggccagcgc

SEQ ID NO: 878140 - RNA, 17 nt, Mycobacterium avium subsp. paratuberculosis
ucagcgccaccagcacc

SEQ ID NO: 878141 - RNA, 20 nt, Mycobacterium avium subsp. paratuberculosis
ucagcgccaccagcaccggg

SEQ ID NO: 878142 - RNA, 22 nt, Mycobacterium avium subsp. paratuberculosis
ucagcgcccaggaugacgccga

SEQ ID NO: 878143 - RNA, 17 nt, Mycobacterium avium subsp. paratuberculosis
ucagcgcccgcccggcc

SEQ ID NO: 878144 - RNA, 13 nt, Mycobacterium avium subsp. paratuberculosis
ucagcgcgacagc

SEQ ID NO: 878145 - RNA, 22 nt, Mycobacterium avium subsp. paratuberculosis
ucagcgcgcacagcgccacacc

SEQ ID NO: 878146 - RNA, 23 nt, Mycobacterium avium subsp. paratuberculosis
ucagcgcggccacaccgaucagc

SEQ ID NO: 878147 - RNA, 23 nt, Mycobacterium avium subsp. paratuberculosis
ucagcgcggccaccuccagcccg

SEQ ID NO: 878148 - RNA, 19 nt, Mycobacterium avium subsp. paratuberculosis
ucagcgcgacaucgccggc

SEQ ID NO: 878149 - RNA, 22 nt, Mycobacterium avium subsp. paratuberculosis
ucagcgcgacaucgccggcgac

SEQ ID NO: 878150 - RNA, 17 nt, Mycobacterium avium subsp. paratuberculosis
ucagcgcgaccucggug

SEQ ID NO: 878151 - RNA, 20 nt, Mycobacterium avium subsp. paratuberculosis
ucagcgcgaccucgguggug

SEQ ID NO: 878152 - RNA, 16 nt, Mycobacterium avium subsp. paratuberculosis
ucagcgcgacgugccg

SEQ ID NO: 878153 - RNA, 21 nt, Mycobacterium avium subsp. paratuberculosis
ucagcgcgacgugccggcgau

SEQ ID NO: 878154 - RNA, 23 nt, Mycobacterium avium subsp. paratuberculosis
ucagcgcgacgugccggcgaugg

SEQ ID NO: 878155 - RNA, 13 nt, Mycobacterium avium subsp. paratuberculosis
ucagcgcgccgcc

SEQ ID NO: 878156 - RNA, 14 nt, Mycobacterium avium subsp. paratuberculosis
ucagcgcgccgccc

SEQ ID NO: 878157 - RNA, 21 nt, Mycobacterium avium subsp. paratuberculosis
ucagcgcggcccgcggcguca

SEQ ID NO: 878158 - RNA, 19 nt, Mycobacterium avium subsp. paratuberculosis
ucagcgcuuccagcgcggc

SEQ ID NO: 878159 - RNA, 22 nt, Mycobacterium avium subsp. paratuberculosis
ucagcgcuuccagcgcggcgau

SEQ ID NO: 878160 - RNA, 21 nt, Mycobacterium avium subsp. paratuberculosis
ucagcggagugaccgccagca

SEQ ID NO: 878161 - RNA, 23 nt, Mycobacterium avium subsp. paratuberculosis
ucagcggagugaccgccagcacc

SEQ ID NO: 878162 - RNA, 22 nt, Mycobacterium avium subsp. paratuberculosis
ucagcggauagaggcggcgcau

SEQ ID NO: 878163 - RNA, 19 nt, Mycobacterium avium subsp. paratuberculosis
ucagcggcaacacgccggc

SEQ ID NO: 878164 - RNA, 20 nt, Mycobacterium avium subsp. paratuberculosis
ucagcgcgucgaggucgcgc

SEQ ID NO: 878165 - RNA, 22 nt, Mycobacterium avium subsp. paratuberculosis
ucagcgcgucgaggucgcgcag

SEQ ID NO: 878166 - RNA, 16 nt, Mycobacterium avium subsp. paratuberculosis
ucagcgcgucggcgac

SEQ ID NO: 878167 - RNA, 17 nt, Mycobacterium avium subsp. paratuberculosis
ucagcgcggcgggccag

SEQ ID NO: 878168 - RNA, 16 nt, Mycobacterium avium subsp. paratuberculosis
ucagcgcgggccagca

SEQ ID NO: 878169 - RNA, 20 nt, Mycobacterium avium subsp. paratuberculosis
ucagcggccaucgccgccau

SEQ ID NO: 878170 - RNA, 23 nt, Mycobacterium avium subsp. paratuberculosis
ucagcggccaucgccgccaucgc

SEQ ID NO: 878171 - RNA, 21 nt, Mycobacterium avium subsp. paratuberculosis
ucagcggcccgaucaccaggc

SEQ ID NO: 878172 - RNA, 18 nt, Mycobacterium avium subsp. paratuberculosis
ucagcggcgggcccagca

SEQ ID NO: 878173 - RNA, 21 nt, Mycobacterium avium subsp. paratuberculosis
ucagcggcgucaggaugguga

SEQ ID NO: 878174 - RNA, 19 nt, Mycobacterium avium subsp. paratuberculosis
ucagcggcgugcugcgcag

SEQ ID NO: 878175 - RNA, 15 nt, Mycobacterium avium subsp. paratuberculosis
ucagcggcgccaccg

SEQ ID NO: 878176 - RNA, 15 nt, Mycobacterium avium subsp. paratuberculosis
uaguugcgcgccgau

SEQ ID NO: 878177 - RNA, 15 nt, Mycobacterium avium subsp. paratuberculosis
uagugguccaccgcc

SEQ ID NO: 878178 - RNA, 13 nt, Mycobacterium avium subsp. paratuberculosis
uaguggucgucgu

SEQ ID NO: 878179 - RNA, 17 nt, Mycobacterium avium subsp. paratuberculosis
uagugcagccgcccguc

SEQ ID NO: 878180 - RNA, 14 nt, Mycobacterium avium subsp. paratuberculosis
uagucgucgaccgc

SEQ ID NO: 878181 - RNA, 19 nt, Mycobacterium avium subsp. paratuberculosis
uaguccagggugucgucgu

SEQ ID NO: 878182 - RNA, 13 nt, Mycobacterium avium subsp. paratuberculosis
uagucgaccaccc

SEQ ID NO: 878183 - RNA, 20 nt, Mycobacterium avium subsp. paratuberculosis
uagucgaccgggaucgugug

SEQ ID NO: 878184 - RNA, 17 nt, Mycobacterium avium subsp. paratuberculosis
uagucggcgaucagcuc

SEQ ID NO: 878185 - RNA, 16 nt, Mycobacterium avium subsp. paratuberculosis
uagucggcgaucggcg

SEQ ID NO: 878186 - RNA, 14 nt, Mycobacterium avium subsp. paratuberculosis
uagguggucuccca

SEQ ID NO: 878187 - RNA, 20 nt, Mycobacterium avium subsp. paratuberculosis
uagguggccagcacgaucgg

SEQ ID NO: 878188 - RNA, 13 nt, Mycobacterium avium subsp. paratuberculosis
uaggugccggccg

SEQ ID NO: 878189 - RNA, 20 nt, Mycobacterium avium subsp. paratuberculosis
uaggucgguggccaccaccg

SEQ ID NO: 878190 - RNA, 13 nt, Mycobacterium avium subsp. paratuberculosis
uaggucacccggu

SEQ ID NO: 878191 - RNA, 16 nt, Mycobacterium avium subsp. paratuberculosis
uagggucgggugcggc

SEQ ID NO: 878192 - RNA, 22 nt, Mycobacterium avium subsp. paratuberculosis
uaggguucgccgauguccccgc

SEQ ID NO: 878193 - RNA, 15 nt, Mycobacterium avium subsp. paratuberculosis
uaguacgaccgcgac

SEQ ID NO: 878194 - RNA, 14 nt, Mycobacterium avium subsp. paratuberculosis
uaguagcgccacau

SEQ ID NO: 878195 - RNA, 21 nt, Mycobacterium avium subsp. paratuberculosis
uaguccagcaccugaccgucg

SEQ ID NO: 878196 - RNA, 13 nt, Mycobacterium avium subsp. paratuberculosis
uauuggcuagcgc

SEQ ID NO: 878197 - RNA, 13 nt, Mycobacterium avium subsp. paratuberculosis
uaucccaucagug

SEQ ID NO: 878198 - RNA, 20 nt, Mycobacterium avium subsp. paratuberculosis
uaucccgucaggucgcggua

SEQ ID NO: 878199 - RNA, 13 nt, Mycobacterium avium subsp. paratuberculosis
uagaagccgcgac

SEQ ID NO: 878200 - RNA, 19 nt, Mycobacterium avium subsp. paratuberculosis
uagaugagccgcagccggg

SEQ ID NO: 878201 - RNA, 22 nt, Mycobacterium avium subsp. paratuberculosis
uagccggaccgcuugacgccgc

SEQ ID NO: 878202 - RNA, 17 nt, Mycobacterium avium subsp. paratuberculosis
uagauguugcggccggc

SEQ ID NO: 878203 - RNA, 16 nt, Mycobacterium avium subsp. paratuberculosis
uagccggccagcgucg

SEQ ID NO: 878204 - RNA, 23 nt, Mycobacterium avium subsp. paratuberculosis
uagccggccagcgucgcgccgcc

SEQ ID NO: 878205 - RNA, 16 nt, Mycobacterium avium subsp. paratuberculosis
uagccggccagcucga

SEQ ID NO: 878206 - RNA, 21 nt, Mycobacterium avium subsp. paratuberculosis
uagccggccgcgucgccgacc

SEQ ID NO: 878207 - RNA, 21 nt, Mycobacterium avium subsp. paratuberculosis
uagccggcgaucgucgccguc

SEQ ID NO: 878208 - RNA, 17 nt, Mycobacterium avium subsp. paratuberculosis
uagccggcgguggccau

SEQ ID NO: 878209 - RNA, 18 nt, Mycobacterium avium subsp. paratuberculosis
uagccggggacggugcag

SEQ ID NO: 878210 - RNA, 18 nt, Mycobacterium avium subsp. paratuberculosis
uagccggugaucgcggcg

SEQ ID NO: 878211 - RNA, 19 nt, Mycobacterium avium subsp. paratuberculosis
uagccggugaucgcggcgc

SEQ ID NO: 878212 - RNA, 17 nt, Mycobacterium avium subsp. paratuberculosis
uagccguacacggcggc

SEQ ID NO: 878213 - RNA, 17 nt, Mycobacterium avium subsp. paratuberculosis
uagccguagaucgucga

SEQ ID NO: 878214 - RNA, 19 nt, Mycobacterium avium subsp. paratuberculosis
uagccgucgaaacggcugc

SEQ ID NO: 878215 - RNA, 16 nt, Mycobacterium avium subsp. paratuberculosis
uagcgugcgcccgacg

SEQ ID NO: 878216 - RNA, 14 nt, Mycobacterium avium subsp. paratuberculosis
uagcucagccacgc

SEQ ID NO: 878217 - RNA, 17 nt, Mycobacterium avium subsp. paratuberculosis
uagcucagccacgccgg

SEQ ID NO: 878218 - RNA, 17 nt, Mycobacterium avium subsp. paratuberculosis
uagcggaucaggucggu

SEQ ID NO: 878219 - RNA, 22 nt, Mycobacterium avium subsp. paratuberculosis
uagcgcugggugaacaccccgc

SEQ ID NO: 878220 - RNA, 16 nt, Mycobacterium avium subsp. paratuberculosis
uagcgagcgggcacgc

SEQ ID NO: 878221 - RNA, 22 nt, Mycobacterium avium subsp. paratuberculosis
uagccuuugccgugcucggcgg

SEQ ID NO: 878222 - RNA, 12 nt, Mycobacterium avium subsp. paratuberculosis
uagcgcgccggg

SEQ ID NO: 878223 - RNA, 23 nt, Mycobacterium avium subsp. paratuberculosis
uagcgcgcgaaggcucgccacgc

SEQ ID NO: 878224 - RNA, 14 nt, Mycobacterium avium subsp. paratuberculosis
uagcgccgcccguc

SEQ ID NO: 878225 - RNA, 16 nt, Mycobacterium avium subsp. paratuberculosis
uagcgccgccggggcg

SEQ ID NO: 878226 - RNA, 19 nt, Mycobacterium avium subsp. paratuberculosis
uagcgccgccggggcgggc

SEQ ID NO: 878227 - RNA, 15 nt, Mycobacterium avium subsp. paratuberculosis
uagcgccgcucggcc

SEQ ID NO: 878228 - RNA, 14 nt, Mycobacterium avium subsp. paratuberculosis
uagcgccggcaaca

SEQ ID NO: 878229 - RNA, 21 nt, Mycobacterium avium subsp. paratuberculosis
uagcgccgguaggccgcgccg

SEQ ID NO: 878230 - RNA, 23 nt, Mycobacterium avium subsp. paratuberculosis
uagcgccgguaggccgcgccgau

SEQ ID NO: 878231 - RNA, 17 nt, Mycobacterium avium subsp. paratuberculosis
uagcgcggccgcccguc

SEQ ID NO: 878232 - RNA, 20 nt, Mycobacterium avium subsp. paratuberculosis
uaggacaccgaacccggauc

SEQ ID NO: 878233 - RNA, 14 nt, Mycobacterium avium subsp. paratuberculosis
uaggacccggcgag

SEQ ID NO: 878234 - RNA, 14 nt, Mycobacterium avium subsp. paratuberculosis
uaggagcugccggc

SEQ ID NO: 878235 - RNA, 17 nt, Mycobacterium avium subsp. paratuberculosis
uaggagcugccggcgac

SEQ ID NO: 878236 - RNA, 18 nt, Mycobacterium avium subsp. paratuberculosis
uaggccagcagcgcggcg

SEQ ID NO: 878237 - RNA, 14 nt, Mycobacterium avium subsp. paratuberculosis
uaggccagcccggc

SEQ ID NO: 878238 - RNA, 19 nt, Mycobacterium avium subsp. paratuberculosis
uaggccagcccggcgugca

SEQ ID NO: 878239 - RNA, 22 nt, Mycobacterium avium subsp. paratuberculosis
uaggcauccugcuggccgggcu

SEQ ID NO: 878240 - RNA, 18 nt, Mycobacterium avium subsp. paratuberculosis
uagcuucacgcucggcgc

SEQ ID NO: 878241 - RNA, 15 nt, Mycobacterium avium subsp. paratuberculosis
uagcugcgggucucg

SEQ ID NO: 878242 - RNA, 14 nt, Mycobacterium avium subsp. paratuberculosis
uaggccgcgcagau

SEQ ID NO: 878243 - RNA, 15 nt, Mycobacterium avium subsp. paratuberculosis
uaggccgccgcgacc

SEQ ID NO: 878244 - RNA, 14 nt, Mycobacterium avium subsp. paratuberculosis
uaggccaggaccgg

SEQ ID NO: 878245 - RNA, 18 nt, Mycobacterium avium subsp. paratuberculosis
uaggccucguggaacacc

SEQ ID NO: 878246 - RNA, 18 nt, Mycobacterium avium subsp. paratuberculosis
uaggccgcgaggauuucg

SEQ ID NO: 878247 - RNA, 11 nt, Mycobacterium avium subsp. paratuberculosis
uaggcgaucgg

SEQ ID NO: 878248 - RNA, 16 nt, Mycobacterium avium subsp. paratuberculosis
uaggcgaugucgacgu

SEQ ID NO: 878249 - RNA, 13 nt, Mycobacterium avium subsp. paratuberculosis
uaggcucggcagc

SEQ ID NO: 878250 - RNA, 22 nt, Mycobacterium avium subsp. paratuberculosis
uaggcgucgaacgggccgggca

SEQ ID NO: 878251 - RNA, 15 nt, Mycobacterium avium subsp. paratuberculosis
uaggcgccgccgcgc

SEQ ID NO: 878252 - RNA, 18 nt, Mycobacterium avium subsp. paratuberculosis
uaggcgcgggugauuucg

SEQ ID NO: 878253 - RNA, 23 nt, Mycobacterium avium subsp. paratuberculosis
uaggcggcgagauuggccucggc

SEQ ID NO: 878254 - RNA, 14 nt, Mycobacterium avium subsp. paratuberculosis
uagggcccacgcuc

SEQ ID NO: 878255 - RNA, 14 nt, Mycobacterium avium subsp. paratuberculosis
uagggcgaccacca

SEQ ID NO: 878256 - RNA, 22 nt, Mycobacterium avium subsp. paratuberculosis
uagggcuccgcgcugaccagcg

SEQ ID NO: 878257 - RNA, 19 nt, Mycobacterium avium subsp. paratuberculosis
uacucggucaccucgucga

SEQ ID NO: 878258 - RNA, 14 nt, Mycobacterium avium subsp. paratuberculosis
uacucggacgccgg

SEQ ID NO: 878259 - RNA, 21 nt, Mycobacterium avium subsp. paratuberculosis
uacuccgguaccacgccgucg

SEQ ID NO: 878260 - RNA, 13 nt, Mycobacterium avium subsp. paratuberculosis
uagaacgacgaca

SEQ ID NO: 878261 - RNA, 16 nt, Mycobacterium avium subsp. paratuberculosis
uacuucgucagcagcg

SEQ ID NO: 878262 - RNA, 15 nt, Mycobacterium avium subsp. paratuberculosis
uacggcggcucgggg

SEQ ID NO: 878263 - RNA, 22 nt, Mycobacterium avium subsp. paratuberculosis
uacggcucaacggccggcgccg

SEQ ID NO: 878264 - RNA, 12 nt, Mycobacterium avium subsp. paratuberculosis
uacggcggccgc

SEQ ID NO: 878265 - RNA, 13 nt, Mycobacterium avium subsp. paratuberculosis
uacggcgccggua

SEQ ID NO: 878266 - RNA, 15 nt, Mycobacterium avium subsp. paratuberculosis
uaccgugccucgcca

SEQ ID NO: 878267 - RNA, 13 nt, Mycobacterium avium subsp. paratuberculosis
uacaugugccgau

SEQ ID NO: 878268 - RNA, 16 nt, Mycobacterium avium subsp. paratuberculosis
uacgacaucucgacgg

SEQ ID NO: 878269 - RNA, 15 nt, Mycobacterium avium subsp. paratuberculosis
uacggccgacgccca

SEQ ID NO: 878270 - RNA, 17 nt, Mycobacterium avium subsp. paratuberculosis
uacgcugcggcgccggg

SEQ ID NO: 878271 - RNA, 13 nt, Mycobacterium avium subsp. paratuberculosis
uacgaccgcgacg

SEQ ID NO: 878272 - RNA, 14 nt, Mycobacterium avium subsp. paratuberculosis
uacgcgccggccag

SEQ ID NO: 878273 - RNA, 19 nt, Mycobacterium avium subsp. paratuberculosis
uacgcgccggccagccggc

SEQ ID NO: 878274 - RNA, 20 nt, Mycobacterium avium subsp. paratuberculosis
uacgcgccggccugucaacg

SEQ ID NO: 878275 - RNA, 19 nt, Mycobacterium avium subsp. paratuberculosis
uacgcgauggcggcgcgcu

SEQ ID NO: 878276 - RNA, 20 nt, Mycobacterium avium subsp. paratuberculosis
uacgcgauggcggcgcgcuc

SEQ ID NO: 878277 - RNA, 16 nt, Mycobacterium avium subsp. paratuberculosis
uacgcgagcugcuucg

SEQ ID NO: 878278 - RNA, 23 nt, Mycobacterium avium subsp. paratuberculosis
uacgcgagcugcuucgucgccgg

SEQ ID NO: 878279 - RNA, 23 nt, Mycobacterium avium subsp. paratuberculosis
uacgcgacgaaccgccacacguc

SEQ ID NO: 878280 - RNA, 20 nt, Mycobacterium avium subsp. paratuberculosis
uacgcgguucgugcgcaacg

SEQ ID NO: 878281 - RNA, 21 nt, Mycobacterium avium subsp. paratuberculosis
uacgcgguucgugcgcaacga

SEQ ID NO: 878282 - RNA, 19 nt, Mycobacterium avium subsp. paratuberculosis
uacgcggcguugccgccgg

SEQ ID NO: 878283 - RNA, 16 nt, Mycobacterium avium subsp. paratuberculosis
uacgcgcugccgacga

SEQ ID NO: 878284 - RNA, 15 nt, Mycobacterium avium subsp. paratuberculosis
uaaagccgaccgccc

SEQ ID NO: 878285 - RNA, 15 nt, Mycobacterium avium subsp. paratuberculosis
uaacuucacgcucgg

SEQ ID NO: 878286 - RNA, 23 nt, Mycobacterium avium subsp. paratuberculosis
uaaccgggcaguuccuugcgcag

SEQ ID NO: 878287 - RNA, 19 nt, Mycobacterium avium subsp. paratuberculosis
uaacgcgucgacggcaagc

SEQ ID NO: 878288 - RNA, 22 nt, Mycobacterium avium subsp. paratuberculosis
uaacccgggacccggaacccgc

SEQ ID NO: 878289 - RNA, 18 nt, Mycobacterium avium subsp. paratuberculosis
uaaccgaagcggcccgag

SEQ ID NO: 878290 - RNA, 15 nt, Mycobacterium avium subsp. paratuberculosis
uaaccgcgggcaucg

SEQ ID NO: 878291 - RNA, 13 nt, Mycobacterium avium subsp. paratuberculosis
uaaccucggcggc

SEQ ID NO: 878292 - RNA, 13 nt, Mycobacterium avium subsp. paratuberculosis
uacacggcccgcg

SEQ ID NO: 878293 - RNA, 15 nt, Mycobacterium avium subsp. paratuberculosis
uacacggcccgcggc

SEQ ID NO: 878294 - RNA, 19 nt, Mycobacterium avium subsp. paratuberculosis
uacacggcccgcggcacgc

SEQ ID NO: 878295 - RNA, 19 nt, Mycobacterium avium subsp. paratuberculosis
uacaaggugauggcccgcu

SEQ ID NO: 878296 - RNA, 15 nt, Mycobacterium avium subsp. paratuberculosis
uacaggccgucgggg

SEQ ID NO: 878297 - RNA, 18 nt, Mycobacterium avium subsp. paratuberculosis
uacaggagggccagggcu

SEQ ID NO: 878298 - RNA, 22 nt, Mycobacterium avium subsp. paratuberculosis
guuuuguugaccguugcgcccc

SEQ ID NO: 878299 - RNA, 16 nt, Mycobacterium avium subsp. paratuberculosis
guuuugaugccgccgg

SEQ ID NO: 878300 - RNA, 16 nt, Mycobacterium avium subsp. paratuberculosis
guuuugcggcccugca

SEQ ID NO: 878301 - RNA, 24 nt, Mycobacterium avium subsp. paratuberculosis
guuuugcgucugcucggcggcuca

SEQ ID NO: 878302 - RNA, 21 nt, Mycobacterium avium subsp. paratuberculosis
guuuucggcgcgcagcucgcg

SEQ ID NO: 878303 - RNA, 19 nt, Mycobacterium avium subsp. paratuberculosis
guuugucccuugggcggau

SEQ ID NO: 878304 - RNA, 15 nt, Mycobacterium avium subsp. paratuberculosis
guuuguccugcucgg

SEQ ID NO: 878305 - RNA, 14 nt, Mycobacterium avium subsp. paratuberculosis
guuugcccucgucg

SEQ ID NO: 878306 - RNA, 18 nt, Mycobacterium avium subsp. paratuberculosis
guuuggucagcgcccccg

SEQ ID NO: 878307 - RNA, 12 nt, Mycobacterium avium subsp. paratuberculosis
guuuggcgccgc

SEQ ID NO: 878308 - RNA, 12 nt, Mycobacterium avium subsp. paratuberculosis
guuuggccgcgc

SEQ ID NO: 878309 - RNA, 21 nt, Mycobacterium avium subsp. paratuberculosis
guuucgucucuuccucgggca

SEQ ID NO: 878310 - RNA, 18 nt, Mycobacterium avium subsp. paratuberculosis
guuugagcgugccgccgg

SEQ ID NO: 878311 - RNA, 20 nt, Mycobacterium avium subsp. paratuberculosis
guuucuccacccccuacgcc

SEQ ID NO: 878312 - RNA, 14 nt, Mycobacterium avium subsp. paratuberculosis
guuucggucggcgu

SEQ ID NO: 878313 - RNA, 17 nt, Mycobacterium avium subsp. paratuberculosis
guuucggucggcgucga

SEQ ID NO: 878314 - RNA, 16 nt, Mycobacterium avium subsp. paratuberculosis
guuucgggucgagagc

SEQ ID NO: 878315 - RNA, 18 nt, Mycobacterium avium subsp. paratuberculosis
guuucgugaacgacgccg

SEQ ID NO: 878316 - RNA, 23 nt, Mycobacterium avium subsp. paratuberculosis
guuucgugugguacagcgccagc

SEQ ID NO: 878317 - RNA, 19 nt, Mycobacterium avium subsp. paratuberculosis
guugucgcucagaggcggg

SEQ ID NO: 878318 - RNA, 14 nt, Mycobacterium avium subsp. paratuberculosis
guugucgcugaacg

SEQ ID NO: 878319 - RNA, 17 nt, Mycobacterium avium subsp. paratuberculosis
guugucgaucuccucgc

SEQ ID NO: 878320 - RNA, 14 nt, Mycobacterium avium subsp. paratuberculosis
guuucccgucgggg

SEQ ID NO: 878321 - RNA, 22 nt, Mycobacterium avium subsp. paratuberculosis
guuuccggugcucccccggacc

SEQ ID NO: 878322 - RNA, 16 nt, Mycobacterium avium subsp. paratuberculosis
guuuccguccggcgac

SEQ ID NO: 878323 - RNA, 17 nt, Mycobacterium avium subsp. paratuberculosis
guuuccguccggcgaca

SEQ ID NO: 878324 - RNA, 20 nt, Mycobacterium avium subsp. paratuberculosis
guuuccguccggcgacaugc

SEQ ID NO: 878325 - RNA, 16 nt, Mycobacterium avium subsp. paratuberculosis
guuuccaguccggcgc

SEQ ID NO: 878326 - RNA, 21 nt, Mycobacterium avium subsp. paratuberculosis
guuuccaguccggcgcccggc

SEQ ID NO: 878327 - RNA, 17 nt, Mycobacterium avium subsp. paratuberculosis
guuucgaggaucugggc

SEQ ID NO: 878328 - RNA, 17 nt, Mycobacterium avium subsp. paratuberculosis
guuucggccggccccgc

SEQ ID NO: 878329 - RNA, 21 nt, Mycobacterium avium subsp. paratuberculosis
guuggcacccgaccgacgccc

SEQ ID NO: 878330 - RNA, 15 nt, Mycobacterium avium subsp. paratuberculosis
guuggcaggcccggu

SEQ ID NO: 878331 - RNA, 13 nt, Mycobacterium avium subsp. paratuberculosis
guuggccaccggg

SEQ ID NO: 878332 - RNA, 23 nt, Mycobacterium avium subsp. paratuberculosis
guuggccagauacuccucgguga

SEQ ID NO: 878333 - RNA, 15 nt, Mycobacterium avium subsp. paratuberculosis
guuggccagaugccc

SEQ ID NO: 878334 - RNA, 16 nt, Mycobacterium avium subsp. paratuberculosis
guuggccagcaccgcg

SEQ ID NO: 878335 - RNA, 14 nt, Mycobacterium avium subsp. paratuberculosis
guuggugccgcuga

SEQ ID NO: 878336 - RNA, 11 nt, Mycobacterium avium subsp. paratuberculosis
guuggugcggg

SEQ ID NO: 878337 - RNA, 20 nt, Mycobacterium avium subsp. paratuberculosis
guuggugcggugcaucgucg

SEQ ID NO: 878338 - RNA, 20 nt, Mycobacterium avium subsp. paratuberculosis
guugguggucgacgcgccgc

SEQ ID NO: 878339 - RNA, 20 nt, Mycobacterium avium subsp. paratuberculosis
guuggugacgcucacccggc

SEQ ID NO: 878340 - RNA, 21 nt, Mycobacterium avium subsp. paratuberculosis
guuggugaucagccccgccuc

SEQ ID NO: 878341 - RNA, 22 nt, Mycobacterium avium subsp. paratuberculosis
guuggugaucgccgacgucugg

SEQ ID NO: 878342 - RNA, 23 nt, Mycobacterium avium subsp. paratuberculosis
guuggugaacagguaggcggcgc

SEQ ID NO: 878343 - RNA, 20 nt, Mycobacterium avium subsp. paratuberculosis
guuggcccgcaccacccagc

SEQ ID NO: 878344 - RNA, 23 nt, Mycobacterium avium subsp. paratuberculosis
guuggcccgcaccacccagcccu

SEQ ID NO: 878345 - RNA, 15 nt, Mycobacterium avium subsp. paratuberculosis
guuggcccuucgacc

SEQ ID NO: 878346 - RNA, 20 nt, Mycobacterium avium subsp. paratuberculosis
guuggccgagcagccgggcc

SEQ ID NO: 878347 - RNA, 19 nt, Mycobacterium avium subsp. paratuberculosis
guuggccgccaagugcggu

SEQ ID NO: 878348 - RNA, 14 nt, Mycobacterium avium subsp. paratuberculosis
guugucgccgcgcc

SEQ ID NO: 878349 - RNA, 15 nt, Mycobacterium avium subsp. paratuberculosis
guugucgccgcgcca

SEQ ID NO: 878350 - RNA, 17 nt, Mycobacterium avium subsp. paratuberculosis
guugucgccgcgccagc

SEQ ID NO: 878351 - RNA, 21 nt, Mycobacterium avium subsp. paratuberculosis
guugucccggaagugccggcg

SEQ ID NO: 878352 - RNA, 22 nt, Mycobacterium avium subsp. paratuberculosis
guugucccgggcgaacgucggg

SEQ ID NO: 878353 - RNA, 14 nt, Mycobacterium avium subsp. paratuberculosis
guuguccagcagcg

SEQ ID NO: 878354 - RNA, 14 nt, Mycobacterium avium subsp. paratuberculosis
guuguccgaccagg

SEQ ID NO: 878355 - RNA, 15 nt, Mycobacterium avium subsp. paratuberculosis
guuguccgaccagga

SEQ ID NO: 878356 - RNA, 16 nt, Mycobacterium avium subsp. paratuberculosis
guuguccgagccgccc

SEQ ID NO: 878357 - RNA, 18 nt, Mycobacterium avium subsp. paratuberculosis
guugguguccacccgcgc

SEQ ID NO: 878358 - RNA, 18 nt, Mycobacterium avium subsp. paratuberculosis
guugauacucgggcaacg

SEQ ID NO: 878359 - RNA, 19 nt, Mycobacterium avium subsp. paratuberculosis
guugauaggucacgccggg

SEQ ID NO: 878360 - RNA, 19 nt, Mycobacterium avium subsp. paratuberculosis
guugaucacgggcacaccg

SEQ ID NO: 878361 - RNA, 22 nt, Mycobacterium avium subsp. paratuberculosis
guugaucacgggcacaccgucg

SEQ ID NO: 878362 - RNA, 16 nt, Mycobacterium avium subsp. paratuberculosis
guugaggaugucgacg

SEQ ID NO: 878363 - RNA, 14 nt, Mycobacterium avium subsp. paratuberculosis
guugagugcgccgu

SEQ ID NO: 878364 - RNA, 16 nt, Mycobacterium avium subsp. paratuberculosis
guugcaaucucgucgg

SEQ ID NO: 878365 - RNA, 12 nt, Mycobacterium avium subsp. paratuberculosis
guugcaccggca

SEQ ID NO: 878366 - RNA, 15 nt, Mycobacterium avium subsp. paratuberculosis
guugcaccggcaccg

SEQ ID NO: 878367 - RNA, 17 nt, Mycobacterium avium subsp. paratuberculosis
guugcacaggucgaugg

SEQ ID NO: 878368 - RNA, 23 nt, Mycobacterium avium subsp. paratuberculosis
guugcaccgcgauggcccgcgcg

SEQ ID NO: 878369 - RNA, 17 nt, Mycobacterium avium subsp. paratuberculosis
guugcacuuucgcgguc

SEQ ID NO: 878370 - RNA, 18 nt, Mycobacterium avium subsp. paratuberculosis
guugcacuuucggcagcu

SEQ ID NO: 878371 - RNA, 20 nt, Mycobacterium avium subsp. paratuberculosis
guugcacuuucggcagcuga

SEQ ID NO: 878372 - RNA, 22 nt, Mycobacterium avium subsp. paratuberculosis
guugccaacaccagggugucga

SEQ ID NO: 878373 - RNA, 17 nt, Mycobacterium avium subsp. paratuberculosis
guugccaggccgcgagc

SEQ ID NO: 878374 - RNA, 18 nt, Mycobacterium avium subsp. paratuberculosis
guugcaggccacgcccac

SEQ ID NO: 878375 - RNA, 17 nt, Mycobacterium avium subsp. paratuberculosis
guugcacggucuggugg

SEQ ID NO: 878376 - RNA, 15 nt, Mycobacterium avium subsp. paratuberculosis
guugcagcgccgcgg

SEQ ID NO: 878377 - RNA, 15 nt, Mycobacterium avium subsp. paratuberculosis
guuggacaggccggc

SEQ ID NO: 878378 - RNA, 17 nt, Mycobacterium avium subsp. paratuberculosis
guuggacgcccgcucga

SEQ ID NO: 878379 - RNA, 22 nt, Mycobacterium avium subsp. paratuberculosis
guuggacuccaccgccaccgcg

SEQ ID NO: 878380 - RNA, 22 nt, Mycobacterium avium subsp. paratuberculosis
guugcggcgucagguccgcgaa

SEQ ID NO: 878381 - RNA, 12 nt, Mycobacterium avium subsp. paratuberculosis
guugcggcgggc

SEQ ID NO: 878382 - RNA, 22 nt, Mycobacterium avium subsp. paratuberculosis
guugcggaucggugcaggccgc

SEQ ID NO: 878383 - RNA, 17 nt, Mycobacterium avium subsp. paratuberculosis
guugcggcaccggcgaa

SEQ ID NO: 878384 - RNA, 14 nt, Mycobacterium avium subsp. paratuberculosis
guugcggcagcaca

SEQ ID NO: 878385 - RNA, 14 nt, Mycobacterium avium subsp. paratuberculosis
guugcggccggcca

SEQ ID NO: 878386 - RNA, 17 nt, Mycobacterium avium subsp. paratuberculosis
guugcggccggccauga

SEQ ID NO: 878387 - RNA, 14 nt, Mycobacterium avium subsp. paratuberculosis
guugcggccggcgg

SEQ ID NO: 878388 - RNA, 15 nt, Mycobacterium avium subsp. paratuberculosis
guugcggccggcggu

SEQ ID NO: 878389 - RNA, 20 nt, Mycobacterium avium subsp. paratuberculosis
guugcggccggcggugucgu

SEQ ID NO: 878390 - RNA, 15 nt, Mycobacterium avium subsp. paratuberculosis
guugcugagccgccg

SEQ ID NO: 878391 - RNA, 14 nt, Mycobacterium avium subsp. paratuberculosis
guugcuggcgcgau

SEQ ID NO: 878392 - RNA, 14 nt, Mycobacterium avium subsp. paratuberculosis
guugcuggcgucgu

SEQ ID NO: 878393 - RNA, 20 nt, Mycobacterium avium subsp. paratuberculosis
guugcuggcgucguuggcgc

SEQ ID NO: 878394 - RNA, 17 nt, Mycobacterium avium subsp. paratuberculosis
guugccguuguccuuga

SEQ ID NO: 878395 - RNA, 13 nt, Mycobacterium avium subsp. paratuberculosis
guugccgugcugg

SEQ ID NO: 878396 - RNA, 13 nt, Mycobacterium avium subsp. paratuberculosis
guugccgucgacg

SEQ ID NO: 878397 - RNA, 15 nt, Mycobacterium avium subsp. paratuberculosis
guugccggcccgcag

SEQ ID NO: 878398 - RNA, 16 nt, Mycobacterium avium subsp. paratuberculosis
guugccggcccgcagc

SEQ ID NO: 878399 - RNA, 18 nt, Mycobacterium avium subsp. paratuberculosis
guugccggcccgcagcgc

SEQ ID NO: 878400 - RNA, 19 nt, Mycobacterium avium subsp. paratuberculosis
guugccggucgggauggcg

SEQ ID NO: 878401 - RNA, 14 nt, Mycobacterium avium subsp. paratuberculosis
guugccggucucga

SEQ ID NO: 878402 - RNA, 18 nt, Mycobacterium avium subsp. paratuberculosis
guugcgcguucaagccgc

SEQ ID NO: 878403 - RNA, 18 nt, Mycobacterium avium subsp. paratuberculosis
guugcgcucuguuggccg

SEQ ID NO: 878404 - RNA, 21 nt, Mycobacterium avium subsp. paratuberculosis
guugcggaucgaacggcggaa

SEQ ID NO: 878405 - RNA, 19 nt, Mycobacterium avium subsp. paratuberculosis
guugccugguucgacguga

SEQ ID NO: 878406 - RNA, 21 nt, Mycobacterium avium subsp. paratuberculosis
guugccgugggggucgacccg

SEQ ID NO: 878407 - RNA, 13 nt, Mycobacterium avium subsp. paratuberculosis
guugcgcggcggc

SEQ ID NO: 878408 - RNA, 15 nt, Mycobacterium avium subsp. paratuberculosis
guugcgcggcggcca

SEQ ID NO: 878409 - RNA, 13 nt, Mycobacterium avium subsp. paratuberculosis
guugcgcgggaag

SEQ ID NO: 878410 - RNA, 19 nt, Mycobacterium avium subsp. paratuberculosis
guugcgcgggaagccgccg

SEQ ID NO: 878411 - RNA, 21 nt, Mycobacterium avium subsp. paratuberculosis
guugcgcgggaagccgccgcc

SEQ ID NO: 878412 - RNA, 16 nt, Mycobacterium avium subsp. paratuberculosis
guugcgcggaccggcg

SEQ ID NO: 878413 - RNA, 18 nt, Mycobacterium avium subsp. paratuberculosis
guugcgcggaccggcgau

SEQ ID NO: 878414 - RNA, 20 nt, Mycobacterium avium subsp. paratuberculosis
guucguagggacugcgccgg

SEQ ID NO: 878415 - RNA, 14 nt, Mycobacterium avium subsp. paratuberculosis
guucguugcgccgc

SEQ ID NO: 878416 - RNA, 16 nt, Mycobacterium avium subsp. paratuberculosis
guucguugcgccgcca

SEQ ID NO: 878417 - RNA, 12 nt, Mycobacterium avium subsp. paratuberculosis
guucgucgucgc

SEQ ID NO: 878418 - RNA, 14 nt, Mycobacterium avium subsp. paratuberculosis
guucgucgucgcgc

SEQ ID NO: 878419 - RNA, 16 nt, Mycobacterium avium subsp. paratuberculosis
guucucgcggcggccg

SEQ ID NO: 878420 - RNA, 17 nt, Mycobacterium avium subsp. paratuberculosis
guucucgagcccgaucu

SEQ ID NO: 878421 - RNA, 16 nt, Mycobacterium avium subsp. paratuberculosis
guucuccagcggccgc

SEQ ID NO: 878422 - RNA, 22 nt, Mycobacterium avium subsp. paratuberculosis
guucuccagcggccgcagcgcg

SEQ ID NO: 878423 - RNA, 14 nt, Mycobacterium avium subsp. paratuberculosis
guucuccccgccgg

SEQ ID NO: 878424 - RNA, 13 nt, Mycobacterium avium subsp. paratuberculosis
guucuccaccgcg

SEQ ID NO: 878425 - RNA, 23 nt, Mycobacterium avium subsp. paratuberculosis
guucuccagcacgaaggccgccg

SEQ ID NO: 878426 - RNA, 15 nt, Mycobacterium avium subsp. paratuberculosis
guucuccgcgacauc

SEQ ID NO: 878427 - RNA, 22 nt, Mycobacterium avium subsp. paratuberculosis
guucuccucccagcccucgucg

SEQ ID NO: 878428 - RNA, 16 nt, Mycobacterium avium subsp. paratuberculosis
guucuccucgucgcgg

SEQ ID NO: 878429 - RNA, 19 nt, Mycobacterium avium subsp. paratuberculosis
guggucugaccccccgacg

SEQ ID NO: 878430 - RNA, 21 nt, Mycobacterium avium subsp. paratuberculosis
guggucucguacaaggugaug

SEQ ID NO: 878431 - RNA, 16 nt, Mycobacterium avium subsp. paratuberculosis
guggucucguugugca

SEQ ID NO: 878432 - RNA, 13 nt, Mycobacterium avium subsp. paratuberculosis
guggucgucgacg

SEQ ID NO: 878433 - RNA, 14 nt, Mycobacterium avium subsp. paratuberculosis
guggucgucgucga

SEQ ID NO: 878434 - RNA, 19 nt, Mycobacterium avium subsp. paratuberculosis
guggucucccagacgucga

SEQ ID NO: 878435 - RNA, 18 nt, Mycobacterium avium subsp. paratuberculosis
guggucuccuggccgccg

SEQ ID NO: 878436 - RNA, 22 nt, Mycobacterium avium subsp. paratuberculosis
guggucucgcaccugccgucga

SEQ ID NO: 878437 - RNA, 23 nt, Mycobacterium avium subsp. paratuberculosis
guggugacggccccagacgaagu

SEQ ID NO: 878438 - RNA, 14 nt, Mycobacterium avium subsp. paratuberculosis
guggugacgggcgu

SEQ ID NO: 878439 - RNA, 20 nt, Mycobacterium avium subsp. paratuberculosis
guggugacgggcgucggcgg

SEQ ID NO: 878440 - RNA, 13 nt, Mycobacterium avium subsp. paratuberculosis
guggugacccgca

SEQ ID NO: 878441 - RNA, 21 nt, Mycobacterium avium subsp. paratuberculosis
guggugacccgcaacucgggc

SEQ ID NO: 878442 - RNA, 14 nt, Mycobacterium avium subsp. paratuberculosis
guggugacccggac

SEQ ID NO: 878443 - RNA, 16 nt, Mycobacterium avium subsp. paratuberculosis
guggugacccggaccg

SEQ ID NO: 878444 - RNA, 16 nt, Mycobacterium avium subsp. paratuberculosis
guucgucgcggcggcc

SEQ ID NO: 878445 - RNA, 22 nt, Mycobacterium avium subsp. paratuberculosis
guucgucgcggcggcccgucgc

SEQ ID NO: 878446 - RNA, 13 nt, Mycobacterium avium subsp. paratuberculosis
guucgucggcgau

SEQ ID NO: 878447 - RNA, 20 nt, Mycobacterium avium subsp. paratuberculosis
guucgucggcgaucgccagc

SEQ ID NO: 878448 - RNA, 23 nt, Mycobacterium avium subsp. paratuberculosis
guucgucgaguucgcggcgcagc

SEQ ID NO: 878449 - RNA, 18 nt, Mycobacterium avium subsp. paratuberculosis
guucguccacgcuggcgg

SEQ ID NO: 878450 - RNA, 14 nt, Mycobacterium avium subsp. paratuberculosis
guucguccagcccg

SEQ ID NO: 878451 - RNA, 21 nt, Mycobacterium avium subsp. paratuberculosis
guucgucccgcgcgggggccg

SEQ ID NO: 878452 - RNA, 23 nt, Mycobacterium avium subsp. paratuberculosis
guucgucccgcgcgggggccgcc

SEQ ID NO: 878453 - RNA, 15 nt, Mycobacterium avium subsp. paratuberculosis
guggugaucagcauc

SEQ ID NO: 878454 - RNA, 19 nt, Mycobacterium avium subsp. paratuberculosis
guggugaccguacucgugg

SEQ ID NO: 878455 - RNA, 22 nt, Mycobacterium avium subsp. paratuberculosis
guggugaucggccaggcgccca

SEQ ID NO: 878456 - RNA, 16 nt, Mycobacterium avium subsp. paratuberculosis
guugaacgcgcgggug

SEQ ID NO: 878457 - RNA, 14 nt, Mycobacterium avium subsp. paratuberculosis
guugaacggcaccc

SEQ ID NO: 878458 - RNA, 19 nt, Mycobacterium avium subsp. paratuberculosis
guugaacggcaccccgcgg

SEQ ID NO: 878459 - RNA, 20 nt, Mycobacterium avium subsp. paratuberculosis
guucugcacguccucgucgg

SEQ ID NO: 878460 - RNA, 17 nt, Mycobacterium avium subsp. paratuberculosis
guugaagucuucggcca

SEQ ID NO: 878461 - RNA, 11 nt, Mycobacterium avium subsp. paratuberculosis
guugaccacca

SEQ ID NO: 878462 - RNA, 14 nt, Mycobacterium avium subsp. paratuberculosis
guugaccaccagcg

SEQ ID NO: 878463 - RNA, 22 nt, Mycobacterium avium subsp. paratuberculosis
guugacaccgggugcguccaga

SEQ ID NO: 878464 - RNA, 17 nt, Mycobacterium avium subsp. paratuberculosis
guugaccaacgccgccu

SEQ ID NO: 878465 - RNA, 15 nt, Mycobacterium avium subsp. paratuberculosis
guugaccaccagcgu

SEQ ID NO: 878466 - RNA, 13 nt, Mycobacterium avium subsp. paratuberculosis
guugacgccgaug

SEQ ID NO: 878467 - RNA, 18 nt, Mycobacterium avium subsp. paratuberculosis
guugacgcugggcggcga

SEQ ID NO: 878468 - RNA, 15 nt, Mycobacterium avium subsp. paratuberculosis
guugacgggccgcgg

SEQ ID NO: 878469 - RNA, 16 nt, Mycobacterium avium subsp. paratuberculosis
guugacgggccgcggc

SEQ ID NO: 878470 - RNA, 22 nt, Mycobacterium avium subsp. paratuberculosis
guugagccacaacaugucccgg

SEQ ID NO: 878471 - RNA, 15 nt, Mycobacterium avium subsp. paratuberculosis
guugagcccggaccg

SEQ ID NO: 878472 - RNA, 19 nt, Mycobacterium avium subsp. paratuberculosis
guugagcccggaccggccg

SEQ ID NO: 878473 - RNA, 20 nt, Mycobacterium avium subsp. paratuberculosis
guugagcccggaccggccgu

SEQ ID NO: 878474 - RNA, 19 nt, Mycobacterium avium subsp. paratuberculosis
guugagccggcgcaccgcg

SEQ ID NO: 878475 - RNA, 14 nt, Mycobacterium avium subsp. paratuberculosis
guugagcuucucgg

SEQ ID NO: 878476 - RNA, 17 nt, Mycobacterium avium subsp. paratuberculosis
guugagcuucucgguga

SEQ ID NO: 878477 - RNA, 16 nt, Mycobacterium avium subsp. paratuberculosis
guugagcacgcccgcg

SEQ ID NO: 878478 - RNA, 20 nt, Mycobacterium avium subsp. paratuberculosis
guugagcagcagaccgccgg

SEQ ID NO: 878479 - RNA, 21 nt, Mycobacterium avium subsp. paratuberculosis
guugagcacacacaggucgcc

SEQ ID NO: 878480 - RNA, 17 nt, Mycobacterium avium subsp. paratuberculosis
guugagcacacccagcg

SEQ ID NO: 878481 - RNA, 16 nt, Mycobacterium avium subsp. paratuberculosis
guugagcaccagcccg

SEQ ID NO: 878482 - RNA, 13 nt, Mycobacterium avium subsp. paratuberculosis
guugagcaccgca

SEQ ID NO: 878483 - RNA, 13 nt, Mycobacterium avium subsp. paratuberculosis
guugagcaccgcg

SEQ ID NO: 878484 - RNA, 17 nt, Mycobacterium avium subsp. paratuberculosis
guugacggugaccggcg

SEQ ID NO: 878485 - RNA, 14 nt, Mycobacterium avium subsp. paratuberculosis
guugacguccgcgg

SEQ ID NO: 878486 - RNA, 15 nt, Mycobacterium avium subsp. paratuberculosis
guugacguccgcggg

SEQ ID NO: 878487 - RNA, 20 nt, Mycobacterium avium subsp. paratuberculosis
guugacgugcaccggcgagu

SEQ ID NO: 878488 - RNA, 23 nt, Mycobacterium avium subsp. paratuberculosis
guugacguugaucgcgccgaucu

SEQ ID NO: 878489 - RNA, 20 nt, Mycobacterium avium subsp. paratuberculosis
gguguacacgucgcggguga

SEQ ID NO: 878490 - RNA, 20 nt, Mycobacterium avium subsp. paratuberculosis
ggugguuuugcgucugcucg

SEQ ID NO: 878491 - RNA, 14 nt, Mycobacterium avium subsp. paratuberculosis
ggugguuggccgcc

SEQ ID NO: 878492 - RNA, 13 nt, Mycobacterium avium subsp. paratuberculosis
gguguagcccggu

SEQ ID NO: 878493 - RNA, 15 nt, Mycobacterium avium subsp. paratuberculosis
gguguagccgugccc

SEQ ID NO: 878494 - RNA, 15 nt, Mycobacterium avium subsp. paratuberculosis
gguguggcgucggcc

SEQ ID NO: 878495 - RNA, 21 nt, Mycobacterium avium subsp. paratuberculosis
gguguggcgucggccgggggc

SEQ ID NO: 878496 - RNA, 18 nt, Mycobacterium avium subsp. paratuberculosis
gguguugaucauccggcg

SEQ ID NO: 878497 - RNA, 16 nt, Mycobacterium avium subsp. paratuberculosis
gguguugcgcacccgc

SEQ ID NO: 878498 - RNA, 15 nt, Mycobacterium avium subsp. paratuberculosis
gguguuccaccagcg

SEQ ID NO: 878499 - RNA, 17 nt, Mycobacterium avium subsp. paratuberculosis
gguguuccaccagcggc

SEQ ID NO: 878500 - RNA, 13 nt, Mycobacterium avium subsp. paratuberculosis
gguguucggcgcc

SEQ ID NO: 878501 - RNA, 22 nt, Mycobacterium avium subsp. paratuberculosis
gguguucuugaacggcgcgucg

SEQ ID NO: 878502 - RNA, 15 nt, Mycobacterium avium subsp. paratuberculosis
gguguucaccgcgcc

SEQ ID NO: 878503 - RNA, 14 nt, Mycobacterium avium subsp. paratuberculosis
gguguuccccgggc

SEQ ID NO: 878504 - RNA, 19 nt, Mycobacterium avium subsp. paratuberculosis
gguguuccccgggcgagcg

SEQ ID NO: 878505 - RNA, 16 nt, Mycobacterium avium subsp. paratuberculosis
gguguucgagggcgcg

SEQ ID NO: 878506 - RNA, 17 nt, Mycobacterium avium subsp. paratuberculosis
gguguucgagggcgcgg

SEQ ID NO: 878507 - RNA, 13 nt, Mycobacterium avium subsp. paratuberculosis
gguguuggacgag

SEQ ID NO: 878508 - RNA, 19 nt, Mycobacterium avium subsp. paratuberculosis
gguucacaaaggccgaaga

SEQ ID NO: 878509 - RNA, 14 nt, Mycobacterium avium subsp. paratuberculosis
gguucaccagcacg

SEQ ID NO: 878510 - RNA, 20 nt, Mycobacterium avium subsp. paratuberculosis
gguucgaucuccucggcgua

SEQ ID NO: 878511 - RNA, 20 nt, Mycobacterium avium subsp. paratuberculosis
gguucgcccuccccggccag

SEQ ID NO: 878512 - RNA, 21 nt, Mycobacterium avium subsp. paratuberculosis
gguucgccgauguccccgcgg

SEQ ID NO: 878513 - RNA, 13 nt, Mycobacterium avium subsp. paratuberculosis
gguucgccgccca

SEQ ID NO: 878514 - RNA, 16 nt, Mycobacterium avium subsp. paratuberculosis
gguucauccacucggc

SEQ ID NO: 878515 - RNA, 12 nt, Mycobacterium avium subsp. paratuberculosis
gguucggcggca

SEQ ID NO: 878516 - RNA, 20 nt, Mycobacterium avium subsp. paratuberculosis
gguucgccggugaccgcgcc

SEQ ID NO: 878517 - RNA, 16 nt, Mycobacterium avium subsp. paratuberculosis
gguucgcuggcggcca

SEQ ID NO: 878518 - RNA, 17 nt, Mycobacterium avium subsp. paratuberculosis
gguucgcuggcggccag

SEQ ID NO: 878519 - RNA, 14 nt, Mycobacterium avium subsp. paratuberculosis
gguucgucguggcc

SEQ ID NO: 878520 - RNA, 20 nt, Mycobacterium avium subsp. paratuberculosis
gguucgucgugucguguucg

SEQ ID NO: 878521 - RNA, 16 nt, Mycobacterium avium subsp. paratuberculosis
gguucgguggccccgg

SEQ ID NO: 878522 - RNA, 22 nt, Mycobacterium avium subsp. paratuberculosis
gguucgguggccccgggccgca

SEQ ID NO: 878523 - RNA, 18 nt, Mycobacterium avium subsp. paratuberculosis
gguucguugcgccgccag

SEQ ID NO: 878524 - RNA, 14 nt, Mycobacterium avium subsp. paratuberculosis
gguucuccgcgaca

SEQ ID NO: 878525 - RNA, 15 nt, Mycobacterium avium subsp. paratuberculosis
gguucuccggcccgc

SEQ ID NO: 878526 - RNA, 15 nt, Mycobacterium avium subsp. paratuberculosis
gguucucggugggga

SEQ ID NO: 878527 - RNA, 13 nt, Mycobacterium avium subsp. paratuberculosis
gguucucgcggcg

SEQ ID NO: 878528 - RNA, 18 nt, Mycobacterium avium subsp. paratuberculosis
gguucucgcggcggccga

SEQ ID NO: 878529 - RNA, 22 nt, Mycobacterium avium subsp. paratuberculosis
gguugcagaugucgguggccuu

SEQ ID NO: 878530 - RNA, 17 nt, Mycobacterium avium subsp. paratuberculosis
gguugcacaggucgaug

SEQ ID NO: 878531 - RNA, 17 nt, Mycobacterium avium subsp. paratuberculosis
gguugagcaggucagcc

SEQ ID NO: 878532 - RNA, 21 nt, Mycobacterium avium subsp. paratuberculosis
gguugacgccgaugcgguuga

SEQ ID NO: 878533 - RNA, 17 nt, Mycobacterium avium subsp. paratuberculosis
gguugacguccgcggga

SEQ ID NO: 878534 - RNA, 17 nt, Mycobacterium avium subsp. paratuberculosis
gguugacgugcaccggc

SEQ ID NO: 878535 - RNA, 18 nt, Mycobacterium avium subsp. paratuberculosis
gguugacccggccggucg

SEQ ID NO: 878536 - RNA, 19 nt, Mycobacterium avium subsp. paratuberculosis
gguugacccggccggucgc

SEQ ID NO: 878537 - RNA, 17 nt, Mycobacterium avium subsp. paratuberculosis
gguugacccucagcagg

SEQ ID NO: 878538 - RNA, 15 nt, Mycobacterium avium subsp. paratuberculosis
gguugaacggcaccc

SEQ ID NO: 878539 - RNA, 21 nt, Mycobacterium avium subsp. paratuberculosis
gguugaccaggugggcggcca

SEQ ID NO: 878540 - RNA, 13 nt, Mycobacterium avium subsp. paratuberculosis
gguugaagcuggc

SEQ ID NO: 878541 - RNA, 15 nt, Mycobacterium avium subsp. paratuberculosis
gguugaccaccagcg

SEQ ID NO: 878542 - RNA, 19 nt, Mycobacterium avium subsp. paratuberculosis
gguucuuggcggccugcuc

SEQ ID NO: 878543 - RNA, 13 nt, Mycobacterium avium subsp. paratuberculosis
gguucuucgacca

SEQ ID NO: 878544 - RNA, 23 nt, Mycobacterium avium subsp. paratuberculosis
guaaaccgccagcagcgcaagcu

SEQ ID NO: 878545 - RNA, 17 nt, Mycobacterium avium subsp. paratuberculosis
guaaaccagcagcgcca

SEQ ID NO: 878546 - RNA, 18 nt, Mycobacterium avium subsp. paratuberculosis
guaagccauggcggcccg

SEQ ID NO: 878547 - RNA, 19 nt, Mycobacterium avium subsp. paratuberculosis
guaagccauggcggcccgc

SEQ ID NO: 878548 - RNA, 15 nt, Mycobacterium avium subsp. paratuberculosis
guaaccgcagccggg

SEQ ID NO: 878549 - RNA, 21 nt, Mycobacterium avium subsp. paratuberculosis
guaaccguggcaggcgauggu

SEQ ID NO: 878550 - RNA, 14 nt, Mycobacterium avium subsp. paratuberculosis
guaacccuccggcg

SEQ ID NO: 878551 - RNA, 15 nt, Mycobacterium avium subsp. paratuberculosis
guaacaacucgccgg

SEQ ID NO: 878552 - RNA, 19 nt, Mycobacterium avium subsp. paratuberculosis
guaacacgaucucggucgc

SEQ ID NO: 878553 - RNA, 22 nt, Mycobacterium avium subsp. paratuberculosis
guaacagagcgggaucccgcag

SEQ ID NO: 878554 - RNA, 15 nt, Mycobacterium avium subsp. paratuberculosis
gguuugaccacggcg

SEQ ID NO: 878555 - RNA, 16 nt, Mycobacterium avium subsp. paratuberculosis
gguuucgugugcucag

SEQ ID NO: 878556 - RNA, 17 nt, Mycobacterium avium subsp. paratuberculosis
gguuucggggucgccgu

SEQ ID NO: 878557 - RNA, 15 nt, Mycobacterium avium subsp. paratuberculosis
gguuucggucgcggu

SEQ ID NO: 878558 - RNA, 22 nt, Mycobacterium avium subsp. paratuberculosis
gguuuccacgugcacggcgccg

SEQ ID NO: 878559 - RNA, 17 nt, Mycobacterium avium subsp. paratuberculosis
gguuucaccgugcgcgc

SEQ ID NO: 878560 - RNA, 17 nt, Mycobacterium avium subsp. paratuberculosis
gguuuccgcugaugcgg

SEQ ID NO: 878561 - RNA, 18 nt, Mycobacterium avium subsp. paratuberculosis
gguuucaugcacggcgcu

SEQ ID NO: 878562 - RNA, 17 nt, Mycobacterium avium subsp. paratuberculosis
gguuucauucaccgcgg

SEQ ID NO: 878563 - RNA, 18 nt, Mycobacterium avium subsp. paratuberculosis
gguuucauucaccgcggu

SEQ ID NO: 878564 - RNA, 21 nt, Mycobacterium avium subsp. paratuberculosis
gguuucauucaccgcgguugc

SEQ ID NO: 878565 - RNA, 21 nt, Mycobacterium avium subsp. paratuberculosis
gguugcgggccgaacugccga

SEQ ID NO: 878566 - RNA, 17 nt, Mycobacterium avium subsp. paratuberculosis
gguugcggugcuugcug

SEQ ID NO: 878567 - RNA, 21 nt, Mycobacterium avium subsp. paratuberculosis
gguugcggccccgccagcaga

SEQ ID NO: 878568 - RNA, 14 nt, Mycobacterium avium subsp. paratuberculosis
gguugcgccgaggu

SEQ ID NO: 878569 - RNA, 17 nt, Mycobacterium avium subsp. paratuberculosis
gguugcgccgaggucac

SEQ ID NO: 878570 - RNA, 14 nt, Mycobacterium avium subsp. paratuberculosis
gguugcggaucaug

SEQ ID NO: 878571 - RNA, 16 nt, Mycobacterium avium subsp. paratuberculosis
gguugcggaucaugcg

SEQ ID NO: 878572 - RNA, 15 nt, Mycobacterium avium subsp. paratuberculosis
gguugcggcagcaca

SEQ ID NO: 878573 - RNA, 15 nt, Mycobacterium avium subsp. paratuberculosis
gguugccccacacga

SEQ ID NO: 878574 - RNA, 23 nt, Mycobacterium avium subsp. paratuberculosis
gguugccacgcggauagcccagc

SEQ ID NO: 878575 - RNA, 23 nt, Mycobacterium avium subsp. paratuberculosis
gguugcccggaagccgcauggug

SEQ ID NO: 878576 - RNA, 19 nt, Mycobacterium avium subsp. paratuberculosis
gguugccgcacgaccaugu

SEQ ID NO: 878577 - RNA, 18 nt, Mycobacterium avium subsp. paratuberculosis
gguugccgcccucggccg

SEQ ID NO: 878578 - RNA, 15 nt, Mycobacterium avium subsp. paratuberculosis
gguugccgucgacga

SEQ ID NO: 878579 - RNA, 16 nt, Mycobacterium avium subsp. paratuberculosis
gguugccgucgacgaa

SEQ ID NO: 878580 - RNA, 22 nt, Mycobacterium avium subsp. paratuberculosis
gguugccuuuccgcgcggcggg

SEQ ID NO: 878581 - RNA, 15 nt, Mycobacterium avium subsp. paratuberculosis
gguugccggcggcca

SEQ ID NO: 878582 - RNA, 17 nt, Mycobacterium avium subsp. paratuberculosis
gguggaaggugacgucg

SEQ ID NO: 878583 - RNA, 19 nt, Mycobacterium avium subsp. paratuberculosis
gguggaaggugacgucgcc

SEQ ID NO: 878584 - RNA, 20 nt, Mycobacterium avium subsp. paratuberculosis
ggugcuuucgcgucugcucg

SEQ ID NO: 878585 - RNA, 15 nt, Mycobacterium avium subsp. paratuberculosis
ggugcuuggcguuga

SEQ ID NO: 878586 - RNA, 17 nt, Mycobacterium avium subsp. paratuberculosis
ggugcuuggucagcgcg

SEQ ID NO: 878587 - RNA, 23 nt, Mycobacterium avium subsp. paratuberculosis
ggugcuuucgcgucugcucgcgg

SEQ ID NO: 878588 - RNA, 19 nt, Mycobacterium avium subsp. paratuberculosis
ggugcuuaccggccggccg

SEQ ID NO: 878589 - RNA, 21 nt, Mycobacterium avium subsp. paratuberculosis
ggugcuucaucccgucguuga

SEQ ID NO: 878590 - RNA, 15 nt, Mycobacterium avium subsp. paratuberculosis
ggugcggguguccga

SEQ ID NO: 878591 - RNA, 18 nt, Mycobacterium avium subsp. paratuberculosis
ggugcgguaggugccggc

SEQ ID NO: 878592 - RNA, 14 nt, Mycobacterium avium subsp. paratuberculosis
ggugcgggugccga

SEQ ID NO: 878593 - RNA, 16 nt, Mycobacterium avium subsp. paratuberculosis
ggugcgggugcggccg

SEQ ID NO: 878594 - RNA, 19 nt, Mycobacterium avium subsp. paratuberculosis
ggugcugucgucgcccuga

SEQ ID NO: 878595 - RNA, 12 nt, Mycobacterium avium subsp. paratuberculosis
gguggccagcac

SEQ ID NO: 878596 - RNA, 14 nt, Mycobacterium avium subsp. paratuberculosis
gguggccagcacca

SEQ ID NO: 878597 - RNA, 23 nt, Mycobacterium avium subsp. paratuberculosis
gguggccagcaccacguccgcgg

SEQ ID NO: 878598 - RNA, 20 nt, Mycobacterium avium subsp. paratuberculosis
gguggccagcaccagcccga

SEQ ID NO: 878599 - RNA, 16 nt, Mycobacterium avium subsp. paratuberculosis
gguggccagcaccgcg

SEQ ID NO: 878600 - RNA, 16 nt, Mycobacterium avium subsp. paratuberculosis
gguggccagcacgcug

SEQ ID NO: 878601 - RNA, 20 nt, Mycobacterium avium subsp. paratuberculosis
gguggacagaugccagacga

SEQ ID NO: 878602 - RNA, 21 nt, Mycobacterium avium subsp. paratuberculosis
gguggccaaaaagugccggac

SEQ ID NO: 878603 - RNA, 16 nt, Mycobacterium avium subsp. paratuberculosis
gguggccaccaccgag

SEQ ID NO: 878604 - RNA, 20 nt, Mycobacterium avium subsp. paratuberculosis
gguggccaccaccgaggugg

SEQ ID NO: 878605 - RNA, 14 nt, Mycobacterium avium subsp. paratuberculosis
gguggacagcgcga

SEQ ID NO: 878606 - RNA, 20 nt, Mycobacterium avium subsp. paratuberculosis
gguggacagcgcgacgggca

SEQ ID NO: 878607 - RNA, 17 nt, Mycobacterium avium subsp. paratuberculosis
gguggaauaggccgcgu

SEQ ID NO: 878608 - RNA, 16 nt, Mycobacterium avium subsp. paratuberculosis
gguggaaugcaucgcg

SEQ ID NO: 878609 - RNA, 19 nt, Mycobacterium avium subsp. paratuberculosis
gguggaaugcaucgcgauc

SEQ ID NO: 878610 - RNA, 23 nt, Mycobacterium avium subsp. paratuberculosis
gguggaauucuggccgaccgccg

SEQ ID NO: 878611 - RNA, 13 nt, Mycobacterium avium subsp. paratuberculosis
gguggacaccgcg

SEQ ID NO: 878612 - RNA, 17 nt, Mycobacterium avium subsp. paratuberculosis
ggugcgggccagcacga

SEQ ID NO: 878613 - RNA, 22 nt, Mycobacterium avium subsp. paratuberculosis
ggugcgggccagcacgaccccg

SEQ ID NO: 878614 - RNA, 16 nt, Mycobacterium avium subsp. paratuberculosis
ggugcgggccagcagc

SEQ ID NO: 878615 - RNA, 22 nt, Mycobacterium avium subsp. paratuberculosis
ggugcgggcguccuugaccagc

SEQ ID NO: 878616 - RNA, 15 nt, Mycobacterium avium subsp. paratuberculosis
ggugcggggccgcgg

SEQ ID NO: 878617 - RNA, 12 nt, Mycobacterium avium subsp. paratuberculosis
ggugcggcaccu

SEQ ID NO: 878618 - RNA, 13 nt, Mycobacterium avium subsp. paratuberculosis
ggugcggccagcg

SEQ ID NO: 878619 - RNA, 14 nt, Mycobacterium avium subsp. paratuberculosis
ggugcggcccgcgg

SEQ ID NO: 878620 - RNA, 21 nt, Mycobacterium avium subsp. paratuberculosis
ggugcggccgcauuuggcgua

SEQ ID NO: 878621 - RNA, 20 nt, Mycobacterium avium subsp. paratuberculosis
ggugcggccgcgcagcucga

SEQ ID NO: 878622 - RNA, 14 nt, Mycobacterium avium subsp. paratuberculosis
ggugcggcgcucgg

SEQ ID NO: 878623 - RNA, 19 nt, Mycobacterium avium subsp. paratuberculosis
ggugcggcgcucggugugc

SEQ ID NO: 878624 - RNA, 18 nt, Mycobacterium avium subsp. paratuberculosis
ggugcggcggugacgaug

SEQ ID NO: 878625 - RNA, 17 nt, Mycobacterium avium subsp. paratuberculosis
ggugcggcgguguucga

SEQ ID NO: 878626 - RNA, 22 nt, Mycobacterium avium subsp. paratuberculosis
ggugcggcucacaugggcgcgu

SEQ ID NO: 878627 - RNA, 18 nt, Mycobacterium avium subsp. paratuberculosis
ggugcggaaggcccccgg

SEQ ID NO: 878628 - RNA, 16 nt, Mycobacterium avium subsp. paratuberculosis
ggugcgcuggccgacc

SEQ ID NO: 878629 - RNA, 17 nt, Mycobacterium avium subsp. paratuberculosis
ggugcgcuggccgaccc

SEQ ID NO: 878630 - RNA, 17 nt, Mycobacterium avium subsp. paratuberculosis
ggugcggaaaagucggg

SEQ ID NO: 878631 - RNA, 14 nt, Mycobacterium avium subsp. paratuberculosis
ggugcgcucgacgg

SEQ ID NO: 878632 - RNA, 21 nt, Mycobacterium avium subsp. paratuberculosis
ggugcgcucgacggccugcac

SEQ ID NO: 878633 - RNA, 14 nt, Mycobacterium avium subsp. paratuberculosis
ggugcgcgccggcg

SEQ ID NO: 878634 - RNA, 12 nt, Mycobacterium avium subsp. paratuberculosis
ggugcgcggcga

SEQ ID NO: 878635 - RNA, 15 nt, Mycobacterium avium subsp. paratuberculosis
ggugcgcggucagcg

SEQ ID NO: 878636 - RNA, 17 nt, Mycobacterium avium subsp. paratuberculosis
ggugcgcggucagcgcg

SEQ ID NO: 878637 - RNA, 17 nt, Mycobacterium avium subsp. paratuberculosis
ggugcgcgucagccguc

SEQ ID NO: 878638 - RNA, 15 nt, Mycobacterium avium subsp. paratuberculosis
ggugcgcucaccgca

SEQ ID NO: 878639 - RNA, 18 nt, Mycobacterium avium subsp. paratuberculosis
ggugcgcgagauggcgau

SEQ ID NO: 878640 - RNA, 18 nt, Mycobacterium avium subsp. paratuberculosis
ggugggguuagggcguca

SEQ ID NO: 878641 - RNA, 17 nt, Mycobacterium avium subsp. paratuberculosis
gguggguccgccgggcg

SEQ ID NO: 878642 - RNA, 19 nt, Mycobacterium avium subsp. paratuberculosis
gguggguccgccgggcgcg

SEQ ID NO: 878643 - RNA, 15 nt, Mycobacterium avium subsp. paratuberculosis
gguggggcuggccgc

SEQ ID NO: 878644 - RNA, 13 nt, Mycobacterium avium subsp. paratuberculosis
gguggggccgccg

SEQ ID NO: 878645 - RNA, 16 nt, Mycobacterium avium subsp. paratuberculosis
gguggggaucacgucg

SEQ ID NO: 878646 - RNA, 15 nt, Mycobacterium avium subsp. paratuberculosis
gguggggcacgggcg

SEQ ID NO: 878647 - RNA, 16 nt, Mycobacterium avium subsp. paratuberculosis
gguggggacgacgccg

SEQ ID NO: 878648 - RNA, 22 nt, Mycobacterium avium subsp. paratuberculosis
ggugguagacagcguggucgcg

SEQ ID NO: 878649 - RNA, 14 nt, Mycobacterium avium subsp. paratuberculosis
gguggucaccagcg

SEQ ID NO: 878650 - RNA, 17 nt, Mycobacterium avium subsp. paratuberculosis
gguggucagcaccggcg

SEQ ID NO: 878651 - RNA, 13 nt, Mycobacterium avium subsp. paratuberculosis
gguggucaccgug

SEQ ID NO: 878652 - RNA, 14 nt, Mycobacterium avium subsp. paratuberculosis
ggugguugaucacg

SEQ ID NO: 878653 - RNA, 18 nt, Mycobacterium avium subsp. paratuberculosis
ggugguugaucacgggca

SEQ ID NO: 878654 - RNA, 16 nt, Mycobacterium avium subsp. paratuberculosis
gguggugugcaaggcg

SEQ ID NO: 878655 - RNA, 14 nt, Mycobacterium avium subsp. paratuberculosis
ggugguggcguugg

SEQ ID NO: 878656 - RNA, 14 nt, Mycobacterium avium subsp. paratuberculosis
gguggugggcgcga

SEQ ID NO: 878657 - RNA, 14 nt, Mycobacterium avium subsp. paratuberculosis
gguggugggcgcgg

SEQ ID NO: 878658 - RNA, 19 nt, Mycobacterium avium subsp. paratuberculosis
ggugguggggccggcgaag

SEQ ID NO: 878659 - RNA, 15 nt, Mycobacterium avium subsp. paratuberculosis
ggugguggucgucga

SEQ ID NO: 878660 - RNA, 16 nt, Mycobacterium avium subsp. paratuberculosis
gguggccugcccggcg

SEQ ID NO: 878661 - RNA, 21 nt, Mycobacterium avium subsp. paratuberculosis
gguggccugcccggcggugcc

SEQ ID NO: 878662 - RNA, 22 nt, Mycobacterium avium subsp. paratuberculosis
gguggccugcccggcggugccg

SEQ ID NO: 878663 - RNA, 19 nt, Mycobacterium avium subsp. paratuberculosis
gguggccuucaucaccgcc

SEQ ID NO: 878664 - RNA, 20 nt, Mycobacterium avium subsp. paratuberculosis
gguggccuugacgacggcca

SEQ ID NO: 878665 - RNA, 22 nt, Mycobacterium avium subsp. paratuberculosis
gguggccuugcugauccccagc

SEQ ID NO: 878666 - RNA, 17 nt, Mycobacterium avium subsp. paratuberculosis
gguggcgaacagcgggu

SEQ ID NO: 878667 - RNA, 16 nt, Mycobacterium avium subsp. paratuberculosis
gguggcgaacugcacc

SEQ ID NO: 878668 - RNA, 14 nt, Mycobacterium avium subsp. paratuberculosis
gguggccgggucgc

SEQ ID NO: 878669 - RNA, 15 nt, Mycobacterium avium subsp. paratuberculosis
gguggccgggucgcc

SEQ ID NO: 878670 - RNA, 23 nt, Mycobacterium avium subsp. paratuberculosis
gguggccgucgccucgcccucgg

SEQ ID NO: 878671 - RNA, 16 nt, Mycobacterium avium subsp. paratuberculosis
gguggccgcgcugguc

SEQ ID NO: 878672 - RNA, 16 nt, Mycobacterium avium subsp. paratuberculosis
gguggccgcggccgcc

SEQ ID NO: 878673 - RNA, 19 nt, Mycobacterium avium subsp. paratuberculosis
gguggccgucggccugcgc

SEQ ID NO: 878674 - RNA, 23 nt, Mycobacterium avium subsp. paratuberculosis
gguggccucggcgcugcccgccg

SEQ ID NO: 878675 - RNA, 21 nt, Mycobacterium avium subsp. paratuberculosis
gguggcgacgaaccuggcugc

SEQ ID NO: 878676 - RNA, 13 nt, Mycobacterium avium subsp. paratuberculosis
gguggcgauggug

SEQ ID NO: 878677 - RNA, 22 nt, Mycobacterium avium subsp. paratuberculosis
gguggcgauggugcugcccggc

SEQ ID NO: 878678 - RNA, 13 nt, Mycobacterium avium subsp. paratuberculosis
gguggcgcccagc

SEQ ID NO: 878679 - RNA, 13 nt, Mycobacterium avium subsp. paratuberculosis
gguggcgcccgcg

SEQ ID NO: 878680 - RNA, 14 nt, Mycobacterium avium subsp. paratuberculosis
gguggcgcccgcgg

SEQ ID NO: 878681 - RNA, 18 nt, Mycobacterium avium subsp. paratuberculosis
gguggcgcccgcggugga

SEQ ID NO: 878682 - RNA, 14 nt, Mycobacterium avium subsp. paratuberculosis
gguggcgcccggag

SEQ ID NO: 878683 - RNA, 18 nt, Mycobacterium avium subsp. paratuberculosis
gguggcgaucaccgcggc

SEQ ID NO: 878684 - RNA, 15 nt, Mycobacterium avium subsp. paratuberculosis
ggugggcucggcgcc

SEQ ID NO: 878685 - RNA, 17 nt, Mycobacterium avium subsp. paratuberculosis
gguggcccggucgucga

SEQ ID NO: 878686 - RNA, 24 nt, Mycobacterium avium subsp. paratuberculosis
gguggccgaacgggucggcgacca

SEQ ID NO: 878687 - RNA, 18 nt, Mycobacterium avium subsp. paratuberculosis
gguggccgaucagcggcg

SEQ ID NO: 878688 - RNA, 14 nt, Mycobacterium avium subsp. paratuberculosis
gguggccgccacca

SEQ ID NO: 878689 - RNA, 15 nt, Mycobacterium avium subsp. paratuberculosis
gguggccgccaccag

SEQ ID NO: 878690 - RNA, 13 nt, Mycobacterium avium subsp. paratuberculosis
gguggccgccagc

SEQ ID NO: 878691 - RNA, 15 nt, Mycobacterium avium subsp. paratuberculosis
gguggccccgggccg

SEQ ID NO: 878692 - RNA, 17 nt, Mycobacterium avium subsp. paratuberculosis
gguggcccgcccgggca

SEQ ID NO: 878693 - RNA, 12 nt, Mycobacterium avium subsp. paratuberculosis
gguggcccgcgc

SEQ ID NO: 878694 - RNA, 18 nt, Mycobacterium avium subsp. paratuberculosis
gguggcccaaucggugcg

SEQ ID NO: 878695 - RNA, 21 nt, Mycobacterium avium subsp. paratuberculosis
gguggcccagccgcugacgau

SEQ ID NO: 878696 - RNA, 22 nt, Mycobacterium avium subsp. paratuberculosis
gguggcccaggcagacccccag

SEQ ID NO: 878697 - RNA, 23 nt, Mycobacterium avium subsp. paratuberculosis
gguggcccaggcagacccccagc

SEQ ID NO: 878698 - RNA, 17 nt, Mycobacterium avium subsp. paratuberculosis
gguggccccagcccggg

SEQ ID NO: 878699 - RNA, 12 nt, Mycobacterium avium subsp. paratuberculosis
gguggccaccgc

SEQ ID NO: 878700 - RNA, 13 nt, Mycobacterium avium subsp. paratuberculosis
gguggccaccgcg

SEQ ID NO: 878701 - RNA, 18 nt, Mycobacterium avium subsp. paratuberculosis
gguggccaccgcgacgcc

SEQ ID NO: 878702 - RNA, 22 nt, Mycobacterium avium subsp. paratuberculosis
gguggccaccgcgacgcccagg

SEQ ID NO: 878703 - RNA, 13 nt, Mycobacterium avium subsp. paratuberculosis
gguggccagccgg

SEQ ID NO: 878704 - RNA, 16 nt, Mycobacterium avium subsp. paratuberculosis
gguggccagccgggcg

SEQ ID NO: 878705 - RNA, 14 nt, Mycobacterium avium subsp. paratuberculosis
ggugcccgggccgc

SEQ ID NO: 878706 - RNA, 21 nt, Mycobacterium avium subsp. paratuberculosis
ggugcccgggguccaccggcc

SEQ ID NO: 878707 - RNA, 21 nt, Mycobacterium avium subsp. paratuberculosis
ggugcccucaauagcgggcua

SEQ ID NO: 878708 - RNA, 14 nt, Mycobacterium avium subsp. paratuberculosis
ggugcccuccucgc

SEQ ID NO: 878709 - RNA, 23 nt, Mycobacterium avium subsp. paratuberculosis
ggugcccgauuggaagagggcca

SEQ ID NO: 878710 - RNA, 16 nt, Mycobacterium avium subsp. paratuberculosis
ggugcccgccgcgacc

SEQ ID NO: 878711 - RNA, 19 nt, Mycobacterium avium subsp. paratuberculosis
ggugcccgccgcgaccgcg

SEQ ID NO: 878712 - RNA, 18 nt, Mycobacterium avium subsp. paratuberculosis
ggugcccgcguacagcgg

SEQ ID NO: 878713 - RNA, 21 nt, Mycobacterium avium subsp. paratuberculosis
ggugcccgcguacagcggguc

SEQ ID NO: 878714 - RNA, 21 nt, Mycobacterium avium subsp. paratuberculosis
ggugcccggaacggcgggccc

SEQ ID NO: 878715 - RNA, 15 nt, Mycobacterium avium subsp. paratuberculosis
ggugcccggcgagga

SEQ ID NO: 878716 - RNA, 19 nt, Mycobacterium avium subsp. paratuberculosis
ggugcccggcugggcgcgc

SEQ ID NO: 878717 - RNA, 18 nt, Mycobacterium avium subsp. paratuberculosis
ggugccgacggugcgugc

SEQ ID NO: 878718 - RNA, 14 nt, Mycobacterium avium subsp. paratuberculosis
ggugccgagcacgc

SEQ ID NO: 878719 - RNA, 21 nt, Mycobacterium avium subsp. paratuberculosis
ggugccgagcacgcggccgcg

SEQ ID NO: 878720 - RNA, 22 nt, Mycobacterium avium subsp. paratuberculosis
ggugccgagcacgcggccgcgc

SEQ ID NO: 878721 - RNA, 17 nt, Mycobacterium avium subsp. paratuberculosis
ggugccgaccugggcgg

SEQ ID NO: 878722 - RNA, 20 nt, Mycobacterium avium subsp. paratuberculosis
ggugccgaccugggcggcca

SEQ ID NO: 878723 - RNA, 20 nt, Mycobacterium avium subsp. paratuberculosis
ggugccgacgaugagggcca

SEQ ID NO: 878724 - RNA, 13 nt, Mycobacterium avium subsp. paratuberculosis
ggugccgaccgcg

SEQ ID NO: 878725 - RNA, 22 nt, Mycobacterium avium subsp. paratuberculosis
ggugccgacgagcucgccgcug

SEQ ID NO: 878726 - RNA, 23 nt, Mycobacterium avium subsp. paratuberculosis
ggugccgacgagcucgccgcugu

SEQ ID NO: 878727 - RNA, 23 nt, Mycobacterium avium subsp. paratuberculosis
ggugccgacgauccgggcgcccu

SEQ ID NO: 878728 - RNA, 24 nt, Mycobacterium avium subsp. paratuberculosis
ggugcccgagcugaucgcggccgg

SEQ ID NO: 878729 - RNA, 17 nt, Mycobacterium avium subsp. paratuberculosis
ggugcccccgcccggcc

SEQ ID NO: 878730 - RNA, 19 nt, Mycobacterium avium subsp. paratuberculosis
ggugccccgcgaccgcagc

SEQ ID NO: 878731 - RNA, 14 nt, Mycobacterium avium subsp. paratuberculosis
ggugcccagccagg

SEQ ID NO: 878732 - RNA, 18 nt, Mycobacterium avium subsp. paratuberculosis
ggugcccaucugcacagc

SEQ ID NO: 878733 - RNA, 15 nt, Mycobacterium avium subsp. paratuberculosis
ggugccaugccgggu

SEQ ID NO: 878734 - RNA, 14 nt, Mycobacterium avium subsp. paratuberculosis
ggugcccaccagca

SEQ ID NO: 878735 - RNA, 13 nt, Mycobacterium avium subsp. paratuberculosis
ggugcccaccggg

SEQ ID NO: 878736 - RNA, 17 nt, Mycobacterium avium subsp. paratuberculosis
ggugcccaccgggcagc

SEQ ID NO: 878737 - RNA, 20 nt, Mycobacterium avium subsp. paratuberculosis
ggugccgcccaucgaccgga

SEQ ID NO: 878738 - RNA, 16 nt, Mycobacterium avium subsp. paratuberculosis
ggugccgagcccgccg

SEQ ID NO: 878739 - RNA, 17 nt, Mycobacterium avium subsp. paratuberculosis
ggugccgaguucgaccu

SEQ ID NO: 878740 - RNA, 19 nt, Mycobacterium avium subsp. paratuberculosis
ggugccgaguucgaccucg

SEQ ID NO: 878741 - RNA, 20 nt, Mycobacterium avium subsp. paratuberculosis
ggugccgaguucgaccucgg

SEQ ID NO: 878742 - RNA, 20 nt, Mycobacterium avium subsp. paratuberculosis
ggugccgaucaccucgccgg

SEQ ID NO: 878743 - RNA, 14 nt, Mycobacterium avium subsp. paratuberculosis
ggugccgagcgcgc

SEQ ID NO: 878744 - RNA, 18 nt, Mycobacterium avium subsp. paratuberculosis
ggugccgagcgcgcuugg

SEQ ID NO: 878745 - RNA, 15 nt, Mycobacterium avium subsp. paratuberculosis
ggugccgauccgcac

SEQ ID NO: 878746 - RNA, 21 nt, Mycobacterium avium subsp. paratuberculosis
ggugccgauccgcaccggacg

SEQ ID NO: 878747 - RNA, 13 nt, Mycobacterium avium subsp. paratuberculosis
ggugccgccggcg

SEQ ID NO: 878748 - RNA, 18 nt, Mycobacterium avium subsp. paratuberculosis
ggugccgcgaugcccgcc

SEQ ID NO: 878749 - RNA, 22 nt, Mycobacterium avium subsp. paratuberculosis
ggugccgcgcagcaccgucacc

SEQ ID NO: 878750 - RNA, 13 nt, Mycobacterium avium subsp. paratuberculosis
ggugccgcccgga

SEQ ID NO: 878751 - RNA, 15 nt, Mycobacterium avium subsp. paratuberculosis
ggugccgccggcgau

SEQ ID NO: 878752 - RNA, 16 nt, Mycobacterium avium subsp. paratuberculosis
ggugccgccggcgauc

SEQ ID NO: 878753 - RNA, 14 nt, Mycobacterium avium subsp. paratuberculosis
ggugccgccgggga

SEQ ID NO: 878754 - RNA, 12 nt, Mycobacterium avium subsp. paratuberculosis
ggugccgccggu

SEQ ID NO: 878755 - RNA, 15 nt, Mycobacterium avium subsp. paratuberculosis
ggugccgcguucgga

SEQ ID NO: 878756 - RNA, 15 nt, Mycobacterium avium subsp. paratuberculosis
ggugccgcugcccgc

SEQ ID NO: 878757 - RNA, 17 nt, Mycobacterium avium subsp. paratuberculosis
ggugccgcugcccgccg

SEQ ID NO: 878758 - RNA, 23 nt, Mycobacterium avium subsp. paratuberculosis
ggugccgccgugcgcggcgacca

SEQ ID NO: 878759 - RNA, 18 nt, Mycobacterium avium subsp. paratuberculosis
ggugccguugaccacgcc

SEQ ID NO: 878760 - RNA, 23 nt, Mycobacterium avium subsp. paratuberculosis
ggugccguugaucagggcggcgc

SEQ ID NO: 878761 - RNA, 19 nt, Mycobacterium avium subsp. paratuberculosis
ggugccgucgaucgcccgc

SEQ ID NO: 878762 - RNA, 13 nt, Mycobacterium avium subsp. paratuberculosis
ggugccgucgcgc

SEQ ID NO: 878763 - RNA, 16 nt, Mycobacterium avium subsp. paratuberculosis
ggugccggugacgguc

SEQ ID NO: 878764 - RNA, 23 nt, Mycobacterium avium subsp. paratuberculosis
ggugccggugauccacuccagca

SEQ ID NO: 878765 - RNA, 13 nt, Mycobacterium avium subsp. paratuberculosis
ggugccggugaug

SEQ ID NO: 878766 - RNA, 19 nt, Mycobacterium avium subsp. paratuberculosis
ggugccggugaugaacgcg

SEQ ID NO: 878767 - RNA, 23 nt, Mycobacterium avium subsp. paratuberculosis
ggugccgguguugccgacggcgc

SEQ ID NO: 878768 - RNA, 19 nt, Mycobacterium avium subsp. paratuberculosis
ggugccggccagaucgacg

SEQ ID NO: 878769 - RNA, 21 nt, Mycobacterium avium subsp. paratuberculosis
ggugccggccagaucgacgcc

SEQ ID NO: 878770 - RNA, 22 nt, Mycobacterium avium subsp. paratuberculosis
ggugccggccagaucgacgccg

SEQ ID NO: 878771 - RNA, 14 nt, Mycobacterium avium subsp. paratuberculosis
ggugccggccgguc

SEQ ID NO: 878772 - RNA, 12 nt, Mycobacterium avium subsp. paratuberculosis
ggugccggccac

SEQ ID NO: 878773 - RNA, 17 nt, Mycobacterium avium subsp. paratuberculosis
ggugccggccaccggcg

SEQ ID NO: 878774 - RNA, 12 nt, Mycobacterium avium subsp. paratuberculosis
ggugccggcggc

SEQ ID NO: 878775 - RNA, 18 nt, Mycobacterium avium subsp. paratuberculosis
ggugcgcauggcgugcug

SEQ ID NO: 878776 - RNA, 20 nt, Mycobacterium avium subsp. paratuberculosis
ggugcgccacgcccgcagcg

SEQ ID NO: 878777 - RNA, 15 nt, Mycobacterium avium subsp. paratuberculosis
ggugcgccacugcgg

SEQ ID NO: 878778 - RNA, 13 nt, Mycobacterium avium subsp. paratuberculosis
ggugcgccaggca

SEQ ID NO: 878779 - RNA, 14 nt, Mycobacterium avium subsp. paratuberculosis
ggugcgccaggcag

SEQ ID NO: 878780 - RNA, 21 nt, Mycobacterium avium subsp. paratuberculosis
ggugcgccaggcaggcggcca

SEQ ID NO: 878781 - RNA, 20 nt, Mycobacterium avium subsp. paratuberculosis
ggugcgccgcucgucggcca

SEQ ID NO: 878782 - RNA, 15 nt, Mycobacterium avium subsp. paratuberculosis
ggugcgccgccgcgu

SEQ ID NO: 878783 - RNA, 19 nt, Mycobacterium avium subsp. paratuberculosis
ggugcgccgccgcgucgcc

SEQ ID NO: 878784 - RNA, 13 nt, Mycobacterium avium subsp. paratuberculosis
ggugcgcccgucg

SEQ ID NO: 878785 - RNA, 17 nt, Mycobacterium avium subsp. paratuberculosis
ggugcgcccgucggugg

SEQ ID NO: 878786 - RNA, 19 nt, Mycobacterium avium subsp. paratuberculosis
ggugcgcccgucgucgccg

SEQ ID NO: 878787 - RNA, 21 nt, Mycobacterium avium subsp. paratuberculosis
ggugcgccgaccgcgaucgag

SEQ ID NO: 878788 - RNA, 19 nt, Mycobacterium avium subsp. paratuberculosis
ggugcgcagcccgccggga

SEQ ID NO: 878789 - RNA, 15 nt, Mycobacterium avium subsp. paratuberculosis
ggugcgcagccgcug

SEQ ID NO: 878790 - RNA, 14 nt, Mycobacterium avium subsp. paratuberculosis
ggugcgcagccguc

SEQ ID NO: 878791 - RNA, 20 nt, Mycobacterium avium subsp. paratuberculosis
ggugcgcagcgcgucgucgg

SEQ ID NO: 878792 - RNA, 13 nt, Mycobacterium avium subsp. paratuberculosis
ggugcgcaccagc

SEQ ID NO: 878793 - RNA, 15 nt, Mycobacterium avium subsp. paratuberculosis
ggugcgcacgaucug

SEQ ID NO: 878794 - RNA, 21 nt, Mycobacterium avium subsp. paratuberculosis
ggugcgauggcaacgccgguc

SEQ ID NO: 878795 - RNA, 21 nt, Mycobacterium avium subsp. paratuberculosis
ggugcgaaaauggcugcccgg

SEQ ID NO: 878796 - RNA, 22 nt, Mycobacterium avium subsp. paratuberculosis
ggugcgaaaauggcugcccggc

SEQ ID NO: 878797 - RNA, 14 nt, Mycobacterium avium subsp. paratuberculosis
ggugcgacgcccac

SEQ ID NO: 878798 - RNA, 15 nt, Mycobacterium avium subsp. paratuberculosis
ggugcgagccaccuc

SEQ ID NO: 878799 - RNA, 14 nt, Mycobacterium avium subsp. paratuberculosis
ggugcgagccgcug

SEQ ID NO: 878800 - RNA, 16 nt, Mycobacterium avium subsp. paratuberculosis
ggucgucaacgacccg

SEQ ID NO: 878801 - RNA, 17 nt, Mycobacterium avium subsp. paratuberculosis
ggucgucaacgacccgg

SEQ ID NO: 878802 - RNA, 16 nt, Mycobacterium avium subsp. paratuberculosis
ggucucagcgcccgcc

SEQ ID NO: 878803 - RNA, 20 nt, Mycobacterium avium subsp. paratuberculosis
ggucucagcgcccgcccggc

SEQ ID NO: 878804 - RNA, 19 nt, Mycobacterium avium subsp. paratuberculosis
ggucucaucccgccgaccc

SEQ ID NO: 878805 - RNA, 15 nt, Mycobacterium avium subsp. paratuberculosis
ggucuccuggccgcc

SEQ ID NO: 878806 - RNA, 15 nt, Mycobacterium avium subsp. paratuberculosis
ggucucgaaccgggc

SEQ ID NO: 878807 - RNA, 21 nt, Mycobacterium avium subsp. paratuberculosis
ggucucgaaccgggcggugac

SEQ ID NO: 878808 - RNA, 17 nt, Mycobacterium avium subsp. paratuberculosis
ggucuccaugucgucgg

SEQ ID NO: 878809 - RNA, 19 nt, Mycobacterium avium subsp. paratuberculosis
ggucucccagacgucgacc

SEQ ID NO: 878810 - RNA, 17 nt, Mycobacterium avium subsp. paratuberculosis
ggucguagucggcccgc

SEQ ID NO: 878811 - RNA, 23 nt, Mycobacterium avium subsp. paratuberculosis
ggucguagucggcccgccgggcc

SEQ ID NO: 878812 - RNA, 23 nt, Mycobacterium avium subsp. paratuberculosis
ggucguagccgucgaaacggcug

SEQ ID NO: 878813 - RNA, 18 nt, Mycobacterium avium subsp. paratuberculosis
ggucguaggccggauccc

SEQ ID NO: 878814 - RNA, 17 nt, Mycobacterium avium subsp. paratuberculosis
ggucguagaugguccgc

SEQ ID NO: 878815 - RNA, 18 nt, Mycobacterium avium subsp. paratuberculosis
ggucguagaugguccgca

SEQ ID NO: 878816 - RNA, 15 nt, Mycobacterium avium subsp. paratuberculosis
ggucggugguucgcg

SEQ ID NO: 878817 - RNA, 16 nt, Mycobacterium avium subsp. paratuberculosis
ggucggugguucgcgc

SEQ ID NO: 878818 - RNA, 17 nt, Mycobacterium avium subsp. paratuberculosis
ggucggugguucgcgcg

SEQ ID NO: 878819 - RNA, 23 nt, Mycobacterium avium subsp. paratuberculosis
ggucgguuugcgggccagugauc

SEQ ID NO: 878820 - RNA, 23 nt, Mycobacterium avium subsp. paratuberculosis
ggucuccuccaggaaacggccca

SEQ ID NO: 878821 - RNA, 13 nt, Mycobacterium avium subsp. paratuberculosis
ggucugccacgcc

SEQ ID NO: 878822 - RNA, 21 nt, Mycobacterium avium subsp. paratuberculosis
ggucugccacgcccaccggug

SEQ ID NO: 878823 - RNA, 20 nt, Mycobacterium avium subsp. paratuberculosis
ggucugccagaacggcggca

SEQ ID NO: 878824 - RNA, 22 nt, Mycobacterium avium subsp. paratuberculosis
ggucugccagaacggcggcagc

SEQ ID NO: 878825 - RNA, 16 nt, Mycobacterium avium subsp. paratuberculosis
ggucugaucgcccagc

SEQ ID NO: 878826 - RNA, 14 nt, Mycobacterium avium subsp. paratuberculosis
ggucugcaccggga

SEQ ID NO: 878827 - RNA, 20 nt, Mycobacterium avium subsp. paratuberculosis
ggucugcggccgcgacugca

SEQ ID NO: 878828 - RNA, 17 nt, Mycobacterium avium subsp. paratuberculosis
ggucugcgccggcggug

SEQ ID NO: 878829 - RNA, 21 nt, Mycobacterium avium subsp. paratuberculosis
ggucugcgccggcggugucga

SEQ ID NO: 878830 - RNA, 17 nt, Mycobacterium avium subsp. paratuberculosis
ggucugccuggcgaacu

SEQ ID NO: 878831 - RNA, 19 nt, Mycobacterium avium subsp. paratuberculosis
ggucugacccaugccccag

SEQ ID NO: 878832 - RNA, 18 nt, Mycobacterium avium subsp. paratuberculosis
ggucugaccccccgacgc

SEQ ID NO: 878833 - RNA, 23 nt, Mycobacterium avium subsp. paratuberculosis
ggucugaccccccgacgccgacg

SEQ ID NO: 878834 - RNA, 13 nt, Mycobacterium avium subsp. paratuberculosis
ggucucgcgcagc

SEQ ID NO: 878835 - RNA, 16 nt, Mycobacterium avium subsp. paratuberculosis
ggucucggucgcggcg

SEQ ID NO: 878836 - RNA, 19 nt, Mycobacterium avium subsp. paratuberculosis
ggucucguacaaggugaug

SEQ ID NO: 878837 - RNA, 20 nt, Mycobacterium avium subsp. paratuberculosis
ggucucguacaaggugaugg

SEQ ID NO: 878838 - RNA, 17 nt, Mycobacterium avium subsp. paratuberculosis
ggucucguugugcaccg

SEQ ID NO: 878839 - RNA, 16 nt, Mycobacterium avium subsp. paratuberculosis
ggucucgacaccggcg

SEQ ID NO: 878840 - RNA, 13 nt, Mycobacterium avium subsp. paratuberculosis
ggucucgaucgag

SEQ ID NO: 878841 - RNA, 20 nt, Mycobacterium avium subsp. paratuberculosis
ggucucgaucugcaccagcg

SEQ ID NO: 878842 - RNA, 23 nt, Mycobacterium avium subsp. paratuberculosis
ggucucgcccaccuuggcgucga

SEQ ID NO: 878843 - RNA, 12 nt, Mycobacterium avium subsp. paratuberculosis
ggucucggcgag

SEQ ID NO: 878844 - RNA, 15 nt, Mycobacterium avium subsp. paratuberculosis
ggucucggcgaggcg

SEQ ID NO: 878845 - RNA, 13 nt, Mycobacterium avium subsp. paratuberculosis
ggucucggcggcg

SEQ ID NO: 878846 - RNA, 17 nt, Mycobacterium avium subsp. paratuberculosis
ggucucggcggcgccca

SEQ ID NO: 878847 - RNA, 13 nt, Mycobacterium avium subsp. paratuberculosis
ggucgggccggac

SEQ ID NO: 878848 - RNA, 15 nt, Mycobacterium avium subsp. paratuberculosis
ggucgggccggacag

SEQ ID NO: 878849 - RNA, 16 nt, Mycobacterium avium subsp. paratuberculosis
ggucgggcgcaccacg

SEQ ID NO: 878850 - RNA, 23 nt, Mycobacterium avium subsp. paratuberculosis
ggucgggcgcaccacgaccuccg

SEQ ID NO: 878851 - RNA, 15 nt, Mycobacterium avium subsp. paratuberculosis
ggucggugcccagca

SEQ ID NO: 878852 - RNA, 14 nt, Mycobacterium avium subsp. paratuberculosis
ggucggugcgcagc

SEQ ID NO: 878853 - RNA, 15 nt, Mycobacterium avium subsp. paratuberculosis
ggucggugcgcagca

SEQ ID NO: 878854 - RNA, 13 nt, Mycobacterium avium subsp. paratuberculosis
ggucggugcgcgg

SEQ ID NO: 878855 - RNA, 20 nt, Mycobacterium avium subsp. paratuberculosis
ggucgguggcccagccggcc

SEQ ID NO: 878856 - RNA, 15 nt, Mycobacterium avium subsp. paratuberculosis
ggucgguggcgauga

SEQ ID NO: 878857 - RNA, 15 nt, Mycobacterium avium subsp. paratuberculosis
ggucgguggcggugc

SEQ ID NO: 878858 - RNA, 21 nt, Mycobacterium avium subsp. paratuberculosis
ggucgggaccgaugccgcuga

SEQ ID NO: 878859 - RNA, 17 nt, Mycobacterium avium subsp. paratuberculosis
ggucgggacguccgcgc

SEQ ID NO: 878860 - RNA, 17 nt, Mycobacterium avium subsp. paratuberculosis
ggucgggacgucggcgc

SEQ ID NO: 878861 - RNA, 18 nt, Mycobacterium avium subsp. paratuberculosis
ggucgggauacucguccu

SEQ ID NO: 878862 - RNA, 22 nt, Mycobacterium avium subsp. paratuberculosis
ggucgggauacucguccucccg

SEQ ID NO: 878863 - RNA, 16 nt, Mycobacterium avium subsp. paratuberculosis
ggucgggcaugccggc

SEQ ID NO: 878864 - RNA, 17 nt, Mycobacterium avium subsp. paratuberculosis
ggucgggcaugccggcc

SEQ ID NO: 878865 - RNA, 18 nt, Mycobacterium avium subsp. paratuberculosis
ggucgggcaugccggccg

SEQ ID NO: 878866 - RNA, 19 nt, Mycobacterium avium subsp. paratuberculosis
ggucggcgggagccggcgg

SEQ ID NO: 878867 - RNA, 21 nt, Mycobacterium avium subsp. paratuberculosis
ggucggcgggagccggcggcg

SEQ ID NO: 878868 - RNA, 23 nt, Mycobacterium avium subsp. paratuberculosis
ggucggcgggagccggcggcggu

SEQ ID NO: 878869 - RNA, 15 nt, Mycobacterium avium subsp. paratuberculosis
ggucggccgcggccg

SEQ ID NO: 878870 - RNA, 15 nt, Mycobacterium avium subsp. paratuberculosis
ggucggccgcgugca

SEQ ID NO: 878871 - RNA, 18 nt, Mycobacterium avium subsp. paratuberculosis
ggucggccgcgugcaccu

SEQ ID NO: 878872 - RNA, 13 nt, Mycobacterium avium subsp. paratuberculosis
ggucggcccgcuc

SEQ ID NO: 878873 - RNA, 22 nt, Mycobacterium avium subsp. paratuberculosis
ggucggccacgacgcggcgcgc

SEQ ID NO: 878874 - RNA, 16 nt, Mycobacterium avium subsp. paratuberculosis
ggucggcggucgcggu

SEQ ID NO: 878875 - RNA, 23 nt, Mycobacterium avium subsp. paratuberculosis
ggucggcguccagcgcggugagc

SEQ ID NO: 878876 - RNA, 20 nt, Mycobacterium avium subsp. paratuberculosis
ggucggcgucgggccggggg

SEQ ID NO: 878877 - RNA, 22 nt, Mycobacterium avium subsp. paratuberculosis
ggucggcgucguacagcagccc

SEQ ID NO: 878878 - RNA, 21 nt, Mycobacterium avium subsp. paratuberculosis
ggucggcgucaccccaccgag

SEQ ID NO: 878879 - RNA, 21 nt, Mycobacterium avium subsp. paratuberculosis
ggucggcucggcucggccggc

SEQ ID NO: 878880 - RNA, 17 nt, Mycobacterium avium subsp. paratuberculosis
ggucggcuuccagaugc

SEQ ID NO: 878881 - RNA, 12 nt, Mycobacterium avium subsp. paratuberculosis
ggucggccagcu

SEQ ID NO: 878882 - RNA, 17 nt, Mycobacterium avium subsp. paratuberculosis
ggucggccagcugcggg

SEQ ID NO: 878883 - RNA, 18 nt, Mycobacterium avium subsp. paratuberculosis
ggucggccagcugcgggu

SEQ ID NO: 878884 - RNA, 16 nt, Mycobacterium avium subsp. paratuberculosis
ggucggccagcgaaug

SEQ ID NO: 878885 - RNA, 17 nt, Mycobacterium avium subsp. paratuberculosis
ggucggccagcgccgcc

SEQ ID NO: 878886 - RNA, 21 nt, Mycobacterium avium subsp. paratuberculosis
ggucggccagcgcgcgcagcg

SEQ ID NO: 878887 - RNA, 15 nt, Mycobacterium avium subsp. paratuberculosis
ggucggcaacccgac

SEQ ID NO: 878888 - RNA, 23 nt, Mycobacterium avium subsp. paratuberculosis
ggucggcaacccgaccucgucga

SEQ ID NO: 878889 - RNA, 18 nt, Mycobacterium avium subsp. paratuberculosis
ggucggcagcaccggcag

SEQ ID NO: 878890 - RNA, 22 nt, Mycobacterium avium subsp. paratuberculosis
ggucgcggaucucgucgggcca

SEQ ID NO: 878891 - RNA, 20 nt, Mycobacterium avium subsp. paratuberculosis
ggucgcggccuugcgggccg

SEQ ID NO: 878892 - RNA, 15 nt, Mycobacterium avium subsp. paratuberculosis
ggucgcggcgccggu

SEQ ID NO: 878893 - RNA, 15 nt, Mycobacterium avium subsp. paratuberculosis
ggucgcggagcgggu

SEQ ID NO: 878894 - RNA, 16 nt, Mycobacterium avium subsp. paratuberculosis
ggucgcggcggccggc

SEQ ID NO: 878895 - RNA, 14 nt, Mycobacterium avium subsp. paratuberculosis
ggucgcggcguugc

SEQ ID NO: 878896 - RNA, 19 nt, Mycobacterium avium subsp. paratuberculosis
ggucgcggcguugcccgcu

SEQ ID NO: 878897 - RNA, 20 nt, Mycobacterium avium subsp. paratuberculosis
ggugagcagcaugccgagca

SEQ ID NO: 878898 - RNA, 22 nt, Mycobacterium avium subsp. paratuberculosis
ggugagcagcaugccgagcacc

SEQ ID NO: 878899 - RNA, 22 nt, Mycobacterium avium subsp. paratuberculosis
ggugagcagcucggucaccagc

SEQ ID NO: 878900 - RNA, 23 nt, Mycobacterium avium subsp. paratuberculosis
ggugagcagcucggucaccagcg

SEQ ID NO: 878901 - RNA, 18 nt, Mycobacterium avium subsp. paratuberculosis
ggugagcagggccagcgg

SEQ ID NO: 878902 - RNA, 23 nt, Mycobacterium avium subsp. paratuberculosis
ggugagcagggccagcggcaacu

SEQ ID NO: 878903 - RNA, 18 nt, Mycobacterium avium subsp. paratuberculosis
ggugaacgaggccgcgcc

SEQ ID NO: 878904 - RNA, 22 nt, Mycobacterium avium subsp. paratuberculosis
ggugaccgagucgucgcgcacc

SEQ ID NO: 878905 - RNA, 23 nt, Mycobacterium avium subsp. paratuberculosis
ggugagcgacaccaggucgaggu

SEQ ID NO: 878906 - RNA, 12 nt, Mycobacterium avium subsp. paratuberculosis
ggugagcgccac

SEQ ID NO: 878907 - RNA, 16 nt, Mycobacterium avium subsp. paratuberculosis
ggugagcgccaccccg

SEQ ID NO: 878908 - RNA, 15 nt, Mycobacterium avium subsp. paratuberculosis
ggugaggacgcccgg

SEQ ID NO: 878909 - RNA, 16 nt, Mycobacterium avium subsp. paratuberculosis
ggugaggacgcccggc

SEQ ID NO: 878910 - RNA, 20 nt, Mycobacterium avium subsp. paratuberculosis
ggugaggacgcccggcgagu

SEQ ID NO: 878911 - RNA, 17 nt, Mycobacterium avium subsp. paratuberculosis
ggugaggcacccgcugc

SEQ ID NO: 878912 - RNA, 11 nt, Mycobacterium avium subsp. paratuberculosis
ggugagcaccg

SEQ ID NO: 878913 - RNA, 14 nt, Mycobacterium avium subsp. paratuberculosis
ggugagcaccgcga

SEQ ID NO: 878914 - RNA, 13 nt, Mycobacterium avium subsp. paratuberculosis
ggugagcaccggg

SEQ ID NO: 878915 - RNA, 22 nt, Mycobacterium avium subsp. paratuberculosis
ggugaccgccgccauccgcgcc

SEQ ID NO: 878916 - RNA, 14 nt, Mycobacterium avium subsp. paratuberculosis
ggugaccgcgacgc

SEQ ID NO: 878917 - RNA, 16 nt, Mycobacterium avium subsp. paratuberculosis
ggugaccgcgacgcug

SEQ ID NO: 878918 - RNA, 17 nt, Mycobacterium avium subsp. paratuberculosis
ggugaccgcgacgcugc

SEQ ID NO: 878919 - RNA, 17 nt, Mycobacterium avium subsp. paratuberculosis
ggugaccgcgccgcggg

SEQ ID NO: 878920 - RNA, 23 nt, Mycobacterium avium subsp. paratuberculosis
ggugaccggccugagacgacgcc

SEQ ID NO: 878921 - RNA, 13 nt, Mycobacterium avium subsp. paratuberculosis
ggugaccggcgag

SEQ ID NO: 878922 - RNA, 15 nt, Mycobacterium avium subsp. paratuberculosis
ggugaccggcgaggu

SEQ ID NO: 878923 - RNA, 17 nt, Mycobacterium avium subsp. paratuberculosis
ggugaccggcgaggugc

SEQ ID NO: 878924 - RNA, 20 nt, Mycobacterium avium subsp. paratuberculosis
ggugaccggcgaggugcgcc

SEQ ID NO: 878925 - RNA, 23 nt, Mycobacterium avium subsp. paratuberculosis
ggugagcaacagcgcuucgcgcu

SEQ ID NO: 878926 - RNA, 17 nt, Mycobacterium avium subsp. paratuberculosis
ggugagcaacgccagcg

SEQ ID NO: 878927 - RNA, 14 nt, Mycobacterium avium subsp. paratuberculosis
ggugaccaucgggu

SEQ ID NO: 878928 - RNA, 16 nt, Mycobacterium avium subsp. paratuberculosis
ggugacccaauccggc

SEQ ID NO: 878929 - RNA, 14 nt, Mycobacterium avium subsp. paratuberculosis
ggugacccggaccg

SEQ ID NO: 878930 - RNA, 14 nt, Mycobacterium avium subsp. paratuberculosis
ggugacccggccgu

SEQ ID NO: 878931 - RNA, 13 nt, Mycobacterium avium subsp. paratuberculosis
ggugacaugaugg

SEQ ID NO: 878932 - RNA, 15 nt, Mycobacterium avium subsp. paratuberculosis
ggugacaugcccggg

SEQ ID NO: 878933 - RNA, 18 nt, Mycobacterium avium subsp. paratuberculosis
ggugaccacggucggcgg

SEQ ID NO: 878934 - RNA, 20 nt, Mycobacterium avium subsp. paratuberculosis
ggugaccaccugcaccugcg

SEQ ID NO: 878935 - RNA, 15 nt, Mycobacterium avium subsp. paratuberculosis
ggugaacgccugcgg

SEQ ID NO: 878936 - RNA, 17 nt, Mycobacterium avium subsp. paratuberculosis
ggugaaauagcgcagca

SEQ ID NO: 878937 - RNA, 16 nt, Mycobacterium avium subsp. paratuberculosis
ggugaacccgacguug

SEQ ID NO: 878938 - RNA, 24 nt, Mycobacterium avium subsp. paratuberculosis
ggugaacccgacguugccgcuggu

SEQ ID NO: 878939 - RNA, 14 nt, Mycobacterium avium subsp. paratuberculosis
ggucuuucaucgcc

SEQ ID NO: 878940 - RNA, 23 nt, Mycobacterium avium subsp. paratuberculosis
ggucuuucaucgccccggcgacg

SEQ ID NO: 878941 - RNA, 13 nt, Mycobacterium avium subsp. paratuberculosis
ggucuuucgucgc

SEQ ID NO: 878942 - RNA, 15 nt, Mycobacterium avium subsp. paratuberculosis
ggucugcggugcgcc

SEQ ID NO: 878943 - RNA, 16 nt, Mycobacterium avium subsp. paratuberculosis
ggucuuugccggccau

SEQ ID NO: 878944 - RNA, 18 nt, Mycobacterium avium subsp. paratuberculosis
ggugaaaccguuggccug

SEQ ID NO: 878945 - RNA, 16 nt, Mycobacterium avium subsp. paratuberculosis
ggugaacaccccgcgg

SEQ ID NO: 878946 - RNA, 21 nt, Mycobacterium avium subsp. paratuberculosis
ggugaucucaccggcggcggc

SEQ ID NO: 878947 - RNA, 14 nt, Mycobacterium avium subsp. paratuberculosis
ggugaucucgccga

SEQ ID NO: 878948 - RNA, 18 nt, Mycobacterium avium subsp. paratuberculosis
ggugaucucgccgagcac

SEQ ID NO: 878949 - RNA, 20 nt, Mycobacterium avium subsp. paratuberculosis
ggugaucucgccgagcacac

SEQ ID NO: 878950 - RNA, 16 nt, Mycobacterium avium subsp. paratuberculosis
ggugaucggccaggcg

SEQ ID NO: 878951 - RNA, 22 nt, Mycobacterium avium subsp. paratuberculosis
ggugaucggccaggcgcccagc

SEQ ID NO: 878952 - RNA, 15 nt, Mycobacterium avium subsp. paratuberculosis
ggugaucucgucggc

SEQ ID NO: 878953 - RNA, 17 nt, Mycobacterium avium subsp. paratuberculosis
ggugaucugcaccagcg

SEQ ID NO: 878954 - RNA, 15 nt, Mycobacterium avium subsp. paratuberculosis
ggugaucgccagccc

SEQ ID NO: 878955 - RNA, 14 nt, Mycobacterium avium subsp. paratuberculosis
ggugaucgccgccc

SEQ ID NO: 878956 - RNA, 13 nt, Mycobacterium avium subsp. paratuberculosis
ggugaucgccgcg

SEQ ID NO: 878957 - RNA, 16 nt, Mycobacterium avium subsp. paratuberculosis
ggugaucgcgaacgcg

SEQ ID NO: 878958 - RNA, 13 nt, Mycobacterium avium subsp. paratuberculosis
ggugaucgcggcc

SEQ ID NO: 878959 - RNA, 18 nt, Mycobacterium avium subsp. paratuberculosis
ggugaucgcggcccgcgg

SEQ ID NO: 878960 - RNA, 14 nt, Mycobacterium avium subsp. paratuberculosis
ggugaucgcggcgc

SEQ ID NO: 878961 - RNA, 22 nt, Mycobacterium avium subsp. paratuberculosis
ggugaucgcggcgcugccgccg

SEQ ID NO: 878962 - RNA, 17 nt, Mycobacterium avium subsp. paratuberculosis
ggugaggacaccacgau

SEQ ID NO: 878963 - RNA, 14 nt, Mycobacterium avium subsp. paratuberculosis
ggugaggggcgcgc

SEQ ID NO: 878964 - RNA, 23 nt, Mycobacterium avium subsp. paratuberculosis
ggugaugaaucgucccgucgacc

SEQ ID NO: 878965 - RNA, 15 nt, Mycobacterium avium subsp. paratuberculosis
ggugaugacggggcg

SEQ ID NO: 878966 - RNA, 22 nt, Mycobacterium avium subsp. paratuberculosis
ggugaugaggucgcgaccgccg

SEQ ID NO: 878967 - RNA, 22 nt, Mycobacterium avium subsp. paratuberculosis
ggugaucgccggaucgccgagg

SEQ ID NO: 878968 - RNA, 23 nt, Mycobacterium avium subsp. paratuberculosis
ggugaucgccggaucgccgaggu

SEQ ID NO: 878969 - RNA, 17 nt, Mycobacterium avium subsp. paratuberculosis
ggugaucugcgccguga

SEQ ID NO: 878970 - RNA, 22 nt, Mycobacterium avium subsp. paratuberculosis
ggugaucuugcccagccacgcc

SEQ ID NO: 878971 - RNA, 23 nt, Mycobacterium avium subsp. paratuberculosis
ggugaucuuggccuccaccggca

SEQ ID NO: 878972 - RNA, 23 nt, Mycobacterium avium subsp. paratuberculosis
ggugcaacgccgccgacagcacc

SEQ ID NO: 878973 - RNA, 22 nt, Mycobacterium avium subsp. paratuberculosis
ggugaugcagugguugagcagc

SEQ ID NO: 878974 - RNA, 20 nt, Mycobacterium avium subsp. paratuberculosis
ggugauuccggcacccgcca

SEQ ID NO: 878975 - RNA, 19 nt, Mycobacterium avium subsp. paratuberculosis
ggugauucgcgcggcgccc

SEQ ID NO: 878976 - RNA, 22 nt, Mycobacterium avium subsp. paratuberculosis
ggugauucgcgcggcgcccagg

SEQ ID NO: 878977 - RNA, 14 nt, Mycobacterium avium subsp. paratuberculosis
ggugauucgugcag

SEQ ID NO: 878978 - RNA, 16 nt, Mycobacterium avium subsp. paratuberculosis
ggugcaggugcccguc

SEQ ID NO: 878979 - RNA, 20 nt, Mycobacterium avium subsp. paratuberculosis
ggugcaggugcccgucggcc

SEQ ID NO: 878980 - RNA, 21 nt, Mycobacterium avium subsp. paratuberculosis
ggugcaacgugaugccguggu

SEQ ID NO: 878981 - RNA, 13 nt, Mycobacterium avium subsp. paratuberculosis
ggugccacgauga

SEQ ID NO: 878982 - RNA, 15 nt, Mycobacterium avium subsp. paratuberculosis
ggugccacgaugaug

SEQ ID NO: 878983 - RNA, 20 nt, Mycobacterium avium subsp. paratuberculosis
ggugccagccgugcggcggc

SEQ ID NO: 878984 - RNA, 14 nt, Mycobacterium avium subsp. paratuberculosis
ggugcacagcccgu

SEQ ID NO: 878985 - RNA, 16 nt, Mycobacterium avium subsp. paratuberculosis
ggugcacagcccgugc

SEQ ID NO: 878986 - RNA, 15 nt, Mycobacterium avium subsp. paratuberculosis
ggugcaccacccagg

SEQ ID NO: 878987 - RNA, 21 nt, Mycobacterium avium subsp. paratuberculosis
ggugcaccacccaggccaccc

SEQ ID NO: 878988 - RNA, 14 nt, Mycobacterium avium subsp. paratuberculosis
ggugcacccgcggc

SEQ ID NO: 878989 - RNA, 14 nt, Mycobacterium avium subsp. paratuberculosis
ggugcaccgccagc

SEQ ID NO: 878990 - RNA, 15 nt, Mycobacterium avium subsp. paratuberculosis
ggugcaccgccagcg

SEQ ID NO: 878991 - RNA, 22 nt, Mycobacterium avium subsp. paratuberculosis
ggugcaccgccagcgcggcggc

SEQ ID NO: 878992 - RNA, 12 nt, Mycobacterium avium subsp. paratuberculosis
ggugcaccgcgc

SEQ ID NO: 878993 - RNA, 20 nt, Mycobacterium avium subsp. paratuberculosis
ggugcaccgcgcgcaccacg

SEQ ID NO: 878994 - RNA, 21 nt, Mycobacterium avium subsp. paratuberculosis
ggugcaccgcgcgcaccacgu

SEQ ID NO: 878995 - RNA, 15 nt, Mycobacterium avium subsp. paratuberculosis
ggugcacgagcgucg

SEQ ID NO: 878996 - RNA, 14 nt, Mycobacterium avium subsp. paratuberculosis
ggugcacgcccaga

SEQ ID NO: 878997 - RNA, 15 nt, Mycobacterium avium subsp. paratuberculosis
ggugcacgccgagca

SEQ ID NO: 878998 - RNA, 17 nt, Mycobacterium avium subsp. paratuberculosis
ggugcacgccgagcagc

SEQ ID NO: 878999 - RNA, 20 nt, Mycobacterium avium subsp. paratuberculosis
ggucaucgagccgagcaccg

SEQ ID NO: 879000 - RNA, 17 nt, Mycobacterium avium subsp. paratuberculosis
ggucaugaaggcgacgu

SEQ ID NO: 879001 - RNA, 22 nt, Mycobacterium avium subsp. paratuberculosis
ggucaucgggguuuugaucagc

SEQ ID NO: 879002 - RNA, 12 nt, Mycobacterium avium subsp. paratuberculosis
ggucaugccgag

SEQ ID NO: 879003 - RNA, 16 nt, Mycobacterium avium subsp. paratuberculosis
ggucaugccgucgacg

SEQ ID NO: 879004 - RNA, 12 nt, Mycobacterium avium subsp. paratuberculosis
ggucaucgcgcc

SEQ ID NO: 879005 - RNA, 14 nt, Mycobacterium avium subsp. paratuberculosis
ggucagggucagcu

SEQ ID NO: 879006 - RNA, 18 nt, Mycobacterium avium subsp. paratuberculosis
gguccagcacgugcccag

SEQ ID NO: 879007 - RNA, 15 nt, Mycobacterium avium subsp. paratuberculosis
gguccagcaccggcg

SEQ ID NO: 879008 - RNA, 16 nt, Mycobacterium avium subsp. paratuberculosis
gguccagcaccggcgc

SEQ ID NO: 879009 - RNA, 20 nt, Mycobacterium avium subsp. paratuberculosis
gguccagcaccggcgccccg

SEQ ID NO: 879010 - RNA, 23 nt, Mycobacterium avium subsp. paratuberculosis
gguccaaaacaucccggacaggu

SEQ ID NO: 879011 - RNA, 15 nt, Mycobacterium avium subsp. paratuberculosis
gguccaaagacguug

SEQ ID NO: 879012 - RNA, 15 nt, Mycobacterium avium subsp. paratuberculosis
gguccagaucggcgc

SEQ ID NO: 879013 - RNA, 17 nt, Mycobacterium avium subsp. paratuberculosis
ggucauggcgaccgcga

SEQ ID NO: 879014 - RNA, 13 nt, Mycobacterium avium subsp. paratuberculosis
ggucaugguggcg

SEQ ID NO: 879015 - RNA, 20 nt, Mycobacterium avium subsp. paratuberculosis
ggucauguaccaggcgacgu

SEQ ID NO: 879016 - RNA, 19 nt, Mycobacterium avium subsp. paratuberculosis
ggucauugaucuccgcggc

SEQ ID NO: 879017 - RNA, 16 nt, Mycobacterium avium subsp. paratuberculosis
gguccaucuccagcuc

SEQ ID NO: 879018 - RNA, 17 nt, Mycobacterium avium subsp. paratuberculosis
gguccagugccggcgag

SEQ ID NO: 879019 - RNA, 16 nt, Mycobacterium avium subsp. paratuberculosis
gguccaguugugccgc

SEQ ID NO: 879020 - RNA, 18 nt, Mycobacterium avium subsp. paratuberculosis
gguccaggugggguggug

SEQ ID NO: 879021 - RNA, 20 nt, Mycobacterium avium subsp. paratuberculosis
gguccaggugggguggugga

SEQ ID NO: 879022 - RNA, 19 nt, Mycobacterium avium subsp. paratuberculosis
gguccagggcgggucgucg

SEQ ID NO: 879023 - RNA, 20 nt, Mycobacterium avium subsp. paratuberculosis
gguccagggcgggucgucga

SEQ ID NO: 879024 - RNA, 22 nt, Mycobacterium avium subsp. paratuberculosis
gguccagggcgggucgucgaug

SEQ ID NO: 879025 - RNA, 14 nt, Mycobacterium avium subsp. paratuberculosis
gguccaggaucacg

SEQ ID NO: 879026 - RNA, 16 nt, Mycobacterium avium subsp. paratuberculosis
gguccaggccgcgccg

SEQ ID NO: 879027 - RNA, 19 nt, Mycobacterium avium subsp. paratuberculosis
gguccaggccgcgccgggc

SEQ ID NO: 879028 - RNA, 14 nt, Mycobacterium avium subsp. paratuberculosis
gguccagcgugcgc

SEQ ID NO: 879029 - RNA, 16 nt, Mycobacterium avium subsp. paratuberculosis
gguccagcgugcgcgg

SEQ ID NO: 879030 - RNA, 18 nt, Mycobacterium avium subsp. paratuberculosis
gguccagccgccgcgugg

SEQ ID NO: 879031 - RNA, 16 nt, Mycobacterium avium subsp. paratuberculosis
gguccagcgagcccuu

SEQ ID NO: 879032 - RNA, 14 nt, Mycobacterium avium subsp. paratuberculosis
gguccagccggucg

SEQ ID NO: 879033 - RNA, 16 nt, Mycobacterium avium subsp. paratuberculosis
gguccagccggucgca

SEQ ID NO: 879034 - RNA, 18 nt, Mycobacterium avium subsp. paratuberculosis
ggucccaauccucgccga

SEQ ID NO: 879035 - RNA, 21 nt, Mycobacterium avium subsp. paratuberculosis
ggucccagaugcgcgacggcc

SEQ ID NO: 879036 - RNA, 22 nt, Mycobacterium avium subsp. paratuberculosis
gguccauggccuugacgucggg

SEQ ID NO: 879037 - RNA, 16 nt, Mycobacterium avium subsp. paratuberculosis
gguccaugugccgcau

SEQ ID NO: 879038 - RNA, 19 nt, Mycobacterium avium subsp. paratuberculosis
gguccaugugccgcaucug

SEQ ID NO: 879039 - RNA, 21 nt, Mycobacterium avium subsp. paratuberculosis
ggucccaggcguggucggcgc

SEQ ID NO: 879040 - RNA, 17 nt, Mycobacterium avium subsp. paratuberculosis
ggucccaggugggcgcg

SEQ ID NO: 879041 - RNA, 19 nt, Mycobacterium avium subsp. paratuberculosis
ggucccaguccccgguuca

SEQ ID NO: 879042 - RNA, 12 nt, Mycobacterium avium subsp. paratuberculosis
ggucccccugag

SEQ ID NO: 879043 - RNA, 18 nt, Mycobacterium avium subsp. paratuberculosis
gguccccgccgccgugca

SEQ ID NO: 879044 - RNA, 13 nt, Mycobacterium avium subsp. paratuberculosis
gguccccgcgccc

SEQ ID NO: 879045 - RNA, 12 nt, Mycobacterium avium subsp. paratuberculosis
ggucccgacgcg

SEQ ID NO: 879046 - RNA, 13 nt, Mycobacterium avium subsp. paratuberculosis
ggucccgacgcgg

SEQ ID NO: 879047 - RNA, 12 nt, Mycobacterium avium subsp. paratuberculosis
ggucccgacgcu

SEQ ID NO: 879048 - RNA, 11 nt, Mycobacterium avium subsp. paratuberculosis
ggucccgccgg

SEQ ID NO: 879049 - RNA, 16 nt, Mycobacterium avium subsp. paratuberculosis
ggucccgccggugauc

SEQ ID NO: 879050 - RNA, 14 nt, Mycobacterium avium subsp. paratuberculosis
ggucaggccggcgc

SEQ ID NO: 879051 - RNA, 13 nt, Mycobacterium avium subsp. paratuberculosis
ggucaggcccagg

SEQ ID NO: 879052 - RNA, 20 nt, Mycobacterium avium subsp. paratuberculosis
ggucaggcccaggucgugaa

SEQ ID NO: 879053 - RNA, 16 nt, Mycobacterium avium subsp. paratuberculosis
ggucagcuuggagccg

SEQ ID NO: 879054 - RNA, 19 nt, Mycobacterium avium subsp. paratuberculosis
ggucagcuuggagccgagc

SEQ ID NO: 879055 - RNA, 23 nt, Mycobacterium avium subsp. paratuberculosis
ggucaggaacaccgagccggcgg

SEQ ID NO: 879056 - RNA, 18 nt, Mycobacterium avium subsp. paratuberculosis
ggucagcguggcgucggc

SEQ ID NO: 879057 - RNA, 20 nt, Mycobacterium avium subsp. paratuberculosis
ggucagcguggcgucggcgc

SEQ ID NO: 879058 - RNA, 17 nt, Mycobacterium avium subsp. paratuberculosis
ggucagcuccaccugcg

SEQ ID NO: 879059 - RNA, 19 nt, Mycobacterium avium subsp. paratuberculosis
ggucagcuccaccugcggc

SEQ ID NO: 879060 - RNA, 17 nt, Mycobacterium avium subsp. paratuberculosis
ggucagcucccggcaga

SEQ ID NO: 879061 - RNA, 16 nt, Mycobacterium avium subsp. paratuberculosis
ggucagcucgaucgcc

SEQ ID NO: 879062 - RNA, 21 nt, Mycobacterium avium subsp. paratuberculosis
ggucagcucgaucgccgcgcc

SEQ ID NO: 879063 - RNA, 14 nt, Mycobacterium avium subsp. paratuberculosis
ggucagcucgccgu

SEQ ID NO: 879064 - RNA, 18 nt, Mycobacterium avium subsp. paratuberculosis
ggucagcucgcgcccggc

SEQ ID NO: 879065 - RNA, 15 nt, Mycobacterium avium subsp. paratuberculosis
ggucagcggcgccac

SEQ ID NO: 879066 - RNA, 19 nt, Mycobacterium avium subsp. paratuberculosis
ggucagcggcgccaccggg

SEQ ID NO: 879067 - RNA, 13 nt, Mycobacterium avium subsp. paratuberculosis
ggucagcggcguc

SEQ ID NO: 879068 - RNA, 13 nt, Mycobacterium avium subsp. paratuberculosis
ggucagcgucgcc

SEQ ID NO: 879069 - RNA, 15 nt, Mycobacterium avium subsp. paratuberculosis
ggucagcgucgccgc

SEQ ID NO: 879070 - RNA, 20 nt, Mycobacterium avium subsp. paratuberculosis
ggucagcgucgccgccccga

SEQ ID NO: 879071 - RNA, 20 nt, Mycobacterium avium subsp. paratuberculosis
ggucagcgucucggcgauca

SEQ ID NO: 879072 - RNA, 21 nt, Mycobacterium avium subsp. paratuberculosis
gggugacgcgaaugucgacca

SEQ ID NO: 879073 - RNA, 19 nt, Mycobacterium avium subsp. paratuberculosis
gggugacggucacggugac

SEQ ID NO: 879074 - RNA, 15 nt, Mycobacterium avium subsp. paratuberculosis
ggucagcgcgucggc

SEQ ID NO: 879075 - RNA, 17 nt, Mycobacterium avium subsp. paratuberculosis
ggucagcgcgucggcga

SEQ ID NO: 879076 - RNA, 18 nt, Mycobacterium avium subsp. paratuberculosis
ggucagcgcuccuggccg

SEQ ID NO: 879077 - RNA, 19 nt, Mycobacterium avium subsp. paratuberculosis
ggucagcgcuccuggccgg

SEQ ID NO: 879078 - RNA, 16 nt, Mycobacterium avium subsp. paratuberculosis
ggucagcggcaacacg

SEQ ID NO: 879079 - RNA, 22 nt, Mycobacterium avium subsp. paratuberculosis
ggucagcggcaacacgccggcg

SEQ ID NO: 879080 - RNA, 23 nt, Mycobacterium avium subsp. paratuberculosis
ggucagcggcaggucccaggcca

SEQ ID NO: 879081 - RNA, 16 nt, Mycobacterium avium subsp. paratuberculosis
ggucagcggccagccc

SEQ ID NO: 879082 - RNA, 18 nt, Mycobacterium avium subsp. paratuberculosis
ggucagcggcccgaucac

SEQ ID NO: 879083 - RNA, 12 nt, Mycobacterium avium subsp. paratuberculosis
gggugacgacca

SEQ ID NO: 879084 - RNA, 20 nt, Mycobacterium avium subsp. paratuberculosis
gggugacgauccacagcgcg

SEQ ID NO: 879085 - RNA, 21 nt, Mycobacterium avium subsp. paratuberculosis
gggugacgauccacagcgcga

SEQ ID NO: 879086 - RNA, 16 nt, Mycobacterium avium subsp. paratuberculosis
gggugagacggccagc

SEQ ID NO: 879087 - RNA, 17 nt, Mycobacterium avium subsp. paratuberculosis
gggugagacggccagca

SEQ ID NO: 879088 - RNA, 17 nt, Mycobacterium avium subsp. paratuberculosis
gggugagcagggccagc

SEQ ID NO: 879089 - RNA, 22 nt, Mycobacterium avium subsp. paratuberculosis
ggucagcgcgacaucgccggcg

SEQ ID NO: 879090 - RNA, 12 nt, Mycobacterium avium subsp. paratuberculosis
ggucagcgcgcc

SEQ ID NO: 879091 - RNA, 14 nt, Mycobacterium avium subsp. paratuberculosis
ggucagcgcggccc

SEQ ID NO: 879092 - RNA, 17 nt, Mycobacterium avium subsp. paratuberculosis
gggugaccgaggccgcc

SEQ ID NO: 879093 - RNA, 23 nt, Mycobacterium avium subsp. paratuberculosis
gggugaccgagucgucgcgcacc

SEQ ID NO: 879094 - RNA, 19 nt, Mycobacterium avium subsp. paratuberculosis
gggugaccggcgcgcagca

SEQ ID NO: 879095 - RNA, 14 nt, Mycobacterium avium subsp. paratuberculosis
gggugaccggcggc

SEQ ID NO: 879096 - RNA, 17 nt, Mycobacterium avium subsp. paratuberculosis
gggugaccggcggccag

SEQ ID NO: 879097 - RNA, 22 nt, Mycobacterium avium subsp. paratuberculosis
gggugaccgucacccccggcgc

SEQ ID NO: 879098 - RNA, 15 nt, Mycobacterium avium subsp. paratuberculosis
gggugacccggccgu

SEQ ID NO: 879099 - RNA, 16 nt, Mycobacterium avium subsp. paratuberculosis
gggugaaggcggccac

SEQ ID NO: 879100 - RNA, 15 nt, Mycobacterium avium subsp. paratuberculosis
gggugaagucguucu

SEQ ID NO: 879101 - RNA, 14 nt, Mycobacterium avium subsp. paratuberculosis
gggugaaucaccaa

SEQ ID NO: 879102 - RNA, 16 nt, Mycobacterium avium subsp. paratuberculosis
gggugaaucgacaccg

SEQ ID NO: 879103 - RNA, 21 nt, Mycobacterium avium subsp. paratuberculosis
gggugaaucgacaccgcacgg

SEQ ID NO: 879104 - RNA, 18 nt, Mycobacterium avium subsp. paratuberculosis
gggugaacgaggccgcgc

SEQ ID NO: 879105 - RNA, 15 nt, Mycobacterium avium subsp. paratuberculosis
gggucuggucgguuu

SEQ ID NO: 879106 - RNA, 15 nt, Mycobacterium avium subsp. paratuberculosis
gggucuucagcccgc

SEQ ID NO: 879107 - RNA, 14 nt, Mycobacterium avium subsp. paratuberculosis
gggucuuccacgcc

SEQ ID NO: 879108 - RNA, 15 nt, Mycobacterium avium subsp. paratuberculosis
gggucuuccacgccg

SEQ ID NO: 879109 - RNA, 21 nt, Mycobacterium avium subsp. paratuberculosis
gggugaaacacaaacucgccc

SEQ ID NO: 879110 - RNA, 15 nt, Mycobacterium avium subsp. paratuberculosis
gggugaacaccccgc

SEQ ID NO: 879111 - RNA, 18 nt, Mycobacterium avium subsp. paratuberculosis
ggucgaugaacucgcggg

SEQ ID NO: 879112 - RNA, 16 nt, Mycobacterium avium subsp. paratuberculosis
ggucgaugacgccgcg

SEQ ID NO: 879113 - RNA, 19 nt, Mycobacterium avium subsp. paratuberculosis
ggucgaugaucuggcgguc

SEQ ID NO: 879114 - RNA, 18 nt, Mycobacterium avium subsp. paratuberculosis
ggucgauggucugcccgc

SEQ ID NO: 879115 - RNA, 18 nt, Mycobacterium avium subsp. paratuberculosis
ggucgaugucggcgaacc

SEQ ID NO: 879116 - RNA, 20 nt, Mycobacterium avium subsp. paratuberculosis
ggucgcacaccagcacggcg

SEQ ID NO: 879117 - RNA, 22 nt, Mycobacterium avium subsp. paratuberculosis
ggucgcccaccacgacgacgug

SEQ ID NO: 879118 - RNA, 22 nt, Mycobacterium avium subsp. paratuberculosis
ggucgcccccucggccgguccg

SEQ ID NO: 879119 - RNA, 20 nt, Mycobacterium avium subsp. paratuberculosis
ggucgauccacucccgcgcg

SEQ ID NO: 879120 - RNA, 13 nt, Mycobacterium avium subsp. paratuberculosis
ggucgaucccgcc

SEQ ID NO: 879121 - RNA, 18 nt, Mycobacterium avium subsp. paratuberculosis
ggucgaucccgccggcga

SEQ ID NO: 879122 - RNA, 15 nt, Mycobacterium avium subsp. paratuberculosis
ggucgaucucggcca

SEQ ID NO: 879123 - RNA, 17 nt, Mycobacterium avium subsp. paratuberculosis
ggucgaucucggccagc

SEQ ID NO: 879124 - RNA, 14 nt, Mycobacterium avium subsp. paratuberculosis
ggucgaucucggcg

SEQ ID NO: 879125 - RNA, 17 nt, Mycobacterium avium subsp. paratuberculosis
ggucgaucucggcgcag

SEQ ID NO: 879126 - RNA, 12 nt, Mycobacterium avium subsp. paratuberculosis
ggucgaucugcg

SEQ ID NO: 879127 - RNA, 17 nt, Mycobacterium avium subsp. paratuberculosis
ggucgaucugcggcacg

SEQ ID NO: 879128 - RNA, 19 nt, Mycobacterium avium subsp. paratuberculosis
ggucgaucaccucgucgag

SEQ ID NO: 879129 - RNA, 19 nt, Mycobacterium avium subsp. paratuberculosis
ggucgagacaccgucgcgc

SEQ ID NO: 879130 - RNA, 20 nt, Mycobacterium avium subsp. paratuberculosis
ggucgagacaccgucgcgca

SEQ ID NO: 879131 - RNA, 21 nt, Mycobacterium avium subsp. paratuberculosis
ggucgagacaccgucgcgcac

SEQ ID NO: 879132 - RNA, 22 nt, Mycobacterium avium subsp. paratuberculosis
ggucgagacaccgucgcgcacc

SEQ ID NO: 879133 - RNA, 16 nt, Mycobacterium avium subsp. paratuberculosis
ggucgccgaauccggc

SEQ ID NO: 879134 - RNA, 19 nt, Mycobacterium avium subsp. paratuberculosis
ggucgccgaauccggcggg

SEQ ID NO: 879135 - RNA, 21 nt, Mycobacterium avium subsp. paratuberculosis
ggucgccgaauccggcgggga

SEQ ID NO: 879136 - RNA, 20 nt, Mycobacterium avium subsp. paratuberculosis
ggucgccgacgccgucgaug

SEQ ID NO: 879137 - RNA, 19 nt, Mycobacterium avium subsp. paratuberculosis
ggucgccgacguagacgag

SEQ ID NO: 879138 - RNA, 11 nt, Mycobacterium avium subsp. paratuberculosis
ggucgcccggc

SEQ ID NO: 879139 - RNA, 18 nt, Mycobacterium avium subsp. paratuberculosis
ggucgcccggcucgccgg

SEQ ID NO: 879140 - RNA, 22 nt, Mycobacterium avium subsp. paratuberculosis
ggucgcaccaaagugccguuga

SEQ ID NO: 879141 - RNA, 18 nt, Mycobacterium avium subsp. paratuberculosis
ggucgccaggccaccgca

SEQ ID NO: 879142 - RNA, 17 nt, Mycobacterium avium subsp. paratuberculosis
ggucgccccggccgcgg

SEQ ID NO: 879143 - RNA, 14 nt, Mycobacterium avium subsp. paratuberculosis
ggucgccgaacgug

SEQ ID NO: 879144 - RNA, 19 nt, Mycobacterium avium subsp. paratuberculosis
ggucgccgaacgugcgcgg

SEQ ID NO: 879145 - RNA, 21 nt, Mycobacterium avium subsp. paratuberculosis
ggucgccgaacgugcgcggcg

SEQ ID NO: 879146 - RNA, 23 nt, Mycobacterium avium subsp. paratuberculosis
ggucgccgaacgugcgcggcgcg

SEQ ID NO: 879147 - RNA, 21 nt, Mycobacterium avium subsp. paratuberculosis
ggucgcgccgaccuggucgcc

SEQ ID NO: 879148 - RNA, 13 nt, Mycobacterium avium subsp. paratuberculosis
ggucgcgccgcgg

SEQ ID NO: 879149 - RNA, 17 nt, Mycobacterium avium subsp. paratuberculosis
ggucgcgccgcggcgcu

SEQ ID NO: 879150 - RNA, 17 nt, Mycobacterium avium subsp. paratuberculosis
ggucgcgcagccgggcg

SEQ ID NO: 879151 - RNA, 20 nt, Mycobacterium avium subsp. paratuberculosis
ggucgcgcagccgggcggcg

SEQ ID NO: 879152 - RNA, 19 nt, Mycobacterium avium subsp. paratuberculosis
ggucgccgauccagccguc

SEQ ID NO: 879153 - RNA, 18 nt, Mycobacterium avium subsp. paratuberculosis
ggucgccgaucucggcca

SEQ ID NO: 879154 - RNA, 16 nt, Mycobacterium avium subsp. paratuberculosis
ggucgccgcccacgcc

SEQ ID NO: 879155 - RNA, 21 nt, Mycobacterium avium subsp. paratuberculosis
ggucgccgcccacgccgugca

SEQ ID NO: 879156 - RNA, 14 nt, Mycobacterium avium subsp. paratuberculosis
ggucgacgccgagu

SEQ ID NO: 879157 - RNA, 18 nt, Mycobacterium avium subsp. paratuberculosis
ggucgacggagucgucgg

SEQ ID NO: 879158 - RNA, 17 nt, Mycobacterium avium subsp. paratuberculosis
ggucgacugggccaggu

SEQ ID NO: 879159 - RNA, 16 nt, Mycobacterium avium subsp. paratuberculosis
ggucgacuggucgucg

SEQ ID NO: 879160 - RNA, 19 nt, Mycobacterium avium subsp. paratuberculosis
ggucgacuugggcggggga

SEQ ID NO: 879161 - RNA, 14 nt, Mycobacterium avium subsp. paratuberculosis
ggucgacgcgccgc

SEQ ID NO: 879162 - RNA, 16 nt, Mycobacterium avium subsp. paratuberculosis
ggucgacgcgccgcac

SEQ ID NO: 879163 - RNA, 21 nt, Mycobacterium avium subsp. paratuberculosis
ggucgacgcggggcggcggcg

SEQ ID NO: 879164 - RNA, 23 nt, Mycobacterium avium subsp. paratuberculosis
ggucgacgcggggcggcggcgcc

SEQ ID NO: 879165 - RNA, 18 nt, Mycobacterium avium subsp. paratuberculosis
ggucgacggaagccgagc

SEQ ID NO: 879166 - RNA, 12 nt, Mycobacterium avium subsp. paratuberculosis
ggucgacgcccc

SEQ ID NO: 879167 - RNA, 19 nt, Mycobacterium avium subsp. paratuberculosis
ggucgaccaucugccggcg

SEQ ID NO: 879168 - RNA, 22 nt, Mycobacterium avium subsp. paratuberculosis
ggucgacgacgaacggguaggu

SEQ ID NO: 879169 - RNA, 16 nt, Mycobacterium avium subsp. paratuberculosis
ggucgacgagcccgcg

SEQ ID NO: 879170 - RNA, 19 nt, Mycobacterium avium subsp. paratuberculosis
ggucgacgagcccgcgccc

SEQ ID NO: 879171 - RNA, 15 nt, Mycobacterium avium subsp. paratuberculosis
ggucgacccgccgca

SEQ ID NO: 879172 - RNA, 17 nt, Mycobacterium avium subsp. paratuberculosis
ggucgacccgccgcagc

SEQ ID NO: 879173 - RNA, 18 nt, Mycobacterium avium subsp. paratuberculosis
ggucgacccgccgcagcc

SEQ ID NO: 879174 - RNA, 16 nt, Mycobacterium avium subsp. paratuberculosis
ggucgaccgccucgga

SEQ ID NO: 879175 - RNA, 20 nt, Mycobacterium avium subsp. paratuberculosis
ggucgaccgcgaugguggcg

SEQ ID NO: 879176 - RNA, 14 nt, Mycobacterium avium subsp. paratuberculosis
ggucgaccgcgcac

SEQ ID NO: 879177 - RNA, 15 nt, Mycobacterium avium subsp. paratuberculosis
gguccguucggcggu

SEQ ID NO: 879178 - RNA, 14 nt, Mycobacterium avium subsp. paratuberculosis
gguccguggugauc

SEQ ID NO: 879179 - RNA, 17 nt, Mycobacterium avium subsp. paratuberculosis
ggucgacagccugaccg

SEQ ID NO: 879180 - RNA, 20 nt, Mycobacterium avium subsp. paratuberculosis
ggucgacagccugaccgcgg

SEQ ID NO: 879181 - RNA, 22 nt, Mycobacterium avium subsp. paratuberculosis
ggucgacagccugaccgcgggu

SEQ ID NO: 879182 - RNA, 23 nt, Mycobacterium avium subsp. paratuberculosis
ggucgacagccugaccgcgggug

SEQ ID NO: 879183 - RNA, 19 nt, Mycobacterium avium subsp. paratuberculosis
gguccggucacgcccgggg

SEQ ID NO: 879184 - RNA, 12 nt, Mycobacterium avium subsp. paratuberculosis
gguccggucagc

SEQ ID NO: 879185 - RNA, 19 nt, Mycobacterium avium subsp. paratuberculosis
gguccggucagcaccgcgc

SEQ ID NO: 879186 - RNA, 19 nt, Mycobacterium avium subsp. paratuberculosis
gguccgugccacggccgcg

SEQ ID NO: 879187 - RNA, 17 nt, Mycobacterium avium subsp. paratuberculosis
gguccggcuggucggcc

SEQ ID NO: 879188 - RNA, 13 nt, Mycobacterium avium subsp. paratuberculosis
gguccggcccggg

SEQ ID NO: 879189 - RNA, 14 nt, Mycobacterium avium subsp. paratuberculosis
gguccggcccgggg

SEQ ID NO: 879190 - RNA, 12 nt, Mycobacterium avium subsp. paratuberculosis
gguccggccggc

SEQ ID NO: 879191 - RNA, 13 nt, Mycobacterium avium subsp. paratuberculosis
gguccggccggcc

SEQ ID NO: 879192 - RNA, 15 nt, Mycobacterium avium subsp. paratuberculosis
gguccggccggccga

SEQ ID NO: 879193 - RNA, 14 nt, Mycobacterium avium subsp. paratuberculosis
gguccggcgcccga

SEQ ID NO: 879194 - RNA, 23 nt, Mycobacterium avium subsp. paratuberculosis
gguccggcgcccgaucggcaccc

SEQ ID NO: 879195 - RNA, 15 nt, Mycobacterium avium subsp. paratuberculosis
gguccggcgcgacca

SEQ ID NO: 879196 - RNA, 18 nt, Mycobacterium avium subsp. paratuberculosis
gguccggcgcgaccaggu

SEQ ID NO: 879197 - RNA, 15 nt, Mycobacterium avium subsp. paratuberculosis
gguccggcggcacca

SEQ ID NO: 879198 - RNA, 17 nt, Mycobacterium avium subsp. paratuberculosis
gguccggcggcaccacc

SEQ ID NO: 879199 - RNA, 18 nt, Mycobacterium avium subsp. paratuberculosis
gguccggcggcaccaccc

SEQ ID NO: 879200 - RNA, 22 nt, Mycobacterium avium subsp. paratuberculosis
gguccggcggcaccacccgcgg

SEQ ID NO: 879201 - RNA, 14 nt, Mycobacterium avium subsp. paratuberculosis
ggucccgcggcggc

SEQ ID NO: 879202 - RNA, 12 nt, Mycobacterium avium subsp. paratuberculosis
ggucccggccga

SEQ ID NO: 879203 - RNA, 14 nt, Mycobacterium avium subsp. paratuberculosis
ggucccggcggacc

SEQ ID NO: 879204 - RNA, 14 nt, Mycobacterium avium subsp. paratuberculosis
ggucccggucaggu

SEQ ID NO: 879205 - RNA, 13 nt, Mycobacterium avium subsp. paratuberculosis
gguccggaaccgc

SEQ ID NO: 879206 - RNA, 20 nt, Mycobacterium avium subsp. paratuberculosis
gguccggcagcgcgcccagg

SEQ ID NO: 879207 - RNA, 17 nt, Mycobacterium avium subsp. paratuberculosis
guacggccgacgcccag

SEQ ID NO: 879208 - RNA, 21 nt, Mycobacterium avium subsp. paratuberculosis
guacggcccgggaagccgcag

SEQ ID NO: 879209 - RNA, 22 nt, Mycobacterium avium subsp. paratuberculosis
guacggcccgggaagccgcagc

SEQ ID NO: 879210 - RNA, 14 nt, Mycobacterium avium subsp. paratuberculosis
guacggcggccgcg

SEQ ID NO: 879211 - RNA, 16 nt, Mycobacterium avium subsp. paratuberculosis
guacggcucaacggcc

SEQ ID NO: 879212 - RNA, 17 nt, Mycobacterium avium subsp. paratuberculosis
guacgggcgcagcgccg

SEQ ID NO: 879213 - RNA, 15 nt, Mycobacterium avium subsp. paratuberculosis
guacgcgcugccgac

SEQ ID NO: 879214 - RNA, 16 nt, Mycobacterium avium subsp. paratuberculosis
guaaucgaugacgugg

SEQ ID NO: 879215 - RNA, 13 nt, Mycobacterium avium subsp. paratuberculosis
guaaucgaaggcc

SEQ ID NO: 879216 - RNA, 14 nt, Mycobacterium avium subsp. paratuberculosis
guagacggucaggu

SEQ ID NO: 879217 - RNA, 15 nt, Mycobacterium avium subsp. paratuberculosis
guagagccgcugcac

SEQ ID NO: 879218 - RNA, 21 nt, Mycobacterium avium subsp. paratuberculosis
guagagccguuuggcgccgcc

SEQ ID NO: 879219 - RNA, 15 nt, Mycobacterium avium subsp. paratuberculosis
guagauaagcggauu

SEQ ID NO: 879220 - RNA, 16 nt, Mycobacterium avium subsp. paratuberculosis
guagauauggcccucc

SEQ ID NO: 879221 - RNA, 20 nt, Mycobacterium avium subsp. paratuberculosis
guagagcaggaccgagccgc

SEQ ID NO: 879222 - RNA, 22 nt, Mycobacterium avium subsp. paratuberculosis
guagagcgggauccccaccgug

SEQ ID NO: 879223 - RNA, 17 nt, Mycobacterium avium subsp. paratuberculosis
guagacgaucaccggcu

SEQ ID NO: 879224 - RNA, 15 nt, Mycobacterium avium subsp. paratuberculosis
guagacggcaugccg

SEQ ID NO: 879225 - RNA, 14 nt, Mycobacterium avium subsp. paratuberculosis
guagacgccggacg

SEQ ID NO: 879226 - RNA, 18 nt, Mycobacterium avium subsp. paratuberculosis
guagacgcgggccggcac

SEQ ID NO: 879227 - RNA, 20 nt, Mycobacterium avium subsp. paratuberculosis
guagacggugcuggcgaugu

SEQ ID NO: 879228 - RNA, 17 nt, Mycobacterium avium subsp. paratuberculosis
guagacguugccgaucc

SEQ ID NO: 879229 - RNA, 19 nt, Mycobacterium avium subsp. paratuberculosis
guagacucagcgucgaugg

SEQ ID NO: 879230 - RNA, 20 nt, Mycobacterium avium subsp. paratuberculosis
guagaccuuguccggcgucc

SEQ ID NO: 879231 - RNA, 19 nt, Mycobacterium avium subsp. paratuberculosis
guagaccgggaugacggac

SEQ ID NO: 879232 - RNA, 15 nt, Mycobacterium avium subsp. paratuberculosis
guacugaucaccgcg

SEQ ID NO: 879233 - RNA, 17 nt, Mycobacterium avium subsp. paratuberculosis
guacggguugccgucga

SEQ ID NO: 879234 - RNA, 16 nt, Mycobacterium avium subsp. paratuberculosis
guacucggcgucgccg

SEQ ID NO: 879235 - RNA, 19 nt, Mycobacterium avium subsp. paratuberculosis
guacucggcgucgccgagc

SEQ ID NO: 879236 - RNA, 15 nt, Mycobacterium avium subsp. paratuberculosis
guacugggccgucgc

SEQ ID NO: 879237 - RNA, 14 nt, Mycobacterium avium subsp. paratuberculosis
guacugcucggcgc

SEQ ID NO: 879238 - RNA, 17 nt, Mycobacterium avium subsp. paratuberculosis
guacugcuugccgccgg

SEQ ID NO: 879239 - RNA, 21 nt, Mycobacterium avium subsp. paratuberculosis
guacugcuugccgccgggcca

SEQ ID NO: 879240 - RNA, 19 nt, Mycobacterium avium subsp. paratuberculosis
guacuggggugucagcgcg

SEQ ID NO: 879241 - RNA, 20 nt, Mycobacterium avium subsp. paratuberculosis
guacuggggugucagcgcga

SEQ ID NO: 879242 - RNA, 23 nt, Mycobacterium avium subsp. paratuberculosis
guacuggggugucagcgcgaccu

SEQ ID NO: 879243 - RNA, 16 nt, Mycobacterium avium subsp. paratuberculosis
guagcguugccggccg

SEQ ID NO: 879244 - RNA, 17 nt, Mycobacterium avium subsp. paratuberculosis
guagcucacggugucgg

SEQ ID NO: 879245 - RNA, 20 nt, Mycobacterium avium subsp. paratuberculosis
guagcucagccacgccggca

SEQ ID NO: 879246 - RNA, 22 nt, Mycobacterium avium subsp. paratuberculosis
guagcucagcggaaccgacacc

SEQ ID NO: 879247 - RNA, 15 nt, Mycobacterium avium subsp. paratuberculosis
guagcucgccgcggc

SEQ ID NO: 879248 - RNA, 23 nt, Mycobacterium avium subsp. paratuberculosis
guagcugagcagcaggucggcgu

SEQ ID NO: 879249 - RNA, 17 nt, Mycobacterium avium subsp. paratuberculosis
guagcgugcgcccgacg

SEQ ID NO: 879250 - RNA, 23 nt, Mycobacterium avium subsp. paratuberculosis
guagcgugcgcccgacgccggac

SEQ ID NO: 879251 - RNA, 14 nt, Mycobacterium avium subsp. paratuberculosis
guagcggucguaga

SEQ ID NO: 879252 - RNA, 16 nt, Mycobacterium avium subsp. paratuberculosis
guagccgcucgcccag

SEQ ID NO: 879253 - RNA, 17 nt, Mycobacterium avium subsp. paratuberculosis
guagccgcucgcccagc

SEQ ID NO: 879254 - RNA, 21 nt, Mycobacterium avium subsp. paratuberculosis
guagccgcucgcccagcgcgg

SEQ ID NO: 879255 - RNA, 22 nt, Mycobacterium avium subsp. paratuberculosis
guagcggugaaacgccugcacc

SEQ ID NO: 879256 - RNA, 14 nt, Mycobacterium avium subsp. paratuberculosis
guagcggugggcgc

SEQ ID NO: 879257 - RNA, 19 nt, Mycobacterium avium subsp. paratuberculosis
guagaucacgccggugagc

SEQ ID NO: 879258 - RNA, 13 nt, Mycobacterium avium subsp. paratuberculosis
guagaucagcgcc

SEQ ID NO: 879259 - RNA, 16 nt, Mycobacterium avium subsp. paratuberculosis
guagaucgccagcgcc

SEQ ID NO: 879260 - RNA, 20 nt, Mycobacterium avium subsp. paratuberculosis
guagaucgccagcgccccca

SEQ ID NO: 879261 - RNA, 16 nt, Mycobacterium avium subsp. paratuberculosis
guagaucggcucaccg

SEQ ID NO: 879262 - RNA, 18 nt, Mycobacterium avium subsp. paratuberculosis
guagaucggcucaccgaa

SEQ ID NO: 879263 - RNA, 13 nt, Mycobacterium avium subsp. paratuberculosis
guagaucucgcgc

SEQ ID NO: 879264 - RNA, 18 nt, Mycobacterium avium subsp. paratuberculosis
guagaugguggccgucgg

SEQ ID NO: 879265 - RNA, 12 nt, Mycobacterium avium subsp. paratuberculosis
guagcccgccga

SEQ ID NO: 879266 - RNA, 13 nt, Mycobacterium avium subsp. paratuberculosis
guagcccgccgaa

SEQ ID NO: 879267 - RNA, 13 nt, Mycobacterium avium subsp. paratuberculosis
guagcccggugcc

SEQ ID NO: 879268 - RNA, 14 nt, Mycobacterium avium subsp. paratuberculosis
guagcccgucgacg

SEQ ID NO: 879269 - RNA, 19 nt, Mycobacterium avium subsp. paratuberculosis
guagcccuaccggcucggc

SEQ ID NO: 879270 - RNA, 20 nt, Mycobacterium avium subsp. paratuberculosis
guagcccuaccggcucggcc

SEQ ID NO: 879271 - RNA, 17 nt, Mycobacterium avium subsp. paratuberculosis
guagccggccagcgucg

SEQ ID NO: 879272 - RNA, 20 nt, Mycobacterium avium subsp. paratuberculosis
guagccggccagcgucgcgc

SEQ ID NO: 879273 - RNA, 20 nt, Mycobacterium avium subsp. paratuberculosis
guagccggccagcucgagca

SEQ ID NO: 879274 - RNA, 14 nt, Mycobacterium avium subsp. paratuberculosis
guagcgguccucga

SEQ ID NO: 879275 - RNA, 14 nt, Mycobacterium avium subsp. paratuberculosis
guagccgccgggcg

SEQ ID NO: 879276 - RNA, 13 nt, Mycobacterium avium subsp. paratuberculosis
guagccgccggug

SEQ ID NO: 879277 - RNA, 13 nt, Mycobacterium avium subsp. paratuberculosis
guagccgccgguu

SEQ ID NO: 879278 - RNA, 21 nt, Mycobacterium avium subsp. paratuberculosis
guagccgccguagccggcggu

SEQ ID NO: 879279 - RNA, 12 nt, Mycobacterium avium subsp. paratuberculosis
guagccgcgcac

SEQ ID NO: 879280 - RNA, 19 nt, Mycobacterium avium subsp. paratuberculosis
guagccgcgcaccacggug

SEQ ID NO: 879281 - RNA, 20 nt, Mycobacterium avium subsp. paratuberculosis
guagccgaccaacgggcggc

SEQ ID NO: 879282 - RNA, 14 nt, Mycobacterium avium subsp. paratuberculosis
guagccgaagccgc

SEQ ID NO: 879283 - RNA, 22 nt, Mycobacterium avium subsp. paratuberculosis
guagccgaccgacccggccagc

SEQ ID NO: 879284 - RNA, 21 nt, Mycobacterium avium subsp. paratuberculosis
guaggcgagaucaacaccgcg

SEQ ID NO: 879285 - RNA, 23 nt, Mycobacterium avium subsp. paratuberculosis
guaggcgagaucaacaccgcgca

SEQ ID NO: 879286 - RNA, 13 nt, Mycobacterium avium subsp. paratuberculosis
guaggccggaucc

SEQ ID NO: 879287 - RNA, 19 nt, Mycobacterium avium subsp. paratuberculosis
guaggcgaccacaccgccg

SEQ ID NO: 879288 - RNA, 20 nt, Mycobacterium avium subsp. paratuberculosis
guaggcgaccacaccgccgg

SEQ ID NO: 879289 - RNA, 23 nt, Mycobacterium avium subsp. paratuberculosis
guaggcgaccacaccgccggcca

SEQ ID NO: 879290 - RNA, 19 nt, Mycobacterium avium subsp. paratuberculosis
guaggcgaccaugcccagc

SEQ ID NO: 879291 - RNA, 20 nt, Mycobacterium avium subsp. paratuberculosis
guaggcgaccaugcccagca

SEQ ID NO: 879292 - RNA, 22 nt, Mycobacterium avium subsp. paratuberculosis
guaggcgaaauaacccaccccg

SEQ ID NO: 879293 - RNA, 20 nt, Mycobacterium avium subsp. paratuberculosis
guaggcgaagagcggcacga

SEQ ID NO: 879294 - RNA, 22 nt, Mycobacterium avium subsp. paratuberculosis
guaggcgaagagcggcacgauc

SEQ ID NO: 879295 - RNA, 15 nt, Mycobacterium avium subsp. paratuberculosis
guaggccgccgcgac

SEQ ID NO: 879296 - RNA, 22 nt, Mycobacterium avium subsp. paratuberculosis
guaggcccaguccugcagcucg

SEQ ID NO: 879297 - RNA, 16 nt, Mycobacterium avium subsp. paratuberculosis
guaggcccauucgucu

SEQ ID NO: 879298 - RNA, 14 nt, Mycobacterium avium subsp. paratuberculosis
guaggccggccgca

SEQ ID NO: 879299 - RNA, 16 nt, Mycobacterium avium subsp. paratuberculosis
guaggcgucgcgcagc

SEQ ID NO: 879300 - RNA, 23 nt, Mycobacterium avium subsp. paratuberculosis
guaggcgucgcgcagcagcggga

SEQ ID NO: 879301 - RNA, 20 nt, Mycobacterium avium subsp. paratuberculosis
guaggcguggcaggccauca

SEQ ID NO: 879302 - RNA, 14 nt, Mycobacterium avium subsp. paratuberculosis
guagggccaccacg

SEQ ID NO: 879303 - RNA, 19 nt, Mycobacterium avium subsp. paratuberculosis
guagggccaccacgccagc

SEQ ID NO: 879304 - RNA, 15 nt, Mycobacterium avium subsp. paratuberculosis
guagggccggucacc

SEQ ID NO: 879305 - RNA, 14 nt, Mycobacterium avium subsp. paratuberculosis
guagggcagcccga

SEQ ID NO: 879306 - RNA, 16 nt, Mycobacterium avium subsp. paratuberculosis
guagggcacaccggug

SEQ ID NO: 879307 - RNA, 12 nt, Mycobacterium avium subsp. paratuberculosis
guaggcggcgug

SEQ ID NO: 879308 - RNA, 15 nt, Mycobacterium avium subsp. paratuberculosis
guaggcggcugucga

SEQ ID NO: 879309 - RNA, 13 nt, Mycobacterium avium subsp. paratuberculosis
guaggcggccggg

SEQ ID NO: 879310 - RNA, 15 nt, Mycobacterium avium subsp. paratuberculosis
guaggcggccgggau

SEQ ID NO: 879311 - RNA, 17 nt, Mycobacterium avium subsp. paratuberculosis
guaggcgcggucggugg

SEQ ID NO: 879312 - RNA, 14 nt, Mycobacterium avium subsp. paratuberculosis
guaggcggccagca

SEQ ID NO: 879313 - RNA, 19 nt, Mycobacterium avium subsp. paratuberculosis
guaggcggccagcagcacc

SEQ ID NO: 879314 - RNA, 14 nt, Mycobacterium avium subsp. paratuberculosis
guaggcgcggguga

SEQ ID NO: 879315 - RNA, 17 nt, Mycobacterium avium subsp. paratuberculosis
guaggcgaucagcgcgc

SEQ ID NO: 879316 - RNA, 22 nt, Mycobacterium avium subsp. paratuberculosis
guaggcgaucagcgcgcacagc

SEQ ID NO: 879317 - RNA, 15 nt, Mycobacterium avium subsp. paratuberculosis
guaggcgcaccgccg

SEQ ID NO: 879318 - RNA, 20 nt, Mycobacterium avium subsp. paratuberculosis
guaggcgccgaacgccggau

SEQ ID NO: 879319 - RNA, 12 nt, Mycobacterium avium subsp. paratuberculosis
guaggcgccgau

SEQ ID NO: 879320 - RNA, 13 nt, Mycobacterium avium subsp. paratuberculosis
gucaccagcucgc

SEQ ID NO: 879321 - RNA, 14 nt, Mycobacterium avium subsp. paratuberculosis
gucaccagcucgcc

SEQ ID NO: 879322 - RNA, 16 nt, Mycobacterium avium subsp. paratuberculosis
gucaccagcucgccga

SEQ ID NO: 879323 - RNA, 14 nt, Mycobacterium avium subsp. paratuberculosis
gucaccagcgcggu

SEQ ID NO: 879324 - RNA, 13 nt, Mycobacterium avium subsp. paratuberculosis
gucaccagcggcc

SEQ ID NO: 879325 - RNA, 22 nt, Mycobacterium avium subsp. paratuberculosis
gucaccagcggcccgcuguggu

SEQ ID NO: 879326 - RNA, 17 nt, Mycobacterium avium subsp. paratuberculosis
gucaccaggcugcucgg

SEQ ID NO: 879327 - RNA, 23 nt, Mycobacterium avium subsp. paratuberculosis
gucaccaggucgcgguagaucga

SEQ ID NO: 879328 - RNA, 16 nt, Mycobacterium avium subsp. paratuberculosis
gucaccaucagcaccg

SEQ ID NO: 879329 - RNA, 13 nt, Mycobacterium avium subsp. paratuberculosis
gucaccaucagcg

SEQ ID NO: 879330 - RNA, 14 nt, Mycobacterium avium subsp. paratuberculosis
gucaccaucagcgg

SEQ ID NO: 879331 - RNA, 16 nt, Mycobacterium avium subsp. paratuberculosis
gucaccaucagcggcu

SEQ ID NO: 879332 - RNA, 17 nt, Mycobacterium avium subsp. paratuberculosis
gucaaugauggucagcc

SEQ ID NO: 879333 - RNA, 18 nt, Mycobacterium avium subsp. paratuberculosis
gucaaugauggucagccg

SEQ ID NO: 879334 - RNA, 21 nt, Mycobacterium avium subsp. paratuberculosis
gucaaugauggucagccgcac

SEQ ID NO: 879335 - RNA, 15 nt, Mycobacterium avium subsp. paratuberculosis
gucaaugccgcagcc

SEQ ID NO: 879336 - RNA, 16 nt, Mycobacterium avium subsp. paratuberculosis
gucaccuuggccggau

SEQ ID NO: 879337 - RNA, 17 nt, Mycobacterium avium subsp. paratuberculosis
gucacgacggucacggc

SEQ ID NO: 879338 - RNA, 20 nt, Mycobacterium avium subsp. paratuberculosis
gucacgacggucacggccgc

SEQ ID NO: 879339 - RNA, 21 nt, Mycobacterium avium subsp. paratuberculosis
gucaccucgagcacucgcggg

SEQ ID NO: 879340 - RNA, 14 nt, Mycobacterium avium subsp. paratuberculosis
gucaccugacgcuc

SEQ ID NO: 879341 - RNA, 18 nt, Mycobacterium avium subsp. paratuberculosis
gucaccuucaccacggcc

SEQ ID NO: 879342 - RNA, 20 nt, Mycobacterium avium subsp. paratuberculosis
gucaccuucaccacggccau

SEQ ID NO: 879343 - RNA, 22 nt, Mycobacterium avium subsp. paratuberculosis
gucaccuucacccccacccagg

SEQ ID NO: 879344 - RNA, 21 nt, Mycobacterium avium subsp. paratuberculosis
gucaccccggagauccggccg

SEQ ID NO: 879345 - RNA, 13 nt, Mycobacterium avium subsp. paratuberculosis
gucaccccggcca

SEQ ID NO: 879346 - RNA, 16 nt, Mycobacterium avium subsp. paratuberculosis
gucaccccggccauca

SEQ ID NO: 879347 - RNA, 19 nt, Mycobacterium avium subsp. paratuberculosis
gucaccccaccgagcagcu

SEQ ID NO: 879348 - RNA, 20 nt, Mycobacterium avium subsp. paratuberculosis
gucacccacuggcggccggc

SEQ ID NO: 879349 - RNA, 21 nt, Mycobacterium avium subsp. paratuberculosis
gucacccacuggcggccggcc

SEQ ID NO: 879350 - RNA, 22 nt, Mycobacterium avium subsp. paratuberculosis
gucacccagaucgcccgggcgg

SEQ ID NO: 879351 - RNA, 14 nt, Mycobacterium avium subsp. paratuberculosis
gucacccaggccga

SEQ ID NO: 879352 - RNA, 20 nt, Mycobacterium avium subsp. paratuberculosis
gucaccggugucacgcuggc

SEQ ID NO: 879353 - RNA, 21 nt, Mycobacterium avium subsp. paratuberculosis
gucaccggugucacgcuggcg

SEQ ID NO: 879354 - RNA, 21 nt, Mycobacterium avium subsp. paratuberculosis
gucaccgucguacucgaccgc

SEQ ID NO: 879355 - RNA, 20 nt, Mycobacterium avium subsp. paratuberculosis
gucaccgugcgggucgcgcu

SEQ ID NO: 879356 - RNA, 18 nt, Mycobacterium avium subsp. paratuberculosis
gucaccguggcgggggag

SEQ ID NO: 879357 - RNA, 19 nt, Mycobacterium avium subsp. paratuberculosis
gucaccgugggcggcgcga

SEQ ID NO: 879358 - RNA, 20 nt, Mycobacterium avium subsp. paratuberculosis
gucaccgugggcggcgcgau

SEQ ID NO: 879359 - RNA, 23 nt, Mycobacterium avium subsp. paratuberculosis
gucaccguggugugcccgcgggc

SEQ ID NO: 879360 - RNA, 16 nt, Mycobacterium avium subsp. paratuberculosis
gucaccgugucggcgg

SEQ ID NO: 879361 - RNA, 20 nt, Mycobacterium avium subsp. paratuberculosis
gucaccgugucggcgggcgg

SEQ ID NO: 879362 - RNA, 17 nt, Mycobacterium avium subsp. paratuberculosis
gucacugcacgcacggc

SEQ ID NO: 879363 - RNA, 22 nt, Mycobacterium avium subsp. paratuberculosis
gucacucuggcgugacgcucgg

SEQ ID NO: 879364 - RNA, 18 nt, Mycobacterium avium subsp. paratuberculosis
gucacguugaugaucgcc

SEQ ID NO: 879365 - RNA, 15 nt, Mycobacterium avium subsp. paratuberculosis
gucacuacccgcgau

SEQ ID NO: 879366 - RNA, 15 nt, Mycobacterium avium subsp. paratuberculosis
gucacugucggcgcg

SEQ ID NO: 879367 - RNA, 16 nt, Mycobacterium avium subsp. paratuberculosis
gucacuucgccgggcu

SEQ ID NO: 879368 - RNA, 15 nt, Mycobacterium avium subsp. paratuberculosis
gucagaaccggggcc

SEQ ID NO: 879369 - RNA, 21 nt, Mycobacterium avium subsp. paratuberculosis
gucagaaccggggccagcacg

SEQ ID NO: 879370 - RNA, 12 nt, Mycobacterium avium subsp. paratuberculosis
gucagcagcgcg

SEQ ID NO: 879371 - RNA, 13 nt, Mycobacterium avium subsp. paratuberculosis
gucagcagcaccc

SEQ ID NO: 879372 - RNA, 21 nt, Mycobacterium avium subsp. paratuberculosis
gucagcagcacccggucgccg

SEQ ID NO: 879373 - RNA, 13 nt, Mycobacterium avium subsp. paratuberculosis
gucagccccgagu

SEQ ID NO: 879374 - RNA, 20 nt, Mycobacterium avium subsp. paratuberculosis
gucagcccgcgucgcgcagc

SEQ ID NO: 879375 - RNA, 21 nt, Mycobacterium avium subsp. paratuberculosis
gucagcccgcgucgcgcagca

SEQ ID NO: 879376 - RNA, 19 nt, Mycobacterium avium subsp. paratuberculosis
gucagccagguguagacca

SEQ ID NO: 879377 - RNA, 15 nt, Mycobacterium avium subsp. paratuberculosis
gucagccacgggcgg

SEQ ID NO: 879378 - RNA, 12 nt, Mycobacterium avium subsp. paratuberculosis
gucagcaggcgc

SEQ ID NO: 879379 - RNA, 14 nt, Mycobacterium avium subsp. paratuberculosis
gucagcaggcgccg

SEQ ID NO: 879380 - RNA, 16 nt, Mycobacterium avium subsp. paratuberculosis
gucagcaggcgccgca

SEQ ID NO: 879381 - RNA, 22 nt, Mycobacterium avium subsp. paratuberculosis
gucagcccccaccgcgccguga

SEQ ID NO: 879382 - RNA, 15 nt, Mycobacterium avium subsp. paratuberculosis
gucagccgcggcggc

SEQ ID NO: 879383 - RNA, 17 nt, Mycobacterium avium subsp. paratuberculosis
gucagccgcggcggcag

SEQ ID NO: 879384 - RNA, 13 nt, Mycobacterium avium subsp. paratuberculosis
gucagccggcucg

SEQ ID NO: 879385 - RNA, 16 nt, Mycobacterium avium subsp. paratuberculosis
gucagccggcucggua

SEQ ID NO: 879386 - RNA, 14 nt, Mycobacterium avium subsp. paratuberculosis
gucagccgggcggc

SEQ ID NO: 879387 - RNA, 16 nt, Mycobacterium avium subsp. paratuberculosis
gucagccgggcggccu

SEQ ID NO: 879388 - RNA, 18 nt, Mycobacterium avium subsp. paratuberculosis
gucagccgggcggccucg

SEQ ID NO: 879389 - RNA, 18 nt, Mycobacterium avium subsp. paratuberculosis
guauugguagaacucggg

SEQ ID NO: 879390 - RNA, 19 nt, Mycobacterium avium subsp. paratuberculosis
gucaaaacaacgcgcagcc

SEQ ID NO: 879391 - RNA, 16 nt, Mycobacterium avium subsp. paratuberculosis
guauucgucgucggcc

SEQ ID NO: 879392 - RNA, 13 nt, Mycobacterium avium subsp. paratuberculosis
guauucgauggug

SEQ ID NO: 879393 - RNA, 13 nt, Mycobacterium avium subsp. paratuberculosis
guauucgcccacc

SEQ ID NO: 879394 - RNA, 15 nt, Mycobacterium avium subsp. paratuberculosis
guauugcacggcggc

SEQ ID NO: 879395 - RNA, 21 nt, Mycobacterium avium subsp. paratuberculosis
gucaagauaccggccggcgcg

SEQ ID NO: 879396 - RNA, 21 nt, Mycobacterium avium subsp. paratuberculosis
gucaagaacgcaaucgcccag

SEQ ID NO: 879397 - RNA, 17 nt, Mycobacterium avium subsp. paratuberculosis
gucaacucgacccgcac

SEQ ID NO: 879398 - RNA, 18 nt, Mycobacterium avium subsp. paratuberculosis
gucaacucgacccgcacc

SEQ ID NO: 879399 - RNA, 23 nt, Mycobacterium avium subsp. paratuberculosis
gucaacucgacccgcaccucgaa

SEQ ID NO: 879400 - RNA, 15 nt, Mycobacterium avium subsp. paratuberculosis
gucaacucgucggcg

SEQ ID NO: 879401 - RNA, 16 nt, Mycobacterium avium subsp. paratuberculosis
gucaagccggcauggu

SEQ ID NO: 879402 - RNA, 14 nt, Mycobacterium avium subsp. paratuberculosis
gucaagccggccag

SEQ ID NO: 879403 - RNA, 15 nt, Mycobacterium avium subsp. paratuberculosis
gucaacgccgcgcgc

SEQ ID NO: 879404 - RNA, 19 nt, Mycobacterium avium subsp. paratuberculosis
gucaacgccgcgcgcagca

SEQ ID NO: 879405 - RNA, 20 nt, Mycobacterium avium subsp. paratuberculosis
gucaacgccgcgcgcagcac

SEQ ID NO: 879406 - RNA, 12 nt, Mycobacterium avium subsp. paratuberculosis
gucaacgcgcac

SEQ ID NO: 879407 - RNA, 21 nt, Mycobacterium avium subsp. paratuberculosis
gucaacggcaccgacagggcc

SEQ ID NO: 879408 - RNA, 13 nt, Mycobacterium avium subsp. paratuberculosis
gucaacggcucgg

SEQ ID NO: 879409 - RNA, 17 nt, Mycobacterium avium subsp. paratuberculosis
gucaacggcuugcgcag

SEQ ID NO: 879410 - RNA, 19 nt, Mycobacterium avium subsp. paratuberculosis
gucaacggcuugcgcaggu

SEQ ID NO: 879411 - RNA, 15 nt, Mycobacterium avium subsp. paratuberculosis
gucaacgugucgagc

SEQ ID NO: 879412 - RNA, 18 nt, Mycobacterium avium subsp. paratuberculosis
guaggugggcagcgcggc

SEQ ID NO: 879413 - RNA, 18 nt, Mycobacterium avium subsp. paratuberculosis
guaggugugcagccaggu

SEQ ID NO: 879414 - RNA, 18 nt, Mycobacterium avium subsp. paratuberculosis
guaucuuguucgccgaca

SEQ ID NO: 879415 - RNA, 20 nt, Mycobacterium avium subsp. paratuberculosis
guaucuuguucgccgacacc

SEQ ID NO: 879416 - RNA, 19 nt, Mycobacterium avium subsp. paratuberculosis
guaucgggucaccgugcgg

SEQ ID NO: 879417 - RNA, 16 nt, Mycobacterium avium subsp. paratuberculosis
guaucggccccggccg

SEQ ID NO: 879418 - RNA, 17 nt, Mycobacterium avium subsp. paratuberculosis
guaggucaucagcgacg

SEQ ID NO: 879419 - RNA, 17 nt, Mycobacterium avium subsp. paratuberculosis
guaggucacccgguccc

SEQ ID NO: 879420 - RNA, 24 nt, Mycobacterium avium subsp. paratuberculosis
guaggucaacccgcucaggucggc

SEQ ID NO: 879421 - RNA, 23 nt, Mycobacterium avium subsp. paratuberculosis
guagggcuccgcgcugaccagcg

SEQ ID NO: 879422 - RNA, 14 nt, Mycobacterium avium subsp. paratuberculosis
guagggcucggcgu

SEQ ID NO: 879423 - RNA, 14 nt, Mycobacterium avium subsp. paratuberculosis
guaggugcacagcc

SEQ ID NO: 879424 - RNA, 19 nt, Mycobacterium avium subsp. paratuberculosis
guaggugagcaacgccagc

SEQ ID NO: 879425 - RNA, 15 nt, Mycobacterium avium subsp. paratuberculosis
guaggugaucguguu

SEQ ID NO: 879426 - RNA, 15 nt, Mycobacterium avium subsp. paratuberculosis
guaggugccggccgc

SEQ ID NO: 879427 - RNA, 22 nt, Mycobacterium avium subsp. paratuberculosis
guaggugcgcgagauggcgauc

SEQ ID NO: 879428 - RNA, 14 nt, Mycobacterium avium subsp. paratuberculosis
guaggugcgcgagg

SEQ ID NO: 879429 - RNA, 17 nt, Mycobacterium avium subsp. paratuberculosis
guagguggcgaccaccg

SEQ ID NO: 879430 - RNA, 16 nt, Mycobacterium avium subsp. paratuberculosis
guaucgccacgccgac

SEQ ID NO: 879431 - RNA, 17 nt, Mycobacterium avium subsp. paratuberculosis
guaucgccacgccgacc

SEQ ID NO: 879432 - RNA, 15 nt, Mycobacterium avium subsp. paratuberculosis
guaucgcgccugcac

SEQ ID NO: 879433 - RNA, 16 nt, Mycobacterium avium subsp. paratuberculosis
guaucgcgccugcacc

SEQ ID NO: 879434 - RNA, 19 nt, Mycobacterium avium subsp. paratuberculosis
guaucgcgccugcaccggc

SEQ ID NO: 879435 - RNA, 19 nt, Mycobacterium avium subsp. paratuberculosis
guccaaugcgccgauggug

SEQ ID NO: 879436 - RNA, 23 nt, Mycobacterium avium subsp. paratuberculosis
guccaaagacguugaccgcgaag

SEQ ID NO: 879437 - RNA, 22 nt, Mycobacterium avium subsp. paratuberculosis
guccaaaacaucccggacaggu

SEQ ID NO: 879438 - RNA, 15 nt, Mycobacterium avium subsp. paratuberculosis
guccaaccgcggacu

SEQ ID NO: 879439 - RNA, 17 nt, Mycobacterium avium subsp. paratuberculosis
guccaccagaagugguc

SEQ ID NO: 879440 - RNA, 18 nt, Mycobacterium avium subsp. paratuberculosis
guccaccagcacgccguu

SEQ ID NO: 879441 - RNA, 20 nt, Mycobacterium avium subsp. paratuberculosis
guccaccagcacgccguuga

SEQ ID NO: 879442 - RNA, 18 nt, Mycobacterium avium subsp. paratuberculosis
guccaccaccacacccgc

SEQ ID NO: 879443 - RNA, 13 nt, Mycobacterium avium subsp. paratuberculosis
guccacgccgcgg

SEQ ID NO: 879444 - RNA, 13 nt, Mycobacterium avium subsp. paratuberculosis
guccacgccggcg

SEQ ID NO: 879445 - RNA, 19 nt, Mycobacterium avium subsp. paratuberculosis
guccacgcccagcgccccg

SEQ ID NO: 879446 - RNA, 13 nt, Mycobacterium avium subsp. paratuberculosis
guccacgccgagg

SEQ ID NO: 879447 - RNA, 20 nt, Mycobacterium avium subsp. paratuberculosis
guccaccguugucucggcgc

SEQ ID NO: 879448 - RNA, 17 nt, Mycobacterium avium subsp. paratuberculosis
guccacgaugcguuggu

SEQ ID NO: 879449 - RNA, 19 nt, Mycobacterium avium subsp. paratuberculosis
guccacgaccccggcggca

SEQ ID NO: 879450 - RNA, 19 nt, Mycobacterium avium subsp. paratuberculosis
guccacgacguccucgacg

SEQ ID NO: 879451 - RNA, 13 nt, Mycobacterium avium subsp. paratuberculosis
guccaccggccga

SEQ ID NO: 879452 - RNA, 16 nt, Mycobacterium avium subsp. paratuberculosis
guccaccggccgaugg

SEQ ID NO: 879453 - RNA, 19 nt, Mycobacterium avium subsp. paratuberculosis
guccaccggauggcgcccg

SEQ ID NO: 879454 - RNA, 20 nt, Mycobacterium avium subsp. paratuberculosis
guccaccggauggcgcccgg

SEQ ID NO: 879455 - RNA, 23 nt, Mycobacterium avium subsp. paratuberculosis
guccaccccgccaaucaccgcgg

SEQ ID NO: 879456 - RNA, 16 nt, Mycobacterium avium subsp. paratuberculosis
guccacccgccccgcc

SEQ ID NO: 879457 - RNA, 18 nt, Mycobacterium avium subsp. paratuberculosis
guccacccgccccgccgc

SEQ ID NO: 879458 - RNA, 21 nt, Mycobacterium avium subsp. paratuberculosis
guccacccgccccgccgcggc

SEQ ID NO: 879459 - RNA, 22 nt, Mycobacterium avium subsp. paratuberculosis
guccacccgccccgccgcggcc

SEQ ID NO: 879460 - RNA, 23 nt, Mycobacterium avium subsp. paratuberculosis
guccacccgccccgccgcggcca

SEQ ID NO: 879461 - RNA, 14 nt, Mycobacterium avium subsp. paratuberculosis
guccacccggccca

SEQ ID NO: 879462 - RNA, 23 nt, Mycobacterium avium subsp. paratuberculosis
guccaccgacaucgaaugcagcg

SEQ ID NO: 879463 - RNA, 14 nt, Mycobacterium avium subsp. paratuberculosis
guccaccagcucga

SEQ ID NO: 879464 - RNA, 17 nt, Mycobacterium avium subsp. paratuberculosis
guccaccaggguggccg

SEQ ID NO: 879465 - RNA, 20 nt, Mycobacterium avium subsp. paratuberculosis
guccaccaggguggccgcca

SEQ ID NO: 879466 - RNA, 21 nt, Mycobacterium avium subsp. paratuberculosis
guccaccauggcuuccgccga

SEQ ID NO: 879467 - RNA, 15 nt, Mycobacterium avium subsp. paratuberculosis
guccacccccgcggu

SEQ ID NO: 879468 - RNA, 16 nt, Mycobacterium avium subsp. paratuberculosis
guccacccccgcggug

SEQ ID NO: 879469 - RNA, 14 nt, Mycobacterium avium subsp. paratuberculosis
guccaccgccgcgc

SEQ ID NO: 879470 - RNA, 17 nt, Mycobacterium avium subsp. paratuberculosis
guccaccgccgcgccga

SEQ ID NO: 879471 - RNA, 17 nt, Mycobacterium avium subsp. paratuberculosis
guccacuuccgcgcagg

SEQ ID NO: 879472 - RNA, 18 nt, Mycobacterium avium subsp. paratuberculosis
guccacucgucggcgguu

SEQ ID NO: 879473 - RNA, 22 nt, Mycobacterium avium subsp. paratuberculosis
guccacguugaugccgcccagc

SEQ ID NO: 879474 - RNA, 22 nt, Mycobacterium avium subsp. paratuberculosis
guccacuccaauacggcccggc

SEQ ID NO: 879475 - RNA, 23 nt, Mycobacterium avium subsp. paratuberculosis
guccacuccaauacggcccggcg

SEQ ID NO: 879476 - RNA, 16 nt, Mycobacterium avium subsp. paratuberculosis
guccacgucgcccagc

SEQ ID NO: 879477 - RNA, 14 nt, Mycobacterium avium subsp. paratuberculosis
guccacgguggcgc

SEQ ID NO: 879478 - RNA, 17 nt, Mycobacterium avium subsp. paratuberculosis
guccacgcuggcggugu

SEQ ID NO: 879479 - RNA, 15 nt, Mycobacterium avium subsp. paratuberculosis
guccacggucagcgc

SEQ ID NO: 879480 - RNA, 16 nt, Mycobacterium avium subsp. paratuberculosis
guccacggucagcgcg

SEQ ID NO: 879481 - RNA, 19 nt, Mycobacterium avium subsp. paratuberculosis
guccacggucagcgcgucg

SEQ ID NO: 879482 - RNA, 13 nt, Mycobacterium avium subsp. paratuberculosis
guccagcaccgcc

SEQ ID NO: 879483 - RNA, 14 nt, Mycobacterium avium subsp. paratuberculosis
guccagcaccgcca

SEQ ID NO: 879484 - RNA, 13 nt, Mycobacterium avium subsp. paratuberculosis
guccagcaccggc

SEQ ID NO: 879485 - RNA, 15 nt, Mycobacterium avium subsp. paratuberculosis
guccagaucggccag

SEQ ID NO: 879486 - RNA, 16 nt, Mycobacterium avium subsp. paratuberculosis
guccagaucggccagc

SEQ ID NO: 879487 - RNA, 19 nt, Mycobacterium avium subsp. paratuberculosis
guccagaucggccagcgcg

SEQ ID NO: 879488 - RNA, 20 nt, Mycobacterium avium subsp. paratuberculosis
guccagaucggccagcgcgg

SEQ ID NO: 879489 - RNA, 15 nt, Mycobacterium avium subsp. paratuberculosis
guccagaucggcgcg

SEQ ID NO: 879490 - RNA, 16 nt, Mycobacterium avium subsp. paratuberculosis
guccagaucggcgcgc

SEQ ID NO: 879491 - RNA, 15 nt, Mycobacterium avium subsp. paratuberculosis
guccagcaacgccga

SEQ ID NO: 879492 - RNA, 16 nt, Mycobacterium avium subsp. paratuberculosis
guccagcaacgccgac

SEQ ID NO: 879493 - RNA, 14 nt, Mycobacterium avium subsp. paratuberculosis
guccagaccggccg

SEQ ID NO: 879494 - RNA, 19 nt, Mycobacterium avium subsp. paratuberculosis
guccagccguucgcgcacg

SEQ ID NO: 879495 - RNA, 18 nt, Mycobacterium avium subsp. paratuberculosis
guccagccggucgcaggu

SEQ ID NO: 879496 - RNA, 12 nt, Mycobacterium avium subsp. paratuberculosis
guccagcccgau

SEQ ID NO: 879497 - RNA, 22 nt, Mycobacterium avium subsp. paratuberculosis
guccagcccgauguuggccuca

SEQ ID NO: 879498 - RNA, 14 nt, Mycobacterium avium subsp. paratuberculosis
guccagcccgguca

SEQ ID NO: 879499 - RNA, 22 nt, Mycobacterium avium subsp. paratuberculosis
guccagcccuacccguccagcg

SEQ ID NO: 879500 - RNA, 13 nt, Mycobacterium avium subsp. paratuberculosis
guccagccgccgc

SEQ ID NO: 879501 - RNA, 14 nt, Mycobacterium avium subsp. paratuberculosis
guccagcagcagcg

SEQ ID NO: 879502 - RNA, 22 nt, Mycobacterium avium subsp. paratuberculosis
guccagcaugcccacgccgucg

SEQ ID NO: 879503 - RNA, 15 nt, Mycobacterium avium subsp. paratuberculosis
guccagccagccgcg

SEQ ID NO: 879504 - RNA, 16 nt, Mycobacterium avium subsp. paratuberculosis
guccagccagccgcgc

SEQ ID NO: 879505 - RNA, 18 nt, Mycobacterium avium subsp. paratuberculosis
guccagccagccgcgccg

SEQ ID NO: 879506 - RNA, 13 nt, Mycobacterium avium subsp. paratuberculosis
guccagcccagcg

SEQ ID NO: 879507 - RNA, 17 nt, Mycobacterium avium subsp. paratuberculosis
guccagcagcgccggca

SEQ ID NO: 879508 - RNA, 16 nt, Mycobacterium avium subsp. paratuberculosis
guccagcagcagcgcg

SEQ ID NO: 879509 - RNA, 17 nt, Mycobacterium avium subsp. paratuberculosis
guccagcagcagcgcgc

SEQ ID NO: 879510 - RNA, 22 nt, Mycobacterium avium subsp. paratuberculosis
guccagcagcaugucguaguag

SEQ ID NO: 879511 - RNA, 23 nt, Mycobacterium avium subsp. paratuberculosis
guccagcaccugaccgucggcca

SEQ ID NO: 879512 - RNA, 18 nt, Mycobacterium avium subsp. paratuberculosis
guccagcacgugcccagc

SEQ ID NO: 879513 - RNA, 21 nt, Mycobacterium avium subsp. paratuberculosis
guccagcacgugcccagcccg

SEQ ID NO: 879514 - RNA, 20 nt, Mycobacterium avium subsp. paratuberculosis
gucccccgagcgggccuuca

SEQ ID NO: 879515 - RNA, 19 nt, Mycobacterium avium subsp. paratuberculosis
gucccggauggagcgcgac

SEQ ID NO: 879516 - RNA, 21 nt, Mycobacterium avium subsp. paratuberculosis
gucccggcaacaccggcggcg

SEQ ID NO: 879517 - RNA, 13 nt, Mycobacterium avium subsp. paratuberculosis
gucccggccgcga

SEQ ID NO: 879518 - RNA, 20 nt, Mycobacterium avium subsp. paratuberculosis
gucccggccgcgacagccgg

SEQ ID NO: 879519 - RNA, 14 nt, Mycobacterium avium subsp. paratuberculosis
gucccggcgcacca

SEQ ID NO: 879520 - RNA, 17 nt, Mycobacterium avium subsp. paratuberculosis
gucccggcgcaccaggc

SEQ ID NO: 879521 - RNA, 20 nt, Mycobacterium avium subsp. paratuberculosis
gucccggcgcccuucggcgc

SEQ ID NO: 879522 - RNA, 18 nt, Mycobacterium avium subsp. paratuberculosis
gucccggcgccucggcgc

SEQ ID NO: 879523 - RNA, 16 nt, Mycobacterium avium subsp. paratuberculosis
gucccggcggacccgg

SEQ ID NO: 879524 - RNA, 20 nt, Mycobacterium avium subsp. paratuberculosis
gucccaguccagccguucgc

SEQ ID NO: 879525 - RNA, 21 nt, Mycobacterium avium subsp. paratuberculosis
gucccaguuguuuccccagcc

SEQ ID NO: 879526 - RNA, 16 nt, Mycobacterium avium subsp. paratuberculosis
guccccaccaccgaca

SEQ ID NO: 879527 - RNA, 15 nt, Mycobacterium avium subsp. paratuberculosis
guccccaccgaucag

SEQ ID NO: 879528 - RNA, 23 nt, Mycobacterium avium subsp. paratuberculosis
guccccaccgaucaggaucggcg

SEQ ID NO: 879529 - RNA, 16 nt, Mycobacterium avium subsp. paratuberculosis
gucccagugcucgacc

SEQ ID NO: 879530 - RNA, 20 nt, Mycobacterium avium subsp. paratuberculosis
gucccagugcuugggcacgu

SEQ ID NO: 879531 - RNA, 15 nt, Mycobacterium avium subsp. paratuberculosis
gucccaggguugccg

SEQ ID NO: 879532 - RNA, 16 nt, Mycobacterium avium subsp. paratuberculosis
gucccaggcguggucg

SEQ ID NO: 879533 - RNA, 20 nt, Mycobacterium avium subsp. paratuberculosis
gucccaggcguggucggcgc

SEQ ID NO: 879534 - RNA, 14 nt, Mycobacterium avium subsp. paratuberculosis
gucccagccggaca

SEQ ID NO: 879535 - RNA, 18 nt, Mycobacterium avium subsp. paratuberculosis
gucccagccggacagcgg

SEQ ID NO: 879536 - RNA, 14 nt, Mycobacterium avium subsp. paratuberculosis
gucccaggacauca

SEQ ID NO: 879537 - RNA, 20 nt, Mycobacterium avium subsp. paratuberculosis
gucccagaugcgcgacggcc

SEQ ID NO: 879538 - RNA, 21 nt, Mycobacterium avium subsp. paratuberculosis
gucccagcacaacgccuccga

SEQ ID NO: 879539 - RNA, 16 nt, Mycobacterium avium subsp. paratuberculosis
gucccagcacagccgu

SEQ ID NO: 879540 - RNA, 18 nt, Mycobacterium avium subsp. paratuberculosis
gucccagcacagccgucg

SEQ ID NO: 879541 - RNA, 19 nt, Mycobacterium avium subsp. paratuberculosis
gucccgucacggcugccga

SEQ ID NO: 879542 - RNA, 14 nt, Mycobacterium avium subsp. paratuberculosis
gucccggugucgcc

SEQ ID NO: 879543 - RNA, 18 nt, Mycobacterium avium subsp. paratuberculosis
gucccguccaucgccgcg

SEQ ID NO: 879544 - RNA, 15 nt, Mycobacterium avium subsp. paratuberculosis
gucccguccgacggc

SEQ ID NO: 879545 - RNA, 16 nt, Mycobacterium avium subsp. paratuberculosis
gucccguccgacggcu

SEQ ID NO: 879546 - RNA, 18 nt, Mycobacterium avium subsp. paratuberculosis
gucccguccgacggcuac

SEQ ID NO: 879547 - RNA, 23 nt, Mycobacterium avium subsp. paratuberculosis
gucccguccugggccuggcgcuc

SEQ ID NO: 879548 - RNA, 23 nt, Mycobacterium avium subsp. paratuberculosis
gucccgucggccaguucgccggu

SEQ ID NO: 879549 - RNA, 24 nt, Mycobacterium avium subsp. paratuberculosis
gucccgucggccaguucgccggug

SEQ ID NO: 879550 - RNA, 13 nt, Mycobacterium avium subsp. paratuberculosis
gucccgucggcgc

SEQ ID NO: 879551 - RNA, 14 nt, Mycobacterium avium subsp. paratuberculosis
gucccgucggcgcg

SEQ ID NO: 879552 - RNA, 15 nt, Mycobacterium avium subsp. paratuberculosis
gucccgucggcgcga

SEQ ID NO: 879553 - RNA, 18 nt, Mycobacterium avium subsp. paratuberculosis
gucccggcgucucggcgu

SEQ ID NO: 879554 - RNA, 21 nt, Mycobacterium avium subsp. paratuberculosis
gucccggugaugacggggcgu

SEQ ID NO: 879555 - RNA, 23 nt, Mycobacterium avium subsp. paratuberculosis
gucccgggccuuggccaacgcgu

SEQ ID NO: 879556 - RNA, 16 nt, Mycobacterium avium subsp. paratuberculosis
gucccggggcucgaca

SEQ ID NO: 879557 - RNA, 23 nt, Mycobacterium avium subsp. paratuberculosis
gucccggggcucgacaggcagcc

SEQ ID NO: 879558 - RNA, 17 nt, Mycobacterium avium subsp. paratuberculosis
gucccgguacaggucgc

SEQ ID NO: 879559 - RNA, 21 nt, Mycobacterium avium subsp. paratuberculosis
gucccgguacaggucgcugcc

SEQ ID NO: 879560 - RNA, 21 nt, Mycobacterium avium subsp. paratuberculosis
gucccggucagcccccaccgc

SEQ ID NO: 879561 - RNA, 22 nt, Mycobacterium avium subsp. paratuberculosis
gucccggucagcccccaccgcg

SEQ ID NO: 879562 - RNA, 18 nt, Mycobacterium avium subsp. paratuberculosis
guccgagcgggccguggc

SEQ ID NO: 879563 - RNA, 17 nt, Mycobacterium avium subsp. paratuberculosis
guccgacuucgcgugcc

SEQ ID NO: 879564 - RNA, 19 nt, Mycobacterium avium subsp. paratuberculosis
guccgagaagggccgccgc

SEQ ID NO: 879565 - RNA, 21 nt, Mycobacterium avium subsp. paratuberculosis
guccgagaagggccgccgcug

SEQ ID NO: 879566 - RNA, 12 nt, Mycobacterium avium subsp. paratuberculosis
guccgaccgcgu

SEQ ID NO: 879567 - RNA, 23 nt, Mycobacterium avium subsp. paratuberculosis
guccgaccgcguacagggcgucg

SEQ ID NO: 879568 - RNA, 12 nt, Mycobacterium avium subsp. paratuberculosis
guccgacgccgu

SEQ ID NO: 879569 - RNA, 13 nt, Mycobacterium avium subsp. paratuberculosis
guccgacgccguc

SEQ ID NO: 879570 - RNA, 14 nt, Mycobacterium avium subsp. paratuberculosis
guccgacgccgucg

SEQ ID NO: 879571 - RNA, 15 nt, Mycobacterium avium subsp. paratuberculosis
guccgacgccgucga

SEQ ID NO: 879572 - RNA, 15 nt, Mycobacterium avium subsp. paratuberculosis
guccgacgcgacggu

SEQ ID NO: 879573 - RNA, 19 nt, Mycobacterium avium subsp. paratuberculosis
guccgacggcuggguggcg

SEQ ID NO: 879574 - RNA, 13 nt, Mycobacterium avium subsp. paratuberculosis
guccgacagcccg

SEQ ID NO: 879575 - RNA, 13 nt, Mycobacterium avium subsp. paratuberculosis
guccgacagcgcc

SEQ ID NO: 879576 - RNA, 17 nt, Mycobacterium avium subsp. paratuberculosis
guccgacagcgccugcc

SEQ ID NO: 879577 - RNA, 13 nt, Mycobacterium avium subsp. paratuberculosis
guccgaccagcac

SEQ ID NO: 879578 - RNA, 19 nt, Mycobacterium avium subsp. paratuberculosis
guccgaccagcggcccacc

SEQ ID NO: 879579 - RNA, 20 nt, Mycobacterium avium subsp. paratuberculosis
guccgaccagcggcccaccg

SEQ ID NO: 879580 - RNA, 22 nt, Mycobacterium avium subsp. paratuberculosis
guccgaccagcggcccaccgcg

SEQ ID NO: 879581 - RNA, 14 nt, Mycobacterium avium subsp. paratuberculosis
guccaugugccgca

SEQ ID NO: 879582 - RNA, 19 nt, Mycobacterium avium subsp. paratuberculosis
guccauguaguucagcagc

SEQ ID NO: 879583 - RNA, 17 nt, Mycobacterium avium subsp. paratuberculosis
guccaugcccgcccacg

SEQ ID NO: 879584 - RNA, 16 nt, Mycobacterium avium subsp. paratuberculosis
guccaucgggaccgcg

SEQ ID NO: 879585 - RNA, 18 nt, Mycobacterium avium subsp. paratuberculosis
guccaucgggaccgcggg

SEQ ID NO: 879586 - RNA, 23 nt, Mycobacterium avium subsp. paratuberculosis
guccaucuccagcuccgcggcca

SEQ ID NO: 879587 - RNA, 19 nt, Mycobacterium avium subsp. paratuberculosis
guccaggugggguggugga

SEQ ID NO: 879588 - RNA, 15 nt, Mycobacterium avium subsp. paratuberculosis
guccagggugguggu

SEQ ID NO: 879589 - RNA, 15 nt, Mycobacterium avium subsp. paratuberculosis
guccagggugucguc

SEQ ID NO: 879590 - RNA, 19 nt, Mycobacterium avium subsp. paratuberculosis
guccagggugucgucgucg

SEQ ID NO: 879591 - RNA, 16 nt, Mycobacterium avium subsp. paratuberculosis
guccaggugcacccgc

SEQ ID NO: 879592 - RNA, 17 nt, Mycobacterium avium subsp. paratuberculosis
guccaggugcacccgcg

SEQ ID NO: 879593 - RNA, 13 nt, Mycobacterium avium subsp. paratuberculosis
guccaggugcgcc

SEQ ID NO: 879594 - RNA, 16 nt, Mycobacterium avium subsp. paratuberculosis
guccaggugcgccgcc

SEQ ID NO: 879595 - RNA, 20 nt, Mycobacterium avium subsp. paratuberculosis
guccaggugcgccgccgcgu

SEQ ID NO: 879596 - RNA, 22 nt, Mycobacterium avium subsp. paratuberculosis
guccaggugcgccgccgcgucg

SEQ ID NO: 879597 - RNA, 18 nt, Mycobacterium avium subsp. paratuberculosis
guccaggcguucgacccc

SEQ ID NO: 879598 - RNA, 14 nt, Mycobacterium avium subsp. paratuberculosis
guccagggccaccg

SEQ ID NO: 879599 - RNA, 16 nt, Mycobacterium avium subsp. paratuberculosis
guccagggccaccgcg

SEQ ID NO: 879600 - RNA, 20 nt, Mycobacterium avium subsp. paratuberculosis
guccagggccaccgcgucgc

SEQ ID NO: 879601 - RNA, 15 nt, Mycobacterium avium subsp. paratuberculosis
guccagggcgggucg

SEQ ID NO: 879602 - RNA, 19 nt, Mycobacterium avium subsp. paratuberculosis
guccagggcgggucgucga

SEQ ID NO: 879603 - RNA, 17 nt, Mycobacterium avium subsp. paratuberculosis
guccaggccgucgaggc

SEQ ID NO: 879604 - RNA, 16 nt, Mycobacterium avium subsp. paratuberculosis
guccaggcgaccggcc

SEQ ID NO: 879605 - RNA, 18 nt, Mycobacterium avium subsp. paratuberculosis
guccagcguccgggcgua

SEQ ID NO: 879606 - RNA, 23 nt, Mycobacterium avium subsp. paratuberculosis
guccagcgucgacugcaccgacu

SEQ ID NO: 879607 - RNA, 16 nt, Mycobacterium avium subsp. paratuberculosis
guccagcggguugccg

SEQ ID NO: 879608 - RNA, 17 nt, Mycobacterium avium subsp. paratuberculosis
guccagcggcucggugu

SEQ ID NO: 879609 - RNA, 14 nt, Mycobacterium avium subsp. paratuberculosis
guccagcgcgaggu

SEQ ID NO: 879610 - RNA, 13 nt, Mycobacterium avium subsp. paratuberculosis
guccagcgcggug

SEQ ID NO: 879611 - RNA, 13 nt, Mycobacterium avium subsp. paratuberculosis
guccagcgccgcc

SEQ ID NO: 879612 - RNA, 19 nt, Mycobacterium avium subsp. paratuberculosis
guccagcgccgccacggcc

SEQ ID NO: 879613 - RNA, 19 nt, Mycobacterium avium subsp. paratuberculosis
guccaaaaacugcgcgucg

SEQ ID NO: 879614 - RNA, 16 nt, Mycobacterium avium subsp. paratuberculosis
gucauuccgccgcgcc

SEQ ID NO: 879615 - RNA, 20 nt, Mycobacterium avium subsp. paratuberculosis
gucauucugaauucggccac

SEQ ID NO: 879616 - RNA, 18 nt, Mycobacterium avium subsp. paratuberculosis
gucaugguggcggcgccg

SEQ ID NO: 879617 - RNA, 17 nt, Mycobacterium avium subsp. paratuberculosis
gucauggacagccaccg

SEQ ID NO: 879618 - RNA, 14 nt, Mycobacterium avium subsp. paratuberculosis
gucauggccgucgg

SEQ ID NO: 879619 - RNA, 20 nt, Mycobacterium avium subsp. paratuberculosis
gucauggcgaccgcgacggu

SEQ ID NO: 879620 - RNA, 15 nt, Mycobacterium avium subsp. paratuberculosis
gucaugccgagccgc

SEQ ID NO: 879621 - RNA, 20 nt, Mycobacterium avium subsp. paratuberculosis
gucaugccgcgcucgucgau

SEQ ID NO: 879622 - RNA, 20 nt, Mycobacterium avium subsp. paratuberculosis
gucaucuccgacucgaugua

SEQ ID NO: 879623 - RNA, 22 nt, Mycobacterium avium subsp. paratuberculosis
gucaucucggugguggccaucg

SEQ ID NO: 879624 - RNA, 18 nt, Mycobacterium avium subsp. paratuberculosis
gucaucgugaucgcccac

SEQ ID NO: 879625 - RNA, 19 nt, Mycobacterium avium subsp. paratuberculosis
gucaucgugaucgcccacc

SEQ ID NO: 879626 - RNA, 16 nt, Mycobacterium avium subsp. paratuberculosis
gucaucgugugggcgc

SEQ ID NO: 879627 - RNA, 19 nt, Mycobacterium avium subsp. paratuberculosis
gucaucgugugggcgcccg

SEQ ID NO: 879628 - RNA, 22 nt, Mycobacterium avium subsp. paratuberculosis
gucaucgugugggcgcccgcgg

SEQ ID NO: 879629 - RNA, 18 nt, Mycobacterium avium subsp. paratuberculosis
gucaugaaggcgacgucg

SEQ ID NO: 879630 - RNA, 20 nt, Mycobacterium avium subsp. paratuberculosis
gucaugaaggcgacgucggu

SEQ ID NO: 879631 - RNA, 16 nt, Mycobacterium avium subsp. paratuberculosis
gucaguuggucgaugu

SEQ ID NO: 879632 - RNA, 22 nt, Mycobacterium avium subsp. paratuberculosis
gucagugccccacaagcgaggu

SEQ ID NO: 879633 - RNA, 20 nt, Mycobacterium avium subsp. paratuberculosis
gucauagggcucguccucga

SEQ ID NO: 879634 - RNA, 16 nt, Mycobacterium avium subsp. paratuberculosis
gucaucagugaccgca

SEQ ID NO: 879635 - RNA, 18 nt, Mycobacterium avium subsp. paratuberculosis
gucaucagugaccgcacg

SEQ ID NO: 879636 - RNA, 15 nt, Mycobacterium avium subsp. paratuberculosis
gucauccccgugcgg

SEQ ID NO: 879637 - RNA, 16 nt, Mycobacterium avium subsp. paratuberculosis
gucauccccuggccga

SEQ ID NO: 879638 - RNA, 20 nt, Mycobacterium avium subsp. paratuberculosis
gucauccccuggccgaaggu

SEQ ID NO: 879639 - RNA, 16 nt, Mycobacterium avium subsp. paratuberculosis
gucaucccccgcagcu

SEQ ID NO: 879640 - RNA, 15 nt, Mycobacterium avium subsp. paratuberculosis
gucauccggcugccc

SEQ ID NO: 879641 - RNA, 14 nt, Mycobacterium avium subsp. paratuberculosis
gucauccgggccac

SEQ ID NO: 879642 - RNA, 23 nt, Mycobacterium avium subsp. paratuberculosis
gucauccgggccaccaccacggc

SEQ ID NO: 879643 - RNA, 21 nt, Mycobacterium avium subsp. paratuberculosis
gucaucgacuugccgccgcac

SEQ ID NO: 879644 - RNA, 21 nt, Mycobacterium avium subsp. paratuberculosis
gucaucgagccgagcaccggc

SEQ ID NO: 879645 - RNA, 14 nt, Mycobacterium avium subsp. paratuberculosis
gucaucgagccggu

SEQ ID NO: 879646 - RNA, 14 nt, Mycobacterium avium subsp. paratuberculosis
gucauccucgccgc

SEQ ID NO: 879647 - RNA, 15 nt, Mycobacterium avium subsp. paratuberculosis
gucauccucgccgcg

SEQ ID NO: 879648 - RNA, 18 nt, Mycobacterium avium subsp. paratuberculosis
gucauccucgccgcgcca

SEQ ID NO: 879649 - RNA, 12 nt, Mycobacterium avium subsp. paratuberculosis
gucaucgcggcg

SEQ ID NO: 879650 - RNA, 23 nt, Mycobacterium avium subsp. paratuberculosis
gucaucgcggcgaacaacgccac

SEQ ID NO: 879651 - RNA, 17 nt, Mycobacterium avium subsp. paratuberculosis
gucaucgccacccgcac

SEQ ID NO: 879652 - RNA, 16 nt, Mycobacterium avium subsp. paratuberculosis
gucaucgccgacggug

SEQ ID NO: 879653 - RNA, 23 nt, Mycobacterium avium subsp. paratuberculosis
gucaucgccgacggugagcaccg

SEQ ID NO: 879654 - RNA, 15 nt, Mycobacterium avium subsp. paratuberculosis
gucagguuggggccg

SEQ ID NO: 879655 - RNA, 16 nt, Mycobacterium avium subsp. paratuberculosis
gucaguacagcuaggc

SEQ ID NO: 879656 - RNA, 15 nt, Mycobacterium avium subsp. paratuberculosis
gucagucgcgccgcc

SEQ ID NO: 879657 - RNA, 16 nt, Mycobacterium avium subsp. paratuberculosis
gucagucgcgccgcca

SEQ ID NO: 879658 - RNA, 22 nt, Mycobacterium avium subsp. paratuberculosis
gucagucgcgccgccagcaacc

SEQ ID NO: 879659 - RNA, 21 nt, Mycobacterium avium subsp. paratuberculosis
gucagguagccgaggucgccg

SEQ ID NO: 879660 - RNA, 15 nt, Mycobacterium avium subsp. paratuberculosis
gucagguaggcgucg

SEQ ID NO: 879661 - RNA, 18 nt, Mycobacterium avium subsp. paratuberculosis
gucagguaggcgucgaac

SEQ ID NO: 879662 - RNA, 21 nt, Mycobacterium avium subsp. paratuberculosis
gucaggucgaagcccgccguc

SEQ ID NO: 879663 - RNA, 14 nt, Mycobacterium avium subsp. paratuberculosis
gucaggucgaccgg

SEQ ID NO: 879664 - RNA, 15 nt, Mycobacterium avium subsp. paratuberculosis
gucaggucgaccggc

SEQ ID NO: 879665 - RNA, 18 nt, Mycobacterium avium subsp. paratuberculosis
gucaggucgaccggcucg

SEQ ID NO: 879666 - RNA, 19 nt, Mycobacterium avium subsp. paratuberculosis
gucaggucgcugcgcucgc

SEQ ID NO: 879667 - RNA, 12 nt, Mycobacterium avium subsp. paratuberculosis
gucaggucggcg

SEQ ID NO: 879668 - RNA, 13 nt, Mycobacterium avium subsp. paratuberculosis
gucaggucggcga

SEQ ID NO: 879669 - RNA, 21 nt, Mycobacterium avium subsp. paratuberculosis
gucaggucuucggucgcgacc

SEQ ID NO: 879670 - RNA, 22 nt, Mycobacterium avium subsp. paratuberculosis
gucaggucuucggucgcgaccc

SEQ ID NO: 879671 - RNA, 20 nt, Mycobacterium avium subsp. paratuberculosis
gucagguggauggucaccgg

SEQ ID NO: 879672 - RNA, 20 nt, Mycobacterium avium subsp. paratuberculosis
gucagguucuucugcgcgau

SEQ ID NO: 879673 - RNA, 19 nt, Mycobacterium avium subsp. paratuberculosis
gucagguugacgccgauga

SEQ ID NO: 879674 - RNA, 17 nt, Mycobacterium avium subsp. paratuberculosis
gucaggcgcagccagcg

SEQ ID NO: 879675 - RNA, 20 nt, Mycobacterium avium subsp. paratuberculosis
gucaggccggucagcgacga

SEQ ID NO: 879676 - RNA, 21 nt, Mycobacterium avium subsp. paratuberculosis
gucaggccgucucgagccggc

SEQ ID NO: 879677 - RNA, 24 nt, Mycobacterium avium subsp. paratuberculosis
gucaggccgucucgagccggcgca

SEQ ID NO: 879678 - RNA, 21 nt, Mycobacterium avium subsp. paratuberculosis
gucaggccgugaucggccagc

SEQ ID NO: 879679 - RNA, 14 nt, Mycobacterium avium subsp. paratuberculosis
gucaggccucgagg

SEQ ID NO: 879680 - RNA, 15 nt, Mycobacterium avium subsp. paratuberculosis
gucaggccggcgccg

SEQ ID NO: 879681 - RNA, 17 nt, Mycobacterium avium subsp. paratuberculosis
gucaggccggcgccggg

SEQ ID NO: 879682 - RNA, 16 nt, Mycobacterium avium subsp. paratuberculosis
gucaggcccagcgagg

SEQ ID NO: 879683 - RNA, 21 nt, Mycobacterium avium subsp. paratuberculosis
gucagggcgacuccggcgccg

SEQ ID NO: 879684 - RNA, 21 nt, Mycobacterium avium subsp. paratuberculosis
gucaggggugccggaggcggc

SEQ ID NO: 879685 - RNA, 22 nt, Mycobacterium avium subsp. paratuberculosis
gucaggggugccggaggcggcg

SEQ ID NO: 879686 - RNA, 21 nt, Mycobacterium avium subsp. paratuberculosis
gucagggugacguggcggccg

SEQ ID NO: 879687 - RNA, 23 nt, Mycobacterium avium subsp. paratuberculosis
gucagggugacguggcggccguc

SEQ ID NO: 879688 - RNA, 20 nt, Mycobacterium avium subsp. paratuberculosis
gucagggugugacggauccg

SEQ ID NO: 879689 - RNA, 20 nt, Mycobacterium avium subsp. paratuberculosis
gucaggagugcucggcguug

SEQ ID NO: 879690 - RNA, 23 nt, Mycobacterium avium subsp. paratuberculosis
gucaggagugcucggcguugagc

SEQ ID NO: 879691 - RNA, 21 nt, Mycobacterium avium subsp. paratuberculosis
gucaggaaugcgacgacgucg

SEQ ID NO: 879692 - RNA, 15 nt, Mycobacterium avium subsp. paratuberculosis
gucagcugccgcacc

SEQ ID NO: 879693 - RNA, 16 nt, Mycobacterium avium subsp. paratuberculosis
gucagcugccgcaccg

SEQ ID NO: 879694 - RNA, 22 nt, Mycobacterium avium subsp. paratuberculosis
gucagcuuggagccgagcaccg

SEQ ID NO: 879695 - RNA, 17 nt, Mycobacterium avium subsp. paratuberculosis
gucaggaacccggcccg

SEQ ID NO: 879696 - RNA, 14 nt, Mycobacterium avium subsp. paratuberculosis
gucaggaacgcgga

SEQ ID NO: 879697 - RNA, 18 nt, Mycobacterium avium subsp. paratuberculosis
gucaggcauuccaccgcg

SEQ ID NO: 879698 - RNA, 19 nt, Mycobacterium avium subsp. paratuberculosis
gucaggcauuccaccgcgc

SEQ ID NO: 879699 - RNA, 21 nt, Mycobacterium avium subsp. paratuberculosis
gucaggcauuccaccgcgcgg

SEQ ID NO: 879700 - RNA, 23 nt, Mycobacterium avium subsp. paratuberculosis
gucaggcauuccaccgcgcggcg

SEQ ID NO: 879701 - RNA, 18 nt, Mycobacterium avium subsp. paratuberculosis
gucagcucgaucgccgcg

SEQ ID NO: 879702 - RNA, 19 nt, Mycobacterium avium subsp. paratuberculosis
gucagcucgaucgccgcgc

SEQ ID NO: 879703 - RNA, 14 nt, Mycobacterium avium subsp. paratuberculosis
gucagcucgccguc

SEQ ID NO: 879704 - RNA, 15 nt, Mycobacterium avium subsp. paratuberculosis
gucagcucgcgcccg

SEQ ID NO: 879705 - RNA, 18 nt, Mycobacterium avium subsp. paratuberculosis
gucagcucgcgcccggcc

SEQ ID NO: 879706 - RNA, 20 nt, Mycobacterium avium subsp. paratuberculosis
gucagcucgcgcccggccag

SEQ ID NO: 879707 - RNA, 22 nt, Mycobacterium avium subsp. paratuberculosis
gucagcucgggguaguucagcg

SEQ ID NO: 879708 - RNA, 21 nt, Mycobacterium avium subsp. paratuberculosis
gucagcuccaccugcggcacc

SEQ ID NO: 879709 - RNA, 22 nt, Mycobacterium avium subsp. paratuberculosis
gucagcucccccgacaccgcca

SEQ ID NO: 879710 - RNA, 19 nt, Mycobacterium avium subsp. paratuberculosis
gucagcucccccgucgggc

SEQ ID NO: 879711 - RNA, 21 nt, Mycobacterium avium subsp. paratuberculosis
gucagcucgaaggugcccgca

SEQ ID NO: 879712 - RNA, 19 nt, Mycobacterium avium subsp. paratuberculosis
gucagcucaggaacggccg

SEQ ID NO: 879713 - RNA, 21 nt, Mycobacterium avium subsp. paratuberculosis
gucagcucaggaacggccgga

SEQ ID NO: 879714 - RNA, 22 nt, Mycobacterium avium subsp. paratuberculosis
gucagcucaggaacggccggau

SEQ ID NO: 879715 - RNA, 20 nt, Mycobacterium avium subsp. paratuberculosis
gucagcgcgacaucgccggc

SEQ ID NO: 879716 - RNA, 17 nt, Mycobacterium avium subsp. paratuberculosis
gucagcgcgggccagca

SEQ ID NO: 879717 - RNA, 20 nt, Mycobacterium avium subsp. paratuberculosis
gucagcgcguccaggugcgc

SEQ ID NO: 879718 - RNA, 14 nt, Mycobacterium avium subsp. paratuberculosis
gucagcgcgucggc

SEQ ID NO: 879719 - RNA, 19 nt, Mycobacterium avium subsp. paratuberculosis
gucagcgcgucggcgaccg

SEQ ID NO: 879720 - RNA, 22 nt, Mycobacterium avium subsp. paratuberculosis
gucagcgcgucggcgaccgcgc

SEQ ID NO: 879721 - RNA, 13 nt, Mycobacterium avium subsp. paratuberculosis
gucagcgcggccc

SEQ ID NO: 879722 - RNA, 15 nt, Mycobacterium avium subsp. paratuberculosis
gucagcgcggcccgc

SEQ ID NO: 879723 - RNA, 16 nt, Mycobacterium avium subsp. paratuberculosis
gucagcgcggcccgcg

SEQ ID NO: 879724 - RNA, 15 nt, Mycobacterium avium subsp. paratuberculosis
gucagcgcgugaccc

SEQ ID NO: 879725 - RNA, 20 nt, Mycobacterium avium subsp. paratuberculosis
gucagcgcgugaccccggcg

SEQ ID NO: 879726 - RNA, 21 nt, Mycobacterium avium subsp. paratuberculosis
gucagcgcuuccagcgcggcg

SEQ ID NO: 879727 - RNA, 16 nt, Mycobacterium avium subsp. paratuberculosis
gucagcguggcgucgg

SEQ ID NO: 879728 - RNA, 17 nt, Mycobacterium avium subsp. paratuberculosis
gucagcguggcgucggc

SEQ ID NO: 879729 - RNA, 15 nt, Mycobacterium avium subsp. paratuberculosis
gucagcgucgccgcc

SEQ ID NO: 879730 - RNA, 19 nt, Mycobacterium avium subsp. paratuberculosis
gucagcgucgccgccccga

SEQ ID NO: 879731 - RNA, 16 nt, Mycobacterium avium subsp. paratuberculosis
gucagcgucucgccgg

SEQ ID NO: 879732 - RNA, 18 nt, Mycobacterium avium subsp. paratuberculosis
gucagcgucucggcgauc

SEQ ID NO: 879733 - RNA, 19 nt, Mycobacterium avium subsp. paratuberculosis
gucagcgucucggcgauca

SEQ ID NO: 879734 - RNA, 15 nt, Mycobacterium avium subsp. paratuberculosis
gucagcgucagcacg

SEQ ID NO: 879735 - RNA, 16 nt, Mycobacterium avium subsp. paratuberculosis
gucagcgucagcacgu

SEQ ID NO: 879736 - RNA, 14 nt, Mycobacterium avium subsp. paratuberculosis
gucagcggccucgg

SEQ ID NO: 879737 - RNA, 20 nt, Mycobacterium avium subsp. paratuberculosis
gucagcggcaacacgccggc

SEQ ID NO: 879738 - RNA, 23 nt, Mycobacterium avium subsp. paratuberculosis
gucagcggcaacacgccggcggc

SEQ ID NO: 879739 - RNA, 20 nt, Mycobacterium avium subsp. paratuberculosis
gucagcggcaggucccaggc

SEQ ID NO: 879740 - RNA, 14 nt, Mycobacterium avium subsp. paratuberculosis
gucagcggcccgau

SEQ ID NO: 879741 - RNA, 16 nt, Mycobacterium avium subsp. paratuberculosis
gucagcggcccgauca

SEQ ID NO: 879742 - RNA, 13 nt, Mycobacterium avium subsp. paratuberculosis
gucagcggcgggc

SEQ ID NO: 879743 - RNA, 12 nt, Mycobacterium avium subsp. paratuberculosis
gucagcggcgug

SEQ ID NO: 879744 - RNA, 20 nt, Mycobacterium avium subsp. paratuberculosis
gucagcggcgugcugcgcag

SEQ ID NO: 879745 - RNA, 21 nt, Mycobacterium avium subsp. paratuberculosis
gugccucgccacugggcgucg

SEQ ID NO: 879746 - RNA, 17 nt, Mycobacterium avium subsp. paratuberculosis
gugccucuucgucggcc

SEQ ID NO: 879747 - RNA, 20 nt, Mycobacterium avium subsp. paratuberculosis
gugccucuucgucggccggc

SEQ ID NO: 879748 - RNA, 15 nt, Mycobacterium avium subsp. paratuberculosis
gugccggccgggucg

SEQ ID NO: 879749 - RNA, 15 nt, Mycobacterium avium subsp. paratuberculosis
gugccggccucgucg

SEQ ID NO: 879750 - RNA, 16 nt, Mycobacterium avium subsp. paratuberculosis
gugccggccucgucgg

SEQ ID NO: 879751 - RNA, 22 nt, Mycobacterium avium subsp. paratuberculosis
gugccggccucgucggcgagca

SEQ ID NO: 879752 - RNA, 13 nt, Mycobacterium avium subsp. paratuberculosis
gugccggccagcu

SEQ ID NO: 879753 - RNA, 19 nt, Mycobacterium avium subsp. paratuberculosis
gugccggccagcucgccgc

SEQ ID NO: 879754 - RNA, 21 nt, Mycobacterium avium subsp. paratuberculosis
gugccggccagcucgccgccg

SEQ ID NO: 879755 - RNA, 22 nt, Mycobacterium avium subsp. paratuberculosis
gugccggccagcucgccgccga

SEQ ID NO: 879756 - RNA, 15 nt, Mycobacterium avium subsp. paratuberculosis
gugccggcccggcgg

SEQ ID NO: 879757 - RNA, 16 nt, Mycobacterium avium subsp. paratuberculosis
gugccggcccggcggg

SEQ ID NO: 879758 - RNA, 15 nt, Mycobacterium avium subsp. paratuberculosis
gugccguugaccacg

SEQ ID NO: 879759 - RNA, 18 nt, Mycobacterium avium subsp. paratuberculosis
gugccguugaccacgccc

SEQ ID NO: 879760 - RNA, 16 nt, Mycobacterium avium subsp. paratuberculosis
gugccguugaucaggg

SEQ ID NO: 879761 - RNA, 22 nt, Mycobacterium avium subsp. paratuberculosis
gugccguugaucagggcggcgc

SEQ ID NO: 879762 - RNA, 20 nt, Mycobacterium avium subsp. paratuberculosis
gugccgcugacggucgccga

SEQ ID NO: 879763 - RNA, 18 nt, Mycobacterium avium subsp. paratuberculosis
gugccgcugcccgccgcg

SEQ ID NO: 879764 - RNA, 20 nt, Mycobacterium avium subsp. paratuberculosis
gugccgcuccggucgcgucg

SEQ ID NO: 879765 - RNA, 23 nt, Mycobacterium avium subsp. paratuberculosis
gugccgcugggagcacgugauga

SEQ ID NO: 879766 - RNA, 20 nt, Mycobacterium avium subsp. paratuberculosis
gugccgcugguaggcggcgc

SEQ ID NO: 879767 - RNA, 16 nt, Mycobacterium avium subsp. paratuberculosis
gugccggaagcggcgg

SEQ ID NO: 879768 - RNA, 21 nt, Mycobacterium avium subsp. paratuberculosis
gugccggaaguucucgccgug

SEQ ID NO: 879769 - RNA, 22 nt, Mycobacterium avium subsp. paratuberculosis
gugccggaaguucucgccgugc

SEQ ID NO: 879770 - RNA, 17 nt, Mycobacterium avium subsp. paratuberculosis
gugccggaauugaagaa

SEQ ID NO: 879771 - RNA, 15 nt, Mycobacterium avium subsp. paratuberculosis
gugccggacaccggc

SEQ ID NO: 879772 - RNA, 16 nt, Mycobacterium avium subsp. paratuberculosis
gugccggaccgcgcgg

SEQ ID NO: 879773 - RNA, 20 nt, Mycobacterium avium subsp. paratuberculosis
gugccggaccgcgcgggcca

SEQ ID NO: 879774 - RNA, 19 nt, Mycobacterium avium subsp. paratuberculosis
gugccggaugcggucgaug

SEQ ID NO: 879775 - RNA, 15 nt, Mycobacterium avium subsp. paratuberculosis
gugccggccaccggc

SEQ ID NO: 879776 - RNA, 15 nt, Mycobacterium avium subsp. paratuberculosis
gugccggccagaucg

SEQ ID NO: 879777 - RNA, 16 nt, Mycobacterium avium subsp. paratuberculosis
gugccggccagaucga

SEQ ID NO: 879778 - RNA, 20 nt, Mycobacterium avium subsp. paratuberculosis
gugccggccagaucgacgcc

SEQ ID NO: 879779 - RNA, 22 nt, Mycobacterium avium subsp. paratuberculosis
gugccggccagaucgacgccgc

SEQ ID NO: 879780 - RNA, 12 nt, Mycobacterium avium subsp. paratuberculosis
gugcccggccag

SEQ ID NO: 879781 - RNA, 12 nt, Mycobacterium avium subsp. paratuberculosis
gugcccggcgag

SEQ ID NO: 879782 - RNA, 14 nt, Mycobacterium avium subsp. paratuberculosis
gugcccggcgcccu

SEQ ID NO: 879783 - RNA, 20 nt, Mycobacterium avium subsp. paratuberculosis
gugcccggcgccgaccaggc

SEQ ID NO: 879784 - RNA, 15 nt, Mycobacterium avium subsp. paratuberculosis
gugccgccgggcacc

SEQ ID NO: 879785 - RNA, 17 nt, Mycobacterium avium subsp. paratuberculosis
gugcccgggccgcagcu

SEQ ID NO: 879786 - RNA, 16 nt, Mycobacterium avium subsp. paratuberculosis
gugccgccggcgaucu

SEQ ID NO: 879787 - RNA, 22 nt, Mycobacterium avium subsp. paratuberculosis
gugccgccggcgaucucgucgc

SEQ ID NO: 879788 - RNA, 15 nt, Mycobacterium avium subsp. paratuberculosis
gugcccggaacggcg

SEQ ID NO: 879789 - RNA, 17 nt, Mycobacterium avium subsp. paratuberculosis
gugcccggaucgccgaa

SEQ ID NO: 879790 - RNA, 15 nt, Mycobacterium avium subsp. paratuberculosis
gugcccgcaucgccg

SEQ ID NO: 879791 - RNA, 16 nt, Mycobacterium avium subsp. paratuberculosis
gugcccgcccagcugc

SEQ ID NO: 879792 - RNA, 13 nt, Mycobacterium avium subsp. paratuberculosis
gugcccgccgcga

SEQ ID NO: 879793 - RNA, 15 nt, Mycobacterium avium subsp. paratuberculosis
gugcccgccgcgacc

SEQ ID NO: 879794 - RNA, 18 nt, Mycobacterium avium subsp. paratuberculosis
gugcccgccgugcgcccc

SEQ ID NO: 879795 - RNA, 13 nt, Mycobacterium avium subsp. paratuberculosis
gugcccgccucgc

SEQ ID NO: 879796 - RNA, 14 nt, Mycobacterium avium subsp. paratuberculosis
gugcccgcgggaca

SEQ ID NO: 879797 - RNA, 14 nt, Mycobacterium avium subsp. paratuberculosis
gugcccgcgggcca

SEQ ID NO: 879798 - RNA, 20 nt, Mycobacterium avium subsp. paratuberculosis
gugcccgcggucaugcgcgg

SEQ ID NO: 879799 - RNA, 18 nt, Mycobacterium avium subsp. paratuberculosis
gugcccgcguacagcggg

SEQ ID NO: 879800 - RNA, 21 nt, Mycobacterium avium subsp. paratuberculosis
gugccgcgccaacgaggcacg

SEQ ID NO: 879801 - RNA, 13 nt, Mycobacterium avium subsp. paratuberculosis
gugccgcgcggca

SEQ ID NO: 879802 - RNA, 15 nt, Mycobacterium avium subsp. paratuberculosis
gugccgcgcggcggu

SEQ ID NO: 879803 - RNA, 15 nt, Mycobacterium avium subsp. paratuberculosis
gugccgcggcggcgc

SEQ ID NO: 879804 - RNA, 17 nt, Mycobacterium avium subsp. paratuberculosis
gugccgcggcggcgccg

SEQ ID NO: 879805 - RNA, 18 nt, Mycobacterium avium subsp. paratuberculosis
gugccgcggcggcgccga

SEQ ID NO: 879806 - RNA, 13 nt, Mycobacterium avium subsp. paratuberculosis
gugccgcgggucg

SEQ ID NO: 879807 - RNA, 19 nt, Mycobacterium avium subsp. paratuberculosis
gugccgcggugcggcccgc

SEQ ID NO: 879808 - RNA, 22 nt, Mycobacterium avium subsp. paratuberculosis
gugccgcggugcggcccgcggc

SEQ ID NO: 879809 - RNA, 20 nt, Mycobacterium avium subsp. paratuberculosis
gugccgcgaugcccgccggc

SEQ ID NO: 879810 - RNA, 15 nt, Mycobacterium avium subsp. paratuberculosis
gugccgcgcaccacc

SEQ ID NO: 879811 - RNA, 13 nt, Mycobacterium avium subsp. paratuberculosis
gugccgcgcagca

SEQ ID NO: 879812 - RNA, 15 nt, Mycobacterium avium subsp. paratuberculosis
gugccgcgcagcacc

SEQ ID NO: 879813 - RNA, 13 nt, Mycobacterium avium subsp. paratuberculosis
gugccgccgguga

SEQ ID NO: 879814 - RNA, 15 nt, Mycobacterium avium subsp. paratuberculosis
gugccgccgucgacg

SEQ ID NO: 879815 - RNA, 17 nt, Mycobacterium avium subsp. paratuberculosis
gugcgcagucgcugguc

SEQ ID NO: 879816 - RNA, 17 nt, Mycobacterium avium subsp. paratuberculosis
gugcgcaguucgggauc

SEQ ID NO: 879817 - RNA, 21 nt, Mycobacterium avium subsp. paratuberculosis
gugcgcaguucgggaucgucg

SEQ ID NO: 879818 - RNA, 16 nt, Mycobacterium avium subsp. paratuberculosis
gugcgcaucggcgacg

SEQ ID NO: 879819 - RNA, 18 nt, Mycobacterium avium subsp. paratuberculosis
gugcgcaucggcgacgcc

SEQ ID NO: 879820 - RNA, 20 nt, Mycobacterium avium subsp. paratuberculosis
gugcgcaucggcgacgccgc

SEQ ID NO: 879821 - RNA, 16 nt, Mycobacterium avium subsp. paratuberculosis
gugcgcauucggcgac

SEQ ID NO: 879822 - RNA, 19 nt, Mycobacterium avium subsp. paratuberculosis
gugcgcauucggcgacgcu

SEQ ID NO: 879823 - RNA, 12 nt, Mycobacterium avium subsp. paratuberculosis
gugcgcaggcgg

SEQ ID NO: 879824 - RNA, 15 nt, Mycobacterium avium subsp. paratuberculosis
gugcgcaggcggcgc

SEQ ID NO: 879825 - RNA, 16 nt, Mycobacterium avium subsp. paratuberculosis
gugcgcaggcggcgcg

SEQ ID NO: 879826 - RNA, 17 nt, Mycobacterium avium subsp. paratuberculosis
gugcgcaggcggcgcgc

SEQ ID NO: 879827 - RNA, 21 nt, Mycobacterium avium subsp. paratuberculosis
gugcgcaggcggcgcgcagcc

SEQ ID NO: 879828 - RNA, 20 nt, Mycobacterium avium subsp. paratuberculosis
gugcgacuugguggccagca

SEQ ID NO: 879829 - RNA, 21 nt, Mycobacterium avium subsp. paratuberculosis
gugcgagaaaaucgcccgcga

SEQ ID NO: 879830 - RNA, 14 nt, Mycobacterium avium subsp. paratuberculosis
gugcgagccgcuga

SEQ ID NO: 879831 - RNA, 14 nt, Mycobacterium avium subsp. paratuberculosis
gugcgccaggcagg

SEQ ID NO: 879832 - RNA, 16 nt, Mycobacterium avium subsp. paratuberculosis
gugcgcccauccggcg

SEQ ID NO: 879833 - RNA, 17 nt, Mycobacterium avium subsp. paratuberculosis
gugcgcccauccggcgc

SEQ ID NO: 879834 - RNA, 19 nt, Mycobacterium avium subsp. paratuberculosis
gugcgcccauccggcgccg

SEQ ID NO: 879835 - RNA, 21 nt, Mycobacterium avium subsp. paratuberculosis
gugcgcccauccggcgccgcg

SEQ ID NO: 879836 - RNA, 16 nt, Mycobacterium avium subsp. paratuberculosis
gugcgccccacggcgc

SEQ ID NO: 879837 - RNA, 17 nt, Mycobacterium avium subsp. paratuberculosis
gugcgccccacggcgcg

SEQ ID NO: 879838 - RNA, 18 nt, Mycobacterium avium subsp. paratuberculosis
gugcgccccacggcgcgu

SEQ ID NO: 879839 - RNA, 15 nt, Mycobacterium avium subsp. paratuberculosis
gugcgccacgcccgc

SEQ ID NO: 879840 - RNA, 19 nt, Mycobacterium avium subsp. paratuberculosis
gugcgccacgcccgcagcg

SEQ ID NO: 879841 - RNA, 15 nt, Mycobacterium avium subsp. paratuberculosis
gugcgccagcgacgg

SEQ ID NO: 879842 - RNA, 14 nt, Mycobacterium avium subsp. paratuberculosis
gugcgccagaucag

SEQ ID NO: 879843 - RNA, 19 nt, Mycobacterium avium subsp. paratuberculosis
gugcgaaucaucguggcgc

SEQ ID NO: 879844 - RNA, 14 nt, Mycobacterium avium subsp. paratuberculosis
gugcgacaccggcg

SEQ ID NO: 879845 - RNA, 14 nt, Mycobacterium avium subsp. paratuberculosis
gugcgagccaccuc

SEQ ID NO: 879846 - RNA, 16 nt, Mycobacterium avium subsp. paratuberculosis
gugcgagccaccucga

SEQ ID NO: 879847 - RNA, 18 nt, Mycobacterium avium subsp. paratuberculosis
gugcgagccaccucgauc

SEQ ID NO: 879848 - RNA, 21 nt, Mycobacterium avium subsp. paratuberculosis
gugcgagccaccucgaucagc

SEQ ID NO: 879849 - RNA, 23 nt, Mycobacterium avium subsp. paratuberculosis
gugcgagccaccucgaucagcgg

SEQ ID NO: 879850 - RNA, 14 nt, Mycobacterium avium subsp. paratuberculosis
gugcgacggcgucg

SEQ ID NO: 879851 - RNA, 16 nt, Mycobacterium avium subsp. paratuberculosis
gugcgacggcgucggc

SEQ ID NO: 879852 - RNA, 14 nt, Mycobacterium avium subsp. paratuberculosis
gugcgacgcccacu

SEQ ID NO: 879853 - RNA, 14 nt, Mycobacterium avium subsp. paratuberculosis
gugcgacgccgcgc

SEQ ID NO: 879854 - RNA, 20 nt, Mycobacterium avium subsp. paratuberculosis
gugccuugcacccagcggaa

SEQ ID NO: 879855 - RNA, 17 nt, Mycobacterium avium subsp. paratuberculosis
gugccuggcccagacag

SEQ ID NO: 879856 - RNA, 23 nt, Mycobacterium avium subsp. paratuberculosis
gugccuggcccagacaggccggc

SEQ ID NO: 879857 - RNA, 12 nt, Mycobacterium avium subsp. paratuberculosis
gugccugcgggc

SEQ ID NO: 879858 - RNA, 14 nt, Mycobacterium avium subsp. paratuberculosis
gugccugcgggccc

SEQ ID NO: 879859 - RNA, 20 nt, Mycobacterium avium subsp. paratuberculosis
gugccugcgggcccagcucg

SEQ ID NO: 879860 - RNA, 21 nt, Mycobacterium avium subsp. paratuberculosis
gugccugcgggcccagcucgg

SEQ ID NO: 879861 - RNA, 19 nt, Mycobacterium avium subsp. paratuberculosis
gugcucaucagcgacacca

SEQ ID NO: 879862 - RNA, 17 nt, Mycobacterium avium subsp. paratuberculosis
gugcuccagcaggcgcg

SEQ ID NO: 879863 - RNA, 20 nt, Mycobacterium avium subsp. paratuberculosis
gugcuccagcaggcgcgccg

SEQ ID NO: 879864 - RNA, 13 nt, Mycobacterium avium subsp. paratuberculosis
gugcucccagcuc

SEQ ID NO: 879865 - RNA, 15 nt, Mycobacterium avium subsp. paratuberculosis
gugcucccgccgaga

SEQ ID NO: 879866 - RNA, 14 nt, Mycobacterium avium subsp. paratuberculosis
gugcucgaucagcg

SEQ ID NO: 879867 - RNA, 17 nt, Mycobacterium avium subsp. paratuberculosis
gugcucgacggcacccg

SEQ ID NO: 879868 - RNA, 13 nt, Mycobacterium avium subsp. paratuberculosis
gugcucgaucgcg

SEQ ID NO: 879869 - RNA, 14 nt, Mycobacterium avium subsp. paratuberculosis
gugcucgaucggcg

SEQ ID NO: 879870 - RNA, 20 nt, Mycobacterium avium subsp. paratuberculosis
gugcucgaugcgacgcaccu

SEQ ID NO: 879871 - RNA, 22 nt, Mycobacterium avium subsp. paratuberculosis
gugcucgaugcgacgcaccucg

SEQ ID NO: 879872 - RNA, 20 nt, Mycobacterium avium subsp. paratuberculosis
gugcucgauggccagcgcgu

SEQ ID NO: 879873 - RNA, 22 nt, Mycobacterium avium subsp. paratuberculosis
gugcucaucuacgucgucgccg

SEQ ID NO: 879874 - RNA, 13 nt, Mycobacterium avium subsp. paratuberculosis
gugcucagccgca

SEQ ID NO: 879875 - RNA, 14 nt, Mycobacterium avium subsp. paratuberculosis
gugcuacugccgac

SEQ ID NO: 879876 - RNA, 20 nt, Mycobacterium avium subsp. paratuberculosis
gugcuagcgagcgggcacgc

SEQ ID NO: 879877 - RNA, 15 nt, Mycobacterium avium subsp. paratuberculosis
gugcugauccacgcc

SEQ ID NO: 879878 - RNA, 20 nt, Mycobacterium avium subsp. paratuberculosis
gugcugauccacgcccggac

SEQ ID NO: 879879 - RNA, 16 nt, Mycobacterium avium subsp. paratuberculosis
gugcucucgucgucgg

SEQ ID NO: 879880 - RNA, 23 nt, Mycobacterium avium subsp. paratuberculosis
gugcugaacgccugccggcgccg

SEQ ID NO: 879881 - RNA, 17 nt, Mycobacterium avium subsp. paratuberculosis
gugcugacccagcgcgg

SEQ ID NO: 879882 - RNA, 15 nt, Mycobacterium avium subsp. paratuberculosis
gugcugacccggucg

SEQ ID NO: 879883 - RNA, 19 nt, Mycobacterium avium subsp. paratuberculosis
gugcugacccggucgcggc

SEQ ID NO: 879884 - RNA, 20 nt, Mycobacterium avium subsp. paratuberculosis
gugcugccggacaccccggc

SEQ ID NO: 879885 - RNA, 15 nt, Mycobacterium avium subsp. paratuberculosis
gugcugccggccggc

SEQ ID NO: 879886 - RNA, 17 nt, Mycobacterium avium subsp. paratuberculosis
gugcugccgugccgauu

SEQ ID NO: 879887 - RNA, 13 nt, Mycobacterium avium subsp. paratuberculosis
gugcugccugccg

SEQ ID NO: 879888 - RNA, 23 nt, Mycobacterium avium subsp. paratuberculosis
gugcugcagaccgaacgucacgg

SEQ ID NO: 879889 - RNA, 19 nt, Mycobacterium avium subsp. paratuberculosis
gugcugcagauccgcucgc

SEQ ID NO: 879890 - RNA, 13 nt, Mycobacterium avium subsp. paratuberculosis
gugcugcgcagca

SEQ ID NO: 879891 - RNA, 21 nt, Mycobacterium avium subsp. paratuberculosis
gugcugcgcagcagcgccagc

SEQ ID NO: 879892 - RNA, 14 nt, Mycobacterium avium subsp. paratuberculosis
gugcucgccggcgc

SEQ ID NO: 879893 - RNA, 15 nt, Mycobacterium avium subsp. paratuberculosis
gugcucgccggcgcg

SEQ ID NO: 879894 - RNA, 15 nt, Mycobacterium avium subsp. paratuberculosis
gugcucgagcucggc

SEQ ID NO: 879895 - RNA, 16 nt, Mycobacterium avium subsp. paratuberculosis
gugcucggcgcgcggg

SEQ ID NO: 879896 - RNA, 14 nt, Mycobacterium avium subsp. paratuberculosis
gugcucggcggccg

SEQ ID NO: 879897 - RNA, 16 nt, Mycobacterium avium subsp. paratuberculosis
gugcucggcggccgcc

SEQ ID NO: 879898 - RNA, 21 nt, Mycobacterium avium subsp. paratuberculosis
gugcucggcggcgcaggcgcg

SEQ ID NO: 879899 - RNA, 23 nt, Mycobacterium avium subsp. paratuberculosis
gugcucggcggcggggucguugc

SEQ ID NO: 879900 - RNA, 16 nt, Mycobacterium avium subsp. paratuberculosis
gugcucggcgucccgc

SEQ ID NO: 879901 - RNA, 19 nt, Mycobacterium avium subsp. paratuberculosis
gugcucggcgucccgcgcc

SEQ ID NO: 879902 - RNA, 20 nt, Mycobacterium avium subsp. paratuberculosis
gugcucggcgucccgcgcca

SEQ ID NO: 879903 - RNA, 22 nt, Mycobacterium avium subsp. paratuberculosis
gugcucggcguugagccggcgc

SEQ ID NO: 879904 - RNA, 16 nt, Mycobacterium avium subsp. paratuberculosis
gugcucgcgccgggcg

SEQ ID NO: 879905 - RNA, 12 nt, Mycobacterium avium subsp. paratuberculosis
gugcucgcgcuc

SEQ ID NO: 879906 - RNA, 15 nt, Mycobacterium avium subsp. paratuberculosis
gugcucgcgcucguc

SEQ ID NO: 879907 - RNA, 23 nt, Mycobacterium avium subsp. paratuberculosis
gugcucggaguaguccagcaccg

SEQ ID NO: 879908 - RNA, 20 nt, Mycobacterium avium subsp. paratuberculosis
gugcucggugauccacgcgg

SEQ ID NO: 879909 - RNA, 15 nt, Mycobacterium avium subsp. paratuberculosis
gugcucgucgcggag

SEQ ID NO: 879910 - RNA, 13 nt, Mycobacterium avium subsp. paratuberculosis
gugcucgucggcg

SEQ ID NO: 879911 - RNA, 17 nt, Mycobacterium avium subsp. paratuberculosis
gugcucuugacggccgc

SEQ ID NO: 879912 - RNA, 19 nt, Mycobacterium avium subsp. paratuberculosis
gugcucuugacggccgcgg

SEQ ID NO: 879913 - RNA, 17 nt, Mycobacterium avium subsp. paratuberculosis
gugcucuuggugguggu

SEQ ID NO: 879914 - RNA, 15 nt, Mycobacterium avium subsp. paratuberculosis
gugcgcccgucgucg

SEQ ID NO: 879915 - RNA, 11 nt, Mycobacterium avium subsp. paratuberculosis
gugcgccgcgg

SEQ ID NO: 879916 - RNA, 12 nt, Mycobacterium avium subsp. paratuberculosis
gugcgccgcggc

SEQ ID NO: 879917 - RNA, 13 nt, Mycobacterium avium subsp. paratuberculosis
gugcgccgcggcg

SEQ ID NO: 879918 - RNA, 17 nt, Mycobacterium avium subsp. paratuberculosis
gugcgccgcggcggcuc

SEQ ID NO: 879919 - RNA, 22 nt, Mycobacterium avium subsp. paratuberculosis
gugcgccgcggcggcucggcgg

SEQ ID NO: 879920 - RNA, 13 nt, Mycobacterium avium subsp. paratuberculosis
gugcgccggcggu

SEQ ID NO: 879921 - RNA, 23 nt, Mycobacterium avium subsp. paratuberculosis
gugcgccggcggugcggcggggu

SEQ ID NO: 879922 - RNA, 10 nt, Mycobacterium avium subsp. paratuberculosis
gugcgccggg

SEQ ID NO: 879923 - RNA, 16 nt, Mycobacterium avium subsp. paratuberculosis
gugcgccgacagcuga

SEQ ID NO: 879924 - RNA, 16 nt, Mycobacterium avium subsp. paratuberculosis
gugcgccgaccgcgau

SEQ ID NO: 879925 - RNA, 17 nt, Mycobacterium avium subsp. paratuberculosis
gugcgccgcccacaccg

SEQ ID NO: 879926 - RNA, 14 nt, Mycobacterium avium subsp. paratuberculosis
gugcgccgccgcgu

SEQ ID NO: 879927 - RNA, 16 nt, Mycobacterium avium subsp. paratuberculosis
gugcgccgcucgucgg

SEQ ID NO: 879928 - RNA, 18 nt, Mycobacterium avium subsp. paratuberculosis
gugcggcuugcccguucg

SEQ ID NO: 879929 - RNA, 15 nt, Mycobacterium avium subsp. paratuberculosis
gugcgggccagcacg

SEQ ID NO: 879930 - RNA, 19 nt, Mycobacterium avium subsp. paratuberculosis
gugcgggccagcagccgcg

SEQ ID NO: 879931 - RNA, 21 nt, Mycobacterium avium subsp. paratuberculosis
gugcgggcaucggcuggucgg

SEQ ID NO: 879932 - RNA, 13 nt, Mycobacterium avium subsp. paratuberculosis
gugcgccgggucg

SEQ ID NO: 879933 - RNA, 17 nt, Mycobacterium avium subsp. paratuberculosis
gugcgccgggucgcggu

SEQ ID NO: 879934 - RNA, 18 nt, Mycobacterium avium subsp. paratuberculosis
gugcgccgggucgcggug

SEQ ID NO: 879935 - RNA, 13 nt, Mycobacterium avium subsp. paratuberculosis
gugcggcggugac

SEQ ID NO: 879936 - RNA, 21 nt, Mycobacterium avium subsp. paratuberculosis
gugcggcucgggcgguggcgc

SEQ ID NO: 879937 - RNA, 20 nt, Mycobacterium avium subsp. paratuberculosis
gugcgguaggugccggccgc

SEQ ID NO: 879938 - RNA, 20 nt, Mycobacterium avium subsp. paratuberculosis
gugcgggugguguggcgucg

SEQ ID NO: 879939 - RNA, 19 nt, Mycobacterium avium subsp. paratuberculosis
gugcggguguccgagcggg

SEQ ID NO: 879940 - RNA, 20 nt, Mycobacterium avium subsp. paratuberculosis
gugcggguguccgagcgggc

SEQ ID NO: 879941 - RNA, 17 nt, Mycobacterium avium subsp. paratuberculosis
gugcgggugccgaacac

SEQ ID NO: 879942 - RNA, 17 nt, Mycobacterium avium subsp. paratuberculosis
gugcgggugcggccggu

SEQ ID NO: 879943 - RNA, 13 nt, Mycobacterium avium subsp. paratuberculosis
gugcggguggccg

SEQ ID NO: 879944 - RNA, 18 nt, Mycobacterium avium subsp. paratuberculosis
gugcggguggccgggucg

SEQ ID NO: 879945 - RNA, 13 nt, Mycobacterium avium subsp. paratuberculosis
gugcgggucgcgc

SEQ ID NO: 879946 - RNA, 20 nt, Mycobacterium avium subsp. paratuberculosis
gugcggggugugcaggccga

SEQ ID NO: 879947 - RNA, 22 nt, Mycobacterium avium subsp. paratuberculosis
gugcggggccucgucgccgcgg

SEQ ID NO: 879948 - RNA, 23 nt, Mycobacterium avium subsp. paratuberculosis
gugcggggccucgucgccgcggu

SEQ ID NO: 879949 - RNA, 15 nt, Mycobacterium avium subsp. paratuberculosis
gugcgggcuccgcac

SEQ ID NO: 879950 - RNA, 20 nt, Mycobacterium avium subsp. paratuberculosis
gugcgggcuccgcacgaccu

SEQ ID NO: 879951 - RNA, 21 nt, Mycobacterium avium subsp. paratuberculosis
gugcgggcugcaccagggcgu

SEQ ID NO: 879952 - RNA, 17 nt, Mycobacterium avium subsp. paratuberculosis
gugcgguuggcccgcgg

SEQ ID NO: 879953 - RNA, 18 nt, Mycobacterium avium subsp. paratuberculosis
gugcgguuggcccgcggc

SEQ ID NO: 879954 - RNA, 20 nt, Mycobacterium avium subsp. paratuberculosis
gugcgguuggcccgcggcgc

SEQ ID NO: 879955 - RNA, 19 nt, Mycobacterium avium subsp. paratuberculosis
gugcggugcaccgcggcgc

SEQ ID NO: 879956 - RNA, 14 nt, Mycobacterium avium subsp. paratuberculosis
gugcggugcagccg

SEQ ID NO: 879957 - RNA, 18 nt, Mycobacterium avium subsp. paratuberculosis
gugcggugcagccgcggu

SEQ ID NO: 879958 - RNA, 12 nt, Mycobacterium avium subsp. paratuberculosis
gugcggugucau

SEQ ID NO: 879959 - RNA, 15 nt, Mycobacterium avium subsp. paratuberculosis
gugcgguucacgcgg

SEQ ID NO: 879960 - RNA, 17 nt, Mycobacterium avium subsp. paratuberculosis
gugcggucgaugacgcc

SEQ ID NO: 879961 - RNA, 16 nt, Mycobacterium avium subsp. paratuberculosis
gugcggucgcgggaca

SEQ ID NO: 879962 - RNA, 15 nt, Mycobacterium avium subsp. paratuberculosis
gugcggucggcgacg

SEQ ID NO: 879963 - RNA, 15 nt, Mycobacterium avium subsp. paratuberculosis
gugcggugcgccgca

SEQ ID NO: 879964 - RNA, 13 nt, Mycobacterium avium subsp. paratuberculosis
gugcggugcggcc

SEQ ID NO: 879965 - RNA, 15 nt, Mycobacterium avium subsp. paratuberculosis
gugcggugcggccgc

SEQ ID NO: 879966 - RNA, 18 nt, Mycobacterium avium subsp. paratuberculosis
gugcggugcggccgcgca

SEQ ID NO: 879967 - RNA, 23 nt, Mycobacterium avium subsp. paratuberculosis
gugauggacaucuccggcacguu

SEQ ID NO: 879968 - RNA, 14 nt, Mycobacterium avium subsp. paratuberculosis
gugaugcggucggc

SEQ ID NO: 879969 - RNA, 15 nt, Mycobacterium avium subsp. paratuberculosis
gugaugcggucggcg

SEQ ID NO: 879970 - RNA, 18 nt, Mycobacterium avium subsp. paratuberculosis
gugaugcggucggcgcgg

SEQ ID NO: 879971 - RNA, 16 nt, Mycobacterium avium subsp. paratuberculosis
gugcacacccgcagcg

SEQ ID NO: 879972 - RNA, 20 nt, Mycobacterium avium subsp. paratuberculosis
gugcacacccgcagcgaccg

SEQ ID NO: 879973 - RNA, 15 nt, Mycobacterium avium subsp. paratuberculosis
gugaugcgccggcgg

SEQ ID NO: 879974 - RNA, 13 nt, Mycobacterium avium subsp. paratuberculosis
gugaugcgcgccg

SEQ ID NO: 879975 - RNA, 15 nt, Mycobacterium avium subsp. paratuberculosis
gugaugccggcaucc

SEQ ID NO: 879976 - RNA, 14 nt, Mycobacterium avium subsp. paratuberculosis
gugaugccggccag

SEQ ID NO: 879977 - RNA, 21 nt, Mycobacterium avium subsp. paratuberculosis
gugaugccggccagccgcgcg

SEQ ID NO: 879978 - RNA, 22 nt, Mycobacterium avium subsp. paratuberculosis
gugaugccggcgguaccgccga

SEQ ID NO: 879979 - RNA, 14 nt, Mycobacterium avium subsp. paratuberculosis
gugaugcgcggcga

SEQ ID NO: 879980 - RNA, 21 nt, Mycobacterium avium subsp. paratuberculosis
gugaugcggcccgacccgguc

SEQ ID NO: 879981 - RNA, 23 nt, Mycobacterium avium subsp. paratuberculosis
gugaugcggcccgacccggucag

SEQ ID NO: 879982 - RNA, 16 nt, Mycobacterium avium subsp. paratuberculosis
gugaugcacccggacg

SEQ ID NO: 879983 - RNA, 13 nt, Mycobacterium avium subsp. paratuberculosis
gugaugaccugga

SEQ ID NO: 879984 - RNA, 14 nt, Mycobacterium avium subsp. paratuberculosis
gugaugacggcggc

SEQ ID NO: 879985 - RNA, 18 nt, Mycobacterium avium subsp. paratuberculosis
gugaugacguagucgucc

SEQ ID NO: 879986 - RNA, 17 nt, Mycobacterium avium subsp. paratuberculosis
gugaugacgucgcccac

SEQ ID NO: 879987 - RNA, 15 nt, Mycobacterium avium subsp. paratuberculosis
gugaugaggucgcga

SEQ ID NO: 879988 - RNA, 12 nt, Mycobacterium avium subsp. paratuberculosis
gugaucgccgac

SEQ ID NO: 879989 - RNA, 15 nt, Mycobacterium avium subsp. paratuberculosis
gugaucgccgacguc

SEQ ID NO: 879990 - RNA, 13 nt, Mycobacterium avium subsp. paratuberculosis
gugaucgccgccc

SEQ ID NO: 879991 - RNA, 23 nt, Mycobacterium avium subsp. paratuberculosis
gugauccucgucuccggcggcag

SEQ ID NO: 879992 - RNA, 23 nt, Mycobacterium avium subsp. paratuberculosis
gugaugaaucgucccgucgacca

SEQ ID NO: 879993 - RNA, 22 nt, Mycobacterium avium subsp. paratuberculosis
gugaucgccacggcggugucgg

SEQ ID NO: 879994 - RNA, 16 nt, Mycobacterium avium subsp. paratuberculosis
gugaucgccagcccgg

SEQ ID NO: 879995 - RNA, 20 nt, Mycobacterium avium subsp. paratuberculosis
gugaucgccagcccggcgua

SEQ ID NO: 879996 - RNA, 13 nt, Mycobacterium avium subsp. paratuberculosis
gugaucgccacca

SEQ ID NO: 879997 - RNA, 16 nt, Mycobacterium avium subsp. paratuberculosis
gugaucgccaccacca

SEQ ID NO: 879998 - RNA, 13 nt, Mycobacterium avium subsp. paratuberculosis
gugauccacgcgg

SEQ ID NO: 879999 - RNA, 18 nt, Mycobacterium avium subsp. paratuberculosis
gugauccacuccagcacc

SEQ ID NO: 880000 - RNA, 17 nt, Mycobacterium avium subsp. paratuberculosis
gugaucccgaugccgcg

SEQ ID NO: 880001 - RNA, 20 nt, Mycobacterium avium subsp. paratuberculosis
gugaucccgaugccgcgcag

SEQ ID NO: 880002 - RNA, 22 nt, Mycobacterium avium subsp. paratuberculosis
gugaucccgaugccgcgcaggc

SEQ ID NO: 880003 - RNA, 13 nt, Mycobacterium avium subsp. paratuberculosis
gugauccgcccgg

SEQ ID NO: 880004 - RNA, 17 nt, Mycobacterium avium subsp. paratuberculosis
gugauccgcccggcccg

SEQ ID NO: 880005 - RNA, 15 nt, Mycobacterium avium subsp. paratuberculosis
gugauccggugccac

SEQ ID NO: 880006 - RNA, 21 nt, Mycobacterium avium subsp. paratuberculosis
gugauccggugccacgcggcu

SEQ ID NO: 880007 - RNA, 14 nt, Mycobacterium avium subsp. paratuberculosis
gugaucgagcacca

SEQ ID NO: 880008 - RNA, 21 nt, Mycobacterium avium subsp. paratuberculosis
gugaucgagcaccagcgucga

SEQ ID NO: 880009 - RNA, 21 nt, Mycobacterium avium subsp. paratuberculosis
gugauaucccuugccgccgaa

SEQ ID NO: 880010 - RNA, 21 nt, Mycobacterium avium subsp. paratuberculosis
gugaucaccaugaucagcgcc

SEQ ID NO: 880011 - RNA, 16 nt, Mycobacterium avium subsp. paratuberculosis
gugaucacccagccgu

SEQ ID NO: 880012 - RNA, 15 nt, Mycobacterium avium subsp. paratuberculosis
gugaucacccgccgg

SEQ ID NO: 880013 - RNA, 17 nt, Mycobacterium avium subsp. paratuberculosis
gugaucacccgccgggu

SEQ ID NO: 880014 - RNA, 16 nt, Mycobacterium avium subsp. paratuberculosis
gugaucaggcccucgu

SEQ ID NO: 880015 - RNA, 19 nt, Mycobacterium avium subsp. paratuberculosis
gugaucaggcccucgucgg

SEQ ID NO: 880016 - RNA, 22 nt, Mycobacterium avium subsp. paratuberculosis
gugaucaggcccucgucggcga

SEQ ID NO: 880017 - RNA, 21 nt, Mycobacterium avium subsp. paratuberculosis
gugaucagggucccggucagc

SEQ ID NO: 880018 - RNA, 13 nt, Mycobacterium avium subsp. paratuberculosis
gugaucagcaucc

SEQ ID NO: 880019 - RNA, 19 nt, Mycobacterium avium subsp. paratuberculosis
gugauccagagcaucaggg

SEQ ID NO: 880020 - RNA, 17 nt, Mycobacterium avium subsp. paratuberculosis
gugauaguggucgucgu

SEQ ID NO: 880021 - RNA, 14 nt, Mycobacterium avium subsp. paratuberculosis
gugauagcggccgc

SEQ ID NO: 880022 - RNA, 17 nt, Mycobacterium avium subsp. paratuberculosis
gugauagcggcguaccg

SEQ ID NO: 880023 - RNA, 23 nt, Mycobacterium avium subsp. paratuberculosis
gugauagcggcguaccgcggcgg

SEQ ID NO: 880024 - RNA, 20 nt, Mycobacterium avium subsp. paratuberculosis
gugauaccggcccagcgcgg

SEQ ID NO: 880025 - RNA, 17 nt, Mycobacterium avium subsp. paratuberculosis
gugagcuggccgcgcag

SEQ ID NO: 880026 - RNA, 21 nt, Mycobacterium avium subsp. paratuberculosis
gugauagaucaucccggccac

SEQ ID NO: 880027 - RNA, 14 nt, Mycobacterium avium subsp. paratuberculosis
gugagcugaucgcg

SEQ ID NO: 880028 - RNA, 17 nt, Mycobacterium avium subsp. paratuberculosis
gugagcugaucgcgucg

SEQ ID NO: 880029 - RNA, 12 nt, Mycobacterium avium subsp. paratuberculosis
gugagcggcgcg

SEQ ID NO: 880030 - RNA, 19 nt, Mycobacterium avium subsp. paratuberculosis
gugagcgggaacgcgucga

SEQ ID NO: 880031 - RNA, 12 nt, Mycobacterium avium subsp. paratuberculosis
gugagcgguggc

SEQ ID NO: 880032 - RNA, 16 nt, Mycobacterium avium subsp. paratuberculosis
gugagcgugccgaucg

SEQ ID NO: 880033 - RNA, 16 nt, Mycobacterium avium subsp. paratuberculosis
gugagcgcgccggccc

SEQ ID NO: 880034 - RNA, 19 nt, Mycobacterium avium subsp. paratuberculosis
gugagcgcgccggcccgau

SEQ ID NO: 880035 - RNA, 15 nt, Mycobacterium avium subsp. paratuberculosis
gugagcgcgucgagc

SEQ ID NO: 880036 - RNA, 22 nt, Mycobacterium avium subsp. paratuberculosis
gugagcccgaugcuggccaucg

SEQ ID NO: 880037 - RNA, 17 nt, Mycobacterium avium subsp. paratuberculosis
gugagccgggugcccgc

SEQ ID NO: 880038 - RNA, 20 nt, Mycobacterium avium subsp. paratuberculosis
gugagccggucgaacgccag

SEQ ID NO: 880039 - RNA, 16 nt, Mycobacterium avium subsp. paratuberculosis
gugagccucagggcgc

SEQ ID NO: 880040 - RNA, 19 nt, Mycobacterium avium subsp. paratuberculosis
gugagccucagggcgcgcu

SEQ ID NO: 880041 - RNA, 21 nt, Mycobacterium avium subsp. paratuberculosis
gugagccucagggcgcgcugu

SEQ ID NO: 880042 - RNA, 22 nt, Mycobacterium avium subsp. paratuberculosis
gugagcgacaccaggucgaggu

SEQ ID NO: 880043 - RNA, 15 nt, Mycobacterium avium subsp. paratuberculosis
gugagcagcaugccg

SEQ ID NO: 880044 - RNA, 19 nt, Mycobacterium avium subsp. paratuberculosis
gugagcaccggaucgacca

SEQ ID NO: 880045 - RNA, 21 nt, Mycobacterium avium subsp. paratuberculosis
gugagcaccggaucgaccaac

SEQ ID NO: 880046 - RNA, 13 nt, Mycobacterium avium subsp. paratuberculosis
gugagccgccaca

SEQ ID NO: 880047 - RNA, 16 nt, Mycobacterium avium subsp. paratuberculosis
gugagccgccacagcg

SEQ ID NO: 880048 - RNA, 18 nt, Mycobacterium avium subsp. paratuberculosis
gugagcagggccagcggc

SEQ ID NO: 880049 - RNA, 19 nt, Mycobacterium avium subsp. paratuberculosis
gugaacgggucaauugcca

SEQ ID NO: 880050 - RNA, 18 nt, Mycobacterium avium subsp. paratuberculosis
gugaacuccgggcccacc

SEQ ID NO: 880051 - RNA, 16 nt, Mycobacterium avium subsp. paratuberculosis
gugaacuccgucucgc

SEQ ID NO: 880052 - RNA, 11 nt, Mycobacterium avium subsp. paratuberculosis
gugaacgccgg

SEQ ID NO: 880053 - RNA, 22 nt, Mycobacterium avium subsp. paratuberculosis
gugaacgccucgggccggcagc

SEQ ID NO: 880054 - RNA, 16 nt, Mycobacterium avium subsp. paratuberculosis
gugaacgccugcggga

SEQ ID NO: 880055 - RNA, 22 nt, Mycobacterium avium subsp. paratuberculosis
gugaacaccgcguuggccgcca

SEQ ID NO: 880056 - RNA, 14 nt, Mycobacterium avium subsp. paratuberculosis
gugaacagguaggc

SEQ ID NO: 880057 - RNA, 13 nt, Mycobacterium avium subsp. paratuberculosis
gugaacagcagcc

SEQ ID NO: 880058 - RNA, 15 nt, Mycobacterium avium subsp. paratuberculosis
gugaacagcgcccgg

SEQ ID NO: 880059 - RNA, 16 nt, Mycobacterium avium subsp. paratuberculosis
gugaacagcgcccggc

SEQ ID NO: 880060 - RNA, 16 nt, Mycobacterium avium subsp. paratuberculosis
gugaacgaggccgcgc

SEQ ID NO: 880061 - RNA, 17 nt, Mycobacterium avium subsp. paratuberculosis
gugcacccgcggcgcga

SEQ ID NO: 880062 - RNA, 20 nt, Mycobacterium avium subsp. paratuberculosis
gugcaccacccaggccaccc

SEQ ID NO: 880063 - RNA, 14 nt, Mycobacterium avium subsp. paratuberculosis
gugcacccacgcca

SEQ ID NO: 880064 - RNA, 19 nt, Mycobacterium avium subsp. paratuberculosis
gugcaccaggacgcgaccg

SEQ ID NO: 880065 - RNA, 23 nt, Mycobacterium avium subsp. paratuberculosis
gugcacccgaugcucgaugcgca

SEQ ID NO: 880066 - RNA, 17 nt, Mycobacterium avium subsp. paratuberculosis
gugcacaggccgccgca

SEQ ID NO: 880067 - RNA, 16 nt, Mycobacterium avium subsp. paratuberculosis
gugcaccaacacgucg

SEQ ID NO: 880068 - RNA, 12 nt, Mycobacterium avium subsp. paratuberculosis
gugcaccagcga

SEQ ID NO: 880069 - RNA, 18 nt, Mycobacterium avium subsp. paratuberculosis
gugcaccagcgauccggc

SEQ ID NO: 880070 - RNA, 19 nt, Mycobacterium avium subsp. paratuberculosis
gugcaccagcgauccggcg

SEQ ID NO: 880071 - RNA, 20 nt, Mycobacterium avium subsp. paratuberculosis
gugcaccagcgauccggcgc

SEQ ID NO: 880072 - RNA, 17 nt, Mycobacterium avium subsp. paratuberculosis
gugcagcgcggcgauga

SEQ ID NO: 880073 - RNA, 13 nt, Mycobacterium avium subsp. paratuberculosis
gugcagcgccagc

SEQ ID NO: 880074 - RNA, 19 nt, Mycobacterium avium subsp. paratuberculosis
gugcagcgccagcaccggg

SEQ ID NO: 880075 - RNA, 23 nt, Mycobacterium avium subsp. paratuberculosis
gugcagcgccagcaccgggccca

SEQ ID NO: 880076 - RNA, 13 nt, Mycobacterium avium subsp. paratuberculosis
gugcagccgggcc

SEQ ID NO: 880077 - RNA, 17 nt, Mycobacterium avium subsp. paratuberculosis
gugcagccgggcggcgc

SEQ ID NO: 880078 - RNA, 22 nt, Mycobacterium avium subsp. paratuberculosis
gugcagccgggcggcgccgaac

SEQ ID NO: 880079 - RNA, 17 nt, Mycobacterium avium subsp. paratuberculosis
gugcagccgggggcggu

SEQ ID NO: 880080 - RNA, 20 nt, Mycobacterium avium subsp. paratuberculosis
gugcagcaguuccggagcgc

SEQ ID NO: 880081 - RNA, 22 nt, Mycobacterium avium subsp. paratuberculosis
gugcagccgcaaggugauucgc

SEQ ID NO: 880082 - RNA, 14 nt, Mycobacterium avium subsp. paratuberculosis
gugcagcagcucgg

SEQ ID NO: 880083 - RNA, 14 nt, Mycobacterium avium subsp. paratuberculosis
gugcagcagggcgc

SEQ ID NO: 880084 - RNA, 14 nt, Mycobacterium avium subsp. paratuberculosis
gugcaccgccagcg

SEQ ID NO: 880085 - RNA, 17 nt, Mycobacterium avium subsp. paratuberculosis
gugcaccgccagcgcgg

SEQ ID NO: 880086 - RNA, 19 nt, Mycobacterium avium subsp. paratuberculosis
gugcaccgccagcgcggcg

SEQ ID NO: 880087 - RNA, 23 nt, Mycobacterium avium subsp. paratuberculosis
gugcaccgccagcgcggcggcgc

SEQ ID NO: 880088 - RNA, 15 nt, Mycobacterium avium subsp. paratuberculosis
gugcaccgcccgcgc

SEQ ID NO: 880089 - RNA, 18 nt, Mycobacterium avium subsp. paratuberculosis
gugcaccgcccgcgcgau

SEQ ID NO: 880090 - RNA, 19 nt, Mycobacterium avium subsp. paratuberculosis
gugcagcgugguccagcac

SEQ ID NO: 880091 - RNA, 20 nt, Mycobacterium avium subsp. paratuberculosis
gugcagcgugguccagcacg

SEQ ID NO: 880092 - RNA, 21 nt, Mycobacterium avium subsp. paratuberculosis
gugcagcuccuugagccgccg

SEQ ID NO: 880093 - RNA, 22 nt, Mycobacterium avium subsp. paratuberculosis
gugcagcucggugcagaccccg

SEQ ID NO: 880094 - RNA, 23 nt, Mycobacterium avium subsp. paratuberculosis
gugcaugccggccuucucgcgca

SEQ ID NO: 880095 - RNA, 17 nt, Mycobacterium avium subsp. paratuberculosis
gugcaugugcucggcga

SEQ ID NO: 880096 - RNA, 19 nt, Mycobacterium avium subsp. paratuberculosis
gugcauguggccgucgccg

SEQ ID NO: 880097 - RNA, 21 nt, Mycobacterium avium subsp. paratuberculosis
gugcauguggccgucgccgaa

SEQ ID NO: 880098 - RNA, 17 nt, Mycobacterium avium subsp. paratuberculosis
gugcauccugggcgucg

SEQ ID NO: 880099 - RNA, 18 nt, Mycobacterium avium subsp. paratuberculosis
gugcauccugggcgucga

SEQ ID NO: 880100 - RNA, 15 nt, Mycobacterium avium subsp. paratuberculosis
gugcaucgccaccgu

SEQ ID NO: 880101 - RNA, 21 nt, Mycobacterium avium subsp. paratuberculosis
gugcaucgccaccgucgucga

SEQ ID NO: 880102 - RNA, 22 nt, Mycobacterium avium subsp. paratuberculosis
gugcaucgccaccgucgucgag

SEQ ID NO: 880103 - RNA, 12 nt, Mycobacterium avium subsp. paratuberculosis
gugcaucgccac

SEQ ID NO: 880104 - RNA, 14 nt, Mycobacterium avium subsp. paratuberculosis
gugccccacgccau

SEQ ID NO: 880105 - RNA, 16 nt, Mycobacterium avium subsp. paratuberculosis
gugcccaucgacccgu

SEQ ID NO: 880106 - RNA, 13 nt, Mycobacterium avium subsp. paratuberculosis
gugcccagcgcga

SEQ ID NO: 880107 - RNA, 15 nt, Mycobacterium avium subsp. paratuberculosis
gugcccagcccgcgc

SEQ ID NO: 880108 - RNA, 22 nt, Mycobacterium avium subsp. paratuberculosis
gugcccaccgggcagccgcaca

SEQ ID NO: 880109 - RNA, 18 nt, Mycobacterium avium subsp. paratuberculosis
gugcccagcaccgccggc

SEQ ID NO: 880110 - RNA, 22 nt, Mycobacterium avium subsp. paratuberculosis
gugcccagcaccgccggcgccg

SEQ ID NO: 880111 - RNA, 13 nt, Mycobacterium avium subsp. paratuberculosis
gugcccagcacga

SEQ ID NO: 880112 - RNA, 15 nt, Mycobacterium avium subsp. paratuberculosis
gugcccagcacgacg

SEQ ID NO: 880113 - RNA, 18 nt, Mycobacterium avium subsp. paratuberculosis
gugcccagcacgacgccg

SEQ ID NO: 880114 - RNA, 19 nt, Mycobacterium avium subsp. paratuberculosis
gugcccagcacgacgccgc

SEQ ID NO: 880115 - RNA, 15 nt, Mycobacterium avium subsp. paratuberculosis
gugcccccgcccggc

SEQ ID NO: 880116 - RNA, 22 nt, Mycobacterium avium subsp. paratuberculosis
gugccccgccguuucagcagcg

SEQ ID NO: 880117 - RNA, 23 nt, Mycobacterium avium subsp. paratuberculosis
gugccccgccguuucagcagcgc

SEQ ID NO: 880118 - RNA, 13 nt, Mycobacterium avium subsp. paratuberculosis
gugccccgcgacc

SEQ ID NO: 880119 - RNA, 23 nt, Mycobacterium avium subsp. paratuberculosis
gugccccgcgaccgcagcaggcg

SEQ ID NO: 880120 - RNA, 21 nt, Mycobacterium avium subsp. paratuberculosis
gugccccgcuggaucccggug

SEQ ID NO: 880121 - RNA, 13 nt, Mycobacterium avium subsp. paratuberculosis
gugcccgacggcg

SEQ ID NO: 880122 - RNA, 14 nt, Mycobacterium avium subsp. paratuberculosis
gugcccgacggcgc

SEQ ID NO: 880123 - RNA, 15 nt, Mycobacterium avium subsp. paratuberculosis
gugcccgacggcgcg

SEQ ID NO: 880124 - RNA, 16 nt, Mycobacterium avium subsp. paratuberculosis
gugcccgacggcgcgc

SEQ ID NO: 880125 - RNA, 18 nt, Mycobacterium avium subsp. paratuberculosis
gugcccgacggcgcgccc

SEQ ID NO: 880126 - RNA, 12 nt, Mycobacterium avium subsp. paratuberculosis
gugcccgagccg

SEQ ID NO: 880127 - RNA, 18 nt, Mycobacterium avium subsp. paratuberculosis
gugcccgagcugaucgcg

SEQ ID NO: 880128 - RNA, 23 nt, Mycobacterium avium subsp. paratuberculosis
gugccccguccggcgccagcccg

SEQ ID NO: 880129 - RNA, 15 nt, Mycobacterium avium subsp. paratuberculosis
gugccccucgacccg

SEQ ID NO: 880130 - RNA, 16 nt, Mycobacterium avium subsp. paratuberculosis
gugccaguaccagcgg

SEQ ID NO: 880131 - RNA, 18 nt, Mycobacterium avium subsp. paratuberculosis
gugcccaauagcacccgc

SEQ ID NO: 880132 - RNA, 15 nt, Mycobacterium avium subsp. paratuberculosis
gugccaucgcuggug

SEQ ID NO: 880133 - RNA, 19 nt, Mycobacterium avium subsp. paratuberculosis
gugccaucgugggcgccgu

SEQ ID NO: 880134 - RNA, 22 nt, Mycobacterium avium subsp. paratuberculosis
gugccaucgugggcgccgucgc

SEQ ID NO: 880135 - RNA, 17 nt, Mycobacterium avium subsp. paratuberculosis
gugccagggcagcgcga

SEQ ID NO: 880136 - RNA, 22 nt, Mycobacterium avium subsp. paratuberculosis
gugcauucaggucaccgcgcga

SEQ ID NO: 880137 - RNA, 12 nt, Mycobacterium avium subsp. paratuberculosis
gugccagccgaa

SEQ ID NO: 880138 - RNA, 16 nt, Mycobacterium avium subsp. paratuberculosis
gugccagccggccgcu

SEQ ID NO: 880139 - RNA, 14 nt, Mycobacterium avium subsp. paratuberculosis
gugccagccgugcg

SEQ ID NO: 880140 - RNA, 20 nt, Mycobacterium avium subsp. paratuberculosis
gugccagccgugcggcggcg

SEQ ID NO: 880141 - RNA, 16 nt, Mycobacterium avium subsp. paratuberculosis
guggaauucuggccga

SEQ ID NO: 880142 - RNA, 15 nt, Mycobacterium avium subsp. paratuberculosis
guggaagucagcgcg

SEQ ID NO: 880143 - RNA, 19 nt, Mycobacterium avium subsp. paratuberculosis
guggaaggcgccggcgcgg

SEQ ID NO: 880144 - RNA, 20 nt, Mycobacterium avium subsp. paratuberculosis
guggaagggccccggcaucg

SEQ ID NO: 880145 - RNA, 15 nt, Mycobacterium avium subsp. paratuberculosis
guggaacccagcacc

SEQ ID NO: 880146 - RNA, 23 nt, Mycobacterium avium subsp. paratuberculosis
guggaacgacgccagaaccggca

SEQ ID NO: 880147 - RNA, 21 nt, Mycobacterium avium subsp. paratuberculosis
guggaagccgcgaucggcgug

SEQ ID NO: 880148 - RNA, 21 nt, Mycobacterium avium subsp. paratuberculosis
guggaacacgcccagcgccgc

SEQ ID NO: 880149 - RNA, 22 nt, Mycobacterium avium subsp. paratuberculosis
gugcuucuugaagaaccgggaa

SEQ ID NO: 880150 - RNA, 15 nt, Mycobacterium avium subsp. paratuberculosis
gugcuugaacgccgc

SEQ ID NO: 880151 - RNA, 16 nt, Mycobacterium avium subsp. paratuberculosis
gugcuugaucagcggg

SEQ ID NO: 880152 - RNA, 13 nt, Mycobacterium avium subsp. paratuberculosis
gugcuuggcggcg

SEQ ID NO: 880153 - RNA, 16 nt, Mycobacterium avium subsp. paratuberculosis
gugcuuggucagcgcg

SEQ ID NO: 880154 - RNA, 22 nt, Mycobacterium avium subsp. paratuberculosis
gugcuuggucagcgcggcccgc

SEQ ID NO: 880155 - RNA, 14 nt, Mycobacterium avium subsp. paratuberculosis
gugcugcucgaggg

SEQ ID NO: 880156 - RNA, 18 nt, Mycobacterium avium subsp. paratuberculosis
gugcuggccaccacgggu

SEQ ID NO: 880157 - RNA, 16 nt, Mycobacterium avium subsp. paratuberculosis
gugcuggccaucgcgg

SEQ ID NO: 880158 - RNA, 16 nt, Mycobacterium avium subsp. paratuberculosis
gugcuggccggguugg

SEQ ID NO: 880159 - RNA, 18 nt, Mycobacterium avium subsp. paratuberculosis
gugcuggggguggcgucg

SEQ ID NO: 880160 - RNA, 21 nt, Mycobacterium avium subsp. paratuberculosis
gugcuggggguggcgucgacg

SEQ ID NO: 880161 - RNA, 13 nt, Mycobacterium avium subsp. paratuberculosis
gugcuggcgaugu

SEQ ID NO: 880162 - RNA, 21 nt, Mycobacterium avium subsp. paratuberculosis
gugcuggcgaugugaucgcgg

SEQ ID NO: 880163 - RNA, 17 nt, Mycobacterium avium subsp. paratuberculosis
gugcugugcgggcggug

SEQ ID NO: 880164 - RNA, 13 nt, Mycobacterium avium subsp. paratuberculosis
gugcugucgucgc

SEQ ID NO: 880165 - RNA, 14 nt, Mycobacterium avium subsp. paratuberculosis
gugcugucgucgcc

SEQ ID NO: 880166 - RNA, 20 nt, Mycobacterium avium subsp. paratuberculosis
gugcugucgucgcccugaca

SEQ ID NO: 880167 - RNA, 23 nt, Mycobacterium avium subsp. paratuberculosis
gugcuggucaugccgucgacgac

SEQ ID NO: 880168 - RNA, 19 nt, Mycobacterium avium subsp. paratuberculosis
gugcuguugcaggugcgcg

SEQ ID NO: 880169 - RNA, 22 nt, Mycobacterium avium subsp. paratuberculosis
gugcuguggaacacgucggcga

SEQ ID NO: 880170 - RNA, 23 nt, Mycobacterium avium subsp. paratuberculosis
gugcuguggaacacgucggcgau

SEQ ID NO: 880171 - RNA, 19 nt, Mycobacterium avium subsp. paratuberculosis
guggaucgcuucggccagc

SEQ ID NO: 880172 - RNA, 22 nt, Mycobacterium avium subsp. paratuberculosis
guggaucgcuucggccagcgcg

SEQ ID NO: 880173 - RNA, 14 nt, Mycobacterium avium subsp. paratuberculosis
guggaucggcccga

SEQ ID NO: 880174 - RNA, 21 nt, Mycobacterium avium subsp. paratuberculosis
guggaucucgaacggcccggu

SEQ ID NO: 880175 - RNA, 17 nt, Mycobacterium avium subsp. paratuberculosis
guggaugacgcagccga

SEQ ID NO: 880176 - RNA, 18 nt, Mycobacterium avium subsp. paratuberculosis
guggaugaugccggcggu

SEQ ID NO: 880177 - RNA, 19 nt, Mycobacterium avium subsp. paratuberculosis
guggauauuucgcggccga

SEQ ID NO: 880178 - RNA, 20 nt, Mycobacterium avium subsp. paratuberculosis
guggauauuucgcggccgaa

SEQ ID NO: 880179 - RNA, 15 nt, Mycobacterium avium subsp. paratuberculosis
guggcaacgugccac

SEQ ID NO: 880180 - RNA, 14 nt, Mycobacterium avium subsp. paratuberculosis
guggauggccggcc

SEQ ID NO: 880181 - RNA, 16 nt, Mycobacterium avium subsp. paratuberculosis
guggauggccggccgg

SEQ ID NO: 880182 - RNA, 22 nt, Mycobacterium avium subsp. paratuberculosis
guggauggccggccgggucacg

SEQ ID NO: 880183 - RNA, 19 nt, Mycobacterium avium subsp. paratuberculosis
guggauccggugaccgcga

SEQ ID NO: 880184 - RNA, 16 nt, Mycobacterium avium subsp. paratuberculosis
guggagacguaccagc

SEQ ID NO: 880185 - RNA, 20 nt, Mycobacterium avium subsp. paratuberculosis
guggagacguaccagcugcc

SEQ ID NO: 880186 - RNA, 15 nt, Mycobacterium avium subsp. paratuberculosis
guggacuccagcacc

SEQ ID NO: 880187 - RNA, 18 nt, Mycobacterium avium subsp. paratuberculosis
guggacuccagcaccagc

SEQ ID NO: 880188 - RNA, 16 nt, Mycobacterium avium subsp. paratuberculosis
guggacggucagcgcg

SEQ ID NO: 880189 - RNA, 18 nt, Mycobacterium avium subsp. paratuberculosis
guggacggucagcgcgcc

SEQ ID NO: 880190 - RNA, 21 nt, Mycobacterium avium subsp. paratuberculosis
guggacggucagcgcgccguc

SEQ ID NO: 880191 - RNA, 21 nt, Mycobacterium avium subsp. paratuberculosis
guggacgucaggccguagcgg

SEQ ID NO: 880192 - RNA, 22 nt, Mycobacterium avium subsp. paratuberculosis
guggacgucguuuuccagccgg

SEQ ID NO: 880193 - RNA, 16 nt, Mycobacterium avium subsp. paratuberculosis
guggagauggccagca

SEQ ID NO: 880194 - RNA, 17 nt, Mycobacterium avium subsp. paratuberculosis
guggagauggccagcac

SEQ ID NO: 880195 - RNA, 18 nt, Mycobacterium avium subsp. paratuberculosis
guggagauggccagcacc

SEQ ID NO: 880196 - RNA, 18 nt, Mycobacterium avium subsp. paratuberculosis
guggagcacagcacggca

SEQ ID NO: 880197 - RNA, 16 nt, Mycobacterium avium subsp. paratuberculosis
guggagcgcggcaugc

SEQ ID NO: 880198 - RNA, 15 nt, Mycobacterium avium subsp. paratuberculosis
guggagcggcccagc

SEQ ID NO: 880199 - RNA, 19 nt, Mycobacterium avium subsp. paratuberculosis
guggagcggcccagcucgg

SEQ ID NO: 880200 - RNA, 14 nt, Mycobacterium avium subsp. paratuberculosis
guggacgcgcgcgg

SEQ ID NO: 880201 - RNA, 14 nt, Mycobacterium avium subsp. paratuberculosis
guggacgaacgcgg

SEQ ID NO: 880202 - RNA, 17 nt, Mycobacterium avium subsp. paratuberculosis
guggacgaacgcggcga

SEQ ID NO: 880203 - RNA, 18 nt, Mycobacterium avium subsp. paratuberculosis
guggacgaacgcggcgaa

SEQ ID NO: 880204 - RNA, 18 nt, Mycobacterium avium subsp. paratuberculosis
guggacaacuccuggauc

SEQ ID NO: 880205 - RNA, 14 nt, Mycobacterium avium subsp. paratuberculosis
guggacagcgcgac

SEQ ID NO: 880206 - RNA, 19 nt, Mycobacterium avium subsp. paratuberculosis
guggacagguagcggugcu

SEQ ID NO: 880207 - RNA, 19 nt, Mycobacterium avium subsp. paratuberculosis
guggacaugcagccgccgc

SEQ ID NO: 880208 - RNA, 21 nt, Mycobacterium avium subsp. paratuberculosis
guggacaugcagccgccgcgg

SEQ ID NO: 880209 - RNA, 15 nt, Mycobacterium avium subsp. paratuberculosis
guggacccgccccga

SEQ ID NO: 880210 - RNA, 13 nt, Mycobacterium avium subsp. paratuberculosis
guggacaccgcac

SEQ ID NO: 880211 - RNA, 15 nt, Mycobacterium avium subsp. paratuberculosis
guggaccgcgcaguc

SEQ ID NO: 880212 - RNA, 20 nt, Mycobacterium avium subsp. paratuberculosis
guggaccgcgcagucggcgu

SEQ ID NO: 880213 - RNA, 22 nt, Mycobacterium avium subsp. paratuberculosis
guggccucccccuugccgguga

SEQ ID NO: 880214 - RNA, 22 nt, Mycobacterium avium subsp. paratuberculosis
guggccucccgguagaucgccg

SEQ ID NO: 880215 - RNA, 23 nt, Mycobacterium avium subsp. paratuberculosis
guggccucccgguagaucgccgg

SEQ ID NO: 880216 - RNA, 21 nt, Mycobacterium avium subsp. paratuberculosis
guggccgugugcgcaucggcg

SEQ ID NO: 880217 - RNA, 19 nt, Mycobacterium avium subsp. paratuberculosis
guggccuggaagaugaccc

SEQ ID NO: 880218 - RNA, 15 nt, Mycobacterium avium subsp. paratuberculosis
guggccugggcgacc

SEQ ID NO: 880219 - RNA, 16 nt, Mycobacterium avium subsp. paratuberculosis
guggccugggcgacca

SEQ ID NO: 880220 - RNA, 21 nt, Mycobacterium avium subsp. paratuberculosis
guggccugggcgaccagauag

SEQ ID NO: 880221 - RNA, 13 nt, Mycobacterium avium subsp. paratuberculosis
guggccuggucga

SEQ ID NO: 880222 - RNA, 15 nt, Mycobacterium avium subsp. paratuberculosis
guggccuggucggcg

SEQ ID NO: 880223 - RNA, 21 nt, Mycobacterium avium subsp. paratuberculosis
guggccuugacgacggccacc

SEQ ID NO: 880224 - RNA, 22 nt, Mycobacterium avium subsp. paratuberculosis
guggccuugacgacggccaccg

SEQ ID NO: 880225 - RNA, 16 nt, Mycobacterium avium subsp. paratuberculosis
guggccucgucggcgc

SEQ ID NO: 880226 - RNA, 17 nt, Mycobacterium avium subsp. paratuberculosis
guggccucgucggcgcc

SEQ ID NO: 880227 - RNA, 18 nt, Mycobacterium avium subsp. paratuberculosis
guggccucgucggcgccg

SEQ ID NO: 880228 - RNA, 14 nt, Mycobacterium avium subsp. paratuberculosis
guggccugcccggc

SEQ ID NO: 880229 - RNA, 16 nt, Mycobacterium avium subsp. paratuberculosis
guggccugcccggcgg

SEQ ID NO: 880230 - RNA, 22 nt, Mycobacterium avium subsp. paratuberculosis
guggccucgcgcaaugccgccg

SEQ ID NO: 880231 - RNA, 18 nt, Mycobacterium avium subsp. paratuberculosis
guggcgacaacaggcgac

SEQ ID NO: 880232 - RNA, 19 nt, Mycobacterium avium subsp. paratuberculosis
guggcgacaucgccgcggc

SEQ ID NO: 880233 - RNA, 16 nt, Mycobacterium avium subsp. paratuberculosis
guggcgacgacgccga

SEQ ID NO: 880234 - RNA, 15 nt, Mycobacterium avium subsp. paratuberculosis
guggccuucaucacc

SEQ ID NO: 880235 - RNA, 20 nt, Mycobacterium avium subsp. paratuberculosis
guggccuucaucaccgcccc

SEQ ID NO: 880236 - RNA, 18 nt, Mycobacterium avium subsp. paratuberculosis
guggccuuggccaccacg

SEQ ID NO: 880237 - RNA, 17 nt, Mycobacterium avium subsp. paratuberculosis
guggcgaaaccaacacc

SEQ ID NO: 880238 - RNA, 15 nt, Mycobacterium avium subsp. paratuberculosis
guggcgaacggguga

SEQ ID NO: 880239 - RNA, 18 nt, Mycobacterium avium subsp. paratuberculosis
guggcgaacugcaccagc

SEQ ID NO: 880240 - RNA, 22 nt, Mycobacterium avium subsp. paratuberculosis
guggcgaacugcaccagcacga

SEQ ID NO: 880241 - RNA, 18 nt, Mycobacterium avium subsp. paratuberculosis
guggcgaagcacgaccac

SEQ ID NO: 880242 - RNA, 19 nt, Mycobacterium avium subsp. paratuberculosis
guggcgaagcacgaccaca

SEQ ID NO: 880243 - RNA, 13 nt, Mycobacterium avium subsp. paratuberculosis
guggccgccacca

SEQ ID NO: 880244 - RNA, 17 nt, Mycobacterium avium subsp. paratuberculosis
guggccgccaccaacau

SEQ ID NO: 880245 - RNA, 22 nt, Mycobacterium avium subsp. paratuberculosis
guggccgccaccaacaucgacg

SEQ ID NO: 880246 - RNA, 23 nt, Mycobacterium avium subsp. paratuberculosis
guggccgccaccaacaucgacgu

SEQ ID NO: 880247 - RNA, 22 nt, Mycobacterium avium subsp. paratuberculosis
guggccgccaccaggcugaacg

SEQ ID NO: 880248 - RNA, 12 nt, Mycobacterium avium subsp. paratuberculosis
guggccgccacc

SEQ ID NO: 880249 - RNA, 20 nt, Mycobacterium avium subsp. paratuberculosis
guggcccugcucgucguuga

SEQ ID NO: 880250 - RNA, 13 nt, Mycobacterium avium subsp. paratuberculosis
guggccgcggugg

SEQ ID NO: 880251 - RNA, 14 nt, Mycobacterium avium subsp. paratuberculosis
guggccgcgguggu

SEQ ID NO: 880252 - RNA, 13 nt, Mycobacterium avium subsp. paratuberculosis
guggccgcgucga

SEQ ID NO: 880253 - RNA, 18 nt, Mycobacterium avium subsp. paratuberculosis
guggccgcgucgaccagc

SEQ ID NO: 880254 - RNA, 23 nt, Mycobacterium avium subsp. paratuberculosis
guggccgaggauggggucgcggg

SEQ ID NO: 880255 - RNA, 17 nt, Mycobacterium avium subsp. paratuberculosis
guggccgaucagcggcg

SEQ ID NO: 880256 - RNA, 22 nt, Mycobacterium avium subsp. paratuberculosis
guggccgaucagcugcucggcc

SEQ ID NO: 880257 - RNA, 14 nt, Mycobacterium avium subsp. paratuberculosis
guggccgcgaagau

SEQ ID NO: 880258 - RNA, 19 nt, Mycobacterium avium subsp. paratuberculosis
guggccgggucgccgucga

SEQ ID NO: 880259 - RNA, 16 nt, Mycobacterium avium subsp. paratuberculosis
guggccgucacgcugg

SEQ ID NO: 880260 - RNA, 20 nt, Mycobacterium avium subsp. paratuberculosis
guggccguccgaaucguuga

SEQ ID NO: 880261 - RNA, 21 nt, Mycobacterium avium subsp. paratuberculosis
guggccggugggcggcgcccg

SEQ ID NO: 880262 - RNA, 22 nt, Mycobacterium avium subsp. paratuberculosis
guggccggugggcggcgcccga

SEQ ID NO: 880263 - RNA, 12 nt, Mycobacterium avium subsp. paratuberculosis
guggccgucgcc

SEQ ID NO: 880264 - RNA, 13 nt, Mycobacterium avium subsp. paratuberculosis
guggccgucgccg

SEQ ID NO: 880265 - RNA, 13 nt, Mycobacterium avium subsp. paratuberculosis
guggccgucgccu

SEQ ID NO: 880266 - RNA, 13 nt, Mycobacterium avium subsp. paratuberculosis
guggccgucggcc

SEQ ID NO: 880267 - RNA, 16 nt, Mycobacterium avium subsp. paratuberculosis
guggccgucucgucgg

SEQ ID NO: 880268 - RNA, 21 nt, Mycobacterium avium subsp. paratuberculosis
guggccgucucgucggccgcg

SEQ ID NO: 880269 - RNA, 22 nt, Mycobacterium avium subsp. paratuberculosis
guggccgucucgucggccgcga

SEQ ID NO: 880270 - RNA, 20 nt, Mycobacterium avium subsp. paratuberculosis
guggccgcggcggcccggcg

SEQ ID NO: 880271 - RNA, 22 nt, Mycobacterium avium subsp. paratuberculosis
guggccgcggcggcccggcguc

SEQ ID NO: 880272 - RNA, 17 nt, Mycobacterium avium subsp. paratuberculosis
guggccgcuuuccaccc

SEQ ID NO: 880273 - RNA, 22 nt, Mycobacterium avium subsp. paratuberculosis
guggccgcuuuccaccccggcg

SEQ ID NO: 880274 - RNA, 17 nt, Mycobacterium avium subsp. paratuberculosis
guggccaguucgucgcg

SEQ ID NO: 880275 - RNA, 18 nt, Mycobacterium avium subsp. paratuberculosis
guggccaguucgucgcgc

SEQ ID NO: 880276 - RNA, 14 nt, Mycobacterium avium subsp. paratuberculosis
guggccagcagggu

SEQ ID NO: 880277 - RNA, 17 nt, Mycobacterium avium subsp. paratuberculosis
guggccagcuucaccgg

SEQ ID NO: 880278 - RNA, 18 nt, Mycobacterium avium subsp. paratuberculosis
guggccagcuucaccggu

SEQ ID NO: 880279 - RNA, 19 nt, Mycobacterium avium subsp. paratuberculosis
guggccaucgcggccccca

SEQ ID NO: 880280 - RNA, 22 nt, Mycobacterium avium subsp. paratuberculosis
guggcccagccgcugacgaugg

SEQ ID NO: 880281 - RNA, 17 nt, Mycobacterium avium subsp. paratuberculosis
guggcccagccggccga

SEQ ID NO: 880282 - RNA, 19 nt, Mycobacterium avium subsp. paratuberculosis
guggcccagccggccgacg

SEQ ID NO: 880283 - RNA, 13 nt, Mycobacterium avium subsp. paratuberculosis
guggcccaggccg

SEQ ID NO: 880284 - RNA, 16 nt, Mycobacterium avium subsp. paratuberculosis
guggcccaggccggcg

SEQ ID NO: 880285 - RNA, 21 nt, Mycobacterium avium subsp. paratuberculosis
guggccgaaccgcucgucggg

SEQ ID NO: 880286 - RNA, 19 nt, Mycobacterium avium subsp. paratuberculosis
guggccgaacgggucggcg

SEQ ID NO: 880287 - RNA, 20 nt, Mycobacterium avium subsp. paratuberculosis
guggccgaacgggucggcga

SEQ ID NO: 880288 - RNA, 20 nt, Mycobacterium avium subsp. paratuberculosis
guggcccggauggccgggca

SEQ ID NO: 880289 - RNA, 23 nt, Mycobacterium avium subsp. paratuberculosis
guggcccggauggccgggcaggc

SEQ ID NO: 880290 - RNA, 18 nt, Mycobacterium avium subsp. paratuberculosis
guggcccgguacagcgcc

SEQ ID NO: 880291 - RNA, 12 nt, Mycobacterium avium subsp. paratuberculosis
guggcccggucg

SEQ ID NO: 880292 - RNA, 16 nt, Mycobacterium avium subsp. paratuberculosis
guggcccggucgucga

SEQ ID NO: 880293 - RNA, 13 nt, Mycobacterium avium subsp. paratuberculosis
guggcccgcccag

SEQ ID NO: 880294 - RNA, 14 nt, Mycobacterium avium subsp. paratuberculosis
guggcccgcccagc

SEQ ID NO: 880295 - RNA, 14 nt, Mycobacterium avium subsp. paratuberculosis
guggcccgcccggg

SEQ ID NO: 880296 - RNA, 16 nt, Mycobacterium avium subsp. paratuberculosis
guggcccgcccgggca

SEQ ID NO: 880297 - RNA, 16 nt, Mycobacterium avium subsp. paratuberculosis
guggcccgcgcgcuga

SEQ ID NO: 880298 - RNA, 15 nt, Mycobacterium avium subsp. paratuberculosis
guggcccccaccacg

SEQ ID NO: 880299 - RNA, 16 nt, Mycobacterium avium subsp. paratuberculosis
guggcccccaccacga

SEQ ID NO: 880300 - RNA, 19 nt, Mycobacterium avium subsp. paratuberculosis
guggcccccaccacgaagc

SEQ ID NO: 880301 - RNA, 13 nt, Mycobacterium avium subsp. paratuberculosis
guggcccgacccg

SEQ ID NO: 880302 - RNA, 14 nt, Mycobacterium avium subsp. paratuberculosis
guggcccgacccgu

SEQ ID NO: 880303 - RNA, 13 nt, Mycobacterium avium subsp. paratuberculosis
guggcccagccgc

SEQ ID NO: 880304 - RNA, 14 nt, Mycobacterium avium subsp. paratuberculosis
guggccccagcccg

SEQ ID NO: 880305 - RNA, 20 nt, Mycobacterium avium subsp. paratuberculosis
guggccccagcccgggggug

SEQ ID NO: 880306 - RNA, 13 nt, Mycobacterium avium subsp. paratuberculosis
guggcaggaagcg

SEQ ID NO: 880307 - RNA, 21 nt, Mycobacterium avium subsp. paratuberculosis
guggccaaaaagugccggacc

SEQ ID NO: 880308 - RNA, 17 nt, Mycobacterium avium subsp. paratuberculosis
guggccacccucgccgc

SEQ ID NO: 880309 - RNA, 19 nt, Mycobacterium avium subsp. paratuberculosis
guggccacccucgccgccg

SEQ ID NO: 880310 - RNA, 15 nt, Mycobacterium avium subsp. paratuberculosis
guggccaccgaugcc

SEQ ID NO: 880311 - RNA, 12 nt, Mycobacterium avium subsp. paratuberculosis
guggccaccgcg

SEQ ID NO: 880312 - RNA, 23 nt, Mycobacterium avium subsp. paratuberculosis
guggccagcaccacguccgcggu

SEQ ID NO: 880313 - RNA, 19 nt, Mycobacterium avium subsp. paratuberculosis
guggccagcaccagcccga

SEQ ID NO: 880314 - RNA, 21 nt, Mycobacterium avium subsp. paratuberculosis
guggccagcaccgcgucgaug

SEQ ID NO: 880315 - RNA, 14 nt, Mycobacterium avium subsp. paratuberculosis
guggccagcacgau

SEQ ID NO: 880316 - RNA, 18 nt, Mycobacterium avium subsp. paratuberculosis
guggccagcacgaucggg

SEQ ID NO: 880317 - RNA, 12 nt, Mycobacterium avium subsp. paratuberculosis
guggcaggcacg

SEQ ID NO: 880318 - RNA, 22 nt, Mycobacterium avium subsp. paratuberculosis
guggcaggccaucagcccggcg

SEQ ID NO: 880319 - RNA, 20 nt, Mycobacterium avium subsp. paratuberculosis
guggcagggccagcagcccg

SEQ ID NO: 880320 - RNA, 21 nt, Mycobacterium avium subsp. paratuberculosis
guggcacccgggugcccggcu

SEQ ID NO: 880321 - RNA, 16 nt, Mycobacterium avium subsp. paratuberculosis
guggcaccccgcgccg

SEQ ID NO: 880322 - RNA, 17 nt, Mycobacterium avium subsp. paratuberculosis
guggcaccccgcgccgg

SEQ ID NO: 880323 - RNA, 13 nt, Mycobacterium avium subsp. paratuberculosis
guggcagcccggc

SEQ ID NO: 880324 - RNA, 14 nt, Mycobacterium avium subsp. paratuberculosis
guggcagcccggcu

SEQ ID NO: 880325 - RNA, 13 nt, Mycobacterium avium subsp. paratuberculosis
guggcgcacgcug

SEQ ID NO: 880326 - RNA, 21 nt, Mycobacterium avium subsp. paratuberculosis
guggcgcacagaucgucucgg

SEQ ID NO: 880327 - RNA, 15 nt, Mycobacterium avium subsp. paratuberculosis
guggcgaucaccgcg

SEQ ID NO: 880328 - RNA, 12 nt, Mycobacterium avium subsp. paratuberculosis
guggcgccgcgc

SEQ ID NO: 880329 - RNA, 13 nt, Mycobacterium avium subsp. paratuberculosis
guggcgccgcgca

SEQ ID NO: 880330 - RNA, 14 nt, Mycobacterium avium subsp. paratuberculosis
guggcgccgcgcag

SEQ ID NO: 880331 - RNA, 13 nt, Mycobacterium avium subsp. paratuberculosis
guggcgccgcggu

SEQ ID NO: 880332 - RNA, 12 nt, Mycobacterium avium subsp. paratuberculosis
guggcgccggca

SEQ ID NO: 880333 - RNA, 14 nt, Mycobacterium avium subsp. paratuberculosis
guggcgccggcauc

SEQ ID NO: 880334 - RNA, 15 nt, Mycobacterium avium subsp. paratuberculosis
guggcgccggcaucg

SEQ ID NO: 880335 - RNA, 16 nt, Mycobacterium avium subsp. paratuberculosis
guggcgccggcaucga

SEQ ID NO: 880336 - RNA, 13 nt, Mycobacterium avium subsp. paratuberculosis
guggcgccggggc

SEQ ID NO: 880337 - RNA, 18 nt, Mycobacterium avium subsp. paratuberculosis
guggcgccgguaggcgcg

SEQ ID NO: 880338 - RNA, 14 nt, Mycobacterium avium subsp. paratuberculosis
guggcgccgugcag

SEQ ID NO: 880339 - RNA, 14 nt, Mycobacterium avium subsp. paratuberculosis
guggcgcgccccgg

SEQ ID NO: 880340 - RNA, 15 nt, Mycobacterium avium subsp. paratuberculosis
guggcggcgccggau

SEQ ID NO: 880341 - RNA, 19 nt, Mycobacterium avium subsp. paratuberculosis
guggcggcgaacgcgcggu

SEQ ID NO: 880342 - RNA, 16 nt, Mycobacterium avium subsp. paratuberculosis
guggcggccgucgcgc

SEQ ID NO: 880343 - RNA, 18 nt, Mycobacterium avium subsp. paratuberculosis
guggcggccgucgcgcac

SEQ ID NO: 880344 - RNA, 14 nt, Mycobacterium avium subsp. paratuberculosis
guggcggcgggcca

SEQ ID NO: 880345 - RNA, 19 nt, Mycobacterium avium subsp. paratuberculosis
guggcggcgggccagcucg

SEQ ID NO: 880346 - RNA, 20 nt, Mycobacterium avium subsp. paratuberculosis
guggcggcgggccagcucgu

SEQ ID NO: 880347 - RNA, 23 nt, Mycobacterium avium subsp. paratuberculosis
guggcggcgggccagcucgucga

SEQ ID NO: 880348 - RNA, 15 nt, Mycobacterium avium subsp. paratuberculosis
guggcggcggugucg

SEQ ID NO: 880349 - RNA, 16 nt, Mycobacterium avium subsp. paratuberculosis
guggcggccagcgaga

SEQ ID NO: 880350 - RNA, 20 nt, Mycobacterium avium subsp. paratuberculosis
guggcggccaggccggcgac

SEQ ID NO: 880351 - RNA, 14 nt, Mycobacterium avium subsp. paratuberculosis
guggcgcugccgag

SEQ ID NO: 880352 - RNA, 14 nt, Mycobacterium avium subsp. paratuberculosis
guggcgcucagcgg

SEQ ID NO: 880353 - RNA, 19 nt, Mycobacterium avium subsp. paratuberculosis
guggcgcucagcggcagcg

SEQ ID NO: 880354 - RNA, 21 nt, Mycobacterium avium subsp. paratuberculosis
guggcgguggggccgaagccg

SEQ ID NO: 880355 - RNA, 20 nt, Mycobacterium avium subsp. paratuberculosis
guggcgguguucgagggcgc

SEQ ID NO: 880356 - RNA, 16 nt, Mycobacterium avium subsp. paratuberculosis
guggcggugccgcggc

SEQ ID NO: 880357 - RNA, 17 nt, Mycobacterium avium subsp. paratuberculosis
guggcggugccgcggcg

SEQ ID NO: 880358 - RNA, 16 nt, Mycobacterium avium subsp. paratuberculosis
guggcgguggccacgg

SEQ ID NO: 880359 - RNA, 19 nt, Mycobacterium avium subsp. paratuberculosis
guggcgggcguccugcggg

SEQ ID NO: 880360 - RNA, 16 nt, Mycobacterium avium subsp. paratuberculosis
guggcgggccaggcgg

SEQ ID NO: 880361 - RNA, 14 nt, Mycobacterium avium subsp. paratuberculosis
guggcgggcccggg

SEQ ID NO: 880362 - RNA, 16 nt, Mycobacterium avium subsp. paratuberculosis
guggcgugcggccucg

SEQ ID NO: 880363 - RNA, 12 nt, Mycobacterium avium subsp. paratuberculosis
guggcgucggcg

SEQ ID NO: 880364 - RNA, 13 nt, Mycobacterium avium subsp. paratuberculosis
guggcgucggcgg

SEQ ID NO: 880365 - RNA, 14 nt, Mycobacterium avium subsp. paratuberculosis
guggcgucggcggc

SEQ ID NO: 880366 - RNA, 16 nt, Mycobacterium avium subsp. paratuberculosis
guggcgucggcggccu

SEQ ID NO: 880367 - RNA, 15 nt, Mycobacterium avium subsp. paratuberculosis
guggcgucggcgucg

SEQ ID NO: 880368 - RNA, 16 nt, Mycobacterium avium subsp. paratuberculosis
guggcgucggcgucga

SEQ ID NO: 880369 - RNA, 13 nt, Mycobacterium avium subsp. paratuberculosis
guggcgucgguga

SEQ ID NO: 880370 - RNA, 15 nt, Mycobacterium avium subsp. paratuberculosis
guggcgucgaugccg

SEQ ID NO: 880371 - RNA, 19 nt, Mycobacterium avium subsp. paratuberculosis
guggcgucgaugccgauca

SEQ ID NO: 880372 - RNA, 22 nt, Mycobacterium avium subsp. paratuberculosis
guggcgucgaugccgaucacgg

SEQ ID NO: 880373 - RNA, 16 nt, Mycobacterium avium subsp. paratuberculosis
guggcgucgccgccgg

SEQ ID NO: 880374 - RNA, 17 nt, Mycobacterium avium subsp. paratuberculosis
guggcguccagaugccg

SEQ ID NO: 880375 - RNA, 16 nt, Mycobacterium avium subsp. paratuberculosis
guggcguccucgacgg

SEQ ID NO: 880376 - RNA, 13 nt, Mycobacterium avium subsp. paratuberculosis
guggcgucgacgg

SEQ ID NO: 880377 - RNA, 14 nt, Mycobacterium avium subsp. paratuberculosis
guggcgucgacggg

SEQ ID NO: 880378 - RNA, 15 nt, Mycobacterium avium subsp. paratuberculosis
guggcgugcagcgcg

SEQ ID NO: 880379 - RNA, 20 nt, Mycobacterium avium subsp. paratuberculosis
guggcgugugggcucgcccg

SEQ ID NO: 880380 - RNA, 14 nt, Mycobacterium avium subsp. paratuberculosis
guggcguugcgggc

SEQ ID NO: 880381 - RNA, 21 nt, Mycobacterium avium subsp. paratuberculosis
guggcguuuuccuucggugcg

SEQ ID NO: 880382 - RNA, 23 nt, Mycobacterium avium subsp. paratuberculosis
guggcuaccgccgggcgggccgc

SEQ ID NO: 880383 - RNA, 16 nt, Mycobacterium avium subsp. paratuberculosis
guggcugaccgacggc

SEQ ID NO: 880384 - RNA, 13 nt, Mycobacterium avium subsp. paratuberculosis
guggcugaggccg

SEQ ID NO: 880385 - RNA, 23 nt, Mycobacterium avium subsp. paratuberculosis
guggcugaggccgccccggccgc

SEQ ID NO: 880386 - RNA, 16 nt, Mycobacterium avium subsp. paratuberculosis
guggcucggcccgccg

SEQ ID NO: 880387 - RNA, 19 nt, Mycobacterium avium subsp. paratuberculosis
guggcugaacagcgcgccg

SEQ ID NO: 880388 - RNA, 14 nt, Mycobacterium avium subsp. paratuberculosis
guggcucagcggca

SEQ ID NO: 880389 - RNA, 16 nt, Mycobacterium avium subsp. paratuberculosis
gugggaaugcggcugg

SEQ ID NO: 880390 - RNA, 20 nt, Mycobacterium avium subsp. paratuberculosis
gugggacugggcgccgccgg

SEQ ID NO: 880391 - RNA, 23 nt, Mycobacterium avium subsp. paratuberculosis
gugggugccgacgagcucgccgc

SEQ ID NO: 880392 - RNA, 14 nt, Mycobacterium avium subsp. paratuberculosis
gugggguucccggc

SEQ ID NO: 880393 - RNA, 12 nt, Mycobacterium avium subsp. paratuberculosis
gugggucgacag

SEQ ID NO: 880394 - RNA, 20 nt, Mycobacterium avium subsp. paratuberculosis
gugguagacagcguggucgc

SEQ ID NO: 880395 - RNA, 15 nt, Mycobacterium avium subsp. paratuberculosis
gugguagacgccgga

SEQ ID NO: 880396 - RNA, 15 nt, Mycobacterium avium subsp. paratuberculosis
gugguaccggcgcca

SEQ ID NO: 880397 - RNA, 15 nt, Mycobacterium avium subsp. paratuberculosis
gugguaccggguggc

SEQ ID NO: 880398 - RNA, 18 nt, Mycobacterium avium subsp. paratuberculosis
guggucaacggcaccgac

SEQ ID NO: 880399 - RNA, 19 nt, Mycobacterium avium subsp. paratuberculosis
guggucaacggcaccgaca

SEQ ID NO: 880400 - RNA, 14 nt, Mycobacterium avium subsp. paratuberculosis
guggucggccgccc

SEQ ID NO: 880401 - RNA, 13 nt, Mycobacterium avium subsp. paratuberculosis
guggucggcgcgg

SEQ ID NO: 880402 - RNA, 14 nt, Mycobacterium avium subsp. paratuberculosis
guggucggcgcggu

SEQ ID NO: 880403 - RNA, 14 nt, Mycobacterium avium subsp. paratuberculosis
guggucgggcaugc

SEQ ID NO: 880404 - RNA, 22 nt, Mycobacterium avium subsp. paratuberculosis
guggucgggcaugccggccggc

SEQ ID NO: 880405 - RNA, 14 nt, Mycobacterium avium subsp. paratuberculosis
guggucgcgcagca

SEQ ID NO: 880406 - RNA, 15 nt, Mycobacterium avium subsp. paratuberculosis
guggucgccgucgua

SEQ ID NO: 880407 - RNA, 14 nt, Mycobacterium avium subsp. paratuberculosis
guggucgccguugg

SEQ ID NO: 880408 - RNA, 19 nt, Mycobacterium avium subsp. paratuberculosis
gugguccagcacgugccca

SEQ ID NO: 880409 - RNA, 22 nt, Mycobacterium avium subsp. paratuberculosis
gugguccgcgcgaccaucagcc

SEQ ID NO: 880410 - RNA, 23 nt, Mycobacterium avium subsp. paratuberculosis
guggucgaucccgccggcgaucg

SEQ ID NO: 880411 - RNA, 19 nt, Mycobacterium avium subsp. paratuberculosis
guggucgaugaacucgcgg

SEQ ID NO: 880412 - RNA, 22 nt, Mycobacterium avium subsp. paratuberculosis
guggucgaugaacucgcgggcg

SEQ ID NO: 880413 - RNA, 12 nt, Mycobacterium avium subsp. paratuberculosis
guggucgaugcc

SEQ ID NO: 880414 - RNA, 19 nt, Mycobacterium avium subsp. paratuberculosis
guggucgaugcccgcgccg

SEQ ID NO: 880415 - RNA, 12 nt, Mycobacterium avium subsp. paratuberculosis
guggucacccgc

SEQ ID NO: 880416 - RNA, 13 nt, Mycobacterium avium subsp. paratuberculosis
guggucagcgcgg

SEQ ID NO: 880417 - RNA, 18 nt, Mycobacterium avium subsp. paratuberculosis
guggucagcgucucgccg

SEQ ID NO: 880418 - RNA, 16 nt, Mycobacterium avium subsp. paratuberculosis
guggucagcgucucgg

SEQ ID NO: 880419 - RNA, 16 nt, Mycobacterium avium subsp. paratuberculosis
guggucaccagcgcgg

SEQ ID NO: 880420 - RNA, 15 nt, Mycobacterium avium subsp. paratuberculosis
gugguccaccgccgc

SEQ ID NO: 880421 - RNA, 13 nt, Mycobacterium avium subsp. paratuberculosis
gugguccucguca

SEQ ID NO: 880422 - RNA, 19 nt, Mycobacterium avium subsp. paratuberculosis
guggucgaacuggcgcacc

SEQ ID NO: 880423 - RNA, 19 nt, Mycobacterium avium subsp. paratuberculosis
guggucgacgagcccgcgc

SEQ ID NO: 880424 - RNA, 13 nt, Mycobacterium avium subsp. paratuberculosis
guggucgacgccg

SEQ ID NO: 880425 - RNA, 16 nt, Mycobacterium avium subsp. paratuberculosis
guggucgacgcgccgc

SEQ ID NO: 880426 - RNA, 17 nt, Mycobacterium avium subsp. paratuberculosis
guggucgacgcgccgca

SEQ ID NO: 880427 - RNA, 23 nt, Mycobacterium avium subsp. paratuberculosis
gugggcaacacgucguccggcgc

SEQ ID NO: 880428 - RNA, 13 nt, Mycobacterium avium subsp. paratuberculosis
gugggcaccggca

SEQ ID NO: 880429 - RNA, 19 nt, Mycobacterium avium subsp. paratuberculosis
gugggcaccagcagcgcga

SEQ ID NO: 880430 - RNA, 18 nt, Mycobacterium avium subsp. paratuberculosis
gugggcaccagcugcgga

SEQ ID NO: 880431 - RNA, 16 nt, Mycobacterium avium subsp. paratuberculosis
gugggcagcucggugg

SEQ ID NO: 880432 - RNA, 16 nt, Mycobacterium avium subsp. paratuberculosis
gugggcagcucgucgg

SEQ ID NO: 880433 - RNA, 15 nt, Mycobacterium avium subsp. paratuberculosis
gugggcagaugcccg

SEQ ID NO: 880434 - RNA, 18 nt, Mycobacterium avium subsp. paratuberculosis
gugggcagcgcggccagc

SEQ ID NO: 880435 - RNA, 13 nt, Mycobacterium avium subsp. paratuberculosis
gugggcagcccca

SEQ ID NO: 880436 - RNA, 23 nt, Mycobacterium avium subsp. paratuberculosis
gugggcagccccagcgagcaggu

SEQ ID NO: 880437 - RNA, 16 nt, Mycobacterium avium subsp. paratuberculosis
gugggcagccggcaac

SEQ ID NO: 880438 - RNA, 13 nt, Mycobacterium avium subsp. paratuberculosis
gugggcagcgcga

SEQ ID NO: 880439 - RNA, 14 nt, Mycobacterium avium subsp. paratuberculosis
gugggcgacgaggu

SEQ ID NO: 880440 - RNA, 13 nt, Mycobacterium avium subsp. paratuberculosis
gugggcgauggcg

SEQ ID NO: 880441 - RNA, 14 nt, Mycobacterium avium subsp. paratuberculosis
gugggcgcagggcc

SEQ ID NO: 880442 - RNA, 17 nt, Mycobacterium avium subsp. paratuberculosis
gugggcgcagggccgcu

SEQ ID NO: 880443 - RNA, 15 nt, Mycobacterium avium subsp. paratuberculosis
gugggcgcccgcggc

SEQ ID NO: 880444 - RNA, 20 nt, Mycobacterium avium subsp. paratuberculosis
gugggcgcccgcggcgcgca

SEQ ID NO: 880445 - RNA, 14 nt, Mycobacterium avium subsp. paratuberculosis
gugggccagucgaa

SEQ ID NO: 880446 - RNA, 21 nt, Mycobacterium avium subsp. paratuberculosis
gugggcccgccgucgaccacg

SEQ ID NO: 880447 - RNA, 23 nt, Mycobacterium avium subsp. paratuberculosis
gugggcccgccgucgaccacgaa

SEQ ID NO: 880448 - RNA, 17 nt, Mycobacterium avium subsp. paratuberculosis
gugggccgcaccuggca

SEQ ID NO: 880449 - RNA, 14 nt, Mycobacterium avium subsp. paratuberculosis
gugggccaucggca

SEQ ID NO: 880450 - RNA, 15 nt, Mycobacterium avium subsp. paratuberculosis
gugggcucggcgccg

SEQ ID NO: 880451 - RNA, 22 nt, Mycobacterium avium subsp. paratuberculosis
gugggcggugcgcagucgcugg

SEQ ID NO: 880452 - RNA, 16 nt, Mycobacterium avium subsp. paratuberculosis
gugggcguacgggcgg

SEQ ID NO: 880453 - RNA, 19 nt, Mycobacterium avium subsp. paratuberculosis
gugggcguacgggcgggca

SEQ ID NO: 880454 - RNA, 14 nt, Mycobacterium avium subsp. paratuberculosis
gugggcgucguggu

SEQ ID NO: 880455 - RNA, 22 nt, Mycobacterium avium subsp. paratuberculosis
gugggcgucguggucgacgccg

SEQ ID NO: 880456 - RNA, 15 nt, Mycobacterium avium subsp. paratuberculosis
gugggcgugccggau

SEQ ID NO: 880457 - RNA, 13 nt, Mycobacterium avium subsp. paratuberculosis
gugggcggccacc

SEQ ID NO: 880458 - RNA, 15 nt, Mycobacterium avium subsp. paratuberculosis
gugggcggcgcccga

SEQ ID NO: 880459 - RNA, 13 nt, Mycobacterium avium subsp. paratuberculosis
gugggcggcgcga

SEQ ID NO: 880460 - RNA, 20 nt, Mycobacterium avium subsp. paratuberculosis
gugggcggcgcgaucgucga

SEQ ID NO: 880461 - RNA, 23 nt, Mycobacterium avium subsp. paratuberculosis
gugggcgggacguggcucagcgg

SEQ ID NO: 880462 - RNA, 13 nt, Mycobacterium avium subsp. paratuberculosis
gugggcgggcacc

SEQ ID NO: 880463 - RNA, 14 nt, Mycobacterium avium subsp. paratuberculosis
gugggcgccggguc

SEQ ID NO: 880464 - RNA, 17 nt, Mycobacterium avium subsp. paratuberculosis
gugggcgccgucaaugg

SEQ ID NO: 880465 - RNA, 16 nt, Mycobacterium avium subsp. paratuberculosis
gugggcgccgucgccg

SEQ ID NO: 880466 - RNA, 21 nt, Mycobacterium avium subsp. paratuberculosis
gugggcgacgucgucgcccac

SEQ ID NO: 880467 - RNA, 15 nt, Mycobacterium avium subsp. paratuberculosis
gugggcgcgcagcac

SEQ ID NO: 880468 - RNA, 16 nt, Mycobacterium avium subsp. paratuberculosis
gugggggucuggucgg

SEQ ID NO: 880469 - RNA, 15 nt, Mycobacterium avium subsp. paratuberculosis
guggggacgacgccg

SEQ ID NO: 880470 - RNA, 17 nt, Mycobacterium avium subsp. paratuberculosis
guggggacgacgccgaa

SEQ ID NO: 880471 - RNA, 20 nt, Mycobacterium avium subsp. paratuberculosis
gugggcugcaucuccagccg

SEQ ID NO: 880472 - RNA, 21 nt, Mycobacterium avium subsp. paratuberculosis
gugaaacuagcuucacggucg

SEQ ID NO: 880473 - RNA, 20 nt, Mycobacterium avium subsp. paratuberculosis
gugaaacauggcgcccgcgu

SEQ ID NO: 880474 - RNA, 22 nt, Mycobacterium avium subsp. paratuberculosis
gugaaaucguggcuuucggcgc

SEQ ID NO: 880475 - RNA, 15 nt, Mycobacterium avium subsp. paratuberculosis
gugaacaccccgcgg

SEQ ID NO: 880476 - RNA, 17 nt, Mycobacterium avium subsp. paratuberculosis
gucuuguuggucagccu

SEQ ID NO: 880477 - RNA, 16 nt, Mycobacterium avium subsp. paratuberculosis
gucuuggucucgccga

SEQ ID NO: 880478 - RNA, 17 nt, Mycobacterium avium subsp. paratuberculosis
gucuuggucucgccgau

SEQ ID NO: 880479 - RNA, 20 nt, Mycobacterium avium subsp. paratuberculosis
gucuuguagucgaccacccg

SEQ ID NO: 880480 - RNA, 16 nt, Mycobacterium avium subsp. paratuberculosis
gucuuggacgcccggu

SEQ ID NO: 880481 - RNA, 22 nt, Mycobacterium avium subsp. paratuberculosis
gucuuggacgcccggucgacca

SEQ ID NO: 880482 - RNA, 13 nt, Mycobacterium avium subsp. paratuberculosis
gucugcgccucga

SEQ ID NO: 880483 - RNA, 14 nt, Mycobacterium avium subsp. paratuberculosis
gucugcgccucgau

SEQ ID NO: 880484 - RNA, 22 nt, Mycobacterium avium subsp. paratuberculosis
gucugcgcgagcagaucgcgga

SEQ ID NO: 880485 - RNA, 17 nt, Mycobacterium avium subsp. paratuberculosis
gucuucccgccgccguc

SEQ ID NO: 880486 - RNA, 17 nt, Mycobacterium avium subsp. paratuberculosis
gucuugcggcccaaccg

SEQ ID NO: 880487 - RNA, 15 nt, Mycobacterium avium subsp. paratuberculosis
gucuugcggccguca

SEQ ID NO: 880488 - RNA, 21 nt, Mycobacterium avium subsp. paratuberculosis
gucuuggaaagcgcuugucgc

SEQ ID NO: 880489 - RNA, 20 nt, Mycobacterium avium subsp. paratuberculosis
gucugaccccccgacgccga

SEQ ID NO: 880490 - RNA, 14 nt, Mycobacterium avium subsp. paratuberculosis
gucugaccucgcgc

SEQ ID NO: 880491 - RNA, 21 nt, Mycobacterium avium subsp. paratuberculosis
gucugaccucgcgccgcgauc

SEQ ID NO: 880492 - RNA, 17 nt, Mycobacterium avium subsp. paratuberculosis
gucugaaaugccgggcc

SEQ ID NO: 880493 - RNA, 19 nt, Mycobacterium avium subsp. paratuberculosis
gucugaaaugccgggccgg

SEQ ID NO: 880494 - RNA, 14 nt, Mycobacterium avium subsp. paratuberculosis
gucuccggcgcggu

SEQ ID NO: 880495 - RNA, 17 nt, Mycobacterium avium subsp. paratuberculosis
gucuccggcgcgguugc

SEQ ID NO: 880496 - RNA, 19 nt, Mycobacterium avium subsp. paratuberculosis
gucuccgggcugugggcgc

SEQ ID NO: 880497 - RNA, 15 nt, Mycobacterium avium subsp. paratuberculosis
gucuccucgaccagc

SEQ ID NO: 880498 - RNA, 22 nt, Mycobacterium avium subsp. paratuberculosis
gucucuggccugauugacggcc

SEQ ID NO: 880499 - RNA, 17 nt, Mycobacterium avium subsp. paratuberculosis
gucucugucgucgacca

SEQ ID NO: 880500 - RNA, 13 nt, Mycobacterium avium subsp. paratuberculosis
gucucccgggcgg

SEQ ID NO: 880501 - RNA, 16 nt, Mycobacterium avium subsp. paratuberculosis
gucucccgggcggucg

SEQ ID NO: 880502 - RNA, 14 nt, Mycobacterium avium subsp. paratuberculosis
gucucccgguccac

SEQ ID NO: 880503 - RNA, 16 nt, Mycobacterium avium subsp. paratuberculosis
gucuccaugucgucgg

SEQ ID NO: 880504 - RNA, 17 nt, Mycobacterium avium subsp. paratuberculosis
gucuccaugucgucggc

SEQ ID NO: 880505 - RNA, 21 nt, Mycobacterium avium subsp. paratuberculosis
gucuccaugucgucggcggac

SEQ ID NO: 880506 - RNA, 14 nt, Mycobacterium avium subsp. paratuberculosis
gucuccgcgcagcc

SEQ ID NO: 880507 - RNA, 18 nt, Mycobacterium avium subsp. paratuberculosis
gucuccgcgcagccaggu

SEQ ID NO: 880508 - RNA, 23 nt, Mycobacterium avium subsp. paratuberculosis
gucuccggccccgagccgacgau

SEQ ID NO: 880509 - RNA, 19 nt, Mycobacterium avium subsp. paratuberculosis
gucugccagaacggcggca

SEQ ID NO: 880510 - RNA, 12 nt, Mycobacterium avium subsp. paratuberculosis
gucugcccgccg

SEQ ID NO: 880511 - RNA, 23 nt, Mycobacterium avium subsp. paratuberculosis
gucugccgggacagguagcgcag

SEQ ID NO: 880512 - RNA, 22 nt, Mycobacterium avium subsp. paratuberculosis
gucugcgccagcuccagcagcc

SEQ ID NO: 880513 - RNA, 19 nt, Mycobacterium avium subsp. paratuberculosis
gucugcgccccggcgucga

SEQ ID NO: 880514 - RNA, 15 nt, Mycobacterium avium subsp. paratuberculosis
gucugcgcccgaucg

SEQ ID NO: 880515 - RNA, 17 nt, Mycobacterium avium subsp. paratuberculosis
gucugcgcccgaucggc

SEQ ID NO: 880516 - RNA, 21 nt, Mycobacterium avium subsp. paratuberculosis
gucugcgcccgaucggcguga

SEQ ID NO: 880517 - RNA, 15 nt, Mycobacterium avium subsp. paratuberculosis
gucugccacgcccac

SEQ ID NO: 880518 - RNA, 16 nt, Mycobacterium avium subsp. paratuberculosis
gucugccacgcccacc

SEQ ID NO: 880519 - RNA, 19 nt, Mycobacterium avium subsp. paratuberculosis
gucugccacgcccaccggu

SEQ ID NO: 880520 - RNA, 22 nt, Mycobacterium avium subsp. paratuberculosis
gucugcaggucguaguaggcgc

SEQ ID NO: 880521 - RNA, 21 nt, Mycobacterium avium subsp. paratuberculosis
gucugcagcagccgcugcugg

SEQ ID NO: 880522 - RNA, 21 nt, Mycobacterium avium subsp. paratuberculosis
gucugaucgcccagcaccgcg

SEQ ID NO: 880523 - RNA, 18 nt, Mycobacterium avium subsp. paratuberculosis
gucugagcccgggcaggc

SEQ ID NO: 880524 - RNA, 21 nt, Mycobacterium avium subsp. paratuberculosis
gucugagcccgggcaggcggc

SEQ ID NO: 880525 - RNA, 21 nt, Mycobacterium avium subsp. paratuberculosis
gucucaaucuucuccgcggcc

SEQ ID NO: 880526 - RNA, 22 nt, Mycobacterium avium subsp. paratuberculosis
gucuagcggccuaggacgccgc

SEQ ID NO: 880527 - RNA, 15 nt, Mycobacterium avium subsp. paratuberculosis
gucuagccgccgagc

SEQ ID NO: 880528 - RNA, 14 nt, Mycobacterium avium subsp. paratuberculosis
gucucaucccgccg

SEQ ID NO: 880529 - RNA, 16 nt, Mycobacterium avium subsp. paratuberculosis
gucucagucggccacc

SEQ ID NO: 880530 - RNA, 19 nt, Mycobacterium avium subsp. paratuberculosis
gucucagucggccaccgcg

SEQ ID NO: 880531 - RNA, 17 nt, Mycobacterium avium subsp. paratuberculosis
gucucacgccucgucga

SEQ ID NO: 880532 - RNA, 16 nt, Mycobacterium avium subsp. paratuberculosis
gucucagcgcccgccc

SEQ ID NO: 880533 - RNA, 20 nt, Mycobacterium avium subsp. paratuberculosis
gucucaggaauuugcggccc

SEQ ID NO: 880534 - RNA, 16 nt, Mycobacterium avium subsp. paratuberculosis
gucguuggugcgcacc

SEQ ID NO: 880535 - RNA, 15 nt, Mycobacterium avium subsp. paratuberculosis
gucguuggugucgaa

SEQ ID NO: 880536 - RNA, 23 nt, Mycobacterium avium subsp. paratuberculosis
gucguugucgucgccggccgcgg

SEQ ID NO: 880537 - RNA, 15 nt, Mycobacterium avium subsp. paratuberculosis
gucguugcgggcggc

SEQ ID NO: 880538 - RNA, 16 nt, Mycobacterium avium subsp. paratuberculosis
gucguugcccgccagc

SEQ ID NO: 880539 - RNA, 17 nt, Mycobacterium avium subsp. paratuberculosis
gucguugcccgccagca

SEQ ID NO: 880540 - RNA, 18 nt, Mycobacterium avium subsp. paratuberculosis
gucguuggcccgccgcgg

SEQ ID NO: 880541 - RNA, 14 nt, Mycobacterium avium subsp. paratuberculosis
gucguuggcggcgg

SEQ ID NO: 880542 - RNA, 16 nt, Mycobacterium avium subsp. paratuberculosis
gucguuggcggcggug

SEQ ID NO: 880543 - RNA, 19 nt, Mycobacterium avium subsp. paratuberculosis
gucguugagcacacccagc

SEQ ID NO: 880544 - RNA, 24 nt, Mycobacterium avium subsp. paratuberculosis
gucguugagcacacccagcgagcc

SEQ ID NO: 880545 - RNA, 16 nt, Mycobacterium avium subsp. paratuberculosis
gucguugcacacccgg

SEQ ID NO: 880546 - RNA, 19 nt, Mycobacterium avium subsp. paratuberculosis
gucguugcacacccggugc

SEQ ID NO: 880547 - RNA, 17 nt, Mycobacterium avium subsp. paratuberculosis
gucguugacgcccuccu

SEQ ID NO: 880548 - RNA, 13 nt, Mycobacterium avium subsp. paratuberculosis
gucguugacgcug

SEQ ID NO: 880549 - RNA, 14 nt, Mycobacterium avium subsp. paratuberculosis
gucguugaacgcgc

SEQ ID NO: 880550 - RNA, 16 nt, Mycobacterium avium subsp. paratuberculosis
gucguugaacgcgcgg

SEQ ID NO: 880551 - RNA, 17 nt, Mycobacterium avium subsp. paratuberculosis
gucguugaaggccugca

SEQ ID NO: 880552 - RNA, 22 nt, Mycobacterium avium subsp. paratuberculosis
gucguggcgacaucgccgcggc

SEQ ID NO: 880553 - RNA, 13 nt, Mycobacterium avium subsp. paratuberculosis
gucguggcccgga

SEQ ID NO: 880554 - RNA, 17 nt, Mycobacterium avium subsp. paratuberculosis
gucguggcccugcucgu

SEQ ID NO: 880555 - RNA, 23 nt, Mycobacterium avium subsp. paratuberculosis
gucguggcccugcucgucguuga

SEQ ID NO: 880556 - RNA, 14 nt, Mycobacterium avium subsp. paratuberculosis
gucgugcggccggc

SEQ ID NO: 880557 - RNA, 15 nt, Mycobacterium avium subsp. paratuberculosis
gucgugcggccggcg

SEQ ID NO: 880558 - RNA, 22 nt, Mycobacterium avium subsp. paratuberculosis
gucgugcgggaugccgagcagc

SEQ ID NO: 880559 - RNA, 16 nt, Mycobacterium avium subsp. paratuberculosis
gucgugcggucgcacc

SEQ ID NO: 880560 - RNA, 17 nt, Mycobacterium avium subsp. paratuberculosis
gucgugcggucgcacca

SEQ ID NO: 880561 - RNA, 17 nt, Mycobacterium avium subsp. paratuberculosis
gucgugcucgucggcgg

SEQ ID NO: 880562 - RNA, 13 nt, Mycobacterium avium subsp. paratuberculosis
gucgugcagcacc

SEQ ID NO: 880563 - RNA, 20 nt, Mycobacterium avium subsp. paratuberculosis
gucgugcagcaccgccagca

SEQ ID NO: 880564 - RNA, 22 nt, Mycobacterium avium subsp. paratuberculosis
gucgugcauucaggucaccgcg

SEQ ID NO: 880565 - RNA, 23 nt, Mycobacterium avium subsp. paratuberculosis
gucgugcauucaggucaccgcgc

SEQ ID NO: 880566 - RNA, 16 nt, Mycobacterium avium subsp. paratuberculosis
gucgugccgagcguga

SEQ ID NO: 880567 - RNA, 16 nt, Mycobacterium avium subsp. paratuberculosis
gucgugcaucggcgcc

SEQ ID NO: 880568 - RNA, 21 nt, Mycobacterium avium subsp. paratuberculosis
gucgucccaggguugccgcac

SEQ ID NO: 880569 - RNA, 20 nt, Mycobacterium avium subsp. paratuberculosis
gucgucccggcgccucggcg

SEQ ID NO: 880570 - RNA, 16 nt, Mycobacterium avium subsp. paratuberculosis
gucgucccggugauga

SEQ ID NO: 880571 - RNA, 21 nt, Mycobacterium avium subsp. paratuberculosis
gucgucccgucggcgcgaggc

SEQ ID NO: 880572 - RNA, 14 nt, Mycobacterium avium subsp. paratuberculosis
gucguccgaacccg

SEQ ID NO: 880573 - RNA, 16 nt, Mycobacterium avium subsp. paratuberculosis
gucguccgacaccacc

SEQ ID NO: 880574 - RNA, 21 nt, Mycobacterium avium subsp. paratuberculosis
gucguccgacaccaccugcac

SEQ ID NO: 880575 - RNA, 21 nt, Mycobacterium avium subsp. paratuberculosis
gucguccgacaggaugcuggg

SEQ ID NO: 880576 - RNA, 18 nt, Mycobacterium avium subsp. paratuberculosis
gucguccgcaaccgccgg

SEQ ID NO: 880577 - RNA, 20 nt, Mycobacterium avium subsp. paratuberculosis
gucguccgcaaccgccggca

SEQ ID NO: 880578 - RNA, 14 nt, Mycobacterium avium subsp. paratuberculosis
gucguccucgguca

SEQ ID NO: 880579 - RNA, 15 nt, Mycobacterium avium subsp. paratuberculosis
gucguccucggucag

SEQ ID NO: 880580 - RNA, 19 nt, Mycobacterium avium subsp. paratuberculosis
gucguccucguucuggccc

SEQ ID NO: 880581 - RNA, 16 nt, Mycobacterium avium subsp. paratuberculosis
gucguccucccggccg

SEQ ID NO: 880582 - RNA, 17 nt, Mycobacterium avium subsp. paratuberculosis
gucguccucccggccga

SEQ ID NO: 880583 - RNA, 20 nt, Mycobacterium avium subsp. paratuberculosis
gucguccucccggccgacga

SEQ ID NO: 880584 - RNA, 18 nt, Mycobacterium avium subsp. paratuberculosis
gucgguguagucggcgau

SEQ ID NO: 880585 - RNA, 11 nt, Mycobacterium avium subsp. paratuberculosis
gucggugucga

SEQ ID NO: 880586 - RNA, 14 nt, Mycobacterium avium subsp. paratuberculosis
gucggugucgaaga

SEQ ID NO: 880587 - RNA, 19 nt, Mycobacterium avium subsp. paratuberculosis
gucggugucgaagacgguc

SEQ ID NO: 880588 - RNA, 20 nt, Mycobacterium avium subsp. paratuberculosis
gucggugucgaaguacgccg

SEQ ID NO: 880589 - RNA, 15 nt, Mycobacterium avium subsp. paratuberculosis
gucggugugagcggu

SEQ ID NO: 880590 - RNA, 16 nt, Mycobacterium avium subsp. paratuberculosis
gucggugugcagcagc

SEQ ID NO: 880591 - RNA, 22 nt, Mycobacterium avium subsp. paratuberculosis
gucggugugcagcagcucggcg

SEQ ID NO: 880592 - RNA, 23 nt, Mycobacterium avium subsp. paratuberculosis
gucggugugcagcagcucggcga

SEQ ID NO: 880593 - RNA, 18 nt, Mycobacterium avium subsp. paratuberculosis
gucgguggugaucgcggc

SEQ ID NO: 880594 - RNA, 14 nt, Mycobacterium avium subsp. paratuberculosis
gucggugaccugca

SEQ ID NO: 880595 - RNA, 18 nt, Mycobacterium avium subsp. paratuberculosis
gucggugggggccaggcg

SEQ ID NO: 880596 - RNA, 21 nt, Mycobacterium avium subsp. paratuberculosis
gucggugggggccaggcgggu

SEQ ID NO: 880597 - RNA, 13 nt, Mycobacterium avium subsp. paratuberculosis
gucgucgcggcgc

SEQ ID NO: 880598 - RNA, 23 nt, Mycobacterium avium subsp. paratuberculosis
gucgucgcuccacaucugccggc

SEQ ID NO: 880599 - RNA, 20 nt, Mycobacterium avium subsp. paratuberculosis
gucgucgcugacgccgagca

SEQ ID NO: 880600 - RNA, 21 nt, Mycobacterium avium subsp. paratuberculosis
gucgucggacaccagcauggc

SEQ ID NO: 880601 - RNA, 14 nt, Mycobacterium avium subsp. paratuberculosis
gucgucggacagca

SEQ ID NO: 880602 - RNA, 22 nt, Mycobacterium avium subsp. paratuberculosis
gucgucggacagcagcaccggc

SEQ ID NO: 880603 - RNA, 24 nt, Mycobacterium avium subsp. paratuberculosis
gucgucggacagcagcaccggcac

SEQ ID NO: 880604 - RNA, 18 nt, Mycobacterium avium subsp. paratuberculosis
gucgucggagacguugcc

SEQ ID NO: 880605 - RNA, 14 nt, Mycobacterium avium subsp. paratuberculosis
gucgugcacgccgu

SEQ ID NO: 880606 - RNA, 20 nt, Mycobacterium avium subsp. paratuberculosis
gucgucggccaguucaccgc

SEQ ID NO: 880607 - RNA, 17 nt, Mycobacterium avium subsp. paratuberculosis
gucgucgcuguccucga

SEQ ID NO: 880608 - RNA, 15 nt, Mycobacterium avium subsp. paratuberculosis
gucgucggcccaguc

SEQ ID NO: 880609 - RNA, 19 nt, Mycobacterium avium subsp. paratuberculosis
gucgucggcccaguccagu

SEQ ID NO: 880610 - RNA, 23 nt, Mycobacterium avium subsp. paratuberculosis
gucgucggccgggccggcgguga

SEQ ID NO: 880611 - RNA, 19 nt, Mycobacterium avium subsp. paratuberculosis
gucgugcaccacgacgucg

SEQ ID NO: 880612 - RNA, 22 nt, Mycobacterium avium subsp. paratuberculosis
gucgucgcggccaacgcccacc

SEQ ID NO: 880613 - RNA, 15 nt, Mycobacterium avium subsp. paratuberculosis
gucgucgccgguggc

SEQ ID NO: 880614 - RNA, 18 nt, Mycobacterium avium subsp. paratuberculosis
gucgucgccgguggccgc

SEQ ID NO: 880615 - RNA, 21 nt, Mycobacterium avium subsp. paratuberculosis
gucgucgccguggcggcccga

SEQ ID NO: 880616 - RNA, 14 nt, Mycobacterium avium subsp. paratuberculosis
gucgucgcgcaccc

SEQ ID NO: 880617 - RNA, 14 nt, Mycobacterium avium subsp. paratuberculosis
gucgucgcgcaggu

SEQ ID NO: 880618 - RNA, 12 nt, Mycobacterium avium subsp. paratuberculosis
gucgucgccgaa

SEQ ID NO: 880619 - RNA, 14 nt, Mycobacterium avium subsp. paratuberculosis
gucgucgccgccgg

SEQ ID NO: 880620 - RNA, 13 nt, Mycobacterium avium subsp. paratuberculosis
gucgucgccggcc

SEQ ID NO: 880621 - RNA, 18 nt, Mycobacterium avium subsp. paratuberculosis
gucgucgaacgcggcgaa

SEQ ID NO: 880622 - RNA, 22 nt, Mycobacterium avium subsp. paratuberculosis
gucgucgaacucgaugggggug

SEQ ID NO: 880623 - RNA, 20 nt, Mycobacterium avium subsp. paratuberculosis
gucgucgaagagcuggucgc

SEQ ID NO: 880624 - RNA, 20 nt, Mycobacterium avium subsp. paratuberculosis
gucgucgcccacccgccagc

SEQ ID NO: 880625 - RNA, 14 nt, Mycobacterium avium subsp. paratuberculosis
gucgucgcccaccg

SEQ ID NO: 880626 - RNA, 23 nt, Mycobacterium avium subsp. paratuberculosis
gucgucgcccaccgacgcggcgg

SEQ ID NO: 880627 - RNA, 22 nt, Mycobacterium avium subsp. paratuberculosis
gucggcgugauaggccucgugg

SEQ ID NO: 880628 - RNA, 19 nt, Mycobacterium avium subsp. paratuberculosis
gucggcgugaucccgaucc

SEQ ID NO: 880629 - RNA, 18 nt, Mycobacterium avium subsp. paratuberculosis
gucggcgucgaucgccgu

SEQ ID NO: 880630 - RNA, 20 nt, Mycobacterium avium subsp. paratuberculosis
gucggcgucgaucgccguca

SEQ ID NO: 880631 - RNA, 21 nt, Mycobacterium avium subsp. paratuberculosis
gucggcgucgaucgccgucac

SEQ ID NO: 880632 - RNA, 14 nt, Mycobacterium avium subsp. paratuberculosis
gucggcgucgaugu

SEQ ID NO: 880633 - RNA, 14 nt, Mycobacterium avium subsp. paratuberculosis
gucggcgucgccga

SEQ ID NO: 880634 - RNA, 16 nt, Mycobacterium avium subsp. paratuberculosis
gucggcgucgccgagc

SEQ ID NO: 880635 - RNA, 16 nt, Mycobacterium avium subsp. paratuberculosis
gucggcgucgcggcgc

SEQ ID NO: 880636 - RNA, 13 nt, Mycobacterium avium subsp. paratuberculosis
gucggcgucggcc

SEQ ID NO: 880637 - RNA, 14 nt, Mycobacterium avium subsp. paratuberculosis
gucggcgucggcca

SEQ ID NO: 880638 - RNA, 19 nt, Mycobacterium avium subsp. paratuberculosis
gucggcgucggccaccgcg

SEQ ID NO: 880639 - RNA, 14 nt, Mycobacterium avium subsp. paratuberculosis
gucggcgucgggcc

SEQ ID NO: 880640 - RNA, 14 nt, Mycobacterium avium subsp. paratuberculosis
gucggcgucguaca

SEQ ID NO: 880641 - RNA, 18 nt, Mycobacterium avium subsp. paratuberculosis
gucggcgggagccggcgg

SEQ ID NO: 880642 - RNA, 19 nt, Mycobacterium avium subsp. paratuberculosis
gucggcgggagccggcggc

SEQ ID NO: 880643 - RNA, 22 nt, Mycobacterium avium subsp. paratuberculosis
gucggcgggagccggcggcggu

SEQ ID NO: 880644 - RNA, 19 nt, Mycobacterium avium subsp. paratuberculosis
gucggcguccagcgcggug

SEQ ID NO: 880645 - RNA, 20 nt, Mycobacterium avium subsp. paratuberculosis
gucggcguccagcgcgguga

SEQ ID NO: 880646 - RNA, 13 nt, Mycobacterium avium subsp. paratuberculosis
gucggcggcggcc

SEQ ID NO: 880647 - RNA, 15 nt, Mycobacterium avium subsp. paratuberculosis
gucggcggcggccug

SEQ ID NO: 880648 - RNA, 17 nt, Mycobacterium avium subsp. paratuberculosis
gucggcggcggccugca

SEQ ID NO: 880649 - RNA, 16 nt, Mycobacterium avium subsp. paratuberculosis
gucggcggcggcggcc

SEQ ID NO: 880650 - RNA, 17 nt, Mycobacterium avium subsp. paratuberculosis
gucggcggcggcggccg

SEQ ID NO: 880651 - RNA, 20 nt, Mycobacterium avium subsp. paratuberculosis
gucggcggcugaaccaccgc

SEQ ID NO: 880652 - RNA, 22 nt, Mycobacterium avium subsp. paratuberculosis
gucggcguccgugccguccggc

SEQ ID NO: 880653 - RNA, 14 nt, Mycobacterium avium subsp. paratuberculosis
gucggcgucgaacg

SEQ ID NO: 880654 - RNA, 14 nt, Mycobacterium avium subsp. paratuberculosis
gucggcucgcccgc

SEQ ID NO: 880655 - RNA, 18 nt, Mycobacterium avium subsp. paratuberculosis
gucggcucgcccgcgacu

SEQ ID NO: 880656 - RNA, 17 nt, Mycobacterium avium subsp. paratuberculosis
gucggcucgccugcgag

SEQ ID NO: 880657 - RNA, 16 nt, Mycobacterium avium subsp. paratuberculosis
gucgggacgucggcgc

SEQ ID NO: 880658 - RNA, 20 nt, Mycobacterium avium subsp. paratuberculosis
gucgggauagggcgcgucga

SEQ ID NO: 880659 - RNA, 14 nt, Mycobacterium avium subsp. paratuberculosis
gucggcgugcccgc

SEQ ID NO: 880660 - RNA, 16 nt, Mycobacterium avium subsp. paratuberculosis
gucggcgugcccgccg

SEQ ID NO: 880661 - RNA, 20 nt, Mycobacterium avium subsp. paratuberculosis
gucggcgugcccgccgacca

SEQ ID NO: 880662 - RNA, 17 nt, Mycobacterium avium subsp. paratuberculosis
gucggcgugcucgucgc

SEQ ID NO: 880663 - RNA, 17 nt, Mycobacterium avium subsp. paratuberculosis
gucggcguggccguccg

SEQ ID NO: 880664 - RNA, 17 nt, Mycobacterium avium subsp. paratuberculosis
gucggcguucagcggca

SEQ ID NO: 880665 - RNA, 19 nt, Mycobacterium avium subsp. paratuberculosis
gucggcguucagcggcacc

SEQ ID NO: 880666 - RNA, 20 nt, Mycobacterium avium subsp. paratuberculosis
gucggcguucagcggcaccg

SEQ ID NO: 880667 - RNA, 23 nt, Mycobacterium avium subsp. paratuberculosis
gucggcguucagcggcaccguca

SEQ ID NO: 880668 - RNA, 18 nt, Mycobacterium avium subsp. paratuberculosis
gucggcggccgacccugc

SEQ ID NO: 880669 - RNA, 13 nt, Mycobacterium avium subsp. paratuberculosis
gucggcggccggg

SEQ ID NO: 880670 - RNA, 11 nt, Mycobacterium avium subsp. paratuberculosis
gucggcggccu

SEQ ID NO: 880671 - RNA, 21 nt, Mycobacterium avium subsp. paratuberculosis
gucggcggccuuuuccggcga

SEQ ID NO: 880672 - RNA, 17 nt, Mycobacterium avium subsp. paratuberculosis
gucggcggcgacgugcc

SEQ ID NO: 880673 - RNA, 13 nt, Mycobacterium avium subsp. paratuberculosis
gucggcggcgagg

SEQ ID NO: 880674 - RNA, 19 nt, Mycobacterium avium subsp. paratuberculosis
gucggcgcuuuccaccucg

SEQ ID NO: 880675 - RNA, 23 nt, Mycobacterium avium subsp. paratuberculosis
gucggcgcuuuccaccucgagca

SEQ ID NO: 880676 - RNA, 23 nt, Mycobacterium avium subsp. paratuberculosis
gucggcggaggcgaaugcggcca

SEQ ID NO: 880677 - RNA, 14 nt, Mycobacterium avium subsp. paratuberculosis
gucggcgcgggcca

SEQ ID NO: 880678 - RNA, 20 nt, Mycobacterium avium subsp. paratuberculosis
gucggcgcgggccagcagca

SEQ ID NO: 880679 - RNA, 14 nt, Mycobacterium avium subsp. paratuberculosis
gucggcgcggcgac

SEQ ID NO: 880680 - RNA, 18 nt, Mycobacterium avium subsp. paratuberculosis
gucggcgcggggccacca

SEQ ID NO: 880681 - RNA, 14 nt, Mycobacterium avium subsp. paratuberculosis
gucggcgcgguugu

SEQ ID NO: 880682 - RNA, 13 nt, Mycobacterium avium subsp. paratuberculosis
gucggcgcgucgu

SEQ ID NO: 880683 - RNA, 21 nt, Mycobacterium avium subsp. paratuberculosis
gucggcgcgucguacaccucg

SEQ ID NO: 880684 - RNA, 14 nt, Mycobacterium avium subsp. paratuberculosis
gucggcgcgugcca

SEQ ID NO: 880685 - RNA, 16 nt, Mycobacterium avium subsp. paratuberculosis
gucggcgcguuggccg

SEQ ID NO: 880686 - RNA, 17 nt, Mycobacterium avium subsp. paratuberculosis
gucggcgcucgcgggug

SEQ ID NO: 880687 - RNA, 18 nt, Mycobacterium avium subsp. paratuberculosis
gucggcgcggccggaucg

SEQ ID NO: 880688 - RNA, 16 nt, Mycobacterium avium subsp. paratuberculosis
gucggcgcggacguga

SEQ ID NO: 880689 - RNA, 15 nt, Mycobacterium avium subsp. paratuberculosis
gucggcgcgcaccgc

SEQ ID NO: 880690 - RNA, 16 nt, Mycobacterium avium subsp. paratuberculosis
gucggcgcgcaccgcg

SEQ ID NO: 880691 - RNA, 14 nt, Mycobacterium avium subsp. paratuberculosis
gucggcgcgcaggc

SEQ ID NO: 880692 - RNA, 16 nt, Mycobacterium avium subsp. paratuberculosis
gucggcgcgccacccg

SEQ ID NO: 880693 - RNA, 17 nt, Mycobacterium avium subsp. paratuberculosis
gucggcgcgccacccga

SEQ ID NO: 880694 - RNA, 13 nt, Mycobacterium avium subsp. paratuberculosis
gucgggccgcacu

SEQ ID NO: 880695 - RNA, 23 nt, Mycobacterium avium subsp. paratuberculosis
gucgggccgcacuccgucgcgau

SEQ ID NO: 880696 - RNA, 18 nt, Mycobacterium avium subsp. paratuberculosis
gucgggcagugcacgacg

SEQ ID NO: 880697 - RNA, 16 nt, Mycobacterium avium subsp. paratuberculosis
gucgggcaugccggcc

SEQ ID NO: 880698 - RNA, 18 nt, Mycobacterium avium subsp. paratuberculosis
gucgggcaugccggccgg

SEQ ID NO: 880699 - RNA, 19 nt, Mycobacterium avium subsp. paratuberculosis
gucgggcaugccggccggc

SEQ ID NO: 880700 - RNA, 16 nt, Mycobacterium avium subsp. paratuberculosis
gucgggcaaucggacc

SEQ ID NO: 880701 - RNA, 18 nt, Mycobacterium avium subsp. paratuberculosis
gucgggcaaucggaccca

SEQ ID NO: 880702 - RNA, 23 nt, Mycobacterium avium subsp. paratuberculosis
gucgggcagcagcuccaucgacg

SEQ ID NO: 880703 - RNA, 18 nt, Mycobacterium avium subsp. paratuberculosis
gucgggcacagccagcgc

SEQ ID NO: 880704 - RNA, 15 nt, Mycobacterium avium subsp. paratuberculosis
gucgggcacaucccg

SEQ ID NO: 880705 - RNA, 17 nt, Mycobacterium avium subsp. paratuberculosis
gucgggcacaucccgca

SEQ ID NO: 880706 - RNA, 14 nt, Mycobacterium avium subsp. paratuberculosis
gucgggcaccacgg

SEQ ID NO: 880707 - RNA, 16 nt, Mycobacterium avium subsp. paratuberculosis
gucgggcaccacggcg

SEQ ID NO: 880708 - RNA, 17 nt, Mycobacterium avium subsp. paratuberculosis
gucgggcaccacggcgg

SEQ ID NO: 880709 - RNA, 19 nt, Mycobacterium avium subsp. paratuberculosis
gucgggcaccacggcggca

SEQ ID NO: 880710 - RNA, 19 nt, Mycobacterium avium subsp. paratuberculosis
gucgggcaccagcaccgag

SEQ ID NO: 880711 - RNA, 14 nt, Mycobacterium avium subsp. paratuberculosis
gucgggcaccgcca

SEQ ID NO: 880712 - RNA, 15 nt, Mycobacterium avium subsp. paratuberculosis
gucgggcaccgccag

SEQ ID NO: 880713 - RNA, 17 nt, Mycobacterium avium subsp. paratuberculosis
gucgggcgggguggcca

SEQ ID NO: 880714 - RNA, 16 nt, Mycobacterium avium subsp. paratuberculosis
gucgggcguugcgcuc

SEQ ID NO: 880715 - RNA, 13 nt, Mycobacterium avium subsp. paratuberculosis
gucgggcucgcgg

SEQ ID NO: 880716 - RNA, 14 nt, Mycobacterium avium subsp. paratuberculosis
gucgggcucggccg

SEQ ID NO: 880717 - RNA, 16 nt, Mycobacterium avium subsp. paratuberculosis
gucgggcucgucguga

SEQ ID NO: 880718 - RNA, 11 nt, Mycobacterium avium subsp. paratuberculosis
gucgggcgcgg

SEQ ID NO: 880719 - RNA, 16 nt, Mycobacterium avium subsp. paratuberculosis
gucgggcgcggcggca

SEQ ID NO: 880720 - RNA, 17 nt, Mycobacterium avium subsp. paratuberculosis
gucgggcgcggcggcaa

SEQ ID NO: 880721 - RNA, 15 nt, Mycobacterium avium subsp. paratuberculosis
gucgggcccgccccu

SEQ ID NO: 880722 - RNA, 14 nt, Mycobacterium avium subsp. paratuberculosis
gucgggcgccagcc

SEQ ID NO: 880723 - RNA, 14 nt, Mycobacterium avium subsp. paratuberculosis
gucgggccgcgggc

SEQ ID NO: 880724 - RNA, 17 nt, Mycobacterium avium subsp. paratuberculosis
gucgggccguccgccgg

SEQ ID NO: 880725 - RNA, 19 nt, Mycobacterium avium subsp. paratuberculosis
gucgggccguccgccggcu

SEQ ID NO: 880726 - RNA, 15 nt, Mycobacterium avium subsp. paratuberculosis
gucggucagucgcgc

SEQ ID NO: 880727 - RNA, 18 nt, Mycobacterium avium subsp. paratuberculosis
gucggucagucgcgccgc

SEQ ID NO: 880728 - RNA, 15 nt, Mycobacterium avium subsp. paratuberculosis
gucgguccagguggc

SEQ ID NO: 880729 - RNA, 14 nt, Mycobacterium avium subsp. paratuberculosis
gucggucccgacgc

SEQ ID NO: 880730 - RNA, 21 nt, Mycobacterium avium subsp. paratuberculosis
gucggucccgacgcggcgcga

SEQ ID NO: 880731 - RNA, 22 nt, Mycobacterium avium subsp. paratuberculosis
gucggucggcaggauccggacg

SEQ ID NO: 880732 - RNA, 18 nt, Mycobacterium avium subsp. paratuberculosis
gucggucggcccgcugcg

SEQ ID NO: 880733 - RNA, 15 nt, Mycobacterium avium subsp. paratuberculosis
gucggucggccgcac

SEQ ID NO: 880734 - RNA, 23 nt, Mycobacterium avium subsp. paratuberculosis
gucggucaggcacucgaucagca

SEQ ID NO: 880735 - RNA, 21 nt, Mycobacterium avium subsp. paratuberculosis
gucggggaauuccggcgcgau

SEQ ID NO: 880736 - RNA, 19 nt, Mycobacterium avium subsp. paratuberculosis
gucggggacgaagaccggg

SEQ ID NO: 880737 - RNA, 16 nt, Mycobacterium avium subsp. paratuberculosis
gucggggagccgaaga

SEQ ID NO: 880738 - RNA, 15 nt, Mycobacterium avium subsp. paratuberculosis
gucggugaacgccgg

SEQ ID NO: 880739 - RNA, 16 nt, Mycobacterium avium subsp. paratuberculosis
gucggugaacucgucc

SEQ ID NO: 880740 - RNA, 18 nt, Mycobacterium avium subsp. paratuberculosis
gucggugaagugccggcu

SEQ ID NO: 880741 - RNA, 19 nt, Mycobacterium avium subsp. paratuberculosis
gucggugaaguuggcggcg

SEQ ID NO: 880742 - RNA, 14 nt, Mycobacterium avium subsp. paratuberculosis
gucggugaccaccu

SEQ ID NO: 880743 - RNA, 20 nt, Mycobacterium avium subsp. paratuberculosis
gucggugaccacggucggcg

SEQ ID NO: 880744 - RNA, 21 nt, Mycobacterium avium subsp. paratuberculosis
gucggugaccacggucggcgg

SEQ ID NO: 880745 - RNA, 22 nt, Mycobacterium avium subsp. paratuberculosis
gucggugaccacggucggcggg

SEQ ID NO: 880746 - RNA, 23 nt, Mycobacterium avium subsp. paratuberculosis
gucggugacgcccuuguccucga

SEQ ID NO: 880747 - RNA, 14 nt, Mycobacterium avium subsp. paratuberculosis
gucggugagcaccg

SEQ ID NO: 880748 - RNA, 14 nt, Mycobacterium avium subsp. paratuberculosis
gucgguggccacca

SEQ ID NO: 880749 - RNA, 20 nt, Mycobacterium avium subsp. paratuberculosis
gucgguggcccagccggccg

SEQ ID NO: 880750 - RNA, 11 nt, Mycobacterium avium subsp. paratuberculosis
gucgguggccg

SEQ ID NO: 880751 - RNA, 14 nt, Mycobacterium avium subsp. paratuberculosis
gucgguggcgcgca

SEQ ID NO: 880752 - RNA, 13 nt, Mycobacterium avium subsp. paratuberculosis
gucgguggcggcg

SEQ ID NO: 880753 - RNA, 19 nt, Mycobacterium avium subsp. paratuberculosis
gucgguggcggcggcgacg

SEQ ID NO: 880754 - RNA, 18 nt, Mycobacterium avium subsp. paratuberculosis
gucgguggcggugccgcg

SEQ ID NO: 880755 - RNA, 19 nt, Mycobacterium avium subsp. paratuberculosis
gucgguggcggugccgcgg

SEQ ID NO: 880756 - RNA, 20 nt, Mycobacterium avium subsp. paratuberculosis
gucggugggcagcucgucgg

SEQ ID NO: 880757 - RNA, 23 nt, Mycobacterium avium subsp. paratuberculosis
gucggugggcagcucgucggcgc

SEQ ID NO: 880758 - RNA, 14 nt, Mycobacterium avium subsp. paratuberculosis
gucggugggccgcc

SEQ ID NO: 880759 - RNA, 18 nt, Mycobacterium avium subsp. paratuberculosis
gucggugggccgccgcgg

SEQ ID NO: 880760 - RNA, 18 nt, Mycobacterium avium subsp. paratuberculosis
gucggcgaccgcgcgcgg

SEQ ID NO: 880761 - RNA, 22 nt, Mycobacterium avium subsp. paratuberculosis
gucggcgagcagcagcgcggug

SEQ ID NO: 880762 - RNA, 17 nt, Mycobacterium avium subsp. paratuberculosis
gucggcgagcagccgcg

SEQ ID NO: 880763 - RNA, 19 nt, Mycobacterium avium subsp. paratuberculosis
gucggcgagcagccgcgcc

SEQ ID NO: 880764 - RNA, 20 nt, Mycobacterium avium subsp. paratuberculosis
gucggcgagcagccgcgccg

SEQ ID NO: 880765 - RNA, 15 nt, Mycobacterium avium subsp. paratuberculosis
gucggcgagcagcug

SEQ ID NO: 880766 - RNA, 16 nt, Mycobacterium avium subsp. paratuberculosis
gucggcgacgccgucg

SEQ ID NO: 880767 - RNA, 20 nt, Mycobacterium avium subsp. paratuberculosis
gucggcgacgccgucggggu

SEQ ID NO: 880768 - RNA, 13 nt, Mycobacterium avium subsp. paratuberculosis
gucggcgacggcg

SEQ ID NO: 880769 - RNA, 17 nt, Mycobacterium avium subsp. paratuberculosis
gucggcgacggcgcuca

SEQ ID NO: 880770 - RNA, 22 nt, Mycobacterium avium subsp. paratuberculosis
gucggcgacggcgcucaccggc

SEQ ID NO: 880771 - RNA, 23 nt, Mycobacterium avium subsp. paratuberculosis
gucggcgacggcggggugcgcgg

SEQ ID NO: 880772 - RNA, 17 nt, Mycobacterium avium subsp. paratuberculosis
gucggcgagcuuggcgg

SEQ ID NO: 880773 - RNA, 22 nt, Mycobacterium avium subsp. paratuberculosis
gucggcgagcuuguccugcacc

SEQ ID NO: 880774 - RNA, 13 nt, Mycobacterium avium subsp. paratuberculosis
gucggcgaucagc

SEQ ID NO: 880775 - RNA, 17 nt, Mycobacterium avium subsp. paratuberculosis
gucggcgaucagcuccu

SEQ ID NO: 880776 - RNA, 11 nt, Mycobacterium avium subsp. paratuberculosis
gucggcgaucc

SEQ ID NO: 880777 - RNA, 20 nt, Mycobacterium avium subsp. paratuberculosis
gucggcgauccacgccuccg

SEQ ID NO: 880778 - RNA, 15 nt, Mycobacterium avium subsp. paratuberculosis
gucggcgaucgccag

SEQ ID NO: 880779 - RNA, 16 nt, Mycobacterium avium subsp. paratuberculosis
gucggcgaaggcgcgc

SEQ ID NO: 880780 - RNA, 17 nt, Mycobacterium avium subsp. paratuberculosis
gucggcgaaggcgcgca

SEQ ID NO: 880781 - RNA, 15 nt, Mycobacterium avium subsp. paratuberculosis
gucggcgaacggcca

SEQ ID NO: 880782 - RNA, 17 nt, Mycobacterium avium subsp. paratuberculosis
gucggcgaacggccagu

SEQ ID NO: 880783 - RNA, 23 nt, Mycobacterium avium subsp. paratuberculosis
gucggcgaacuccagaucgccgc

SEQ ID NO: 880784 - RNA, 20 nt, Mycobacterium avium subsp. paratuberculosis
gucggcgaacugcuugauca

SEQ ID NO: 880785 - RNA, 19 nt, Mycobacterium avium subsp. paratuberculosis
gucggcgaaccguucgucg

SEQ ID NO: 880786 - RNA, 22 nt, Mycobacterium avium subsp. paratuberculosis
gucggcgaacgcccggucgaug

SEQ ID NO: 880787 - RNA, 19 nt, Mycobacterium avium subsp. paratuberculosis
gucggcgaaccagggcagc

SEQ ID NO: 880788 - RNA, 24 nt, Mycobacterium avium subsp. paratuberculosis
gucggcgaaccagggcagccagcc

SEQ ID NO: 880789 - RNA, 17 nt, Mycobacterium avium subsp. paratuberculosis
gucggcgaaggugcccc

SEQ ID NO: 880790 - RNA, 15 nt, Mycobacterium avium subsp. paratuberculosis
gucggcgaagguguc

SEQ ID NO: 880791 - RNA, 14 nt, Mycobacterium avium subsp. paratuberculosis
gucggcgaccaugc

SEQ ID NO: 880792 - RNA, 21 nt, Mycobacterium avium subsp. paratuberculosis
gucggcgaccaugccguagcg

SEQ ID NO: 880793 - RNA, 15 nt, Mycobacterium avium subsp. paratuberculosis
gucggcgacccgcac

SEQ ID NO: 880794 - RNA, 16 nt, Mycobacterium avium subsp. paratuberculosis
gucggcgacccgcacg

SEQ ID NO: 880795 - RNA, 14 nt, Mycobacterium avium subsp. paratuberculosis
gucggcgccgcgcc

SEQ ID NO: 880796 - RNA, 15 nt, Mycobacterium avium subsp. paratuberculosis
gucggcgccgcgccg

SEQ ID NO: 880797 - RNA, 18 nt, Mycobacterium avium subsp. paratuberculosis
gucggcgccgcgccggca

SEQ ID NO: 880798 - RNA, 16 nt, Mycobacterium avium subsp. paratuberculosis
gucggcgccgcgcgcc

SEQ ID NO: 880799 - RNA, 19 nt, Mycobacterium avium subsp. paratuberculosis
gucggcgccggaucggccc

SEQ ID NO: 880800 - RNA, 23 nt, Mycobacterium avium subsp. paratuberculosis
gucggcgcccagaucggccagcc

SEQ ID NO: 880801 - RNA, 22 nt, Mycobacterium avium subsp. paratuberculosis
gucggcgccgaucacgccggug

SEQ ID NO: 880802 - RNA, 15 nt, Mycobacterium avium subsp. paratuberculosis
gucggcgccgaugca

SEQ ID NO: 880803 - RNA, 19 nt, Mycobacterium avium subsp. paratuberculosis
gucggcgccgaugcagcac

SEQ ID NO: 880804 - RNA, 13 nt, Mycobacterium avium subsp. paratuberculosis
gucggcgccggcc

SEQ ID NO: 880805 - RNA, 14 nt, Mycobacterium avium subsp. paratuberculosis
gucggcgccggcca

SEQ ID NO: 880806 - RNA, 16 nt, Mycobacterium avium subsp. paratuberculosis
gucggcgccggccagc

SEQ ID NO: 880807 - RNA, 17 nt, Mycobacterium avium subsp. paratuberculosis
gucggcgccggccagcg

SEQ ID NO: 880808 - RNA, 19 nt, Mycobacterium avium subsp. paratuberculosis
gucggcgccggccagcggc

SEQ ID NO: 880809 - RNA, 15 nt, Mycobacterium avium subsp. paratuberculosis
gucggcgccggcgcg

SEQ ID NO: 880810 - RNA, 14 nt, Mycobacterium avium subsp. paratuberculosis
gucggcgccccgcc

SEQ ID NO: 880811 - RNA, 23 nt, Mycobacterium avium subsp. paratuberculosis
gucggcgcccggcccagccgcug

SEQ ID NO: 880812 - RNA, 16 nt, Mycobacterium avium subsp. paratuberculosis
gucggcgccgccgagc

SEQ ID NO: 880813 - RNA, 22 nt, Mycobacterium avium subsp. paratuberculosis
gucggcgcgaggcggguaggcg

SEQ ID NO: 880814 - RNA, 16 nt, Mycobacterium avium subsp. paratuberculosis
gucggcgcccucggcg

SEQ ID NO: 880815 - RNA, 18 nt, Mycobacterium avium subsp. paratuberculosis
gucggcgcccucggcgau

SEQ ID NO: 880816 - RNA, 20 nt, Mycobacterium avium subsp. paratuberculosis
gucggcgcccucggcgaucu

SEQ ID NO: 880817 - RNA, 14 nt, Mycobacterium avium subsp. paratuberculosis
gucggcgccgacgg

SEQ ID NO: 880818 - RNA, 15 nt, Mycobacterium avium subsp. paratuberculosis
gucggcgccgacggc

SEQ ID NO: 880819 - RNA, 20 nt, Mycobacterium avium subsp. paratuberculosis
gucggcgccgacggccagca

SEQ ID NO: 880820 - RNA, 24 nt, Mycobacterium avium subsp. paratuberculosis
gucggcgcagcgcacgucgccgcc

SEQ ID NO: 880821 - RNA, 17 nt, Mycobacterium avium subsp. paratuberculosis
gucggcgaugccggaaa

SEQ ID NO: 880822 - RNA, 16 nt, Mycobacterium avium subsp. paratuberculosis
gucggcgaugcgcacc

SEQ ID NO: 880823 - RNA, 23 nt, Mycobacterium avium subsp. paratuberculosis
gucggcgauguccuugucgcuca

SEQ ID NO: 880824 - RNA, 18 nt, Mycobacterium avium subsp. paratuberculosis
gucggcgaucgccagcac

SEQ ID NO: 880825 - RNA, 22 nt, Mycobacterium avium subsp. paratuberculosis
gucggcgaucgccagcacggug

SEQ ID NO: 880826 - RNA, 18 nt, Mycobacterium avium subsp. paratuberculosis
gucggcgaucgccgggga

SEQ ID NO: 880827 - RNA, 17 nt, Mycobacterium avium subsp. paratuberculosis
gucggcgaucgcgcgca

SEQ ID NO: 880828 - RNA, 17 nt, Mycobacterium avium subsp. paratuberculosis
gucggcgaucucgguca

SEQ ID NO: 880829 - RNA, 18 nt, Mycobacterium avium subsp. paratuberculosis
gucggcgaucucggucac

SEQ ID NO: 880830 - RNA, 23 nt, Mycobacterium avium subsp. paratuberculosis
gucggcgaucucggucaccgagc

SEQ ID NO: 880831 - RNA, 18 nt, Mycobacterium avium subsp. paratuberculosis
gucggccaucagcaccga

SEQ ID NO: 880832 - RNA, 14 nt, Mycobacterium avium subsp. paratuberculosis
gucggccaucagcc

SEQ ID NO: 880833 - RNA, 17 nt, Mycobacterium avium subsp. paratuberculosis
gucggccaucagccgcc

SEQ ID NO: 880834 - RNA, 19 nt, Mycobacterium avium subsp. paratuberculosis
gucggccaucagccgccgu

SEQ ID NO: 880835 - RNA, 19 nt, Mycobacterium avium subsp. paratuberculosis
gucggccaguucgccggug

SEQ ID NO: 880836 - RNA, 20 nt, Mycobacterium avium subsp. paratuberculosis
gucggccaguucgccgguga

SEQ ID NO: 880837 - RNA, 18 nt, Mycobacterium avium subsp. paratuberculosis
gucggcccagacgauguc

SEQ ID NO: 880838 - RNA, 24 nt, Mycobacterium avium subsp. paratuberculosis
gucggcccagacgaugucgucgcc

SEQ ID NO: 880839 - RNA, 12 nt, Mycobacterium avium subsp. paratuberculosis
gucggcccaggc

SEQ ID NO: 880840 - RNA, 17 nt, Mycobacterium avium subsp. paratuberculosis
gucggccgcggccggcg

SEQ ID NO: 880841 - RNA, 18 nt, Mycobacterium avium subsp. paratuberculosis
gucggccgcggccggcgg

SEQ ID NO: 880842 - RNA, 19 nt, Mycobacterium avium subsp. paratuberculosis
gucggccgcggccggcggc

SEQ ID NO: 880843 - RNA, 12 nt, Mycobacterium avium subsp. paratuberculosis
gucggccgcacg

SEQ ID NO: 880844 - RNA, 20 nt, Mycobacterium avium subsp. paratuberculosis
gucggccgcacgucccgccc

SEQ ID NO: 880845 - RNA, 12 nt, Mycobacterium avium subsp. paratuberculosis
gucggccccgcg

SEQ ID NO: 880846 - RNA, 20 nt, Mycobacterium avium subsp. paratuberculosis
gucggcccgaucgcgucgac

SEQ ID NO: 880847 - RNA, 13 nt, Mycobacterium avium subsp. paratuberculosis
gucggcccgccgg

SEQ ID NO: 880848 - RNA, 15 nt, Mycobacterium avium subsp. paratuberculosis
gucggcccacgguga

SEQ ID NO: 880849 - RNA, 19 nt, Mycobacterium avium subsp. paratuberculosis
gucggcccccagcgaggug

SEQ ID NO: 880850 - RNA, 17 nt, Mycobacterium avium subsp. paratuberculosis
gucggccuugaccagga

SEQ ID NO: 880851 - RNA, 15 nt, Mycobacterium avium subsp. paratuberculosis
gucggccuguccggu

SEQ ID NO: 880852 - RNA, 16 nt, Mycobacterium avium subsp. paratuberculosis
gucggccugcccgcgg

SEQ ID NO: 880853 - RNA, 20 nt, Mycobacterium avium subsp. paratuberculosis
gucggccugcccgcgggugg

SEQ ID NO: 880854 - RNA, 19 nt, Mycobacterium avium subsp. paratuberculosis
gucggccugcgcugcggcc

SEQ ID NO: 880855 - RNA, 20 nt, Mycobacterium avium subsp. paratuberculosis
gucggccugcgcugcggcca

SEQ ID NO: 880856 - RNA, 23 nt, Mycobacterium avium subsp. paratuberculosis
gucggccugcacgucggcgcgca

SEQ ID NO: 880857 - RNA, 14 nt, Mycobacterium avium subsp. paratuberculosis
gucggccucggcgg

SEQ ID NO: 880858 - RNA, 16 nt, Mycobacterium avium subsp. paratuberculosis
gucggccucggcggug

SEQ ID NO: 880859 - RNA, 13 nt, Mycobacterium avium subsp. paratuberculosis
gucggccucggcg

SEQ ID NO: 880860 - RNA, 13 nt, Mycobacterium avium subsp. paratuberculosis
gucggccgggggc

SEQ ID NO: 880861 - RNA, 15 nt, Mycobacterium avium subsp. paratuberculosis
gucggccgucggcgc

SEQ ID NO: 880862 - RNA, 16 nt, Mycobacterium avium subsp. paratuberculosis
gucggccgucggcgcc

SEQ ID NO: 880863 - RNA, 22 nt, Mycobacterium avium subsp. paratuberculosis
gucggccggcaggccgcccgac

SEQ ID NO: 880864 - RNA, 16 nt, Mycobacterium avium subsp. paratuberculosis
gucggccgggccggcg

SEQ ID NO: 880865 - RNA, 23 nt, Mycobacterium avium subsp. paratuberculosis
gucggccgcccguccgggccggc

SEQ ID NO: 880866 - RNA, 13 nt, Mycobacterium avium subsp. paratuberculosis
gucggccgccgac

SEQ ID NO: 880867 - RNA, 14 nt, Mycobacterium avium subsp. paratuberculosis
gucggccgccgacu

SEQ ID NO: 880868 - RNA, 19 nt, Mycobacterium avium subsp. paratuberculosis
gucggccgcgugcaccugu

SEQ ID NO: 880869 - RNA, 20 nt, Mycobacterium avium subsp. paratuberculosis
gucgcuuucggugaccauca

SEQ ID NO: 880870 - RNA, 21 nt, Mycobacterium avium subsp. paratuberculosis
gucgcuuugcggcgaaccggg

SEQ ID NO: 880871 - RNA, 20 nt, Mycobacterium avium subsp. paratuberculosis
gucgcuguuagccucgccag

SEQ ID NO: 880872 - RNA, 18 nt, Mycobacterium avium subsp. paratuberculosis
gucgcuguuggcgacggc

SEQ ID NO: 880873 - RNA, 20 nt, Mycobacterium avium subsp. paratuberculosis
gucgcuguuggcgacggcgc

SEQ ID NO: 880874 - RNA, 19 nt, Mycobacterium avium subsp. paratuberculosis
gucgcuguuggcgacggug

SEQ ID NO: 880875 - RNA, 15 nt, Mycobacterium avium subsp. paratuberculosis
gucgcugccgccgcc

SEQ ID NO: 880876 - RNA, 22 nt, Mycobacterium avium subsp. paratuberculosis
gucgcuguaggccagcccggcg

SEQ ID NO: 880877 - RNA, 14 nt, Mycobacterium avium subsp. paratuberculosis
gucgcugucggcga

SEQ ID NO: 880878 - RNA, 16 nt, Mycobacterium avium subsp. paratuberculosis
gucggacaugccggcg

SEQ ID NO: 880879 - RNA, 20 nt, Mycobacterium avium subsp. paratuberculosis
gucggacaugccggcgccga

SEQ ID NO: 880880 - RNA, 17 nt, Mycobacterium avium subsp. paratuberculosis
gucggacaccagcaugg

SEQ ID NO: 880881 - RNA, 16 nt, Mycobacterium avium subsp. paratuberculosis
gucggacagcagcacc

SEQ ID NO: 880882 - RNA, 17 nt, Mycobacterium avium subsp. paratuberculosis
gucggacagcagcaccg

SEQ ID NO: 880883 - RNA, 20 nt, Mycobacterium avium subsp. paratuberculosis
gucggaaacuuguucgagau

SEQ ID NO: 880884 - RNA, 13 nt, Mycobacterium avium subsp. paratuberculosis
gucggccagcugc

SEQ ID NO: 880885 - RNA, 16 nt, Mycobacterium avium subsp. paratuberculosis
gucggccagcugcggg

SEQ ID NO: 880886 - RNA, 19 nt, Mycobacterium avium subsp. paratuberculosis
gucggccaggaucucgcgg

SEQ ID NO: 880887 - RNA, 13 nt, Mycobacterium avium subsp. paratuberculosis
gucggccagcgcc

SEQ ID NO: 880888 - RNA, 14 nt, Mycobacterium avium subsp. paratuberculosis
gucggccagcgcgc

SEQ ID NO: 880889 - RNA, 19 nt, Mycobacterium avium subsp. paratuberculosis
gucggccagcgcgcgcagc

SEQ ID NO: 880890 - RNA, 20 nt, Mycobacterium avium subsp. paratuberculosis
gucggccagcgcgcgcagcg

SEQ ID NO: 880891 - RNA, 16 nt, Mycobacterium avium subsp. paratuberculosis
gucggccagcgcgcgg

SEQ ID NO: 880892 - RNA, 15 nt, Mycobacterium avium subsp. paratuberculosis
gucggccagcgcgug

SEQ ID NO: 880893 - RNA, 16 nt, Mycobacterium avium subsp. paratuberculosis
gucggccagcgcguga

SEQ ID NO: 880894 - RNA, 15 nt, Mycobacterium avium subsp. paratuberculosis
gucggccagcgccgc

SEQ ID NO: 880895 - RNA, 16 nt, Mycobacterium avium subsp. paratuberculosis
gucggccagcgccgcc

SEQ ID NO: 880896 - RNA, 17 nt, Mycobacterium avium subsp. paratuberculosis
gucggccagcgccgccc

SEQ ID NO: 880897 - RNA, 20 nt, Mycobacterium avium subsp. paratuberculosis
gucggccagcgccgcccggg

SEQ ID NO: 880898 - RNA, 21 nt, Mycobacterium avium subsp. paratuberculosis
gucggccagcgccgcccgggc

SEQ ID NO: 880899 - RNA, 16 nt, Mycobacterium avium subsp. paratuberculosis
gucggccagcgaaugg

SEQ ID NO: 880900 - RNA, 22 nt, Mycobacterium avium subsp. paratuberculosis
gucggccagcgaguccagccag

SEQ ID NO: 880901 - RNA, 13 nt, Mycobacterium avium subsp. paratuberculosis
gucggccagauag

SEQ ID NO: 880902 - RNA, 16 nt, Mycobacterium avium subsp. paratuberculosis
gucggccagcaccacc

SEQ ID NO: 880903 - RNA, 23 nt, Mycobacterium avium subsp. paratuberculosis
gucggccagcaggucgucgacgu

SEQ ID NO: 880904 - RNA, 14 nt, Mycobacterium avium subsp. paratuberculosis
gucggccaccgcgc

SEQ ID NO: 880905 - RNA, 14 nt, Mycobacterium avium subsp. paratuberculosis
gucggccacgccgg

SEQ ID NO: 880906 - RNA, 16 nt, Mycobacterium avium subsp. paratuberculosis
gucggccacguugccg

SEQ ID NO: 880907 - RNA, 13 nt, Mycobacterium avium subsp. paratuberculosis
gucggcaacccga

SEQ ID NO: 880908 - RNA, 14 nt, Mycobacterium avium subsp. paratuberculosis
gucggcaacccgac

SEQ ID NO: 880909 - RNA, 15 nt, Mycobacterium avium subsp. paratuberculosis
gucggcaacgccggg

SEQ ID NO: 880910 - RNA, 20 nt, Mycobacterium avium subsp. paratuberculosis
gucggcaaugaccggcacca

SEQ ID NO: 880911 - RNA, 14 nt, Mycobacterium avium subsp. paratuberculosis
gucggcaccagcgg

SEQ ID NO: 880912 - RNA, 15 nt, Mycobacterium avium subsp. paratuberculosis
gucggcaccagcggc

SEQ ID NO: 880913 - RNA, 23 nt, Mycobacterium avium subsp. paratuberculosis
gucggcaccagcggcaucgccgc

SEQ ID NO: 880914 - RNA, 18 nt, Mycobacterium avium subsp. paratuberculosis
gucggcaccuccugcacc

SEQ ID NO: 880915 - RNA, 23 nt, Mycobacterium avium subsp. paratuberculosis
gucgcugacgaugauccuggccu

SEQ ID NO: 880916 - RNA, 16 nt, Mycobacterium avium subsp. paratuberculosis
gucgcugacgccgagc

SEQ ID NO: 880917 - RNA, 20 nt, Mycobacterium avium subsp. paratuberculosis
gucgcugagcaauucgguga

SEQ ID NO: 880918 - RNA, 13 nt, Mycobacterium avium subsp. paratuberculosis
gucgcugaccacc

SEQ ID NO: 880919 - RNA, 12 nt, Mycobacterium avium subsp. paratuberculosis
gucgcugacccc

SEQ ID NO: 880920 - RNA, 18 nt, Mycobacterium avium subsp. paratuberculosis
gucgcugacccgccgcaa

SEQ ID NO: 880921 - RNA, 19 nt, Mycobacterium avium subsp. paratuberculosis
gucgcugacccgccgcaac

SEQ ID NO: 880922 - RNA, 15 nt, Mycobacterium avium subsp. paratuberculosis
gucgcugacccgggc

SEQ ID NO: 880923 - RNA, 17 nt, Mycobacterium avium subsp. paratuberculosis
gucgcugacccgggcgg

SEQ ID NO: 880924 - RNA, 22 nt, Mycobacterium avium subsp. paratuberculosis
gucgcugacccgggcggccugc

SEQ ID NO: 880925 - RNA, 13 nt, Mycobacterium avium subsp. paratuberculosis
gucgcugaucgcg

SEQ ID NO: 880926 - RNA, 16 nt, Mycobacterium avium subsp. paratuberculosis
gucgcugaucgcgauc

SEQ ID NO: 880927 - RNA, 22 nt, Mycobacterium avium subsp. paratuberculosis
gucgcugcaguagccggccagc

SEQ ID NO: 880928 - RNA, 24 nt, Mycobacterium avium subsp. paratuberculosis
gucgcugcccagauacgccgcgac

SEQ ID NO: 880929 - RNA, 14 nt, Mycobacterium avium subsp. paratuberculosis
gucgcugcccggcg

SEQ ID NO: 880930 - RNA, 16 nt, Mycobacterium avium subsp. paratuberculosis
gucgcugcccggcgug

SEQ ID NO: 880931 - RNA, 14 nt, Mycobacterium avium subsp. paratuberculosis
gucgcgucgucggc

SEQ ID NO: 880932 - RNA, 15 nt, Mycobacterium avium subsp. paratuberculosis
gucgcgucgucggcg

SEQ ID NO: 880933 - RNA, 16 nt, Mycobacterium avium subsp. paratuberculosis
gucgcgucgucggcgg

SEQ ID NO: 880934 - RNA, 21 nt, Mycobacterium avium subsp. paratuberculosis
gucgcgucgucggcgggcugc

SEQ ID NO: 880935 - RNA, 15 nt, Mycobacterium avium subsp. paratuberculosis
gucgcgucgugcggc

SEQ ID NO: 880936 - RNA, 21 nt, Mycobacterium avium subsp. paratuberculosis
gucgcgucgugcggccggcgc

SEQ ID NO: 880937 - RNA, 14 nt, Mycobacterium avium subsp. paratuberculosis
gucgcgugaccggc

SEQ ID NO: 880938 - RNA, 15 nt, Mycobacterium avium subsp. paratuberculosis
gucgcgugaccggcg

SEQ ID NO: 880939 - RNA, 17 nt, Mycobacterium avium subsp. paratuberculosis
gucgcgugaccggcggu

SEQ ID NO: 880940 - RNA, 16 nt, Mycobacterium avium subsp. paratuberculosis
gucgcguucccgggcc

SEQ ID NO: 880941 - RNA, 22 nt, Mycobacterium avium subsp. paratuberculosis
gucgcguucgacccacaccucg

SEQ ID NO: 880942 - RNA, 16 nt, Mycobacterium avium subsp. paratuberculosis
gucgcguccgcgaucg

SEQ ID NO: 880943 - RNA, 19 nt, Mycobacterium avium subsp. paratuberculosis
gucgcugaacgccccgugg

SEQ ID NO: 880944 - RNA, 14 nt, Mycobacterium avium subsp. paratuberculosis
gucgcugaacgcgu

SEQ ID NO: 880945 - RNA, 18 nt, Mycobacterium avium subsp. paratuberculosis
gucgcggccuugcgcacc

SEQ ID NO: 880946 - RNA, 19 nt, Mycobacterium avium subsp. paratuberculosis
gucgcggccuugcgcaccg

SEQ ID NO: 880947 - RNA, 22 nt, Mycobacterium avium subsp. paratuberculosis
gucgcggccuugcgcaccggag

SEQ ID NO: 880948 - RNA, 21 nt, Mycobacterium avium subsp. paratuberculosis
gucgcggccuccgagcggcgc

SEQ ID NO: 880949 - RNA, 15 nt, Mycobacterium avium subsp. paratuberculosis
gucgcggcccaccgc

SEQ ID NO: 880950 - RNA, 16 nt, Mycobacterium avium subsp. paratuberculosis
gucgcggcccaccgcg

SEQ ID NO: 880951 - RNA, 20 nt, Mycobacterium avium subsp. paratuberculosis
gucgcggcccaccgcgucgc

SEQ ID NO: 880952 - RNA, 23 nt, Mycobacterium avium subsp. paratuberculosis
gucgcguacgggaugaucagcag

SEQ ID NO: 880953 - RNA, 23 nt, Mycobacterium avium subsp. paratuberculosis
gucgcggugggcgcgggccgcgu

SEQ ID NO: 880954 - RNA, 19 nt, Mycobacterium avium subsp. paratuberculosis
gucgcggugggcucggcgc

SEQ ID NO: 880955 - RNA, 21 nt, Mycobacterium avium subsp. paratuberculosis
gucgcggugggcucggcgccg

SEQ ID NO: 880956 - RNA, 23 nt, Mycobacterium avium subsp. paratuberculosis
gucgcggugggcucggcgccgac

SEQ ID NO: 880957 - RNA, 16 nt, Mycobacterium avium subsp. paratuberculosis
gucgcggugucggcgu

SEQ ID NO: 880958 - RNA, 21 nt, Mycobacterium avium subsp. paratuberculosis
gucgcggugucggcgucgauc

SEQ ID NO: 880959 - RNA, 18 nt, Mycobacterium avium subsp. paratuberculosis
gucgcgguugaucacacc

SEQ ID NO: 880960 - RNA, 14 nt, Mycobacterium avium subsp. paratuberculosis
gucgcggcccagca

SEQ ID NO: 880961 - RNA, 15 nt, Mycobacterium avium subsp. paratuberculosis
gucgcggcccagcac

SEQ ID NO: 880962 - RNA, 18 nt, Mycobacterium avium subsp. paratuberculosis
gucgcggcccagcaccac

SEQ ID NO: 880963 - RNA, 18 nt, Mycobacterium avium subsp. paratuberculosis
gucgcggccaacgcccac

SEQ ID NO: 880964 - RNA, 17 nt, Mycobacterium avium subsp. paratuberculosis
gucgcggcaucccuggu

SEQ ID NO: 880965 - RNA, 19 nt, Mycobacterium avium subsp. paratuberculosis
gucgcggcaucccugguga

SEQ ID NO: 880966 - RNA, 20 nt, Mycobacterium avium subsp. paratuberculosis
gucgcggacccuggccagca

SEQ ID NO: 880967 - RNA, 23 nt, Mycobacterium avium subsp. paratuberculosis
gucgcggacccuggccagcaccg

SEQ ID NO: 880968 - RNA, 22 nt, Mycobacterium avium subsp. paratuberculosis
gucgcggacuggugggcgucgu

SEQ ID NO: 880969 - RNA, 20 nt, Mycobacterium avium subsp. paratuberculosis
gucgcggauacgcccggcca

SEQ ID NO: 880970 - RNA, 23 nt, Mycobacterium avium subsp. paratuberculosis
gucgcggauacgcccggccaccu

SEQ ID NO: 880971 - RNA, 19 nt, Mycobacterium avium subsp. paratuberculosis
gucgcggagaugcugguga

SEQ ID NO: 880972 - RNA, 17 nt, Mycobacterium avium subsp. paratuberculosis
gucgcccgcccaggccg

SEQ ID NO: 880973 - RNA, 18 nt, Mycobacterium avium subsp. paratuberculosis
gucgcccgcccaggccgc

SEQ ID NO: 880974 - RNA, 14 nt, Mycobacterium avium subsp. paratuberculosis
gucgcccgccgacg

SEQ ID NO: 880975 - RNA, 17 nt, Mycobacterium avium subsp. paratuberculosis
gucgcccgccgacggcu

SEQ ID NO: 880976 - RNA, 15 nt, Mycobacterium avium subsp. paratuberculosis
gucgcccccucggcc

SEQ ID NO: 880977 - RNA, 12 nt, Mycobacterium avium subsp. paratuberculosis
gucgccccgcac

SEQ ID NO: 880978 - RNA, 14 nt, Mycobacterium avium subsp. paratuberculosis
gucgccccggccgc

SEQ ID NO: 880979 - RNA, 18 nt, Mycobacterium avium subsp. paratuberculosis
gucgccccggccgcggug

SEQ ID NO: 880980 - RNA, 19 nt, Mycobacterium avium subsp. paratuberculosis
gucgccccggccgcgguga

SEQ ID NO: 880981 - RNA, 19 nt, Mycobacterium avium subsp. paratuberculosis
gucgcccagcgugucggcg

SEQ ID NO: 880982 - RNA, 16 nt, Mycobacterium avium subsp. paratuberculosis
gucgcccagcugggcc

SEQ ID NO: 880983 - RNA, 17 nt, Mycobacterium avium subsp. paratuberculosis
gucgcccagcugggcca

SEQ ID NO: 880984 - RNA, 17 nt, Mycobacterium avium subsp. paratuberculosis
gucgcccaucaccagca

SEQ ID NO: 880985 - RNA, 14 nt, Mycobacterium avium subsp. paratuberculosis
gucgcccggguugc

SEQ ID NO: 880986 - RNA, 20 nt, Mycobacterium avium subsp. paratuberculosis
gucgcccggguugcacaggu

SEQ ID NO: 880987 - RNA, 15 nt, Mycobacterium avium subsp. paratuberculosis
gucgcccgucucggc

SEQ ID NO: 880988 - RNA, 18 nt, Mycobacterium avium subsp. paratuberculosis
gucgcccgucucggcgug

SEQ ID NO: 880989 - RNA, 19 nt, Mycobacterium avium subsp. paratuberculosis
gucgcccgcguugcggcgc

SEQ ID NO: 880990 - RNA, 20 nt, Mycobacterium avium subsp. paratuberculosis
gucgcccgcguugcggcgca

SEQ ID NO: 880991 - RNA, 19 nt, Mycobacterium avium subsp. paratuberculosis
gucgcccggcgcggcaucg

SEQ ID NO: 880992 - RNA, 12 nt, Mycobacterium avium subsp. paratuberculosis
gucgcccggcgg

SEQ ID NO: 880993 - RNA, 16 nt, Mycobacterium avium subsp. paratuberculosis
gucgcccggcggcacc

SEQ ID NO: 880994 - RNA, 13 nt, Mycobacterium avium subsp. paratuberculosis
gucgcccggcguc

SEQ ID NO: 880995 - RNA, 23 nt, Mycobacterium avium subsp. paratuberculosis
gucgcccggcucgccgggcugca

SEQ ID NO: 880996 - RNA, 21 nt, Mycobacterium avium subsp. paratuberculosis
gucgccgacgggcccagcgcg

SEQ ID NO: 880997 - RNA, 16 nt, Mycobacterium avium subsp. paratuberculosis
gucgccgacgguggcg

SEQ ID NO: 880998 - RNA, 21 nt, Mycobacterium avium subsp. paratuberculosis
gucgccgacguagacgagccg

SEQ ID NO: 880999 - RNA, 23 nt, Mycobacterium avium subsp. paratuberculosis
gucgccgacguagacgagccggu

SEQ ID NO: 881000 - RNA, 23 nt, Mycobacterium avium subsp. paratuberculosis
gucgccgacucgcaggugccggu

SEQ ID NO: 881001 - RNA, 14 nt, Mycobacterium avium subsp. paratuberculosis
gucgccgacgccga

SEQ ID NO: 881002 - RNA, 14 nt, Mycobacterium avium subsp. paratuberculosis
gucgccgacgccgu

SEQ ID NO: 881003 - RNA, 15 nt, Mycobacterium avium subsp. paratuberculosis
gucgccgagccgcac

SEQ ID NO: 881004 - RNA, 17 nt, Mycobacterium avium subsp. paratuberculosis
gucgccgagccgcaccg

SEQ ID NO: 881005 - RNA, 18 nt, Mycobacterium avium subsp. paratuberculosis
gucgccgagccgcaccgc

SEQ ID NO: 881006 - RNA, 15 nt, Mycobacterium avium subsp. paratuberculosis
gucgccgagccgcgc

SEQ ID NO: 881007 - RNA, 20 nt, Mycobacterium avium subsp. paratuberculosis
gucgccgagcucgugauggu

SEQ ID NO: 881008 - RNA, 23 nt, Mycobacterium avium subsp. paratuberculosis
gucgccgcgguagacaccgccgu

SEQ ID NO: 881009 - RNA, 21 nt, Mycobacterium avium subsp. paratuberculosis
gucgccgcucuucgacgaccc

SEQ ID NO: 881010 - RNA, 23 nt, Mycobacterium avium subsp. paratuberculosis
gucgccgcucuucgacgacccga

SEQ ID NO: 881011 - RNA, 13 nt, Mycobacterium avium subsp. paratuberculosis
gucgccgcgcaga

SEQ ID NO: 881012 - RNA, 17 nt, Mycobacterium avium subsp. paratuberculosis
gucgccgcgcagcaccg

SEQ ID NO: 881013 - RNA, 20 nt, Mycobacterium avium subsp. paratuberculosis
gucgccgcgcagcaccgcgu

SEQ ID NO: 881014 - RNA, 16 nt, Mycobacterium avium subsp. paratuberculosis
gucgccgcgccagccg

SEQ ID NO: 881015 - RNA, 20 nt, Mycobacterium avium subsp. paratuberculosis
gucgccgcgccagccgccgc

SEQ ID NO: 881016 - RNA, 17 nt, Mycobacterium avium subsp. paratuberculosis
gucgccgcgcccgccgg

SEQ ID NO: 881017 - RNA, 18 nt, Mycobacterium avium subsp. paratuberculosis
gucgccgcgcccgccggc

SEQ ID NO: 881018 - RNA, 19 nt, Mycobacterium avium subsp. paratuberculosis
gucgccgcgcccgccggcc

SEQ ID NO: 881019 - RNA, 14 nt, Mycobacterium avium subsp. paratuberculosis
gucgccgcgccgcc

SEQ ID NO: 881020 - RNA, 15 nt, Mycobacterium avium subsp. paratuberculosis
gucgccgcgccgccg

SEQ ID NO: 881021 - RNA, 12 nt, Mycobacterium avium subsp. paratuberculosis
gucgccgccgug

SEQ ID NO: 881022 - RNA, 16 nt, Mycobacterium avium subsp. paratuberculosis
gucgccgaugcgccgc

SEQ ID NO: 881023 - RNA, 17 nt, Mycobacterium avium subsp. paratuberculosis
gucgccgaugcgccgca

SEQ ID NO: 881024 - RNA, 13 nt, Mycobacterium avium subsp. paratuberculosis
gucgccgauggug

SEQ ID NO: 881025 - RNA, 21 nt, Mycobacterium avium subsp. paratuberculosis
gucgccgauguaguccagccc

SEQ ID NO: 881026 - RNA, 19 nt, Mycobacterium avium subsp. paratuberculosis
gucgccgauuucggugucg

SEQ ID NO: 881027 - RNA, 17 nt, Mycobacterium avium subsp. paratuberculosis
gucgccgagguccucga

SEQ ID NO: 881028 - RNA, 19 nt, Mycobacterium avium subsp. paratuberculosis
gucgccgagguccucgacc

SEQ ID NO: 881029 - RNA, 20 nt, Mycobacterium avium subsp. paratuberculosis
gucgccgagguccucgaccu

SEQ ID NO: 881030 - RNA, 16 nt, Mycobacterium avium subsp. paratuberculosis
gucgccgauccagccg

SEQ ID NO: 881031 - RNA, 23 nt, Mycobacterium avium subsp. paratuberculosis
gucgccgauccagccgucguugc

SEQ ID NO: 881032 - RNA, 17 nt, Mycobacterium avium subsp. paratuberculosis
gucgccgaucgcccggu

SEQ ID NO: 881033 - RNA, 16 nt, Mycobacterium avium subsp. paratuberculosis
gucgccgaucucggcc

SEQ ID NO: 881034 - RNA, 20 nt, Mycobacterium avium subsp. paratuberculosis
gucgccgaucucggccaacc

SEQ ID NO: 881035 - RNA, 17 nt, Mycobacterium avium subsp. paratuberculosis
gucgcgcagcauccgca

SEQ ID NO: 881036 - RNA, 13 nt, Mycobacterium avium subsp. paratuberculosis
gucgcgcagcccg

SEQ ID NO: 881037 - RNA, 14 nt, Mycobacterium avium subsp. paratuberculosis
gucgcgcagcccga

SEQ ID NO: 881038 - RNA, 19 nt, Mycobacterium avium subsp. paratuberculosis
gucgcgcagcccgaucgcc

SEQ ID NO: 881039 - RNA, 21 nt, Mycobacterium avium subsp. paratuberculosis
gucgcgcagcccgaucgccag

SEQ ID NO: 881040 - RNA, 14 nt, Mycobacterium avium subsp. paratuberculosis
gucgcgcagccgcc

SEQ ID NO: 881041 - RNA, 15 nt, Mycobacterium avium subsp. paratuberculosis
gucgcgcagccgccg

SEQ ID NO: 881042 - RNA, 16 nt, Mycobacterium avium subsp. paratuberculosis
gucgcgcagccgggcg

SEQ ID NO: 881043 - RNA, 18 nt, Mycobacterium avium subsp. paratuberculosis
gucgcgcagccgggcggc

SEQ ID NO: 881044 - RNA, 21 nt, Mycobacterium avium subsp. paratuberculosis
gucgccguggccgaacggcau

SEQ ID NO: 881045 - RNA, 23 nt, Mycobacterium avium subsp. paratuberculosis
gucgccguggcggcccgaccagc

SEQ ID NO: 881046 - RNA, 18 nt, Mycobacterium avium subsp. paratuberculosis
gucgcgcagcugcgccgc

SEQ ID NO: 881047 - RNA, 14 nt, Mycobacterium avium subsp. paratuberculosis
gucgcgcagcuggg

SEQ ID NO: 881048 - RNA, 20 nt, Mycobacterium avium subsp. paratuberculosis
gucgcgcaucgccucggcgg

SEQ ID NO: 881049 - RNA, 23 nt, Mycobacterium avium subsp. paratuberculosis
gucgcgcaucgccucggcggccg

SEQ ID NO: 881050 - RNA, 15 nt, Mycobacterium avium subsp. paratuberculosis
gucgccuccugcugg

SEQ ID NO: 881051 - RNA, 18 nt, Mycobacterium avium subsp. paratuberculosis
gucgccuccugcuggcgc

SEQ ID NO: 881052 - RNA, 14 nt, Mycobacterium avium subsp. paratuberculosis
gucgccgucgccgc

SEQ ID NO: 881053 - RNA, 15 nt, Mycobacterium avium subsp. paratuberculosis
gucgccgucgccgca

SEQ ID NO: 881054 - RNA, 14 nt, Mycobacterium avium subsp. paratuberculosis
gucgccgucgugcu

SEQ ID NO: 881055 - RNA, 17 nt, Mycobacterium avium subsp. paratuberculosis
gucgccgugccggaccg

SEQ ID NO: 881056 - RNA, 13 nt, Mycobacterium avium subsp. paratuberculosis
gucgccgugcggc

SEQ ID NO: 881057 - RNA, 18 nt, Mycobacterium avium subsp. paratuberculosis
gucgccgugcggcguucg

SEQ ID NO: 881058 - RNA, 20 nt, Mycobacterium avium subsp. paratuberculosis
gucgccgucggggucgcgcc

SEQ ID NO: 881059 - RNA, 21 nt, Mycobacterium avium subsp. paratuberculosis
gucgccgucggggucgcgccg

SEQ ID NO: 881060 - RNA, 23 nt, Mycobacterium avium subsp. paratuberculosis
gucgccgucggggucgcgccggu

SEQ ID NO: 881061 - RNA, 15 nt, Mycobacterium avium subsp. paratuberculosis
gucgccguccggggc

SEQ ID NO: 881062 - RNA, 14 nt, Mycobacterium avium subsp. paratuberculosis
gucgccgguggccg

SEQ ID NO: 881063 - RNA, 20 nt, Mycobacterium avium subsp. paratuberculosis
gucgccgguguagaucggcu

SEQ ID NO: 881064 - RNA, 20 nt, Mycobacterium avium subsp. paratuberculosis
gucgccggugugaucgagca

SEQ ID NO: 881065 - RNA, 22 nt, Mycobacterium avium subsp. paratuberculosis
gucgcgcccaggaacgcgccgg

SEQ ID NO: 881066 - RNA, 23 nt, Mycobacterium avium subsp. paratuberculosis
gucgcgcccaggaacgcgccggc

SEQ ID NO: 881067 - RNA, 13 nt, Mycobacterium avium subsp. paratuberculosis
gucgcgcccggcg

SEQ ID NO: 881068 - RNA, 15 nt, Mycobacterium avium subsp. paratuberculosis
gucgcgcccggcguc

SEQ ID NO: 881069 - RNA, 17 nt, Mycobacterium avium subsp. paratuberculosis
gucgcgcccggcgucgg

SEQ ID NO: 881070 - RNA, 19 nt, Mycobacterium avium subsp. paratuberculosis
gucgcgccgaccuggucgc

SEQ ID NO: 881071 - RNA, 12 nt, Mycobacterium avium subsp. paratuberculosis
gucgcgcggggu

SEQ ID NO: 881072 - RNA, 13 nt, Mycobacterium avium subsp. paratuberculosis
gucgcgcggggug

SEQ ID NO: 881073 - RNA, 20 nt, Mycobacterium avium subsp. paratuberculosis
gucgcgcgguuccggcgugc

SEQ ID NO: 881074 - RNA, 20 nt, Mycobacterium avium subsp. paratuberculosis
gucgcgcaggucgggccggc

SEQ ID NO: 881075 - RNA, 23 nt, Mycobacterium avium subsp. paratuberculosis
gucgcgcaggucgggccggccga

SEQ ID NO: 881076 - RNA, 14 nt, Mycobacterium avium subsp. paratuberculosis
gucgcgcugccggc

SEQ ID NO: 881077 - RNA, 16 nt, Mycobacterium avium subsp. paratuberculosis
gucgcgcucagugcac

SEQ ID NO: 881078 - RNA, 18 nt, Mycobacterium avium subsp. paratuberculosis
gucgcgcucagugcacgc

SEQ ID NO: 881079 - RNA, 22 nt, Mycobacterium avium subsp. paratuberculosis
gucgcgcucagugcacgcucgg

SEQ ID NO: 881080 - RNA, 23 nt, Mycobacterium avium subsp. paratuberculosis
gucgcgcucauaucccgucaggu

SEQ ID NO: 881081 - RNA, 15 nt, Mycobacterium avium subsp. paratuberculosis
gucgcgcucgacgau

SEQ ID NO: 881082 - RNA, 23 nt, Mycobacterium avium subsp. paratuberculosis
gucgcgcucgacgaugucgacgc

SEQ ID NO: 881083 - RNA, 16 nt, Mycobacterium avium subsp. paratuberculosis
gucgcgcugccggccc

SEQ ID NO: 881084 - RNA, 17 nt, Mycobacterium avium subsp. paratuberculosis
gucgcgcugccggcccg

SEQ ID NO: 881085 - RNA, 18 nt, Mycobacterium avium subsp. paratuberculosis
gucgcgcugccggcccga

SEQ ID NO: 881086 - RNA, 19 nt, Mycobacterium avium subsp. paratuberculosis
gucgcgcugccggcccgau

SEQ ID NO: 881087 - RNA, 16 nt, Mycobacterium avium subsp. paratuberculosis
gucgcggaacagccgg

SEQ ID NO: 881088 - RNA, 22 nt, Mycobacterium avium subsp. paratuberculosis
gucgcggaaccggccggggcgc

SEQ ID NO: 881089 - RNA, 22 nt, Mycobacterium avium subsp. paratuberculosis
gucgcggaaccguugcagcaca

SEQ ID NO: 881090 - RNA, 21 nt, Mycobacterium avium subsp. paratuberculosis
gucgcacugcuucgggucgcc

SEQ ID NO: 881091 - RNA, 18 nt, Mycobacterium avium subsp. paratuberculosis
gucgccaggccaccgcac

SEQ ID NO: 881092 - RNA, 19 nt, Mycobacterium avium subsp. paratuberculosis
gucgccaggccaccgcacg

SEQ ID NO: 881093 - RNA, 19 nt, Mycobacterium avium subsp. paratuberculosis
gucgcagaucccgccggcg

SEQ ID NO: 881094 - RNA, 21 nt, Mycobacterium avium subsp. paratuberculosis
gucgcagaucccgccggcggc

SEQ ID NO: 881095 - RNA, 15 nt, Mycobacterium avium subsp. paratuberculosis
gucgcagcagcagcc

SEQ ID NO: 881096 - RNA, 18 nt, Mycobacterium avium subsp. paratuberculosis
gucgcagcagcagcccga

SEQ ID NO: 881097 - RNA, 19 nt, Mycobacterium avium subsp. paratuberculosis
gucgcagcagcagcccgaa

SEQ ID NO: 881098 - RNA, 12 nt, Mycobacterium avium subsp. paratuberculosis
gucgcagcccgg

SEQ ID NO: 881099 - RNA, 13 nt, Mycobacterium avium subsp. paratuberculosis
gucgcagcccggg

SEQ ID NO: 881100 - RNA, 16 nt, Mycobacterium avium subsp. paratuberculosis
gucgcagcccgggugc

SEQ ID NO: 881101 - RNA, 14 nt, Mycobacterium avium subsp. paratuberculosis
gucgccaugccguc

SEQ ID NO: 881102 - RNA, 18 nt, Mycobacterium avium subsp. paratuberculosis
gucgccaugccgucgcgc

SEQ ID NO: 881103 - RNA, 19 nt, Mycobacterium avium subsp. paratuberculosis
gucgcccagcagcccggcc

SEQ ID NO: 881104 - RNA, 23 nt, Mycobacterium avium subsp. paratuberculosis
gucgcccagcagcccggccagcc

SEQ ID NO: 881105 - RNA, 16 nt, Mycobacterium avium subsp. paratuberculosis
gucgcccacaccggau

SEQ ID NO: 881106 - RNA, 14 nt, Mycobacterium avium subsp. paratuberculosis
gucgcccacccgcc

SEQ ID NO: 881107 - RNA, 15 nt, Mycobacterium avium subsp. paratuberculosis
gucgcccacccgcca

SEQ ID NO: 881108 - RNA, 16 nt, Mycobacterium avium subsp. paratuberculosis
gucgcccacccggggc

SEQ ID NO: 881109 - RNA, 21 nt, Mycobacterium avium subsp. paratuberculosis
gucgcccaccgacgcggcggc

SEQ ID NO: 881110 - RNA, 14 nt, Mycobacterium avium subsp. paratuberculosis
gucgcaacggucgg

SEQ ID NO: 881111 - RNA, 17 nt, Mycobacterium avium subsp. paratuberculosis
gucgcacaaccgggcca

SEQ ID NO: 881112 - RNA, 23 nt, Mycobacterium avium subsp. paratuberculosis
gucgcacaaccgugacugggugg

SEQ ID NO: 881113 - RNA, 15 nt, Mycobacterium avium subsp. paratuberculosis
gucgcacaccagcac

SEQ ID NO: 881114 - RNA, 16 nt, Mycobacterium avium subsp. paratuberculosis
gucgcacaccagcacg

SEQ ID NO: 881115 - RNA, 17 nt, Mycobacterium avium subsp. paratuberculosis
gucgcacaccagcacgg

SEQ ID NO: 881116 - RNA, 19 nt, Mycobacterium avium subsp. paratuberculosis
gucgcacaccagcacggcg

SEQ ID NO: 881117 - RNA, 16 nt, Mycobacterium avium subsp. paratuberculosis
gucgcacagcgccgcg

SEQ ID NO: 881118 - RNA, 16 nt, Mycobacterium avium subsp. paratuberculosis
gucgcacuagguccgg

SEQ ID NO: 881119 - RNA, 19 nt, Mycobacterium avium subsp. paratuberculosis
gucgcacuagguccggcgc

SEQ ID NO: 881120 - RNA, 22 nt, Mycobacterium avium subsp. paratuberculosis
gucgcaccggcagugaucggcg

SEQ ID NO: 881121 - RNA, 19 nt, Mycobacterium avium subsp. paratuberculosis
gucgaggcccucgacaccg

SEQ ID NO: 881122 - RNA, 22 nt, Mycobacterium avium subsp. paratuberculosis
gucgaggcccucgacaccggug

SEQ ID NO: 881123 - RNA, 20 nt, Mycobacterium avium subsp. paratuberculosis
gucgaggccgaaccgcagcc

SEQ ID NO: 881124 - RNA, 23 nt, Mycobacterium avium subsp. paratuberculosis
gucgaggccgaaccgcagccgga

SEQ ID NO: 881125 - RNA, 23 nt, Mycobacterium avium subsp. paratuberculosis
gucgaggccguaucccaccacga

SEQ ID NO: 881126 - RNA, 22 nt, Mycobacterium avium subsp. paratuberculosis
gucgaucgaauacaccugccgc

SEQ ID NO: 881127 - RNA, 14 nt, Mycobacterium avium subsp. paratuberculosis
gucgaucucggcgc

SEQ ID NO: 881128 - RNA, 15 nt, Mycobacterium avium subsp. paratuberculosis
gucgaucucggcgca

SEQ ID NO: 881129 - RNA, 19 nt, Mycobacterium avium subsp. paratuberculosis
gucgaucucggcgcaggug

SEQ ID NO: 881130 - RNA, 17 nt, Mycobacterium avium subsp. paratuberculosis
gucgaucucgucgcaca

SEQ ID NO: 881131 - RNA, 20 nt, Mycobacterium avium subsp. paratuberculosis
gucgaucucuucgccggaca

SEQ ID NO: 881132 - RNA, 18 nt, Mycobacterium avium subsp. paratuberculosis
gucgaucuucgcggcgua

SEQ ID NO: 881133 - RNA, 22 nt, Mycobacterium avium subsp. paratuberculosis
gucgaucuugcguuccucgacg

SEQ ID NO: 881134 - RNA, 17 nt, Mycobacterium avium subsp. paratuberculosis
gucgaucuugucgucca

SEQ ID NO: 881135 - RNA, 20 nt, Mycobacterium avium subsp. paratuberculosis
gucgaucgccagcgcgcaga

SEQ ID NO: 881136 - RNA, 13 nt, Mycobacterium avium subsp. paratuberculosis
gucgaucgacgcc

SEQ ID NO: 881137 - RNA, 15 nt, Mycobacterium avium subsp. paratuberculosis
gucgaucgacgccga

SEQ ID NO: 881138 - RNA, 16 nt, Mycobacterium avium subsp. paratuberculosis
gucgaucgacgccgac

SEQ ID NO: 881139 - RNA, 13 nt, Mycobacterium avium subsp. paratuberculosis
gucgaucgccguc

SEQ ID NO: 881140 - RNA, 12 nt, Mycobacterium avium subsp. paratuberculosis
gucgaucgcguc

SEQ ID NO: 881141 - RNA, 13 nt, Mycobacterium avium subsp. paratuberculosis
gucgaugccggcc

SEQ ID NO: 881142 - RNA, 19 nt, Mycobacterium avium subsp. paratuberculosis
gucgaugccggccagcggc

SEQ ID NO: 881143 - RNA, 20 nt, Mycobacterium avium subsp. paratuberculosis
gucgaugccggccagcggcc

SEQ ID NO: 881144 - RNA, 14 nt, Mycobacterium avium subsp. paratuberculosis
gucgaugccggcga

SEQ ID NO: 881145 - RNA, 14 nt, Mycobacterium avium subsp. paratuberculosis
gucgauucaucgcc

SEQ ID NO: 881146 - RNA, 15 nt, Mycobacterium avium subsp. paratuberculosis
gucgauucaucgccg

SEQ ID NO: 881147 - RNA, 17 nt, Mycobacterium avium subsp. paratuberculosis
gucgauugccgcggccg

SEQ ID NO: 881148 - RNA, 18 nt, Mycobacterium avium subsp. paratuberculosis
gucgauugccgcggccgc

SEQ ID NO: 881149 - RNA, 17 nt, Mycobacterium avium subsp. paratuberculosis
gucgaugacggcggcgc

SEQ ID NO: 881150 - RNA, 16 nt, Mycobacterium avium subsp. paratuberculosis
gucgaugcacgccgga

SEQ ID NO: 881151 - RNA, 17 nt, Mycobacterium avium subsp. paratuberculosis
gucgaugcccgcgccga

SEQ ID NO: 881152 - RNA, 18 nt, Mycobacterium avium subsp. paratuberculosis
gucgaugcccgcgccgac

SEQ ID NO: 881153 - RNA, 15 nt, Mycobacterium avium subsp. paratuberculosis
gucgaugcccgcguc

SEQ ID NO: 881154 - RNA, 19 nt, Mycobacterium avium subsp. paratuberculosis
gucgaugcccuagcggugg

SEQ ID NO: 881155 - RNA, 20 nt, Mycobacterium avium subsp. paratuberculosis
gucgaugcccuagcgguggc

SEQ ID NO: 881156 - RNA, 21 nt, Mycobacterium avium subsp. paratuberculosis
gucgaugcccuagcgguggcg

SEQ ID NO: 881157 - RNA, 16 nt, Mycobacterium avium subsp. paratuberculosis
gucgaugaccucgcgc

SEQ ID NO: 881158 - RNA, 19 nt, Mycobacterium avium subsp. paratuberculosis
gucgaugaccucgcgcagc

SEQ ID NO: 881159 - RNA, 19 nt, Mycobacterium avium subsp. paratuberculosis
gucgaugaccucgcgcccg

SEQ ID NO: 881160 - RNA, 22 nt, Mycobacterium avium subsp. paratuberculosis
gucgaugaccucgcgcccggcg

SEQ ID NO: 881161 - RNA, 23 nt, Mycobacterium avium subsp. paratuberculosis
gucgaugaccucgcgcccggcgc

SEQ ID NO: 881162 - RNA, 23 nt, Mycobacterium avium subsp. paratuberculosis
gucgaugaaccgcugcugcucgg

SEQ ID NO: 881163 - RNA, 23 nt, Mycobacterium avium subsp. paratuberculosis
gucgaugaagucggugagcaccg

SEQ ID NO: 881164 - RNA, 21 nt, Mycobacterium avium subsp. paratuberculosis
gucgaugaauuccggugugcc

SEQ ID NO: 881165 - RNA, 15 nt, Mycobacterium avium subsp. paratuberculosis
gucgaugacgccgcg

SEQ ID NO: 881166 - RNA, 17 nt, Mycobacterium avium subsp. paratuberculosis
gucgaugacgccgcgcc

SEQ ID NO: 881167 - RNA, 16 nt, Mycobacterium avium subsp. paratuberculosis
gucgaugaucuggcgg

SEQ ID NO: 881168 - RNA, 23 nt, Mycobacterium avium subsp. paratuberculosis
gucgaugaucuggcggucccgca

SEQ ID NO: 881169 - RNA, 24 nt, Mycobacterium avium subsp. paratuberculosis
guccgcacccgggcccggucgucg

SEQ ID NO: 881170 - RNA, 12 nt, Mycobacterium avium subsp. paratuberculosis
guccgcaccgcg

SEQ ID NO: 881171 - RNA, 14 nt, Mycobacterium avium subsp. paratuberculosis
guccgcaccgcgac

SEQ ID NO: 881172 - RNA, 15 nt, Mycobacterium avium subsp. paratuberculosis
guccgcaccgcgacg

SEQ ID NO: 881173 - RNA, 19 nt, Mycobacterium avium subsp. paratuberculosis
guccgcagauagaucgacg

SEQ ID NO: 881174 - RNA, 21 nt, Mycobacterium avium subsp. paratuberculosis
guccgccagggugccgcugcc

SEQ ID NO: 881175 - RNA, 14 nt, Mycobacterium avium subsp. paratuberculosis
gucgacgcgggcga

SEQ ID NO: 881176 - RNA, 19 nt, Mycobacterium avium subsp. paratuberculosis
gucgacgcgggcgacguca

SEQ ID NO: 881177 - RNA, 19 nt, Mycobacterium avium subsp. paratuberculosis
gucgacgcggggcggcggc

SEQ ID NO: 881178 - RNA, 15 nt, Mycobacterium avium subsp. paratuberculosis
guccgcaaccgccgg

SEQ ID NO: 881179 - RNA, 17 nt, Mycobacterium avium subsp. paratuberculosis
guccgcaaccgccggca

SEQ ID NO: 881180 - RNA, 20 nt, Mycobacterium avium subsp. paratuberculosis
guccgcaaccgccggcagcg

SEQ ID NO: 881181 - RNA, 14 nt, Mycobacterium avium subsp. paratuberculosis
guccgcaacgccgg

SEQ ID NO: 881182 - RNA, 15 nt, Mycobacterium avium subsp. paratuberculosis
guccgcaacgccggc

SEQ ID NO: 881183 - RNA, 16 nt, Mycobacterium avium subsp. paratuberculosis
guccgcaacgccggcg

SEQ ID NO: 881184 - RNA, 18 nt, Mycobacterium avium subsp. paratuberculosis
guccgcaacgccggcgug

SEQ ID NO: 881185 - RNA, 13 nt, Mycobacterium avium subsp. paratuberculosis
guccgcaacgcgg

SEQ ID NO: 881186 - RNA, 21 nt, Mycobacterium avium subsp. paratuberculosis
guccgcaagcaccucgcgcuc

SEQ ID NO: 881187 - RNA, 13 nt, Mycobacterium avium subsp. paratuberculosis
guccgagacgucg

SEQ ID NO: 881188 - RNA, 15 nt, Mycobacterium avium subsp. paratuberculosis
guccgagacgucggc

SEQ ID NO: 881189 - RNA, 14 nt, Mycobacterium avium subsp. paratuberculosis
guccgagccgccca

SEQ ID NO: 881190 - RNA, 23 nt, Mycobacterium avium subsp. paratuberculosis
guccgaggucuuggugaugcgcu

SEQ ID NO: 881191 - RNA, 20 nt, Mycobacterium avium subsp. paratuberculosis
guccgaucguccggcgccac

SEQ ID NO: 881192 - RNA, 23 nt, Mycobacterium avium subsp. paratuberculosis
gucgacgguugccucggccagca

SEQ ID NO: 881193 - RNA, 15 nt, Mycobacterium avium subsp. paratuberculosis
gucgacgucaacacc

SEQ ID NO: 881194 - RNA, 18 nt, Mycobacterium avium subsp. paratuberculosis
gucgacgucaacaccgug

SEQ ID NO: 881195 - RNA, 22 nt, Mycobacterium avium subsp. paratuberculosis
gucgacgucaacaccguggugg

SEQ ID NO: 881196 - RNA, 15 nt, Mycobacterium avium subsp. paratuberculosis
gucgacgggccacca

SEQ ID NO: 881197 - RNA, 16 nt, Mycobacterium avium subsp. paratuberculosis
gucgacgggccaccag

SEQ ID NO: 881198 - RNA, 17 nt, Mycobacterium avium subsp. paratuberculosis
gucgacgggccaccagc

SEQ ID NO: 881199 - RNA, 18 nt, Mycobacterium avium subsp. paratuberculosis
gucgacgggccaccagcg

SEQ ID NO: 881200 - RNA, 17 nt, Mycobacterium avium subsp. paratuberculosis
gucgacggggucggaca

SEQ ID NO: 881201 - RNA, 23 nt, Mycobacterium avium subsp. paratuberculosis
gucgacgcggucgaacaacgcgg

SEQ ID NO: 881202 - RNA, 12 nt, Mycobacterium avium subsp. paratuberculosis
gucgacgcggug

SEQ ID NO: 881203 - RNA, 21 nt, Mycobacterium avium subsp. paratuberculosis
gucgacgcugagcacccgccc

SEQ ID NO: 881204 - RNA, 23 nt, Mycobacterium avium subsp. paratuberculosis
gucgacgcugagccgcucgucga

SEQ ID NO: 881205 - RNA, 20 nt, Mycobacterium avium subsp. paratuberculosis
gucgacgcugcagguggccc

SEQ ID NO: 881206 - RNA, 23 nt, Mycobacterium avium subsp. paratuberculosis
gucgacgcugcagguggcccaca

SEQ ID NO: 881207 - RNA, 15 nt, Mycobacterium avium subsp. paratuberculosis
gucgacgcugcccaa

SEQ ID NO: 881208 - RNA, 15 nt, Mycobacterium avium subsp. paratuberculosis
gucgacgcugugcgc

SEQ ID NO: 881209 - RNA, 21 nt, Mycobacterium avium subsp. paratuberculosis
gucgacgcugugcgccuugcc

SEQ ID NO: 881210 - RNA, 14 nt, Mycobacterium avium subsp. paratuberculosis
gucgacggccgccg

SEQ ID NO: 881211 - RNA, 16 nt, Mycobacterium avium subsp. paratuberculosis
gucgacggccgccgcg

SEQ ID NO: 881212 - RNA, 17 nt, Mycobacterium avium subsp. paratuberculosis
gucgacggccgcgccga

SEQ ID NO: 881213 - RNA, 19 nt, Mycobacterium avium subsp. paratuberculosis
gucgacggccgcgccgaac

SEQ ID NO: 881214 - RNA, 12 nt, Mycobacterium avium subsp. paratuberculosis
gucgacggcgcc

SEQ ID NO: 881215 - RNA, 15 nt, Mycobacterium avium subsp. paratuberculosis
gucgacggcgccgga

SEQ ID NO: 881216 - RNA, 20 nt, Mycobacterium avium subsp. paratuberculosis
gucgacggcgccggacaccu

SEQ ID NO: 881217 - RNA, 17 nt, Mycobacterium avium subsp. paratuberculosis
gucgacggagucgucgg

SEQ ID NO: 881218 - RNA, 20 nt, Mycobacterium avium subsp. paratuberculosis
gucgacggagucgucggcgc

SEQ ID NO: 881219 - RNA, 14 nt, Mycobacterium avium subsp. paratuberculosis
gucgacggcggcgu

SEQ ID NO: 881220 - RNA, 16 nt, Mycobacterium avium subsp. paratuberculosis
gucgacggcggcgucc

SEQ ID NO: 881221 - RNA, 19 nt, Mycobacterium avium subsp. paratuberculosis
gucgacggcggugacguuc

SEQ ID NO: 881222 - RNA, 22 nt, Mycobacterium avium subsp. paratuberculosis
gucgacggcguggaacacgccc

SEQ ID NO: 881223 - RNA, 15 nt, Mycobacterium avium subsp. paratuberculosis
gucgagcggcccgca

SEQ ID NO: 881224 - RNA, 20 nt, Mycobacterium avium subsp. paratuberculosis
gucgagcggcccgcaccgau

SEQ ID NO: 881225 - RNA, 21 nt, Mycobacterium avium subsp. paratuberculosis
gucgagcggcccgcaccgaug

SEQ ID NO: 881226 - RNA, 14 nt, Mycobacterium avium subsp. paratuberculosis
gucgagcggcccgu

SEQ ID NO: 881227 - RNA, 20 nt, Mycobacterium avium subsp. paratuberculosis
gucgagcggcccgucgccga

SEQ ID NO: 881228 - RNA, 23 nt, Mycobacterium avium subsp. paratuberculosis
gucgagcggcccgucgccgauca

SEQ ID NO: 881229 - RNA, 20 nt, Mycobacterium avium subsp. paratuberculosis
gucgagcggcuugccgccgc

SEQ ID NO: 881230 - RNA, 15 nt, Mycobacterium avium subsp. paratuberculosis
gucgagcgcucgcgg

SEQ ID NO: 881231 - RNA, 16 nt, Mycobacterium avium subsp. paratuberculosis
gucgagcgcggcccgc

SEQ ID NO: 881232 - RNA, 19 nt, Mycobacterium avium subsp. paratuberculosis
gucgagcgcggcccgccga

SEQ ID NO: 881233 - RNA, 17 nt, Mycobacterium avium subsp. paratuberculosis
gucgagcgucacgccgc

SEQ ID NO: 881234 - RNA, 20 nt, Mycobacterium avium subsp. paratuberculosis
gucgagcgucacgcuggcgu

SEQ ID NO: 881235 - RNA, 20 nt, Mycobacterium avium subsp. paratuberculosis
gucgagcgucauuccgccgc

SEQ ID NO: 881236 - RNA, 21 nt, Mycobacterium avium subsp. paratuberculosis
gucgagcgucauuccgccgcg

SEQ ID NO: 881237 - RNA, 22 nt, Mycobacterium avium subsp. paratuberculosis
gucgagcgucauuccgccgcgc

SEQ ID NO: 881238 - RNA, 23 nt, Mycobacterium avium subsp. paratuberculosis
gucgagcgucauuccgccgcgcc

SEQ ID NO: 881239 - RNA, 16 nt, Mycobacterium avium subsp. paratuberculosis
gucgagcuccucggcc

SEQ ID NO: 881240 - RNA, 17 nt, Mycobacterium avium subsp. paratuberculosis
gucgagcuccucggcca

SEQ ID NO: 881241 - RNA, 13 nt, Mycobacterium avium subsp. paratuberculosis
gucgagcucgaag

SEQ ID NO: 881242 - RNA, 20 nt, Mycobacterium avium subsp. paratuberculosis
gucgagcucgaagcccaggg

SEQ ID NO: 881243 - RNA, 13 nt, Mycobacterium avium subsp. paratuberculosis
gucgagcgcgccg

SEQ ID NO: 881244 - RNA, 14 nt, Mycobacterium avium subsp. paratuberculosis
gucgagcgcgccga

SEQ ID NO: 881245 - RNA, 13 nt, Mycobacterium avium subsp. paratuberculosis
gucgagcgcggcc

SEQ ID NO: 881246 - RNA, 14 nt, Mycobacterium avium subsp. paratuberculosis
gucgagccuggcgc

SEQ ID NO: 881247 - RNA, 15 nt, Mycobacterium avium subsp. paratuberculosis
gucgagccuggugau

SEQ ID NO: 881248 - RNA, 19 nt, Mycobacterium avium subsp. paratuberculosis
gucgagccggugccgaggc

SEQ ID NO: 881249 - RNA, 13 nt, Mycobacterium avium subsp. paratuberculosis
gucgagccgggcc

SEQ ID NO: 881250 - RNA, 15 nt, Mycobacterium avium subsp. paratuberculosis
gucgagccaccacug

SEQ ID NO: 881251 - RNA, 22 nt, Mycobacterium avium subsp. paratuberculosis
gucgagccaccacugcgccguc

SEQ ID NO: 881252 - RNA, 19 nt, Mycobacterium avium subsp. paratuberculosis
gucgagccgcagucgauca

SEQ ID NO: 881253 - RNA, 20 nt, Mycobacterium avium subsp. paratuberculosis
gucgagccgcagucgaucac

SEQ ID NO: 881254 - RNA, 18 nt, Mycobacterium avium subsp. paratuberculosis
gucgagccgcucgcgcac

SEQ ID NO: 881255 - RNA, 14 nt, Mycobacterium avium subsp. paratuberculosis
gucgagcagcgccc

SEQ ID NO: 881256 - RNA, 15 nt, Mycobacterium avium subsp. paratuberculosis
gucgagcagcgcccg

SEQ ID NO: 881257 - RNA, 17 nt, Mycobacterium avium subsp. paratuberculosis
gucgagcagcgcccggc

SEQ ID NO: 881258 - RNA, 20 nt, Mycobacterium avium subsp. paratuberculosis
gucgagcacgucgacgccgg

SEQ ID NO: 881259 - RNA, 22 nt, Mycobacterium avium subsp. paratuberculosis
gucgagcagguucuccucccag

SEQ ID NO: 881260 - RNA, 16 nt, Mycobacterium avium subsp. paratuberculosis
gucgagcauccggcgc

SEQ ID NO: 881261 - RNA, 22 nt, Mycobacterium avium subsp. paratuberculosis
gucgagcauccggcgcacggcg

SEQ ID NO: 881262 - RNA, 16 nt, Mycobacterium avium subsp. paratuberculosis
gucgagcagcaccacc

SEQ ID NO: 881263 - RNA, 17 nt, Mycobacterium avium subsp. paratuberculosis
gucgagcagcaccaccc

SEQ ID NO: 881264 - RNA, 17 nt, Mycobacterium avium subsp. paratuberculosis
gucgagcagcagccgcc

SEQ ID NO: 881265 - RNA, 22 nt, Mycobacterium avium subsp. paratuberculosis
gucgagcagcagccgccgggcc

SEQ ID NO: 881266 - RNA, 14 nt, Mycobacterium avium subsp. paratuberculosis
gucgagcagccgca

SEQ ID NO: 881267 - RNA, 16 nt, Mycobacterium avium subsp. paratuberculosis
gucgagcagccgcaac

SEQ ID NO: 881268 - RNA, 20 nt, Mycobacterium avium subsp. paratuberculosis
gucgacguccacguugaugc

SEQ ID NO: 881269 - RNA, 15 nt, Mycobacterium avium subsp. paratuberculosis
gucgacguccucgcc

SEQ ID NO: 881270 - RNA, 19 nt, Mycobacterium avium subsp. paratuberculosis
gucgacguccucgcccggg

SEQ ID NO: 881271 - RNA, 14 nt, Mycobacterium avium subsp. paratuberculosis
gucgacgucgagaa

SEQ ID NO: 881272 - RNA, 20 nt, Mycobacterium avium subsp. paratuberculosis
gucgacgucgagggcgccgu

SEQ ID NO: 881273 - RNA, 19 nt, Mycobacterium avium subsp. paratuberculosis
gucgacgucggacgcggcc

SEQ ID NO: 881274 - RNA, 20 nt, Mycobacterium avium subsp. paratuberculosis
gucgacgucggacgcggccg

SEQ ID NO: 881275 - RNA, 22 nt, Mycobacterium avium subsp. paratuberculosis
gucgacgucggacgcggccgag

SEQ ID NO: 881276 - RNA, 18 nt, Mycobacterium avium subsp. paratuberculosis
gucgacgucggggauggu

SEQ ID NO: 881277 - RNA, 14 nt, Mycobacterium avium subsp. paratuberculosis
gucgacgucggugg

SEQ ID NO: 881278 - RNA, 22 nt, Mycobacterium avium subsp. paratuberculosis
gucgacgucgguggugacgguu

SEQ ID NO: 881279 - RNA, 16 nt, Mycobacterium avium subsp. paratuberculosis
gucgacgucgucgacc

SEQ ID NO: 881280 - RNA, 19 nt, Mycobacterium avium subsp. paratuberculosis
gucgacgucgucgacccgc

SEQ ID NO: 881281 - RNA, 17 nt, Mycobacterium avium subsp. paratuberculosis
gucgacgugcgcggcgu

SEQ ID NO: 881282 - RNA, 22 nt, Mycobacterium avium subsp. paratuberculosis
gucgagcaccggcagccgcagc

SEQ ID NO: 881283 - RNA, 12 nt, Mycobacterium avium subsp. paratuberculosis
gucgagcaccug

SEQ ID NO: 881284 - RNA, 14 nt, Mycobacterium avium subsp. paratuberculosis
gucgagcaccucca

SEQ ID NO: 881285 - RNA, 17 nt, Mycobacterium avium subsp. paratuberculosis
gggaacucggugaugcc

SEQ ID NO: 881286 - RNA, 18 nt, Mycobacterium avium subsp. paratuberculosis
gggaacgucauggccagc

SEQ ID NO: 881287 - RNA, 17 nt, Mycobacterium avium subsp. paratuberculosis
gggaacgccgaucaccg

SEQ ID NO: 881288 - RNA, 19 nt, Mycobacterium avium subsp. paratuberculosis
gggaacgccgaucaccgcg

SEQ ID NO: 881289 - RNA, 21 nt, Mycobacterium avium subsp. paratuberculosis
gggaacgccgaucaccggcac

SEQ ID NO: 881290 - RNA, 13 nt, Mycobacterium avium subsp. paratuberculosis
gggaacgacggug

SEQ ID NO: 881291 - RNA, 17 nt, Mycobacterium avium subsp. paratuberculosis
gggaacgacggugcgcc

SEQ ID NO: 881292 - RNA, 19 nt, Mycobacterium avium subsp. paratuberculosis
gggaacagcgacgcccaga

SEQ ID NO: 881293 - RNA, 20 nt, Mycobacterium avium subsp. paratuberculosis
gggaaaguuguagcgcagca

SEQ ID NO: 881294 - RNA, 19 nt, Mycobacterium avium subsp. paratuberculosis
ggcuugggcccgucggcgu

SEQ ID NO: 881295 - RNA, 16 nt, Mycobacterium avium subsp. paratuberculosis
gggaacaccacgucgu

SEQ ID NO: 881296 - RNA, 23 nt, Mycobacterium avium subsp. paratuberculosis
ggcuuggcgacgaagucgacggc

SEQ ID NO: 881297 - RNA, 16 nt, Mycobacterium avium subsp. paratuberculosis
ggcuugcgcucggccg

SEQ ID NO: 881298 - RNA, 13 nt, Mycobacterium avium subsp. paratuberculosis
ggcuuggccacca

SEQ ID NO: 881299 - RNA, 14 nt, Mycobacterium avium subsp. paratuberculosis
ggcuuggcccgccg

SEQ ID NO: 881300 - RNA, 15 nt, Mycobacterium avium subsp. paratuberculosis
ggcuuggcccgccgc

SEQ ID NO: 881301 - RNA, 21 nt, Mycobacterium avium subsp. paratuberculosis
ggcuuggcccgccgccggcgc

SEQ ID NO: 881302 - RNA, 13 nt, Mycobacterium avium subsp. paratuberculosis
gggaagccggcca

SEQ ID NO: 881303 - RNA, 20 nt, Mycobacterium avium subsp. paratuberculosis
gggaagacgugcacgugcag

SEQ ID NO: 881304 - RNA, 18 nt, Mycobacterium avium subsp. paratuberculosis
gggaagaucgucgucccg

SEQ ID NO: 881305 - RNA, 13 nt, Mycobacterium avium subsp. paratuberculosis
gggaagcccagca

SEQ ID NO: 881306 - RNA, 14 nt, Mycobacterium avium subsp. paratuberculosis
gggaagccgcagca

SEQ ID NO: 881307 - RNA, 12 nt, Mycobacterium avium subsp. paratuberculosis
gggaccacccgc

SEQ ID NO: 881308 - RNA, 23 nt, Mycobacterium avium subsp. paratuberculosis
gggaccacccgcagcgcggcgga

SEQ ID NO: 881309 - RNA, 18 nt, Mycobacterium avium subsp. paratuberculosis
gggaccagcgcaaccgcg

SEQ ID NO: 881310 - RNA, 21 nt, Mycobacterium avium subsp. paratuberculosis
gggaccagcgccucggccugc

SEQ ID NO: 881311 - RNA, 14 nt, Mycobacterium avium subsp. paratuberculosis
gggaccagcgcggu

SEQ ID NO: 881312 - RNA, 17 nt, Mycobacterium avium subsp. paratuberculosis
gggacaucgucgcgccc

SEQ ID NO: 881313 - RNA, 18 nt, Mycobacterium avium subsp. paratuberculosis
gggacaucgucgcgccca

SEQ ID NO: 881314 - RNA, 19 nt, Mycobacterium avium subsp. paratuberculosis
gggacccccucgucgaucg

SEQ ID NO: 881315 - RNA, 15 nt, Mycobacterium avium subsp. paratuberculosis
gggacccgcaccgga

SEQ ID NO: 881316 - RNA, 16 nt, Mycobacterium avium subsp. paratuberculosis
gggacccggaacccgc

SEQ ID NO: 881317 - RNA, 23 nt, Mycobacterium avium subsp. paratuberculosis
gggagaacagguaggacaccgaa

SEQ ID NO: 881318 - RNA, 15 nt, Mycobacterium avium subsp. paratuberculosis
gggacgacgccgaac

SEQ ID NO: 881319 - RNA, 16 nt, Mycobacterium avium subsp. paratuberculosis
gggaccgucgcgcagc

SEQ ID NO: 881320 - RNA, 21 nt, Mycobacterium avium subsp. paratuberculosis
gggaccgucgggaauggggcc

SEQ ID NO: 881321 - RNA, 16 nt, Mycobacterium avium subsp. paratuberculosis
gggaccgggcccggcg

SEQ ID NO: 881322 - RNA, 17 nt, Mycobacterium avium subsp. paratuberculosis
gggaccggugcgguccc

SEQ ID NO: 881323 - RNA, 18 nt, Mycobacterium avium subsp. paratuberculosis
gggacgaagaccgggucg

SEQ ID NO: 881324 - RNA, 19 nt, Mycobacterium avium subsp. paratuberculosis
gggacgaaggugcgcacga

SEQ ID NO: 881325 - RNA, 22 nt, Mycobacterium avium subsp. paratuberculosis
gggacgaaggugcgcacgaacg

SEQ ID NO: 881326 - RNA, 14 nt, Mycobacterium avium subsp. paratuberculosis
gggagugacguuga

SEQ ID NO: 881327 - RNA, 15 nt, Mycobacterium avium subsp. paratuberculosis
gggagugcggcccac

SEQ ID NO: 881328 - RNA, 18 nt, Mycobacterium avium subsp. paratuberculosis
gggaggucgucgcgucca

SEQ ID NO: 881329 - RNA, 16 nt, Mycobacterium avium subsp. paratuberculosis
gggaguagucggcgau

SEQ ID NO: 881330 - RNA, 17 nt, Mycobacterium avium subsp. paratuberculosis
gggagucgggcccgccc

SEQ ID NO: 881331 - RNA, 15 nt, Mycobacterium avium subsp. paratuberculosis
gggauagagcaccgc

SEQ ID NO: 881332 - RNA, 16 nt, Mycobacterium avium subsp. paratuberculosis
gggauagagcaccgcg

SEQ ID NO: 881333 - RNA, 19 nt, Mycobacterium avium subsp. paratuberculosis
gggauagccgagcggcgcc

SEQ ID NO: 881334 - RNA, 20 nt, Mycobacterium avium subsp. paratuberculosis
gggauagccgagcggcgcca

SEQ ID NO: 881335 - RNA, 14 nt, Mycobacterium avium subsp. paratuberculosis
gggauaccgcgacc

SEQ ID NO: 881336 - RNA, 17 nt, Mycobacterium avium subsp. paratuberculosis
gggauaccgcgaccgcc

SEQ ID NO: 881337 - RNA, 18 nt, Mycobacterium avium subsp. paratuberculosis
gggagcggcccaacacgc

SEQ ID NO: 881338 - RNA, 13 nt, Mycobacterium avium subsp. paratuberculosis
gggagcggcggag

SEQ ID NO: 881339 - RNA, 15 nt, Mycobacterium avium subsp. paratuberculosis
gggagcgggccacgc

SEQ ID NO: 881340 - RNA, 13 nt, Mycobacterium avium subsp. paratuberculosis
gggaggccagcac

SEQ ID NO: 881341 - RNA, 18 nt, Mycobacterium avium subsp. paratuberculosis
gggaggcccagcccgccg

SEQ ID NO: 881342 - RNA, 21 nt, Mycobacterium avium subsp. paratuberculosis
gggaggcccaguagcggaagu

SEQ ID NO: 881343 - RNA, 20 nt, Mycobacterium avium subsp. paratuberculosis
gggagcuaggcggccgggcg

SEQ ID NO: 881344 - RNA, 21 nt, Mycobacterium avium subsp. paratuberculosis
gggaggcguugcgucccgcgc

SEQ ID NO: 881345 - RNA, 23 nt, Mycobacterium avium subsp. paratuberculosis
gggaggcguugcgucccgcgccg

SEQ ID NO: 881346 - RNA, 13 nt, Mycobacterium avium subsp. paratuberculosis
gggagccggccag

SEQ ID NO: 881347 - RNA, 14 nt, Mycobacterium avium subsp. paratuberculosis
gggagccggccagg

SEQ ID NO: 881348 - RNA, 13 nt, Mycobacterium avium subsp. paratuberculosis
gggagccgugcag

SEQ ID NO: 881349 - RNA, 22 nt, Mycobacterium avium subsp. paratuberculosis
gggagccgugcagcgcccagcc

SEQ ID NO: 881350 - RNA, 14 nt, Mycobacterium avium subsp. paratuberculosis
gggagacugcgacc

SEQ ID NO: 881351 - RNA, 18 nt, Mycobacterium avium subsp. paratuberculosis
gggagaggcgcggcgcga

SEQ ID NO: 881352 - RNA, 21 nt, Mycobacterium avium subsp. paratuberculosis
gggagauacggucgcaccgcg

SEQ ID NO: 881353 - RNA, 15 nt, Mycobacterium avium subsp. paratuberculosis
gggaugacaaccauc

SEQ ID NO: 881354 - RNA, 16 nt, Mycobacterium avium subsp. paratuberculosis
gggaugacaccgcgga

SEQ ID NO: 881355 - RNA, 15 nt, Mycobacterium avium subsp. paratuberculosis
gggaugaucggcgcc

SEQ ID NO: 881356 - RNA, 16 nt, Mycobacterium avium subsp. paratuberculosis
gggaugaucggcgccu

SEQ ID NO: 881357 - RNA, 18 nt, Mycobacterium avium subsp. paratuberculosis
gggauaguucgccgccgc

SEQ ID NO: 881358 - RNA, 16 nt, Mycobacterium avium subsp. paratuberculosis
gggauauucgcccagc

SEQ ID NO: 881359 - RNA, 17 nt, Mycobacterium avium subsp. paratuberculosis
gggaucggggugccgcc

SEQ ID NO: 881360 - RNA, 17 nt, Mycobacterium avium subsp. paratuberculosis
gggaugcgccaccgaca

SEQ ID NO: 881361 - RNA, 23 nt, Mycobacterium avium subsp. paratuberculosis
gggaugcgccaccgacaccaccg

SEQ ID NO: 881362 - RNA, 17 nt, Mycobacterium avium subsp. paratuberculosis
gggcaacgaacgcggcg

SEQ ID NO: 881363 - RNA, 20 nt, Mycobacterium avium subsp. paratuberculosis
gggcaacgaacgcggcgccu

SEQ ID NO: 881364 - RNA, 14 nt, Mycobacterium avium subsp. paratuberculosis
gggaugcccggggg

SEQ ID NO: 881365 - RNA, 21 nt, Mycobacterium avium subsp. paratuberculosis
gggaugccgccggucacggcg

SEQ ID NO: 881366 - RNA, 22 nt, Mycobacterium avium subsp. paratuberculosis
ggcuucgaacgcccgcaccacg

SEQ ID NO: 881367 - RNA, 19 nt, Mycobacterium avium subsp. paratuberculosis
ggcuugccgaucgccgcgg

SEQ ID NO: 881368 - RNA, 13 nt, Mycobacterium avium subsp. paratuberculosis
ggcuugccgccgc

SEQ ID NO: 881369 - RNA, 14 nt, Mycobacterium avium subsp. paratuberculosis
ggcuuccgcggacg

SEQ ID NO: 881370 - RNA, 17 nt, Mycobacterium avium subsp. paratuberculosis
ggcuuaccgaccucgag

SEQ ID NO: 881371 - RNA, 19 nt, Mycobacterium avium subsp. paratuberculosis
ggcuuaccggcgggcggcg

SEQ ID NO: 881372 - RNA, 18 nt, Mycobacterium avium subsp. paratuberculosis
ggcucgggaacggucagc

SEQ ID NO: 881373 - RNA, 24 nt, Mycobacterium avium subsp. paratuberculosis
ggcucgggaacggucagccgcggc

SEQ ID NO: 881374 - RNA, 13 nt, Mycobacterium avium subsp. paratuberculosis
ggcucggcgucgu

SEQ ID NO: 881375 - RNA, 16 nt, Mycobacterium avium subsp. paratuberculosis
ggcucggggucggccg

SEQ ID NO: 881376 - RNA, 17 nt, Mycobacterium avium subsp. paratuberculosis
ggcucggggucggccga

SEQ ID NO: 881377 - RNA, 18 nt, Mycobacterium avium subsp. paratuberculosis
ggcucgguaugcggcgac

SEQ ID NO: 881378 - RNA, 19 nt, Mycobacterium avium subsp. paratuberculosis
ggcucggucaagccggcca

SEQ ID NO: 881379 - RNA, 22 nt, Mycobacterium avium subsp. paratuberculosis
ggcucggucaagccggccagca

SEQ ID NO: 881380 - RNA, 19 nt, Mycobacterium avium subsp. paratuberculosis
ggcucgucgaacucgugga

SEQ ID NO: 881381 - RNA, 20 nt, Mycobacterium avium subsp. paratuberculosis
ggcucguccagcccggucac

SEQ ID NO: 881382 - RNA, 14 nt, Mycobacterium avium subsp. paratuberculosis
ggcucguccucgaa

SEQ ID NO: 881383 - RNA, 22 nt, Mycobacterium avium subsp. paratuberculosis
ggcucguagcuggugcgcagcc

SEQ ID NO: 881384 - RNA, 15 nt, Mycobacterium avium subsp. paratuberculosis
ggcucggucgacacg

SEQ ID NO: 881385 - RNA, 21 nt, Mycobacterium avium subsp. paratuberculosis
ggcuguagcacccggccggcg

SEQ ID NO: 881386 - RNA, 17 nt, Mycobacterium avium subsp. paratuberculosis
ggcuguccaccugcacc

SEQ ID NO: 881387 - RNA, 13 nt, Mycobacterium avium subsp. paratuberculosis
ggcuguccagcag

SEQ ID NO: 881388 - RNA, 18 nt, Mycobacterium avium subsp. paratuberculosis
ggcucguggaacgacgcc

SEQ ID NO: 881389 - RNA, 18 nt, Mycobacterium avium subsp. paratuberculosis
ggcucguguccgaugacg

SEQ ID NO: 881390 - RNA, 16 nt, Mycobacterium avium subsp. paratuberculosis
ggcugugggccagcag

SEQ ID NO: 881391 - RNA, 15 nt, Mycobacterium avium subsp. paratuberculosis
ggcugugggcgcagg

SEQ ID NO: 881392 - RNA, 18 nt, Mycobacterium avium subsp. paratuberculosis
ggcugugggcgcagggcc

SEQ ID NO: 881393 - RNA, 20 nt, Mycobacterium avium subsp. paratuberculosis
ggcuguggaugacgcagccg

SEQ ID NO: 881394 - RNA, 14 nt, Mycobacterium avium subsp. paratuberculosis
ggcugucgcgcuga

SEQ ID NO: 881395 - RNA, 14 nt, Mycobacterium avium subsp. paratuberculosis
ggcugucggcgccc

SEQ ID NO: 881396 - RNA, 15 nt, Mycobacterium avium subsp. paratuberculosis
ggcugucggcgccca

SEQ ID NO: 881397 - RNA, 17 nt, Mycobacterium avium subsp. paratuberculosis
ggcugucgggcaggccg

SEQ ID NO: 881398 - RNA, 20 nt, Mycobacterium avium subsp. paratuberculosis
ggcugucgggcaggccggug

SEQ ID NO: 881399 - RNA, 19 nt, Mycobacterium avium subsp. paratuberculosis
ggcuguccgcguggccgag

SEQ ID NO: 881400 - RNA, 19 nt, Mycobacterium avium subsp. paratuberculosis
ggcuguccucccagcgccc

SEQ ID NO: 881401 - RNA, 21 nt, Mycobacterium avium subsp. paratuberculosis
ggcuguccucccagcgcccgg

SEQ ID NO: 881402 - RNA, 14 nt, Mycobacterium avium subsp. paratuberculosis
ggcuguccugcggu

SEQ ID NO: 881403 - RNA, 22 nt, Mycobacterium avium subsp. paratuberculosis
ggcugucccggccgcgacagcc

SEQ ID NO: 881404 - RNA, 19 nt, Mycobacterium avium subsp. paratuberculosis
gggcacaccgucguccacg

SEQ ID NO: 881405 - RNA, 21 nt, Mycobacterium avium subsp. paratuberculosis
gggcacaccgucguccacgcc

SEQ ID NO: 881406 - RNA, 19 nt, Mycobacterium avium subsp. paratuberculosis
gggcaaucgcugcgcccgc

SEQ ID NO: 881407 - RNA, 21 nt, Mycobacterium avium subsp. paratuberculosis
gggcaaucgcugcgcccgccg

SEQ ID NO: 881408 - RNA, 19 nt, Mycobacterium avium subsp. paratuberculosis
gggcaaugaugucggcggg

SEQ ID NO: 881409 - RNA, 20 nt, Mycobacterium avium subsp. paratuberculosis
gggcaauggccgcgacucug

SEQ ID NO: 881410 - RNA, 16 nt, Mycobacterium avium subsp. paratuberculosis
gggcaauaccggcagc

SEQ ID NO: 881411 - RNA, 22 nt, Mycobacterium avium subsp. paratuberculosis
gggcaugaaccaggccgcgcug

SEQ ID NO: 881412 - RNA, 20 nt, Mycobacterium avium subsp. paratuberculosis
gggcaucggcuggucggcgg

SEQ ID NO: 881413 - RNA, 12 nt, Mycobacterium avium subsp. paratuberculosis
gggcaucgcagc

SEQ ID NO: 881414 - RNA, 24 nt, Mycobacterium avium subsp. paratuberculosis
gggcaugccguucagcgcggccac

SEQ ID NO: 881415 - RNA, 16 nt, Mycobacterium avium subsp. paratuberculosis
gggcauggucaccgga

SEQ ID NO: 881416 - RNA, 21 nt, Mycobacterium avium subsp. paratuberculosis
gggcauggugaagcccagcgc

SEQ ID NO: 881417 - RNA, 15 nt, Mycobacterium avium subsp. paratuberculosis
gggcaucccgccgaa

SEQ ID NO: 881418 - RNA, 22 nt, Mycobacterium avium subsp. paratuberculosis
gggcaucccugacacgaccgcc

SEQ ID NO: 881419 - RNA, 16 nt, Mycobacterium avium subsp. paratuberculosis
gggcauccgcucgccg

SEQ ID NO: 881420 - RNA, 17 nt, Mycobacterium avium subsp. paratuberculosis
gggcauccgcucgccgc

SEQ ID NO: 881421 - RNA, 12 nt, Mycobacterium avium subsp. paratuberculosis
gggcauccggga

SEQ ID NO: 881422 - RNA, 13 nt, Mycobacterium avium subsp. paratuberculosis
gggcaccaccacc

SEQ ID NO: 881423 - RNA, 15 nt, Mycobacterium avium subsp. paratuberculosis
gggcaccaccaccga

SEQ ID NO: 881424 - RNA, 11 nt, Mycobacterium avium subsp. paratuberculosis
gggcaccacgc

SEQ ID NO: 881425 - RNA, 17 nt, Mycobacterium avium subsp. paratuberculosis
gggcaccacggcggcau

SEQ ID NO: 881426 - RNA, 18 nt, Mycobacterium avium subsp. paratuberculosis
gggcaccacggcggcaug

SEQ ID NO: 881427 - RNA, 21 nt, Mycobacterium avium subsp. paratuberculosis
gggccagacugcgcaccgcca

SEQ ID NO: 881428 - RNA, 20 nt, Mycobacterium avium subsp. paratuberculosis
gggccacgauccgcgcggcc

SEQ ID NO: 881429 - RNA, 20 nt, Mycobacterium avium subsp. paratuberculosis
gggccacgcagucgucgaug

SEQ ID NO: 881430 - RNA, 22 nt, Mycobacterium avium subsp. paratuberculosis
gggccacgcagucgucgaugaa

SEQ ID NO: 881431 - RNA, 12 nt, Mycobacterium avium subsp. paratuberculosis
gggccaccacgu

SEQ ID NO: 881432 - RNA, 12 nt, Mycobacterium avium subsp. paratuberculosis
gggccaccagcg

SEQ ID NO: 881433 - RNA, 18 nt, Mycobacterium avium subsp. paratuberculosis
gggccaccaggccgaaga

SEQ ID NO: 881434 - RNA, 20 nt, Mycobacterium avium subsp. paratuberculosis
gggccaccaggccgaagacg

SEQ ID NO: 881435 - RNA, 17 nt, Mycobacterium avium subsp. paratuberculosis
gggccaccaggcgccgu

SEQ ID NO: 881436 - RNA, 20 nt, Mycobacterium avium subsp. paratuberculosis
gggccacccgcgaucggaug

SEQ ID NO: 881437 - RNA, 14 nt, Mycobacterium avium subsp. paratuberculosis
gggccaccgcggcg

SEQ ID NO: 881438 - RNA, 16 nt, Mycobacterium avium subsp. paratuberculosis
gggccaccgcgucgcu

SEQ ID NO: 881439 - RNA, 19 nt, Mycobacterium avium subsp. paratuberculosis
gggccaccgcgucgcugcc

SEQ ID NO: 881440 - RNA, 14 nt, Mycobacterium avium subsp. paratuberculosis
gggccaccggcgcc

SEQ ID NO: 881441 - RNA, 16 nt, Mycobacterium avium subsp. paratuberculosis
gggccaccggcgccag

SEQ ID NO: 881442 - RNA, 15 nt, Mycobacterium avium subsp. paratuberculosis
gggcaugucgccgaa

SEQ ID NO: 881443 - RNA, 17 nt, Mycobacterium avium subsp. paratuberculosis
gggcaugucgccgaacg

SEQ ID NO: 881444 - RNA, 17 nt, Mycobacterium avium subsp. paratuberculosis
gggcauuggcagcucgg

SEQ ID NO: 881445 - RNA, 23 nt, Mycobacterium avium subsp. paratuberculosis
gggcauuucggcuuccaccugcg

SEQ ID NO: 881446 - RNA, 20 nt, Mycobacterium avium subsp. paratuberculosis
gggccaacgguucggccgcu

SEQ ID NO: 881447 - RNA, 17 nt, Mycobacterium avium subsp. paratuberculosis
gggccaacuccggcggc

SEQ ID NO: 881448 - RNA, 18 nt, Mycobacterium avium subsp. paratuberculosis
gggccaacuccggcggca

SEQ ID NO: 881449 - RNA, 19 nt, Mycobacterium avium subsp. paratuberculosis
gggccaacugggugggugc

SEQ ID NO: 881450 - RNA, 13 nt, Mycobacterium avium subsp. paratuberculosis
gggccaagcaccg

SEQ ID NO: 881451 - RNA, 16 nt, Mycobacterium avium subsp. paratuberculosis
gggccaagcaccggga

SEQ ID NO: 881452 - RNA, 21 nt, Mycobacterium avium subsp. paratuberculosis
gggccaaaucgcuugcgccgc

SEQ ID NO: 881453 - RNA, 23 nt, Mycobacterium avium subsp. paratuberculosis
gggccaaaucgcuugcgccgcag

SEQ ID NO: 881454 - RNA, 23 nt, Mycobacterium avium subsp. paratuberculosis
gggccaauuacgcugcggcgccg

SEQ ID NO: 881455 - RNA, 18 nt, Mycobacterium avium subsp. paratuberculosis
gggccacacccgucgacu

SEQ ID NO: 881456 - RNA, 14 nt, Mycobacterium avium subsp. paratuberculosis
gggccacagcggcg

SEQ ID NO: 881457 - RNA, 15 nt, Mycobacterium avium subsp. paratuberculosis
gggccaccaccacgg

SEQ ID NO: 881458 - RNA, 13 nt, Mycobacterium avium subsp. paratuberculosis
gggccaccacgcc

SEQ ID NO: 881459 - RNA, 15 nt, Mycobacterium avium subsp. paratuberculosis
gggccaccacgccag

SEQ ID NO: 881460 - RNA, 16 nt, Mycobacterium avium subsp. paratuberculosis
gggccaccacgccagc

SEQ ID NO: 881461 - RNA, 17 nt, Mycobacterium avium subsp. paratuberculosis
gggccaccacgccagcc

SEQ ID NO: 881462 - RNA, 19 nt, Mycobacterium avium subsp. paratuberculosis
gggccaccacgccagccuc

SEQ ID NO: 881463 - RNA, 21 nt, Mycobacterium avium subsp. paratuberculosis
gggccgacagcacgccgggca

SEQ ID NO: 881464 - RNA, 13 nt, Mycobacterium avium subsp. paratuberculosis
gggccccggcauc

SEQ ID NO: 881465 - RNA, 14 nt, Mycobacterium avium subsp. paratuberculosis
gggccccggcaucg

SEQ ID NO: 881466 - RNA, 15 nt, Mycobacterium avium subsp. paratuberculosis
gggccccggcaucga

SEQ ID NO: 881467 - RNA, 15 nt, Mycobacterium avium subsp. paratuberculosis
gggccccuccagccg

SEQ ID NO: 881468 - RNA, 22 nt, Mycobacterium avium subsp. paratuberculosis
gggccccuccagccgccggucc

SEQ ID NO: 881469 - RNA, 23 nt, Mycobacterium avium subsp. paratuberculosis
gggccccuccagccgccggucca

SEQ ID NO: 881470 - RNA, 18 nt, Mycobacterium avium subsp. paratuberculosis
gggcccacgcucgacgcg

SEQ ID NO: 881471 - RNA, 13 nt, Mycobacterium avium subsp. paratuberculosis
gggcccaccgcca

SEQ ID NO: 881472 - RNA, 14 nt, Mycobacterium avium subsp. paratuberculosis
gggcccaccgccac

SEQ ID NO: 881473 - RNA, 17 nt, Mycobacterium avium subsp. paratuberculosis
gggcccagcaccaccac

SEQ ID NO: 881474 - RNA, 19 nt, Mycobacterium avium subsp. paratuberculosis
gggcccagcaccaccacgu

SEQ ID NO: 881475 - RNA, 18 nt, Mycobacterium avium subsp. paratuberculosis
gggccauguccccgacca

SEQ ID NO: 881476 - RNA, 13 nt, Mycobacterium avium subsp. paratuberculosis
gggcccacagcag

SEQ ID NO: 881477 - RNA, 13 nt, Mycobacterium avium subsp. paratuberculosis
gggccauccggcc

SEQ ID NO: 881478 - RNA, 14 nt, Mycobacterium avium subsp. paratuberculosis
gggccaucgccagg

SEQ ID NO: 881479 - RNA, 17 nt, Mycobacterium avium subsp. paratuberculosis
gggccauauuucgugaa

SEQ ID NO: 881480 - RNA, 23 nt, Mycobacterium avium subsp. paratuberculosis
gggccaucggcagacccagcagc

SEQ ID NO: 881481 - RNA, 17 nt, Mycobacterium avium subsp. paratuberculosis
gggccaugccggccuga

SEQ ID NO: 881482 - RNA, 19 nt, Mycobacterium avium subsp. paratuberculosis
gggccaugccucuucggcg

SEQ ID NO: 881483 - RNA, 20 nt, Mycobacterium avium subsp. paratuberculosis
gggccaugccucuucggcgc

SEQ ID NO: 881484 - RNA, 22 nt, Mycobacterium avium subsp. paratuberculosis
gggccaugccucuucggcgcgc

SEQ ID NO: 881485 - RNA, 14 nt, Mycobacterium avium subsp. paratuberculosis
gggccagucgccgc

SEQ ID NO: 881486 - RNA, 14 nt, Mycobacterium avium subsp. paratuberculosis
gggccaggucggug

SEQ ID NO: 881487 - RNA, 17 nt, Mycobacterium avium subsp. paratuberculosis
gggccaggugugcccgc

SEQ ID NO: 881488 - RNA, 15 nt, Mycobacterium avium subsp. paratuberculosis
gggccagguucaggc

SEQ ID NO: 881489 - RNA, 19 nt, Mycobacterium avium subsp. paratuberculosis
gggccagguucaggcccgc

SEQ ID NO: 881490 - RNA, 22 nt, Mycobacterium avium subsp. paratuberculosis
gggccagguucaggcccgcgcc

SEQ ID NO: 881491 - RNA, 16 nt, Mycobacterium avium subsp. paratuberculosis
gggccaggcgcgcgcu

SEQ ID NO: 881492 - RNA, 15 nt, Mycobacterium avium subsp. paratuberculosis
gggccaggcgggacg

SEQ ID NO: 881493 - RNA, 15 nt, Mycobacterium avium subsp. paratuberculosis
gggccaggcggguga

SEQ ID NO: 881494 - RNA, 16 nt, Mycobacterium avium subsp. paratuberculosis
gggccaggccgugauc

SEQ ID NO: 881495 - RNA, 20 nt, Mycobacterium avium subsp. paratuberculosis
gggccaggaugaccgcccag

SEQ ID NO: 881496 - RNA, 18 nt, Mycobacterium avium subsp. paratuberculosis
gggccaggaugccgaacg

SEQ ID NO: 881497 - RNA, 23 nt, Mycobacterium avium subsp. paratuberculosis
gggccaggauguucaccccggcg

SEQ ID NO: 881498 - RNA, 18 nt, Mycobacterium avium subsp. paratuberculosis
gggccaggcacggcccgu

SEQ ID NO: 881499 - RNA, 15 nt, Mycobacterium avium subsp. paratuberculosis
gggccagcggcgccg

SEQ ID NO: 881500 - RNA, 13 nt, Mycobacterium avium subsp. paratuberculosis
gggccagcgcggu

SEQ ID NO: 881501 - RNA, 18 nt, Mycobacterium avium subsp. paratuberculosis
gggccagcgcgguggcca

SEQ ID NO: 881502 - RNA, 13 nt, Mycobacterium avium subsp. paratuberculosis
gggccagcgccga

SEQ ID NO: 881503 - RNA, 16 nt, Mycobacterium avium subsp. paratuberculosis
gggccagcgccgagcc

SEQ ID NO: 881504 - RNA, 17 nt, Mycobacterium avium subsp. paratuberculosis
gggccagcgccucggcg

SEQ ID NO: 881505 - RNA, 21 nt, Mycobacterium avium subsp. paratuberculosis
gggccagcgccuucggcgcca

SEQ ID NO: 881506 - RNA, 23 nt, Mycobacterium avium subsp. paratuberculosis
gggccagcgccuucggcgccagc

SEQ ID NO: 881507 - RNA, 24 nt, Mycobacterium avium subsp. paratuberculosis
gggccagcgccuucggcgccagcc

SEQ ID NO: 881508 - RNA, 14 nt, Mycobacterium avium subsp. paratuberculosis
gggccagccgaugc

SEQ ID NO: 881509 - RNA, 19 nt, Mycobacterium avium subsp. paratuberculosis
gggccagccgaugcgcccg

SEQ ID NO: 881510 - RNA, 20 nt, Mycobacterium avium subsp. paratuberculosis
gggccagccgaugcgcccgc

SEQ ID NO: 881511 - RNA, 16 nt, Mycobacterium avium subsp. paratuberculosis
gggccagcagucguga

SEQ ID NO: 881512 - RNA, 18 nt, Mycobacterium avium subsp. paratuberculosis
gggccagcagcgucguca

SEQ ID NO: 881513 - RNA, 14 nt, Mycobacterium avium subsp. paratuberculosis
gggccagccguugu

SEQ ID NO: 881514 - RNA, 15 nt, Mycobacterium avium subsp. paratuberculosis
gggccagcaacacca

SEQ ID NO: 881515 - RNA, 23 nt, Mycobacterium avium subsp. paratuberculosis
gggccagcaacagcagcggcaug

SEQ ID NO: 881516 - RNA, 21 nt, Mycobacterium avium subsp. paratuberculosis
gggccagcacgaccccgccca

SEQ ID NO: 881517 - RNA, 23 nt, Mycobacterium avium subsp. paratuberculosis
gggccagcacgaccccgcccacg

SEQ ID NO: 881518 - RNA, 15 nt, Mycobacterium avium subsp. paratuberculosis
gggccagcagccagc

SEQ ID NO: 881519 - RNA, 21 nt, Mycobacterium avium subsp. paratuberculosis
gggccagcagccagcugguga

SEQ ID NO: 881520 - RNA, 15 nt, Mycobacterium avium subsp. paratuberculosis
gggcgaacccggcgc

SEQ ID NO: 881521 - RNA, 21 nt, Mycobacterium avium subsp. paratuberculosis
gggcgaagcgaaagacguuga

SEQ ID NO: 881522 - RNA, 20 nt, Mycobacterium avium subsp. paratuberculosis
gggcgaaggagaagacacgc

SEQ ID NO: 881523 - RNA, 14 nt, Mycobacterium avium subsp. paratuberculosis
gggcgaugcggccc

SEQ ID NO: 881524 - RNA, 16 nt, Mycobacterium avium subsp. paratuberculosis
gggcgaugcggcccgg

SEQ ID NO: 881525 - RNA, 17 nt, Mycobacterium avium subsp. paratuberculosis
gggcgaaucugucgaug

SEQ ID NO: 881526 - RNA, 14 nt, Mycobacterium avium subsp. paratuberculosis
gggcgaugccgaca

SEQ ID NO: 881527 - RNA, 15 nt, Mycobacterium avium subsp. paratuberculosis
gggcgaugccgacac

SEQ ID NO: 881528 - RNA, 23 nt, Mycobacterium avium subsp. paratuberculosis
gggcgcaccacgaccuccgugcc

SEQ ID NO: 881529 - RNA, 17 nt, Mycobacterium avium subsp. paratuberculosis
gggcgcagcccggcggu

SEQ ID NO: 881530 - RNA, 15 nt, Mycobacterium avium subsp. paratuberculosis
gggcgcagccgaucg

SEQ ID NO: 881531 - RNA, 14 nt, Mycobacterium avium subsp. paratuberculosis
gggcgcagcgccgu

SEQ ID NO: 881532 - RNA, 19 nt, Mycobacterium avium subsp. paratuberculosis
gggcgcagcgccgucucga

SEQ ID NO: 881533 - RNA, 18 nt, Mycobacterium avium subsp. paratuberculosis
gggcgauuucgucggcgg

SEQ ID NO: 881534 - RNA, 19 nt, Mycobacterium avium subsp. paratuberculosis
gggcgauuucgucggcggu

SEQ ID NO: 881535 - RNA, 14 nt, Mycobacterium avium subsp. paratuberculosis
gggcgccggcguca

SEQ ID NO: 881536 - RNA, 13 nt, Mycobacterium avium subsp. paratuberculosis
gggcgccggcugc

SEQ ID NO: 881537 - RNA, 13 nt, Mycobacterium avium subsp. paratuberculosis
gggcgccgguauc

SEQ ID NO: 881538 - RNA, 21 nt, Mycobacterium avium subsp. paratuberculosis
gggcgccgguaucgagcacca

SEQ ID NO: 881539 - RNA, 20 nt, Mycobacterium avium subsp. paratuberculosis
gggcgccggucggcggaacg

SEQ ID NO: 881540 - RNA, 13 nt, Mycobacterium avium subsp. paratuberculosis
gggcgccagccgu

SEQ ID NO: 881541 - RNA, 14 nt, Mycobacterium avium subsp. paratuberculosis
gggcgccggccggc

SEQ ID NO: 881542 - RNA, 21 nt, Mycobacterium avium subsp. paratuberculosis
gggcgccggccggcgcgugcg

SEQ ID NO: 881543 - RNA, 12 nt, Mycobacterium avium subsp. paratuberculosis
gggcgccggcgc

SEQ ID NO: 881544 - RNA, 15 nt, Mycobacterium avium subsp. paratuberculosis
gggcgccgccgaaca

SEQ ID NO: 881545 - RNA, 23 nt, Mycobacterium avium subsp. paratuberculosis
gggcgccgccggcgucgacgucg

SEQ ID NO: 881546 - RNA, 23 nt, Mycobacterium avium subsp. paratuberculosis
gggcgccgacgaucccggcgagc

SEQ ID NO: 881547 - RNA, 13 nt, Mycobacterium avium subsp. paratuberculosis
gggcgccgagaac

SEQ ID NO: 881548 - RNA, 19 nt, Mycobacterium avium subsp. paratuberculosis
gggcgccgaguccgggccg

SEQ ID NO: 881549 - RNA, 20 nt, Mycobacterium avium subsp. paratuberculosis
gggcgccgaguccgggccgc

SEQ ID NO: 881550 - RNA, 15 nt, Mycobacterium avium subsp. paratuberculosis
gggcgccauccgcag

SEQ ID NO: 881551 - RNA, 16 nt, Mycobacterium avium subsp. paratuberculosis
gggcgccauccgccac

SEQ ID NO: 881552 - RNA, 22 nt, Mycobacterium avium subsp. paratuberculosis
gggcgccccgacaucgccauca

SEQ ID NO: 881553 - RNA, 13 nt, Mycobacterium avium subsp. paratuberculosis
gggcgccccgcug

SEQ ID NO: 881554 - RNA, 18 nt, Mycobacterium avium subsp. paratuberculosis
gggcgccccuggcgucgg

SEQ ID NO: 881555 - RNA, 16 nt, Mycobacterium avium subsp. paratuberculosis
gggcgcccgcggcgcg

SEQ ID NO: 881556 - RNA, 17 nt, Mycobacterium avium subsp. paratuberculosis
gggcgcccgcggcgcgc

SEQ ID NO: 881557 - RNA, 14 nt, Mycobacterium avium subsp. paratuberculosis
gggcgcauaccagc

SEQ ID NO: 881558 - RNA, 21 nt, Mycobacterium avium subsp. paratuberculosis
gggcgccacuucuccacgccg

SEQ ID NO: 881559 - RNA, 12 nt, Mycobacterium avium subsp. paratuberculosis
gggcgccagcag

SEQ ID NO: 881560 - RNA, 18 nt, Mycobacterium avium subsp. paratuberculosis
gggcgcaccgcgcgccag

SEQ ID NO: 881561 - RNA, 23 nt, Mycobacterium avium subsp. paratuberculosis
gggcgcagguccacccgccccgc

SEQ ID NO: 881562 - RNA, 17 nt, Mycobacterium avium subsp. paratuberculosis
gggcgcaggugggcggu

SEQ ID NO: 881563 - RNA, 21 nt, Mycobacterium avium subsp. paratuberculosis
gggccuucuuggcggcggccu

SEQ ID NO: 881564 - RNA, 15 nt, Mycobacterium avium subsp. paratuberculosis
gggccuuggccaacg

SEQ ID NO: 881565 - RNA, 15 nt, Mycobacterium avium subsp. paratuberculosis
gggccuuguugcggc

SEQ ID NO: 881566 - RNA, 18 nt, Mycobacterium avium subsp. paratuberculosis
gggccuuguugcggcgca

SEQ ID NO: 881567 - RNA, 14 nt, Mycobacterium avium subsp. paratuberculosis
gggccuugagcacc

SEQ ID NO: 881568 - RNA, 16 nt, Mycobacterium avium subsp. paratuberculosis
gggccuugagcaccgc

SEQ ID NO: 881569 - RNA, 21 nt, Mycobacterium avium subsp. paratuberculosis
gggcgaacuugcuggccgagu

SEQ ID NO: 881570 - RNA, 20 nt, Mycobacterium avium subsp. paratuberculosis
gggcgaacggcaacggcggc

SEQ ID NO: 881571 - RNA, 12 nt, Mycobacterium avium subsp. paratuberculosis
gggccgucgccc

SEQ ID NO: 881572 - RNA, 15 nt, Mycobacterium avium subsp. paratuberculosis
gggccgucgcccgga

SEQ ID NO: 881573 - RNA, 22 nt, Mycobacterium avium subsp. paratuberculosis
gggccgccagguuggcggcggc

SEQ ID NO: 881574 - RNA, 22 nt, Mycobacterium avium subsp. paratuberculosis
gggccguaucggccccggccga

SEQ ID NO: 881575 - RNA, 24 nt, Mycobacterium avium subsp. paratuberculosis
gggccguaucggccccggccgagc

SEQ ID NO: 881576 - RNA, 15 nt, Mycobacterium avium subsp. paratuberculosis
gggccgucacaggcc

SEQ ID NO: 881577 - RNA, 23 nt, Mycobacterium avium subsp. paratuberculosis
gggccgucacaggccgccugcgg

SEQ ID NO: 881578 - RNA, 13 nt, Mycobacterium avium subsp. paratuberculosis
gggccgucaucgc

SEQ ID NO: 881579 - RNA, 14 nt, Mycobacterium avium subsp. paratuberculosis
gggccguccgccgg

SEQ ID NO: 881580 - RNA, 18 nt, Mycobacterium avium subsp. paratuberculosis
gggccggugcagcacgug

SEQ ID NO: 881581 - RNA, 20 nt, Mycobacterium avium subsp. paratuberculosis
gggccggugcagcacgugcg

SEQ ID NO: 881582 - RNA, 13 nt, Mycobacterium avium subsp. paratuberculosis
gggccgccagccg

SEQ ID NO: 881583 - RNA, 20 nt, Mycobacterium avium subsp. paratuberculosis
gggccggucggucggccgca

SEQ ID NO: 881584 - RNA, 18 nt, Mycobacterium avium subsp. paratuberculosis
gggccgcagccgcgcggc

SEQ ID NO: 881585 - RNA, 19 nt, Mycobacterium avium subsp. paratuberculosis
gggccgcaggguggccagc

SEQ ID NO: 881586 - RNA, 23 nt, Mycobacterium avium subsp. paratuberculosis
gggccgcaauacggugcccgccg

SEQ ID NO: 881587 - RNA, 17 nt, Mycobacterium avium subsp. paratuberculosis
gggccgcacccccucca

SEQ ID NO: 881588 - RNA, 21 nt, Mycobacterium avium subsp. paratuberculosis
gggccgcaccugaucgaugcc

SEQ ID NO: 881589 - RNA, 22 nt, Mycobacterium avium subsp. paratuberculosis
gggccgcaccugaucgaugccg

SEQ ID NO: 881590 - RNA, 13 nt, Mycobacterium avium subsp. paratuberculosis
gggccgcccgcgc

SEQ ID NO: 881591 - RNA, 20 nt, Mycobacterium avium subsp. paratuberculosis
gggccgcccgcgcguggucc

SEQ ID NO: 881592 - RNA, 19 nt, Mycobacterium avium subsp. paratuberculosis
gggccgggcgggcacccca

SEQ ID NO: 881593 - RNA, 19 nt, Mycobacterium avium subsp. paratuberculosis
gggccgggcgugcccggcg

SEQ ID NO: 881594 - RNA, 20 nt, Mycobacterium avium subsp. paratuberculosis
gggccgggcgugcccggcgc

SEQ ID NO: 881595 - RNA, 13 nt, Mycobacterium avium subsp. paratuberculosis
gggccgggcuacc

SEQ ID NO: 881596 - RNA, 18 nt, Mycobacterium avium subsp. paratuberculosis
gggccggggcuucgaacg

SEQ ID NO: 881597 - RNA, 18 nt, Mycobacterium avium subsp. paratuberculosis
gggccgggggcggcggcg

SEQ ID NO: 881598 - RNA, 16 nt, Mycobacterium avium subsp. paratuberculosis
gggccggguccacgcc

SEQ ID NO: 881599 - RNA, 15 nt, Mycobacterium avium subsp. paratuberculosis
gggccgggucgaacg

SEQ ID NO: 881600 - RNA, 20 nt, Mycobacterium avium subsp. paratuberculosis
gggccgggucgaacggcaac

SEQ ID NO: 881601 - RNA, 14 nt, Mycobacterium avium subsp. paratuberculosis
gggccggucaccgg

SEQ ID NO: 881602 - RNA, 16 nt, Mycobacterium avium subsp. paratuberculosis
gggccggucaccgguc

SEQ ID NO: 881603 - RNA, 24 nt, Mycobacterium avium subsp. paratuberculosis
gggccggucagcgcgacaucgccg

SEQ ID NO: 881604 - RNA, 18 nt, Mycobacterium avium subsp. paratuberculosis
gggccgguccccggcgac

SEQ ID NO: 881605 - RNA, 16 nt, Mycobacterium avium subsp. paratuberculosis
gggccgaugaccgcgg

SEQ ID NO: 881606 - RNA, 17 nt, Mycobacterium avium subsp. paratuberculosis
gggccgaugaccgcggc

SEQ ID NO: 881607 - RNA, 22 nt, Mycobacterium avium subsp. paratuberculosis
gggccgaugaccgcggcgggca

SEQ ID NO: 881608 - RNA, 20 nt, Mycobacterium avium subsp. paratuberculosis
gggccgaucagugccgcgcc

SEQ ID NO: 881609 - RNA, 22 nt, Mycobacterium avium subsp. paratuberculosis
gggccgaucagugccgcgccaa

SEQ ID NO: 881610 - RNA, 15 nt, Mycobacterium avium subsp. paratuberculosis
gggccgagcgcgccg

SEQ ID NO: 881611 - RNA, 17 nt, Mycobacterium avium subsp. paratuberculosis
gggccgagcgcgccgcc

SEQ ID NO: 881612 - RNA, 16 nt, Mycobacterium avium subsp. paratuberculosis
gggccgaccuggcggc

SEQ ID NO: 881613 - RNA, 20 nt, Mycobacterium avium subsp. paratuberculosis
gggccgaccuggcggccgga

SEQ ID NO: 881614 - RNA, 20 nt, Mycobacterium avium subsp. paratuberculosis
gggcccgauggcggccugca

SEQ ID NO: 881615 - RNA, 16 nt, Mycobacterium avium subsp. paratuberculosis
gggccgaccggccggu

SEQ ID NO: 881616 - RNA, 22 nt, Mycobacterium avium subsp. paratuberculosis
gggccgaccugcacgcugaagc

SEQ ID NO: 881617 - RNA, 23 nt, Mycobacterium avium subsp. paratuberculosis
gggucaauugccacagccgguca

SEQ ID NO: 881618 - RNA, 17 nt, Mycobacterium avium subsp. paratuberculosis
ggguauuucgagcacac

SEQ ID NO: 881619 - RNA, 18 nt, Mycobacterium avium subsp. paratuberculosis
gggucacacccucggccc

SEQ ID NO: 881620 - RNA, 11 nt, Mycobacterium avium subsp. paratuberculosis
gggucaccgga

SEQ ID NO: 881621 - RNA, 16 nt, Mycobacterium avium subsp. paratuberculosis
gggucaccggccgagc

SEQ ID NO: 881622 - RNA, 20 nt, Mycobacterium avium subsp. paratuberculosis
gggucaccggccgagccgau

SEQ ID NO: 881623 - RNA, 14 nt, Mycobacterium avium subsp. paratuberculosis
gggucaccgugcgg

SEQ ID NO: 881624 - RNA, 19 nt, Mycobacterium avium subsp. paratuberculosis
ggguaguucagcgcgcggg

SEQ ID NO: 881625 - RNA, 21 nt, Mycobacterium avium subsp. paratuberculosis
gggucagcagcgucugcgcca

SEQ ID NO: 881626 - RNA, 20 nt, Mycobacterium avium subsp. paratuberculosis
gggucagccacgggcggucg

SEQ ID NO: 881627 - RNA, 21 nt, Mycobacterium avium subsp. paratuberculosis
gggucagcgcuuccagcgcgg

SEQ ID NO: 881628 - RNA, 15 nt, Mycobacterium avium subsp. paratuberculosis
gggucagcgucgcca

SEQ ID NO: 881629 - RNA, 12 nt, Mycobacterium avium subsp. paratuberculosis
gggucagcgugc

SEQ ID NO: 881630 - RNA, 22 nt, Mycobacterium avium subsp. paratuberculosis
gggucagcucccccgucgggcc

SEQ ID NO: 881631 - RNA, 18 nt, Mycobacterium avium subsp. paratuberculosis
gggucaccgugcgggucg

SEQ ID NO: 881632 - RNA, 21 nt, Mycobacterium avium subsp. paratuberculosis
gggucaccgugcgggucgcgc

SEQ ID NO: 881633 - RNA, 23 nt, Mycobacterium avium subsp. paratuberculosis
gggucacggauacccgcggccuc

SEQ ID NO: 881634 - RNA, 23 nt, Mycobacterium avium subsp. paratuberculosis
gggucacgugcacccacgccagc

SEQ ID NO: 881635 - RNA, 14 nt, Mycobacterium avium subsp. paratuberculosis
gggucacucgaccu

SEQ ID NO: 881636 - RNA, 16 nt, Mycobacterium avium subsp. paratuberculosis
gggucagaccgcggcg

SEQ ID NO: 881637 - RNA, 18 nt, Mycobacterium avium subsp. paratuberculosis
gggucagaccgcggcggu

SEQ ID NO: 881638 - RNA, 13 nt, Mycobacterium avium subsp. paratuberculosis
gggucagcaccac

SEQ ID NO: 881639 - RNA, 24 nt, Mycobacterium avium subsp. paratuberculosis
gggucagcacccgcagccgcgagu

SEQ ID NO: 881640 - RNA, 15 nt, Mycobacterium avium subsp. paratuberculosis
gggucauccagccgu

SEQ ID NO: 881641 - RNA, 17 nt, Mycobacterium avium subsp. paratuberculosis
gggucauccccgugcgg

SEQ ID NO: 881642 - RNA, 19 nt, Mycobacterium avium subsp. paratuberculosis
gggucauccccgugcgggg

SEQ ID NO: 881643 - RNA, 16 nt, Mycobacterium avium subsp. paratuberculosis
gggucaguucgcggcg

SEQ ID NO: 881644 - RNA, 18 nt, Mycobacterium avium subsp. paratuberculosis
gggucaguucgcggcgca

SEQ ID NO: 881645 - RNA, 15 nt, Mycobacterium avium subsp. paratuberculosis
ggguccagccgcggu

SEQ ID NO: 881646 - RNA, 13 nt, Mycobacterium avium subsp. paratuberculosis
ggguccgccgucg

SEQ ID NO: 881647 - RNA, 15 nt, Mycobacterium avium subsp. paratuberculosis
ggguccggucagcac

SEQ ID NO: 881648 - RNA, 17 nt, Mycobacterium avium subsp. paratuberculosis
ggguccggucagcaccg

SEQ ID NO: 881649 - RNA, 22 nt, Mycobacterium avium subsp. paratuberculosis
ggguccguguggcgcugaugaa

SEQ ID NO: 881650 - RNA, 14 nt, Mycobacterium avium subsp. paratuberculosis
ggguccucucggcg

SEQ ID NO: 881651 - RNA, 18 nt, Mycobacterium avium subsp. paratuberculosis
ggguccucucggcgccgu

SEQ ID NO: 881652 - RNA, 15 nt, Mycobacterium avium subsp. paratuberculosis
ggguccuugccggcg

SEQ ID NO: 881653 - RNA, 19 nt, Mycobacterium avium subsp. paratuberculosis
ggguccuugcgccccggcg

SEQ ID NO: 881654 - RNA, 20 nt, Mycobacterium avium subsp. paratuberculosis
gggucgaacaucacccggcg

SEQ ID NO: 881655 - RNA, 21 nt, Mycobacterium avium subsp. paratuberculosis
gggucgaacaucacccggcgg

SEQ ID NO: 881656 - RNA, 18 nt, Mycobacterium avium subsp. paratuberculosis
ggguccgcaacgccggcg

SEQ ID NO: 881657 - RNA, 14 nt, Mycobacterium avium subsp. paratuberculosis
ggguccgcacccgg

SEQ ID NO: 881658 - RNA, 14 nt, Mycobacterium avium subsp. paratuberculosis
ggguccgccgggcg

SEQ ID NO: 881659 - RNA, 17 nt, Mycobacterium avium subsp. paratuberculosis
ggguccaggccgcgccg

SEQ ID NO: 881660 - RNA, 21 nt, Mycobacterium avium subsp. paratuberculosis
ggguccaucgccucgaccagc

SEQ ID NO: 881661 - RNA, 24 nt, Mycobacterium avium subsp. paratuberculosis
ggguccaucgccucgaccagcacc

SEQ ID NO: 881662 - RNA, 18 nt, Mycobacterium avium subsp. paratuberculosis
gggucccaauccucgccg

SEQ ID NO: 881663 - RNA, 19 nt, Mycobacterium avium subsp. paratuberculosis
gggucccagaugcgcgacg

SEQ ID NO: 881664 - RNA, 23 nt, Mycobacterium avium subsp. paratuberculosis
gggucccuuugcuguucgucgag

SEQ ID NO: 881665 - RNA, 18 nt, Mycobacterium avium subsp. paratuberculosis
gggucuggcucggcacca

SEQ ID NO: 881666 - RNA, 14 nt, Mycobacterium avium subsp. paratuberculosis
gggucuggcccggu

SEQ ID NO: 881667 - RNA, 14 nt, Mycobacterium avium subsp. paratuberculosis
gggucugcggccgg

SEQ ID NO: 881668 - RNA, 18 nt, Mycobacterium avium subsp. paratuberculosis
gggucugcucacgcaacg

SEQ ID NO: 881669 - RNA, 19 nt, Mycobacterium avium subsp. paratuberculosis
gggucgugcaucggcgccu

SEQ ID NO: 881670 - RNA, 15 nt, Mycobacterium avium subsp. paratuberculosis
gggucguccgcgacg

SEQ ID NO: 881671 - RNA, 17 nt, Mycobacterium avium subsp. paratuberculosis
gggucguccgcgacgcu

SEQ ID NO: 881672 - RNA, 20 nt, Mycobacterium avium subsp. paratuberculosis
gggucgucgcgguccacgcc

SEQ ID NO: 881673 - RNA, 17 nt, Mycobacterium avium subsp. paratuberculosis
gggucucaucccgccga

SEQ ID NO: 881674 - RNA, 13 nt, Mycobacterium avium subsp. paratuberculosis
gggucgucggcgu

SEQ ID NO: 881675 - RNA, 15 nt, Mycobacterium avium subsp. paratuberculosis
gggucguagccgucg

SEQ ID NO: 881676 - RNA, 12 nt, Mycobacterium avium subsp. paratuberculosis
gggucgucgacg

SEQ ID NO: 881677 - RNA, 13 nt, Mycobacterium avium subsp. paratuberculosis
gggucgucgacgg

SEQ ID NO: 881678 - RNA, 18 nt, Mycobacterium avium subsp. paratuberculosis
gggucgucgacggccgcg

SEQ ID NO: 881679 - RNA, 14 nt, Mycobacterium avium subsp. paratuberculosis
gggucgucgacguc

SEQ ID NO: 881680 - RNA, 23 nt, Mycobacterium avium subsp. paratuberculosis
gggucgucgacgucggacgcggc

SEQ ID NO: 881681 - RNA, 16 nt, Mycobacterium avium subsp. paratuberculosis
gggucguaccaccacc

SEQ ID NO: 881682 - RNA, 14 nt, Mycobacterium avium subsp. paratuberculosis
gggucgguggccca

SEQ ID NO: 881683 - RNA, 17 nt, Mycobacterium avium subsp. paratuberculosis
gggucgggccggacagc

SEQ ID NO: 881684 - RNA, 17 nt, Mycobacterium avium subsp. paratuberculosis
gggucgggugcggcggu

SEQ ID NO: 881685 - RNA, 14 nt, Mycobacterium avium subsp. paratuberculosis
gggucggucgagcc

SEQ ID NO: 881686 - RNA, 13 nt, Mycobacterium avium subsp. paratuberculosis
gggucggucggcc

SEQ ID NO: 881687 - RNA, 16 nt, Mycobacterium avium subsp. paratuberculosis
gggucggucggcccgc

SEQ ID NO: 881688 - RNA, 12 nt, Mycobacterium avium subsp. paratuberculosis
gggucggcgccg

SEQ ID NO: 881689 - RNA, 21 nt, Mycobacterium avium subsp. paratuberculosis
gggucggcgccgcgcgccagc

SEQ ID NO: 881690 - RNA, 18 nt, Mycobacterium avium subsp. paratuberculosis
gggucggcgccggccagc

SEQ ID NO: 881691 - RNA, 17 nt, Mycobacterium avium subsp. paratuberculosis
gggucggcgucgggccg

SEQ ID NO: 881692 - RNA, 21 nt, Mycobacterium avium subsp. paratuberculosis
gggucggcucggcucggccgg

SEQ ID NO: 881693 - RNA, 22 nt, Mycobacterium avium subsp. paratuberculosis
gggucggcucggcucggccggc

SEQ ID NO: 881694 - RNA, 22 nt, Mycobacterium avium subsp. paratuberculosis
gggucggagcaaauccggcagc

SEQ ID NO: 881695 - RNA, 15 nt, Mycobacterium avium subsp. paratuberculosis
gggucggccggaucg

SEQ ID NO: 881696 - RNA, 12 nt, Mycobacterium avium subsp. paratuberculosis
gggucggccggc

SEQ ID NO: 881697 - RNA, 15 nt, Mycobacterium avium subsp. paratuberculosis
gggucggccggcggg

SEQ ID NO: 881698 - RNA, 16 nt, Mycobacterium avium subsp. paratuberculosis
gggucggcgaccaugc

SEQ ID NO: 881699 - RNA, 21 nt, Mycobacterium avium subsp. paratuberculosis
gggucgccaggccaccgcacg

SEQ ID NO: 881700 - RNA, 19 nt, Mycobacterium avium subsp. paratuberculosis
gggucgccgaucucggcca

SEQ ID NO: 881701 - RNA, 13 nt, Mycobacterium avium subsp. paratuberculosis
gggucgcggccca

SEQ ID NO: 881702 - RNA, 13 nt, Mycobacterium avium subsp. paratuberculosis
gggucgccggucu

SEQ ID NO: 881703 - RNA, 12 nt, Mycobacterium avium subsp. paratuberculosis
gggucgccgucg

SEQ ID NO: 881704 - RNA, 16 nt, Mycobacterium avium subsp. paratuberculosis
gggucgaucucggcgc

SEQ ID NO: 881705 - RNA, 15 nt, Mycobacterium avium subsp. paratuberculosis
gggucgauggcgacg

SEQ ID NO: 881706 - RNA, 16 nt, Mycobacterium avium subsp. paratuberculosis
ggguccuggcccccgc

SEQ ID NO: 881707 - RNA, 22 nt, Mycobacterium avium subsp. paratuberculosis
gggucgaaguccugcgccgcgg

SEQ ID NO: 881708 - RNA, 21 nt, Mycobacterium avium subsp. paratuberculosis
gggucgacagccugaccgcgg

SEQ ID NO: 881709 - RNA, 14 nt, Mycobacterium avium subsp. paratuberculosis
gggucgacccgccg

SEQ ID NO: 881710 - RNA, 16 nt, Mycobacterium avium subsp. paratuberculosis
gggucgacccgccgca

SEQ ID NO: 881711 - RNA, 13 nt, Mycobacterium avium subsp. paratuberculosis
gggucgaccgccg

SEQ ID NO: 881712 - RNA, 14 nt, Mycobacterium avium subsp. paratuberculosis
gggucgaccgccgc

SEQ ID NO: 881713 - RNA, 11 nt, Mycobacterium avium subsp. paratuberculosis
gggucgacgcc

SEQ ID NO: 881714 - RNA, 20 nt, Mycobacterium avium subsp. paratuberculosis
gggucgacugggccaggucg

SEQ ID NO: 881715 - RNA, 20 nt, Mycobacterium avium subsp. paratuberculosis
gggucgagacaccgucgcgc

SEQ ID NO: 881716 - RNA, 16 nt, Mycobacterium avium subsp. paratuberculosis
gggucgagaucagcac

SEQ ID NO: 881717 - RNA, 23 nt, Mycobacterium avium subsp. paratuberculosis
ggggcugcgcggcuugcugcggu

SEQ ID NO: 881718 - RNA, 18 nt, Mycobacterium avium subsp. paratuberculosis
ggggcugcgggccaggcg

SEQ ID NO: 881719 - RNA, 16 nt, Mycobacterium avium subsp. paratuberculosis
ggggcuguccucccag

SEQ ID NO: 881720 - RNA, 14 nt, Mycobacterium avium subsp. paratuberculosis
ggggcgucgcccgc

SEQ ID NO: 881721 - RNA, 13 nt, Mycobacterium avium subsp. paratuberculosis
ggggcgucgccgc

SEQ ID NO: 881722 - RNA, 14 nt, Mycobacterium avium subsp. paratuberculosis
ggggcgucgccgcc

SEQ ID NO: 881723 - RNA, 13 nt, Mycobacterium avium subsp. paratuberculosis
ggggcgucggcgg

SEQ ID NO: 881724 - RNA, 19 nt, Mycobacterium avium subsp. paratuberculosis
ggggcgucggcggccuuga

SEQ ID NO: 881725 - RNA, 16 nt, Mycobacterium avium subsp. paratuberculosis
ggggcguugcccgucg

SEQ ID NO: 881726 - RNA, 18 nt, Mycobacterium avium subsp. paratuberculosis
ggggcguugcccgucgcc

SEQ ID NO: 881727 - RNA, 13 nt, Mycobacterium avium subsp. paratuberculosis
ggggcucagccga

SEQ ID NO: 881728 - RNA, 22 nt, Mycobacterium avium subsp. paratuberculosis
ggggcucagccgaagccggcgc

SEQ ID NO: 881729 - RNA, 17 nt, Mycobacterium avium subsp. paratuberculosis
gggggaacccccucgcg

SEQ ID NO: 881730 - RNA, 18 nt, Mycobacterium avium subsp. paratuberculosis
gggggaacccccucgcgc

SEQ ID NO: 881731 - RNA, 18 nt, Mycobacterium avium subsp. paratuberculosis
ggggcuucgaacgcccgc

SEQ ID NO: 881732 - RNA, 22 nt, Mycobacterium avium subsp. paratuberculosis
ggggcuucgaacgcccgcacca

SEQ ID NO: 881733 - RNA, 22 nt, Mycobacterium avium subsp. paratuberculosis
ggggcuuuugcgucugcucgcg

SEQ ID NO: 881734 - RNA, 20 nt, Mycobacterium avium subsp. paratuberculosis
gggggcuuuugcgucugcuc

SEQ ID NO: 881735 - RNA, 14 nt, Mycobacterium avium subsp. paratuberculosis
gggguacucggcgg

SEQ ID NO: 881736 - RNA, 15 nt, Mycobacterium avium subsp. paratuberculosis
gggguacucggcggc

SEQ ID NO: 881737 - RNA, 17 nt, Mycobacterium avium subsp. paratuberculosis
gggguagaggccgcgga

SEQ ID NO: 881738 - RNA, 15 nt, Mycobacterium avium subsp. paratuberculosis
gggguccaccggccg

SEQ ID NO: 881739 - RNA, 19 nt, Mycobacterium avium subsp. paratuberculosis
gggguccuccagcggcagg

SEQ ID NO: 881740 - RNA, 21 nt, Mycobacterium avium subsp. paratuberculosis
gggguccucgauggcggcggc

SEQ ID NO: 881741 - RNA, 16 nt, Mycobacterium avium subsp. paratuberculosis
ggggucaagcggcaga

SEQ ID NO: 881742 - RNA, 14 nt, Mycobacterium avium subsp. paratuberculosis
gggguagccggccc

SEQ ID NO: 881743 - RNA, 17 nt, Mycobacterium avium subsp. paratuberculosis
gggguaguucugcucga

SEQ ID NO: 881744 - RNA, 23 nt, Mycobacterium avium subsp. paratuberculosis
gggggucaucagugaccgcacga

SEQ ID NO: 881745 - RNA, 14 nt, Mycobacterium avium subsp. paratuberculosis
gggggucgacccgc

SEQ ID NO: 881746 - RNA, 19 nt, Mycobacterium avium subsp. paratuberculosis
gggggcuuuugcgucugcu

SEQ ID NO: 881747 - RNA, 11 nt, Mycobacterium avium subsp. paratuberculosis
gggggcggccg

SEQ ID NO: 881748 - RNA, 15 nt, Mycobacterium avium subsp. paratuberculosis
gggguucccggccgg

SEQ ID NO: 881749 - RNA, 19 nt, Mycobacterium avium subsp. paratuberculosis
gggguucccggccgguggc

SEQ ID NO: 881750 - RNA, 14 nt, Mycobacterium avium subsp. paratuberculosis
gggguucgacguca

SEQ ID NO: 881751 - RNA, 21 nt, Mycobacterium avium subsp. paratuberculosis
gggguucguugcgccgccagg

SEQ ID NO: 881752 - RNA, 14 nt, Mycobacterium avium subsp. paratuberculosis
gggguuggcgcgca

SEQ ID NO: 881753 - RNA, 15 nt, Mycobacterium avium subsp. paratuberculosis
ggggugggcacgucg

SEQ ID NO: 881754 - RNA, 14 nt, Mycobacterium avium subsp. paratuberculosis
ggggugggccaucg

SEQ ID NO: 881755 - RNA, 20 nt, Mycobacterium avium subsp. paratuberculosis
ggggucaccuuggccggauc

SEQ ID NO: 881756 - RNA, 16 nt, Mycobacterium avium subsp. paratuberculosis
gggguggccggccagc

SEQ ID NO: 881757 - RNA, 19 nt, Mycobacterium avium subsp. paratuberculosis
gggguguaggcgucggcgg

SEQ ID NO: 881758 - RNA, 20 nt, Mycobacterium avium subsp. paratuberculosis
ggggugucagcgcgaccucg

SEQ ID NO: 881759 - RNA, 15 nt, Mycobacterium avium subsp. paratuberculosis
ggggugucgacccag

SEQ ID NO: 881760 - RNA, 18 nt, Mycobacterium avium subsp. paratuberculosis
ggggugugcggcacggcg

SEQ ID NO: 881761 - RNA, 17 nt, Mycobacterium avium subsp. paratuberculosis
ggggugcaccgugguga

SEQ ID NO: 881762 - RNA, 19 nt, Mycobacterium avium subsp. paratuberculosis
ggggugccagccgugcggc

SEQ ID NO: 881763 - RNA, 13 nt, Mycobacterium avium subsp. paratuberculosis
ggggugcccggcg

SEQ ID NO: 881764 - RNA, 20 nt, Mycobacterium avium subsp. paratuberculosis
ggggugcccuuuacccggac

SEQ ID NO: 881765 - RNA, 20 nt, Mycobacterium avium subsp. paratuberculosis
ggggugccgcagcggcggca

SEQ ID NO: 881766 - RNA, 21 nt, Mycobacterium avium subsp. paratuberculosis
ggggugccgcagcggcggcac

SEQ ID NO: 881767 - RNA, 15 nt, Mycobacterium avium subsp. paratuberculosis
ggggugccgcccaac

SEQ ID NO: 881768 - RNA, 22 nt, Mycobacterium avium subsp. paratuberculosis
ggggugaccgucacccccggcg

SEQ ID NO: 881769 - RNA, 14 nt, Mycobacterium avium subsp. paratuberculosis
ggggugacgcccgu

SEQ ID NO: 881770 - RNA, 14 nt, Mycobacterium avium subsp. paratuberculosis
ggggucgggccgga

SEQ ID NO: 881771 - RNA, 16 nt, Mycobacterium avium subsp. paratuberculosis
ggggucgagaagcccg

SEQ ID NO: 881772 - RNA, 17 nt, Mycobacterium avium subsp. paratuberculosis
ggggucgcgggcgccga

SEQ ID NO: 881773 - RNA, 23 nt, Mycobacterium avium subsp. paratuberculosis
ggggucggagcgcuccaccaccg

SEQ ID NO: 881774 - RNA, 13 nt, Mycobacterium avium subsp. paratuberculosis
ggggucggccagc

SEQ ID NO: 881775 - RNA, 12 nt, Mycobacterium avium subsp. paratuberculosis
ggggucggccga

SEQ ID NO: 881776 - RNA, 11 nt, Mycobacterium avium subsp. paratuberculosis
ggggucggcgc

SEQ ID NO: 881777 - RNA, 13 nt, Mycobacterium avium subsp. paratuberculosis
ggggucggcgccc

SEQ ID NO: 881778 - RNA, 14 nt, Mycobacterium avium subsp. paratuberculosis
ggggucggcgcccu

SEQ ID NO: 881779 - RNA, 14 nt, Mycobacterium avium subsp. paratuberculosis
ggggucggcgccgc

SEQ ID NO: 881780 - RNA, 22 nt, Mycobacterium avium subsp. paratuberculosis
ggguagaaccagcccggcccgu

SEQ ID NO: 881781 - RNA, 22 nt, Mycobacterium avium subsp. paratuberculosis
ggguagaggcggcgaccgcgac

SEQ ID NO: 881782 - RNA, 15 nt, Mycobacterium avium subsp. paratuberculosis
ggguagccggcccgc

SEQ ID NO: 881783 - RNA, 13 nt, Mycobacterium avium subsp. paratuberculosis
ggguacgcguacg

SEQ ID NO: 881784 - RNA, 19 nt, Mycobacterium avium subsp. paratuberculosis
ggguaaaccgccagcagcg

SEQ ID NO: 881785 - RNA, 19 nt, Mycobacterium avium subsp. paratuberculosis
ggguaacccuccggcgccu

SEQ ID NO: 881786 - RNA, 16 nt, Mycobacterium avium subsp. paratuberculosis
ggguacaccgagccgg

SEQ ID NO: 881787 - RNA, 23 nt, Mycobacterium avium subsp. paratuberculosis
ggggccagcgccgagaucgcggu

SEQ ID NO: 881788 - RNA, 23 nt, Mycobacterium avium subsp. paratuberculosis
ggggcaguagugguccaccgccg

SEQ ID NO: 881789 - RNA, 17 nt, Mycobacterium avium subsp. paratuberculosis
ggggccaacuccggcgg

SEQ ID NO: 881790 - RNA, 14 nt, Mycobacterium avium subsp. paratuberculosis
ggggcccggcccgg

SEQ ID NO: 881791 - RNA, 19 nt, Mycobacterium avium subsp. paratuberculosis
ggggcccguccccaccacc

SEQ ID NO: 881792 - RNA, 23 nt, Mycobacterium avium subsp. paratuberculosis
ggggcccguccccaccaccgaca

SEQ ID NO: 881793 - RNA, 16 nt, Mycobacterium avium subsp. paratuberculosis
ggggcccuccgcggcg

SEQ ID NO: 881794 - RNA, 18 nt, Mycobacterium avium subsp. paratuberculosis
ggggcccuccgcggcgcc

SEQ ID NO: 881795 - RNA, 19 nt, Mycobacterium avium subsp. paratuberculosis
ggggcccaccccggacaac

SEQ ID NO: 881796 - RNA, 13 nt, Mycobacterium avium subsp. paratuberculosis
ggggccagcacgc

SEQ ID NO: 881797 - RNA, 18 nt, Mycobacterium avium subsp. paratuberculosis
ggggcccgcgacccagac

SEQ ID NO: 881798 - RNA, 21 nt, Mycobacterium avium subsp. paratuberculosis
ggggcaucgcagcgcgcggcg

SEQ ID NO: 881799 - RNA, 14 nt, Mycobacterium avium subsp. paratuberculosis
ggggcagcugcugg

SEQ ID NO: 881800 - RNA, 22 nt, Mycobacterium avium subsp. paratuberculosis
ggggcagccgucgaugccggcg

SEQ ID NO: 881801 - RNA, 17 nt, Mycobacterium avium subsp. paratuberculosis
ggggcagcagcgcccac

SEQ ID NO: 881802 - RNA, 20 nt, Mycobacterium avium subsp. paratuberculosis
ggggauuucacgucugcucg

SEQ ID NO: 881803 - RNA, 23 nt, Mycobacterium avium subsp. paratuberculosis
ggggauuucacgucugcucggcg

SEQ ID NO: 881804 - RNA, 20 nt, Mycobacterium avium subsp. paratuberculosis
ggggcaccacguccaccagc

SEQ ID NO: 881805 - RNA, 11 nt, Mycobacterium avium subsp. paratuberculosis
ggggcaccaga

SEQ ID NO: 881806 - RNA, 19 nt, Mycobacterium avium subsp. paratuberculosis
ggggcacgcgcgcccggca

SEQ ID NO: 881807 - RNA, 17 nt, Mycobacterium avium subsp. paratuberculosis
ggggcagacccgcgucg

SEQ ID NO: 881808 - RNA, 22 nt, Mycobacterium avium subsp. paratuberculosis
ggggcagaucgucggcacugcc

SEQ ID NO: 881809 - RNA, 17 nt, Mycobacterium avium subsp. paratuberculosis
ggggcggcgggcgaagu

SEQ ID NO: 881810 - RNA, 13 nt, Mycobacterium avium subsp. paratuberculosis
ggggcguacgcgc

SEQ ID NO: 881811 - RNA, 13 nt, Mycobacterium avium subsp. paratuberculosis
ggggcgggcccca

SEQ ID NO: 881812 - RNA, 11 nt, Mycobacterium avium subsp. paratuberculosis
ggggcggggcg

SEQ ID NO: 881813 - RNA, 16 nt, Mycobacterium avium subsp. paratuberculosis
ggggcggauccccgcg

SEQ ID NO: 881814 - RNA, 13 nt, Mycobacterium avium subsp. paratuberculosis
ggggcggccgccg

SEQ ID NO: 881815 - RNA, 16 nt, Mycobacterium avium subsp. paratuberculosis
ggggcgcagcccggcg

SEQ ID NO: 881816 - RNA, 14 nt, Mycobacterium avium subsp. paratuberculosis
ggggcgccgcggcg

SEQ ID NO: 881817 - RNA, 16 nt, Mycobacterium avium subsp. paratuberculosis
ggggcgcgcgccggga

SEQ ID NO: 881818 - RNA, 12 nt, Mycobacterium avium subsp. paratuberculosis
ggggcgcgcugg

SEQ ID NO: 881819 - RNA, 23 nt, Mycobacterium avium subsp. paratuberculosis
ggggcgcggaccgcacccccagc

SEQ ID NO: 881820 - RNA, 14 nt, Mycobacterium avium subsp. paratuberculosis
ggggcgccgacagu

SEQ ID NO: 881821 - RNA, 22 nt, Mycobacterium avium subsp. paratuberculosis
ggggcgccgacagucgcgggca

SEQ ID NO: 881822 - RNA, 12 nt, Mycobacterium avium subsp. paratuberculosis
ggggcgccgccg

SEQ ID NO: 881823 - RNA, 18 nt, Mycobacterium avium subsp. paratuberculosis
ggggcgcagauggggauc

SEQ ID NO: 881824 - RNA, 20 nt, Mycobacterium avium subsp. paratuberculosis
ggggcgaugccgacacccca

SEQ ID NO: 881825 - RNA, 24 nt, Mycobacterium avium subsp. paratuberculosis
ggggccgagcagagcuacggacgc

SEQ ID NO: 881826 - RNA, 15 nt, Mycobacterium avium subsp. paratuberculosis
ggggcgagccggccc

SEQ ID NO: 881827 - RNA, 14 nt, Mycobacterium avium subsp. paratuberculosis
ggggccucgucgcc

SEQ ID NO: 881828 - RNA, 12 nt, Mycobacterium avium subsp. paratuberculosis
ggggccugcggg

SEQ ID NO: 881829 - RNA, 15 nt, Mycobacterium avium subsp. paratuberculosis
ggggcgaacccggcg

SEQ ID NO: 881830 - RNA, 13 nt, Mycobacterium avium subsp. paratuberculosis
ggggccggugaug

SEQ ID NO: 881831 - RNA, 14 nt, Mycobacterium avium subsp. paratuberculosis
ggggccuccaccag

SEQ ID NO: 881832 - RNA, 16 nt, Mycobacterium avium subsp. paratuberculosis
ggggccuccaccagcg

SEQ ID NO: 881833 - RNA, 19 nt, Mycobacterium avium subsp. paratuberculosis
ggggccuccaccagcggcg

SEQ ID NO: 881834 - RNA, 16 nt, Mycobacterium avium subsp. paratuberculosis
ggggccuccagccagc

SEQ ID NO: 881835 - RNA, 19 nt, Mycobacterium avium subsp. paratuberculosis
ggggccuccagccagcgcg

SEQ ID NO: 881836 - RNA, 12 nt, Mycobacterium avium subsp. paratuberculosis
ggggccgcucca

SEQ ID NO: 881837 - RNA, 14 nt, Mycobacterium avium subsp. paratuberculosis
ggggccggcgcggu

SEQ ID NO: 881838 - RNA, 15 nt, Mycobacterium avium subsp. paratuberculosis
ggggccggcggcggc

SEQ ID NO: 881839 - RNA, 15 nt, Mycobacterium avium subsp. paratuberculosis
ggggccgccgucggu

SEQ ID NO: 881840 - RNA, 20 nt, Mycobacterium avium subsp. paratuberculosis
ggggccgcacucuugcgugc

SEQ ID NO: 881841 - RNA, 19 nt, Mycobacterium avium subsp. paratuberculosis
ggggccgaugaccgcggcg

SEQ ID NO: 881842 - RNA, 22 nt, Mycobacterium avium subsp. paratuberculosis
gggcuugggcgcgaucggcagg

SEQ ID NO: 881843 - RNA, 19 nt, Mycobacterium avium subsp. paratuberculosis
gggcuuuagaaggccgccu

SEQ ID NO: 881844 - RNA, 20 nt, Mycobacterium avium subsp. paratuberculosis
gggcuuuugcgucugcucgc

SEQ ID NO: 881845 - RNA, 21 nt, Mycobacterium avium subsp. paratuberculosis
ggggaaccgcccuuccagcac

SEQ ID NO: 881846 - RNA, 23 nt, Mycobacterium avium subsp. paratuberculosis
ggggaacucggugaugccggcca

SEQ ID NO: 881847 - RNA, 19 nt, Mycobacterium avium subsp. paratuberculosis
ggggaagcccagcacccgc

SEQ ID NO: 881848 - RNA, 13 nt, Mycobacterium avium subsp. paratuberculosis
ggggaugcccggg

SEQ ID NO: 881849 - RNA, 14 nt, Mycobacterium avium subsp. paratuberculosis
ggggaucgugucga

SEQ ID NO: 881850 - RNA, 20 nt, Mycobacterium avium subsp. paratuberculosis
ggggaucaggaugacgccgc

SEQ ID NO: 881851 - RNA, 12 nt, Mycobacterium avium subsp. paratuberculosis
ggggaucccgaa

SEQ ID NO: 881852 - RNA, 18 nt, Mycobacterium avium subsp. paratuberculosis
ggggauccgaucugcucg

SEQ ID NO: 881853 - RNA, 17 nt, Mycobacterium avium subsp. paratuberculosis
ggggauccgccugcgcg

SEQ ID NO: 881854 - RNA, 15 nt, Mycobacterium avium subsp. paratuberculosis
ggggaucgcgcagcc

SEQ ID NO: 881855 - RNA, 14 nt, Mycobacterium avium subsp. paratuberculosis
ggggaucggcggga

SEQ ID NO: 881856 - RNA, 20 nt, Mycobacterium avium subsp. paratuberculosis
ggggaggcccagcccgccgc

SEQ ID NO: 881857 - RNA, 22 nt, Mycobacterium avium subsp. paratuberculosis
ggggagggucgguggcccagcc

SEQ ID NO: 881858 - RNA, 22 nt, Mycobacterium avium subsp. paratuberculosis
ggggaggucgucgcguccagca

SEQ ID NO: 881859 - RNA, 18 nt, Mycobacterium avium subsp. paratuberculosis
ggggaguagucggcgauc

SEQ ID NO: 881860 - RNA, 13 nt, Mycobacterium avium subsp. paratuberculosis
ggggaguucgcgg

SEQ ID NO: 881861 - RNA, 21 nt, Mycobacterium avium subsp. paratuberculosis
ggggaucaccucaucgcccag

SEQ ID NO: 881862 - RNA, 16 nt, Mycobacterium avium subsp. paratuberculosis
ggggaccagcgcaacc

SEQ ID NO: 881863 - RNA, 14 nt, Mycobacterium avium subsp. paratuberculosis
ggggacccgcaccg

SEQ ID NO: 881864 - RNA, 18 nt, Mycobacterium avium subsp. paratuberculosis
ggggaagggcuccccgga

SEQ ID NO: 881865 - RNA, 17 nt, Mycobacterium avium subsp. paratuberculosis
ggggacgacggcgggga

SEQ ID NO: 881866 - RNA, 19 nt, Mycobacterium avium subsp. paratuberculosis
ggggacuuucgcgucugcu

SEQ ID NO: 881867 - RNA, 16 nt, Mycobacterium avium subsp. paratuberculosis
ggggagaggcgcggcg

SEQ ID NO: 881868 - RNA, 19 nt, Mycobacterium avium subsp. paratuberculosis
ggggagaggcgcggcgcga

SEQ ID NO: 881869 - RNA, 17 nt, Mycobacterium avium subsp. paratuberculosis
ggggacgcugaacagcc

SEQ ID NO: 881870 - RNA, 23 nt, Mycobacterium avium subsp. paratuberculosis
ggggacgucgacgugggcggcca

SEQ ID NO: 881871 - RNA, 19 nt, Mycobacterium avium subsp. paratuberculosis
ggggagcaggacgguggcc

SEQ ID NO: 881872 - RNA, 13 nt, Mycobacterium avium subsp. paratuberculosis
ggggagcggcgga

SEQ ID NO: 881873 - RNA, 17 nt, Mycobacterium avium subsp. paratuberculosis
gggcugcgcgucgagca

SEQ ID NO: 881874 - RNA, 17 nt, Mycobacterium avium subsp. paratuberculosis
gggcugcgcuugcggcg

SEQ ID NO: 881875 - RNA, 22 nt, Mycobacterium avium subsp. paratuberculosis
gggcugauccgcgacgccaaca

SEQ ID NO: 881876 - RNA, 13 nt, Mycobacterium avium subsp. paratuberculosis
gggcuggccgucg

SEQ ID NO: 881877 - RNA, 19 nt, Mycobacterium avium subsp. paratuberculosis
gggcuggccgcacggugca

SEQ ID NO: 881878 - RNA, 20 nt, Mycobacterium avium subsp. paratuberculosis
gggcuggccgcacggugcag

SEQ ID NO: 881879 - RNA, 15 nt, Mycobacterium avium subsp. paratuberculosis
gggcuggccgucggc

SEQ ID NO: 881880 - RNA, 17 nt, Mycobacterium avium subsp. paratuberculosis
gggcugggucaccacgg

SEQ ID NO: 881881 - RNA, 13 nt, Mycobacterium avium subsp. paratuberculosis
gggcugcgcagca

SEQ ID NO: 881882 - RNA, 12 nt, Mycobacterium avium subsp. paratuberculosis
gggcugcgggcc

SEQ ID NO: 881883 - RNA, 17 nt, Mycobacterium avium subsp. paratuberculosis
gggcugcgggccaggcg

SEQ ID NO: 881884 - RNA, 17 nt, Mycobacterium avium subsp. paratuberculosis
gggcugcgguuccgggc

SEQ ID NO: 881885 - RNA, 16 nt, Mycobacterium avium subsp. paratuberculosis
gggcugcccaccacca

SEQ ID NO: 881886 - RNA, 17 nt, Mycobacterium avium subsp. paratuberculosis
gggcugcccaccaccag

SEQ ID NO: 881887 - RNA, 14 nt, Mycobacterium avium subsp. paratuberculosis
gggcugucggcgcc

SEQ ID NO: 881888 - RNA, 19 nt, Mycobacterium avium subsp. paratuberculosis
gggcugugccggcggguca

SEQ ID NO: 881889 - RNA, 16 nt, Mycobacterium avium subsp. paratuberculosis
gggcuggugcgcagcc

SEQ ID NO: 881890 - RNA, 16 nt, Mycobacterium avium subsp. paratuberculosis
gggcugucccggccgc

SEQ ID NO: 881891 - RNA, 23 nt, Mycobacterium avium subsp. paratuberculosis
gggcugucccggccgcgacagcc

SEQ ID NO: 881892 - RNA, 14 nt, Mycobacterium avium subsp. paratuberculosis
gggcuucccacgcc

SEQ ID NO: 881893 - RNA, 14 nt, Mycobacterium avium subsp. paratuberculosis
gggcuucgaacgcc

SEQ ID NO: 881894 - RNA, 18 nt, Mycobacterium avium subsp. paratuberculosis
gggcuucgaacgcccgca

SEQ ID NO: 881895 - RNA, 22 nt, Mycobacterium avium subsp. paratuberculosis
gggcuucgaacgcccgcaccac

SEQ ID NO: 881896 - RNA, 18 nt, Mycobacterium avium subsp. paratuberculosis
gggcugacccggaugauc

SEQ ID NO: 881897 - RNA, 16 nt, Mycobacterium avium subsp. paratuberculosis
gggcucgucgugaugg

SEQ ID NO: 881898 - RNA, 18 nt, Mycobacterium avium subsp. paratuberculosis
gggcucgucguugcgcag

SEQ ID NO: 881899 - RNA, 16 nt, Mycobacterium avium subsp. paratuberculosis
gggcugaccgccagga

SEQ ID NO: 881900 - RNA, 13 nt, Mycobacterium avium subsp. paratuberculosis
gggcugaccgucg

SEQ ID NO: 881901 - RNA, 14 nt, Mycobacterium avium subsp. paratuberculosis
gggcugaccgucga

SEQ ID NO: 881902 - RNA, 17 nt, Mycobacterium avium subsp. paratuberculosis
gggcugaccgucgacca

SEQ ID NO: 881903 - RNA, 15 nt, Mycobacterium avium subsp. paratuberculosis
gggcugaccucgccg

SEQ ID NO: 881904 - RNA, 16 nt, Mycobacterium avium subsp. paratuberculosis
gggcugaccucgccgc

SEQ ID NO: 881905 - RNA, 17 nt, Mycobacterium avium subsp. paratuberculosis
gggcugaccucgccgcc

SEQ ID NO: 881906 - RNA, 18 nt, Mycobacterium avium subsp. paratuberculosis
gggcugaguucggugaac

SEQ ID NO: 881907 - RNA, 19 nt, Mycobacterium avium subsp. paratuberculosis
gggcugcaccagggcgucg

SEQ ID NO: 881908 - RNA, 19 nt, Mycobacterium avium subsp. paratuberculosis
gggcugcacgcugcgcacc

SEQ ID NO: 881909 - RNA, 16 nt, Mycobacterium avium subsp. paratuberculosis
gggcugcagggccggg

SEQ ID NO: 881910 - RNA, 13 nt, Mycobacterium avium subsp. paratuberculosis
gggcugcaucucc

SEQ ID NO: 881911 - RNA, 15 nt, Mycobacterium avium subsp. paratuberculosis
gggcucggccgccga

SEQ ID NO: 881912 - RNA, 13 nt, Mycobacterium avium subsp. paratuberculosis
gggcucgaccacg

SEQ ID NO: 881913 - RNA, 18 nt, Mycobacterium avium subsp. paratuberculosis
gggcucggaguugcgcag

SEQ ID NO: 881914 - RNA, 13 nt, Mycobacterium avium subsp. paratuberculosis
gggcucggcgccg

SEQ ID NO: 881915 - RNA, 22 nt, Mycobacterium avium subsp. paratuberculosis
gggcucggucaccccggagauc

SEQ ID NO: 881916 - RNA, 21 nt, Mycobacterium avium subsp. paratuberculosis
gggcucgaacaacccggccgc

SEQ ID NO: 881917 - RNA, 21 nt, Mycobacterium avium subsp. paratuberculosis
gggcucgcccgggcuaucgcc

SEQ ID NO: 881918 - RNA, 16 nt, Mycobacterium avium subsp. paratuberculosis
gggcucgccggcccga

SEQ ID NO: 881919 - RNA, 13 nt, Mycobacterium avium subsp. paratuberculosis
gggcucgcgcacc

SEQ ID NO: 881920 - RNA, 14 nt, Mycobacterium avium subsp. paratuberculosis
gggcucgagcaccg

SEQ ID NO: 881921 - RNA, 15 nt, Mycobacterium avium subsp. paratuberculosis
gggcucgagggcggc

SEQ ID NO: 881922 - RNA, 16 nt, Mycobacterium avium subsp. paratuberculosis
gggcucgagggcggcg

SEQ ID NO: 881923 - RNA, 19 nt, Mycobacterium avium subsp. paratuberculosis
gggcucgagugccggcagc

SEQ ID NO: 881924 - RNA, 20 nt, Mycobacterium avium subsp. paratuberculosis
gggcucgagugccggcagcc

SEQ ID NO: 881925 - RNA, 19 nt, Mycobacterium avium subsp. paratuberculosis
gggcucgauguugaucgcc

SEQ ID NO: 881926 - RNA, 19 nt, Mycobacterium avium subsp. paratuberculosis
gggcguggcgucggugaac

SEQ ID NO: 881927 - RNA, 12 nt, Mycobacterium avium subsp. paratuberculosis
gggcguggugcg

SEQ ID NO: 881928 - RNA, 23 nt, Mycobacterium avium subsp. paratuberculosis
gggcguguagccugcggccugca

SEQ ID NO: 881929 - RNA, 15 nt, Mycobacterium avium subsp. paratuberculosis
gggcguucgacgucc

SEQ ID NO: 881930 - RNA, 20 nt, Mycobacterium avium subsp. paratuberculosis
gggcguucgacguccaccgg

SEQ ID NO: 881931 - RNA, 15 nt, Mycobacterium avium subsp. paratuberculosis
gggcguucgcggugg

SEQ ID NO: 881932 - RNA, 15 nt, Mycobacterium avium subsp. paratuberculosis
gggcguugcccgccg

SEQ ID NO: 881933 - RNA, 13 nt, Mycobacterium avium subsp. paratuberculosis
gggcguugccggu

SEQ ID NO: 881934 - RNA, 18 nt, Mycobacterium avium subsp. paratuberculosis
gggcguugccggucucga

SEQ ID NO: 881935 - RNA, 21 nt, Mycobacterium avium subsp. paratuberculosis
gggcguguugcaggcggaccu

SEQ ID NO: 881936 - RNA, 22 nt, Mycobacterium avium subsp. paratuberculosis
gggcuaacgcuggucgaacgcc

SEQ ID NO: 881937 - RNA, 23 nt, Mycobacterium avium subsp. paratuberculosis
gggcuaagucguugcccgccagc

SEQ ID NO: 881938 - RNA, 19 nt, Mycobacterium avium subsp. paratuberculosis
gggcguugguugcggcccc

SEQ ID NO: 881939 - RNA, 15 nt, Mycobacterium avium subsp. paratuberculosis
gggcuagacgcgcac

SEQ ID NO: 881940 - RNA, 17 nt, Mycobacterium avium subsp. paratuberculosis
gggcuagacgcgcacca

SEQ ID NO: 881941 - RNA, 18 nt, Mycobacterium avium subsp. paratuberculosis
gggcuaggcucggcagcc

SEQ ID NO: 881942 - RNA, 16 nt, Mycobacterium avium subsp. paratuberculosis
gggcuccucgaccacg

SEQ ID NO: 881943 - RNA, 17 nt, Mycobacterium avium subsp. paratuberculosis
gggcuccucgaccacgc

SEQ ID NO: 881944 - RNA, 15 nt, Mycobacterium avium subsp. paratuberculosis
gggcucagcaccaca

SEQ ID NO: 881945 - RNA, 12 nt, Mycobacterium avium subsp. paratuberculosis
gggcuccgcgcu

SEQ ID NO: 881946 - RNA, 18 nt, Mycobacterium avium subsp. paratuberculosis
gggcucccagucccagca

SEQ ID NO: 881947 - RNA, 21 nt, Mycobacterium avium subsp. paratuberculosis
gggcucccagucccagcacag

SEQ ID NO: 881948 - RNA, 20 nt, Mycobacterium avium subsp. paratuberculosis
gggcucagccgaagccggcg

SEQ ID NO: 881949 - RNA, 22 nt, Mycobacterium avium subsp. paratuberculosis
gggcucagccgaagccggcgca

SEQ ID NO: 881950 - RNA, 23 nt, Mycobacterium avium subsp. paratuberculosis
gggcucagccgaagccggcgcag

SEQ ID NO: 881951 - RNA, 16 nt, Mycobacterium avium subsp. paratuberculosis
gggcgugcgcggccgc

SEQ ID NO: 881952 - RNA, 12 nt, Mycobacterium avium subsp. paratuberculosis
gggcgugcgcgu

SEQ ID NO: 881953 - RNA, 15 nt, Mycobacterium avium subsp. paratuberculosis
gggcgugcggccgca

SEQ ID NO: 881954 - RNA, 23 nt, Mycobacterium avium subsp. paratuberculosis
gggcguggaacgcgucgcgccag

SEQ ID NO: 881955 - RNA, 14 nt, Mycobacterium avium subsp. paratuberculosis
gggcgugccggcgg

SEQ ID NO: 881956 - RNA, 15 nt, Mycobacterium avium subsp. paratuberculosis
gggcgugccggcggc

SEQ ID NO: 881957 - RNA, 16 nt, Mycobacterium avium subsp. paratuberculosis
gggcgugccggcggcg

SEQ ID NO: 881958 - RNA, 14 nt, Mycobacterium avium subsp. paratuberculosis
gggcgugccgaacg

SEQ ID NO: 881959 - RNA, 18 nt, Mycobacterium avium subsp. paratuberculosis
gggcgugcccggcgccga

SEQ ID NO: 881960 - RNA, 19 nt, Mycobacterium avium subsp. paratuberculosis
gggcgugcccggcgccgac

SEQ ID NO: 881961 - RNA, 17 nt, Mycobacterium avium subsp. paratuberculosis
gggcgugcaggccgcgg

SEQ ID NO: 881962 - RNA, 21 nt, Mycobacterium avium subsp. paratuberculosis
gggcgugaucuguucggcggc

SEQ ID NO: 881963 - RNA, 22 nt, Mycobacterium avium subsp. paratuberculosis
gggcgugaucuguucggcggcg

SEQ ID NO: 881964 - RNA, 14 nt, Mycobacterium avium subsp. paratuberculosis
gggcgugacgccgc

SEQ ID NO: 881965 - RNA, 15 nt, Mycobacterium avium subsp. paratuberculosis
gggcgugacgccgcu

SEQ ID NO: 881966 - RNA, 16 nt, Mycobacterium avium subsp. paratuberculosis
gggcgcgcagcaccag

SEQ ID NO: 881967 - RNA, 16 nt, Mycobacterium avium subsp. paratuberculosis
gggcgucgucggccgg

SEQ ID NO: 881968 - RNA, 17 nt, Mycobacterium avium subsp. paratuberculosis
gggcgucgucggccggc

SEQ ID NO: 881969 - RNA, 21 nt, Mycobacterium avium subsp. paratuberculosis
gggcgucggacaugccggcgc

SEQ ID NO: 881970 - RNA, 13 nt, Mycobacterium avium subsp. paratuberculosis
gggcgucggcggc

SEQ ID NO: 881971 - RNA, 18 nt, Mycobacterium avium subsp. paratuberculosis
gggcgucggcgguggucc

SEQ ID NO: 881972 - RNA, 12 nt, Mycobacterium avium subsp. paratuberculosis
gggcgcgaucag

SEQ ID NO: 881973 - RNA, 23 nt, Mycobacterium avium subsp. paratuberculosis
gggcgcgaucggcaggucgucga

SEQ ID NO: 881974 - RNA, 21 nt, Mycobacterium avium subsp. paratuberculosis
gggcgcgcaucugcucggcgu

SEQ ID NO: 881975 - RNA, 23 nt, Mycobacterium avium subsp. paratuberculosis
gggcgcgcccacccgcgccggca

SEQ ID NO: 881976 - RNA, 12 nt, Mycobacterium avium subsp. paratuberculosis
gggcgcgcagcc

SEQ ID NO: 881977 - RNA, 15 nt, Mycobacterium avium subsp. paratuberculosis
gggcgcgcagccacg

SEQ ID NO: 881978 - RNA, 14 nt, Mycobacterium avium subsp. paratuberculosis
gggcgcgacgguca

SEQ ID NO: 881979 - RNA, 15 nt, Mycobacterium avium subsp. paratuberculosis
gggcgcgaacagcgc

SEQ ID NO: 881980 - RNA, 22 nt, Mycobacterium avium subsp. paratuberculosis
gggcgccuucuuggccgcgccc

SEQ ID NO: 881981 - RNA, 16 nt, Mycobacterium avium subsp. paratuberculosis
gggcgccgcggcgccg

SEQ ID NO: 881982 - RNA, 14 nt, Mycobacterium avium subsp. paratuberculosis
gggcgccugcggug

SEQ ID NO: 881983 - RNA, 14 nt, Mycobacterium avium subsp. paratuberculosis
gggcgccgucgccg

SEQ ID NO: 881984 - RNA, 16 nt, Mycobacterium avium subsp. paratuberculosis
gggcgccgucgccgcc

SEQ ID NO: 881985 - RNA, 13 nt, Mycobacterium avium subsp. paratuberculosis
gggcgccgucggc

SEQ ID NO: 881986 - RNA, 20 nt, Mycobacterium avium subsp. paratuberculosis
gggcgccucgaacaucggca

SEQ ID NO: 881987 - RNA, 22 nt, Mycobacterium avium subsp. paratuberculosis
gggcgccucgaacaucggcacg

SEQ ID NO: 881988 - RNA, 13 nt, Mycobacterium avium subsp. paratuberculosis
gggcgccucgccg

SEQ ID NO: 881989 - RNA, 14 nt, Mycobacterium avium subsp. paratuberculosis
gggcgccucgccga

SEQ ID NO: 881990 - RNA, 17 nt, Mycobacterium avium subsp. paratuberculosis
gggcgccucgccgaccu

SEQ ID NO: 881991 - RNA, 21 nt, Mycobacterium avium subsp. paratuberculosis
ggcguacgacaucucgacggu

SEQ ID NO: 881992 - RNA, 22 nt, Mycobacterium avium subsp. paratuberculosis
ggcguaucaacugagcgcccgg

SEQ ID NO: 881993 - RNA, 19 nt, Mycobacterium avium subsp. paratuberculosis
ggcguaucuccaccgucga

SEQ ID NO: 881994 - RNA, 17 nt, Mycobacterium avium subsp. paratuberculosis
ggcguaugccuccucgg

SEQ ID NO: 881995 - RNA, 16 nt, Mycobacterium avium subsp. paratuberculosis
ggcguauucggcgcgc

SEQ ID NO: 881996 - RNA, 18 nt, Mycobacterium avium subsp. paratuberculosis
ggcguagugggucggcgg

SEQ ID NO: 881997 - RNA, 14 nt, Mycobacterium avium subsp. paratuberculosis
ggcguaguggugca

SEQ ID NO: 881998 - RNA, 19 nt, Mycobacterium avium subsp. paratuberculosis
ggcguaguggugcaggugc

SEQ ID NO: 881999 - RNA, 19 nt, Mycobacterium avium subsp. paratuberculosis
ggcguagucgauggccucg

SEQ ID NO: 882000 - RNA, 21 nt, Mycobacterium avium subsp. paratuberculosis
ggcguagucgauggccucguc

SEQ ID NO: 882001 - RNA, 24 nt, Mycobacterium avium subsp. paratuberculosis
ggcgucacgcaucagggccagccg

SEQ ID NO: 882002 - RNA, 16 nt, Mycobacterium avium subsp. paratuberculosis
ggcgucacgccagcgu

SEQ ID NO: 882003 - RNA, 18 nt, Mycobacterium avium subsp. paratuberculosis
ggcgucacgccagcguga

SEQ ID NO: 882004 - RNA, 19 nt, Mycobacterium avium subsp. paratuberculosis
ggcgucacgccagcgugac

SEQ ID NO: 882005 - RNA, 20 nt, Mycobacterium avium subsp. paratuberculosis
ggcgucacgccagcgugacg

SEQ ID NO: 882006 - RNA, 12 nt, Mycobacterium avium subsp. paratuberculosis
ggcgucaccgcg

SEQ ID NO: 882007 - RNA, 13 nt, Mycobacterium avium subsp. paratuberculosis
ggcgucaccgcgg

SEQ ID NO: 882008 - RNA, 17 nt, Mycobacterium avium subsp. paratuberculosis
ggcgucaccgcggguga

SEQ ID NO: 882009 - RNA, 19 nt, Mycobacterium avium subsp. paratuberculosis
ggcgucaucgacuugccgc

SEQ ID NO: 882010 - RNA, 20 nt, Mycobacterium avium subsp. paratuberculosis
ggcgucaggggugccagccg

SEQ ID NO: 882011 - RNA, 19 nt, Mycobacterium avium subsp. paratuberculosis
ggcgucagggguuggcgcg

SEQ ID NO: 882012 - RNA, 13 nt, Mycobacterium avium subsp. paratuberculosis
ggcgucaggcgcu

SEQ ID NO: 882013 - RNA, 17 nt, Mycobacterium avium subsp. paratuberculosis
ggcgucaggcgcugggu

SEQ ID NO: 882014 - RNA, 22 nt, Mycobacterium avium subsp. paratuberculosis
ggcgucaggcgcugggugcggg

SEQ ID NO: 882015 - RNA, 22 nt, Mycobacterium avium subsp. paratuberculosis
ggcgucaggaccucgaagcagc

SEQ ID NO: 882016 - RNA, 16 nt, Mycobacterium avium subsp. paratuberculosis
ggcgucacgcugcgcg

SEQ ID NO: 882017 - RNA, 17 nt, Mycobacterium avium subsp. paratuberculosis
ggcgucacgcugcgcgc

SEQ ID NO: 882018 - RNA, 18 nt, Mycobacterium avium subsp. paratuberculosis
ggcgucacgcugcgcgcc

SEQ ID NO: 882019 - RNA, 19 nt, Mycobacterium avium subsp. paratuberculosis
ggcgucacgcuggcgugac

SEQ ID NO: 882020 - RNA, 18 nt, Mycobacterium avium subsp. paratuberculosis
ggcgucacucuggcguga

SEQ ID NO: 882021 - RNA, 20 nt, Mycobacterium avium subsp. paratuberculosis
ggcgucacucuggcgugacg

SEQ ID NO: 882022 - RNA, 15 nt, Mycobacterium avium subsp. paratuberculosis
ggcgucagagguugg

SEQ ID NO: 882023 - RNA, 15 nt, Mycobacterium avium subsp. paratuberculosis
ggcguccagggccac

SEQ ID NO: 882024 - RNA, 17 nt, Mycobacterium avium subsp. paratuberculosis
ggcguccagggccaccg

SEQ ID NO: 882025 - RNA, 18 nt, Mycobacterium avium subsp. paratuberculosis
ggcguccagaugccguuc

SEQ ID NO: 882026 - RNA, 13 nt, Mycobacterium avium subsp. paratuberculosis
ggcguccagcacc

SEQ ID NO: 882027 - RNA, 20 nt, Mycobacterium avium subsp. paratuberculosis
ggcguccagcaccugcucga

SEQ ID NO: 882028 - RNA, 17 nt, Mycobacterium avium subsp. paratuberculosis
ggcguccagcgccgcca

SEQ ID NO: 882029 - RNA, 19 nt, Mycobacterium avium subsp. paratuberculosis
ggcguccagcgccgccacg

SEQ ID NO: 882030 - RNA, 15 nt, Mycobacterium avium subsp. paratuberculosis
ggcguccagcgcggu

SEQ ID NO: 882031 - RNA, 16 nt, Mycobacterium avium subsp. paratuberculosis
ggcguccagcgcggug

SEQ ID NO: 882032 - RNA, 17 nt, Mycobacterium avium subsp. paratuberculosis
ggcguccagcgcgguga

SEQ ID NO: 882033 - RNA, 17 nt, Mycobacterium avium subsp. paratuberculosis
ggcguccagcggguugc

SEQ ID NO: 882034 - RNA, 22 nt, Mycobacterium avium subsp. paratuberculosis
ggcguccagcugcgcgccggcg

SEQ ID NO: 882035 - RNA, 18 nt, Mycobacterium avium subsp. paratuberculosis
ggcguccaggcgcaccgc

SEQ ID NO: 882036 - RNA, 22 nt, Mycobacterium avium subsp. paratuberculosis
ggcguccaggcgcaccgccacc

SEQ ID NO: 882037 - RNA, 23 nt, Mycobacterium avium subsp. paratuberculosis
ggcguccaggcgcaccgccaccg

SEQ ID NO: 882038 - RNA, 15 nt, Mycobacterium avium subsp. paratuberculosis
ggcguccacgaaacc

SEQ ID NO: 882039 - RNA, 14 nt, Mycobacterium avium subsp. paratuberculosis
ggcguccacgccgu

SEQ ID NO: 882040 - RNA, 23 nt, Mycobacterium avium subsp. paratuberculosis
ggcguccaccagcacgccguuga

SEQ ID NO: 882041 - RNA, 17 nt, Mycobacterium avium subsp. paratuberculosis
ggcguccaccggucgac

SEQ ID NO: 882042 - RNA, 17 nt, Mycobacterium avium subsp. paratuberculosis
ggcgucgaugaccucgc

SEQ ID NO: 882043 - RNA, 14 nt, Mycobacterium avium subsp. paratuberculosis
ggcgucgagcgcgu

SEQ ID NO: 882044 - RNA, 12 nt, Mycobacterium avium subsp. paratuberculosis
ggcgucgacgcg

SEQ ID NO: 882045 - RNA, 16 nt, Mycobacterium avium subsp. paratuberculosis
ggcgucgacgcgcugc

SEQ ID NO: 882046 - RNA, 20 nt, Mycobacterium avium subsp. paratuberculosis
ggcgucgacgacggcgccgc

SEQ ID NO: 882047 - RNA, 24 nt, Mycobacterium avium subsp. paratuberculosis
ggcgucgacgacggcgccgcgucg

SEQ ID NO: 882048 - RNA, 14 nt, Mycobacterium avium subsp. paratuberculosis
ggcgucgagcaccu

SEQ ID NO: 882049 - RNA, 17 nt, Mycobacterium avium subsp. paratuberculosis
ggcgucgagcaccucca

SEQ ID NO: 882050 - RNA, 13 nt, Mycobacterium avium subsp. paratuberculosis
ggcgucgaccgcc

SEQ ID NO: 882051 - RNA, 22 nt, Mycobacterium avium subsp. paratuberculosis
ggcgucgaccgccccgccggug

SEQ ID NO: 882052 - RNA, 17 nt, Mycobacterium avium subsp. paratuberculosis
ggcgucgacacccgggc

SEQ ID NO: 882053 - RNA, 18 nt, Mycobacterium avium subsp. paratuberculosis
ggcgucgacacccgggcg

SEQ ID NO: 882054 - RNA, 16 nt, Mycobacterium avium subsp. paratuberculosis
ggcguccuugccgauc

SEQ ID NO: 882055 - RNA, 22 nt, Mycobacterium avium subsp. paratuberculosis
ggcgucgaaauccacgaugccg

SEQ ID NO: 882056 - RNA, 16 nt, Mycobacterium avium subsp. paratuberculosis
ggcgucgaagcgcaug

SEQ ID NO: 882057 - RNA, 18 nt, Mycobacterium avium subsp. paratuberculosis
ggcgucgaagcgcaugcc

SEQ ID NO: 882058 - RNA, 14 nt, Mycobacterium avium subsp. paratuberculosis
ggcguccugcgggg

SEQ ID NO: 882059 - RNA, 16 nt, Mycobacterium avium subsp. paratuberculosis
ggcguccugcggggag

SEQ ID NO: 882060 - RNA, 19 nt, Mycobacterium avium subsp. paratuberculosis
ggcguccucgucggcgaag

SEQ ID NO: 882061 - RNA, 17 nt, Mycobacterium avium subsp. paratuberculosis
ggcguccugcagcagcc

SEQ ID NO: 882062 - RNA, 22 nt, Mycobacterium avium subsp. paratuberculosis
ggcguccuugauccgggcgcca

SEQ ID NO: 882063 - RNA, 15 nt, Mycobacterium avium subsp. paratuberculosis
ggcguccgugccguc

SEQ ID NO: 882064 - RNA, 23 nt, Mycobacterium avium subsp. paratuberculosis
ggcguccgugccguccggccggu

SEQ ID NO: 882065 - RNA, 23 nt, Mycobacterium avium subsp. paratuberculosis
ggcguccuccucguccgcggcgg

SEQ ID NO: 882066 - RNA, 16 nt, Mycobacterium avium subsp. paratuberculosis
ggcguccucgaccacc

SEQ ID NO: 882067 - RNA, 15 nt, Mycobacterium avium subsp. paratuberculosis
ggcguccucgacggu

SEQ ID NO: 882068 - RNA, 16 nt, Mycobacterium avium subsp. paratuberculosis
ggcguccgcaagcacc

SEQ ID NO: 882069 - RNA, 19 nt, Mycobacterium avium subsp. paratuberculosis
ggcguccgcgaacgggugc

SEQ ID NO: 882070 - RNA, 23 nt, Mycobacterium avium subsp. paratuberculosis
ggcguccgcgaacgggugcggcg

SEQ ID NO: 882071 - RNA, 15 nt, Mycobacterium avium subsp. paratuberculosis
ggcguccgcggccgc

SEQ ID NO: 882072 - RNA, 18 nt, Mycobacterium avium subsp. paratuberculosis
ggcgucccagugcucgac

SEQ ID NO: 882073 - RNA, 13 nt, Mycobacterium avium subsp. paratuberculosis
ggcguccagccag

SEQ ID NO: 882074 - RNA, 15 nt, Mycobacterium avium subsp. paratuberculosis
ggcguccaggucgcc

SEQ ID NO: 882075 - RNA, 15 nt, Mycobacterium avium subsp. paratuberculosis
ggcguccccggcggu

SEQ ID NO: 882076 - RNA, 16 nt, Mycobacterium avium subsp. paratuberculosis
ggcguccccggcgguu

SEQ ID NO: 882077 - RNA, 15 nt, Mycobacterium avium subsp. paratuberculosis
ggcgucccgcgccac

SEQ ID NO: 882078 - RNA, 14 nt, Mycobacterium avium subsp. paratuberculosis
ggcgggagccggcg

SEQ ID NO: 882079 - RNA, 16 nt, Mycobacterium avium subsp. paratuberculosis
ggcgggaucgcggcgg

SEQ ID NO: 882080 - RNA, 14 nt, Mycobacterium avium subsp. paratuberculosis
ggcgggaucggacc

SEQ ID NO: 882081 - RNA, 17 nt, Mycobacterium avium subsp. paratuberculosis
ggcgggauguggcauca

SEQ ID NO: 882082 - RNA, 23 nt, Mycobacterium avium subsp. paratuberculosis
ggcgggcacuuaacaccucgccu

SEQ ID NO: 882083 - RNA, 16 nt, Mycobacterium avium subsp. paratuberculosis
ggcgggcaccccaucg

SEQ ID NO: 882084 - RNA, 17 nt, Mycobacterium avium subsp. paratuberculosis
ggcgggcaccucggcca

SEQ ID NO: 882085 - RNA, 11 nt, Mycobacterium avium subsp. paratuberculosis
ggcgggcacgu

SEQ ID NO: 882086 - RNA, 16 nt, Mycobacterium avium subsp. paratuberculosis
ggcgggcuggugcgca

SEQ ID NO: 882087 - RNA, 17 nt, Mycobacterium avium subsp. paratuberculosis
ggcgggcugcagcgacu

SEQ ID NO: 882088 - RNA, 13 nt, Mycobacterium avium subsp. paratuberculosis
ggcgggcggcggc

SEQ ID NO: 882089 - RNA, 16 nt, Mycobacterium avium subsp. paratuberculosis
ggcgggcggcaucgcg

SEQ ID NO: 882090 - RNA, 17 nt, Mycobacterium avium subsp. paratuberculosis
ggcgggcgccggucggc

SEQ ID NO: 882091 - RNA, 20 nt, Mycobacterium avium subsp. paratuberculosis
ggcgggcgccuucuuggcgg

SEQ ID NO: 882092 - RNA, 13 nt, Mycobacterium avium subsp. paratuberculosis
ggcgggcgcgccg

SEQ ID NO: 882093 - RNA, 16 nt, Mycobacterium avium subsp. paratuberculosis
ggcgggcgcgccggcg

SEQ ID NO: 882094 - RNA, 11 nt, Mycobacterium avium subsp. paratuberculosis
ggcgggcgcgu

SEQ ID NO: 882095 - RNA, 15 nt, Mycobacterium avium subsp. paratuberculosis
ggcggugcgucgggc

SEQ ID NO: 882096 - RNA, 20 nt, Mycobacterium avium subsp. paratuberculosis
ggcggugcucgcgccgggcg

SEQ ID NO: 882097 - RNA, 16 nt, Mycobacterium avium subsp. paratuberculosis
ggcggugcggugcgcc

SEQ ID NO: 882098 - RNA, 19 nt, Mycobacterium avium subsp. paratuberculosis
ggcggugcggugcgccgca

SEQ ID NO: 882099 - RNA, 16 nt, Mycobacterium avium subsp. paratuberculosis
ggcggugcgcagucgc

SEQ ID NO: 882100 - RNA, 14 nt, Mycobacterium avium subsp. paratuberculosis
ggcggugcgggugg

SEQ ID NO: 882101 - RNA, 23 nt, Mycobacterium avium subsp. paratuberculosis
ggcggugcgggugguguggcguc

SEQ ID NO: 882102 - RNA, 18 nt, Mycobacterium avium subsp. paratuberculosis
ggcggugggcucggccau

SEQ ID NO: 882103 - RNA, 19 nt, Mycobacterium avium subsp. paratuberculosis
ggcgguggccugcccggcg

SEQ ID NO: 882104 - RNA, 22 nt, Mycobacterium avium subsp. paratuberculosis
ggcgguggccugcccggcggug

SEQ ID NO: 882105 - RNA, 14 nt, Mycobacterium avium subsp. paratuberculosis
ggcgguggcgcaca

SEQ ID NO: 882106 - RNA, 15 nt, Mycobacterium avium subsp. paratuberculosis
ggcgguggcgcacaa

SEQ ID NO: 882107 - RNA, 13 nt, Mycobacterium avium subsp. paratuberculosis
ggcgguggcggcg

SEQ ID NO: 882108 - RNA, 19 nt, Mycobacterium avium subsp. paratuberculosis
ggcgguggcggcgaacgcg

SEQ ID NO: 882109 - RNA, 15 nt, Mycobacterium avium subsp. paratuberculosis
ggcggugccgcggcg

SEQ ID NO: 882110 - RNA, 16 nt, Mycobacterium avium subsp. paratuberculosis
ggcggugccgcggcgg

SEQ ID NO: 882111 - RNA, 21 nt, Mycobacterium avium subsp. paratuberculosis
ggcggugccgcggcggcgccg

SEQ ID NO: 882112 - RNA, 23 nt, Mycobacterium avium subsp. paratuberculosis
ggcggugccguccucggccgcca

SEQ ID NO: 882113 - RNA, 14 nt, Mycobacterium avium subsp. paratuberculosis
ggcggugcgcagcc

SEQ ID NO: 882114 - RNA, 14 nt, Mycobacterium avium subsp. paratuberculosis
ggcggugccgagcc

SEQ ID NO: 882115 - RNA, 17 nt, Mycobacterium avium subsp. paratuberculosis
ggcggugccgagcccgc

SEQ ID NO: 882116 - RNA, 15 nt, Mycobacterium avium subsp. paratuberculosis
ggcgguggugccgcc

SEQ ID NO: 882117 - RNA, 19 nt, Mycobacterium avium subsp. paratuberculosis
ggcgguggggccgaagccg

SEQ ID NO: 882118 - RNA, 14 nt, Mycobacterium avium subsp. paratuberculosis
ggcggugucgaaga

SEQ ID NO: 882119 - RNA, 15 nt, Mycobacterium avium subsp. paratuberculosis
ggcggugucgaagac

SEQ ID NO: 882120 - RNA, 19 nt, Mycobacterium avium subsp. paratuberculosis
ggcggugucgaagaccggu

SEQ ID NO: 882121 - RNA, 15 nt, Mycobacterium avium subsp. paratuberculosis
ggcggugucggcgcc

SEQ ID NO: 882122 - RNA, 18 nt, Mycobacterium avium subsp. paratuberculosis
ggcggugucggcgccccg

SEQ ID NO: 882123 - RNA, 22 nt, Mycobacterium avium subsp. paratuberculosis
ggcggugucggcgccccggcgc

SEQ ID NO: 882124 - RNA, 14 nt, Mycobacterium avium subsp. paratuberculosis
ggcggugucggcgg

SEQ ID NO: 882125 - RNA, 14 nt, Mycobacterium avium subsp. paratuberculosis
ggcggugucggugc

SEQ ID NO: 882126 - RNA, 23 nt, Mycobacterium avium subsp. paratuberculosis
ggcggugucggugccgagcacgc

SEQ ID NO: 882127 - RNA, 18 nt, Mycobacterium avium subsp. paratuberculosis
ggcgguuccgguggcgcg

SEQ ID NO: 882128 - RNA, 15 nt, Mycobacterium avium subsp. paratuberculosis
ggcgguuucggugcc

SEQ ID NO: 882129 - RNA, 20 nt, Mycobacterium avium subsp. paratuberculosis
ggcgguuucggugccggccc

SEQ ID NO: 882130 - RNA, 20 nt, Mycobacterium avium subsp. paratuberculosis
ggcgguucggaguccaccgg

SEQ ID NO: 882131 - RNA, 14 nt, Mycobacterium avium subsp. paratuberculosis
ggcgguucggcggg

SEQ ID NO: 882132 - RNA, 20 nt, Mycobacterium avium subsp. paratuberculosis
ggcgguuggacaggccggcg

SEQ ID NO: 882133 - RNA, 13 nt, Mycobacterium avium subsp. paratuberculosis
ggcguaaccggug

SEQ ID NO: 882134 - RNA, 17 nt, Mycobacterium avium subsp. paratuberculosis
ggcgguuuuggucggca

SEQ ID NO: 882135 - RNA, 18 nt, Mycobacterium avium subsp. paratuberculosis
ggcgguuuuggucggcac

SEQ ID NO: 882136 - RNA, 24 nt, Mycobacterium avium subsp. paratuberculosis
ggcguacacguagaaggcgccguc

SEQ ID NO: 882137 - RNA, 17 nt, Mycobacterium avium subsp. paratuberculosis
ggcguacagcggcgcca

SEQ ID NO: 882138 - RNA, 19 nt, Mycobacterium avium subsp. paratuberculosis
ggcguacagcggcgccagg

SEQ ID NO: 882139 - RNA, 16 nt, Mycobacterium avium subsp. paratuberculosis
ggcguacugcgcgagc

SEQ ID NO: 882140 - RNA, 16 nt, Mycobacterium avium subsp. paratuberculosis
ggcguacugcucggcg

SEQ ID NO: 882141 - RNA, 17 nt, Mycobacterium avium subsp. paratuberculosis
ggcguacugcucggcgc

SEQ ID NO: 882142 - RNA, 21 nt, Mycobacterium avium subsp. paratuberculosis
ggcguagcgccagucgcggcg

SEQ ID NO: 882143 - RNA, 19 nt, Mycobacterium avium subsp. paratuberculosis
ggcguagcgggucagcucc

SEQ ID NO: 882144 - RNA, 23 nt, Mycobacterium avium subsp. paratuberculosis
ggcguaggugggcagcgcggcca

SEQ ID NO: 882145 - RNA, 17 nt, Mycobacterium avium subsp. paratuberculosis
ggcguagcagucggccu

SEQ ID NO: 882146 - RNA, 14 nt, Mycobacterium avium subsp. paratuberculosis
ggcguagaccagcg

SEQ ID NO: 882147 - RNA, 20 nt, Mycobacterium avium subsp. paratuberculosis
ggcguagaccagcgacgcca

SEQ ID NO: 882148 - RNA, 15 nt, Mycobacterium avium subsp. paratuberculosis
ggcucagccgaagcc

SEQ ID NO: 882149 - RNA, 19 nt, Mycobacterium avium subsp. paratuberculosis
ggcucagccgaagccggcg

SEQ ID NO: 882150 - RNA, 21 nt, Mycobacterium avium subsp. paratuberculosis
ggcucagccgaagccggcgca

SEQ ID NO: 882151 - RNA, 21 nt, Mycobacterium avium subsp. paratuberculosis
ggcucagcgcgacgugccggc

SEQ ID NO: 882152 - RNA, 22 nt, Mycobacterium avium subsp. paratuberculosis
ggcucagcgcgacgugccggcg

SEQ ID NO: 882153 - RNA, 18 nt, Mycobacterium avium subsp. paratuberculosis
ggcucagggugcgcuggc

SEQ ID NO: 882154 - RNA, 15 nt, Mycobacterium avium subsp. paratuberculosis
ggcucaggaucagca

SEQ ID NO: 882155 - RNA, 19 nt, Mycobacterium avium subsp. paratuberculosis
ggcuaccuaggcgucgucg

SEQ ID NO: 882156 - RNA, 17 nt, Mycobacterium avium subsp. paratuberculosis
ggcucagcaacccgccg

SEQ ID NO: 882157 - RNA, 15 nt, Mycobacterium avium subsp. paratuberculosis
ggcucagcagcaccg

SEQ ID NO: 882158 - RNA, 17 nt, Mycobacterium avium subsp. paratuberculosis
ggcuccaccgcgccggc

SEQ ID NO: 882159 - RNA, 21 nt, Mycobacterium avium subsp. paratuberculosis
ggcuccagguagggcacaccg

SEQ ID NO: 882160 - RNA, 17 nt, Mycobacterium avium subsp. paratuberculosis
ggcucgcucccgcgcgg

SEQ ID NO: 882161 - RNA, 18 nt, Mycobacterium avium subsp. paratuberculosis
ggcucgcucccgcgcggg

SEQ ID NO: 882162 - RNA, 12 nt, Mycobacterium avium subsp. paratuberculosis
ggcucgcgcugg

SEQ ID NO: 882163 - RNA, 16 nt, Mycobacterium avium subsp. paratuberculosis
ggcucgcgcuggcggc

SEQ ID NO: 882164 - RNA, 18 nt, Mycobacterium avium subsp. paratuberculosis
ggcucgcgcuggcggcca

SEQ ID NO: 882165 - RNA, 19 nt, Mycobacterium avium subsp. paratuberculosis
ggcucgcgggggccgcgau

SEQ ID NO: 882166 - RNA, 18 nt, Mycobacterium avium subsp. paratuberculosis
ggcucgcgggugcggcgc

SEQ ID NO: 882167 - RNA, 16 nt, Mycobacterium avium subsp. paratuberculosis
ggcucgcgggugucga

SEQ ID NO: 882168 - RNA, 11 nt, Mycobacterium avium subsp. paratuberculosis
ggcucgcgguc

SEQ ID NO: 882169 - RNA, 20 nt, Mycobacterium avium subsp. paratuberculosis
ggcucgccucggggaucgcc

SEQ ID NO: 882170 - RNA, 20 nt, Mycobacterium avium subsp. paratuberculosis
ggcucgccuuugaugacgac

SEQ ID NO: 882171 - RNA, 14 nt, Mycobacterium avium subsp. paratuberculosis
ggcucgccggcgcg

SEQ ID NO: 882172 - RNA, 16 nt, Mycobacterium avium subsp. paratuberculosis
ggcucgccggcgcgca

SEQ ID NO: 882173 - RNA, 23 nt, Mycobacterium avium subsp. paratuberculosis
ggcucgccggcgcgcaccccggc

SEQ ID NO: 882174 - RNA, 15 nt, Mycobacterium avium subsp. paratuberculosis
ggcucgccggcgucu

SEQ ID NO: 882175 - RNA, 23 nt, Mycobacterium avium subsp. paratuberculosis
ggcucgccggcccgaccggagcc

SEQ ID NO: 882176 - RNA, 23 nt, Mycobacterium avium subsp. paratuberculosis
ggcucgccguugcgggucggcgu

SEQ ID NO: 882177 - RNA, 16 nt, Mycobacterium avium subsp. paratuberculosis
ggcucggccgccgaca

SEQ ID NO: 882178 - RNA, 22 nt, Mycobacterium avium subsp. paratuberculosis
ggcucggccggccggccgugcc

SEQ ID NO: 882179 - RNA, 15 nt, Mycobacterium avium subsp. paratuberculosis
ggcucggcccgccgg

SEQ ID NO: 882180 - RNA, 21 nt, Mycobacterium avium subsp. paratuberculosis
ggcucggcccgccgggcgcca

SEQ ID NO: 882181 - RNA, 18 nt, Mycobacterium avium subsp. paratuberculosis
ggcucggcgccccacgcc

SEQ ID NO: 882182 - RNA, 15 nt, Mycobacterium avium subsp. paratuberculosis
ggcucggcgccgacc

SEQ ID NO: 882183 - RNA, 13 nt, Mycobacterium avium subsp. paratuberculosis
ggcucggcgcuga

SEQ ID NO: 882184 - RNA, 20 nt, Mycobacterium avium subsp. paratuberculosis
ggcucggcggcgucguaguu

SEQ ID NO: 882185 - RNA, 19 nt, Mycobacterium avium subsp. paratuberculosis
ggcucggccaucccggugc

SEQ ID NO: 882186 - RNA, 13 nt, Mycobacterium avium subsp. paratuberculosis
ggcucggacgacu

SEQ ID NO: 882187 - RNA, 21 nt, Mycobacterium avium subsp. paratuberculosis
ggcucggaguugcgcagccgg

SEQ ID NO: 882188 - RNA, 14 nt, Mycobacterium avium subsp. paratuberculosis
ggcucggcagccgg

SEQ ID NO: 882189 - RNA, 19 nt, Mycobacterium avium subsp. paratuberculosis
ggcucgcugaucugcggca

SEQ ID NO: 882190 - RNA, 17 nt, Mycobacterium avium subsp. paratuberculosis
ggcucgccgauccgcgg

SEQ ID NO: 882191 - RNA, 21 nt, Mycobacterium avium subsp. paratuberculosis
ggcucgccgcgcaucaucgcc

SEQ ID NO: 882192 - RNA, 23 nt, Mycobacterium avium subsp. paratuberculosis
ggcucgccgcgcaucaucgccca

SEQ ID NO: 882193 - RNA, 18 nt, Mycobacterium avium subsp. paratuberculosis
ggcucgagugccggcagc

SEQ ID NO: 882194 - RNA, 23 nt, Mycobacterium avium subsp. paratuberculosis
ggcucgagugccggcagcccgga

SEQ ID NO: 882195 - RNA, 13 nt, Mycobacterium avium subsp. paratuberculosis
ggcucgaccacgc

SEQ ID NO: 882196 - RNA, 20 nt, Mycobacterium avium subsp. paratuberculosis
ggcucgacaggcagcccggc

SEQ ID NO: 882197 - RNA, 22 nt, Mycobacterium avium subsp. paratuberculosis
ggcucgacaggcagcccggcug

SEQ ID NO: 882198 - RNA, 23 nt, Mycobacterium avium subsp. paratuberculosis
ggcucgaaaugccuuggcggcgu

SEQ ID NO: 882199 - RNA, 18 nt, Mycobacterium avium subsp. paratuberculosis
ggcgugcagcacggggac

SEQ ID NO: 882200 - RNA, 18 nt, Mycobacterium avium subsp. paratuberculosis
ggcgugcaggccgcgggu

SEQ ID NO: 882201 - RNA, 22 nt, Mycobacterium avium subsp. paratuberculosis
ggcgugaucuguucggcggcga

SEQ ID NO: 882202 - RNA, 19 nt, Mycobacterium avium subsp. paratuberculosis
ggcgugcacaggccgccgc

SEQ ID NO: 882203 - RNA, 20 nt, Mycobacterium avium subsp. paratuberculosis
ggcgucgccgagccgcgcca

SEQ ID NO: 882204 - RNA, 11 nt, Mycobacterium avium subsp. paratuberculosis
ggcgucgccgc

SEQ ID NO: 882205 - RNA, 20 nt, Mycobacterium avium subsp. paratuberculosis
ggcgucgaugucgucgucga

SEQ ID NO: 882206 - RNA, 16 nt, Mycobacterium avium subsp. paratuberculosis
ggcgucgcagaucccg

SEQ ID NO: 882207 - RNA, 22 nt, Mycobacterium avium subsp. paratuberculosis
ggcgucgcagaucccgccggcg

SEQ ID NO: 882208 - RNA, 23 nt, Mycobacterium avium subsp. paratuberculosis
ggcgucgcagaucccgccggcgg

SEQ ID NO: 882209 - RNA, 17 nt, Mycobacterium avium subsp. paratuberculosis
ggcgucgcccgccgacg

SEQ ID NO: 882210 - RNA, 16 nt, Mycobacterium avium subsp. paratuberculosis
ggcgucgaugcgcgcc

SEQ ID NO: 882211 - RNA, 17 nt, Mycobacterium avium subsp. paratuberculosis
ggcgucgaugcgcgcca

SEQ ID NO: 882212 - RNA, 13 nt, Mycobacterium avium subsp. paratuberculosis
ggcgucgaugucg

SEQ ID NO: 882213 - RNA, 16 nt, Mycobacterium avium subsp. paratuberculosis
ggcgucgaugucgccc

SEQ ID NO: 882214 - RNA, 12 nt, Mycobacterium avium subsp. paratuberculosis
ggcgucgaucgc

SEQ ID NO: 882215 - RNA, 17 nt, Mycobacterium avium subsp. paratuberculosis
ggcgucgaucgccguca

SEQ ID NO: 882216 - RNA, 18 nt, Mycobacterium avium subsp. paratuberculosis
ggcgucgaugaugccggc

SEQ ID NO: 882217 - RNA, 20 nt, Mycobacterium avium subsp. paratuberculosis
ggcgucgaugaugccggcgg

SEQ ID NO: 882218 - RNA, 11 nt, Mycobacterium avium subsp. paratuberculosis
ggcgucgaugc

SEQ ID NO: 882219 - RNA, 12 nt, Mycobacterium avium subsp. paratuberculosis
ggcgucgaugcc

SEQ ID NO: 882220 - RNA, 14 nt, Mycobacterium avium subsp. paratuberculosis
ggcgugggugucga

SEQ ID NO: 882221 - RNA, 20 nt, Mycobacterium avium subsp. paratuberculosis
ggcguggcucggcccgccgg

SEQ ID NO: 882222 - RNA, 22 nt, Mycobacterium avium subsp. paratuberculosis
ggcguggcugaggccgccccgg

SEQ ID NO: 882223 - RNA, 12 nt, Mycobacterium avium subsp. paratuberculosis
ggcguggcuuga

SEQ ID NO: 882224 - RNA, 17 nt, Mycobacterium avium subsp. paratuberculosis
ggcgugggaaccaccaa

SEQ ID NO: 882225 - RNA, 17 nt, Mycobacterium avium subsp. paratuberculosis
ggcguggcgggccaggc

SEQ ID NO: 882226 - RNA, 18 nt, Mycobacterium avium subsp. paratuberculosis
ggcguggcgggccaggcg

SEQ ID NO: 882227 - RNA, 20 nt, Mycobacterium avium subsp. paratuberculosis
ggcguggcgggccaggcgga

SEQ ID NO: 882228 - RNA, 18 nt, Mycobacterium avium subsp. paratuberculosis
ggcguggcgguggcggcg

SEQ ID NO: 882229 - RNA, 20 nt, Mycobacterium avium subsp. paratuberculosis
ggcguggcgccggcgcgcga

SEQ ID NO: 882230 - RNA, 12 nt, Mycobacterium avium subsp. paratuberculosis
ggcguggccguc

SEQ ID NO: 882231 - RNA, 18 nt, Mycobacterium avium subsp. paratuberculosis
ggcguggauggccggccg

SEQ ID NO: 882232 - RNA, 22 nt, Mycobacterium avium subsp. paratuberculosis
ggcguggcacccgggcgcgacg

SEQ ID NO: 882233 - RNA, 18 nt, Mycobacterium avium subsp. paratuberculosis
ggcguggcaggccaucag

SEQ ID NO: 882234 - RNA, 15 nt, Mycobacterium avium subsp. paratuberculosis
ggcguggcaggcgau

SEQ ID NO: 882235 - RNA, 15 nt, Mycobacterium avium subsp. paratuberculosis
ggcguggcccagccg

SEQ ID NO: 882236 - RNA, 17 nt, Mycobacterium avium subsp. paratuberculosis
ggcguggcccagccggu

SEQ ID NO: 882237 - RNA, 20 nt, Mycobacterium avium subsp. paratuberculosis
ggcgugcccgcucgcuagca

SEQ ID NO: 882238 - RNA, 15 nt, Mycobacterium avium subsp. paratuberculosis
ggcgugcccggcgca

SEQ ID NO: 882239 - RNA, 20 nt, Mycobacterium avium subsp. paratuberculosis
ggcguggaacacgcccagcg

SEQ ID NO: 882240 - RNA, 21 nt, Mycobacterium avium subsp. paratuberculosis
ggcguggaacgcgucgcgcca

SEQ ID NO: 882241 - RNA, 20 nt, Mycobacterium avium subsp. paratuberculosis
ggcgugccagggcagcgcga

SEQ ID NO: 882242 - RNA, 13 nt, Mycobacterium avium subsp. paratuberculosis
ggcgugcccgccg

SEQ ID NO: 882243 - RNA, 15 nt, Mycobacterium avium subsp. paratuberculosis
ggcgugcccgccgaa

SEQ ID NO: 882244 - RNA, 13 nt, Mycobacterium avium subsp. paratuberculosis
ggcgugccaccgc

SEQ ID NO: 882245 - RNA, 16 nt, Mycobacterium avium subsp. paratuberculosis
ggcgugccaccgcugg

SEQ ID NO: 882246 - RNA, 19 nt, Mycobacterium avium subsp. paratuberculosis
ggcgugccaccgcugggcg

SEQ ID NO: 882247 - RNA, 18 nt, Mycobacterium avium subsp. paratuberculosis
ggcguguugcaggcggac

SEQ ID NO: 882248 - RNA, 15 nt, Mycobacterium avium subsp. paratuberculosis
ggcguugcaccgcgg

SEQ ID NO: 882249 - RNA, 22 nt, Mycobacterium avium subsp. paratuberculosis
ggcguugagcuucucggugauc

SEQ ID NO: 882250 - RNA, 15 nt, Mycobacterium avium subsp. paratuberculosis
ggcguugaucacgau

SEQ ID NO: 882251 - RNA, 16 nt, Mycobacterium avium subsp. paratuberculosis
ggcguugaugcgggcg

SEQ ID NO: 882252 - RNA, 19 nt, Mycobacterium avium subsp. paratuberculosis
ggcguugaugcgggcgugc

SEQ ID NO: 882253 - RNA, 14 nt, Mycobacterium avium subsp. paratuberculosis
ggcgugucggcgcc

SEQ ID NO: 882254 - RNA, 15 nt, Mycobacterium avium subsp. paratuberculosis
ggcgugucggcgcca

SEQ ID NO: 882255 - RNA, 19 nt, Mycobacterium avium subsp. paratuberculosis
ggcgugugggcucgcccgg

SEQ ID NO: 882256 - RNA, 21 nt, Mycobacterium avium subsp. paratuberculosis
ggcguguuccuugcggccgcc

SEQ ID NO: 882257 - RNA, 22 nt, Mycobacterium avium subsp. paratuberculosis
ggcguggugcggugcaccgcgg

SEQ ID NO: 882258 - RNA, 19 nt, Mycobacterium avium subsp. paratuberculosis
ggcguguaguacugcucga

SEQ ID NO: 882259 - RNA, 15 nt, Mycobacterium avium subsp. paratuberculosis
ggcguggucgccguu

SEQ ID NO: 882260 - RNA, 17 nt, Mycobacterium avium subsp. paratuberculosis
ggcguggguuccgccgu

SEQ ID NO: 882261 - RNA, 23 nt, Mycobacterium avium subsp. paratuberculosis
ggcgugcuugaacgccgcccccg

SEQ ID NO: 882262 - RNA, 22 nt, Mycobacterium avium subsp. paratuberculosis
ggcguggggacccccucgucga

SEQ ID NO: 882263 - RNA, 14 nt, Mycobacterium avium subsp. paratuberculosis
ggcuaagccggcgu

SEQ ID NO: 882264 - RNA, 16 nt, Mycobacterium avium subsp. paratuberculosis
ggcuaagccggcgucg

SEQ ID NO: 882265 - RNA, 20 nt, Mycobacterium avium subsp. paratuberculosis
ggcuaacgcuggucgaacgc

SEQ ID NO: 882266 - RNA, 12 nt, Mycobacterium avium subsp. paratuberculosis
ggcuaagucguu

SEQ ID NO: 882267 - RNA, 23 nt, Mycobacterium avium subsp. paratuberculosis
ggcuaagucguugcccgccagca

SEQ ID NO: 882268 - RNA, 20 nt, Mycobacterium avium subsp. paratuberculosis
ggcuacagcaacauccuggu

SEQ ID NO: 882269 - RNA, 23 nt, Mycobacterium avium subsp. paratuberculosis
ggcguugcggaucgaacggcgga

SEQ ID NO: 882270 - RNA, 14 nt, Mycobacterium avium subsp. paratuberculosis
ggcguuggagccga

SEQ ID NO: 882271 - RNA, 20 nt, Mycobacterium avium subsp. paratuberculosis
ggcguuggagccgaccagcg

SEQ ID NO: 882272 - RNA, 16 nt, Mycobacterium avium subsp. paratuberculosis
ggcguuggcccgcacc

SEQ ID NO: 882273 - RNA, 17 nt, Mycobacterium avium subsp. paratuberculosis
ggcguuggcccgcaccc

SEQ ID NO: 882274 - RNA, 22 nt, Mycobacterium avium subsp. paratuberculosis
ggcguuggcccgcacccgccgc

SEQ ID NO: 882275 - RNA, 18 nt, Mycobacterium avium subsp. paratuberculosis
ggcguuggcgaucucgau

SEQ ID NO: 882276 - RNA, 17 nt, Mycobacterium avium subsp. paratuberculosis
ggcguugcgggcgaacg

SEQ ID NO: 882277 - RNA, 19 nt, Mycobacterium avium subsp. paratuberculosis
ggcguugcgggcgaacgcg

SEQ ID NO: 882278 - RNA, 15 nt, Mycobacterium avium subsp. paratuberculosis
ggcguugcccgccgc

SEQ ID NO: 882279 - RNA, 21 nt, Mycobacterium avium subsp. paratuberculosis
ggcguugcccgccgcggcgag

SEQ ID NO: 882280 - RNA, 15 nt, Mycobacterium avium subsp. paratuberculosis
ggcguugcccgcugc

SEQ ID NO: 882281 - RNA, 20 nt, Mycobacterium avium subsp. paratuberculosis
ggcgggaaaccaccugccgc

SEQ ID NO: 882282 - RNA, 12 nt, Mycobacterium avium subsp. paratuberculosis
ggcgggaaucac

SEQ ID NO: 882283 - RNA, 23 nt, Mycobacterium avium subsp. paratuberculosis
ggcgggaaucacgccccaggcgc

SEQ ID NO: 882284 - RNA, 12 nt, Mycobacterium avium subsp. paratuberculosis
ggcgggacccgc

SEQ ID NO: 882285 - RNA, 19 nt, Mycobacterium avium subsp. paratuberculosis
ggcgggacccgcgaccccu

SEQ ID NO: 882286 - RNA, 19 nt, Mycobacterium avium subsp. paratuberculosis
ggcgggacgaaugucucga

SEQ ID NO: 882287 - RNA, 20 nt, Mycobacterium avium subsp. paratuberculosis
ggcgggaacucgaugcggca

SEQ ID NO: 882288 - RNA, 13 nt, Mycobacterium avium subsp. paratuberculosis
ggcgggacguugu

SEQ ID NO: 882289 - RNA, 18 nt, Mycobacterium avium subsp. paratuberculosis
ggcggcuccgaucuccug

SEQ ID NO: 882290 - RNA, 15 nt, Mycobacterium avium subsp. paratuberculosis
ggcggcucgccggcg

SEQ ID NO: 882291 - RNA, 23 nt, Mycobacterium avium subsp. paratuberculosis
ggcggcucagcaacccgccgagc

SEQ ID NO: 882292 - RNA, 16 nt, Mycobacterium avium subsp. paratuberculosis
ggcggcgugccgcccg

SEQ ID NO: 882293 - RNA, 17 nt, Mycobacterium avium subsp. paratuberculosis
ggcggcgugcaccgccc

SEQ ID NO: 882294 - RNA, 19 nt, Mycobacterium avium subsp. paratuberculosis
ggcggcgugcaccgcccgc

SEQ ID NO: 882295 - RNA, 23 nt, Mycobacterium avium subsp. paratuberculosis
ggcggcgucgaugucgcccggcg

SEQ ID NO: 882296 - RNA, 20 nt, Mycobacterium avium subsp. paratuberculosis
ggcggcgucgagcaccucca

SEQ ID NO: 882297 - RNA, 13 nt, Mycobacterium avium subsp. paratuberculosis
ggcggcgucgagu

SEQ ID NO: 882298 - RNA, 23 nt, Mycobacterium avium subsp. paratuberculosis
ggcggcgucccacguggugauca

SEQ ID NO: 882299 - RNA, 20 nt, Mycobacterium avium subsp. paratuberculosis
ggcggcgucccagugcucga

SEQ ID NO: 882300 - RNA, 17 nt, Mycobacterium avium subsp. paratuberculosis
ggcggcguccgcggccg

SEQ ID NO: 882301 - RNA, 21 nt, Mycobacterium avium subsp. paratuberculosis
ggcggcguccucgaccacccg

SEQ ID NO: 882302 - RNA, 20 nt, Mycobacterium avium subsp. paratuberculosis
ggcggcgucgaccgccccgc

SEQ ID NO: 882303 - RNA, 13 nt, Mycobacterium avium subsp. paratuberculosis
ggcggcgguauuc

SEQ ID NO: 882304 - RNA, 22 nt, Mycobacterium avium subsp. paratuberculosis
ggcggcgguauucgucacccca

SEQ ID NO: 882305 - RNA, 20 nt, Mycobacterium avium subsp. paratuberculosis
ggcggcggggcugcccaggu

SEQ ID NO: 882306 - RNA, 17 nt, Mycobacterium avium subsp. paratuberculosis
ggcggcgggggcgagac

SEQ ID NO: 882307 - RNA, 18 nt, Mycobacterium avium subsp. paratuberculosis
ggcggcgggggcgggccc

SEQ ID NO: 882308 - RNA, 23 nt, Mycobacterium avium subsp. paratuberculosis
ggcggcgggggcgggccccacgc

SEQ ID NO: 882309 - RNA, 18 nt, Mycobacterium avium subsp. paratuberculosis
ggcggcggggugacgguc

SEQ ID NO: 882310 - RNA, 14 nt, Mycobacterium avium subsp. paratuberculosis
ggcggcggccugca

SEQ ID NO: 882311 - RNA, 20 nt, Mycobacterium avium subsp. paratuberculosis
ggcggcgguccguucggcgg

SEQ ID NO: 882312 - RNA, 20 nt, Mycobacterium avium subsp. paratuberculosis
ggcggcggugaucucgucgg

SEQ ID NO: 882313 - RNA, 22 nt, Mycobacterium avium subsp. paratuberculosis
ggcggcggugaucucgucggcg

SEQ ID NO: 882314 - RNA, 16 nt, Mycobacterium avium subsp. paratuberculosis
ggcggcggugccuggu

SEQ ID NO: 882315 - RNA, 13 nt, Mycobacterium avium subsp. paratuberculosis
ggcggcggugcuc

SEQ ID NO: 882316 - RNA, 20 nt, Mycobacterium avium subsp. paratuberculosis
ggcggcggugcucucgucgu

SEQ ID NO: 882317 - RNA, 11 nt, Mycobacterium avium subsp. paratuberculosis
ggcggcggugu

SEQ ID NO: 882318 - RNA, 17 nt, Mycobacterium avium subsp. paratuberculosis
ggcggcggugucgccca

SEQ ID NO: 882319 - RNA, 19 nt, Mycobacterium avium subsp. paratuberculosis
ggcggcggugucgcccagc

SEQ ID NO: 882320 - RNA, 15 nt, Mycobacterium avium subsp. paratuberculosis
ggcggcggcgguccc

SEQ ID NO: 882321 - RNA, 15 nt, Mycobacterium avium subsp. paratuberculosis
ggcggcggcggucgg

SEQ ID NO: 882322 - RNA, 14 nt, Mycobacterium avium subsp. paratuberculosis
ggcggcggcgcgcc

SEQ ID NO: 882323 - RNA, 12 nt, Mycobacterium avium subsp. paratuberculosis
ggcggcgggccc

SEQ ID NO: 882324 - RNA, 16 nt, Mycobacterium avium subsp. paratuberculosis
ggcggcggcagguugg

SEQ ID NO: 882325 - RNA, 14 nt, Mycobacterium avium subsp. paratuberculosis
ggcggcggccaccu

SEQ ID NO: 882326 - RNA, 13 nt, Mycobacterium avium subsp. paratuberculosis
ggcggcggccagg

SEQ ID NO: 882327 - RNA, 11 nt, Mycobacterium avium subsp. paratuberculosis
ggcggcggccc

SEQ ID NO: 882328 - RNA, 13 nt, Mycobacterium avium subsp. paratuberculosis
ggcggcggcccgu

SEQ ID NO: 882329 - RNA, 21 nt, Mycobacterium avium subsp. paratuberculosis
ggcggcggcccguccgccccg

SEQ ID NO: 882330 - RNA, 13 nt, Mycobacterium avium subsp. paratuberculosis
ggcggcggccgcg

SEQ ID NO: 882331 - RNA, 14 nt, Mycobacterium avium subsp. paratuberculosis
ggcggcggccgcgu

SEQ ID NO: 882332 - RNA, 13 nt, Mycobacterium avium subsp. paratuberculosis
ggcggcggcgccg

SEQ ID NO: 882333 - RNA, 14 nt, Mycobacterium avium subsp. paratuberculosis
ggcggcggcgccgg

SEQ ID NO: 882334 - RNA, 19 nt, Mycobacterium avium subsp. paratuberculosis
ggcggcgccgaacucggcg

SEQ ID NO: 882335 - RNA, 19 nt, Mycobacterium avium subsp. paratuberculosis
ggcggcggaucagcaccga

SEQ ID NO: 882336 - RNA, 11 nt, Mycobacterium avium subsp. paratuberculosis
ggcggcgcgca

SEQ ID NO: 882337 - RNA, 23 nt, Mycobacterium avium subsp. paratuberculosis
ggcggcgcgcagccggccgucca

SEQ ID NO: 882338 - RNA, 14 nt, Mycobacterium avium subsp. paratuberculosis
ggcggcgccggccg

SEQ ID NO: 882339 - RNA, 18 nt, Mycobacterium avium subsp. paratuberculosis
ggcggcgccggccgggcu

SEQ ID NO: 882340 - RNA, 19 nt, Mycobacterium avium subsp. paratuberculosis
ggcggcgccgucgaccagc

SEQ ID NO: 882341 - RNA, 20 nt, Mycobacterium avium subsp. paratuberculosis
ggcggcgccgucgaccagcu

SEQ ID NO: 882342 - RNA, 15 nt, Mycobacterium avium subsp. paratuberculosis
ggcggcgccgucgcc

SEQ ID NO: 882343 - RNA, 21 nt, Mycobacterium avium subsp. paratuberculosis
ggcggcgccgucgccgaucac

SEQ ID NO: 882344 - RNA, 12 nt, Mycobacterium avium subsp. paratuberculosis
ggcggcgccgga

SEQ ID NO: 882345 - RNA, 23 nt, Mycobacterium avium subsp. paratuberculosis
ggcggcgccggaggccagcucga

SEQ ID NO: 882346 - RNA, 20 nt, Mycobacterium avium subsp. paratuberculosis
ggcggcgccggaugccagca

SEQ ID NO: 882347 - RNA, 19 nt, Mycobacterium avium subsp. paratuberculosis
ggcggcgccggcacugcug

SEQ ID NO: 882348 - RNA, 17 nt, Mycobacterium avium subsp. paratuberculosis
ggcggcgaacaccagca

SEQ ID NO: 882349 - RNA, 17 nt, Mycobacterium avium subsp. paratuberculosis
ggcggcgaacgccgccg

SEQ ID NO: 882350 - RNA, 20 nt, Mycobacterium avium subsp. paratuberculosis
ggcggccuuuuccggcgaca

SEQ ID NO: 882351 - RNA, 18 nt, Mycobacterium avium subsp. paratuberculosis
ggcggcgaauaccagggc

SEQ ID NO: 882352 - RNA, 16 nt, Mycobacterium avium subsp. paratuberculosis
ggcggcgacaucgaug

SEQ ID NO: 882353 - RNA, 21 nt, Mycobacterium avium subsp. paratuberculosis
ggcggcgaccgcgacgaucac

SEQ ID NO: 882354 - RNA, 23 nt, Mycobacterium avium subsp. paratuberculosis
ggcggcgacgaugcggccguugg

SEQ ID NO: 882355 - RNA, 19 nt, Mycobacterium avium subsp. paratuberculosis
ggcggcgaagccggccccg

SEQ ID NO: 882356 - RNA, 13 nt, Mycobacterium avium subsp. paratuberculosis
ggcggcgacccgg

SEQ ID NO: 882357 - RNA, 20 nt, Mycobacterium avium subsp. paratuberculosis
ggcggcgcaugaucgcccgc

SEQ ID NO: 882358 - RNA, 13 nt, Mycobacterium avium subsp. paratuberculosis
ggcggcgcccagg

SEQ ID NO: 882359 - RNA, 12 nt, Mycobacterium avium subsp. paratuberculosis
ggcggcgccgaa

SEQ ID NO: 882360 - RNA, 13 nt, Mycobacterium avium subsp. paratuberculosis
ggcggcgccgacg

SEQ ID NO: 882361 - RNA, 23 nt, Mycobacterium avium subsp. paratuberculosis
ggcggcgccgacgggcccgcgcc

SEQ ID NO: 882362 - RNA, 16 nt, Mycobacterium avium subsp. paratuberculosis
ggcggcgccgcagcac

SEQ ID NO: 882363 - RNA, 18 nt, Mycobacterium avium subsp. paratuberculosis
ggcggcgccgcagcacgc

SEQ ID NO: 882364 - RNA, 13 nt, Mycobacterium avium subsp. paratuberculosis
ggcggcgccgcgg

SEQ ID NO: 882365 - RNA, 22 nt, Mycobacterium avium subsp. paratuberculosis
ggcggcgccgcgguagcggacc

SEQ ID NO: 882366 - RNA, 17 nt, Mycobacterium avium subsp. paratuberculosis
ggcggcgcaggcgcgca

SEQ ID NO: 882367 - RNA, 20 nt, Mycobacterium avium subsp. paratuberculosis
ggcggcgcaggcgcgcacca

SEQ ID NO: 882368 - RNA, 15 nt, Mycobacterium avium subsp. paratuberculosis
ggcggcgacggcgac

SEQ ID NO: 882369 - RNA, 16 nt, Mycobacterium avium subsp. paratuberculosis
ggcggcgacggcgacg

SEQ ID NO: 882370 - RNA, 20 nt, Mycobacterium avium subsp. paratuberculosis
ggcggcgacggcgacggcca

SEQ ID NO: 882371 - RNA, 15 nt, Mycobacterium avium subsp. paratuberculosis
ggcggcgacgguguc

SEQ ID NO: 882372 - RNA, 19 nt, Mycobacterium avium subsp. paratuberculosis
ggcggcgacgguguccgcg

SEQ ID NO: 882373 - RNA, 22 nt, Mycobacterium avium subsp. paratuberculosis
ggcggcgacggcaccgccggcg

SEQ ID NO: 882374 - RNA, 14 nt, Mycobacterium avium subsp. paratuberculosis
ggcggcgacggccg

SEQ ID NO: 882375 - RNA, 12 nt, Mycobacterium avium subsp. paratuberculosis
ggcggcaggugg

SEQ ID NO: 882376 - RNA, 22 nt, Mycobacterium avium subsp. paratuberculosis
ggcggcagucgcagcagcagcc

SEQ ID NO: 882377 - RNA, 14 nt, Mycobacterium avium subsp. paratuberculosis
ggcggcagugcgcc

SEQ ID NO: 882378 - RNA, 17 nt, Mycobacterium avium subsp. paratuberculosis
ggcggcagggccagcac

SEQ ID NO: 882379 - RNA, 18 nt, Mycobacterium avium subsp. paratuberculosis
ggcggcagggccagcacc

SEQ ID NO: 882380 - RNA, 19 nt, Mycobacterium avium subsp. paratuberculosis
ggcggcagggccagcacca

SEQ ID NO: 882381 - RNA, 15 nt, Mycobacterium avium subsp. paratuberculosis
ggcggcauccccagc

SEQ ID NO: 882382 - RNA, 16 nt, Mycobacterium avium subsp. paratuberculosis
ggcggcauccccagcu

SEQ ID NO: 882383 - RNA, 18 nt, Mycobacterium avium subsp. paratuberculosis
ggcggcauccccagcugg

SEQ ID NO: 882384 - RNA, 17 nt, Mycobacterium avium subsp. paratuberculosis
ggcggcaucgcgccgca

SEQ ID NO: 882385 - RNA, 19 nt, Mycobacterium avium subsp. paratuberculosis
ggcggcaucgcgcgcggcg

SEQ ID NO: 882386 - RNA, 21 nt, Mycobacterium avium subsp. paratuberculosis
ggcggcaucgcgcgcggcggc

SEQ ID NO: 882387 - RNA, 15 nt, Mycobacterium avium subsp. paratuberculosis
ggcggcagcgcggcg

SEQ ID NO: 882388 - RNA, 15 nt, Mycobacterium avium subsp. paratuberculosis
ggcggcagccaggcg

SEQ ID NO: 882389 - RNA, 14 nt, Mycobacterium avium subsp. paratuberculosis
ggcggcacgguugg

SEQ ID NO: 882390 - RNA, 21 nt, Mycobacterium avium subsp. paratuberculosis
ggcggcacgguuggccggccc

SEQ ID NO: 882391 - RNA, 13 nt, Mycobacterium avium subsp. paratuberculosis
ggcggcaccgcgg

SEQ ID NO: 882392 - RNA, 15 nt, Mycobacterium avium subsp. paratuberculosis
ggcggcaccgcugcc

SEQ ID NO: 882393 - RNA, 20 nt, Mycobacterium avium subsp. paratuberculosis
ggcggcaccgcugccggccg

SEQ ID NO: 882394 - RNA, 15 nt, Mycobacterium avium subsp. paratuberculosis
ggcggcaccacccgg

SEQ ID NO: 882395 - RNA, 14 nt, Mycobacterium avium subsp. paratuberculosis
ggcggcacccaggu

SEQ ID NO: 882396 - RNA, 19 nt, Mycobacterium avium subsp. paratuberculosis
ggcggcaccgaucggcacg

SEQ ID NO: 882397 - RNA, 13 nt, Mycobacterium avium subsp. paratuberculosis
ggcggcaccgccc

SEQ ID NO: 882398 - RNA, 17 nt, Mycobacterium avium subsp. paratuberculosis
ggcggcaccgccgcggu

SEQ ID NO: 882399 - RNA, 18 nt, Mycobacterium avium subsp. paratuberculosis
ggcggcaccgccgcggug

SEQ ID NO: 882400 - RNA, 23 nt, Mycobacterium avium subsp. paratuberculosis
ggcggaacggucggggcggcggg

SEQ ID NO: 882401 - RNA, 12 nt, Mycobacterium avium subsp. paratuberculosis
ggcggaacucga

SEQ ID NO: 882402 - RNA, 17 nt, Mycobacterium avium subsp. paratuberculosis
ggcggaacucgaugauc

SEQ ID NO: 882403 - RNA, 18 nt, Mycobacterium avium subsp. paratuberculosis
ggcggaacccggguggcc

SEQ ID NO: 882404 - RNA, 16 nt, Mycobacterium avium subsp. paratuberculosis
ggcggaaggccgcgcg

SEQ ID NO: 882405 - RNA, 15 nt, Mycobacterium avium subsp. paratuberculosis
ggcggccgccgggcc

SEQ ID NO: 882406 - RNA, 19 nt, Mycobacterium avium subsp. paratuberculosis
ggcggccgccgggccggcg

SEQ ID NO: 882407 - RNA, 20 nt, Mycobacterium avium subsp. paratuberculosis
ggcggccgccgggccggcgg

SEQ ID NO: 882408 - RNA, 21 nt, Mycobacterium avium subsp. paratuberculosis
ggcggccgccgggccggcggc

SEQ ID NO: 882409 - RNA, 15 nt, Mycobacterium avium subsp. paratuberculosis
ggcggccgccgcgau

SEQ ID NO: 882410 - RNA, 14 nt, Mycobacterium avium subsp. paratuberculosis
ggcggccgccggca

SEQ ID NO: 882411 - RNA, 15 nt, Mycobacterium avium subsp. paratuberculosis
ggcggccgccggcac

SEQ ID NO: 882412 - RNA, 12 nt, Mycobacterium avium subsp. paratuberculosis
ggcggccgccgc

SEQ ID NO: 882413 - RNA, 16 nt, Mycobacterium avium subsp. paratuberculosis
ggcggccgcccgggcg

SEQ ID NO: 882414 - RNA, 13 nt, Mycobacterium avium subsp. paratuberculosis
ggcggccgccagc

SEQ ID NO: 882415 - RNA, 14 nt, Mycobacterium avium subsp. paratuberculosis
ggcggccgccagcg

SEQ ID NO: 882416 - RNA, 18 nt, Mycobacterium avium subsp. paratuberculosis
ggcggccgagcgcaccgc

SEQ ID NO: 882417 - RNA, 21 nt, Mycobacterium avium subsp. paratuberculosis
ggcggccgagcgcaccgcgga

SEQ ID NO: 882418 - RNA, 15 nt, Mycobacterium avium subsp. paratuberculosis
ggcggccgacccugc

SEQ ID NO: 882419 - RNA, 17 nt, Mycobacterium avium subsp. paratuberculosis
ggcggccgacccugcgu

SEQ ID NO: 882420 - RNA, 18 nt, Mycobacterium avium subsp. paratuberculosis
ggcggccgacgcgccguc

SEQ ID NO: 882421 - RNA, 13 nt, Mycobacterium avium subsp. paratuberculosis
ggcggccgagcgc

SEQ ID NO: 882422 - RNA, 15 nt, Mycobacterium avium subsp. paratuberculosis
ggcggcccggcguca

SEQ ID NO: 882423 - RNA, 21 nt, Mycobacterium avium subsp. paratuberculosis
ggcggcccggcgucacgcugg

SEQ ID NO: 882424 - RNA, 17 nt, Mycobacterium avium subsp. paratuberculosis
ggcggcccgguacaucg

SEQ ID NO: 882425 - RNA, 12 nt, Mycobacterium avium subsp. paratuberculosis
ggcggcccgucg

SEQ ID NO: 882426 - RNA, 11 nt, Mycobacterium avium subsp. paratuberculosis
ggcggccagcc

SEQ ID NO: 882427 - RNA, 19 nt, Mycobacterium avium subsp. paratuberculosis
ggcggccagccgcgcggcg

SEQ ID NO: 882428 - RNA, 15 nt, Mycobacterium avium subsp. paratuberculosis
ggcggccagcguggc

SEQ ID NO: 882429 - RNA, 13 nt, Mycobacterium avium subsp. paratuberculosis
ggcggcccgcucg

SEQ ID NO: 882430 - RNA, 14 nt, Mycobacterium avium subsp. paratuberculosis
ggcggcccgcucga

SEQ ID NO: 882431 - RNA, 14 nt, Mycobacterium avium subsp. paratuberculosis
ggcggccagcgagu

SEQ ID NO: 882432 - RNA, 18 nt, Mycobacterium avium subsp. paratuberculosis
ggcggccagcgagucgau

SEQ ID NO: 882433 - RNA, 14 nt, Mycobacterium avium subsp. paratuberculosis
ggcggccagcgccc

SEQ ID NO: 882434 - RNA, 17 nt, Mycobacterium avium subsp. paratuberculosis
ggcggccagcgcccgcg

SEQ ID NO: 882435 - RNA, 18 nt, Mycobacterium avium subsp. paratuberculosis
ggcggccagcgcccgcgg

SEQ ID NO: 882436 - RNA, 22 nt, Mycobacterium avium subsp. paratuberculosis
ggcggccagcgcccgcgggugc

SEQ ID NO: 882437 - RNA, 14 nt, Mycobacterium avium subsp. paratuberculosis
ggcggccagcgcga

SEQ ID NO: 882438 - RNA, 20 nt, Mycobacterium avium subsp. paratuberculosis
ggcggccagcgcgacgcgca

SEQ ID NO: 882439 - RNA, 17 nt, Mycobacterium avium subsp. paratuberculosis
ggcggccagcgcgccgc

SEQ ID NO: 882440 - RNA, 19 nt, Mycobacterium avium subsp. paratuberculosis
ggcggccagcgcgccgccg

SEQ ID NO: 882441 - RNA, 12 nt, Mycobacterium avium subsp. paratuberculosis
ggcggccagcgg

SEQ ID NO: 882442 - RNA, 12 nt, Mycobacterium avium subsp. paratuberculosis
ggcggccagcag

SEQ ID NO: 882443 - RNA, 17 nt, Mycobacterium avium subsp. paratuberculosis
ggcggccagcagcacca

SEQ ID NO: 882444 - RNA, 20 nt, Mycobacterium avium subsp. paratuberculosis
ggcggccacgcuagcgugac

SEQ ID NO: 882445 - RNA, 21 nt, Mycobacterium avium subsp. paratuberculosis
ggcggccacgcuagcgugacg

SEQ ID NO: 882446 - RNA, 13 nt, Mycobacterium avium subsp. paratuberculosis
ggcggccagcacc

SEQ ID NO: 882447 - RNA, 14 nt, Mycobacterium avium subsp. paratuberculosis
ggcggccagcacca

SEQ ID NO: 882448 - RNA, 19 nt, Mycobacterium avium subsp. paratuberculosis
ggcggccagcaccaguucg

SEQ ID NO: 882449 - RNA, 14 nt, Mycobacterium avium subsp. paratuberculosis
ggcggccacgaugg

SEQ ID NO: 882450 - RNA, 13 nt, Mycobacterium avium subsp. paratuberculosis
ggcggccacgcag

SEQ ID NO: 882451 - RNA, 20 nt, Mycobacterium avium subsp. paratuberculosis
ggcggccacgcaggcgucca

SEQ ID NO: 882452 - RNA, 18 nt, Mycobacterium avium subsp. paratuberculosis
ggcggccaccucgccgca

SEQ ID NO: 882453 - RNA, 19 nt, Mycobacterium avium subsp. paratuberculosis
ggcggccaccucggcggca

SEQ ID NO: 882454 - RNA, 14 nt, Mycobacterium avium subsp. paratuberculosis
ggcggccaccagcc

SEQ ID NO: 882455 - RNA, 19 nt, Mycobacterium avium subsp. paratuberculosis
ggcggccaccagccggccg

SEQ ID NO: 882456 - RNA, 16 nt, Mycobacterium avium subsp. paratuberculosis
ggcggccaccaugccg

SEQ ID NO: 882457 - RNA, 19 nt, Mycobacterium avium subsp. paratuberculosis
ggcggccaccaugccggcg

SEQ ID NO: 882458 - RNA, 20 nt, Mycobacterium avium subsp. paratuberculosis
ggcggccaccaugccggcgu

SEQ ID NO: 882459 - RNA, 23 nt, Mycobacterium avium subsp. paratuberculosis
ggcggccaccaugccggcgucca

SEQ ID NO: 882460 - RNA, 24 nt, Mycobacterium avium subsp. paratuberculosis
ggcggccaccaugccggcguccag

SEQ ID NO: 882461 - RNA, 14 nt, Mycobacterium avium subsp. paratuberculosis
ggcggccaccaugg

SEQ ID NO: 882462 - RNA, 21 nt, Mycobacterium avium subsp. paratuberculosis
ggcggccaccaugggcgggac

SEQ ID NO: 882463 - RNA, 13 nt, Mycobacterium avium subsp. paratuberculosis
ggcggccaccgcg

SEQ ID NO: 882464 - RNA, 21 nt, Mycobacterium avium subsp. paratuberculosis
ggcggccaccgcgccccggcg

SEQ ID NO: 882465 - RNA, 22 nt, Mycobacterium avium subsp. paratuberculosis
ggcggccaccgcgccccggcgc

SEQ ID NO: 882466 - RNA, 14 nt, Mycobacterium avium subsp. paratuberculosis
ggcggccaccgcgg

SEQ ID NO: 882467 - RNA, 17 nt, Mycobacterium avium subsp. paratuberculosis
ggcggccaacaacgcca

SEQ ID NO: 882468 - RNA, 20 nt, Mycobacterium avium subsp. paratuberculosis
ggcggccaacaacgccaaga

SEQ ID NO: 882469 - RNA, 16 nt, Mycobacterium avium subsp. paratuberculosis
ggcggcauguucgaug

SEQ ID NO: 882470 - RNA, 14 nt, Mycobacterium avium subsp. paratuberculosis
ggcggccaacgccu

SEQ ID NO: 882471 - RNA, 20 nt, Mycobacterium avium subsp. paratuberculosis
ggcggccacacuggccaugc

SEQ ID NO: 882472 - RNA, 20 nt, Mycobacterium avium subsp. paratuberculosis
ggcggccaccaacggcagca

SEQ ID NO: 882473 - RNA, 13 nt, Mycobacterium avium subsp. paratuberculosis
ggcgcugaucgag

SEQ ID NO: 882474 - RNA, 14 nt, Mycobacterium avium subsp. paratuberculosis
ggcgcugagcgggu

SEQ ID NO: 882475 - RNA, 22 nt, Mycobacterium avium subsp. paratuberculosis
ggcgcugaacugcucgaccagc

SEQ ID NO: 882476 - RNA, 23 nt, Mycobacterium avium subsp. paratuberculosis
ggcgcugaacugcucgaccagcg

SEQ ID NO: 882477 - RNA, 14 nt, Mycobacterium avium subsp. paratuberculosis
ggcgcugaagugca

SEQ ID NO: 882478 - RNA, 17 nt, Mycobacterium avium subsp. paratuberculosis
ggcgcugaagugcagcg

SEQ ID NO: 882479 - RNA, 18 nt, Mycobacterium avium subsp. paratuberculosis
ggcgcucgucgucgccga

SEQ ID NO: 882480 - RNA, 15 nt, Mycobacterium avium subsp. paratuberculosis
ggcgcugcgcgacac

SEQ ID NO: 882481 - RNA, 23 nt, Mycobacterium avium subsp. paratuberculosis
ggcgcugcgccguugauugcgcc

SEQ ID NO: 882482 - RNA, 15 nt, Mycobacterium avium subsp. paratuberculosis
ggcgcugcgcccggu

SEQ ID NO: 882483 - RNA, 13 nt, Mycobacterium avium subsp. paratuberculosis
ggcgcugccggug

SEQ ID NO: 882484 - RNA, 15 nt, Mycobacterium avium subsp. paratuberculosis
ggcgcugcagcagcc

SEQ ID NO: 882485 - RNA, 21 nt, Mycobacterium avium subsp. paratuberculosis
ggcgcugcagcagcccgauca

SEQ ID NO: 882486 - RNA, 12 nt, Mycobacterium avium subsp. paratuberculosis
ggcgcugccggc

SEQ ID NO: 882487 - RNA, 14 nt, Mycobacterium avium subsp. paratuberculosis
ggcgcugcccgccg

SEQ ID NO: 882488 - RNA, 13 nt, Mycobacterium avium subsp. paratuberculosis
ggcgcugcccgcg

SEQ ID NO: 882489 - RNA, 14 nt, Mycobacterium avium subsp. paratuberculosis
ggcgcugcccgcga

SEQ ID NO: 882490 - RNA, 17 nt, Mycobacterium avium subsp. paratuberculosis
ggcgcugcccgucgacc

SEQ ID NO: 882491 - RNA, 17 nt, Mycobacterium avium subsp. paratuberculosis
ggcgcuuuccaccucga

SEQ ID NO: 882492 - RNA, 20 nt, Mycobacterium avium subsp. paratuberculosis
ggcgcuuucgaagugacgcc

SEQ ID NO: 882493 - RNA, 19 nt, Mycobacterium avium subsp. paratuberculosis
ggcgcuguaggcggcgugc

SEQ ID NO: 882494 - RNA, 21 nt, Mycobacterium avium subsp. paratuberculosis
ggcgcuguaggcggcgugcca

SEQ ID NO: 882495 - RNA, 19 nt, Mycobacterium avium subsp. paratuberculosis
ggcgcugguaguggcgugc

SEQ ID NO: 882496 - RNA, 14 nt, Mycobacterium avium subsp. paratuberculosis
ggcgcuguaccgcg

SEQ ID NO: 882497 - RNA, 21 nt, Mycobacterium avium subsp. paratuberculosis
ggcgcuguaccgcgagaucag

SEQ ID NO: 882498 - RNA, 15 nt, Mycobacterium avium subsp. paratuberculosis
ggcgcugguccucgg

SEQ ID NO: 882499 - RNA, 17 nt, Mycobacterium avium subsp. paratuberculosis
ggcgcugguccucgggg

SEQ ID NO: 882500 - RNA, 13 nt, Mycobacterium avium subsp. paratuberculosis
ggcgcuggcgugc

SEQ ID NO: 882501 - RNA, 19 nt, Mycobacterium avium subsp. paratuberculosis
ggcgcugggugcgggcugc

SEQ ID NO: 882502 - RNA, 23 nt, Mycobacterium avium subsp. paratuberculosis
ggcgcugggagcgggccacgcag

SEQ ID NO: 882503 - RNA, 14 nt, Mycobacterium avium subsp. paratuberculosis
ggcgcuggcgaugg

SEQ ID NO: 882504 - RNA, 17 nt, Mycobacterium avium subsp. paratuberculosis
ggcgcucgcgggugcgc

SEQ ID NO: 882505 - RNA, 19 nt, Mycobacterium avium subsp. paratuberculosis
ggcgcucgccgcgcggccc

SEQ ID NO: 882506 - RNA, 21 nt, Mycobacterium avium subsp. paratuberculosis
ggcgcucgccgcgcggcccgc

SEQ ID NO: 882507 - RNA, 16 nt, Mycobacterium avium subsp. paratuberculosis
ggcgcuacgccggcuc

SEQ ID NO: 882508 - RNA, 12 nt, Mycobacterium avium subsp. paratuberculosis
ggcgcuacgcgc

SEQ ID NO: 882509 - RNA, 17 nt, Mycobacterium avium subsp. paratuberculosis
ggcgcuaaagccaccag

SEQ ID NO: 882510 - RNA, 19 nt, Mycobacterium avium subsp. paratuberculosis
ggcgcuaaagccgaccgcc

SEQ ID NO: 882511 - RNA, 14 nt, Mycobacterium avium subsp. paratuberculosis
ggcgcguugaugcc

SEQ ID NO: 882512 - RNA, 22 nt, Mycobacterium avium subsp. paratuberculosis
ggcgcguugaugccgugcgcgc

SEQ ID NO: 882513 - RNA, 12 nt, Mycobacterium avium subsp. paratuberculosis
ggcgcguucggg

SEQ ID NO: 882514 - RNA, 15 nt, Mycobacterium avium subsp. paratuberculosis
ggcgcguuggccgag

SEQ ID NO: 882515 - RNA, 18 nt, Mycobacterium avium subsp. paratuberculosis
ggcgcguuggccggcugg

SEQ ID NO: 882516 - RNA, 13 nt, Mycobacterium avium subsp. paratuberculosis
ggcgcggcgcacc

SEQ ID NO: 882517 - RNA, 23 nt, Mycobacterium avium subsp. paratuberculosis
ggcgcggcgcaccgagucgguga

SEQ ID NO: 882518 - RNA, 17 nt, Mycobacterium avium subsp. paratuberculosis
ggcgcggcgcaccgccc

SEQ ID NO: 882519 - RNA, 20 nt, Mycobacterium avium subsp. paratuberculosis
ggcgcggcgcaccgcccgcg

SEQ ID NO: 882520 - RNA, 14 nt, Mycobacterium avium subsp. paratuberculosis
ggcgcggcgcagcg

SEQ ID NO: 882521 - RNA, 16 nt, Mycobacterium avium subsp. paratuberculosis
ggcgcggcgcagcgcg

SEQ ID NO: 882522 - RNA, 12 nt, Mycobacterium avium subsp. paratuberculosis
ggcgcggcggca

SEQ ID NO: 882523 - RNA, 13 nt, Mycobacterium avium subsp. paratuberculosis
ggcgcggcggcaa

SEQ ID NO: 882524 - RNA, 19 nt, Mycobacterium avium subsp. paratuberculosis
ggcgcggagaaggugucgc

SEQ ID NO: 882525 - RNA, 16 nt, Mycobacterium avium subsp. paratuberculosis
ggcgcggacggaucga

SEQ ID NO: 882526 - RNA, 19 nt, Mycobacterium avium subsp. paratuberculosis
ggcgcggacagcugcgcgg

SEQ ID NO: 882527 - RNA, 21 nt, Mycobacterium avium subsp. paratuberculosis
ggcgcggaccgcacccccagc

SEQ ID NO: 882528 - RNA, 18 nt, Mycobacterium avium subsp. paratuberculosis
ggcgcggcguagccgccg

SEQ ID NO: 882529 - RNA, 19 nt, Mycobacterium avium subsp. paratuberculosis
ggcgcggcguagccgccgg

SEQ ID NO: 882530 - RNA, 11 nt, Mycobacterium avium subsp. paratuberculosis
ggcgcggcgua

SEQ ID NO: 882531 - RNA, 12 nt, Mycobacterium avium subsp. paratuberculosis
ggcgcggcgacg

SEQ ID NO: 882532 - RNA, 14 nt, Mycobacterium avium subsp. paratuberculosis
ggcgcggcggcgcc

SEQ ID NO: 882533 - RNA, 18 nt, Mycobacterium avium subsp. paratuberculosis
ggcgcggcggcgccgcgg

SEQ ID NO: 882534 - RNA, 20 nt, Mycobacterium avium subsp. paratuberculosis
ggcgcggcggcgccgcggua

SEQ ID NO: 882535 - RNA, 15 nt, Mycobacterium avium subsp. paratuberculosis
ggcgcaccgccugug

SEQ ID NO: 882536 - RNA, 16 nt, Mycobacterium avium subsp. paratuberculosis
ggcgcaccaggguguc

SEQ ID NO: 882537 - RNA, 21 nt, Mycobacterium avium subsp. paratuberculosis
ggcgcgauagccggugaucgc

SEQ ID NO: 882538 - RNA, 23 nt, Mycobacterium avium subsp. paratuberculosis
ggcgcgauagccggugaucgcgg

SEQ ID NO: 882539 - RNA, 15 nt, Mycobacterium avium subsp. paratuberculosis
ggcgcacccgcacga

SEQ ID NO: 882540 - RNA, 19 nt, Mycobacterium avium subsp. paratuberculosis
ggcgcacccgcacgaugug

SEQ ID NO: 882541 - RNA, 16 nt, Mycobacterium avium subsp. paratuberculosis
ggcgcaccgccaccgc

SEQ ID NO: 882542 - RNA, 18 nt, Mycobacterium avium subsp. paratuberculosis
ggcgcaccgccaccgcgc

SEQ ID NO: 882543 - RNA, 19 nt, Mycobacterium avium subsp. paratuberculosis
ggcgcaccgccaccgcgca

SEQ ID NO: 882544 - RNA, 14 nt, Mycobacterium avium subsp. paratuberculosis
ggcgcaccgcccgc

SEQ ID NO: 882545 - RNA, 16 nt, Mycobacterium avium subsp. paratuberculosis
ggcgcaccgcccgcgg

SEQ ID NO: 882546 - RNA, 15 nt, Mycobacterium avium subsp. paratuberculosis
ggcgcaccgccgcgg

SEQ ID NO: 882547 - RNA, 16 nt, Mycobacterium avium subsp. paratuberculosis
ggcgcaccgccgcggg

SEQ ID NO: 882548 - RNA, 19 nt, Mycobacterium avium subsp. paratuberculosis
ggcgcgaugaucgccggcg

SEQ ID NO: 882549 - RNA, 21 nt, Mycobacterium avium subsp. paratuberculosis
ggcgcgaugaucgccggcgcc

SEQ ID NO: 882550 - RNA, 21 nt, Mycobacterium avium subsp. paratuberculosis
ggcgcgaugcuauucgggcca

SEQ ID NO: 882551 - RNA, 22 nt, Mycobacterium avium subsp. paratuberculosis
ggcgcgcaacgauucacccagc

SEQ ID NO: 882552 - RNA, 22 nt, Mycobacterium avium subsp. paratuberculosis
ggcgcgaucggcaggucgucga

SEQ ID NO: 882553 - RNA, 23 nt, Mycobacterium avium subsp. paratuberculosis
ggcgcgaucggcaggucgucgac

SEQ ID NO: 882554 - RNA, 13 nt, Mycobacterium avium subsp. paratuberculosis
ggcgcgaucggcc

SEQ ID NO: 882555 - RNA, 16 nt, Mycobacterium avium subsp. paratuberculosis
ggcgcgaucggccgcu

SEQ ID NO: 882556 - RNA, 15 nt, Mycobacterium avium subsp. paratuberculosis
ggcgcgaucgucgac

SEQ ID NO: 882557 - RNA, 16 nt, Mycobacterium avium subsp. paratuberculosis
ggcgcgaucgucgacc

SEQ ID NO: 882558 - RNA, 19 nt, Mycobacterium avium subsp. paratuberculosis
ggcgcgaucgucgaccacc

SEQ ID NO: 882559 - RNA, 16 nt, Mycobacterium avium subsp. paratuberculosis
ggcgcgcaucgucgcg

SEQ ID NO: 882560 - RNA, 22 nt, Mycobacterium avium subsp. paratuberculosis
ggcgcgcaucgucgcggcgcua

SEQ ID NO: 882561 - RNA, 14 nt, Mycobacterium avium subsp. paratuberculosis
ggcgcgcaggcgca

SEQ ID NO: 882562 - RNA, 17 nt, Mycobacterium avium subsp. paratuberculosis
ggcgcgcaggcgcacca

SEQ ID NO: 882563 - RNA, 20 nt, Mycobacterium avium subsp. paratuberculosis
ggcgcgcaggcgcaccacca

SEQ ID NO: 882564 - RNA, 14 nt, Mycobacterium avium subsp. paratuberculosis
ggcgcgcagcucgc

SEQ ID NO: 882565 - RNA, 16 nt, Mycobacterium avium subsp. paratuberculosis
ggcgcgcagcucgcgc

SEQ ID NO: 882566 - RNA, 22 nt, Mycobacterium avium subsp. paratuberculosis
ggcgcgcagccacgagcccagc

SEQ ID NO: 882567 - RNA, 18 nt, Mycobacterium avium subsp. paratuberculosis
ggcgcgcagccagucgcc

SEQ ID NO: 882568 - RNA, 15 nt, Mycobacterium avium subsp. paratuberculosis
ggcgcgcagcccagc

SEQ ID NO: 882569 - RNA, 18 nt, Mycobacterium avium subsp. paratuberculosis
ggcgcgcagcccagccag

SEQ ID NO: 882570 - RNA, 13 nt, Mycobacterium avium subsp. paratuberculosis
ggcgcgcagcgaa

SEQ ID NO: 882571 - RNA, 23 nt, Mycobacterium avium subsp. paratuberculosis
ggcgcgcagaucgucgaccugcu

SEQ ID NO: 882572 - RNA, 20 nt, Mycobacterium avium subsp. paratuberculosis
ggcgcgcagcaauugacgcc

SEQ ID NO: 882573 - RNA, 13 nt, Mycobacterium avium subsp. paratuberculosis
ggcgcgcagcacc

SEQ ID NO: 882574 - RNA, 20 nt, Mycobacterium avium subsp. paratuberculosis
ggcgcgcagcaggcgccggu

SEQ ID NO: 882575 - RNA, 12 nt, Mycobacterium avium subsp. paratuberculosis
ggcgcgcacguc

SEQ ID NO: 882576 - RNA, 18 nt, Mycobacterium avium subsp. paratuberculosis
ggcgcgcacgucaccgcg

SEQ ID NO: 882577 - RNA, 20 nt, Mycobacterium avium subsp. paratuberculosis
ggcgcgcacguuggcggcca

SEQ ID NO: 882578 - RNA, 14 nt, Mycobacterium avium subsp. paratuberculosis
ggcgcgcacggcag

SEQ ID NO: 882579 - RNA, 23 nt, Mycobacterium avium subsp. paratuberculosis
ggcgcgcacggcagcccgacguc

SEQ ID NO: 882580 - RNA, 14 nt, Mycobacterium avium subsp. paratuberculosis
ggcgcgcaccgcgg

SEQ ID NO: 882581 - RNA, 12 nt, Mycobacterium avium subsp. paratuberculosis
ggcgcgcaccgg

SEQ ID NO: 882582 - RNA, 15 nt, Mycobacterium avium subsp. paratuberculosis
ggcgcgcaccccggc

SEQ ID NO: 882583 - RNA, 19 nt, Mycobacterium avium subsp. paratuberculosis
ggcgcgcaccagcucggcg

SEQ ID NO: 882584 - RNA, 13 nt, Mycobacterium avium subsp. paratuberculosis
ggcgcgcaccauc

SEQ ID NO: 882585 - RNA, 22 nt, Mycobacterium avium subsp. paratuberculosis
ggcgcgcaacucguccaccagc

SEQ ID NO: 882586 - RNA, 23 nt, Mycobacterium avium subsp. paratuberculosis
ggcgcgcaacucguccaccagcu

SEQ ID NO: 882587 - RNA, 13 nt, Mycobacterium avium subsp. paratuberculosis
ggcgcgcaccagc

SEQ ID NO: 882588 - RNA, 22 nt, Mycobacterium avium subsp. paratuberculosis
ggcgcgcugaagcgcgaccccu

SEQ ID NO: 882589 - RNA, 20 nt, Mycobacterium avium subsp. paratuberculosis
ggcgcgcucgucgucgguga

SEQ ID NO: 882590 - RNA, 22 nt, Mycobacterium avium subsp. paratuberculosis
ggcgcgcucgucgucggugaac

SEQ ID NO: 882591 - RNA, 23 nt, Mycobacterium avium subsp. paratuberculosis
ggcgcggaacagcgucgccgacg

SEQ ID NO: 882592 - RNA, 17 nt, Mycobacterium avium subsp. paratuberculosis
ggcgcgcugucgacgcg

SEQ ID NO: 882593 - RNA, 15 nt, Mycobacterium avium subsp. paratuberculosis
ggcgcgccugcgcgg

SEQ ID NO: 882594 - RNA, 18 nt, Mycobacterium avium subsp. paratuberculosis
ggcgcgcuaacggcgcgg

SEQ ID NO: 882595 - RNA, 21 nt, Mycobacterium avium subsp. paratuberculosis
ggcgcgcuaacggcgcggcag

SEQ ID NO: 882596 - RNA, 16 nt, Mycobacterium avium subsp. paratuberculosis
ggcgcgccgucccagc

SEQ ID NO: 882597 - RNA, 18 nt, Mycobacterium avium subsp. paratuberculosis
ggcgcgccgucccagccg

SEQ ID NO: 882598 - RNA, 14 nt, Mycobacterium avium subsp. paratuberculosis
ggcgcgccggcgcg

SEQ ID NO: 882599 - RNA, 13 nt, Mycobacterium avium subsp. paratuberculosis
ggcgcgccgggca

SEQ ID NO: 882600 - RNA, 21 nt, Mycobacterium avium subsp. paratuberculosis
ggcgcgccgggcagcccgccg

SEQ ID NO: 882601 - RNA, 23 nt, Mycobacterium avium subsp. paratuberculosis
ggcgcgccgcguucggcggcgcg

SEQ ID NO: 882602 - RNA, 13 nt, Mycobacterium avium subsp. paratuberculosis
ggcgcgccgaaga

SEQ ID NO: 882603 - RNA, 16 nt, Mycobacterium avium subsp. paratuberculosis
ggcgcgccgagcgcug

SEQ ID NO: 882604 - RNA, 12 nt, Mycobacterium avium subsp. paratuberculosis
ggcgcgccgcac

SEQ ID NO: 882605 - RNA, 13 nt, Mycobacterium avium subsp. paratuberculosis
ggcgcgcccgacg

SEQ ID NO: 882606 - RNA, 13 nt, Mycobacterium avium subsp. paratuberculosis
ggcgcgccccggc

SEQ ID NO: 882607 - RNA, 20 nt, Mycobacterium avium subsp. paratuberculosis
ggcgcgccccggcccgucca

SEQ ID NO: 882608 - RNA, 15 nt, Mycobacterium avium subsp. paratuberculosis
ggcgcgcaucccgau

SEQ ID NO: 882609 - RNA, 14 nt, Mycobacterium avium subsp. paratuberculosis
ggcgcgcccacccg

SEQ ID NO: 882610 - RNA, 19 nt, Mycobacterium avium subsp. paratuberculosis
ggcgcgcccacccgcgccg

SEQ ID NO: 882611 - RNA, 23 nt, Mycobacterium avium subsp. paratuberculosis
ggcgcgcccacccgcgccggcag

SEQ ID NO: 882612 - RNA, 19 nt, Mycobacterium avium subsp. paratuberculosis
ggcgcgcagguagccgccg

SEQ ID NO: 882613 - RNA, 17 nt, Mycobacterium avium subsp. paratuberculosis
ggcgcgccagcguggcg

SEQ ID NO: 882614 - RNA, 19 nt, Mycobacterium avium subsp. paratuberculosis
ggcgcgcaucugcucggcg

SEQ ID NO: 882615 - RNA, 14 nt, Mycobacterium avium subsp. paratuberculosis
ggcgcgccacccga

SEQ ID NO: 882616 - RNA, 22 nt, Mycobacterium avium subsp. paratuberculosis
ggcgcgccacgacguacccccg

SEQ ID NO: 882617 - RNA, 15 nt, Mycobacterium avium subsp. paratuberculosis
ggcauaggccagcac

SEQ ID NO: 882618 - RNA, 17 nt, Mycobacterium avium subsp. paratuberculosis
ggcauaggccagcacca

SEQ ID NO: 882619 - RNA, 19 nt, Mycobacterium avium subsp. paratuberculosis
ggcauaggccagcaccagc

SEQ ID NO: 882620 - RNA, 15 nt, Mycobacterium avium subsp. paratuberculosis
ggcaguugccggcca

SEQ ID NO: 882621 - RNA, 23 nt, Mycobacterium avium subsp. paratuberculosis
ggcaucaucgcuacaccccaccg

SEQ ID NO: 882622 - RNA, 18 nt, Mycobacterium avium subsp. paratuberculosis
ggcaucaucggcacgccg

SEQ ID NO: 882623 - RNA, 14 nt, Mycobacterium avium subsp. paratuberculosis
ggcaugggaucagc

SEQ ID NO: 882624 - RNA, 17 nt, Mycobacterium avium subsp. paratuberculosis
ggcaugggaucagcagc

SEQ ID NO: 882625 - RNA, 16 nt, Mycobacterium avium subsp. paratuberculosis
ggcaugguuccucguu

SEQ ID NO: 882626 - RNA, 18 nt, Mycobacterium avium subsp. paratuberculosis
ggcaugucgccgaacgcc

SEQ ID NO: 882627 - RNA, 13 nt, Mycobacterium avium subsp. paratuberculosis
ggcaugucggugg

SEQ ID NO: 882628 - RNA, 21 nt, Mycobacterium avium subsp. paratuberculosis
ggcaugucgguggacagcgcg

SEQ ID NO: 882629 - RNA, 22 nt, Mycobacterium avium subsp. paratuberculosis
ggcaugucgguggacagcgcga

SEQ ID NO: 882630 - RNA, 12 nt, Mycobacterium avium subsp. paratuberculosis
ggcauggcugga

SEQ ID NO: 882631 - RNA, 22 nt, Mycobacterium avium subsp. paratuberculosis
ggcauggcgaugaccagcgcga

SEQ ID NO: 882632 - RNA, 21 nt, Mycobacterium avium subsp. paratuberculosis
ggcauugcccaucgccacgcc

SEQ ID NO: 882633 - RNA, 16 nt, Mycobacterium avium subsp. paratuberculosis
ggccaacccgggcgcc

SEQ ID NO: 882634 - RNA, 18 nt, Mycobacterium avium subsp. paratuberculosis
ggccaaccgcccggcgcc

SEQ ID NO: 882635 - RNA, 19 nt, Mycobacterium avium subsp. paratuberculosis
ggccaaccgcccggcgccg

SEQ ID NO: 882636 - RNA, 23 nt, Mycobacterium avium subsp. paratuberculosis
ggccaacgcgacgaagccggugc

SEQ ID NO: 882637 - RNA, 19 nt, Mycobacterium avium subsp. paratuberculosis
ggccaacgggaagagcggc

SEQ ID NO: 882638 - RNA, 22 nt, Mycobacterium avium subsp. paratuberculosis
ggccaacgggaagagcggcgug

SEQ ID NO: 882639 - RNA, 14 nt, Mycobacterium avium subsp. paratuberculosis
ggccaacgagcgcg

SEQ ID NO: 882640 - RNA, 16 nt, Mycobacterium avium subsp. paratuberculosis
ggccaacgagcgcgcc

SEQ ID NO: 882641 - RNA, 17 nt, Mycobacterium avium subsp. paratuberculosis
ggccaacgagcgcgccg

SEQ ID NO: 882642 - RNA, 21 nt, Mycobacterium avium subsp. paratuberculosis
ggccaacgagcgcgccgaggu

SEQ ID NO: 882643 - RNA, 20 nt, Mycobacterium avium subsp. paratuberculosis
ggccaacucgcgaagaucgg

SEQ ID NO: 882644 - RNA, 15 nt, Mycobacterium avium subsp. paratuberculosis
ggccaacgguucggc

SEQ ID NO: 882645 - RNA, 16 nt, Mycobacterium avium subsp. paratuberculosis
ggccaacgguucggcc

SEQ ID NO: 882646 - RNA, 18 nt, Mycobacterium avium subsp. paratuberculosis
ggccaacugcaucgccag

SEQ ID NO: 882647 - RNA, 19 nt, Mycobacterium avium subsp. paratuberculosis
ggccaacugcaucgccagc

SEQ ID NO: 882648 - RNA, 20 nt, Mycobacterium avium subsp. paratuberculosis
ggccaacugcaucgccagca

SEQ ID NO: 882649 - RNA, 21 nt, Mycobacterium avium subsp. paratuberculosis
ggccaacugcaucgccagcac

SEQ ID NO: 882650 - RNA, 22 nt, Mycobacterium avium subsp. paratuberculosis
ggccaauuacgcugcggcgccg

SEQ ID NO: 882651 - RNA, 21 nt, Mycobacterium avium subsp. paratuberculosis
ggccaauuccucagcccggca

SEQ ID NO: 882652 - RNA, 19 nt, Mycobacterium avium subsp. paratuberculosis
ggccacacccgucgacucg

SEQ ID NO: 882653 - RNA, 17 nt, Mycobacterium avium subsp. paratuberculosis
ggccacaccgaucagca

SEQ ID NO: 882654 - RNA, 19 nt, Mycobacterium avium subsp. paratuberculosis
ggccacaccggggccaggu

SEQ ID NO: 882655 - RNA, 19 nt, Mycobacterium avium subsp. paratuberculosis
ggccacaugggccacggcg

SEQ ID NO: 882656 - RNA, 20 nt, Mycobacterium avium subsp. paratuberculosis
ggccacagcggcgacagcgg

SEQ ID NO: 882657 - RNA, 20 nt, Mycobacterium avium subsp. paratuberculosis
ggccaccaacaggucggcgu

SEQ ID NO: 882658 - RNA, 22 nt, Mycobacterium avium subsp. paratuberculosis
ggccaccaacaggucggcgugc

SEQ ID NO: 882659 - RNA, 20 nt, Mycobacterium avium subsp. paratuberculosis
ggccaccacauuggcgaccg

SEQ ID NO: 882660 - RNA, 21 nt, Mycobacterium avium subsp. paratuberculosis
ggccaccacauuggcgaccgc

SEQ ID NO: 882661 - RNA, 22 nt, Mycobacterium avium subsp. paratuberculosis
ggccaccacauuggcgaccgcg

SEQ ID NO: 882662 - RNA, 22 nt, Mycobacterium avium subsp. paratuberculosis
ggccagacugcgcaccgccagc

SEQ ID NO: 882663 - RNA, 23 nt, Mycobacterium avium subsp. paratuberculosis
ggccagaccgcacaauccgguca

SEQ ID NO: 882664 - RNA, 15 nt, Mycobacterium avium subsp. paratuberculosis
ggccagcagccgcgc

SEQ ID NO: 882665 - RNA, 19 nt, Mycobacterium avium subsp. paratuberculosis
ggccagcagccgcgcgagc

SEQ ID NO: 882666 - RNA, 17 nt, Mycobacterium avium subsp. paratuberculosis
ggccagcagccgcgaca

SEQ ID NO: 882667 - RNA, 18 nt, Mycobacterium avium subsp. paratuberculosis
ggccagcagccgcgacac

SEQ ID NO: 882668 - RNA, 19 nt, Mycobacterium avium subsp. paratuberculosis
ggccagcagccgcgacacg

SEQ ID NO: 882669 - RNA, 13 nt, Mycobacterium avium subsp. paratuberculosis
ggccagaucggcc

SEQ ID NO: 882670 - RNA, 17 nt, Mycobacterium avium subsp. paratuberculosis
ggccagaucggccaggu

SEQ ID NO: 882671 - RNA, 16 nt, Mycobacterium avium subsp. paratuberculosis
ggccagaugcccgccc

SEQ ID NO: 882672 - RNA, 22 nt, Mycobacterium avium subsp. paratuberculosis
ggccagaucgacccccaccgcg

SEQ ID NO: 882673 - RNA, 16 nt, Mycobacterium avium subsp. paratuberculosis
ggccagaucgacgccg

SEQ ID NO: 882674 - RNA, 16 nt, Mycobacterium avium subsp. paratuberculosis
ggccagcaacaccagc

SEQ ID NO: 882675 - RNA, 17 nt, Mycobacterium avium subsp. paratuberculosis
ggccagcaacagcagcg

SEQ ID NO: 882676 - RNA, 20 nt, Mycobacterium avium subsp. paratuberculosis
ggccagcaacagcagcggca

SEQ ID NO: 882677 - RNA, 17 nt, Mycobacterium avium subsp. paratuberculosis
ggccagccgggcggcca

SEQ ID NO: 882678 - RNA, 22 nt, Mycobacterium avium subsp. paratuberculosis
ggccagccgggguagggcggcg

SEQ ID NO: 882679 - RNA, 16 nt, Mycobacterium avium subsp. paratuberculosis
ggccagccggucgucg

SEQ ID NO: 882680 - RNA, 19 nt, Mycobacterium avium subsp. paratuberculosis
ggccagccggucgucgggg

SEQ ID NO: 882681 - RNA, 14 nt, Mycobacterium avium subsp. paratuberculosis
ggccagccgggcga

SEQ ID NO: 882682 - RNA, 15 nt, Mycobacterium avium subsp. paratuberculosis
ggccagccgggcgac

SEQ ID NO: 882683 - RNA, 19 nt, Mycobacterium avium subsp. paratuberculosis
ggccagccgggcgaccguc

SEQ ID NO: 882684 - RNA, 21 nt, Mycobacterium avium subsp. paratuberculosis
ggccagccgcgcggcgucggc

SEQ ID NO: 882685 - RNA, 23 nt, Mycobacterium avium subsp. paratuberculosis
ggccagccgcgcggcgucggccg

SEQ ID NO: 882686 - RNA, 15 nt, Mycobacterium avium subsp. paratuberculosis
ggccagcccgcggca

SEQ ID NO: 882687 - RNA, 18 nt, Mycobacterium avium subsp. paratuberculosis
ggccagcccgcggcagcc

SEQ ID NO: 882688 - RNA, 13 nt, Mycobacterium avium subsp. paratuberculosis
ggccagcccggcg

SEQ ID NO: 882689 - RNA, 14 nt, Mycobacterium avium subsp. paratuberculosis
ggccagcccggcgu

SEQ ID NO: 882690 - RNA, 15 nt, Mycobacterium avium subsp. paratuberculosis
ggccagcccggcgug

SEQ ID NO: 882691 - RNA, 12 nt, Mycobacterium avium subsp. paratuberculosis
ggccagcccggg

SEQ ID NO: 882692 - RNA, 13 nt, Mycobacterium avium subsp. paratuberculosis
ggccagcccggga

SEQ ID NO: 882693 - RNA, 21 nt, Mycobacterium avium subsp. paratuberculosis
ggccagcagguagaucgccag

SEQ ID NO: 882694 - RNA, 16 nt, Mycobacterium avium subsp. paratuberculosis
ggccagcagcgcgucg

SEQ ID NO: 882695 - RNA, 16 nt, Mycobacterium avium subsp. paratuberculosis
ggccagcagcuugacg

SEQ ID NO: 882696 - RNA, 23 nt, Mycobacterium avium subsp. paratuberculosis
ggccagcaggaucuggugcgcgc

SEQ ID NO: 882697 - RNA, 17 nt, Mycobacterium avium subsp. paratuberculosis
ggccagcagcggcuugg

SEQ ID NO: 882698 - RNA, 12 nt, Mycobacterium avium subsp. paratuberculosis
ggccagcagcgu

SEQ ID NO: 882699 - RNA, 14 nt, Mycobacterium avium subsp. paratuberculosis
ggccagcagcgucg

SEQ ID NO: 882700 - RNA, 12 nt, Mycobacterium avium subsp. paratuberculosis
ggccaccccgga

SEQ ID NO: 882701 - RNA, 16 nt, Mycobacterium avium subsp. paratuberculosis
ggccacgaccucgggg

SEQ ID NO: 882702 - RNA, 16 nt, Mycobacterium avium subsp. paratuberculosis
ggccacgacgcgccac

SEQ ID NO: 882703 - RNA, 19 nt, Mycobacterium avium subsp. paratuberculosis
ggccacgacgcggcgcgcg

SEQ ID NO: 882704 - RNA, 14 nt, Mycobacterium avium subsp. paratuberculosis
ggccacgacggcgc

SEQ ID NO: 882705 - RNA, 13 nt, Mycobacterium avium subsp. paratuberculosis
ggccacccgcgau

SEQ ID NO: 882706 - RNA, 23 nt, Mycobacterium avium subsp. paratuberculosis
ggccaccuuggacaggcccagcg

SEQ ID NO: 882707 - RNA, 20 nt, Mycobacterium avium subsp. paratuberculosis
ggccaccuugucggcgccca

SEQ ID NO: 882708 - RNA, 13 nt, Mycobacterium avium subsp. paratuberculosis
ggccacgcccacg

SEQ ID NO: 882709 - RNA, 19 nt, Mycobacterium avium subsp. paratuberculosis
ggccacgcccacgccgagg

SEQ ID NO: 882710 - RNA, 16 nt, Mycobacterium avium subsp. paratuberculosis
ggccacgcagucgucg

SEQ ID NO: 882711 - RNA, 20 nt, Mycobacterium avium subsp. paratuberculosis
ggccacgauccgcgcggcca

SEQ ID NO: 882712 - RNA, 14 nt, Mycobacterium avium subsp. paratuberculosis
ggccacgauccggg

SEQ ID NO: 882713 - RNA, 21 nt, Mycobacterium avium subsp. paratuberculosis
ggccacgaucgcgaucgccga

SEQ ID NO: 882714 - RNA, 21 nt, Mycobacterium avium subsp. paratuberculosis
ggccacgaucgcggccagcgu

SEQ ID NO: 882715 - RNA, 13 nt, Mycobacterium avium subsp. paratuberculosis
ggccacgaugauc

SEQ ID NO: 882716 - RNA, 22 nt, Mycobacterium avium subsp. paratuberculosis
ggccacgaugaucgucggcagc

SEQ ID NO: 882717 - RNA, 23 nt, Mycobacterium avium subsp. paratuberculosis
ggccacgaugaucgucggcagcg

SEQ ID NO: 882718 - RNA, 19 nt, Mycobacterium avium subsp. paratuberculosis
ggccacgauggggacgucg

SEQ ID NO: 882719 - RNA, 20 nt, Mycobacterium avium subsp. paratuberculosis
ggccacgauggggacgucga

SEQ ID NO: 882720 - RNA, 15 nt, Mycobacterium avium subsp. paratuberculosis
ggccacucgccgcga

SEQ ID NO: 882721 - RNA, 13 nt, Mycobacterium avium subsp. paratuberculosis
ggccacgccgggc

SEQ ID NO: 882722 - RNA, 14 nt, Mycobacterium avium subsp. paratuberculosis
ggccacgccggguu

SEQ ID NO: 882723 - RNA, 23 nt, Mycobacterium avium subsp. paratuberculosis
ggccacgccccauugccgcgccg

SEQ ID NO: 882724 - RNA, 18 nt, Mycobacterium avium subsp. paratuberculosis
ggccacgcccuggccgcc

SEQ ID NO: 882725 - RNA, 12 nt, Mycobacterium avium subsp. paratuberculosis
ggccacgccgac

SEQ ID NO: 882726 - RNA, 22 nt, Mycobacterium avium subsp. paratuberculosis
ggccaccagggucucgcgcagc

SEQ ID NO: 882727 - RNA, 22 nt, Mycobacterium avium subsp. paratuberculosis
ggccaccagggacaugccgagc

SEQ ID NO: 882728 - RNA, 17 nt, Mycobacterium avium subsp. paratuberculosis
ggccaccaggucgcaca

SEQ ID NO: 882729 - RNA, 20 nt, Mycobacterium avium subsp. paratuberculosis
ggccaccaggucgcacacca

SEQ ID NO: 882730 - RNA, 22 nt, Mycobacterium avium subsp. paratuberculosis
ggccaccaggucgcacaccagc

SEQ ID NO: 882731 - RNA, 23 nt, Mycobacterium avium subsp. paratuberculosis
ggccaccaggucgcacaccagca

SEQ ID NO: 882732 - RNA, 17 nt, Mycobacterium avium subsp. paratuberculosis
ggccaccagcgcggcca

SEQ ID NO: 882733 - RNA, 20 nt, Mycobacterium avium subsp. paratuberculosis
ggccaccagcgcggccacca

SEQ ID NO: 882734 - RNA, 23 nt, Mycobacterium avium subsp. paratuberculosis
ggccaccagcgcggccaccacca

SEQ ID NO: 882735 - RNA, 14 nt, Mycobacterium avium subsp. paratuberculosis
ggccaccagcgccc

SEQ ID NO: 882736 - RNA, 17 nt, Mycobacterium avium subsp. paratuberculosis
ggccaccaucaggccgg

SEQ ID NO: 882737 - RNA, 20 nt, Mycobacterium avium subsp. paratuberculosis
ggccaccaucaggccggccu

SEQ ID NO: 882738 - RNA, 19 nt, Mycobacterium avium subsp. paratuberculosis
ggccaccaucuccgcggcg

SEQ ID NO: 882739 - RNA, 20 nt, Mycobacterium avium subsp. paratuberculosis
ggccaccaucuccgcggcgc

SEQ ID NO: 882740 - RNA, 16 nt, Mycobacterium avium subsp. paratuberculosis
ggccaccaugccggcg

SEQ ID NO: 882741 - RNA, 16 nt, Mycobacterium avium subsp. paratuberculosis
ggccaccaugucggcg

SEQ ID NO: 882742 - RNA, 19 nt, Mycobacterium avium subsp. paratuberculosis
ggccaccaugucggcgucg

SEQ ID NO: 882743 - RNA, 23 nt, Mycobacterium avium subsp. paratuberculosis
ggccaccaugucggcgucgccga

SEQ ID NO: 882744 - RNA, 20 nt, Mycobacterium avium subsp. paratuberculosis
ggccaccaccacggccgccg

SEQ ID NO: 882745 - RNA, 22 nt, Mycobacterium avium subsp. paratuberculosis
ggccaccacguacuccugcgcg

SEQ ID NO: 882746 - RNA, 21 nt, Mycobacterium avium subsp. paratuberculosis
ggccaccacggcaccgccgcg

SEQ ID NO: 882747 - RNA, 22 nt, Mycobacterium avium subsp. paratuberculosis
ggccaccacggcaccgccgcgc

SEQ ID NO: 882748 - RNA, 19 nt, Mycobacterium avium subsp. paratuberculosis
ggccaccacgggucggucg

SEQ ID NO: 882749 - RNA, 21 nt, Mycobacterium avium subsp. paratuberculosis
ggccaccacgggucggucggc

SEQ ID NO: 882750 - RNA, 19 nt, Mycobacterium avium subsp. paratuberculosis
ggccaccacgacgccgggc

SEQ ID NO: 882751 - RNA, 13 nt, Mycobacterium avium subsp. paratuberculosis
ggccaccacgcca

SEQ ID NO: 882752 - RNA, 15 nt, Mycobacterium avium subsp. paratuberculosis
ggccaccacgccagc

SEQ ID NO: 882753 - RNA, 14 nt, Mycobacterium avium subsp. paratuberculosis
ggccaccaccgcca

SEQ ID NO: 882754 - RNA, 15 nt, Mycobacterium avium subsp. paratuberculosis
ggccaccaccgccac

SEQ ID NO: 882755 - RNA, 17 nt, Mycobacterium avium subsp. paratuberculosis
ggccaccaccacggcca

SEQ ID NO: 882756 - RNA, 12 nt, Mycobacterium avium subsp. paratuberculosis
ggcagugcgcgg

SEQ ID NO: 882757 - RNA, 15 nt, Mycobacterium avium subsp. paratuberculosis
ggcagugcgcggcgu

SEQ ID NO: 882758 - RNA, 20 nt, Mycobacterium avium subsp. paratuberculosis
ggcagguggauugucggccg

SEQ ID NO: 882759 - RNA, 22 nt, Mycobacterium avium subsp. paratuberculosis
ggcagguggauugucggccgcc

SEQ ID NO: 882760 - RNA, 12 nt, Mycobacterium avium subsp. paratuberculosis
ggcagguggcgu

SEQ ID NO: 882761 - RNA, 21 nt, Mycobacterium avium subsp. paratuberculosis
ggcagguggcguagucggugc

SEQ ID NO: 882762 - RNA, 13 nt, Mycobacterium avium subsp. paratuberculosis
ggcagguggucgg

SEQ ID NO: 882763 - RNA, 16 nt, Mycobacterium avium subsp. paratuberculosis
ggcagguggucggcga

SEQ ID NO: 882764 - RNA, 15 nt, Mycobacterium avium subsp. paratuberculosis
ggcaggugagccggg

SEQ ID NO: 882765 - RNA, 18 nt, Mycobacterium avium subsp. paratuberculosis
ggcagguucauccccgcg

SEQ ID NO: 882766 - RNA, 20 nt, Mycobacterium avium subsp. paratuberculosis
ggcaguuccaugucgacgac

SEQ ID NO: 882767 - RNA, 14 nt, Mycobacterium avium subsp. paratuberculosis
ggcaggcacggugu

SEQ ID NO: 882768 - RNA, 16 nt, Mycobacterium avium subsp. paratuberculosis
ggcaggcacggugucg

SEQ ID NO: 882769 - RNA, 19 nt, Mycobacterium avium subsp. paratuberculosis
ggcaggaauuccagcgaca

SEQ ID NO: 882770 - RNA, 15 nt, Mycobacterium avium subsp. paratuberculosis
ggcaggaugccgcgu

SEQ ID NO: 882771 - RNA, 16 nt, Mycobacterium avium subsp. paratuberculosis
ggcaggauggucagcg

SEQ ID NO: 882772 - RNA, 20 nt, Mycobacterium avium subsp. paratuberculosis
ggcaggccaucagcccggcg

SEQ ID NO: 882773 - RNA, 16 nt, Mycobacterium avium subsp. paratuberculosis
ggcaggucggugcgcg

SEQ ID NO: 882774 - RNA, 21 nt, Mycobacterium avium subsp. paratuberculosis
ggcaggucggugcgcggggug

SEQ ID NO: 882775 - RNA, 13 nt, Mycobacterium avium subsp. paratuberculosis
ggcaggucgucga

SEQ ID NO: 882776 - RNA, 15 nt, Mycobacterium avium subsp. paratuberculosis
ggcaggucgucgacg

SEQ ID NO: 882777 - RNA, 16 nt, Mycobacterium avium subsp. paratuberculosis
ggcaggucgucgacgu

SEQ ID NO: 882778 - RNA, 13 nt, Mycobacterium avium subsp. paratuberculosis
ggcaggucggugc

SEQ ID NO: 882779 - RNA, 15 nt, Mycobacterium avium subsp. paratuberculosis
ggcaggucgaggccg

SEQ ID NO: 882780 - RNA, 17 nt, Mycobacterium avium subsp. paratuberculosis
ggcaggucgaggccggc

SEQ ID NO: 882781 - RNA, 15 nt, Mycobacterium avium subsp. paratuberculosis
ggcaggucggccagc

SEQ ID NO: 882782 - RNA, 19 nt, Mycobacterium avium subsp. paratuberculosis
ggcaggucggccagcgccg

SEQ ID NO: 882783 - RNA, 20 nt, Mycobacterium avium subsp. paratuberculosis
ggcaggucggccagcgccgc

SEQ ID NO: 882784 - RNA, 12 nt, Mycobacterium avium subsp. paratuberculosis
ggcaggucgcgc

SEQ ID NO: 882785 - RNA, 15 nt, Mycobacterium avium subsp. paratuberculosis
ggcaggucgcgccgg

SEQ ID NO: 882786 - RNA, 14 nt, Mycobacterium avium subsp. paratuberculosis
ggcaggcccgagcc

SEQ ID NO: 882787 - RNA, 20 nt, Mycobacterium avium subsp. paratuberculosis
ggcaggcccgagcccgacgg

SEQ ID NO: 882788 - RNA, 17 nt, Mycobacterium avium subsp. paratuberculosis
ggcagcgacagcgcguc

SEQ ID NO: 882789 - RNA, 22 nt, Mycobacterium avium subsp. paratuberculosis
ggcagcgacagcgcgucggcca

SEQ ID NO: 882790 - RNA, 18 nt, Mycobacterium avium subsp. paratuberculosis
ggcagcgaacugccggca

SEQ ID NO: 882791 - RNA, 20 nt, Mycobacterium avium subsp. paratuberculosis
ggcagcgaauacaccgucca

SEQ ID NO: 882792 - RNA, 17 nt, Mycobacterium avium subsp. paratuberculosis
ggcagcgagcacagcgg

SEQ ID NO: 882793 - RNA, 20 nt, Mycobacterium avium subsp. paratuberculosis
ggcagcgagcacagcggcgg

SEQ ID NO: 882794 - RNA, 18 nt, Mycobacterium avium subsp. paratuberculosis
ggcagccguuguccacga

SEQ ID NO: 882795 - RNA, 23 nt, Mycobacterium avium subsp. paratuberculosis
ggcagccguuguccacgaucaau

SEQ ID NO: 882796 - RNA, 14 nt, Mycobacterium avium subsp. paratuberculosis
ggcagccggggugc

SEQ ID NO: 882797 - RNA, 18 nt, Mycobacterium avium subsp. paratuberculosis
ggcagccggggugcccgg

SEQ ID NO: 882798 - RNA, 21 nt, Mycobacterium avium subsp. paratuberculosis
ggcagccgucccuguucgcgc

SEQ ID NO: 882799 - RNA, 20 nt, Mycobacterium avium subsp. paratuberculosis
ggcagccgcuccggcccgag

SEQ ID NO: 882800 - RNA, 13 nt, Mycobacterium avium subsp. paratuberculosis
ggcagccggccac

SEQ ID NO: 882801 - RNA, 19 nt, Mycobacterium avium subsp. paratuberculosis
ggcagccgucgaugccggc

SEQ ID NO: 882802 - RNA, 18 nt, Mycobacterium avium subsp. paratuberculosis
ggcagcgccucccggacc

SEQ ID NO: 882803 - RNA, 13 nt, Mycobacterium avium subsp. paratuberculosis
ggcagcgccucgg

SEQ ID NO: 882804 - RNA, 15 nt, Mycobacterium avium subsp. paratuberculosis
ggcagcgccucggcg

SEQ ID NO: 882805 - RNA, 20 nt, Mycobacterium avium subsp. paratuberculosis
ggcagcgccucggcgggccg

SEQ ID NO: 882806 - RNA, 23 nt, Mycobacterium avium subsp. paratuberculosis
ggcagcgccucggcgggccgccc

SEQ ID NO: 882807 - RNA, 15 nt, Mycobacterium avium subsp. paratuberculosis
ggcagcgaggcgcgc

SEQ ID NO: 882808 - RNA, 16 nt, Mycobacterium avium subsp. paratuberculosis
ggcagcgagucgaagg

SEQ ID NO: 882809 - RNA, 18 nt, Mycobacterium avium subsp. paratuberculosis
ggcagcgacgcggugagc

SEQ ID NO: 882810 - RNA, 20 nt, Mycobacterium avium subsp. paratuberculosis
ggcagcgccaacauggcgca

SEQ ID NO: 882811 - RNA, 13 nt, Mycobacterium avium subsp. paratuberculosis
ggcagcgccacca

SEQ ID NO: 882812 - RNA, 20 nt, Mycobacterium avium subsp. paratuberculosis
ggcaggacgggggccggugc

SEQ ID NO: 882813 - RNA, 19 nt, Mycobacterium avium subsp. paratuberculosis
ggcaggaaccgggucagca

SEQ ID NO: 882814 - RNA, 22 nt, Mycobacterium avium subsp. paratuberculosis
ggcaggaaccgggucagcacca

SEQ ID NO: 882815 - RNA, 19 nt, Mycobacterium avium subsp. paratuberculosis
ggcagcuuccgccucggcg

SEQ ID NO: 882816 - RNA, 21 nt, Mycobacterium avium subsp. paratuberculosis
ggcagcugcugggacgggucg

SEQ ID NO: 882817 - RNA, 18 nt, Mycobacterium avium subsp. paratuberculosis
ggcagcugcccgucggag

SEQ ID NO: 882818 - RNA, 15 nt, Mycobacterium avium subsp. paratuberculosis
ggcagcugaagugca

SEQ ID NO: 882819 - RNA, 22 nt, Mycobacterium avium subsp. paratuberculosis
ggcagcugaagugcacucggcg

SEQ ID NO: 882820 - RNA, 23 nt, Mycobacterium avium subsp. paratuberculosis
ggcagcugaagugcacucggcga

SEQ ID NO: 882821 - RNA, 24 nt, Mycobacterium avium subsp. paratuberculosis
ggcagcugaagugcacucggcgau

SEQ ID NO: 882822 - RNA, 15 nt, Mycobacterium avium subsp. paratuberculosis
ggcagcucgguggcc

SEQ ID NO: 882823 - RNA, 17 nt, Mycobacterium avium subsp. paratuberculosis
ggcagcucgguggccgg

SEQ ID NO: 882824 - RNA, 15 nt, Mycobacterium avium subsp. paratuberculosis
ggcagcucgucgacg

SEQ ID NO: 882825 - RNA, 17 nt, Mycobacterium avium subsp. paratuberculosis
ggcagcucgucgacguc

SEQ ID NO: 882826 - RNA, 19 nt, Mycobacterium avium subsp. paratuberculosis
ggcagcucgucggcgcgcc

SEQ ID NO: 882827 - RNA, 22 nt, Mycobacterium avium subsp. paratuberculosis
ggcagcucgucggcgcgccacc

SEQ ID NO: 882828 - RNA, 15 nt, Mycobacterium avium subsp. paratuberculosis
ggcagcucgggcagc

SEQ ID NO: 882829 - RNA, 19 nt, Mycobacterium avium subsp. paratuberculosis
ggcagcucgggcagcccgc

SEQ ID NO: 882830 - RNA, 21 nt, Mycobacterium avium subsp. paratuberculosis
ggcagcucgggcagcccgccg

SEQ ID NO: 882831 - RNA, 15 nt, Mycobacterium avium subsp. paratuberculosis
ggcagcgcgaccagc

SEQ ID NO: 882832 - RNA, 16 nt, Mycobacterium avium subsp. paratuberculosis
ggcagcgcgaccagcc

SEQ ID NO: 882833 - RNA, 16 nt, Mycobacterium avium subsp. paratuberculosis
ggcagcgugucccggu

SEQ ID NO: 882834 - RNA, 20 nt, Mycobacterium avium subsp. paratuberculosis
ggcagcagcagaucggcguc

SEQ ID NO: 882835 - RNA, 21 nt, Mycobacterium avium subsp. paratuberculosis
ggcagcagcagaucggcguca

SEQ ID NO: 882836 - RNA, 13 nt, Mycobacterium avium subsp. paratuberculosis
ggcagcagcacca

SEQ ID NO: 882837 - RNA, 15 nt, Mycobacterium avium subsp. paratuberculosis
ggcagcagcaccagc

SEQ ID NO: 882838 - RNA, 16 nt, Mycobacterium avium subsp. paratuberculosis
ggcagcagcaccagcg

SEQ ID NO: 882839 - RNA, 15 nt, Mycobacterium avium subsp. paratuberculosis
ggcagcagcaccccg

SEQ ID NO: 882840 - RNA, 13 nt, Mycobacterium avium subsp. paratuberculosis
ggcagcagcgccc

SEQ ID NO: 882841 - RNA, 14 nt, Mycobacterium avium subsp. paratuberculosis
ggcagcagcgccca

SEQ ID NO: 882842 - RNA, 13 nt, Mycobacterium avium subsp. paratuberculosis
ggcagcagcucca

SEQ ID NO: 882843 - RNA, 19 nt, Mycobacterium avium subsp. paratuberculosis
ggcagcagcuccaucgacg

SEQ ID NO: 882844 - RNA, 22 nt, Mycobacterium avium subsp. paratuberculosis
ggcagcagcugcgucggcacca

SEQ ID NO: 882845 - RNA, 14 nt, Mycobacterium avium subsp. paratuberculosis
ggcagcagcaucgg

SEQ ID NO: 882846 - RNA, 23 nt, Mycobacterium avium subsp. paratuberculosis
ggcagcagcccgucccggcccau

SEQ ID NO: 882847 - RNA, 22 nt, Mycobacterium avium subsp. paratuberculosis
ggcagcagccggaaggccaagg

SEQ ID NO: 882848 - RNA, 16 nt, Mycobacterium avium subsp. paratuberculosis
ggcagcauccgccgac

SEQ ID NO: 882849 - RNA, 17 nt, Mycobacterium avium subsp. paratuberculosis
ggcagcauccgccgacg

SEQ ID NO: 882850 - RNA, 16 nt, Mycobacterium avium subsp. paratuberculosis
ggcagcaggugcacca

SEQ ID NO: 882851 - RNA, 19 nt, Mycobacterium avium subsp. paratuberculosis
ggcagcaggugcaccaccc

SEQ ID NO: 882852 - RNA, 22 nt, Mycobacterium avium subsp. paratuberculosis
ggcagcaggugcaccacccagg

SEQ ID NO: 882853 - RNA, 23 nt, Mycobacterium avium subsp. paratuberculosis
ggcagcaggugcaucgaccggcg

SEQ ID NO: 882854 - RNA, 24 nt, Mycobacterium avium subsp. paratuberculosis
ggcagcaggugcaucgaccggcgg

SEQ ID NO: 882855 - RNA, 16 nt, Mycobacterium avium subsp. paratuberculosis
ggcagcagggugccgc

SEQ ID NO: 882856 - RNA, 18 nt, Mycobacterium avium subsp. paratuberculosis
ggcagcagcuuggcgaag

SEQ ID NO: 882857 - RNA, 20 nt, Mycobacterium avium subsp. paratuberculosis
ggcagcauucgccggggucg

SEQ ID NO: 882858 - RNA, 19 nt, Mycobacterium avium subsp. paratuberculosis
ggcagccaaccgccgggga

SEQ ID NO: 882859 - RNA, 14 nt, Mycobacterium avium subsp. paratuberculosis
ggcagccagcccgc

SEQ ID NO: 882860 - RNA, 15 nt, Mycobacterium avium subsp. paratuberculosis
ggcagccagcccgcg

SEQ ID NO: 882861 - RNA, 12 nt, Mycobacterium avium subsp. paratuberculosis
ggcagccagccu

SEQ ID NO: 882862 - RNA, 17 nt, Mycobacterium avium subsp. paratuberculosis
ggcagccagccuggcgg

SEQ ID NO: 882863 - RNA, 13 nt, Mycobacterium avium subsp. paratuberculosis
ggcagccaggcgu

SEQ ID NO: 882864 - RNA, 16 nt, Mycobacterium avium subsp. paratuberculosis
ggcagccacgcgcaac

SEQ ID NO: 882865 - RNA, 14 nt, Mycobacterium avium subsp. paratuberculosis
ggcagccacggcag

SEQ ID NO: 882866 - RNA, 15 nt, Mycobacterium avium subsp. paratuberculosis
ggcagccacggcagc

SEQ ID NO: 882867 - RNA, 12 nt, Mycobacterium avium subsp. paratuberculosis
ggcagcccgaac

SEQ ID NO: 882868 - RNA, 16 nt, Mycobacterium avium subsp. paratuberculosis
ggcagcccgaacagcc

SEQ ID NO: 882869 - RNA, 18 nt, Mycobacterium avium subsp. paratuberculosis
ggcagcccgaacagccgg

SEQ ID NO: 882870 - RNA, 15 nt, Mycobacterium avium subsp. paratuberculosis
ggcagcccgacgucc

SEQ ID NO: 882871 - RNA, 13 nt, Mycobacterium avium subsp. paratuberculosis
ggcagcccgagca

SEQ ID NO: 882872 - RNA, 18 nt, Mycobacterium avium subsp. paratuberculosis
ggcagcccgccgaccacc

SEQ ID NO: 882873 - RNA, 15 nt, Mycobacterium avium subsp. paratuberculosis
ggcagcccgccgcgg

SEQ ID NO: 882874 - RNA, 13 nt, Mycobacterium avium subsp. paratuberculosis
ggcagccggccgg

SEQ ID NO: 882875 - RNA, 14 nt, Mycobacterium avium subsp. paratuberculosis
ggcagccggccggc

SEQ ID NO: 882876 - RNA, 13 nt, Mycobacterium avium subsp. paratuberculosis
ggcagccggcgcc

SEQ ID NO: 882877 - RNA, 14 nt, Mycobacterium avium subsp. paratuberculosis
ggcagccggcgccc

SEQ ID NO: 882878 - RNA, 17 nt, Mycobacterium avium subsp. paratuberculosis
ggcagccggcgcgguga

SEQ ID NO: 882879 - RNA, 22 nt, Mycobacterium avium subsp. paratuberculosis
ggcagccggcugagcagccagu

SEQ ID NO: 882880 - RNA, 20 nt, Mycobacterium avium subsp. paratuberculosis
ggcagccgcgcccacccgcg

SEQ ID NO: 882881 - RNA, 23 nt, Mycobacterium avium subsp. paratuberculosis
ggcagccgcgcccacccgcgcac

SEQ ID NO: 882882 - RNA, 18 nt, Mycobacterium avium subsp. paratuberculosis
ggcagccgcacaccgcgg

SEQ ID NO: 882883 - RNA, 21 nt, Mycobacterium avium subsp. paratuberculosis
ggcagccgcacaccgcggcgg

SEQ ID NO: 882884 - RNA, 15 nt, Mycobacterium avium subsp. paratuberculosis
ggcagccgcgcgugc

SEQ ID NO: 882885 - RNA, 21 nt, Mycobacterium avium subsp. paratuberculosis
ggcagccgcgcgugcagccgg

SEQ ID NO: 882886 - RNA, 13 nt, Mycobacterium avium subsp. paratuberculosis
ggcagccccagcg

SEQ ID NO: 882887 - RNA, 22 nt, Mycobacterium avium subsp. paratuberculosis
ggcagccccagcgagcagguca

SEQ ID NO: 882888 - RNA, 14 nt, Mycobacterium avium subsp. paratuberculosis
ggcagcccggcugc

SEQ ID NO: 882889 - RNA, 17 nt, Mycobacterium avium subsp. paratuberculosis
ggcagcccggcugcgca

SEQ ID NO: 882890 - RNA, 12 nt, Mycobacterium avium subsp. paratuberculosis
ggcagccccagc

SEQ ID NO: 882891 - RNA, 14 nt, Mycobacterium avium subsp. paratuberculosis
ggcagccgcagcga

SEQ ID NO: 882892 - RNA, 16 nt, Mycobacterium avium subsp. paratuberculosis
ggcagccgcagcgaca

SEQ ID NO: 882893 - RNA, 18 nt, Mycobacterium avium subsp. paratuberculosis
ggcagauaggcggcgacg

SEQ ID NO: 882894 - RNA, 22 nt, Mycobacterium avium subsp. paratuberculosis
ggcagauaggcggcgacggcgu

SEQ ID NO: 882895 - RNA, 14 nt, Mycobacterium avium subsp. paratuberculosis
ggcagauggucgcc

SEQ ID NO: 882896 - RNA, 22 nt, Mycobacterium avium subsp. paratuberculosis
ggcagauggucgccgacggugg

SEQ ID NO: 882897 - RNA, 15 nt, Mycobacterium avium subsp. paratuberculosis
ggcagaucgucggca

SEQ ID NO: 882898 - RNA, 16 nt, Mycobacterium avium subsp. paratuberculosis
ggcagaucgucggcac

SEQ ID NO: 882899 - RNA, 19 nt, Mycobacterium avium subsp. paratuberculosis
ggcagaucgcggcccgccg

SEQ ID NO: 882900 - RNA, 16 nt, Mycobacterium avium subsp. paratuberculosis
ggcagaugcccgcuga

SEQ ID NO: 882901 - RNA, 18 nt, Mycobacterium avium subsp. paratuberculosis
ggcagaugcccgcugaca

SEQ ID NO: 882902 - RNA, 23 nt, Mycobacterium avium subsp. paratuberculosis
ggcagauggugaaguugccgguc

SEQ ID NO: 882903 - RNA, 14 nt, Mycobacterium avium subsp. paratuberculosis
ggcagcaaccggcg

SEQ ID NO: 882904 - RNA, 16 nt, Mycobacterium avium subsp. paratuberculosis
ggcagcaaccggcggc

SEQ ID NO: 882905 - RNA, 22 nt, Mycobacterium avium subsp. paratuberculosis
ggcagcaaccggcggcugggca

SEQ ID NO: 882906 - RNA, 17 nt, Mycobacterium avium subsp. paratuberculosis
ggcagcaaccgggucac

SEQ ID NO: 882907 - RNA, 11 nt, Mycobacterium avium subsp. paratuberculosis
ggcagcacccg

SEQ ID NO: 882908 - RNA, 12 nt, Mycobacterium avium subsp. paratuberculosis
ggcagcacccgc

SEQ ID NO: 882909 - RNA, 22 nt, Mycobacterium avium subsp. paratuberculosis
ggcagcacaccuuccaccaccg

SEQ ID NO: 882910 - RNA, 14 nt, Mycobacterium avium subsp. paratuberculosis
ggcagcaccagcgg

SEQ ID NO: 882911 - RNA, 17 nt, Mycobacterium avium subsp. paratuberculosis
ggcagcaccagcggcac

SEQ ID NO: 882912 - RNA, 18 nt, Mycobacterium avium subsp. paratuberculosis
ggcagcaccucgcgcagc

SEQ ID NO: 882913 - RNA, 16 nt, Mycobacterium avium subsp. paratuberculosis
ggcagcaccucgcgcg

SEQ ID NO: 882914 - RNA, 22 nt, Mycobacterium avium subsp. paratuberculosis
ggcagcaccucgcgcgcgagcc

SEQ ID NO: 882915 - RNA, 16 nt, Mycobacterium avium subsp. paratuberculosis
ggcagcaccgccgagc

SEQ ID NO: 882916 - RNA, 17 nt, Mycobacterium avium subsp. paratuberculosis
ggcagcaccgccgagcc

SEQ ID NO: 882917 - RNA, 21 nt, Mycobacterium avium subsp. paratuberculosis
ggaugucguccucggucaggc

SEQ ID NO: 882918 - RNA, 16 nt, Mycobacterium avium subsp. paratuberculosis
ggaugucuagccgccg

SEQ ID NO: 882919 - RNA, 18 nt, Mycobacterium avium subsp. paratuberculosis
ggaugucuccgcgcagcc

SEQ ID NO: 882920 - RNA, 19 nt, Mycobacterium avium subsp. paratuberculosis
ggauguggcaucaccgccu

SEQ ID NO: 882921 - RNA, 13 nt, Mycobacterium avium subsp. paratuberculosis
ggauguggucggc

SEQ ID NO: 882922 - RNA, 21 nt, Mycobacterium avium subsp. paratuberculosis
ggaugugguugcuggcgucgu

SEQ ID NO: 882923 - RNA, 16 nt, Mycobacterium avium subsp. paratuberculosis
ggaugucgggcgaggu

SEQ ID NO: 882924 - RNA, 17 nt, Mycobacterium avium subsp. paratuberculosis
ggaugucgacgacaccc

SEQ ID NO: 882925 - RNA, 16 nt, Mycobacterium avium subsp. paratuberculosis
ggauguccuacggcgg

SEQ ID NO: 882926 - RNA, 18 nt, Mycobacterium avium subsp. paratuberculosis
ggauguccaggccgucga

SEQ ID NO: 882927 - RNA, 22 nt, Mycobacterium avium subsp. paratuberculosis
ggauguccaggccgucgaggcg

SEQ ID NO: 882928 - RNA, 14 nt, Mycobacterium avium subsp. paratuberculosis
ggauguacccgcag

SEQ ID NO: 882929 - RNA, 17 nt, Mycobacterium avium subsp. paratuberculosis
ggauguagccgccggug

SEQ ID NO: 882930 - RNA, 21 nt, Mycobacterium avium subsp. paratuberculosis
ggaugggcgcacgaucgggcg

SEQ ID NO: 882931 - RNA, 20 nt, Mycobacterium avium subsp. paratuberculosis
ggauggggucgcgggcgccg

SEQ ID NO: 882932 - RNA, 18 nt, Mycobacterium avium subsp. paratuberculosis
ggaugguccccgggccca

SEQ ID NO: 882933 - RNA, 20 nt, Mycobacterium avium subsp. paratuberculosis
ggauggugagcccgaugcug

SEQ ID NO: 882934 - RNA, 20 nt, Mycobacterium avium subsp. paratuberculosis
ggauggugcccaccgggcag

SEQ ID NO: 882935 - RNA, 23 nt, Mycobacterium avium subsp. paratuberculosis
ggauggugcccaccgggcagccg

SEQ ID NO: 882936 - RNA, 14 nt, Mycobacterium avium subsp. paratuberculosis
ggcccaccaccgcc

SEQ ID NO: 882937 - RNA, 23 nt, Mycobacterium avium subsp. paratuberculosis
ggcccaccaccgccucgacggug

SEQ ID NO: 882938 - RNA, 12 nt, Mycobacterium avium subsp. paratuberculosis
ggcccacacgcg

SEQ ID NO: 882939 - RNA, 15 nt, Mycobacterium avium subsp. paratuberculosis
ggcccacagcagccg

SEQ ID NO: 882940 - RNA, 17 nt, Mycobacterium avium subsp. paratuberculosis
ggcccacagcagccgca

SEQ ID NO: 882941 - RNA, 22 nt, Mycobacterium avium subsp. paratuberculosis
ggccauguacggauugcggacg

SEQ ID NO: 882942 - RNA, 22 nt, Mycobacterium avium subsp. paratuberculosis
ggccauucaucgcgcaccaggg

SEQ ID NO: 882943 - RNA, 20 nt, Mycobacterium avium subsp. paratuberculosis
ggccauguccccgaccauca

SEQ ID NO: 882944 - RNA, 22 nt, Mycobacterium avium subsp. paratuberculosis
ggccaugucggagcugcgcgcc

SEQ ID NO: 882945 - RNA, 18 nt, Mycobacterium avium subsp. paratuberculosis
ggccauggugccgccguu

SEQ ID NO: 882946 - RNA, 13 nt, Mycobacterium avium subsp. paratuberculosis
ggcccagcaccac

SEQ ID NO: 882947 - RNA, 14 nt, Mycobacterium avium subsp. paratuberculosis
ggcccagcaccacc

SEQ ID NO: 882948 - RNA, 15 nt, Mycobacterium avium subsp. paratuberculosis
ggcccacgacgucug

SEQ ID NO: 882949 - RNA, 16 nt, Mycobacterium avium subsp. paratuberculosis
ggcccagaucgcgguc

SEQ ID NO: 882950 - RNA, 19 nt, Mycobacterium avium subsp. paratuberculosis
ggcccacugccugacccgg

SEQ ID NO: 882951 - RNA, 20 nt, Mycobacterium avium subsp. paratuberculosis
ggcccagacaggccggccgc

SEQ ID NO: 882952 - RNA, 21 nt, Mycobacterium avium subsp. paratuberculosis
ggcccagacaggccggccgcu

SEQ ID NO: 882953 - RNA, 13 nt, Mycobacterium avium subsp. paratuberculosis
ggcccagacgaug

SEQ ID NO: 882954 - RNA, 19 nt, Mycobacterium avium subsp. paratuberculosis
ggcccagacgaugucgucg

SEQ ID NO: 882955 - RNA, 18 nt, Mycobacterium avium subsp. paratuberculosis
ggcccacgggaugcggca

SEQ ID NO: 882956 - RNA, 14 nt, Mycobacterium avium subsp. paratuberculosis
ggcccacggugagg

SEQ ID NO: 882957 - RNA, 14 nt, Mycobacterium avium subsp. paratuberculosis
ggcccacggugauu

SEQ ID NO: 882958 - RNA, 17 nt, Mycobacterium avium subsp. paratuberculosis
ggcccacgcucgacgcg

SEQ ID NO: 882959 - RNA, 12 nt, Mycobacterium avium subsp. paratuberculosis
ggcccacgccgu

SEQ ID NO: 882960 - RNA, 21 nt, Mycobacterium avium subsp. paratuberculosis
ggcccacgccgucgucguugu

SEQ ID NO: 882961 - RNA, 15 nt, Mycobacterium avium subsp. paratuberculosis
ggcccaccggcccgg

SEQ ID NO: 882962 - RNA, 14 nt, Mycobacterium avium subsp. paratuberculosis
ggcccaccgccacc

SEQ ID NO: 882963 - RNA, 23 nt, Mycobacterium avium subsp. paratuberculosis
ggcccaccgcgacccggccgagc

SEQ ID NO: 882964 - RNA, 15 nt, Mycobacterium avium subsp. paratuberculosis
ggcccaccgcgcgcu

SEQ ID NO: 882965 - RNA, 16 nt, Mycobacterium avium subsp. paratuberculosis
ggcccaccgcgcgcug

SEQ ID NO: 882966 - RNA, 22 nt, Mycobacterium avium subsp. paratuberculosis
ggcccaccagcugggaggcgca

SEQ ID NO: 882967 - RNA, 22 nt, Mycobacterium avium subsp. paratuberculosis
ggcccaccgaaucacccacggc

SEQ ID NO: 882968 - RNA, 13 nt, Mycobacterium avium subsp. paratuberculosis
ggcccaccccgga

SEQ ID NO: 882969 - RNA, 17 nt, Mycobacterium avium subsp. paratuberculosis
ggcccacccggaugucg

SEQ ID NO: 882970 - RNA, 19 nt, Mycobacterium avium subsp. paratuberculosis
ggcccacccggaugucgug

SEQ ID NO: 882971 - RNA, 22 nt, Mycobacterium avium subsp. paratuberculosis
ggcccacccggaugucgugcgg

SEQ ID NO: 882972 - RNA, 23 nt, Mycobacterium avium subsp. paratuberculosis
ggcccacccggaugucgugcggu

SEQ ID NO: 882973 - RNA, 18 nt, Mycobacterium avium subsp. paratuberculosis
ggccauccccgcguuggc

SEQ ID NO: 882974 - RNA, 14 nt, Mycobacterium avium subsp. paratuberculosis
ggccaucccgggga

SEQ ID NO: 882975 - RNA, 19 nt, Mycobacterium avium subsp. paratuberculosis
ggccauccggccggcgagg

SEQ ID NO: 882976 - RNA, 19 nt, Mycobacterium avium subsp. paratuberculosis
ggccauccgggcggcaucg

SEQ ID NO: 882977 - RNA, 15 nt, Mycobacterium avium subsp. paratuberculosis
ggccaucgccgcggu

SEQ ID NO: 882978 - RNA, 20 nt, Mycobacterium avium subsp. paratuberculosis
ggccaucgccgcgguggcgc

SEQ ID NO: 882979 - RNA, 21 nt, Mycobacterium avium subsp. paratuberculosis
ggccaucgccgcgguggcgcc

SEQ ID NO: 882980 - RNA, 21 nt, Mycobacterium avium subsp. paratuberculosis
ggccaucgacuccaccaccug

SEQ ID NO: 882981 - RNA, 20 nt, Mycobacterium avium subsp. paratuberculosis
ggccaucgacuccagcaccg

SEQ ID NO: 882982 - RNA, 22 nt, Mycobacterium avium subsp. paratuberculosis
ggccaucgacuccagcaccggc

SEQ ID NO: 882983 - RNA, 14 nt, Mycobacterium avium subsp. paratuberculosis
ggccaucgccagga

SEQ ID NO: 882984 - RNA, 14 nt, Mycobacterium avium subsp. paratuberculosis
ggccaucuggccgc

SEQ ID NO: 882985 - RNA, 15 nt, Mycobacterium avium subsp. paratuberculosis
ggccaucuggccgcg

SEQ ID NO: 882986 - RNA, 23 nt, Mycobacterium avium subsp. paratuberculosis
ggccauauaggggugggcgaacg

SEQ ID NO: 882987 - RNA, 22 nt, Mycobacterium avium subsp. paratuberculosis
ggccaucuccugcacgcgcggg

SEQ ID NO: 882988 - RNA, 15 nt, Mycobacterium avium subsp. paratuberculosis
ggccaucgccgagcc

SEQ ID NO: 882989 - RNA, 20 nt, Mycobacterium avium subsp. paratuberculosis
ggccaucgccugagcaaccg

SEQ ID NO: 882990 - RNA, 13 nt, Mycobacterium avium subsp. paratuberculosis
ggccaucgcggcc

SEQ ID NO: 882991 - RNA, 14 nt, Mycobacterium avium subsp. paratuberculosis
ggccaucgcggccc

SEQ ID NO: 882992 - RNA, 20 nt, Mycobacterium avium subsp. paratuberculosis
ggccaucgcggcccccacgc

SEQ ID NO: 882993 - RNA, 14 nt, Mycobacterium avium subsp. paratuberculosis
ggccaucggcagac

SEQ ID NO: 882994 - RNA, 21 nt, Mycobacterium avium subsp. paratuberculosis
ggccaucggcagacccagcag

SEQ ID NO: 882995 - RNA, 20 nt, Mycobacterium avium subsp. paratuberculosis
ggccaugagcuaggucaccg

SEQ ID NO: 882996 - RNA, 16 nt, Mycobacterium avium subsp. paratuberculosis
ggccaugcagaccagc

SEQ ID NO: 882997 - RNA, 22 nt, Mycobacterium avium subsp. paratuberculosis
ggccaugcagaccagcccgucg

SEQ ID NO: 882998 - RNA, 17 nt, Mycobacterium avium subsp. paratuberculosis
ggccaugaagccguugc

SEQ ID NO: 882999 - RNA, 22 nt, Mycobacterium avium subsp. paratuberculosis
ggccaugaagccguugccgccg

SEQ ID NO: 883000 - RNA, 23 nt, Mycobacterium avium subsp. paratuberculosis
ggccaugaauucgaacugggugg

SEQ ID NO: 883001 - RNA, 19 nt, Mycobacterium avium subsp. paratuberculosis
ggccaugaccaugucgacg

SEQ ID NO: 883002 - RNA, 20 nt, Mycobacterium avium subsp. paratuberculosis
ggccaugaccaugucgacgc

SEQ ID NO: 883003 - RNA, 21 nt, Mycobacterium avium subsp. paratuberculosis
ggccaugaccaugucgacgcu

SEQ ID NO: 883004 - RNA, 20 nt, Mycobacterium avium subsp. paratuberculosis
ggccaugggguugaccuuga

SEQ ID NO: 883005 - RNA, 15 nt, Mycobacterium avium subsp. paratuberculosis
ggccauggcgcaccg

SEQ ID NO: 883006 - RNA, 16 nt, Mycobacterium avium subsp. paratuberculosis
ggccaugcgcgagucg

SEQ ID NO: 883007 - RNA, 23 nt, Mycobacterium avium subsp. paratuberculosis
ggccaugcgcgagucgagcaccg

SEQ ID NO: 883008 - RNA, 14 nt, Mycobacterium avium subsp. paratuberculosis
ggccaugccggccu

SEQ ID NO: 883009 - RNA, 16 nt, Mycobacterium avium subsp. paratuberculosis
ggccaugccggccuga

SEQ ID NO: 883010 - RNA, 19 nt, Mycobacterium avium subsp. paratuberculosis
ggccaugccucuucggcgc

SEQ ID NO: 883011 - RNA, 20 nt, Mycobacterium avium subsp. paratuberculosis
ggccaugccucuucggcgcg

SEQ ID NO: 883012 - RNA, 21 nt, Mycobacterium avium subsp. paratuberculosis
ggccaugccucuucggcgcgc

SEQ ID NO: 883013 - RNA, 22 nt, Mycobacterium avium subsp. paratuberculosis
ggccaugccucuucggcgcgcc

SEQ ID NO: 883014 - RNA, 23 nt, Mycobacterium avium subsp. paratuberculosis
ggccaugccucuucggcgcgccg

SEQ ID NO: 883015 - RNA, 16 nt, Mycobacterium avium subsp. paratuberculosis
ggccauaaagccgucg

SEQ ID NO: 883016 - RNA, 18 nt, Mycobacterium avium subsp. paratuberculosis
ggccaucacggugccgag

SEQ ID NO: 883017 - RNA, 16 nt, Mycobacterium avium subsp. paratuberculosis
ggccaucagcaccgaa

SEQ ID NO: 883018 - RNA, 16 nt, Mycobacterium avium subsp. paratuberculosis
ggccaucagcccggcg

SEQ ID NO: 883019 - RNA, 19 nt, Mycobacterium avium subsp. paratuberculosis
ggccaucagcccggcgucc

SEQ ID NO: 883020 - RNA, 22 nt, Mycobacterium avium subsp. paratuberculosis
ggccaucagccgccgucgcgcc

SEQ ID NO: 883021 - RNA, 15 nt, Mycobacterium avium subsp. paratuberculosis
ggccaguucaccgcg

SEQ ID NO: 883022 - RNA, 17 nt, Mycobacterium avium subsp. paratuberculosis
ggccaguucaccgcgcu

SEQ ID NO: 883023 - RNA, 18 nt, Mycobacterium avium subsp. paratuberculosis
ggccaguucgagcgccgc

SEQ ID NO: 883024 - RNA, 19 nt, Mycobacterium avium subsp. paratuberculosis
ggccaguucgagcgccgcg

SEQ ID NO: 883025 - RNA, 23 nt, Mycobacterium avium subsp. paratuberculosis
ggccaguucgagcgccgcggcca

SEQ ID NO: 883026 - RNA, 21 nt, Mycobacterium avium subsp. paratuberculosis
ggccaguugaaguccggcggu

SEQ ID NO: 883027 - RNA, 22 nt, Mycobacterium avium subsp. paratuberculosis
ggccaguugacguugaucgcgc

SEQ ID NO: 883028 - RNA, 15 nt, Mycobacterium avium subsp. paratuberculosis
ggccaguucgucgcg

SEQ ID NO: 883029 - RNA, 16 nt, Mycobacterium avium subsp. paratuberculosis
ggccaguucgucgcgc

SEQ ID NO: 883030 - RNA, 18 nt, Mycobacterium avium subsp. paratuberculosis
ggccaguucgucgcgcga

SEQ ID NO: 883031 - RNA, 19 nt, Mycobacterium avium subsp. paratuberculosis
ggccaguucgucgcgcgac

SEQ ID NO: 883032 - RNA, 15 nt, Mycobacterium avium subsp. paratuberculosis
ggccaguucgggucc

SEQ ID NO: 883033 - RNA, 15 nt, Mycobacterium avium subsp. paratuberculosis
ggccaguucccgggc

SEQ ID NO: 883034 - RNA, 16 nt, Mycobacterium avium subsp. paratuberculosis
ggccagucgccgcgca

SEQ ID NO: 883035 - RNA, 23 nt, Mycobacterium avium subsp. paratuberculosis
ggccagucguacucccaggccgc

SEQ ID NO: 883036 - RNA, 16 nt, Mycobacterium avium subsp. paratuberculosis
ggccaguccggcagca

SEQ ID NO: 883037 - RNA, 22 nt, Mycobacterium avium subsp. paratuberculosis
ggccagucgaaguucggcaucu

SEQ ID NO: 883038 - RNA, 13 nt, Mycobacterium avium subsp. paratuberculosis
ggccaguccagcg

SEQ ID NO: 883039 - RNA, 23 nt, Mycobacterium avium subsp. paratuberculosis
ggccaguccagcgaaucgaccgg

SEQ ID NO: 883040 - RNA, 16 nt, Mycobacterium avium subsp. paratuberculosis
ggccaguccaggccgc

SEQ ID NO: 883041 - RNA, 18 nt, Mycobacterium avium subsp. paratuberculosis
ggccaguccaggccgccg

SEQ ID NO: 883042 - RNA, 18 nt, Mycobacterium avium subsp. paratuberculosis
ggccagguuggucagcag

SEQ ID NO: 883043 - RNA, 15 nt, Mycobacterium avium subsp. paratuberculosis
ggccaggucggugac

SEQ ID NO: 883044 - RNA, 16 nt, Mycobacterium avium subsp. paratuberculosis
ggccagguugccacgc

SEQ ID NO: 883045 - RNA, 18 nt, Mycobacterium avium subsp. paratuberculosis
ggccagguugcgccgucc

SEQ ID NO: 883046 - RNA, 21 nt, Mycobacterium avium subsp. paratuberculosis
ggccagguugcgccguccggc

SEQ ID NO: 883047 - RNA, 23 nt, Mycobacterium avium subsp. paratuberculosis
ggccagguugcgccguccggcca

SEQ ID NO: 883048 - RNA, 19 nt, Mycobacterium avium subsp. paratuberculosis
ggccagguugaccaccagc

SEQ ID NO: 883049 - RNA, 21 nt, Mycobacterium avium subsp. paratuberculosis
ggccagguugaccaccagcgu

SEQ ID NO: 883050 - RNA, 22 nt, Mycobacterium avium subsp. paratuberculosis
ggccagguucaggcccgcgccg

SEQ ID NO: 883051 - RNA, 23 nt, Mycobacterium avium subsp. paratuberculosis
ggccagguucaggcccgcgccga

SEQ ID NO: 883052 - RNA, 14 nt, Mycobacterium avium subsp. paratuberculosis
ggccagguucgcgc

SEQ ID NO: 883053 - RNA, 15 nt, Mycobacterium avium subsp. paratuberculosis
ggccagguucgcgcc

SEQ ID NO: 883054 - RNA, 16 nt, Mycobacterium avium subsp. paratuberculosis
ggccaggugcacgccg

SEQ ID NO: 883055 - RNA, 17 nt, Mycobacterium avium subsp. paratuberculosis
ggccaggugcacgccga

SEQ ID NO: 883056 - RNA, 21 nt, Mycobacterium avium subsp. paratuberculosis
ggccaggugcacgccgagcag

SEQ ID NO: 883057 - RNA, 15 nt, Mycobacterium avium subsp. paratuberculosis
ggccagguggccgcu

SEQ ID NO: 883058 - RNA, 14 nt, Mycobacterium avium subsp. paratuberculosis
ggccaggucgcuga

SEQ ID NO: 883059 - RNA, 20 nt, Mycobacterium avium subsp. paratuberculosis
ggccaggucgcugacgauga

SEQ ID NO: 883060 - RNA, 15 nt, Mycobacterium avium subsp. paratuberculosis
ggccaggucgccgcg

SEQ ID NO: 883061 - RNA, 19 nt, Mycobacterium avium subsp. paratuberculosis
ggccaggucgccgcgcagc

SEQ ID NO: 883062 - RNA, 17 nt, Mycobacterium avium subsp. paratuberculosis
ggccagguagugguggg

SEQ ID NO: 883063 - RNA, 22 nt, Mycobacterium avium subsp. paratuberculosis
ggccagguaguggugggcgugc

SEQ ID NO: 883064 - RNA, 18 nt, Mycobacterium avium subsp. paratuberculosis
ggccagguccucgcuggc

SEQ ID NO: 883065 - RNA, 20 nt, Mycobacterium avium subsp. paratuberculosis
ggccagguccucgcuggcga

SEQ ID NO: 883066 - RNA, 17 nt, Mycobacterium avium subsp. paratuberculosis
ggccagguacaccacca

SEQ ID NO: 883067 - RNA, 14 nt, Mycobacterium avium subsp. paratuberculosis
ggccagggugccga

SEQ ID NO: 883068 - RNA, 22 nt, Mycobacterium avium subsp. paratuberculosis
ggccagggugucccagcgccac

SEQ ID NO: 883069 - RNA, 22 nt, Mycobacterium avium subsp. paratuberculosis
ggccagggcguggaacgcgucg

SEQ ID NO: 883070 - RNA, 14 nt, Mycobacterium avium subsp. paratuberculosis
ggccagggcggcgc

SEQ ID NO: 883071 - RNA, 16 nt, Mycobacterium avium subsp. paratuberculosis
ggccagggcggcgccg

SEQ ID NO: 883072 - RNA, 16 nt, Mycobacterium avium subsp. paratuberculosis
ggccagggcccgcagc

SEQ ID NO: 883073 - RNA, 17 nt, Mycobacterium avium subsp. paratuberculosis
ggccagggcccgcagcc

SEQ ID NO: 883074 - RNA, 18 nt, Mycobacterium avium subsp. paratuberculosis
ggccagggcccgcagccg

SEQ ID NO: 883075 - RNA, 17 nt, Mycobacterium avium subsp. paratuberculosis
ggccagcgccgccagcc

SEQ ID NO: 883076 - RNA, 13 nt, Mycobacterium avium subsp. paratuberculosis
ggccagcgccgcc

SEQ ID NO: 883077 - RNA, 16 nt, Mycobacterium avium subsp. paratuberculosis
ggccaggcuggcgucg

SEQ ID NO: 883078 - RNA, 15 nt, Mycobacterium avium subsp. paratuberculosis
ggccagcgccgcccg

SEQ ID NO: 883079 - RNA, 17 nt, Mycobacterium avium subsp. paratuberculosis
ggccagcgccgcccggg

SEQ ID NO: 883080 - RNA, 23 nt, Mycobacterium avium subsp. paratuberculosis
ggccagcgccgcccgggcggccc

SEQ ID NO: 883081 - RNA, 16 nt, Mycobacterium avium subsp. paratuberculosis
ggccagcgccgcgcgc

SEQ ID NO: 883082 - RNA, 12 nt, Mycobacterium avium subsp. paratuberculosis
ggccagcgccga

SEQ ID NO: 883083 - RNA, 21 nt, Mycobacterium avium subsp. paratuberculosis
ggccagcgccgagaucgcggu

SEQ ID NO: 883084 - RNA, 14 nt, Mycobacterium avium subsp. paratuberculosis
ggccagcgccgagc

SEQ ID NO: 883085 - RNA, 16 nt, Mycobacterium avium subsp. paratuberculosis
ggccagcgccgagccg

SEQ ID NO: 883086 - RNA, 11 nt, Mycobacterium avium subsp. paratuberculosis
ggccagcgccg

SEQ ID NO: 883087 - RNA, 14 nt, Mycobacterium avium subsp. paratuberculosis
ggccagcgcccgcg

SEQ ID NO: 883088 - RNA, 17 nt, Mycobacterium avium subsp. paratuberculosis
ggccagcgcccgcgcga

SEQ ID NO: 883089 - RNA, 22 nt, Mycobacterium avium subsp. paratuberculosis
ggccagcgcaucggucaccagc

SEQ ID NO: 883090 - RNA, 19 nt, Mycobacterium avium subsp. paratuberculosis
ggccagcgccaugccgccg

SEQ ID NO: 883091 - RNA, 22 nt, Mycobacterium avium subsp. paratuberculosis
ggccagcgccaugccgccgacc

SEQ ID NO: 883092 - RNA, 14 nt, Mycobacterium avium subsp. paratuberculosis
ggccagcgccagcg

SEQ ID NO: 883093 - RNA, 16 nt, Mycobacterium avium subsp. paratuberculosis
ggccagcgccagcgcc

SEQ ID NO: 883094 - RNA, 19 nt, Mycobacterium avium subsp. paratuberculosis
ggccagcgccagcgccagc

SEQ ID NO: 883095 - RNA, 21 nt, Mycobacterium avium subsp. paratuberculosis
ggccagcgccagcgccagcgu

SEQ ID NO: 883096 - RNA, 23 nt, Mycobacterium avium subsp. paratuberculosis
ggccagcgcagcgaccuggucca

SEQ ID NO: 883097 - RNA, 14 nt, Mycobacterium avium subsp. paratuberculosis
ggccagcgcaucgg

SEQ ID NO: 883098 - RNA, 19 nt, Mycobacterium avium subsp. paratuberculosis
ggccagcgagaagucgcuc

SEQ ID NO: 883099 - RNA, 22 nt, Mycobacterium avium subsp. paratuberculosis
ggccagcgagaagucgcucagc

SEQ ID NO: 883100 - RNA, 19 nt, Mycobacterium avium subsp. paratuberculosis
ggccagcgaguccagccag

SEQ ID NO: 883101 - RNA, 17 nt, Mycobacterium avium subsp. paratuberculosis
ggccagcgagucgauga

SEQ ID NO: 883102 - RNA, 18 nt, Mycobacterium avium subsp. paratuberculosis
ggccagcgagucgaugac

SEQ ID NO: 883103 - RNA, 18 nt, Mycobacterium avium subsp. paratuberculosis
ggccccguuggugcggug

SEQ ID NO: 883104 - RNA, 22 nt, Mycobacterium avium subsp. paratuberculosis
ggccccguuggugcggugcauc

SEQ ID NO: 883105 - RNA, 15 nt, Mycobacterium avium subsp. paratuberculosis
ggccccuccagccgc

SEQ ID NO: 883106 - RNA, 20 nt, Mycobacterium avium subsp. paratuberculosis
ggccccuccagccgccgguc

SEQ ID NO: 883107 - RNA, 23 nt, Mycobacterium avium subsp. paratuberculosis
ggcccccugaggagacgaucucg

SEQ ID NO: 883108 - RNA, 21 nt, Mycobacterium avium subsp. paratuberculosis
ggccccgggcgcuggcgaugg

SEQ ID NO: 883109 - RNA, 20 nt, Mycobacterium avium subsp. paratuberculosis
ggccccgguagccagcaccg

SEQ ID NO: 883110 - RNA, 23 nt, Mycobacterium avium subsp. paratuberculosis
ggccccgguagccagcaccgccc

SEQ ID NO: 883111 - RNA, 15 nt, Mycobacterium avium subsp. paratuberculosis
ggccccggccggcgg

SEQ ID NO: 883112 - RNA, 18 nt, Mycobacterium avium subsp. paratuberculosis
ggccccggccgggcgacu

SEQ ID NO: 883113 - RNA, 18 nt, Mycobacterium avium subsp. paratuberculosis
ggccccggcguuucgugc

SEQ ID NO: 883114 - RNA, 17 nt, Mycobacterium avium subsp. paratuberculosis
ggccccggcucgggcca

SEQ ID NO: 883115 - RNA, 19 nt, Mycobacterium avium subsp. paratuberculosis
ggcccccggcucgaucgcg

SEQ ID NO: 883116 - RNA, 22 nt, Mycobacterium avium subsp. paratuberculosis
ggcccccggcucgaucgcgguc

SEQ ID NO: 883117 - RNA, 19 nt, Mycobacterium avium subsp. paratuberculosis
ggccccgagcgucacgcca

SEQ ID NO: 883118 - RNA, 21 nt, Mycobacterium avium subsp. paratuberculosis
ggccccgagcgucacgccagc

SEQ ID NO: 883119 - RNA, 18 nt, Mycobacterium avium subsp. paratuberculosis
ggcccgaccagcgggccg

SEQ ID NO: 883120 - RNA, 21 nt, Mycobacterium avium subsp. paratuberculosis
ggcccgaacaucgccucggcc

SEQ ID NO: 883121 - RNA, 22 nt, Mycobacterium avium subsp. paratuberculosis
ggcccgaacaucgccucggccg

SEQ ID NO: 883122 - RNA, 16 nt, Mycobacterium avium subsp. paratuberculosis
ggccccuucgaugucg

SEQ ID NO: 883123 - RNA, 20 nt, Mycobacterium avium subsp. paratuberculosis
ggccccuucgaugucgccgg

SEQ ID NO: 883124 - RNA, 21 nt, Mycobacterium avium subsp. paratuberculosis
ggccccuucgaugucgccggc

SEQ ID NO: 883125 - RNA, 22 nt, Mycobacterium avium subsp. paratuberculosis
ggccccuucgaugucgccggcg

SEQ ID NO: 883126 - RNA, 15 nt, Mycobacterium avium subsp. paratuberculosis
ggcccgacgacgccg

SEQ ID NO: 883127 - RNA, 20 nt, Mycobacterium avium subsp. paratuberculosis
ggcccgcacggccgccaggg

SEQ ID NO: 883128 - RNA, 19 nt, Mycobacterium avium subsp. paratuberculosis
ggcccgcagccgcuggccg

SEQ ID NO: 883129 - RNA, 14 nt, Mycobacterium avium subsp. paratuberculosis
ggcccgcagcgccu

SEQ ID NO: 883130 - RNA, 20 nt, Mycobacterium avium subsp. paratuberculosis
ggcccgcagcgccucggcgu

SEQ ID NO: 883131 - RNA, 21 nt, Mycobacterium avium subsp. paratuberculosis
ggcccgcagcgccucggcgug

SEQ ID NO: 883132 - RNA, 19 nt, Mycobacterium avium subsp. paratuberculosis
ggccccccgggcaccagcg

SEQ ID NO: 883133 - RNA, 18 nt, Mycobacterium avium subsp. paratuberculosis
ggcccccgccucgccggu

SEQ ID NO: 883134 - RNA, 19 nt, Mycobacterium avium subsp. paratuberculosis
ggcccccgccucgccgguc

SEQ ID NO: 883135 - RNA, 14 nt, Mycobacterium avium subsp. paratuberculosis
ggccccagccaccg

SEQ ID NO: 883136 - RNA, 14 nt, Mycobacterium avium subsp. paratuberculosis
ggccccagcccggg

SEQ ID NO: 883137 - RNA, 17 nt, Mycobacterium avium subsp. paratuberculosis
ggccccagccgccgcga

SEQ ID NO: 883138 - RNA, 19 nt, Mycobacterium avium subsp. paratuberculosis
ggccccacgcgcucagcgc

SEQ ID NO: 883139 - RNA, 14 nt, Mycobacterium avium subsp. paratuberculosis
ggccccacgggcca

SEQ ID NO: 883140 - RNA, 23 nt, Mycobacterium avium subsp. paratuberculosis
ggccccacgggccauguccccga

SEQ ID NO: 883141 - RNA, 20 nt, Mycobacterium avium subsp. paratuberculosis
ggccccagaaccgcucggcg

SEQ ID NO: 883142 - RNA, 21 nt, Mycobacterium avium subsp. paratuberculosis
ggccccagaaccgcucggcgg

SEQ ID NO: 883143 - RNA, 14 nt, Mycobacterium avium subsp. paratuberculosis
ggcccagcccaccg

SEQ ID NO: 883144 - RNA, 16 nt, Mycobacterium avium subsp. paratuberculosis
ggcccagccgcgucac

SEQ ID NO: 883145 - RNA, 23 nt, Mycobacterium avium subsp. paratuberculosis
ggcccagccgcgucacgucggcc

SEQ ID NO: 883146 - RNA, 21 nt, Mycobacterium avium subsp. paratuberculosis
ggcccagccgcugcgacaggu

SEQ ID NO: 883147 - RNA, 12 nt, Mycobacterium avium subsp. paratuberculosis
ggcccagccggc

SEQ ID NO: 883148 - RNA, 13 nt, Mycobacterium avium subsp. paratuberculosis
ggcccagccggcg

SEQ ID NO: 883149 - RNA, 15 nt, Mycobacterium avium subsp. paratuberculosis
ggcccagccggcggu

SEQ ID NO: 883150 - RNA, 16 nt, Mycobacterium avium subsp. paratuberculosis
ggcccagcccggccag

SEQ ID NO: 883151 - RNA, 17 nt, Mycobacterium avium subsp. paratuberculosis
ggcccagcccggccagc

SEQ ID NO: 883152 - RNA, 19 nt, Mycobacterium avium subsp. paratuberculosis
ggcccagcccggccagcac

SEQ ID NO: 883153 - RNA, 21 nt, Mycobacterium avium subsp. paratuberculosis
ggcccagcagauagcccagcc

SEQ ID NO: 883154 - RNA, 15 nt, Mycobacterium avium subsp. paratuberculosis
ggcccagcagcaccg

SEQ ID NO: 883155 - RNA, 18 nt, Mycobacterium avium subsp. paratuberculosis
ggcccagcagcaccgcga

SEQ ID NO: 883156 - RNA, 19 nt, Mycobacterium avium subsp. paratuberculosis
ggcccagcagcgcaccggc

SEQ ID NO: 883157 - RNA, 21 nt, Mycobacterium avium subsp. paratuberculosis
ggcccagcagcgcaccggcga

SEQ ID NO: 883158 - RNA, 16 nt, Mycobacterium avium subsp. paratuberculosis
ggcccgguuccagcgg

SEQ ID NO: 883159 - RNA, 20 nt, Mycobacterium avium subsp. paratuberculosis
ggcccgguuccagcggcacc

SEQ ID NO: 883160 - RNA, 21 nt, Mycobacterium avium subsp. paratuberculosis
ggcccgguuccagcggcaccg

SEQ ID NO: 883161 - RNA, 20 nt, Mycobacterium avium subsp. paratuberculosis
ggcccgguugagugcgccgu

SEQ ID NO: 883162 - RNA, 22 nt, Mycobacterium avium subsp. paratuberculosis
ggcccgguugagugcgccgugc

SEQ ID NO: 883163 - RNA, 16 nt, Mycobacterium avium subsp. paratuberculosis
ggcccguacucgggug

SEQ ID NO: 883164 - RNA, 19 nt, Mycobacterium avium subsp. paratuberculosis
ggcccggucuugccggcuu

SEQ ID NO: 883165 - RNA, 13 nt, Mycobacterium avium subsp. paratuberculosis
ggcccggcggccg

SEQ ID NO: 883166 - RNA, 15 nt, Mycobacterium avium subsp. paratuberculosis
ggcccggcggccggc

SEQ ID NO: 883167 - RNA, 16 nt, Mycobacterium avium subsp. paratuberculosis
ggcccggcggccggcc

SEQ ID NO: 883168 - RNA, 19 nt, Mycobacterium avium subsp. paratuberculosis
ggcccggcggccggccgcg

SEQ ID NO: 883169 - RNA, 15 nt, Mycobacterium avium subsp. paratuberculosis
ggcccggccgccagc

SEQ ID NO: 883170 - RNA, 16 nt, Mycobacterium avium subsp. paratuberculosis
ggcccggccggcgcga

SEQ ID NO: 883171 - RNA, 13 nt, Mycobacterium avium subsp. paratuberculosis
ggcccggcgaugc

SEQ ID NO: 883172 - RNA, 15 nt, Mycobacterium avium subsp. paratuberculosis
ggcccggcgaugccg

SEQ ID NO: 883173 - RNA, 22 nt, Mycobacterium avium subsp. paratuberculosis
ggcccggcgaugccgagcccuu

SEQ ID NO: 883174 - RNA, 12 nt, Mycobacterium avium subsp. paratuberculosis
ggcccggcgcca

SEQ ID NO: 883175 - RNA, 12 nt, Mycobacterium avium subsp. paratuberculosis
ggcccggcaccg

SEQ ID NO: 883176 - RNA, 11 nt, Mycobacterium avium subsp. paratuberculosis
ggcccggcagc

SEQ ID NO: 883177 - RNA, 13 nt, Mycobacterium avium subsp. paratuberculosis
ggcccggcagccg

SEQ ID NO: 883178 - RNA, 15 nt, Mycobacterium avium subsp. paratuberculosis
ggcccggcagccggg

SEQ ID NO: 883179 - RNA, 14 nt, Mycobacterium avium subsp. paratuberculosis
ggcccggccacucg

SEQ ID NO: 883180 - RNA, 16 nt, Mycobacterium avium subsp. paratuberculosis
ggcccgcgcaccguca

SEQ ID NO: 883181 - RNA, 12 nt, Mycobacterium avium subsp. paratuberculosis
ggcccggcccgg

SEQ ID NO: 883182 - RNA, 20 nt, Mycobacterium avium subsp. paratuberculosis
ggcccggaccgccgcggcgg

SEQ ID NO: 883183 - RNA, 15 nt, Mycobacterium avium subsp. paratuberculosis
ggcccggacggccac

SEQ ID NO: 883184 - RNA, 17 nt, Mycobacterium avium subsp. paratuberculosis
ggcccggacggccaccu

SEQ ID NO: 883185 - RNA, 16 nt, Mycobacterium avium subsp. paratuberculosis
ggcccgcgccgcgucg

SEQ ID NO: 883186 - RNA, 14 nt, Mycobacterium avium subsp. paratuberculosis
ggcccgcgccggcg

SEQ ID NO: 883187 - RNA, 15 nt, Mycobacterium avium subsp. paratuberculosis
ggcccgcgccggcgu

SEQ ID NO: 883188 - RNA, 19 nt, Mycobacterium avium subsp. paratuberculosis
ggcccgcgccggcgugucg

SEQ ID NO: 883189 - RNA, 22 nt, Mycobacterium avium subsp. paratuberculosis
ggcccgcgccggcgugucggcg

SEQ ID NO: 883190 - RNA, 16 nt, Mycobacterium avium subsp. paratuberculosis
ggcccgcgccgacggc

SEQ ID NO: 883191 - RNA, 18 nt, Mycobacterium avium subsp. paratuberculosis
ggcccgcgccgacggccg

SEQ ID NO: 883192 - RNA, 20 nt, Mycobacterium avium subsp. paratuberculosis
ggcccgcgccccggcggcca

SEQ ID NO: 883193 - RNA, 16 nt, Mycobacterium avium subsp. paratuberculosis
ggcccgccuuccggga

SEQ ID NO: 883194 - RNA, 14 nt, Mycobacterium avium subsp. paratuberculosis
ggcccgcgacgucg

SEQ ID NO: 883195 - RNA, 22 nt, Mycobacterium avium subsp. paratuberculosis
ggcccgcgacgucggagaucag

SEQ ID NO: 883196 - RNA, 22 nt, Mycobacterium avium subsp. paratuberculosis
ggcccgccgcggcuccagcagc

SEQ ID NO: 883197 - RNA, 22 nt, Mycobacterium avium subsp. paratuberculosis
ggcccgccgcucaccgccgagc

SEQ ID NO: 883198 - RNA, 24 nt, Mycobacterium avium subsp. paratuberculosis
ggcccgccgcucaccgccgagccg

SEQ ID NO: 883199 - RNA, 17 nt, Mycobacterium avium subsp. paratuberculosis
ggcccgccgcugcagcu

SEQ ID NO: 883200 - RNA, 14 nt, Mycobacterium avium subsp. paratuberculosis
ggcccgccgggccg

SEQ ID NO: 883201 - RNA, 23 nt, Mycobacterium avium subsp. paratuberculosis
ggcccgccgggccggaucgcgca

SEQ ID NO: 883202 - RNA, 13 nt, Mycobacterium avium subsp. paratuberculosis
ggcccgccgggcg

SEQ ID NO: 883203 - RNA, 16 nt, Mycobacterium avium subsp. paratuberculosis
ggcccgccgggcgucg

SEQ ID NO: 883204 - RNA, 12 nt, Mycobacterium avium subsp. paratuberculosis
ggcccgccgcgg

SEQ ID NO: 883205 - RNA, 13 nt, Mycobacterium avium subsp. paratuberculosis
ggcccgccgccgg

SEQ ID NO: 883206 - RNA, 14 nt, Mycobacterium avium subsp. paratuberculosis
ggcccgccgccggc

SEQ ID NO: 883207 - RNA, 18 nt, Mycobacterium avium subsp. paratuberculosis
ggcccgccgcgcccggcu

SEQ ID NO: 883208 - RNA, 19 nt, Mycobacterium avium subsp. paratuberculosis
ggcccgccgcgcccggcuu

SEQ ID NO: 883209 - RNA, 21 nt, Mycobacterium avium subsp. paratuberculosis
ggcccgccgcgcccggcuucg

SEQ ID NO: 883210 - RNA, 15 nt, Mycobacterium avium subsp. paratuberculosis
ggcccgcccggcggc

SEQ ID NO: 883211 - RNA, 14 nt, Mycobacterium avium subsp. paratuberculosis
ggcccgcccagcgc

SEQ ID NO: 883212 - RNA, 16 nt, Mycobacterium avium subsp. paratuberculosis
ggcccgcccagcgcag

SEQ ID NO: 883213 - RNA, 18 nt, Mycobacterium avium subsp. paratuberculosis
ggcccgccaguucccggc

SEQ ID NO: 883214 - RNA, 17 nt, Mycobacterium avium subsp. paratuberculosis
ggcccgccacgugcggc

SEQ ID NO: 883215 - RNA, 15 nt, Mycobacterium avium subsp. paratuberculosis
ggcccgccagaucgc

SEQ ID NO: 883216 - RNA, 16 nt, Mycobacterium avium subsp. paratuberculosis
ggcccgccagaucgcc

SEQ ID NO: 883217 - RNA, 20 nt, Mycobacterium avium subsp. paratuberculosis
ggcccgccaaaacggggugg

SEQ ID NO: 883218 - RNA, 16 nt, Mycobacterium avium subsp. paratuberculosis
ggcccgcaucgcggcg

SEQ ID NO: 883219 - RNA, 23 nt, Mycobacterium avium subsp. paratuberculosis
ggcccgcaucgcggcgauggugu

SEQ ID NO: 883220 - RNA, 18 nt, Mycobacterium avium subsp. paratuberculosis
ggcccgcagccagcgcag

SEQ ID NO: 883221 - RNA, 14 nt, Mycobacterium avium subsp. paratuberculosis
ggcccgcagcucgg

SEQ ID NO: 883222 - RNA, 16 nt, Mycobacterium avium subsp. paratuberculosis
ggccgacgugccggug

SEQ ID NO: 883223 - RNA, 15 nt, Mycobacterium avium subsp. paratuberculosis
ggccgagcgcaccgc

SEQ ID NO: 883224 - RNA, 12 nt, Mycobacterium avium subsp. paratuberculosis
ggccgagcgcac

SEQ ID NO: 883225 - RNA, 13 nt, Mycobacterium avium subsp. paratuberculosis
ggccgagcgcacc

SEQ ID NO: 883226 - RNA, 14 nt, Mycobacterium avium subsp. paratuberculosis
ggccgagccgagcc

SEQ ID NO: 883227 - RNA, 23 nt, Mycobacterium avium subsp. paratuberculosis
ggccgagccgagccgacccgggc

SEQ ID NO: 883228 - RNA, 14 nt, Mycobacterium avium subsp. paratuberculosis
ggccgagccgaggc

SEQ ID NO: 883229 - RNA, 14 nt, Mycobacterium avium subsp. paratuberculosis
ggccgagccgggcg

SEQ ID NO: 883230 - RNA, 20 nt, Mycobacterium avium subsp. paratuberculosis
ggccgagccgggcggccagc

SEQ ID NO: 883231 - RNA, 23 nt, Mycobacterium avium subsp. paratuberculosis
ggccgagccgggcggccagcgug

SEQ ID NO: 883232 - RNA, 21 nt, Mycobacterium avium subsp. paratuberculosis
ggccgagcgcaagggccgaca

SEQ ID NO: 883233 - RNA, 14 nt, Mycobacterium avium subsp. paratuberculosis
ggccgagcagccgg

SEQ ID NO: 883234 - RNA, 15 nt, Mycobacterium avium subsp. paratuberculosis
ggccgagcagccggg

SEQ ID NO: 883235 - RNA, 17 nt, Mycobacterium avium subsp. paratuberculosis
ggccgagcagccgggcc

SEQ ID NO: 883236 - RNA, 21 nt, Mycobacterium avium subsp. paratuberculosis
ggccgagcagccgggccagca

SEQ ID NO: 883237 - RNA, 14 nt, Mycobacterium avium subsp. paratuberculosis
ggccgaggucacca

SEQ ID NO: 883238 - RNA, 21 nt, Mycobacterium avium subsp. paratuberculosis
ggccgaggucaccaccgagcc

SEQ ID NO: 883239 - RNA, 23 nt, Mycobacterium avium subsp. paratuberculosis
ggccgaggucaccaccgagccgg

SEQ ID NO: 883240 - RNA, 15 nt, Mycobacterium avium subsp. paratuberculosis
ggccgagguccgcgg

SEQ ID NO: 883241 - RNA, 16 nt, Mycobacterium avium subsp. paratuberculosis
ggccgagcggcugcug

SEQ ID NO: 883242 - RNA, 17 nt, Mycobacterium avium subsp. paratuberculosis
ggccgagcguucggcgc

SEQ ID NO: 883243 - RNA, 19 nt, Mycobacterium avium subsp. paratuberculosis
ggccgagcgcagcggggag

SEQ ID NO: 883244 - RNA, 15 nt, Mycobacterium avium subsp. paratuberculosis
ggccgagcgcgccgc

SEQ ID NO: 883245 - RNA, 16 nt, Mycobacterium avium subsp. paratuberculosis
ggccgagcgcgccgcc

SEQ ID NO: 883246 - RNA, 18 nt, Mycobacterium avium subsp. paratuberculosis
ggccgagcgcgccgccgc

SEQ ID NO: 883247 - RNA, 13 nt, Mycobacterium avium subsp. paratuberculosis
ggccgagcgcgcu

SEQ ID NO: 883248 - RNA, 14 nt, Mycobacterium avium subsp. paratuberculosis
ggccgagcgcgcug

SEQ ID NO: 883249 - RNA, 14 nt, Mycobacterium avium subsp. paratuberculosis
ggccgagcgcgccg

SEQ ID NO: 883250 - RNA, 17 nt, Mycobacterium avium subsp. paratuberculosis
ggccgagccgccggauc

SEQ ID NO: 883251 - RNA, 14 nt, Mycobacterium avium subsp. paratuberculosis
ggccgagcgcagcg

SEQ ID NO: 883252 - RNA, 16 nt, Mycobacterium avium subsp. paratuberculosis
ggccgagcgcaccgcg

SEQ ID NO: 883253 - RNA, 20 nt, Mycobacterium avium subsp. paratuberculosis
ggccgagcgcaccgcggagc

SEQ ID NO: 883254 - RNA, 23 nt, Mycobacterium avium subsp. paratuberculosis
ggccgagcgcaccgcggagcgca

SEQ ID NO: 883255 - RNA, 13 nt, Mycobacterium avium subsp. paratuberculosis
ggccgacaucguc

SEQ ID NO: 883256 - RNA, 17 nt, Mycobacterium avium subsp. paratuberculosis
ggccgacaucgucggcu

SEQ ID NO: 883257 - RNA, 19 nt, Mycobacterium avium subsp. paratuberculosis
ggccgacaucgucggcucg

SEQ ID NO: 883258 - RNA, 17 nt, Mycobacterium avium subsp. paratuberculosis
ggccgacauggacgcgg

SEQ ID NO: 883259 - RNA, 19 nt, Mycobacterium avium subsp. paratuberculosis
ggccgacagcacgccgggc

SEQ ID NO: 883260 - RNA, 22 nt, Mycobacterium avium subsp. paratuberculosis
ggccgacagcacgccgggcaug

SEQ ID NO: 883261 - RNA, 13 nt, Mycobacterium avium subsp. paratuberculosis
ggccgacagcgcg

SEQ ID NO: 883262 - RNA, 20 nt, Mycobacterium avium subsp. paratuberculosis
ggccgacagcgcgucggcga

SEQ ID NO: 883263 - RNA, 23 nt, Mycobacterium avium subsp. paratuberculosis
ggccgacagcgcgucggcgaugu

SEQ ID NO: 883264 - RNA, 15 nt, Mycobacterium avium subsp. paratuberculosis
ggcccucguccgaca

SEQ ID NO: 883265 - RNA, 14 nt, Mycobacterium avium subsp. paratuberculosis
ggcccucgucggcg

SEQ ID NO: 883266 - RNA, 15 nt, Mycobacterium avium subsp. paratuberculosis
ggcccucgucggcga

SEQ ID NO: 883267 - RNA, 16 nt, Mycobacterium avium subsp. paratuberculosis
ggcccucggaggugcc

SEQ ID NO: 883268 - RNA, 19 nt, Mycobacterium avium subsp. paratuberculosis
ggcccucggaggugccgcg

SEQ ID NO: 883269 - RNA, 14 nt, Mycobacterium avium subsp. paratuberculosis
ggcccucggccagc

SEQ ID NO: 883270 - RNA, 17 nt, Mycobacterium avium subsp. paratuberculosis
ggcccucggccagccag

SEQ ID NO: 883271 - RNA, 23 nt, Mycobacterium avium subsp. paratuberculosis
ggcccucgacguaguccggccag

SEQ ID NO: 883272 - RNA, 12 nt, Mycobacterium avium subsp. paratuberculosis
ggcccucgccgc

SEQ ID NO: 883273 - RNA, 14 nt, Mycobacterium avium subsp. paratuberculosis
ggccgacaccccga

SEQ ID NO: 883274 - RNA, 19 nt, Mycobacterium avium subsp. paratuberculosis
ggccgacaccccgaugccg

SEQ ID NO: 883275 - RNA, 22 nt, Mycobacterium avium subsp. paratuberculosis
ggccgacaccccgaugccgaac

SEQ ID NO: 883276 - RNA, 17 nt, Mycobacterium avium subsp. paratuberculosis
ggcccgugucgcggccu

SEQ ID NO: 883277 - RNA, 13 nt, Mycobacterium avium subsp. paratuberculosis
ggcccgucggcgu

SEQ ID NO: 883278 - RNA, 14 nt, Mycobacterium avium subsp. paratuberculosis
ggcccgucggcgug

SEQ ID NO: 883279 - RNA, 15 nt, Mycobacterium avium subsp. paratuberculosis
ggcccgucggcguga

SEQ ID NO: 883280 - RNA, 14 nt, Mycobacterium avium subsp. paratuberculosis
ggcccucaucgucg

SEQ ID NO: 883281 - RNA, 16 nt, Mycobacterium avium subsp. paratuberculosis
ggcccucaucgucgac

SEQ ID NO: 883282 - RNA, 21 nt, Mycobacterium avium subsp. paratuberculosis
ggcccuccacggugcgcaccg

SEQ ID NO: 883283 - RNA, 19 nt, Mycobacterium avium subsp. paratuberculosis
ggcccguugagcaccgcga

SEQ ID NO: 883284 - RNA, 15 nt, Mycobacterium avium subsp. paratuberculosis
ggcccuccgcggcgc

SEQ ID NO: 883285 - RNA, 16 nt, Mycobacterium avium subsp. paratuberculosis
ggcccuccgcggcgcc

SEQ ID NO: 883286 - RNA, 12 nt, Mycobacterium avium subsp. paratuberculosis
ggcccgucgcca

SEQ ID NO: 883287 - RNA, 17 nt, Mycobacterium avium subsp. paratuberculosis
ggcccgucgccaccacg

SEQ ID NO: 883288 - RNA, 20 nt, Mycobacterium avium subsp. paratuberculosis
ggcccgucgccaccacggcg

SEQ ID NO: 883289 - RNA, 13 nt, Mycobacterium avium subsp. paratuberculosis
ggcccgucgccga

SEQ ID NO: 883290 - RNA, 13 nt, Mycobacterium avium subsp. paratuberculosis
ggcccgucgccgg

SEQ ID NO: 883291 - RNA, 16 nt, Mycobacterium avium subsp. paratuberculosis
ggcccgucgccggcgc

SEQ ID NO: 883292 - RNA, 19 nt, Mycobacterium avium subsp. paratuberculosis
ggcccgucgccggcgcgca

SEQ ID NO: 883293 - RNA, 14 nt, Mycobacterium avium subsp. paratuberculosis
ggcccgucgccgug

SEQ ID NO: 883294 - RNA, 20 nt, Mycobacterium avium subsp. paratuberculosis
ggcccguccagaucggccag

SEQ ID NO: 883295 - RNA, 12 nt, Mycobacterium avium subsp. paratuberculosis
ggcccgucccca

SEQ ID NO: 883296 - RNA, 19 nt, Mycobacterium avium subsp. paratuberculosis
ggcccguccccaccaccga

SEQ ID NO: 883297 - RNA, 21 nt, Mycobacterium avium subsp. paratuberculosis
ggcccguccccaccaccgaca

SEQ ID NO: 883298 - RNA, 17 nt, Mycobacterium avium subsp. paratuberculosis
ggcccguccgccccgcu

SEQ ID NO: 883299 - RNA, 19 nt, Mycobacterium avium subsp. paratuberculosis
ggcccguagcucgcgccga

SEQ ID NO: 883300 - RNA, 20 nt, Mycobacterium avium subsp. paratuberculosis
ggcccguagcucgcgccgac

SEQ ID NO: 883301 - RNA, 18 nt, Mycobacterium avium subsp. paratuberculosis
ggcgacaccccgcgaguc

SEQ ID NO: 883302 - RNA, 14 nt, Mycobacterium avium subsp. paratuberculosis
ggcgacacgccgac

SEQ ID NO: 883303 - RNA, 23 nt, Mycobacterium avium subsp. paratuberculosis
ggcgaacagcggggugcccacca

SEQ ID NO: 883304 - RNA, 17 nt, Mycobacterium avium subsp. paratuberculosis
ggcgaacagcagcaccc

SEQ ID NO: 883305 - RNA, 21 nt, Mycobacterium avium subsp. paratuberculosis
ggcgaacagcagcacccgggu

SEQ ID NO: 883306 - RNA, 14 nt, Mycobacterium avium subsp. paratuberculosis
ggcgaacaccacgg

SEQ ID NO: 883307 - RNA, 18 nt, Mycobacterium avium subsp. paratuberculosis
ggcgaacaccacgguccc

SEQ ID NO: 883308 - RNA, 13 nt, Mycobacterium avium subsp. paratuberculosis
ggcgaacaccagc

SEQ ID NO: 883309 - RNA, 14 nt, Mycobacterium avium subsp. paratuberculosis
ggcgaacaccagca

SEQ ID NO: 883310 - RNA, 17 nt, Mycobacterium avium subsp. paratuberculosis
ggcgaacaccucggcga

SEQ ID NO: 883311 - RNA, 22 nt, Mycobacterium avium subsp. paratuberculosis
ggcgaacaccucggcgaugccu

SEQ ID NO: 883312 - RNA, 19 nt, Mycobacterium avium subsp. paratuberculosis
ggcgaacacgucggccagc

SEQ ID NO: 883313 - RNA, 19 nt, Mycobacterium avium subsp. paratuberculosis
ggcgacaugcccgcggugc

SEQ ID NO: 883314 - RNA, 22 nt, Mycobacterium avium subsp. paratuberculosis
ggcgacaugcgcagcgcccagg

SEQ ID NO: 883315 - RNA, 18 nt, Mycobacterium avium subsp. paratuberculosis
ggcgaccaccaccgccca

SEQ ID NO: 883316 - RNA, 17 nt, Mycobacterium avium subsp. paratuberculosis
ggcgaccaccagccgca

SEQ ID NO: 883317 - RNA, 22 nt, Mycobacterium avium subsp. paratuberculosis
ggcgaccaccagccgcaggugc

SEQ ID NO: 883318 - RNA, 17 nt, Mycobacterium avium subsp. paratuberculosis
ggcgaccaccgaccccu

SEQ ID NO: 883319 - RNA, 16 nt, Mycobacterium avium subsp. paratuberculosis
ggcgaccaccucggcg

SEQ ID NO: 883320 - RNA, 22 nt, Mycobacterium avium subsp. paratuberculosis
ggcgaccaccucggcgacgaug

SEQ ID NO: 883321 - RNA, 23 nt, Mycobacterium avium subsp. paratuberculosis
ggcgaccaccucggcgacgaugg

SEQ ID NO: 883322 - RNA, 19 nt, Mycobacterium avium subsp. paratuberculosis
ggcgaccacgaacaccggc

SEQ ID NO: 883323 - RNA, 13 nt, Mycobacterium avium subsp. paratuberculosis
ggcgacaucgccg

SEQ ID NO: 883324 - RNA, 15 nt, Mycobacterium avium subsp. paratuberculosis
ggcgacaucgccgcg

SEQ ID NO: 883325 - RNA, 16 nt, Mycobacterium avium subsp. paratuberculosis
ggcgacaucgccgcgg

SEQ ID NO: 883326 - RNA, 19 nt, Mycobacterium avium subsp. paratuberculosis
ggcgacaucgccgcggccg

SEQ ID NO: 883327 - RNA, 20 nt, Mycobacterium avium subsp. paratuberculosis
ggcgacaucgccgcggccgg

SEQ ID NO: 883328 - RNA, 23 nt, Mycobacterium avium subsp. paratuberculosis
ggcgaccaaugcccugaccccgg

SEQ ID NO: 883329 - RNA, 23 nt, Mycobacterium avium subsp. paratuberculosis
ggcgaccaauugcgagcaggccg

SEQ ID NO: 883330 - RNA, 20 nt, Mycobacterium avium subsp. paratuberculosis
ggcgaccacaccgccggcca

SEQ ID NO: 883331 - RNA, 21 nt, Mycobacterium avium subsp. paratuberculosis
ggcgaccacaccgccggccac

SEQ ID NO: 883332 - RNA, 16 nt, Mycobacterium avium subsp. paratuberculosis
ggcgaccacaccgucg

SEQ ID NO: 883333 - RNA, 19 nt, Mycobacterium avium subsp. paratuberculosis
ggcgaccacaccgucgacg

SEQ ID NO: 883334 - RNA, 20 nt, Mycobacterium avium subsp. paratuberculosis
ggcgaccacaccgucgacga

SEQ ID NO: 883335 - RNA, 21 nt, Mycobacterium avium subsp. paratuberculosis
ggcgaccacaccgucgacgac

SEQ ID NO: 883336 - RNA, 14 nt, Mycobacterium avium subsp. paratuberculosis
ggcgacgaagcagc

SEQ ID NO: 883337 - RNA, 19 nt, Mycobacterium avium subsp. paratuberculosis
ggcgacgaaaaugcccagu

SEQ ID NO: 883338 - RNA, 24 nt, Mycobacterium avium subsp. paratuberculosis
ggcgacgaaauugggcugggucac

SEQ ID NO: 883339 - RNA, 16 nt, Mycobacterium avium subsp. paratuberculosis
ggcgacgaacgccggc

SEQ ID NO: 883340 - RNA, 17 nt, Mycobacterium avium subsp. paratuberculosis
ggcgacgaacgccggca

SEQ ID NO: 883341 - RNA, 18 nt, Mycobacterium avium subsp. paratuberculosis
ggcgacgaacgccggcau

SEQ ID NO: 883342 - RNA, 18 nt, Mycobacterium avium subsp. paratuberculosis
ggcgaccuggugcucgau

SEQ ID NO: 883343 - RNA, 19 nt, Mycobacterium avium subsp. paratuberculosis
ggcgaccuggugcucgaug

SEQ ID NO: 883344 - RNA, 21 nt, Mycobacterium avium subsp. paratuberculosis
ggcgaccuggugcucgaugcg

SEQ ID NO: 883345 - RNA, 20 nt, Mycobacterium avium subsp. paratuberculosis
ggcgaccuguuuggccagcc

SEQ ID NO: 883346 - RNA, 21 nt, Mycobacterium avium subsp. paratuberculosis
ggcgaccuguuuggccagcca

SEQ ID NO: 883347 - RNA, 22 nt, Mycobacterium avium subsp. paratuberculosis
ggcgaccuguuuggccagccag

SEQ ID NO: 883348 - RNA, 20 nt, Mycobacterium avium subsp. paratuberculosis
ggcgaccuugcgcagccggc

SEQ ID NO: 883349 - RNA, 21 nt, Mycobacterium avium subsp. paratuberculosis
ggcgaccuugcggcgcgaugc

SEQ ID NO: 883350 - RNA, 16 nt, Mycobacterium avium subsp. paratuberculosis
ggcgaccucguggucc

SEQ ID NO: 883351 - RNA, 21 nt, Mycobacterium avium subsp. paratuberculosis
ggcgaccugcggcucgucggc

SEQ ID NO: 883352 - RNA, 14 nt, Mycobacterium avium subsp. paratuberculosis
ggcgaccugcgggc

SEQ ID NO: 883353 - RNA, 22 nt, Mycobacterium avium subsp. paratuberculosis
ggcgaccugcgggcccaccgcg

SEQ ID NO: 883354 - RNA, 17 nt, Mycobacterium avium subsp. paratuberculosis
ggcgaccggggcgguga

SEQ ID NO: 883355 - RNA, 18 nt, Mycobacterium avium subsp. paratuberculosis
ggcgaccggggcggugac

SEQ ID NO: 883356 - RNA, 16 nt, Mycobacterium avium subsp. paratuberculosis
ggcgaccgguccgcgg

SEQ ID NO: 883357 - RNA, 20 nt, Mycobacterium avium subsp. paratuberculosis
ggcgaccggccccaacggcg

SEQ ID NO: 883358 - RNA, 18 nt, Mycobacterium avium subsp. paratuberculosis
ggcgaccgcguagucguu

SEQ ID NO: 883359 - RNA, 14 nt, Mycobacterium avium subsp. paratuberculosis
ggcgaccgcccggg

SEQ ID NO: 883360 - RNA, 20 nt, Mycobacterium avium subsp. paratuberculosis
ggcgaccgccuugucggcga

SEQ ID NO: 883361 - RNA, 14 nt, Mycobacterium avium subsp. paratuberculosis
ggcgaccgcggccg

SEQ ID NO: 883362 - RNA, 18 nt, Mycobacterium avium subsp. paratuberculosis
ggcgaccgcgcaggcggc

SEQ ID NO: 883363 - RNA, 23 nt, Mycobacterium avium subsp. paratuberculosis
ggcgaccgcgcaggcggcgacgg

SEQ ID NO: 883364 - RNA, 15 nt, Mycobacterium avium subsp. paratuberculosis
ggcgaccgcgcgcgg

SEQ ID NO: 883365 - RNA, 17 nt, Mycobacterium avium subsp. paratuberculosis
ggcgaccgcgcgcggcg

SEQ ID NO: 883366 - RNA, 14 nt, Mycobacterium avium subsp. paratuberculosis
ggcgacccgcaccg

SEQ ID NO: 883367 - RNA, 15 nt, Mycobacterium avium subsp. paratuberculosis
ggcgacccgcaccga

SEQ ID NO: 883368 - RNA, 22 nt, Mycobacterium avium subsp. paratuberculosis
ggcgaccagauaggccagcgcg

SEQ ID NO: 883369 - RNA, 23 nt, Mycobacterium avium subsp. paratuberculosis
ggcgaccagauaggccagcgcgu

SEQ ID NO: 883370 - RNA, 16 nt, Mycobacterium avium subsp. paratuberculosis
ggcgaccagccccucg

SEQ ID NO: 883371 - RNA, 16 nt, Mycobacterium avium subsp. paratuberculosis
ggcgaccaugcccagc

SEQ ID NO: 883372 - RNA, 17 nt, Mycobacterium avium subsp. paratuberculosis
ggcgaccaugcccagca

SEQ ID NO: 883373 - RNA, 16 nt, Mycobacterium avium subsp. paratuberculosis
ggcgaccaugccgcgg

SEQ ID NO: 883374 - RNA, 17 nt, Mycobacterium avium subsp. paratuberculosis
ggcgaccaugccgcggg

SEQ ID NO: 883375 - RNA, 20 nt, Mycobacterium avium subsp. paratuberculosis
ggcgaccaugccgcgggcca

SEQ ID NO: 883376 - RNA, 15 nt, Mycobacterium avium subsp. paratuberculosis
ggcgaccccguucgc

SEQ ID NO: 883377 - RNA, 18 nt, Mycobacterium avium subsp. paratuberculosis
ggcgaccccguucgccga

SEQ ID NO: 883378 - RNA, 19 nt, Mycobacterium avium subsp. paratuberculosis
ggcgaccccguucgccgac

SEQ ID NO: 883379 - RNA, 23 nt, Mycobacterium avium subsp. paratuberculosis
ggcgaccccguucgccgacagca

SEQ ID NO: 883380 - RNA, 23 nt, Mycobacterium avium subsp. paratuberculosis
ggcgacuguccaggccgaggcug

SEQ ID NO: 883381 - RNA, 19 nt, Mycobacterium avium subsp. paratuberculosis
ggcgacuucuucgccggcg

SEQ ID NO: 883382 - RNA, 16 nt, Mycobacterium avium subsp. paratuberculosis
ggcgacugcgugcugg

SEQ ID NO: 883383 - RNA, 16 nt, Mycobacterium avium subsp. paratuberculosis
ggcgacuccggcgccg

SEQ ID NO: 883384 - RNA, 19 nt, Mycobacterium avium subsp. paratuberculosis
ggcgacuccagcagcgcca

SEQ ID NO: 883385 - RNA, 22 nt, Mycobacterium avium subsp. paratuberculosis
ggcgacuccagcagcgccagca

SEQ ID NO: 883386 - RNA, 15 nt, Mycobacterium avium subsp. paratuberculosis
ggcgacgugccggcg

SEQ ID NO: 883387 - RNA, 16 nt, Mycobacterium avium subsp. paratuberculosis
ggcgacgugccggcgg

SEQ ID NO: 883388 - RNA, 17 nt, Mycobacterium avium subsp. paratuberculosis
ggcgacgugccggcggc

SEQ ID NO: 883389 - RNA, 23 nt, Mycobacterium avium subsp. paratuberculosis
ggcgacgugccggcggcagguga

SEQ ID NO: 883390 - RNA, 21 nt, Mycobacterium avium subsp. paratuberculosis
ggcgacguucgauugcaccac

SEQ ID NO: 883391 - RNA, 21 nt, Mycobacterium avium subsp. paratuberculosis
ggcgagcagcagcgcggugcc

SEQ ID NO: 883392 - RNA, 16 nt, Mycobacterium avium subsp. paratuberculosis
ggcgagcagcccggcg

SEQ ID NO: 883393 - RNA, 16 nt, Mycobacterium avium subsp. paratuberculosis
ggcgagcagcgcccgg

SEQ ID NO: 883394 - RNA, 17 nt, Mycobacterium avium subsp. paratuberculosis
ggcgagcagcgcccggg

SEQ ID NO: 883395 - RNA, 23 nt, Mycobacterium avium subsp. paratuberculosis
ggcgagcagcgcgaugccggcca

SEQ ID NO: 883396 - RNA, 19 nt, Mycobacterium avium subsp. paratuberculosis
ggcgagcagacacaaaagc

SEQ ID NO: 883397 - RNA, 17 nt, Mycobacterium avium subsp. paratuberculosis
ggcgagcagcugcagcg

SEQ ID NO: 883398 - RNA, 22 nt, Mycobacterium avium subsp. paratuberculosis
ggcgagcagcugcagcgucggg

SEQ ID NO: 883399 - RNA, 19 nt, Mycobacterium avium subsp. paratuberculosis
ggcgagaucuucuccccgc

SEQ ID NO: 883400 - RNA, 18 nt, Mycobacterium avium subsp. paratuberculosis
ggcgagaucaacaccgcg

SEQ ID NO: 883401 - RNA, 22 nt, Mycobacterium avium subsp. paratuberculosis
ggcgagaucaacaccgcgcaug

SEQ ID NO: 883402 - RNA, 22 nt, Mycobacterium avium subsp. paratuberculosis
ggcgagaucccugcgcucagca

SEQ ID NO: 883403 - RNA, 12 nt, Mycobacterium avium subsp. paratuberculosis
ggcgagaccguc

SEQ ID NO: 883404 - RNA, 14 nt, Mycobacterium avium subsp. paratuberculosis
ggcgagcacccgga

SEQ ID NO: 883405 - RNA, 18 nt, Mycobacterium avium subsp. paratuberculosis
ggcgagcaccgugccguc

SEQ ID NO: 883406 - RNA, 21 nt, Mycobacterium avium subsp. paratuberculosis
ggcgagcaccgugccgucggc

SEQ ID NO: 883407 - RNA, 22 nt, Mycobacterium avium subsp. paratuberculosis
ggcgagcaccgugccgucggcg

SEQ ID NO: 883408 - RNA, 14 nt, Mycobacterium avium subsp. paratuberculosis
ggcgagcacgccgc

SEQ ID NO: 883409 - RNA, 17 nt, Mycobacterium avium subsp. paratuberculosis
ggcgagcaaggcgagca

SEQ ID NO: 883410 - RNA, 23 nt, Mycobacterium avium subsp. paratuberculosis
ggcgagcaaggcgagcacggcac

SEQ ID NO: 883411 - RNA, 14 nt, Mycobacterium avium subsp. paratuberculosis
ggcgacggucugcc

SEQ ID NO: 883412 - RNA, 19 nt, Mycobacterium avium subsp. paratuberculosis
ggcgacggugcaugcgcug

SEQ ID NO: 883413 - RNA, 21 nt, Mycobacterium avium subsp. paratuberculosis
ggcgacggcguugcuggcgcg

SEQ ID NO: 883414 - RNA, 13 nt, Mycobacterium avium subsp. paratuberculosis
ggcgacgggccga

SEQ ID NO: 883415 - RNA, 16 nt, Mycobacterium avium subsp. paratuberculosis
ggcgacgggccgauca

SEQ ID NO: 883416 - RNA, 19 nt, Mycobacterium avium subsp. paratuberculosis
ggcgacgggccgaucacgc

SEQ ID NO: 883417 - RNA, 17 nt, Mycobacterium avium subsp. paratuberculosis
ggcgacgguggcgccca

SEQ ID NO: 883418 - RNA, 19 nt, Mycobacterium avium subsp. paratuberculosis
ggcgacgguggcgcccagc

SEQ ID NO: 883419 - RNA, 15 nt, Mycobacterium avium subsp. paratuberculosis
ggcgacgguggcggg

SEQ ID NO: 883420 - RNA, 16 nt, Mycobacterium avium subsp. paratuberculosis
ggcgacgguggcgggc

SEQ ID NO: 883421 - RNA, 17 nt, Mycobacterium avium subsp. paratuberculosis
ggcgacgguguccgcgg

SEQ ID NO: 883422 - RNA, 19 nt, Mycobacterium avium subsp. paratuberculosis
ggcgacgguguccgcggcg

SEQ ID NO: 883423 - RNA, 20 nt, Mycobacterium avium subsp. paratuberculosis
ggcgacgguguccgcggcgu

SEQ ID NO: 883424 - RNA, 16 nt, Mycobacterium avium subsp. paratuberculosis
ggcgacggcguccagc

SEQ ID NO: 883425 - RNA, 22 nt, Mycobacterium avium subsp. paratuberculosis
ggcgacggcguccgggcgcugc

SEQ ID NO: 883426 - RNA, 21 nt, Mycobacterium avium subsp. paratuberculosis
ggcgacguacagcgagccguc

SEQ ID NO: 883427 - RNA, 20 nt, Mycobacterium avium subsp. paratuberculosis
ggcgacguccuugaucagca

SEQ ID NO: 883428 - RNA, 13 nt, Mycobacterium avium subsp. paratuberculosis
ggcgacgucgacg

SEQ ID NO: 883429 - RNA, 18 nt, Mycobacterium avium subsp. paratuberculosis
ggcgacgucgacggcagc

SEQ ID NO: 883430 - RNA, 12 nt, Mycobacterium avium subsp. paratuberculosis
ggcgacgucgcc

SEQ ID NO: 883431 - RNA, 19 nt, Mycobacterium avium subsp. paratuberculosis
ggcgacgucggggucgucg

SEQ ID NO: 883432 - RNA, 21 nt, Mycobacterium avium subsp. paratuberculosis
ggcgacgucggggucgucgcg

SEQ ID NO: 883433 - RNA, 16 nt, Mycobacterium avium subsp. paratuberculosis
ggcgacgucggucggc

SEQ ID NO: 883434 - RNA, 15 nt, Mycobacterium avium subsp. paratuberculosis
ggcgacgucgucgau

SEQ ID NO: 883435 - RNA, 20 nt, Mycobacterium avium subsp. paratuberculosis
ggcgacggcgcucaccggcg

SEQ ID NO: 883436 - RNA, 18 nt, Mycobacterium avium subsp. paratuberculosis
ggcgacggcgcuguggcc

SEQ ID NO: 883437 - RNA, 16 nt, Mycobacterium avium subsp. paratuberculosis
ggcgacggcggccguc

SEQ ID NO: 883438 - RNA, 14 nt, Mycobacterium avium subsp. paratuberculosis
ggcgacggcggcga

SEQ ID NO: 883439 - RNA, 11 nt, Mycobacterium avium subsp. paratuberculosis
ggcgacggcgc

SEQ ID NO: 883440 - RNA, 12 nt, Mycobacterium avium subsp. paratuberculosis
ggcgacggcgcc

SEQ ID NO: 883441 - RNA, 18 nt, Mycobacterium avium subsp. paratuberculosis
ggcgacggccagcgcggc

SEQ ID NO: 883442 - RNA, 23 nt, Mycobacterium avium subsp. paratuberculosis
ggcgacggccguccggucgcugg

SEQ ID NO: 883443 - RNA, 21 nt, Mycobacterium avium subsp. paratuberculosis
ggcgacggcgaccacaccguc

SEQ ID NO: 883444 - RNA, 19 nt, Mycobacterium avium subsp. paratuberculosis
ggcgacggcgacggccaga

SEQ ID NO: 883445 - RNA, 12 nt, Mycobacterium avium subsp. paratuberculosis
ggcgacggcgag

SEQ ID NO: 883446 - RNA, 14 nt, Mycobacterium avium subsp. paratuberculosis
ggcgacgcggcggg

SEQ ID NO: 883447 - RNA, 16 nt, Mycobacterium avium subsp. paratuberculosis
ggcgacgcucaggcgu

SEQ ID NO: 883448 - RNA, 12 nt, Mycobacterium avium subsp. paratuberculosis
ggcgacgcugaa

SEQ ID NO: 883449 - RNA, 15 nt, Mycobacterium avium subsp. paratuberculosis
ggcgacgcugguggc

SEQ ID NO: 883450 - RNA, 17 nt, Mycobacterium avium subsp. paratuberculosis
ggcgacgcugugcucgg

SEQ ID NO: 883451 - RNA, 20 nt, Mycobacterium avium subsp. paratuberculosis
ggcgacggcaccgccggcgg

SEQ ID NO: 883452 - RNA, 23 nt, Mycobacterium avium subsp. paratuberculosis
ggcgacggcaccgccggcggccu

SEQ ID NO: 883453 - RNA, 12 nt, Mycobacterium avium subsp. paratuberculosis
ggcgacgcggcg

SEQ ID NO: 883454 - RNA, 13 nt, Mycobacterium avium subsp. paratuberculosis
ggcgacgccgcgg

SEQ ID NO: 883455 - RNA, 14 nt, Mycobacterium avium subsp. paratuberculosis
ggcgacgccgcgga

SEQ ID NO: 883456 - RNA, 15 nt, Mycobacterium avium subsp. paratuberculosis
ggcgacgccggcgag

SEQ ID NO: 883457 - RNA, 20 nt, Mycobacterium avium subsp. paratuberculosis
ggcgacgccggcgaggcggu

SEQ ID NO: 883458 - RNA, 13 nt, Mycobacterium avium subsp. paratuberculosis
ggcgacgccgccg

SEQ ID NO: 883459 - RNA, 15 nt, Mycobacterium avium subsp. paratuberculosis
ggcgacgccgccguc

SEQ ID NO: 883460 - RNA, 20 nt, Mycobacterium avium subsp. paratuberculosis
ggcgacgaucggcucgagcu

SEQ ID NO: 883461 - RNA, 12 nt, Mycobacterium avium subsp. paratuberculosis
ggcgacgcacga

SEQ ID NO: 883462 - RNA, 20 nt, Mycobacterium avium subsp. paratuberculosis
ggcgacgauaucggccgcgg

SEQ ID NO: 883463 - RNA, 19 nt, Mycobacterium avium subsp. paratuberculosis
ggcgacgaugccggccggg

SEQ ID NO: 883464 - RNA, 19 nt, Mycobacterium avium subsp. paratuberculosis
ggcgacgaugaagacccgc

SEQ ID NO: 883465 - RNA, 21 nt, Mycobacterium avium subsp. paratuberculosis
ggcgacgaugaagacccgccg

SEQ ID NO: 883466 - RNA, 23 nt, Mycobacterium avium subsp. paratuberculosis
ggcgacgauggccaggcccagcc

SEQ ID NO: 883467 - RNA, 18 nt, Mycobacterium avium subsp. paratuberculosis
ggcgacgaagucgacggc

SEQ ID NO: 883468 - RNA, 23 nt, Mycobacterium avium subsp. paratuberculosis
ggcgacgaagucgacggcgguga

SEQ ID NO: 883469 - RNA, 15 nt, Mycobacterium avium subsp. paratuberculosis
ggcgacgaccaccag

SEQ ID NO: 883470 - RNA, 17 nt, Mycobacterium avium subsp. paratuberculosis
ggcgacgaccaccagga

SEQ ID NO: 883471 - RNA, 15 nt, Mycobacterium avium subsp. paratuberculosis
ggcgacgaccgcacc

SEQ ID NO: 883472 - RNA, 17 nt, Mycobacterium avium subsp. paratuberculosis
ggcgacgaccgcaccga

SEQ ID NO: 883473 - RNA, 13 nt, Mycobacterium avium subsp. paratuberculosis
ggcgacgaccguc

SEQ ID NO: 883474 - RNA, 12 nt, Mycobacterium avium subsp. paratuberculosis
ggcgacgacgcg

SEQ ID NO: 883475 - RNA, 14 nt, Mycobacterium avium subsp. paratuberculosis
ggcgacgacggcgg

SEQ ID NO: 883476 - RNA, 15 nt, Mycobacterium avium subsp. paratuberculosis
ggcgacgagguaggu

SEQ ID NO: 883477 - RNA, 19 nt, Mycobacterium avium subsp. paratuberculosis
ggcgaguucggcggcccgc

SEQ ID NO: 883478 - RNA, 20 nt, Mycobacterium avium subsp. paratuberculosis
ggcgaguucggcggcccgcu

SEQ ID NO: 883479 - RNA, 22 nt, Mycobacterium avium subsp. paratuberculosis
ggcgaguucugguaggcggccg

SEQ ID NO: 883480 - RNA, 18 nt, Mycobacterium avium subsp. paratuberculosis
ggcgaguaaggccgaggc

SEQ ID NO: 883481 - RNA, 16 nt, Mycobacterium avium subsp. paratuberculosis
ggcgaguacaccucga

SEQ ID NO: 883482 - RNA, 14 nt, Mycobacterium avium subsp. paratuberculosis
ggcgagucccggcg

SEQ ID NO: 883483 - RNA, 18 nt, Mycobacterium avium subsp. paratuberculosis
ggcgagucccggcgcacc

SEQ ID NO: 883484 - RNA, 23 nt, Mycobacterium avium subsp. paratuberculosis
ggcgaguccggccaggucgccgc

SEQ ID NO: 883485 - RNA, 23 nt, Mycobacterium avium subsp. paratuberculosis
ggcgagucguacuucgcccccgg

SEQ ID NO: 883486 - RNA, 13 nt, Mycobacterium avium subsp. paratuberculosis
ggcgagugaggac

SEQ ID NO: 883487 - RNA, 18 nt, Mycobacterium avium subsp. paratuberculosis
ggcgagugaggccgaggc

SEQ ID NO: 883488 - RNA, 23 nt, Mycobacterium avium subsp. paratuberculosis
ggcgaguuaugccgucacccaga

SEQ ID NO: 883489 - RNA, 23 nt, Mycobacterium avium subsp. paratuberculosis
ggcgaguucagaagucgcccgcg

SEQ ID NO: 883490 - RNA, 14 nt, Mycobacterium avium subsp. paratuberculosis
ggcgaguucgccug

SEQ ID NO: 883491 - RNA, 18 nt, Mycobacterium avium subsp. paratuberculosis
ggcgaucagggcggcgcc

SEQ ID NO: 883492 - RNA, 19 nt, Mycobacterium avium subsp. paratuberculosis
ggcgaucagggcggcgccg

SEQ ID NO: 883493 - RNA, 20 nt, Mycobacterium avium subsp. paratuberculosis
ggcgaucagggcggcgccgc

SEQ ID NO: 883494 - RNA, 21 nt, Mycobacterium avium subsp. paratuberculosis
ggcgaucagggcggcgccgcg

SEQ ID NO: 883495 - RNA, 21 nt, Mycobacterium avium subsp. paratuberculosis
ggcgaucagcagcacccgggc

SEQ ID NO: 883496 - RNA, 14 nt, Mycobacterium avium subsp. paratuberculosis
ggcgaucagcgcgc

SEQ ID NO: 883497 - RNA, 20 nt, Mycobacterium avium subsp. paratuberculosis
ggcgaucagcgcgcacagcg

SEQ ID NO: 883498 - RNA, 23 nt, Mycobacterium avium subsp. paratuberculosis
ggcgaucagcgcgcacagcgcca

SEQ ID NO: 883499 - RNA, 22 nt, Mycobacterium avium subsp. paratuberculosis
ggcgaucagcccgcccaccacg

SEQ ID NO: 883500 - RNA, 23 nt, Mycobacterium avium subsp. paratuberculosis
ggcgaucagcuccuccugcggug

SEQ ID NO: 883501 - RNA, 19 nt, Mycobacterium avium subsp. paratuberculosis
ggcgaucagcugcccggag

SEQ ID NO: 883502 - RNA, 13 nt, Mycobacterium avium subsp. paratuberculosis
ggcgaucaccgcg

SEQ ID NO: 883503 - RNA, 17 nt, Mycobacterium avium subsp. paratuberculosis
ggcgaucaccgcggcca

SEQ ID NO: 883504 - RNA, 22 nt, Mycobacterium avium subsp. paratuberculosis
ggcgaucaccgcguucucggcg

SEQ ID NO: 883505 - RNA, 19 nt, Mycobacterium avium subsp. paratuberculosis
ggcgaucaccgggacaccg

SEQ ID NO: 883506 - RNA, 16 nt, Mycobacterium avium subsp. paratuberculosis
ggcgaucaccccggcg

SEQ ID NO: 883507 - RNA, 19 nt, Mycobacterium avium subsp. paratuberculosis
ggcgaucaccccggcgacg

SEQ ID NO: 883508 - RNA, 15 nt, Mycobacterium avium subsp. paratuberculosis
ggcgauaggcggcca

SEQ ID NO: 883509 - RNA, 17 nt, Mycobacterium avium subsp. paratuberculosis
ggcgauaggcggccagc

SEQ ID NO: 883510 - RNA, 14 nt, Mycobacterium avium subsp. paratuberculosis
ggcgaggucgucga

SEQ ID NO: 883511 - RNA, 20 nt, Mycobacterium avium subsp. paratuberculosis
ggcgaggucgucgagggcca

SEQ ID NO: 883512 - RNA, 16 nt, Mycobacterium avium subsp. paratuberculosis
ggcgaggucguucgac

SEQ ID NO: 883513 - RNA, 20 nt, Mycobacterium avium subsp. paratuberculosis
ggcgaggugggcaccagcug

SEQ ID NO: 883514 - RNA, 15 nt, Mycobacterium avium subsp. paratuberculosis
ggcgagggcaacguc

SEQ ID NO: 883515 - RNA, 14 nt, Mycobacterium avium subsp. paratuberculosis
ggcgagcuggccgc

SEQ ID NO: 883516 - RNA, 17 nt, Mycobacterium avium subsp. paratuberculosis
ggcgaggaacccgaccg

SEQ ID NO: 883517 - RNA, 19 nt, Mycobacterium avium subsp. paratuberculosis
ggcgaggaacccgaccgcg

SEQ ID NO: 883518 - RNA, 20 nt, Mycobacterium avium subsp. paratuberculosis
ggcgaggaacccgaccgcga

SEQ ID NO: 883519 - RNA, 17 nt, Mycobacterium avium subsp. paratuberculosis
ggcgaggaaguccggcg

SEQ ID NO: 883520 - RNA, 19 nt, Mycobacterium avium subsp. paratuberculosis
ggcgaggaaguccggcgcg

SEQ ID NO: 883521 - RNA, 23 nt, Mycobacterium avium subsp. paratuberculosis
ggcgaggaaguccggcgcgcccg

SEQ ID NO: 883522 - RNA, 15 nt, Mycobacterium avium subsp. paratuberculosis
ggcgagcuuggcggg

SEQ ID NO: 883523 - RNA, 19 nt, Mycobacterium avium subsp. paratuberculosis
ggcgagcuuggcgguguuc

SEQ ID NO: 883524 - RNA, 20 nt, Mycobacterium avium subsp. paratuberculosis
ggcgaggacgucgucgacgu

SEQ ID NO: 883525 - RNA, 15 nt, Mycobacterium avium subsp. paratuberculosis
ggcgaggauggcgau

SEQ ID NO: 883526 - RNA, 20 nt, Mycobacterium avium subsp. paratuberculosis
ggcgaggauggcgaucauca

SEQ ID NO: 883527 - RNA, 14 nt, Mycobacterium avium subsp. paratuberculosis
ggcgaggccaggcg

SEQ ID NO: 883528 - RNA, 15 nt, Mycobacterium avium subsp. paratuberculosis
ggcgaggccaggcgu

SEQ ID NO: 883529 - RNA, 13 nt, Mycobacterium avium subsp. paratuberculosis
ggcgagcgcgcug

SEQ ID NO: 883530 - RNA, 14 nt, Mycobacterium avium subsp. paratuberculosis
ggcgagcgcgcuga

SEQ ID NO: 883531 - RNA, 21 nt, Mycobacterium avium subsp. paratuberculosis
ggcgagcgcgcugaucgccgc

SEQ ID NO: 883532 - RNA, 22 nt, Mycobacterium avium subsp. paratuberculosis
ggcgagcgcgcugaucgccgcu

SEQ ID NO: 883533 - RNA, 15 nt, Mycobacterium avium subsp. paratuberculosis
ggcgagccggcccgg

SEQ ID NO: 883534 - RNA, 16 nt, Mycobacterium avium subsp. paratuberculosis
ggcgagccggcccggg

SEQ ID NO: 883535 - RNA, 21 nt, Mycobacterium avium subsp. paratuberculosis
ggcgagccggcccggggugug

SEQ ID NO: 883536 - RNA, 17 nt, Mycobacterium avium subsp. paratuberculosis
ggcgagcgcgugcacga

SEQ ID NO: 883537 - RNA, 21 nt, Mycobacterium avium subsp. paratuberculosis
ggcgagcgcguucuccaccgc

SEQ ID NO: 883538 - RNA, 22 nt, Mycobacterium avium subsp. paratuberculosis
ggcgagcgcguucuccaccgcg

SEQ ID NO: 883539 - RNA, 13 nt, Mycobacterium avium subsp. paratuberculosis
ggcgagcggcccu

SEQ ID NO: 883540 - RNA, 14 nt, Mycobacterium avium subsp. paratuberculosis
ggcgagcggcccug

SEQ ID NO: 883541 - RNA, 14 nt, Mycobacterium avium subsp. paratuberculosis
ggcgagcucgcggc

SEQ ID NO: 883542 - RNA, 15 nt, Mycobacterium avium subsp. paratuberculosis
ggcgagcgucgccgc

SEQ ID NO: 883543 - RNA, 15 nt, Mycobacterium avium subsp. paratuberculosis
ggcgagcugaccggc

SEQ ID NO: 883544 - RNA, 21 nt, Mycobacterium avium subsp. paratuberculosis
ggcgagcugaucggcguuggc

SEQ ID NO: 883545 - RNA, 22 nt, Mycobacterium avium subsp. paratuberculosis
ggcgagcugcgggugcucagcc

SEQ ID NO: 883546 - RNA, 13 nt, Mycobacterium avium subsp. paratuberculosis
ggcgaucaucgcc

SEQ ID NO: 883547 - RNA, 17 nt, Mycobacterium avium subsp. paratuberculosis
ggcgaucaucgccccgg

SEQ ID NO: 883548 - RNA, 18 nt, Mycobacterium avium subsp. paratuberculosis
ggcgaucaucgccccgga

SEQ ID NO: 883549 - RNA, 12 nt, Mycobacterium avium subsp. paratuberculosis
ggcgauccgcgc

SEQ ID NO: 883550 - RNA, 15 nt, Mycobacterium avium subsp. paratuberculosis
ggcgauccgcgcggc

SEQ ID NO: 883551 - RNA, 19 nt, Mycobacterium avium subsp. paratuberculosis
ggcgauccgcgcggcgacg

SEQ ID NO: 883552 - RNA, 16 nt, Mycobacterium avium subsp. paratuberculosis
ggcgaucaucgucguc

SEQ ID NO: 883553 - RNA, 18 nt, Mycobacterium avium subsp. paratuberculosis
ggcgaucaucgucgucac

SEQ ID NO: 883554 - RNA, 21 nt, Mycobacterium avium subsp. paratuberculosis
ggcgauccgcaggccgucgcc

SEQ ID NO: 883555 - RNA, 15 nt, Mycobacterium avium subsp. paratuberculosis
ggcgauccggccggc

SEQ ID NO: 883556 - RNA, 14 nt, Mycobacterium avium subsp. paratuberculosis
ggcgauccgggcac

SEQ ID NO: 883557 - RNA, 14 nt, Mycobacterium avium subsp. paratuberculosis
ggcgaucgcgagca

SEQ ID NO: 883558 - RNA, 16 nt, Mycobacterium avium subsp. paratuberculosis
ggcgaucgcgagcagg

SEQ ID NO: 883559 - RNA, 15 nt, Mycobacterium avium subsp. paratuberculosis
ggcgaucgcgcgcac

SEQ ID NO: 883560 - RNA, 14 nt, Mycobacterium avium subsp. paratuberculosis
ggcgaucgcggcca

SEQ ID NO: 883561 - RNA, 15 nt, Mycobacterium avium subsp. paratuberculosis
ggcgaucgcggccac

SEQ ID NO: 883562 - RNA, 14 nt, Mycobacterium avium subsp. paratuberculosis
ggcgaucggccgcu

SEQ ID NO: 883563 - RNA, 19 nt, Mycobacterium avium subsp. paratuberculosis
ggcgaucggccgcugcggg

SEQ ID NO: 883564 - RNA, 21 nt, Mycobacterium avium subsp. paratuberculosis
ggcgaucggccgcugcgggcg

SEQ ID NO: 883565 - RNA, 16 nt, Mycobacterium avium subsp. paratuberculosis
ggcgaucggcgcggcg

SEQ ID NO: 883566 - RNA, 18 nt, Mycobacterium avium subsp. paratuberculosis
ggcgaucggcgguccgcc

SEQ ID NO: 883567 - RNA, 15 nt, Mycobacterium avium subsp. paratuberculosis
ggcgaucgccgggga

SEQ ID NO: 883568 - RNA, 15 nt, Mycobacterium avium subsp. paratuberculosis
ggcgaucgccguggu

SEQ ID NO: 883569 - RNA, 12 nt, Mycobacterium avium subsp. paratuberculosis
ggcgaucgccuc

SEQ ID NO: 883570 - RNA, 17 nt, Mycobacterium avium subsp. paratuberculosis
ggcgaucgccucggccu

SEQ ID NO: 883571 - RNA, 20 nt, Mycobacterium avium subsp. paratuberculosis
ggcgaucgggaacagcccgc

SEQ ID NO: 883572 - RNA, 14 nt, Mycobacterium avium subsp. paratuberculosis
ggcgaucgggucac

SEQ ID NO: 883573 - RNA, 19 nt, Mycobacterium avium subsp. paratuberculosis
ggcgaucgacgucaccacc

SEQ ID NO: 883574 - RNA, 13 nt, Mycobacterium avium subsp. paratuberculosis
ggcgaucgauccc

SEQ ID NO: 883575 - RNA, 22 nt, Mycobacterium avium subsp. paratuberculosis
ggcgaucgaucccuuggcggcg

SEQ ID NO: 883576 - RNA, 14 nt, Mycobacterium avium subsp. paratuberculosis
ggcgaucgaugccc

SEQ ID NO: 883577 - RNA, 23 nt, Mycobacterium avium subsp. paratuberculosis
ggcgaucgaugcccagcgcgcgg

SEQ ID NO: 883578 - RNA, 19 nt, Mycobacterium avium subsp. paratuberculosis
ggcgaucucuucgaugccg

SEQ ID NO: 883579 - RNA, 14 nt, Mycobacterium avium subsp. paratuberculosis
ggcgaucuggcggu

SEQ ID NO: 883580 - RNA, 16 nt, Mycobacterium avium subsp. paratuberculosis
ggcgaugaccagcgcg

SEQ ID NO: 883581 - RNA, 20 nt, Mycobacterium avium subsp. paratuberculosis
ggcgaugaagccggcgaacu

SEQ ID NO: 883582 - RNA, 22 nt, Mycobacterium avium subsp. paratuberculosis
ggcgaucucggagaccuuggcg

SEQ ID NO: 883583 - RNA, 13 nt, Mycobacterium avium subsp. paratuberculosis
ggcgaucucggcg

SEQ ID NO: 883584 - RNA, 15 nt, Mycobacterium avium subsp. paratuberculosis
ggcgaucucggcggc

SEQ ID NO: 883585 - RNA, 18 nt, Mycobacterium avium subsp. paratuberculosis
ggcgaucucggucaccga

SEQ ID NO: 883586 - RNA, 23 nt, Mycobacterium avium subsp. paratuberculosis
ggcgaucucgguuuccacgucgc

SEQ ID NO: 883587 - RNA, 20 nt, Mycobacterium avium subsp. paratuberculosis
ggcgaucucgucccacggcg

SEQ ID NO: 883588 - RNA, 16 nt, Mycobacterium avium subsp. paratuberculosis
ggcgaucucgauggcc

SEQ ID NO: 883589 - RNA, 19 nt, Mycobacterium avium subsp. paratuberculosis
ggcgaucucgauggccacg

SEQ ID NO: 883590 - RNA, 14 nt, Mycobacterium avium subsp. paratuberculosis
ggcgaucucgaugu

SEQ ID NO: 883591 - RNA, 20 nt, Mycobacterium avium subsp. paratuberculosis
ggcgaucucgauguagagcg

SEQ ID NO: 883592 - RNA, 13 nt, Mycobacterium avium subsp. paratuberculosis
ggcgaucgucgcc

SEQ ID NO: 883593 - RNA, 16 nt, Mycobacterium avium subsp. paratuberculosis
ggcgaucgucgccguc

SEQ ID NO: 883594 - RNA, 19 nt, Mycobacterium avium subsp. paratuberculosis
ggcgaucuccagcggccgg

SEQ ID NO: 883595 - RNA, 14 nt, Mycobacterium avium subsp. paratuberculosis
ggcgaugccgacac

SEQ ID NO: 883596 - RNA, 23 nt, Mycobacterium avium subsp. paratuberculosis
ggcgaugccgacaccccacaccg

SEQ ID NO: 883597 - RNA, 12 nt, Mycobacterium avium subsp. paratuberculosis
ggcgaugccgag

SEQ ID NO: 883598 - RNA, 13 nt, Mycobacterium avium subsp. paratuberculosis
ggcgaugcccgug

SEQ ID NO: 883599 - RNA, 21 nt, Mycobacterium avium subsp. paratuberculosis
ggcgaugcccgugaucgccac

SEQ ID NO: 883600 - RNA, 15 nt, Mycobacterium avium subsp. paratuberculosis
ggcgaugccgugcug

SEQ ID NO: 883601 - RNA, 13 nt, Mycobacterium avium subsp. paratuberculosis
ggcgaugccgccg

SEQ ID NO: 883602 - RNA, 16 nt, Mycobacterium avium subsp. paratuberculosis
ggcgaugccgccgacg

SEQ ID NO: 883603 - RNA, 19 nt, Mycobacterium avium subsp. paratuberculosis
ggcgaugccuuccucggcg

SEQ ID NO: 883604 - RNA, 15 nt, Mycobacterium avium subsp. paratuberculosis
ggcgauucgucgucg

SEQ ID NO: 883605 - RNA, 21 nt, Mycobacterium avium subsp. paratuberculosis
ggcgaugccagcgcaccgggc

SEQ ID NO: 883606 - RNA, 23 nt, Mycobacterium avium subsp. paratuberculosis
ggcgaugacgaauuccgcaccgg

SEQ ID NO: 883607 - RNA, 14 nt, Mycobacterium avium subsp. paratuberculosis
ggcgaugaccggac

SEQ ID NO: 883608 - RNA, 15 nt, Mycobacterium avium subsp. paratuberculosis
ggcgaugaccgggac

SEQ ID NO: 883609 - RNA, 13 nt, Mycobacterium avium subsp. paratuberculosis
ggcgaugaucagg

SEQ ID NO: 883610 - RNA, 17 nt, Mycobacterium avium subsp. paratuberculosis
ggcgaugaucaggccgg

SEQ ID NO: 883611 - RNA, 19 nt, Mycobacterium avium subsp. paratuberculosis
ggcgaugauccgcggcgcc

SEQ ID NO: 883612 - RNA, 19 nt, Mycobacterium avium subsp. paratuberculosis
ggcgcacaucguggcgacg

SEQ ID NO: 883613 - RNA, 21 nt, Mycobacterium avium subsp. paratuberculosis
ggcgcacaucguggcgacgac

SEQ ID NO: 883614 - RNA, 23 nt, Mycobacterium avium subsp. paratuberculosis
ggcgcacaucguggcgacgacgc

SEQ ID NO: 883615 - RNA, 14 nt, Mycobacterium avium subsp. paratuberculosis
ggcgcaccagcuga

SEQ ID NO: 883616 - RNA, 13 nt, Mycobacterium avium subsp. paratuberculosis
ggcgcaccaccag

SEQ ID NO: 883617 - RNA, 22 nt, Mycobacterium avium subsp. paratuberculosis
ggcgcaccaccagcucgucgcc

SEQ ID NO: 883618 - RNA, 17 nt, Mycobacterium avium subsp. paratuberculosis
ggcgcaccaggcgccac

SEQ ID NO: 883619 - RNA, 18 nt, Mycobacterium avium subsp. paratuberculosis
ggcgcaccaggcgccaca

SEQ ID NO: 883620 - RNA, 21 nt, Mycobacterium avium subsp. paratuberculosis
ggcgcaccaggcgccacagca

SEQ ID NO: 883621 - RNA, 22 nt, Mycobacterium avium subsp. paratuberculosis
ggcgcaccaggcgccacagcag

SEQ ID NO: 883622 - RNA, 18 nt, Mycobacterium avium subsp. paratuberculosis
ggcgauuucgucggcggu

SEQ ID NO: 883623 - RNA, 13 nt, Mycobacterium avium subsp. paratuberculosis
ggcgauuucggga

SEQ ID NO: 883624 - RNA, 14 nt, Mycobacterium avium subsp. paratuberculosis
ggcgauuucgggau

SEQ ID NO: 883625 - RNA, 21 nt, Mycobacterium avium subsp. paratuberculosis
ggccggcccagccuucgccgc

SEQ ID NO: 883626 - RNA, 15 nt, Mycobacterium avium subsp. paratuberculosis
ggccggcccagcgcg

SEQ ID NO: 883627 - RNA, 20 nt, Mycobacterium avium subsp. paratuberculosis
ggccggccccgcccggcgcg

SEQ ID NO: 883628 - RNA, 22 nt, Mycobacterium avium subsp. paratuberculosis
ggccggccccgggggaccagcg

SEQ ID NO: 883629 - RNA, 16 nt, Mycobacterium avium subsp. paratuberculosis
ggccggccgcgcccau

SEQ ID NO: 883630 - RNA, 14 nt, Mycobacterium avium subsp. paratuberculosis
ggccggccggacag

SEQ ID NO: 883631 - RNA, 17 nt, Mycobacterium avium subsp. paratuberculosis
ggccggccgagccgagc

SEQ ID NO: 883632 - RNA, 13 nt, Mycobacterium avium subsp. paratuberculosis
ggccggccgcagc

SEQ ID NO: 883633 - RNA, 12 nt, Mycobacterium avium subsp. paratuberculosis
ggccggccgccg

SEQ ID NO: 883634 - RNA, 15 nt, Mycobacterium avium subsp. paratuberculosis
ggccggccgccggcg

SEQ ID NO: 883635 - RNA, 14 nt, Mycobacterium avium subsp. paratuberculosis
ggccggcgacggcg

SEQ ID NO: 883636 - RNA, 18 nt, Mycobacterium avium subsp. paratuberculosis
ggccggcgaaccgccgca

SEQ ID NO: 883637 - RNA, 12 nt, Mycobacterium avium subsp. paratuberculosis
ggccggcgaagg

SEQ ID NO: 883638 - RNA, 20 nt, Mycobacterium avium subsp. paratuberculosis
ggccggcgagcucgcggccg

SEQ ID NO: 883639 - RNA, 17 nt, Mycobacterium avium subsp. paratuberculosis
ggccggcgagucgcgga

SEQ ID NO: 883640 - RNA, 20 nt, Mycobacterium avium subsp. paratuberculosis
ggccggcgaaacacagcagc

SEQ ID NO: 883641 - RNA, 17 nt, Mycobacterium avium subsp. paratuberculosis
ggccggccuugcucgcc

SEQ ID NO: 883642 - RNA, 19 nt, Mycobacterium avium subsp. paratuberculosis
ggccggccuugcucgccgc

SEQ ID NO: 883643 - RNA, 17 nt, Mycobacterium avium subsp. paratuberculosis
ggccggcgacgauaucg

SEQ ID NO: 883644 - RNA, 23 nt, Mycobacterium avium subsp. paratuberculosis
ggccggcgacgauaucggccgcg

SEQ ID NO: 883645 - RNA, 17 nt, Mycobacterium avium subsp. paratuberculosis
ggccggcgacgccgcgc

SEQ ID NO: 883646 - RNA, 18 nt, Mycobacterium avium subsp. paratuberculosis
ggccggcgacgccgcgcu

SEQ ID NO: 883647 - RNA, 23 nt, Mycobacterium avium subsp. paratuberculosis
ggccggcgacgccgcgcuggccg

SEQ ID NO: 883648 - RNA, 17 nt, Mycobacterium avium subsp. paratuberculosis
ggccggcgacgccggcg

SEQ ID NO: 883649 - RNA, 17 nt, Mycobacterium avium subsp. paratuberculosis
ggccggccugccaccgc

SEQ ID NO: 883650 - RNA, 19 nt, Mycobacterium avium subsp. paratuberculosis
ggccggccugccaccgcga

SEQ ID NO: 883651 - RNA, 20 nt, Mycobacterium avium subsp. paratuberculosis
ggccggccugccaccgcgaa

SEQ ID NO: 883652 - RNA, 21 nt, Mycobacterium avium subsp. paratuberculosis
ggccggccugccaccgcgaau

SEQ ID NO: 883653 - RNA, 13 nt, Mycobacterium avium subsp. paratuberculosis
ggccggccggguc

SEQ ID NO: 883654 - RNA, 14 nt, Mycobacterium avium subsp. paratuberculosis
ggccggccggguca

SEQ ID NO: 883655 - RNA, 16 nt, Mycobacterium avium subsp. paratuberculosis
ggccggccggccgugc

SEQ ID NO: 883656 - RNA, 13 nt, Mycobacterium avium subsp. paratuberculosis
ggccggccggccu

SEQ ID NO: 883657 - RNA, 17 nt, Mycobacterium avium subsp. paratuberculosis
ggccggccucgaugucg

SEQ ID NO: 883658 - RNA, 13 nt, Mycobacterium avium subsp. paratuberculosis
ggccggaggugcg

SEQ ID NO: 883659 - RNA, 21 nt, Mycobacterium avium subsp. paratuberculosis
ggccggagccuucuucgccgc

SEQ ID NO: 883660 - RNA, 22 nt, Mycobacterium avium subsp. paratuberculosis
ggccggagccuucuucgccgca

SEQ ID NO: 883661 - RNA, 23 nt, Mycobacterium avium subsp. paratuberculosis
ggccggagccuuggucgcggccu

SEQ ID NO: 883662 - RNA, 13 nt, Mycobacterium avium subsp. paratuberculosis
ggccggagcggau

SEQ ID NO: 883663 - RNA, 14 nt, Mycobacterium avium subsp. paratuberculosis
ggccggagcggaug

SEQ ID NO: 883664 - RNA, 15 nt, Mycobacterium avium subsp. paratuberculosis
ggccggagcggugcg

SEQ ID NO: 883665 - RNA, 12 nt, Mycobacterium avium subsp. paratuberculosis
ggccggacgggu

SEQ ID NO: 883666 - RNA, 20 nt, Mycobacterium avium subsp. paratuberculosis
ggccggacgggucgaccgcc

SEQ ID NO: 883667 - RNA, 13 nt, Mycobacterium avium subsp. paratuberculosis
ggccggacgguga

SEQ ID NO: 883668 - RNA, 15 nt, Mycobacterium avium subsp. paratuberculosis
ggccggagaccgccg

SEQ ID NO: 883669 - RNA, 23 nt, Mycobacterium avium subsp. paratuberculosis
ggccggagaccgccguggcguua

SEQ ID NO: 883670 - RNA, 14 nt, Mycobacterium avium subsp. paratuberculosis
ggccggagaucccg

SEQ ID NO: 883671 - RNA, 16 nt, Mycobacterium avium subsp. paratuberculosis
ggccggaccguucggu

SEQ ID NO: 883672 - RNA, 13 nt, Mycobacterium avium subsp. paratuberculosis
ggccgcucagcgg

SEQ ID NO: 883673 - RNA, 14 nt, Mycobacterium avium subsp. paratuberculosis
ggccgcucagcggg

SEQ ID NO: 883674 - RNA, 20 nt, Mycobacterium avium subsp. paratuberculosis
ggccgcucagcgggcggcca

SEQ ID NO: 883675 - RNA, 19 nt, Mycobacterium avium subsp. paratuberculosis
ggccgcucgcgggccacag

SEQ ID NO: 883676 - RNA, 17 nt, Mycobacterium avium subsp. paratuberculosis
ggccgcguugucgacca

SEQ ID NO: 883677 - RNA, 18 nt, Mycobacterium avium subsp. paratuberculosis
ggccgcguugucgaccac

SEQ ID NO: 883678 - RNA, 19 nt, Mycobacterium avium subsp. paratuberculosis
ggccgcguugucgaccacc

SEQ ID NO: 883679 - RNA, 23 nt, Mycobacterium avium subsp. paratuberculosis
ggccgcguugucgaccaccaggu

SEQ ID NO: 883680 - RNA, 16 nt, Mycobacterium avium subsp. paratuberculosis
ggccgcgugcaacaca

SEQ ID NO: 883681 - RNA, 13 nt, Mycobacterium avium subsp. paratuberculosis
ggccgggucgacc

SEQ ID NO: 883682 - RNA, 22 nt, Mycobacterium avium subsp. paratuberculosis
ggccgggucgagcgcgccgaga

SEQ ID NO: 883683 - RNA, 18 nt, Mycobacterium avium subsp. paratuberculosis
ggccgggucgcaggcagc

SEQ ID NO: 883684 - RNA, 14 nt, Mycobacterium avium subsp. paratuberculosis
ggccgggucgccgu

SEQ ID NO: 883685 - RNA, 15 nt, Mycobacterium avium subsp. paratuberculosis
ggccgggucgccguc

SEQ ID NO: 883686 - RNA, 16 nt, Mycobacterium avium subsp. paratuberculosis
ggccgggucgccgucg

SEQ ID NO: 883687 - RNA, 18 nt, Mycobacterium avium subsp. paratuberculosis
ggccgggucgccgucgag

SEQ ID NO: 883688 - RNA, 14 nt, Mycobacterium avium subsp. paratuberculosis
ggccggggccagca

SEQ ID NO: 883689 - RNA, 19 nt, Mycobacterium avium subsp. paratuberculosis
ggccggguccacgccgagg

SEQ ID NO: 883690 - RNA, 14 nt, Mycobacterium avium subsp. paratuberculosis
ggccgggucgaacg

SEQ ID NO: 883691 - RNA, 17 nt, Mycobacterium avium subsp. paratuberculosis
ggccgggggcggcggcg

SEQ ID NO: 883692 - RNA, 22 nt, Mycobacterium avium subsp. paratuberculosis
ggccgggggcggcggcgcgugc

SEQ ID NO: 883693 - RNA, 13 nt, Mycobacterium avium subsp. paratuberculosis
ggccggggcgcca

SEQ ID NO: 883694 - RNA, 15 nt, Mycobacterium avium subsp. paratuberculosis
ggccggggcggcggu

SEQ ID NO: 883695 - RNA, 14 nt, Mycobacterium avium subsp. paratuberculosis
ggccggggcgggca

SEQ ID NO: 883696 - RNA, 22 nt, Mycobacterium avium subsp. paratuberculosis
ggccggggcgggcacgucgcgc

SEQ ID NO: 883697 - RNA, 18 nt, Mycobacterium avium subsp. paratuberculosis
ggccggggcuucgaacgc

SEQ ID NO: 883698 - RNA, 17 nt, Mycobacterium avium subsp. paratuberculosis
ggccggggcagacccgc

SEQ ID NO: 883699 - RNA, 22 nt, Mycobacterium avium subsp. paratuberculosis
ggccgggagugcuggacggccc

SEQ ID NO: 883700 - RNA, 19 nt, Mycobacterium avium subsp. paratuberculosis
ggccggcucgaccucaccc

SEQ ID NO: 883701 - RNA, 21 nt, Mycobacterium avium subsp. paratuberculosis
ggccgggauagagcaccgcgc

SEQ ID NO: 883702 - RNA, 20 nt, Mycobacterium avium subsp. paratuberculosis
ggccgggaaugucgcgcagc

SEQ ID NO: 883703 - RNA, 21 nt, Mycobacterium avium subsp. paratuberculosis
ggccgggaaugucgcgcagca

SEQ ID NO: 883704 - RNA, 18 nt, Mycobacterium avium subsp. paratuberculosis
ggccggcuucggccaagg

SEQ ID NO: 883705 - RNA, 14 nt, Mycobacterium avium subsp. paratuberculosis
ggccggcuucucgg

SEQ ID NO: 883706 - RNA, 17 nt, Mycobacterium avium subsp. paratuberculosis
ggccggcuucucggcgu

SEQ ID NO: 883707 - RNA, 23 nt, Mycobacterium avium subsp. paratuberculosis
ggccggcuucucggcgugcccgc

SEQ ID NO: 883708 - RNA, 16 nt, Mycobacterium avium subsp. paratuberculosis
ggccggcugcagccgg

SEQ ID NO: 883709 - RNA, 22 nt, Mycobacterium avium subsp. paratuberculosis
ggccggcugcagccgggcggcg

SEQ ID NO: 883710 - RNA, 17 nt, Mycobacterium avium subsp. paratuberculosis
ggccggcuaccgcgcgg

SEQ ID NO: 883711 - RNA, 17 nt, Mycobacterium avium subsp. paratuberculosis
ggccggcgugggaacca

SEQ ID NO: 883712 - RNA, 21 nt, Mycobacterium avium subsp. paratuberculosis
ggccggcgccgaagccgucga

SEQ ID NO: 883713 - RNA, 20 nt, Mycobacterium avium subsp. paratuberculosis
ggccggcgugcugggccacg

SEQ ID NO: 883714 - RNA, 15 nt, Mycobacterium avium subsp. paratuberculosis
ggccggcgucgucga

SEQ ID NO: 883715 - RNA, 20 nt, Mycobacterium avium subsp. paratuberculosis
ggccggcgucacucuggcgu

SEQ ID NO: 883716 - RNA, 22 nt, Mycobacterium avium subsp. paratuberculosis
ggccggcgucacucuggcguga

SEQ ID NO: 883717 - RNA, 21 nt, Mycobacterium avium subsp. paratuberculosis
ggccggcguccaguugcggca

SEQ ID NO: 883718 - RNA, 20 nt, Mycobacterium avium subsp. paratuberculosis
ggccggcgcgaccagcggca

SEQ ID NO: 883719 - RNA, 23 nt, Mycobacterium avium subsp. paratuberculosis
ggccggcgcgaccagcggcagca

SEQ ID NO: 883720 - RNA, 15 nt, Mycobacterium avium subsp. paratuberculosis
ggccggcgccggugc

SEQ ID NO: 883721 - RNA, 20 nt, Mycobacterium avium subsp. paratuberculosis
ggccggcgccggcggucagc

SEQ ID NO: 883722 - RNA, 13 nt, Mycobacterium avium subsp. paratuberculosis
ggccggcgccgcc

SEQ ID NO: 883723 - RNA, 17 nt, Mycobacterium avium subsp. paratuberculosis
ggccggcgccgaccgag

SEQ ID NO: 883724 - RNA, 14 nt, Mycobacterium avium subsp. paratuberculosis
ggccggcgccgacg

SEQ ID NO: 883725 - RNA, 17 nt, Mycobacterium avium subsp. paratuberculosis
ggccggcgccgacgacg

SEQ ID NO: 883726 - RNA, 12 nt, Mycobacterium avium subsp. paratuberculosis
ggccggcgaugc

SEQ ID NO: 883727 - RNA, 23 nt, Mycobacterium avium subsp. paratuberculosis
ggccggcgaugcccgugaucgcc

SEQ ID NO: 883728 - RNA, 16 nt, Mycobacterium avium subsp. paratuberculosis
ggccggcgauggcgcg

SEQ ID NO: 883729 - RNA, 15 nt, Mycobacterium avium subsp. paratuberculosis
ggccgcgccgaucac

SEQ ID NO: 883730 - RNA, 13 nt, Mycobacterium avium subsp. paratuberculosis
ggccgcgccgagg

SEQ ID NO: 883731 - RNA, 23 nt, Mycobacterium avium subsp. paratuberculosis
ggccgcgccgaacaccacgccga

SEQ ID NO: 883732 - RNA, 13 nt, Mycobacterium avium subsp. paratuberculosis
ggccgcgccacag

SEQ ID NO: 883733 - RNA, 19 nt, Mycobacterium avium subsp. paratuberculosis
ggccgcgccguugaccgcg

SEQ ID NO: 883734 - RNA, 20 nt, Mycobacterium avium subsp. paratuberculosis
ggccgcgccguugaccgcgg

SEQ ID NO: 883735 - RNA, 14 nt, Mycobacterium avium subsp. paratuberculosis
ggccgcgccguagc

SEQ ID NO: 883736 - RNA, 17 nt, Mycobacterium avium subsp. paratuberculosis
ggccgcgccgugcgcca

SEQ ID NO: 883737 - RNA, 19 nt, Mycobacterium avium subsp. paratuberculosis
ggccgcgccgugcgccagc

SEQ ID NO: 883738 - RNA, 15 nt, Mycobacterium avium subsp. paratuberculosis
ggccgcgccggaugg

SEQ ID NO: 883739 - RNA, 13 nt, Mycobacterium avium subsp. paratuberculosis
ggccgcgccggcc

SEQ ID NO: 883740 - RNA, 22 nt, Mycobacterium avium subsp. paratuberculosis
ggccgcgccgccgcccuggccc

SEQ ID NO: 883741 - RNA, 13 nt, Mycobacterium avium subsp. paratuberculosis
ggccgcgccgccg

SEQ ID NO: 883742 - RNA, 16 nt, Mycobacterium avium subsp. paratuberculosis
ggccgcgccgccgacc

SEQ ID NO: 883743 - RNA, 20 nt, Mycobacterium avium subsp. paratuberculosis
ggccgcgccgccgaccacgc

SEQ ID NO: 883744 - RNA, 12 nt, Mycobacterium avium subsp. paratuberculosis
ggccgcgcgcag

SEQ ID NO: 883745 - RNA, 14 nt, Mycobacterium avium subsp. paratuberculosis
ggccgcgcgcggcg

SEQ ID NO: 883746 - RNA, 18 nt, Mycobacterium avium subsp. paratuberculosis
ggccgcgcgcggcgcgga

SEQ ID NO: 883747 - RNA, 17 nt, Mycobacterium avium subsp. paratuberculosis
ggccgcgcccaucgcgg

SEQ ID NO: 883748 - RNA, 20 nt, Mycobacterium avium subsp. paratuberculosis
ggccgcgcccaucgcggccg

SEQ ID NO: 883749 - RNA, 21 nt, Mycobacterium avium subsp. paratuberculosis
ggccgcgcccaucgcggccgc

SEQ ID NO: 883750 - RNA, 23 nt, Mycobacterium avium subsp. paratuberculosis
ggccgcgcccaucgcggccgccc

SEQ ID NO: 883751 - RNA, 17 nt, Mycobacterium avium subsp. paratuberculosis
ggccgaucagcugcucg

SEQ ID NO: 883752 - RNA, 18 nt, Mycobacterium avium subsp. paratuberculosis
ggccgaucagcugcucgg

SEQ ID NO: 883753 - RNA, 15 nt, Mycobacterium avium subsp. paratuberculosis
ggccgaucagcggcg

SEQ ID NO: 883754 - RNA, 19 nt, Mycobacterium avium subsp. paratuberculosis
ggccgaucagcggcgggcc

SEQ ID NO: 883755 - RNA, 13 nt, Mycobacterium avium subsp. paratuberculosis
ggccgaucaccuc

SEQ ID NO: 883756 - RNA, 18 nt, Mycobacterium avium subsp. paratuberculosis
ggccgaucaccucgaugg

SEQ ID NO: 883757 - RNA, 20 nt, Mycobacterium avium subsp. paratuberculosis
ggccgaucaccucgauggcc

SEQ ID NO: 883758 - RNA, 16 nt, Mycobacterium avium subsp. paratuberculosis
ggccgaguauccgcgc

SEQ ID NO: 883759 - RNA, 20 nt, Mycobacterium avium subsp. paratuberculosis
ggccgaguauccgcgcagcg

SEQ ID NO: 883760 - RNA, 16 nt, Mycobacterium avium subsp. paratuberculosis
ggccgaggucggucgc

SEQ ID NO: 883761 - RNA, 21 nt, Mycobacterium avium subsp. paratuberculosis
ggccgaggucggucgcggcau

SEQ ID NO: 883762 - RNA, 15 nt, Mycobacterium avium subsp. paratuberculosis
ggccgagucgacgug

SEQ ID NO: 883763 - RNA, 22 nt, Mycobacterium avium subsp. paratuberculosis
ggccgagucgacgugcucggcg

SEQ ID NO: 883764 - RNA, 15 nt, Mycobacterium avium subsp. paratuberculosis
ggccgcgucgccgac

SEQ ID NO: 883765 - RNA, 19 nt, Mycobacterium avium subsp. paratuberculosis
ggccgcgucgccgaccagc

SEQ ID NO: 883766 - RNA, 15 nt, Mycobacterium avium subsp. paratuberculosis
ggccgcgucgccgau

SEQ ID NO: 883767 - RNA, 12 nt, Mycobacterium avium subsp. paratuberculosis
ggccgcgucggc

SEQ ID NO: 883768 - RNA, 14 nt, Mycobacterium avium subsp. paratuberculosis
ggccgcgucggcca

SEQ ID NO: 883769 - RNA, 14 nt, Mycobacterium avium subsp. paratuberculosis
ggccgcgucggcgg

SEQ ID NO: 883770 - RNA, 15 nt, Mycobacterium avium subsp. paratuberculosis
ggccgcgucggcggc

SEQ ID NO: 883771 - RNA, 16 nt, Mycobacterium avium subsp. paratuberculosis
ggccgcgucggcggcg

SEQ ID NO: 883772 - RNA, 15 nt, Mycobacterium avium subsp. paratuberculosis
ggccgcgucggcggu

SEQ ID NO: 883773 - RNA, 22 nt, Mycobacterium avium subsp. paratuberculosis
ggccgcgucggcggucgccagc

SEQ ID NO: 883774 - RNA, 23 nt, Mycobacterium avium subsp. paratuberculosis
ggccgcgucggcggucgccagcg

SEQ ID NO: 883775 - RNA, 19 nt, Mycobacterium avium subsp. paratuberculosis
ggccgcgucgaccagccgg

SEQ ID NO: 883776 - RNA, 20 nt, Mycobacterium avium subsp. paratuberculosis
ggccgcguagcucgccgcgg

SEQ ID NO: 883777 - RNA, 21 nt, Mycobacterium avium subsp. paratuberculosis
ggccgcguagcucgccgcggc

SEQ ID NO: 883778 - RNA, 17 nt, Mycobacterium avium subsp. paratuberculosis
ggccgcggugaccgcgc

SEQ ID NO: 883779 - RNA, 15 nt, Mycobacterium avium subsp. paratuberculosis
ggccgcggucgcccc

SEQ ID NO: 883780 - RNA, 18 nt, Mycobacterium avium subsp. paratuberculosis
ggccgcggucgccccggc

SEQ ID NO: 883781 - RNA, 20 nt, Mycobacterium avium subsp. paratuberculosis
ggccgcggucgccccggccg

SEQ ID NO: 883782 - RNA, 17 nt, Mycobacterium avium subsp. paratuberculosis
ggccgcggguggcgcca

SEQ ID NO: 883783 - RNA, 16 nt, Mycobacterium avium subsp. paratuberculosis
ggccgcggggccggcg

SEQ ID NO: 883784 - RNA, 17 nt, Mycobacterium avium subsp. paratuberculosis
ggccgcggggccggcgc

SEQ ID NO: 883785 - RNA, 16 nt, Mycobacterium avium subsp. paratuberculosis
ggccgcgggcgggccg

SEQ ID NO: 883786 - RNA, 17 nt, Mycobacterium avium subsp. paratuberculosis
ggccgcgggcgggccga

SEQ ID NO: 883787 - RNA, 16 nt, Mycobacterium avium subsp. paratuberculosis
ggccgcggcgucggga

SEQ ID NO: 883788 - RNA, 14 nt, Mycobacterium avium subsp. paratuberculosis
ggccgcggcggugc

SEQ ID NO: 883789 - RNA, 19 nt, Mycobacterium avium subsp. paratuberculosis
ggccgcggcggugccggug

SEQ ID NO: 883790 - RNA, 15 nt, Mycobacterium avium subsp. paratuberculosis
ggccgcggcgcggcc

SEQ ID NO: 883791 - RNA, 18 nt, Mycobacterium avium subsp. paratuberculosis
ggccgcggcgcggcccgg

SEQ ID NO: 883792 - RNA, 15 nt, Mycobacterium avium subsp. paratuberculosis
ggccgcggcggcccg

SEQ ID NO: 883793 - RNA, 13 nt, Mycobacterium avium subsp. paratuberculosis
ggccgcggcgggc

SEQ ID NO: 883794 - RNA, 22 nt, Mycobacterium avium subsp. paratuberculosis
ggccgcggcgggcgcgucgagg

SEQ ID NO: 883795 - RNA, 13 nt, Mycobacterium avium subsp. paratuberculosis
ggccgcggcgccg

SEQ ID NO: 883796 - RNA, 17 nt, Mycobacterium avium subsp. paratuberculosis
ggccgcggcgccguuga

SEQ ID NO: 883797 - RNA, 14 nt, Mycobacterium avium subsp. paratuberculosis
ggccgcggcgaucg

SEQ ID NO: 883798 - RNA, 16 nt, Mycobacterium avium subsp. paratuberculosis
ggccgcggcgaucggc

SEQ ID NO: 883799 - RNA, 19 nt, Mycobacterium avium subsp. paratuberculosis
ggccgcggcgaucggcggu

SEQ ID NO: 883800 - RNA, 12 nt, Mycobacterium avium subsp. paratuberculosis
ggccgcggcgcg

SEQ ID NO: 883801 - RNA, 14 nt, Mycobacterium avium subsp. paratuberculosis
ggccgcggcgcgca

SEQ ID NO: 883802 - RNA, 15 nt, Mycobacterium avium subsp. paratuberculosis
ggccgcggccggcac

SEQ ID NO: 883803 - RNA, 14 nt, Mycobacterium avium subsp. paratuberculosis
ggccgcggccgucg

SEQ ID NO: 883804 - RNA, 18 nt, Mycobacterium avium subsp. paratuberculosis
ggccgcggccgucgucgu

SEQ ID NO: 883805 - RNA, 15 nt, Mycobacterium avium subsp. paratuberculosis
ggccgcggcccggcc

SEQ ID NO: 883806 - RNA, 13 nt, Mycobacterium avium subsp. paratuberculosis
ggccgcggccgcc

SEQ ID NO: 883807 - RNA, 14 nt, Mycobacterium avium subsp. paratuberculosis
ggccgcggccgccg

SEQ ID NO: 883808 - RNA, 14 nt, Mycobacterium avium subsp. paratuberculosis
ggccgcggccgccu

SEQ ID NO: 883809 - RNA, 13 nt, Mycobacterium avium subsp. paratuberculosis
ggccgcggccagc

SEQ ID NO: 883810 - RNA, 14 nt, Mycobacterium avium subsp. paratuberculosis
ggccgcggccagcg

SEQ ID NO: 883811 - RNA, 16 nt, Mycobacterium avium subsp. paratuberculosis
ggccgcggccagcgag

SEQ ID NO: 883812 - RNA, 17 nt, Mycobacterium avium subsp. paratuberculosis
ggccgcggccagcgagg

SEQ ID NO: 883813 - RNA, 15 nt, Mycobacterium avium subsp. paratuberculosis
ggccgcggccagcug

SEQ ID NO: 883814 - RNA, 16 nt, Mycobacterium avium subsp. paratuberculosis
ggccgcgcgcaucucg

SEQ ID NO: 883815 - RNA, 21 nt, Mycobacterium avium subsp. paratuberculosis
ggccgcggauggugacggccg

SEQ ID NO: 883816 - RNA, 14 nt, Mycobacterium avium subsp. paratuberculosis
ggccgcggccaagu

SEQ ID NO: 883817 - RNA, 16 nt, Mycobacterium avium subsp. paratuberculosis
ggccgcgcuguccacg

SEQ ID NO: 883818 - RNA, 14 nt, Mycobacterium avium subsp. paratuberculosis
ggccgcgcuggcca

SEQ ID NO: 883819 - RNA, 18 nt, Mycobacterium avium subsp. paratuberculosis
ggccgcgcuggcgcaggc

SEQ ID NO: 883820 - RNA, 14 nt, Mycobacterium avium subsp. paratuberculosis
ggccgcgcugguca

SEQ ID NO: 883821 - RNA, 15 nt, Mycobacterium avium subsp. paratuberculosis
ggccgcgcggugcuc

SEQ ID NO: 883822 - RNA, 16 nt, Mycobacterium avium subsp. paratuberculosis
ggccgcgcggugcucg

SEQ ID NO: 883823 - RNA, 19 nt, Mycobacterium avium subsp. paratuberculosis
ggccgcgcggugcucgccc

SEQ ID NO: 883824 - RNA, 18 nt, Mycobacterium avium subsp. paratuberculosis
ggccgcgcgugcccgcgg

SEQ ID NO: 883825 - RNA, 14 nt, Mycobacterium avium subsp. paratuberculosis
ggccgcgcgggcga

SEQ ID NO: 883826 - RNA, 19 nt, Mycobacterium avium subsp. paratuberculosis
ggccgcgcgcccgucgucg

SEQ ID NO: 883827 - RNA, 19 nt, Mycobacterium avium subsp. paratuberculosis
ggccugggcaauggccgcg

SEQ ID NO: 883828 - RNA, 16 nt, Mycobacterium avium subsp. paratuberculosis
ggccugggcgaccacg

SEQ ID NO: 883829 - RNA, 14 nt, Mycobacterium avium subsp. paratuberculosis
ggccuuggccaacg

SEQ ID NO: 883830 - RNA, 17 nt, Mycobacterium avium subsp. paratuberculosis
ggccuuggccaccacgc

SEQ ID NO: 883831 - RNA, 20 nt, Mycobacterium avium subsp. paratuberculosis
ggccuugccgaucagcuggc

SEQ ID NO: 883832 - RNA, 20 nt, Mycobacterium avium subsp. paratuberculosis
ggccuugcugagccggcccu

SEQ ID NO: 883833 - RNA, 22 nt, Mycobacterium avium subsp. paratuberculosis
ggccuugcugagccggcccugc

SEQ ID NO: 883834 - RNA, 15 nt, Mycobacterium avium subsp. paratuberculosis
ggccuugcugauccc

SEQ ID NO: 883835 - RNA, 19 nt, Mycobacterium avium subsp. paratuberculosis
ggccuugcugauccccagc

SEQ ID NO: 883836 - RNA, 23 nt, Mycobacterium avium subsp. paratuberculosis
ggccuugaccacggugcgcucgu

SEQ ID NO: 883837 - RNA, 18 nt, Mycobacterium avium subsp. paratuberculosis
ggccuucuggaagccugg

SEQ ID NO: 883838 - RNA, 22 nt, Mycobacterium avium subsp. paratuberculosis
ggccuucuggaagccuggcacg

SEQ ID NO: 883839 - RNA, 23 nt, Mycobacterium avium subsp. paratuberculosis
ggccuucuuggccggagccuugg

SEQ ID NO: 883840 - RNA, 16 nt, Mycobacterium avium subsp. paratuberculosis
ggccuucuuggcggcg

SEQ ID NO: 883841 - RNA, 21 nt, Mycobacterium avium subsp. paratuberculosis
ggccuucuuucguucgauguc

SEQ ID NO: 883842 - RNA, 22 nt, Mycobacterium avium subsp. paratuberculosis
ggccuucuuucguucgaugucg

SEQ ID NO: 883843 - RNA, 17 nt, Mycobacterium avium subsp. paratuberculosis
ggccuugacgacggcca

SEQ ID NO: 883844 - RNA, 18 nt, Mycobacterium avium subsp. paratuberculosis
ggccuucuucugccacuc

SEQ ID NO: 883845 - RNA, 19 nt, Mycobacterium avium subsp. paratuberculosis
ggccuucucgcgcaccgcg

SEQ ID NO: 883846 - RNA, 20 nt, Mycobacterium avium subsp. paratuberculosis
ggccuucucgcgcaccgcgg

SEQ ID NO: 883847 - RNA, 20 nt, Mycobacterium avium subsp. paratuberculosis
ggccuucgggguggucaccg

SEQ ID NO: 883848 - RNA, 21 nt, Mycobacterium avium subsp. paratuberculosis
ggccuucgggguggucaccgg

SEQ ID NO: 883849 - RNA, 17 nt, Mycobacterium avium subsp. paratuberculosis
ggccugcaacuggucgu

SEQ ID NO: 883850 - RNA, 18 nt, Mycobacterium avium subsp. paratuberculosis
ggccugcuugggcagcag

SEQ ID NO: 883851 - RNA, 21 nt, Mycobacterium avium subsp. paratuberculosis
ggccugcuugggcagcagcuc

SEQ ID NO: 883852 - RNA, 17 nt, Mycobacterium avium subsp. paratuberculosis
ggccugcuuuucggccg

SEQ ID NO: 883853 - RNA, 18 nt, Mycobacterium avium subsp. paratuberculosis
ggccugcuuuucggccga

SEQ ID NO: 883854 - RNA, 19 nt, Mycobacterium avium subsp. paratuberculosis
ggccugcuguuccucgaac

SEQ ID NO: 883855 - RNA, 16 nt, Mycobacterium avium subsp. paratuberculosis
ggccugcuugaccgcc

SEQ ID NO: 883856 - RNA, 20 nt, Mycobacterium avium subsp. paratuberculosis
ggccugcuugaccgccagac

SEQ ID NO: 883857 - RNA, 21 nt, Mycobacterium avium subsp. paratuberculosis
ggccugcucgcuugccagccg

SEQ ID NO: 883858 - RNA, 14 nt, Mycobacterium avium subsp. paratuberculosis
ggccuggaaccggg

SEQ ID NO: 883859 - RNA, 23 nt, Mycobacterium avium subsp. paratuberculosis
ggccuggcccaaaaacaucguca

SEQ ID NO: 883860 - RNA, 14 nt, Mycobacterium avium subsp. paratuberculosis
ggccuggcccagcc

SEQ ID NO: 883861 - RNA, 15 nt, Mycobacterium avium subsp. paratuberculosis
ggccuggcccagccg

SEQ ID NO: 883862 - RNA, 16 nt, Mycobacterium avium subsp. paratuberculosis
ggccuggcccagccgc

SEQ ID NO: 883863 - RNA, 18 nt, Mycobacterium avium subsp. paratuberculosis
ggccuccgugcuggccgg

SEQ ID NO: 883864 - RNA, 23 nt, Mycobacterium avium subsp. paratuberculosis
ggccuccuccucgcugccggccg

SEQ ID NO: 883865 - RNA, 16 nt, Mycobacterium avium subsp. paratuberculosis
ggccuccucggugacc

SEQ ID NO: 883866 - RNA, 16 nt, Mycobacterium avium subsp. paratuberculosis
ggccucucgucgacga

SEQ ID NO: 883867 - RNA, 17 nt, Mycobacterium avium subsp. paratuberculosis
ggccucucgucgacgau

SEQ ID NO: 883868 - RNA, 13 nt, Mycobacterium avium subsp. paratuberculosis
ggccucgacgauu

SEQ ID NO: 883869 - RNA, 16 nt, Mycobacterium avium subsp. paratuberculosis
ggccucgaggaucgcg

SEQ ID NO: 883870 - RNA, 18 nt, Mycobacterium avium subsp. paratuberculosis
ggccucgaggaucgcggc

SEQ ID NO: 883871 - RNA, 20 nt, Mycobacterium avium subsp. paratuberculosis
ggccucgaggaucgcggcca

SEQ ID NO: 883872 - RNA, 22 nt, Mycobacterium avium subsp. paratuberculosis
ggccucgaggaucgcggccacg

SEQ ID NO: 883873 - RNA, 19 nt, Mycobacterium avium subsp. paratuberculosis
ggccugagacgacgccacc

SEQ ID NO: 883874 - RNA, 17 nt, Mycobacterium avium subsp. paratuberculosis
ggccugagccgccgggg

SEQ ID NO: 883875 - RNA, 19 nt, Mycobacterium avium subsp. paratuberculosis
ggccugauugacggcccac

SEQ ID NO: 883876 - RNA, 20 nt, Mycobacterium avium subsp. paratuberculosis
ggccugauugacggcccacg

SEQ ID NO: 883877 - RNA, 16 nt, Mycobacterium avium subsp. paratuberculosis
ggccgguaucggguca

SEQ ID NO: 883878 - RNA, 20 nt, Mycobacterium avium subsp. paratuberculosis
ggccgguaucgggucaccgu

SEQ ID NO: 883879 - RNA, 17 nt, Mycobacterium avium subsp. paratuberculosis
ggccgguauuggccacg

SEQ ID NO: 883880 - RNA, 21 nt, Mycobacterium avium subsp. paratuberculosis
ggccgguauuggccacgcugg

SEQ ID NO: 883881 - RNA, 21 nt, Mycobacterium avium subsp. paratuberculosis
ggccggguuuucgggccgguc

SEQ ID NO: 883882 - RNA, 12 nt, Mycobacterium avium subsp. paratuberculosis
ggccggucagcg

SEQ ID NO: 883883 - RNA, 13 nt, Mycobacterium avium subsp. paratuberculosis
ggccggucagcga

SEQ ID NO: 883884 - RNA, 13 nt, Mycobacterium avium subsp. paratuberculosis
ggccggucagcgc

SEQ ID NO: 883885 - RNA, 15 nt, Mycobacterium avium subsp. paratuberculosis
ggccggucagcgcga

SEQ ID NO: 883886 - RNA, 23 nt, Mycobacterium avium subsp. paratuberculosis
ggccggucagcgcgacaucgccg

SEQ ID NO: 883887 - RNA, 14 nt, Mycobacterium avium subsp. paratuberculosis
ggccgguccccggc

SEQ ID NO: 883888 - RNA, 15 nt, Mycobacterium avium subsp. paratuberculosis
ggccgguccgcccag

SEQ ID NO: 883889 - RNA, 16 nt, Mycobacterium avium subsp. paratuberculosis
ggccgguccgcccaga

SEQ ID NO: 883890 - RNA, 15 nt, Mycobacterium avium subsp. paratuberculosis
ggccgguccgugcac

SEQ ID NO: 883891 - RNA, 21 nt, Mycobacterium avium subsp. paratuberculosis
ggccgguccucugcgaccacc

SEQ ID NO: 883892 - RNA, 23 nt, Mycobacterium avium subsp. paratuberculosis
ggccgguccucugcgaccacccg

SEQ ID NO: 883893 - RNA, 18 nt, Mycobacterium avium subsp. paratuberculosis
ggccggucgaaggccccg

SEQ ID NO: 883894 - RNA, 16 nt, Mycobacterium avium subsp. paratuberculosis
ggccgucgucgaggcc

SEQ ID NO: 883895 - RNA, 21 nt, Mycobacterium avium subsp. paratuberculosis
ggccgucgucgaggccgaacc

SEQ ID NO: 883896 - RNA, 14 nt, Mycobacterium avium subsp. paratuberculosis
ggccgucgguggcc

SEQ ID NO: 883897 - RNA, 20 nt, Mycobacterium avium subsp. paratuberculosis
ggccgucgguggccgguauc

SEQ ID NO: 883898 - RNA, 21 nt, Mycobacterium avium subsp. paratuberculosis
ggccgucgggucggcgagcag

SEQ ID NO: 883899 - RNA, 14 nt, Mycobacterium avium subsp. paratuberculosis
ggccggucgccgau

SEQ ID NO: 883900 - RNA, 18 nt, Mycobacterium avium subsp. paratuberculosis
ggccggucggucagucgc

SEQ ID NO: 883901 - RNA, 21 nt, Mycobacterium avium subsp. paratuberculosis
ggccggucggucagucgcgcc

SEQ ID NO: 883902 - RNA, 17 nt, Mycobacterium avium subsp. paratuberculosis
ggccggucggucggccg

SEQ ID NO: 883903 - RNA, 18 nt, Mycobacterium avium subsp. paratuberculosis
ggccggucggucggccgc

SEQ ID NO: 883904 - RNA, 19 nt, Mycobacterium avium subsp. paratuberculosis
ggccggucggucggccgca

SEQ ID NO: 883905 - RNA, 23 nt, Mycobacterium avium subsp. paratuberculosis
ggccggugacuccuccucggcca

SEQ ID NO: 883906 - RNA, 14 nt, Mycobacterium avium subsp. paratuberculosis
ggccgugaaccggc

SEQ ID NO: 883907 - RNA, 17 nt, Mycobacterium avium subsp. paratuberculosis
ggccgugaaccggcguu

SEQ ID NO: 883908 - RNA, 19 nt, Mycobacterium avium subsp. paratuberculosis
ggccgugaaccggcguugc

SEQ ID NO: 883909 - RNA, 13 nt, Mycobacterium avium subsp. paratuberculosis
ggccgugaucggc

SEQ ID NO: 883910 - RNA, 20 nt, Mycobacterium avium subsp. paratuberculosis
ggccgugaucggccagccac

SEQ ID NO: 883911 - RNA, 22 nt, Mycobacterium avium subsp. paratuberculosis
ggccgugaucucgugccgcacc

SEQ ID NO: 883912 - RNA, 12 nt, Mycobacterium avium subsp. paratuberculosis
ggccgugaugcc

SEQ ID NO: 883913 - RNA, 16 nt, Mycobacterium avium subsp. paratuberculosis
ggccgugaugccgggc

SEQ ID NO: 883914 - RNA, 14 nt, Mycobacterium avium subsp. paratuberculosis
ggccgugaugcgcc

SEQ ID NO: 883915 - RNA, 21 nt, Mycobacterium avium subsp. paratuberculosis
ggccgugaugcgccggcgguc

SEQ ID NO: 883916 - RNA, 19 nt, Mycobacterium avium subsp. paratuberculosis
ggccgucucgagccggcgc

SEQ ID NO: 883917 - RNA, 13 nt, Mycobacterium avium subsp. paratuberculosis
ggccgucucgucg

SEQ ID NO: 883918 - RNA, 14 nt, Mycobacterium avium subsp. paratuberculosis
ggccgucucgucgg

SEQ ID NO: 883919 - RNA, 16 nt, Mycobacterium avium subsp. paratuberculosis
ggccgucucgucggcc

SEQ ID NO: 883920 - RNA, 19 nt, Mycobacterium avium subsp. paratuberculosis
ggccgucucgucggccgcg

SEQ ID NO: 883921 - RNA, 20 nt, Mycobacterium avium subsp. paratuberculosis
ggccgucucgucggccgcga

SEQ ID NO: 883922 - RNA, 14 nt, Mycobacterium avium subsp. paratuberculosis
ggccguggccguca

SEQ ID NO: 883923 - RNA, 13 nt, Mycobacterium avium subsp. paratuberculosis
ggccguggcaccg

SEQ ID NO: 883924 - RNA, 16 nt, Mycobacterium avium subsp. paratuberculosis
ggccguggcaccgggu

SEQ ID NO: 883925 - RNA, 14 nt, Mycobacterium avium subsp. paratuberculosis
ggccguggcgaacu

SEQ ID NO: 883926 - RNA, 20 nt, Mycobacterium avium subsp. paratuberculosis
ggccgugccggcucggcggc

SEQ ID NO: 883927 - RNA, 18 nt, Mycobacterium avium subsp. paratuberculosis
ggccgugccguggucggu

SEQ ID NO: 883928 - RNA, 20 nt, Mycobacterium avium subsp. paratuberculosis
ggccgugccguggucggugc

SEQ ID NO: 883929 - RNA, 21 nt, Mycobacterium avium subsp. paratuberculosis
ggccgucgucgugcaccacga

SEQ ID NO: 883930 - RNA, 14 nt, Mycobacterium avium subsp. paratuberculosis
ggccgugcgcgucg

SEQ ID NO: 883931 - RNA, 19 nt, Mycobacterium avium subsp. paratuberculosis
ggccgugcgcgucgacacc

SEQ ID NO: 883932 - RNA, 12 nt, Mycobacterium avium subsp. paratuberculosis
ggccguggaccc

SEQ ID NO: 883933 - RNA, 23 nt, Mycobacterium avium subsp. paratuberculosis
ggccuccgagcggcgcaggccgg

SEQ ID NO: 883934 - RNA, 19 nt, Mycobacterium avium subsp. paratuberculosis
ggccucccgguaggcggcg

SEQ ID NO: 883935 - RNA, 23 nt, Mycobacterium avium subsp. paratuberculosis
ggccuccgcgcgcggcccguacu

SEQ ID NO: 883936 - RNA, 17 nt, Mycobacterium avium subsp. paratuberculosis
ggccuccggauggcggu

SEQ ID NO: 883937 - RNA, 19 nt, Mycobacterium avium subsp. paratuberculosis
ggccuccggauggcggucg

SEQ ID NO: 883938 - RNA, 24 nt, Mycobacterium avium subsp. paratuberculosis
ggccuccggauggcggucgcgcca

SEQ ID NO: 883939 - RNA, 13 nt, Mycobacterium avium subsp. paratuberculosis
ggccuccggcggc

SEQ ID NO: 883940 - RNA, 17 nt, Mycobacterium avium subsp. paratuberculosis
ggccuccccauccgcgg

SEQ ID NO: 883941 - RNA, 18 nt, Mycobacterium avium subsp. paratuberculosis
ggccuccccauccgcggc

SEQ ID NO: 883942 - RNA, 20 nt, Mycobacterium avium subsp. paratuberculosis
ggccuccccauccgcggcca

SEQ ID NO: 883943 - RNA, 13 nt, Mycobacterium avium subsp. paratuberculosis
ggccguuguggcc

SEQ ID NO: 883944 - RNA, 17 nt, Mycobacterium avium subsp. paratuberculosis
ggccguuguggccaccc

SEQ ID NO: 883945 - RNA, 16 nt, Mycobacterium avium subsp. paratuberculosis
ggccguugggccagcg

SEQ ID NO: 883946 - RNA, 20 nt, Mycobacterium avium subsp. paratuberculosis
ggccguugggccagcggcgc

SEQ ID NO: 883947 - RNA, 22 nt, Mycobacterium avium subsp. paratuberculosis
ggccguugggccagcggcgccg

SEQ ID NO: 883948 - RNA, 15 nt, Mycobacterium avium subsp. paratuberculosis
ggccguuggccuuga

SEQ ID NO: 883949 - RNA, 18 nt, Mycobacterium avium subsp. paratuberculosis
ggccguucuugcggguga

SEQ ID NO: 883950 - RNA, 21 nt, Mycobacterium avium subsp. paratuberculosis
ggccguugaucgagcaccggg

SEQ ID NO: 883951 - RNA, 22 nt, Mycobacterium avium subsp. paratuberculosis
ggccguugaucgagcaccgggc

SEQ ID NO: 883952 - RNA, 17 nt, Mycobacterium avium subsp. paratuberculosis
ggccguucgccggccag

SEQ ID NO: 883953 - RNA, 20 nt, Mycobacterium avium subsp. paratuberculosis
ggccguucgccggccagcac

SEQ ID NO: 883954 - RNA, 14 nt, Mycobacterium avium subsp. paratuberculosis
ggccguucagcggg

SEQ ID NO: 883955 - RNA, 19 nt, Mycobacterium avium subsp. paratuberculosis
ggccgugugcgcaucggcg

SEQ ID NO: 883956 - RNA, 16 nt, Mycobacterium avium subsp. paratuberculosis
ggccgugguuggcgau

SEQ ID NO: 883957 - RNA, 14 nt, Mycobacterium avium subsp. paratuberculosis
ggccguguacagca

SEQ ID NO: 883958 - RNA, 16 nt, Mycobacterium avium subsp. paratuberculosis
gcuugcagcuuggcgg

SEQ ID NO: 883959 - RNA, 20 nt, Mycobacterium avium subsp. paratuberculosis
gcuugaugaugucggcggcc

SEQ ID NO: 883960 - RNA, 14 nt, Mycobacterium avium subsp. paratuberculosis
gcuugauggcggcg

SEQ ID NO: 883961 - RNA, 15 nt, Mycobacterium avium subsp. paratuberculosis
gcuugccagccgggc

SEQ ID NO: 883962 - RNA, 16 nt, Mycobacterium avium subsp. paratuberculosis
gcuugccagccgggcc

SEQ ID NO: 883963 - RNA, 18 nt, Mycobacterium avium subsp. paratuberculosis
gcuugccagccgggccga

SEQ ID NO: 883964 - RNA, 22 nt, Mycobacterium avium subsp. paratuberculosis
gcuugccgacgugaugcacccg

SEQ ID NO: 883965 - RNA, 15 nt, Mycobacterium avium subsp. paratuberculosis
gcuugccgaucgccg

SEQ ID NO: 883966 - RNA, 18 nt, Mycobacterium avium subsp. paratuberculosis
gcuugccgaucgccgcgg

SEQ ID NO: 883967 - RNA, 22 nt, Mycobacterium avium subsp. paratuberculosis
gcuugccgaucugguccagcgu

SEQ ID NO: 883968 - RNA, 17 nt, Mycobacterium avium subsp. paratuberculosis
gcuugccgaugucggcg

SEQ ID NO: 883969 - RNA, 15 nt, Mycobacterium avium subsp. paratuberculosis
gcuugccgccgggcc

SEQ ID NO: 883970 - RNA, 17 nt, Mycobacterium avium subsp. paratuberculosis
gcuugccgccgggccag

SEQ ID NO: 883971 - RNA, 22 nt, Mycobacterium avium subsp. paratuberculosis
gcuugccgcgacccgggccgcc

SEQ ID NO: 883972 - RNA, 23 nt, Mycobacterium avium subsp. paratuberculosis
gcuugccccggucccggggcucg

SEQ ID NO: 883973 - RNA, 14 nt, Mycobacterium avium subsp. paratuberculosis
gcuugcgcucggcc

SEQ ID NO: 883974 - RNA, 18 nt, Mycobacterium avium subsp. paratuberculosis
gcuugcgcucggucgcgg

SEQ ID NO: 883975 - RNA, 11 nt, Mycobacterium avium subsp. paratuberculosis
gcuugcgccgc

SEQ ID NO: 883976 - RNA, 18 nt, Mycobacterium avium subsp. paratuberculosis
gcuugcgcaacagcgugc

SEQ ID NO: 883977 - RNA, 16 nt, Mycobacterium avium subsp. paratuberculosis
gcuugcgaucgccgcg

SEQ ID NO: 883978 - RNA, 17 nt, Mycobacterium avium subsp. paratuberculosis
gcuugcgaucgccgcgc

SEQ ID NO: 883979 - RNA, 14 nt, Mycobacterium avium subsp. paratuberculosis
gcuugccgucgacg

SEQ ID NO: 883980 - RNA, 15 nt, Mycobacterium avium subsp. paratuberculosis
gcuugccgucgacgc

SEQ ID NO: 883981 - RNA, 18 nt, Mycobacterium avium subsp. paratuberculosis
gcuugccguugucgaaga

SEQ ID NO: 883982 - RNA, 17 nt, Mycobacterium avium subsp. paratuberculosis
gcuugccggagcccagc

SEQ ID NO: 883983 - RNA, 22 nt, Mycobacterium avium subsp. paratuberculosis
gcuugccggauugcgagccggu

SEQ ID NO: 883984 - RNA, 18 nt, Mycobacterium avium subsp. paratuberculosis
gcuguugcucggggcucg

SEQ ID NO: 883985 - RNA, 15 nt, Mycobacterium avium subsp. paratuberculosis
gcuguugcggcguca

SEQ ID NO: 883986 - RNA, 23 nt, Mycobacterium avium subsp. paratuberculosis
gcuguuggcgacggugcaugcgc

SEQ ID NO: 883987 - RNA, 23 nt, Mycobacterium avium subsp. paratuberculosis
gcuguuggaaccggccaccacgu

SEQ ID NO: 883988 - RNA, 13 nt, Mycobacterium avium subsp. paratuberculosis
gcugugcgggcgg

SEQ ID NO: 883989 - RNA, 18 nt, Mycobacterium avium subsp. paratuberculosis
gcuguugacgggccgcgg

SEQ ID NO: 883990 - RNA, 17 nt, Mycobacterium avium subsp. paratuberculosis
gcuugacccgcuccagc

SEQ ID NO: 883991 - RNA, 21 nt, Mycobacterium avium subsp. paratuberculosis
gcuugacccgcuccagcggcc

SEQ ID NO: 883992 - RNA, 23 nt, Mycobacterium avium subsp. paratuberculosis
gcuugacccgcuccagcggccac

SEQ ID NO: 883993 - RNA, 14 nt, Mycobacterium avium subsp. paratuberculosis
gcuugaccacccgg

SEQ ID NO: 883994 - RNA, 18 nt, Mycobacterium avium subsp. paratuberculosis
gcuugaccacccggucga

SEQ ID NO: 883995 - RNA, 16 nt, Mycobacterium avium subsp. paratuberculosis
gcuugacgccgccgaa

SEQ ID NO: 883996 - RNA, 16 nt, Mycobacterium avium subsp. paratuberculosis
gcuugacggccgggcc

SEQ ID NO: 883997 - RNA, 15 nt, Mycobacterium avium subsp. paratuberculosis
gcuugacgaacgcca

SEQ ID NO: 883998 - RNA, 18 nt, Mycobacterium avium subsp. paratuberculosis
gcuugacgaacgccacca

SEQ ID NO: 883999 - RNA, 23 nt, Mycobacterium avium subsp. paratuberculosis
gcuugacgaacgccaccacggcg

SEQ ID NO: 884000 - RNA, 20 nt, Mycobacterium avium subsp. paratuberculosis
gcuugaccggcucgccggcg

SEQ ID NO: 884001 - RNA, 14 nt, Mycobacterium avium subsp. paratuberculosis
gcuugaccgugacg

SEQ ID NO: 884002 - RNA, 15 nt, Mycobacterium avium subsp. paratuberculosis
gcuugaccgugacgg

SEQ ID NO: 884003 - RNA, 14 nt, Mycobacterium avium subsp. paratuberculosis
gcuugaccucgccg

SEQ ID NO: 884004 - RNA, 22 nt, Mycobacterium avium subsp. paratuberculosis
gcuugaccucgccgagcagccg

SEQ ID NO: 884005 - RNA, 17 nt, Mycobacterium avium subsp. paratuberculosis
gcuugagcccgucgacg

SEQ ID NO: 884006 - RNA, 16 nt, Mycobacterium avium subsp. paratuberculosis
gcuugagccgccacgg

SEQ ID NO: 884007 - RNA, 15 nt, Mycobacterium avium subsp. paratuberculosis
gcuugagccggaucg

SEQ ID NO: 884008 - RNA, 17 nt, Mycobacterium avium subsp. paratuberculosis
gcuugagccggaucggg

SEQ ID NO: 884009 - RNA, 15 nt, Mycobacterium avium subsp. paratuberculosis
gcuugagcgccagcg

SEQ ID NO: 884010 - RNA, 18 nt, Mycobacterium avium subsp. paratuberculosis
gcuugagcgccagcgcgg

SEQ ID NO: 884011 - RNA, 16 nt, Mycobacterium avium subsp. paratuberculosis
gcuugagcgcgucguc

SEQ ID NO: 884012 - RNA, 17 nt, Mycobacterium avium subsp. paratuberculosis
gcuugaucagcgggcug

SEQ ID NO: 884013 - RNA, 21 nt, Mycobacterium avium subsp. paratuberculosis
gcuugcguucccagcccggcc

SEQ ID NO: 884014 - RNA, 21 nt, Mycobacterium avium subsp. paratuberculosis
gcuugcucuucaggaacccga

SEQ ID NO: 884015 - RNA, 17 nt, Mycobacterium avium subsp. paratuberculosis
gcuuggccagcucggcg

SEQ ID NO: 884016 - RNA, 21 nt, Mycobacterium avium subsp. paratuberculosis
gcuuggccagcucggcggcca

SEQ ID NO: 884017 - RNA, 14 nt, Mycobacterium avium subsp. paratuberculosis
gcuuggccgggcgg

SEQ ID NO: 884018 - RNA, 18 nt, Mycobacterium avium subsp. paratuberculosis
gcuuggggaagccggcca

SEQ ID NO: 884019 - RNA, 19 nt, Mycobacterium avium subsp. paratuberculosis
gcuuggggaagccggccag

SEQ ID NO: 884020 - RNA, 21 nt, Mycobacterium avium subsp. paratuberculosis
gcuuggggaagccggccaguu

SEQ ID NO: 884021 - RNA, 19 nt, Mycobacterium avium subsp. paratuberculosis
gcuuggucaccagcucgcc

SEQ ID NO: 884022 - RNA, 18 nt, Mycobacterium avium subsp. paratuberculosis
gcuuggucgccugcacga

SEQ ID NO: 884023 - RNA, 20 nt, Mycobacterium avium subsp. paratuberculosis
gcuuggucgcggcguugccc

SEQ ID NO: 884024 - RNA, 13 nt, Mycobacterium avium subsp. paratuberculosis
gcuugguggcgcc

SEQ ID NO: 884025 - RNA, 20 nt, Mycobacterium avium subsp. paratuberculosis
gcuugggcagcaaccggguc

SEQ ID NO: 884026 - RNA, 17 nt, Mycobacterium avium subsp. paratuberculosis
gcuuggcgacgaagucg

SEQ ID NO: 884027 - RNA, 23 nt, Mycobacterium avium subsp. paratuberculosis
gcuuggcgacgaagucgacggcg

SEQ ID NO: 884028 - RNA, 18 nt, Mycobacterium avium subsp. paratuberculosis
gcuuggcgcagccgguca

SEQ ID NO: 884029 - RNA, 17 nt, Mycobacterium avium subsp. paratuberculosis
gcuuuccaccccggcgg

SEQ ID NO: 884030 - RNA, 22 nt, Mycobacterium avium subsp. paratuberculosis
gcuuuccaccucgagcaaccgc

SEQ ID NO: 884031 - RNA, 13 nt, Mycobacterium avium subsp. paratuberculosis
gcuuuugcgucug

SEQ ID NO: 884032 - RNA, 18 nt, Mycobacterium avium subsp. paratuberculosis
gcuuuugcgucugcucgc

SEQ ID NO: 884033 - RNA, 19 nt, Mycobacterium avium subsp. paratuberculosis
gcuuuugcgucugcucgcc

SEQ ID NO: 884034 - RNA, 19 nt, Mycobacterium avium subsp. paratuberculosis
gcuuuugcgggucugcuca

SEQ ID NO: 884035 - RNA, 22 nt, Mycobacterium avium subsp. paratuberculosis
gcuuuugcgggucugcucacgc

SEQ ID NO: 884036 - RNA, 19 nt, Mycobacterium avium subsp. paratuberculosis
gcuuuugugucugcucgcc

SEQ ID NO: 884037 - RNA, 14 nt, Mycobacterium avium subsp. paratuberculosis
gcuuuuugaccacc

SEQ ID NO: 884038 - RNA, 22 nt, Mycobacterium avium subsp. paratuberculosis
ggacaacggaucgagcgcaccg

SEQ ID NO: 884039 - RNA, 14 nt, Mycobacterium avium subsp. paratuberculosis
ggaaucgagggcgc

SEQ ID NO: 884040 - RNA, 18 nt, Mycobacterium avium subsp. paratuberculosis
ggaaucgauuggugcgca

SEQ ID NO: 884041 - RNA, 11 nt, Mycobacterium avium subsp. paratuberculosis
ggaaucgucgg

SEQ ID NO: 884042 - RNA, 17 nt, Mycobacterium avium subsp. paratuberculosis
ggaaucgucggccacgc

SEQ ID NO: 884043 - RNA, 17 nt, Mycobacterium avium subsp. paratuberculosis
ggaauccuggccgaugg

SEQ ID NO: 884044 - RNA, 18 nt, Mycobacterium avium subsp. paratuberculosis
ggaaucccacccgcaacg

SEQ ID NO: 884045 - RNA, 22 nt, Mycobacterium avium subsp. paratuberculosis
ggaaguccuuguucgccgggua

SEQ ID NO: 884046 - RNA, 13 nt, Mycobacterium avium subsp. paratuberculosis
ggaagucgaccgg

SEQ ID NO: 884047 - RNA, 16 nt, Mycobacterium avium subsp. paratuberculosis
ggaaguagccggccag

SEQ ID NO: 884048 - RNA, 23 nt, Mycobacterium avium subsp. paratuberculosis
ggaaguaguccagggugucgucg

SEQ ID NO: 884049 - RNA, 19 nt, Mycobacterium avium subsp. paratuberculosis
ggaaggugguccuggcggu

SEQ ID NO: 884050 - RNA, 14 nt, Mycobacterium avium subsp. paratuberculosis
ggaagguguuggug

SEQ ID NO: 884051 - RNA, 12 nt, Mycobacterium avium subsp. paratuberculosis
ggaaggcggccg

SEQ ID NO: 884052 - RNA, 13 nt, Mycobacterium avium subsp. paratuberculosis
ggaaggcggccgc

SEQ ID NO: 884053 - RNA, 21 nt, Mycobacterium avium subsp. paratuberculosis
ggaagggcuuuagaaggccgc

SEQ ID NO: 884054 - RNA, 18 nt, Mycobacterium avium subsp. paratuberculosis
ggaaggaggugguccgcg

SEQ ID NO: 884055 - RNA, 17 nt, Mycobacterium avium subsp. paratuberculosis
ggaaggccaaggccagc

SEQ ID NO: 884056 - RNA, 19 nt, Mycobacterium avium subsp. paratuberculosis
ggaaaaccccaccccgagc

SEQ ID NO: 884057 - RNA, 20 nt, Mycobacterium avium subsp. paratuberculosis
ggaaccgggucagcaccacc

SEQ ID NO: 884058 - RNA, 20 nt, Mycobacterium avium subsp. paratuberculosis
ggaaccgacaccucgccguc

SEQ ID NO: 884059 - RNA, 23 nt, Mycobacterium avium subsp. paratuberculosis
ggaaccgcgccuucgacccggug

SEQ ID NO: 884060 - RNA, 16 nt, Mycobacterium avium subsp. paratuberculosis
ggaaccgcucggcucg

SEQ ID NO: 884061 - RNA, 19 nt, Mycobacterium avium subsp. paratuberculosis
ggaaccgcugcaugccguc

SEQ ID NO: 884062 - RNA, 15 nt, Mycobacterium avium subsp. paratuberculosis
ggaaccggcagccgg

SEQ ID NO: 884063 - RNA, 14 nt, Mycobacterium avium subsp. paratuberculosis
ggaaccggccacca

SEQ ID NO: 884064 - RNA, 17 nt, Mycobacterium avium subsp. paratuberculosis
ggaaccggccaccacgu

SEQ ID NO: 884065 - RNA, 16 nt, Mycobacterium avium subsp. paratuberculosis
ggaacucggccggcac

SEQ ID NO: 884066 - RNA, 17 nt, Mycobacterium avium subsp. paratuberculosis
ggaacucggccggcacc

SEQ ID NO: 884067 - RNA, 21 nt, Mycobacterium avium subsp. paratuberculosis
ggaacucggugaugccggcca

SEQ ID NO: 884068 - RNA, 20 nt, Mycobacterium avium subsp. paratuberculosis
ggaacucggccagcuggucg

SEQ ID NO: 884069 - RNA, 12 nt, Mycobacterium avium subsp. paratuberculosis
ggaacgggccgg

SEQ ID NO: 884070 - RNA, 14 nt, Mycobacterium avium subsp. paratuberculosis
ggaacgggccggcg

SEQ ID NO: 884071 - RNA, 16 nt, Mycobacterium avium subsp. paratuberculosis
ggaacggucagccgcg

SEQ ID NO: 884072 - RNA, 18 nt, Mycobacterium avium subsp. paratuberculosis
ggaacggucggggcggcg

SEQ ID NO: 884073 - RNA, 17 nt, Mycobacterium avium subsp. paratuberculosis
ggaacgucauggccagc

SEQ ID NO: 884074 - RNA, 20 nt, Mycobacterium avium subsp. paratuberculosis
ggaacggccggauggccagc

SEQ ID NO: 884075 - RNA, 18 nt, Mycobacterium avium subsp. paratuberculosis
ggaacggcgggcccgucg

SEQ ID NO: 884076 - RNA, 21 nt, Mycobacterium avium subsp. paratuberculosis
ggaacgcucuucagcgcgaca

SEQ ID NO: 884077 - RNA, 12 nt, Mycobacterium avium subsp. paratuberculosis
ggaacgcgucgc

SEQ ID NO: 884078 - RNA, 18 nt, Mycobacterium avium subsp. paratuberculosis
ggaacgcgucgcccacgc

SEQ ID NO: 884079 - RNA, 16 nt, Mycobacterium avium subsp. paratuberculosis
ggaacgcgucgcgcca

SEQ ID NO: 884080 - RNA, 18 nt, Mycobacterium avium subsp. paratuberculosis
ggaacgcgucgcgccagc

SEQ ID NO: 884081 - RNA, 15 nt, Mycobacterium avium subsp. paratuberculosis
ggaacgcggcgaagg

SEQ ID NO: 884082 - RNA, 13 nt, Mycobacterium avium subsp. paratuberculosis
ggaacgcgccggc

SEQ ID NO: 884083 - RNA, 16 nt, Mycobacterium avium subsp. paratuberculosis
ggaacgcgccggcgca

SEQ ID NO: 884084 - RNA, 14 nt, Mycobacterium avium subsp. paratuberculosis
ggaacgcgccgggc

SEQ ID NO: 884085 - RNA, 16 nt, Mycobacterium avium subsp. paratuberculosis
ggaacgcgccgggcaa

SEQ ID NO: 884086 - RNA, 17 nt, Mycobacterium avium subsp. paratuberculosis
ggaacgccuugaccgcc

SEQ ID NO: 884087 - RNA, 16 nt, Mycobacterium avium subsp. paratuberculosis
ggaacgcgcccggcgg

SEQ ID NO: 884088 - RNA, 17 nt, Mycobacterium avium subsp. paratuberculosis
ggaacgcgcccggcggg

SEQ ID NO: 884089 - RNA, 21 nt, Mycobacterium avium subsp. paratuberculosis
ggaacgccgaggaggccgcgg

SEQ ID NO: 884090 - RNA, 14 nt, Mycobacterium avium subsp. paratuberculosis
ggaacgccgaucac

SEQ ID NO: 884091 - RNA, 19 nt, Mycobacterium avium subsp. paratuberculosis
ggaacgccgaucaccggca

SEQ ID NO: 884092 - RNA, 17 nt, Mycobacterium avium subsp. paratuberculosis
ggaaccuggucggggug

SEQ ID NO: 884093 - RNA, 12 nt, Mycobacterium avium subsp. paratuberculosis
ggaacgccggcu

SEQ ID NO: 884094 - RNA, 20 nt, Mycobacterium avium subsp. paratuberculosis
ggaccacccgcagcgcggcg

SEQ ID NO: 884095 - RNA, 13 nt, Mycobacterium avium subsp. paratuberculosis
ggacaucgucgcg

SEQ ID NO: 884096 - RNA, 17 nt, Mycobacterium avium subsp. paratuberculosis
ggacaucuccggcacgu

SEQ ID NO: 884097 - RNA, 21 nt, Mycobacterium avium subsp. paratuberculosis
ggacaugcagccgccgcggag

SEQ ID NO: 884098 - RNA, 12 nt, Mycobacterium avium subsp. paratuberculosis
ggacaugccggc

SEQ ID NO: 884099 - RNA, 19 nt, Mycobacterium avium subsp. paratuberculosis
ggacaggcacucgcccagg

SEQ ID NO: 884100 - RNA, 17 nt, Mycobacterium avium subsp. paratuberculosis
ggacagcgggccgaccc

SEQ ID NO: 884101 - RNA, 21 nt, Mycobacterium avium subsp. paratuberculosis
ggacagcgggccgacccggcc

SEQ ID NO: 884102 - RNA, 17 nt, Mycobacterium avium subsp. paratuberculosis
ggacagcgucagccccg

SEQ ID NO: 884103 - RNA, 16 nt, Mycobacterium avium subsp. paratuberculosis
ggacagcucgccggcc

SEQ ID NO: 884104 - RNA, 17 nt, Mycobacterium avium subsp. paratuberculosis
ggacagcucgccggccg

SEQ ID NO: 884105 - RNA, 22 nt, Mycobacterium avium subsp. paratuberculosis
ggacagcugcgcgggcgcggcc

SEQ ID NO: 884106 - RNA, 20 nt, Mycobacterium avium subsp. paratuberculosis
ggacagcuggcggucgcuga

SEQ ID NO: 884107 - RNA, 23 nt, Mycobacterium avium subsp. paratuberculosis
ggacagcgcgacgcacgccggcg

SEQ ID NO: 884108 - RNA, 23 nt, Mycobacterium avium subsp. paratuberculosis
ggacagcgcgacgggcacccgcg

SEQ ID NO: 884109 - RNA, 12 nt, Mycobacterium avium subsp. paratuberculosis
ggacagcgcggu

SEQ ID NO: 884110 - RNA, 14 nt, Mycobacterium avium subsp. paratuberculosis
ggacagccacagcu

SEQ ID NO: 884111 - RNA, 22 nt, Mycobacterium avium subsp. paratuberculosis
ggacagccacagcucgggcagc

SEQ ID NO: 884112 - RNA, 13 nt, Mycobacterium avium subsp. paratuberculosis
ggacagccggucg

SEQ ID NO: 884113 - RNA, 17 nt, Mycobacterium avium subsp. paratuberculosis
ggacagccggucgacga

SEQ ID NO: 884114 - RNA, 13 nt, Mycobacterium avium subsp. paratuberculosis
ggacagcaccaca

SEQ ID NO: 884115 - RNA, 14 nt, Mycobacterium avium subsp. paratuberculosis
ggacagcaccacca

SEQ ID NO: 884116 - RNA, 15 nt, Mycobacterium avium subsp. paratuberculosis
ggacagcaccaccag

SEQ ID NO: 884117 - RNA, 18 nt, Mycobacterium avium subsp. paratuberculosis
ggacagcaccuugcccag

SEQ ID NO: 884118 - RNA, 15 nt, Mycobacterium avium subsp. paratuberculosis
ggacagcagccgcuc

SEQ ID NO: 884119 - RNA, 19 nt, Mycobacterium avium subsp. paratuberculosis
ggacagcagccgcucacac

SEQ ID NO: 884120 - RNA, 22 nt, Mycobacterium avium subsp. paratuberculosis
ggacagaucgcccaucaccgca

SEQ ID NO: 884121 - RNA, 13 nt, Mycobacterium avium subsp. paratuberculosis
ggacacggccagc

SEQ ID NO: 884122 - RNA, 14 nt, Mycobacterium avium subsp. paratuberculosis
ggacacggcgccgu

SEQ ID NO: 884123 - RNA, 16 nt, Mycobacterium avium subsp. paratuberculosis
ggacacggcgccgugc

SEQ ID NO: 884124 - RNA, 13 nt, Mycobacterium avium subsp. paratuberculosis
ggacacggcggcg

SEQ ID NO: 884125 - RNA, 15 nt, Mycobacterium avium subsp. paratuberculosis
ggacacggcggcgcg

SEQ ID NO: 884126 - RNA, 16 nt, Mycobacterium avium subsp. paratuberculosis
ggacacggcggcgcgg

SEQ ID NO: 884127 - RNA, 22 nt, Mycobacterium avium subsp. paratuberculosis
ggacacggcggcgcgggcggcg

SEQ ID NO: 884128 - RNA, 12 nt, Mycobacterium avium subsp. paratuberculosis
ggacacggcugc

SEQ ID NO: 884129 - RNA, 13 nt, Mycobacterium avium subsp. paratuberculosis
ggacaccagcaug

SEQ ID NO: 884130 - RNA, 13 nt, Mycobacterium avium subsp. paratuberculosis
ggacaccccggcc

SEQ ID NO: 884131 - RNA, 15 nt, Mycobacterium avium subsp. paratuberculosis
ggacaccccggccag

SEQ ID NO: 884132 - RNA, 17 nt, Mycobacterium avium subsp. paratuberculosis
ggacaccccggcgauga

SEQ ID NO: 884133 - RNA, 15 nt, Mycobacterium avium subsp. paratuberculosis
ggacacccgcgcggu

SEQ ID NO: 884134 - RNA, 23 nt, Mycobacterium avium subsp. paratuberculosis
ggacaccgaacccggaucggcca

SEQ ID NO: 884135 - RNA, 23 nt, Mycobacterium avium subsp. paratuberculosis
ggacaccgaaccgccccgcgcga

SEQ ID NO: 884136 - RNA, 13 nt, Mycobacterium avium subsp. paratuberculosis
ggacaccgcaccc

SEQ ID NO: 884137 - RNA, 15 nt, Mycobacterium avium subsp. paratuberculosis
ggacaccgcgaucac

SEQ ID NO: 884138 - RNA, 16 nt, Mycobacterium avium subsp. paratuberculosis
ggacaccgcuggccga

SEQ ID NO: 884139 - RNA, 20 nt, Mycobacterium avium subsp. paratuberculosis
ggacaccggcacgucggcca

SEQ ID NO: 884140 - RNA, 23 nt, Mycobacterium avium subsp. paratuberculosis
ggacaccucggccagcgccgcgc

SEQ ID NO: 884141 - RNA, 16 nt, Mycobacterium avium subsp. paratuberculosis
ggacaccuuggcggcc

SEQ ID NO: 884142 - RNA, 18 nt, Mycobacterium avium subsp. paratuberculosis
ggacaccuuggcggccac

SEQ ID NO: 884143 - RNA, 13 nt, Mycobacterium avium subsp. paratuberculosis
ggaccaccaggaa

SEQ ID NO: 884144 - RNA, 20 nt, Mycobacterium avium subsp. paratuberculosis
ggaccagcaugugcucccag

SEQ ID NO: 884145 - RNA, 13 nt, Mycobacterium avium subsp. paratuberculosis
ggacccgccccga

SEQ ID NO: 884146 - RNA, 14 nt, Mycobacterium avium subsp. paratuberculosis
ggacauucggacgg

SEQ ID NO: 884147 - RNA, 16 nt, Mycobacterium avium subsp. paratuberculosis
ggacccggaacccgcg

SEQ ID NO: 884148 - RNA, 19 nt, Mycobacterium avium subsp. paratuberculosis
ggaccgauccggcgcccga

SEQ ID NO: 884149 - RNA, 18 nt, Mycobacterium avium subsp. paratuberculosis
ggaccgcacgccggguug

SEQ ID NO: 884150 - RNA, 18 nt, Mycobacterium avium subsp. paratuberculosis
ggaccgccgagagcucuu

SEQ ID NO: 884151 - RNA, 13 nt, Mycobacterium avium subsp. paratuberculosis
ggaccgccgcggc

SEQ ID NO: 884152 - RNA, 20 nt, Mycobacterium avium subsp. paratuberculosis
ggaccgccgcggcgcccggc

SEQ ID NO: 884153 - RNA, 22 nt, Mycobacterium avium subsp. paratuberculosis
ggaccgccgcggcgcccggcgc

SEQ ID NO: 884154 - RNA, 14 nt, Mycobacterium avium subsp. paratuberculosis
ggacccggcgagcg

SEQ ID NO: 884155 - RNA, 15 nt, Mycobacterium avium subsp. paratuberculosis
ggacccggucggccg

SEQ ID NO: 884156 - RNA, 18 nt, Mycobacterium avium subsp. paratuberculosis
ggacccuggccagcaccg

SEQ ID NO: 884157 - RNA, 16 nt, Mycobacterium avium subsp. paratuberculosis
ggacccuucgaacgcg

SEQ ID NO: 884158 - RNA, 13 nt, Mycobacterium avium subsp. paratuberculosis
ggaccgagccgcg

SEQ ID NO: 884159 - RNA, 14 nt, Mycobacterium avium subsp. paratuberculosis
ggaccgagccgcgc

SEQ ID NO: 884160 - RNA, 15 nt, Mycobacterium avium subsp. paratuberculosis
ggacgaaccagugcc

SEQ ID NO: 884161 - RNA, 21 nt, Mycobacterium avium subsp. paratuberculosis
ggacgaaccagugcccggcca

SEQ ID NO: 884162 - RNA, 14 nt, Mycobacterium avium subsp. paratuberculosis
ggacgaacgcggcg

SEQ ID NO: 884163 - RNA, 15 nt, Mycobacterium avium subsp. paratuberculosis
ggacgaaacccggcg

SEQ ID NO: 884164 - RNA, 18 nt, Mycobacterium avium subsp. paratuberculosis
ggacgaaacccggcggac

SEQ ID NO: 884165 - RNA, 19 nt, Mycobacterium avium subsp. paratuberculosis
ggacgaaaaccaggaacga

SEQ ID NO: 884166 - RNA, 17 nt, Mycobacterium avium subsp. paratuberculosis
ggaccuuggugucggcg

SEQ ID NO: 884167 - RNA, 18 nt, Mycobacterium avium subsp. paratuberculosis
ggaccuuggugucggcga

SEQ ID NO: 884168 - RNA, 17 nt, Mycobacterium avium subsp. paratuberculosis
ggaccuugucgggccgc

SEQ ID NO: 884169 - RNA, 22 nt, Mycobacterium avium subsp. paratuberculosis
ggaccuugucgggccgcgggcc

SEQ ID NO: 884170 - RNA, 13 nt, Mycobacterium avium subsp. paratuberculosis
ggaccugaccgaa

SEQ ID NO: 884171 - RNA, 13 nt, Mycobacterium avium subsp. paratuberculosis
ggaccguccccgu

SEQ ID NO: 884172 - RNA, 14 nt, Mycobacterium avium subsp. paratuberculosis
ggaccguccccguc

SEQ ID NO: 884173 - RNA, 17 nt, Mycobacterium avium subsp. paratuberculosis
ggaccguucgguccgga

SEQ ID NO: 884174 - RNA, 12 nt, Mycobacterium avium subsp. paratuberculosis
ggaccugccggc

SEQ ID NO: 884175 - RNA, 17 nt, Mycobacterium avium subsp. paratuberculosis
ggaccugcugcucgucg

SEQ ID NO: 884176 - RNA, 19 nt, Mycobacterium avium subsp. paratuberculosis
ggaccugcugcucgucgcg

SEQ ID NO: 884177 - RNA, 13 nt, Mycobacterium avium subsp. paratuberculosis
ggaguggucaggc

SEQ ID NO: 884178 - RNA, 16 nt, Mycobacterium avium subsp. paratuberculosis
ggagugaccgccagca

SEQ ID NO: 884179 - RNA, 16 nt, Mycobacterium avium subsp. paratuberculosis
ggagugcggcccaccc

SEQ ID NO: 884180 - RNA, 19 nt, Mycobacterium avium subsp. paratuberculosis
ggaguugcgcagccgggcg

SEQ ID NO: 884181 - RNA, 17 nt, Mycobacterium avium subsp. paratuberculosis
ggaguuggaucgccgca

SEQ ID NO: 884182 - RNA, 14 nt, Mycobacterium avium subsp. paratuberculosis
ggaguugucgguga

SEQ ID NO: 884183 - RNA, 16 nt, Mycobacterium avium subsp. paratuberculosis
ggauacgcccggccac

SEQ ID NO: 884184 - RNA, 14 nt, Mycobacterium avium subsp. paratuberculosis
ggauacccgcggcc

SEQ ID NO: 884185 - RNA, 18 nt, Mycobacterium avium subsp. paratuberculosis
ggauagauguugcggccg

SEQ ID NO: 884186 - RNA, 22 nt, Mycobacterium avium subsp. paratuberculosis
ggagugaggggauccagcggcg

SEQ ID NO: 884187 - RNA, 23 nt, Mycobacterium avium subsp. paratuberculosis
ggagucgaagcggugcaccaccg

SEQ ID NO: 884188 - RNA, 17 nt, Mycobacterium avium subsp. paratuberculosis
ggaguaguuccggcggu

SEQ ID NO: 884189 - RNA, 14 nt, Mycobacterium avium subsp. paratuberculosis
ggaguccaccggcg

SEQ ID NO: 884190 - RNA, 23 nt, Mycobacterium avium subsp. paratuberculosis
ggaguccaccggcggauucucgc

SEQ ID NO: 884191 - RNA, 13 nt, Mycobacterium avium subsp. paratuberculosis
ggaguccacgccg

SEQ ID NO: 884192 - RNA, 20 nt, Mycobacterium avium subsp. paratuberculosis
ggaguagaccuuguccggcg

SEQ ID NO: 884193 - RNA, 15 nt, Mycobacterium avium subsp. paratuberculosis
ggagguugauggcca

SEQ ID NO: 884194 - RNA, 15 nt, Mycobacterium avium subsp. paratuberculosis
ggaggugcgggucuc

SEQ ID NO: 884195 - RNA, 22 nt, Mycobacterium avium subsp. paratuberculosis
ggaggucagcagggugacgucg

SEQ ID NO: 884196 - RNA, 17 nt, Mycobacterium avium subsp. paratuberculosis
ggaggucauggcgaccg

SEQ ID NO: 884197 - RNA, 22 nt, Mycobacterium avium subsp. paratuberculosis
ggaggucgcggauacgcccggc

SEQ ID NO: 884198 - RNA, 15 nt, Mycobacterium avium subsp. paratuberculosis
ggaggugaucgccag

SEQ ID NO: 884199 - RNA, 17 nt, Mycobacterium avium subsp. paratuberculosis
ggaggugaucgccagcc

SEQ ID NO: 884200 - RNA, 16 nt, Mycobacterium avium subsp. paratuberculosis
ggaggugccgcgcggc

SEQ ID NO: 884201 - RNA, 14 nt, Mycobacterium avium subsp. paratuberculosis
ggaggggucggugc

SEQ ID NO: 884202 - RNA, 19 nt, Mycobacterium avium subsp. paratuberculosis
ggagggucgguggcccagc

SEQ ID NO: 884203 - RNA, 20 nt, Mycobacterium avium subsp. paratuberculosis
ggagggagcacucgauggcg

SEQ ID NO: 884204 - RNA, 19 nt, Mycobacterium avium subsp. paratuberculosis
ggaggcgagcagccgggug

SEQ ID NO: 884205 - RNA, 16 nt, Mycobacterium avium subsp. paratuberculosis
ggaggcgaugcggguc

SEQ ID NO: 884206 - RNA, 18 nt, Mycobacterium avium subsp. paratuberculosis
ggaggcguagugcgccca

SEQ ID NO: 884207 - RNA, 13 nt, Mycobacterium avium subsp. paratuberculosis
ggagcugccggcg

SEQ ID NO: 884208 - RNA, 16 nt, Mycobacterium avium subsp. paratuberculosis
ggagcugccggcgacc

SEQ ID NO: 884209 - RNA, 17 nt, Mycobacterium avium subsp. paratuberculosis
ggagcugccggcgacca

SEQ ID NO: 884210 - RNA, 22 nt, Mycobacterium avium subsp. paratuberculosis
ggagcuucgaauccuguuggua

SEQ ID NO: 884211 - RNA, 14 nt, Mycobacterium avium subsp. paratuberculosis
ggagcgucgcgaug

SEQ ID NO: 884212 - RNA, 15 nt, Mycobacterium avium subsp. paratuberculosis
ggagcggaucccggu

SEQ ID NO: 884213 - RNA, 21 nt, Mycobacterium avium subsp. paratuberculosis
ggagcuaggcggccgggcggc

SEQ ID NO: 884214 - RNA, 14 nt, Mycobacterium avium subsp. paratuberculosis
ggaggcacuggcgc

SEQ ID NO: 884215 - RNA, 13 nt, Mycobacterium avium subsp. paratuberculosis
ggaggcagcgcgg

SEQ ID NO: 884216 - RNA, 19 nt, Mycobacterium avium subsp. paratuberculosis
ggaggaauucgccgacgcg

SEQ ID NO: 884217 - RNA, 17 nt, Mycobacterium avium subsp. paratuberculosis
ggaggacaacgcgucga

SEQ ID NO: 884218 - RNA, 19 nt, Mycobacterium avium subsp. paratuberculosis
ggaggacaagucaugccgc

SEQ ID NO: 884219 - RNA, 15 nt, Mycobacterium avium subsp. paratuberculosis
ggaggacagcgcggu

SEQ ID NO: 884220 - RNA, 13 nt, Mycobacterium avium subsp. paratuberculosis
ggaggccaccgcg

SEQ ID NO: 884221 - RNA, 14 nt, Mycobacterium avium subsp. paratuberculosis
ggaggccagcaccu

SEQ ID NO: 884222 - RNA, 16 nt, Mycobacterium avium subsp. paratuberculosis
ggaggccgcggcgaca

SEQ ID NO: 884223 - RNA, 22 nt, Mycobacterium avium subsp. paratuberculosis
ggaggccgcggcgacacccagc

SEQ ID NO: 884224 - RNA, 22 nt, Mycobacterium avium subsp. paratuberculosis
ggaggccugcgcggccgcgucg

SEQ ID NO: 884225 - RNA, 17 nt, Mycobacterium avium subsp. paratuberculosis
ggagcaaggucgucgcg

SEQ ID NO: 884226 - RNA, 20 nt, Mycobacterium avium subsp. paratuberculosis
ggagcacucgauggcggcga

SEQ ID NO: 884227 - RNA, 14 nt, Mycobacterium avium subsp. paratuberculosis
ggagcccagcguga

SEQ ID NO: 884228 - RNA, 20 nt, Mycobacterium avium subsp. paratuberculosis
ggagcccagcuuggcgcccu

SEQ ID NO: 884229 - RNA, 14 nt, Mycobacterium avium subsp. paratuberculosis
ggagccgcccaugc

SEQ ID NO: 884230 - RNA, 13 nt, Mycobacterium avium subsp. paratuberculosis
ggagccgaccagc

SEQ ID NO: 884231 - RNA, 16 nt, Mycobacterium avium subsp. paratuberculosis
ggagccgaccucggcg

SEQ ID NO: 884232 - RNA, 20 nt, Mycobacterium avium subsp. paratuberculosis
ggagccgacgaagaucccgc

SEQ ID NO: 884233 - RNA, 12 nt, Mycobacterium avium subsp. paratuberculosis
ggagccgagcac

SEQ ID NO: 884234 - RNA, 20 nt, Mycobacterium avium subsp. paratuberculosis
ggagccgagcaccaggcgca

SEQ ID NO: 884235 - RNA, 16 nt, Mycobacterium avium subsp. paratuberculosis
ggagccgagcaccggg

SEQ ID NO: 884236 - RNA, 16 nt, Mycobacterium avium subsp. paratuberculosis
ggagccgaucgccucc

SEQ ID NO: 884237 - RNA, 20 nt, Mycobacterium avium subsp. paratuberculosis
ggagccggccgccgaagccg

SEQ ID NO: 884238 - RNA, 19 nt, Mycobacterium avium subsp. paratuberculosis
ggagccggccucgccggcg

SEQ ID NO: 884239 - RNA, 22 nt, Mycobacterium avium subsp. paratuberculosis
ggagccguccggguucgacgcc

SEQ ID NO: 884240 - RNA, 15 nt, Mycobacterium avium subsp. paratuberculosis
ggagccgugcagcgc

SEQ ID NO: 884241 - RNA, 22 nt, Mycobacterium avium subsp. paratuberculosis
ggagcgccccagggccucggcg

SEQ ID NO: 884242 - RNA, 13 nt, Mycobacterium avium subsp. paratuberculosis
ggagcgcccggcc

SEQ ID NO: 884243 - RNA, 16 nt, Mycobacterium avium subsp. paratuberculosis
ggagcgcccggccagc

SEQ ID NO: 884244 - RNA, 17 nt, Mycobacterium avium subsp. paratuberculosis
ggagcgcccggccagcc

SEQ ID NO: 884245 - RNA, 19 nt, Mycobacterium avium subsp. paratuberculosis
ggagccuucuugaccgcag

SEQ ID NO: 884246 - RNA, 19 nt, Mycobacterium avium subsp. paratuberculosis
ggagccuuggucgcggccu

SEQ ID NO: 884247 - RNA, 16 nt, Mycobacterium avium subsp. paratuberculosis
ggagcgaaggugccgc

SEQ ID NO: 884248 - RNA, 22 nt, Mycobacterium avium subsp. paratuberculosis
ggagcgcggcaugccgcccggg

SEQ ID NO: 884249 - RNA, 14 nt, Mycobacterium avium subsp. paratuberculosis
ggagcgggccacgc

SEQ ID NO: 884250 - RNA, 13 nt, Mycobacterium avium subsp. paratuberculosis
ggagcggcccaac

SEQ ID NO: 884251 - RNA, 22 nt, Mycobacterium avium subsp. paratuberculosis
ggagcggcccaacacgcccugc

SEQ ID NO: 884252 - RNA, 13 nt, Mycobacterium avium subsp. paratuberculosis
ggagcgcuggucg

SEQ ID NO: 884253 - RNA, 15 nt, Mycobacterium avium subsp. paratuberculosis
ggagcgcuggucggc

SEQ ID NO: 884254 - RNA, 16 nt, Mycobacterium avium subsp. paratuberculosis
ggacgacggccagcug

SEQ ID NO: 884255 - RNA, 13 nt, Mycobacterium avium subsp. paratuberculosis
ggacgacggcgcc

SEQ ID NO: 884256 - RNA, 20 nt, Mycobacterium avium subsp. paratuberculosis
ggacgacggcgccgcccggg

SEQ ID NO: 884257 - RNA, 14 nt, Mycobacterium avium subsp. paratuberculosis
ggacgacgucgaug

SEQ ID NO: 884258 - RNA, 15 nt, Mycobacterium avium subsp. paratuberculosis
ggacgacgucgaugu

SEQ ID NO: 884259 - RNA, 15 nt, Mycobacterium avium subsp. paratuberculosis
ggacgagccgucgcg

SEQ ID NO: 884260 - RNA, 22 nt, Mycobacterium avium subsp. paratuberculosis
ggacgacgccgaacugccggac

SEQ ID NO: 884261 - RNA, 19 nt, Mycobacterium avium subsp. paratuberculosis
ggacgaccugggcgccguc

SEQ ID NO: 884262 - RNA, 20 nt, Mycobacterium avium subsp. paratuberculosis
ggacgaccugggcgccgucg

SEQ ID NO: 884263 - RNA, 17 nt, Mycobacterium avium subsp. paratuberculosis
ggacgaagugcccgccu

SEQ ID NO: 884264 - RNA, 15 nt, Mycobacterium avium subsp. paratuberculosis
ggacgaaugucucga

SEQ ID NO: 884265 - RNA, 22 nt, Mycobacterium avium subsp. paratuberculosis
ggacgacaccacggucgccgcg

SEQ ID NO: 884266 - RNA, 16 nt, Mycobacterium avium subsp. paratuberculosis
ggacgcccgcgacccg

SEQ ID NO: 884267 - RNA, 14 nt, Mycobacterium avium subsp. paratuberculosis
ggacgcccggcgag

SEQ ID NO: 884268 - RNA, 16 nt, Mycobacterium avium subsp. paratuberculosis
ggacgcccggcgagug

SEQ ID NO: 884269 - RNA, 17 nt, Mycobacterium avium subsp. paratuberculosis
ggacgcccggucgacca

SEQ ID NO: 884270 - RNA, 16 nt, Mycobacterium avium subsp. paratuberculosis
ggacgcccgucgcgca

SEQ ID NO: 884271 - RNA, 15 nt, Mycobacterium avium subsp. paratuberculosis
ggacgccgcaccgca

SEQ ID NO: 884272 - RNA, 14 nt, Mycobacterium avium subsp. paratuberculosis
ggacgccugccgcc

SEQ ID NO: 884273 - RNA, 16 nt, Mycobacterium avium subsp. paratuberculosis
ggacgccucgcgcagc

SEQ ID NO: 884274 - RNA, 17 nt, Mycobacterium avium subsp. paratuberculosis
ggacgccucgcgcagcg

SEQ ID NO: 884275 - RNA, 19 nt, Mycobacterium avium subsp. paratuberculosis
ggacgccucgcgcagcgcg

SEQ ID NO: 884276 - RNA, 13 nt, Mycobacterium avium subsp. paratuberculosis
ggacgccgcgcac

SEQ ID NO: 884277 - RNA, 14 nt, Mycobacterium avium subsp. paratuberculosis
ggacgccggcagcc

SEQ ID NO: 884278 - RNA, 16 nt, Mycobacterium avium subsp. paratuberculosis
ggacgccggcagccgc

SEQ ID NO: 884279 - RNA, 16 nt, Mycobacterium avium subsp. paratuberculosis
ggagaugauggccgcg

SEQ ID NO: 884280 - RNA, 20 nt, Mycobacterium avium subsp. paratuberculosis
ggagaugauggccgcgccgc

SEQ ID NO: 884281 - RNA, 17 nt, Mycobacterium avium subsp. paratuberculosis
ggagaugcgggccaccg

SEQ ID NO: 884282 - RNA, 20 nt, Mycobacterium avium subsp. paratuberculosis
ggagauggccagcaccaccg

SEQ ID NO: 884283 - RNA, 22 nt, Mycobacterium avium subsp. paratuberculosis
ggagauggccagcaccaccgcg

SEQ ID NO: 884284 - RNA, 23 nt, Mycobacterium avium subsp. paratuberculosis
ggagauguugaugaucgagccgc

SEQ ID NO: 884285 - RNA, 17 nt, Mycobacterium avium subsp. paratuberculosis
ggagcacagcacggcau

SEQ ID NO: 884286 - RNA, 17 nt, Mycobacterium avium subsp. paratuberculosis
ggagagcuugccgcgga

SEQ ID NO: 884287 - RNA, 13 nt, Mycobacterium avium subsp. paratuberculosis
ggagaucggcgag

SEQ ID NO: 884288 - RNA, 15 nt, Mycobacterium avium subsp. paratuberculosis
ggagaucggcgagug

SEQ ID NO: 884289 - RNA, 16 nt, Mycobacterium avium subsp. paratuberculosis
ggagaucggcgagugc

SEQ ID NO: 884290 - RNA, 13 nt, Mycobacterium avium subsp. paratuberculosis
ggacgcgaccagg

SEQ ID NO: 884291 - RNA, 14 nt, Mycobacterium avium subsp. paratuberculosis
ggacgcgaccaggc

SEQ ID NO: 884292 - RNA, 19 nt, Mycobacterium avium subsp. paratuberculosis
ggacgcgaccaggcccagc

SEQ ID NO: 884293 - RNA, 23 nt, Mycobacterium avium subsp. paratuberculosis
ggacgcgaccaggcccagcggau

SEQ ID NO: 884294 - RNA, 17 nt, Mycobacterium avium subsp. paratuberculosis
ggacgcgaccggccauc

SEQ ID NO: 884295 - RNA, 17 nt, Mycobacterium avium subsp. paratuberculosis
ggacgccguugacaccg

SEQ ID NO: 884296 - RNA, 22 nt, Mycobacterium avium subsp. paratuberculosis
ggacgccguugacaccgggugc

SEQ ID NO: 884297 - RNA, 18 nt, Mycobacterium avium subsp. paratuberculosis
ggacgcgauggcgcuggc

SEQ ID NO: 884298 - RNA, 20 nt, Mycobacterium avium subsp. paratuberculosis
ggacgcgcacacggccucgc

SEQ ID NO: 884299 - RNA, 14 nt, Mycobacterium avium subsp. paratuberculosis
ggagaggcccggca

SEQ ID NO: 884300 - RNA, 19 nt, Mycobacterium avium subsp. paratuberculosis
ggagauacggucgcaccgc

SEQ ID NO: 884301 - RNA, 21 nt, Mycobacterium avium subsp. paratuberculosis
ggagauacggucgcaccgcgg

SEQ ID NO: 884302 - RNA, 22 nt, Mycobacterium avium subsp. paratuberculosis
ggagauacggucgcaccgcggc

SEQ ID NO: 884303 - RNA, 23 nt, Mycobacterium avium subsp. paratuberculosis
ggagauacggucgcaccgcggcg

SEQ ID NO: 884304 - RNA, 22 nt, Mycobacterium avium subsp. paratuberculosis
ggagaucaccccuggcggguac

SEQ ID NO: 884305 - RNA, 13 nt, Mycobacterium avium subsp. paratuberculosis
ggagaucaccgcg

SEQ ID NO: 884306 - RNA, 13 nt, Mycobacterium avium subsp. paratuberculosis
ggagaucaccggc

SEQ ID NO: 884307 - RNA, 14 nt, Mycobacterium avium subsp. paratuberculosis
ggagaucaccggca

SEQ ID NO: 884308 - RNA, 16 nt, Mycobacterium avium subsp. paratuberculosis
ggauauuucgcggccg

SEQ ID NO: 884309 - RNA, 18 nt, Mycobacterium avium subsp. paratuberculosis
ggauauuucgcggccgaa

SEQ ID NO: 884310 - RNA, 15 nt, Mycobacterium avium subsp. paratuberculosis
ggauagaggcggcgc

SEQ ID NO: 884311 - RNA, 21 nt, Mycobacterium avium subsp. paratuberculosis
ggauaucccgcgggucgcggc

SEQ ID NO: 884312 - RNA, 15 nt, Mycobacterium avium subsp. paratuberculosis
ggaucaccgggacgg

SEQ ID NO: 884313 - RNA, 13 nt, Mycobacterium avium subsp. paratuberculosis
ggaucacgcggcg

SEQ ID NO: 884314 - RNA, 21 nt, Mycobacterium avium subsp. paratuberculosis
ggaucagcaccgacgcggcga

SEQ ID NO: 884315 - RNA, 22 nt, Mycobacterium avium subsp. paratuberculosis
ggaucagcagaugcgcgucgcg

SEQ ID NO: 884316 - RNA, 18 nt, Mycobacterium avium subsp. paratuberculosis
ggaucagcagcaccggcg

SEQ ID NO: 884317 - RNA, 20 nt, Mycobacterium avium subsp. paratuberculosis
ggaucaccaucacgucgcgc

SEQ ID NO: 884318 - RNA, 16 nt, Mycobacterium avium subsp. paratuberculosis
ggaucagcuccucgcg

SEQ ID NO: 884319 - RNA, 17 nt, Mycobacterium avium subsp. paratuberculosis
ggaucagcuccucgcgg

SEQ ID NO: 884320 - RNA, 21 nt, Mycobacterium avium subsp. paratuberculosis
ggauccaccaauucgcgcugc

SEQ ID NO: 884321 - RNA, 19 nt, Mycobacterium avium subsp. paratuberculosis
ggaucaucucguagccgug

SEQ ID NO: 884322 - RNA, 16 nt, Mycobacterium avium subsp. paratuberculosis
ggaucaucccgaccag

SEQ ID NO: 884323 - RNA, 15 nt, Mycobacterium avium subsp. paratuberculosis
ggaucccgguacggc

SEQ ID NO: 884324 - RNA, 18 nt, Mycobacterium avium subsp. paratuberculosis
ggaucccgguacggcuca

SEQ ID NO: 884325 - RNA, 14 nt, Mycobacterium avium subsp. paratuberculosis
ggaucccggugagc

SEQ ID NO: 884326 - RNA, 17 nt, Mycobacterium avium subsp. paratuberculosis
ggauccgaucagcagca

SEQ ID NO: 884327 - RNA, 20 nt, Mycobacterium avium subsp. paratuberculosis
ggauccgaugacgcugccgc

SEQ ID NO: 884328 - RNA, 12 nt, Mycobacterium avium subsp. paratuberculosis
ggauccgcaccg

SEQ ID NO: 884329 - RNA, 17 nt, Mycobacterium avium subsp. paratuberculosis
ggauccgcaccgggcag

SEQ ID NO: 884330 - RNA, 22 nt, Mycobacterium avium subsp. paratuberculosis
ggauccgcagcugaucggggcc

SEQ ID NO: 884331 - RNA, 21 nt, Mycobacterium avium subsp. paratuberculosis
ggaucccagucguuggugcgc

SEQ ID NO: 884332 - RNA, 16 nt, Mycobacterium avium subsp. paratuberculosis
ggauccagcggcggcc

SEQ ID NO: 884333 - RNA, 21 nt, Mycobacterium avium subsp. paratuberculosis
ggaucccgaaaccgucgacca

SEQ ID NO: 884334 - RNA, 14 nt, Mycobacterium avium subsp. paratuberculosis
ggaucccgaacugc

SEQ ID NO: 884335 - RNA, 22 nt, Mycobacterium avium subsp. paratuberculosis
ggauccccucacuccagcggcg

SEQ ID NO: 884336 - RNA, 16 nt, Mycobacterium avium subsp. paratuberculosis
ggaucccgcagccgcg

SEQ ID NO: 884337 - RNA, 20 nt, Mycobacterium avium subsp. paratuberculosis
ggaucccgcagccgcgacgg

SEQ ID NO: 884338 - RNA, 14 nt, Mycobacterium avium subsp. paratuberculosis
ggaucgaauccggc

SEQ ID NO: 884339 - RNA, 16 nt, Mycobacterium avium subsp. paratuberculosis
ggauccucgccgcggg

SEQ ID NO: 884340 - RNA, 19 nt, Mycobacterium avium subsp. paratuberculosis
ggauccucgccgcgggcca

SEQ ID NO: 884341 - RNA, 16 nt, Mycobacterium avium subsp. paratuberculosis
ggauccgucgccccgc

SEQ ID NO: 884342 - RNA, 16 nt, Mycobacterium avium subsp. paratuberculosis
ggauccgccugcgcgg

SEQ ID NO: 884343 - RNA, 21 nt, Mycobacterium avium subsp. paratuberculosis
ggauccggauugccgggcagc

SEQ ID NO: 884344 - RNA, 14 nt, Mycobacterium avium subsp. paratuberculosis
ggauccgggccggc

SEQ ID NO: 884345 - RNA, 15 nt, Mycobacterium avium subsp. paratuberculosis
ggauccgggccggcg

SEQ ID NO: 884346 - RNA, 19 nt, Mycobacterium avium subsp. paratuberculosis
ggauccgggccggcgucgc

SEQ ID NO: 884347 - RNA, 17 nt, Mycobacterium avium subsp. paratuberculosis
ggaucgagucccgcgcg

SEQ ID NO: 884348 - RNA, 23 nt, Mycobacterium avium subsp. paratuberculosis
ggaucgaguucagcgucgaugug

SEQ ID NO: 884349 - RNA, 13 nt, Mycobacterium avium subsp. paratuberculosis
ggaucgagcaccc

SEQ ID NO: 884350 - RNA, 18 nt, Mycobacterium avium subsp. paratuberculosis
ggaucgagcacccggcgg

SEQ ID NO: 884351 - RNA, 19 nt, Mycobacterium avium subsp. paratuberculosis
ggaucgagcacccggcggg

SEQ ID NO: 884352 - RNA, 13 nt, Mycobacterium avium subsp. paratuberculosis
ggaucgacgucga

SEQ ID NO: 884353 - RNA, 17 nt, Mycobacterium avium subsp. paratuberculosis
ggaucgacuccgggugg

SEQ ID NO: 884354 - RNA, 21 nt, Mycobacterium avium subsp. paratuberculosis
ggaucgcaggauggccugcac

SEQ ID NO: 884355 - RNA, 18 nt, Mycobacterium avium subsp. paratuberculosis
ggaucggcagcgcguuga

SEQ ID NO: 884356 - RNA, 13 nt, Mycobacterium avium subsp. paratuberculosis
ggaucggcccgau

SEQ ID NO: 884357 - RNA, 12 nt, Mycobacterium avium subsp. paratuberculosis
ggaucggccggc

SEQ ID NO: 884358 - RNA, 15 nt, Mycobacterium avium subsp. paratuberculosis
ggaucggccggcgag

SEQ ID NO: 884359 - RNA, 13 nt, Mycobacterium avium subsp. paratuberculosis
ggaucggcgccca

SEQ ID NO: 884360 - RNA, 18 nt, Mycobacterium avium subsp. paratuberculosis
ggaucggcgcccaccgcg

SEQ ID NO: 884361 - RNA, 14 nt, Mycobacterium avium subsp. paratuberculosis
ggaucggaccgcac

SEQ ID NO: 884362 - RNA, 16 nt, Mycobacterium avium subsp. paratuberculosis
ggaucgcuucggccag

SEQ ID NO: 884363 - RNA, 17 nt, Mycobacterium avium subsp. paratuberculosis
ggaucgcuucggccagc

SEQ ID NO: 884364 - RNA, 17 nt, Mycobacterium avium subsp. paratuberculosis
ggaucgcggcggucagg

SEQ ID NO: 884365 - RNA, 17 nt, Mycobacterium avium subsp. paratuberculosis
ggaucgcgggcgacccg

SEQ ID NO: 884366 - RNA, 11 nt, Mycobacterium avium subsp. paratuberculosis
ggaucgcggug

SEQ ID NO: 884367 - RNA, 22 nt, Mycobacterium avium subsp. paratuberculosis
ggaucgcgcugaccaggccguc

SEQ ID NO: 884368 - RNA, 22 nt, Mycobacterium avium subsp. paratuberculosis
ggaucgcggccacgcccuggcc

SEQ ID NO: 884369 - RNA, 18 nt, Mycobacterium avium subsp. paratuberculosis
ggaucgcgaugucgacgg

SEQ ID NO: 884370 - RNA, 20 nt, Mycobacterium avium subsp. paratuberculosis
ggaucgcgccuugggccauc

SEQ ID NO: 884371 - RNA, 13 nt, Mycobacterium avium subsp. paratuberculosis
ggaucgccaggcg

SEQ ID NO: 884372 - RNA, 17 nt, Mycobacterium avium subsp. paratuberculosis
ggaucgcccacccgcac

SEQ ID NO: 884373 - RNA, 21 nt, Mycobacterium avium subsp. paratuberculosis
ggaucgcccauuugccggugu

SEQ ID NO: 884374 - RNA, 20 nt, Mycobacterium avium subsp. paratuberculosis
ggaucgccgagguagccgcg

SEQ ID NO: 884375 - RNA, 23 nt, Mycobacterium avium subsp. paratuberculosis
ggaucgccgagguagccgcgcac

SEQ ID NO: 884376 - RNA, 16 nt, Mycobacterium avium subsp. paratuberculosis
ggaucuugucggcggc

SEQ ID NO: 884377 - RNA, 16 nt, Mycobacterium avium subsp. paratuberculosis
ggaucugcggugagcg

SEQ ID NO: 884378 - RNA, 18 nt, Mycobacterium avium subsp. paratuberculosis
ggaugaacucgugcggcg

SEQ ID NO: 884379 - RNA, 21 nt, Mycobacterium avium subsp. paratuberculosis
ggaugaacucgugcggcgccg

SEQ ID NO: 884380 - RNA, 17 nt, Mycobacterium avium subsp. paratuberculosis
ggaucuucucgcugcuc

SEQ ID NO: 884381 - RNA, 15 nt, Mycobacterium avium subsp. paratuberculosis
ggaucuugacggcga

SEQ ID NO: 884382 - RNA, 18 nt, Mycobacterium avium subsp. paratuberculosis
ggaucuugacggcgacgg

SEQ ID NO: 884383 - RNA, 17 nt, Mycobacterium avium subsp. paratuberculosis
ggaucuggccggugagc

SEQ ID NO: 884384 - RNA, 14 nt, Mycobacterium avium subsp. paratuberculosis
ggaucugggugagc

SEQ ID NO: 884385 - RNA, 23 nt, Mycobacterium avium subsp. paratuberculosis
ggaugagcugggcggcgcgcugc

SEQ ID NO: 884386 - RNA, 16 nt, Mycobacterium avium subsp. paratuberculosis
ggaugauuucggcgug

SEQ ID NO: 884387 - RNA, 14 nt, Mycobacterium avium subsp. paratuberculosis
ggaugcaccggcag

SEQ ID NO: 884388 - RNA, 20 nt, Mycobacterium avium subsp. paratuberculosis
ggaugaucgucucggccgcg

SEQ ID NO: 884389 - RNA, 23 nt, Mycobacterium avium subsp. paratuberculosis
ggaugauguucuccggcccggcg

SEQ ID NO: 884390 - RNA, 23 nt, Mycobacterium avium subsp. paratuberculosis
ggaugcagccggccaucucggcg

SEQ ID NO: 884391 - RNA, 21 nt, Mycobacterium avium subsp. paratuberculosis
ggaugacaccgcggaccaccg

SEQ ID NO: 884392 - RNA, 15 nt, Mycobacterium avium subsp. paratuberculosis
ggaugaccagggugg

SEQ ID NO: 884393 - RNA, 20 nt, Mycobacterium avium subsp. paratuberculosis
ggaugaccaggucgccggcg

SEQ ID NO: 884394 - RNA, 15 nt, Mycobacterium avium subsp. paratuberculosis
ggaugaccgcccagg

SEQ ID NO: 884395 - RNA, 21 nt, Mycobacterium avium subsp. paratuberculosis
ggaugaccgcgucggcgccgu

SEQ ID NO: 884396 - RNA, 23 nt, Mycobacterium avium subsp. paratuberculosis
ggaugacgaugaugucgcccggc

SEQ ID NO: 884397 - RNA, 23 nt, Mycobacterium avium subsp. paratuberculosis
ggaugaacagcacgugcccgccg

SEQ ID NO: 884398 - RNA, 20 nt, Mycobacterium avium subsp. paratuberculosis
ggaugacggucugcaccggg

SEQ ID NO: 884399 - RNA, 20 nt, Mycobacterium avium subsp. paratuberculosis
ggaugacgugcaccaccgcg

SEQ ID NO: 884400 - RNA, 13 nt, Mycobacterium avium subsp. paratuberculosis
ggaucggugaagc

SEQ ID NO: 884401 - RNA, 22 nt, Mycobacterium avium subsp. paratuberculosis
ggaucgguaacugcguguggcg

SEQ ID NO: 884402 - RNA, 13 nt, Mycobacterium avium subsp. paratuberculosis
ggaucggugcgcg

SEQ ID NO: 884403 - RNA, 19 nt, Mycobacterium avium subsp. paratuberculosis
ggaucgguggacgcggucg

SEQ ID NO: 884404 - RNA, 23 nt, Mycobacterium avium subsp. paratuberculosis
ggaucgguggacgcggucgccgc

SEQ ID NO: 884405 - RNA, 23 nt, Mycobacterium avium subsp. paratuberculosis
ggaucgucaccgaccccucggcg

SEQ ID NO: 884406 - RNA, 19 nt, Mycobacterium avium subsp. paratuberculosis
ggaucggcggcgacggcga

SEQ ID NO: 884407 - RNA, 16 nt, Mycobacterium avium subsp. paratuberculosis
ggaucgggaccgggaa

SEQ ID NO: 884408 - RNA, 21 nt, Mycobacterium avium subsp. paratuberculosis
ggaucgggaccgggaagccga

SEQ ID NO: 884409 - RNA, 19 nt, Mycobacterium avium subsp. paratuberculosis
ggaucgggcgguccaccga

SEQ ID NO: 884410 - RNA, 12 nt, Mycobacterium avium subsp. paratuberculosis
ggaucuccagca

SEQ ID NO: 884411 - RNA, 15 nt, Mycobacterium avium subsp. paratuberculosis
ggaucucccgggugg

SEQ ID NO: 884412 - RNA, 12 nt, Mycobacterium avium subsp. paratuberculosis
ggaucgugucga

SEQ ID NO: 884413 - RNA, 16 nt, Mycobacterium avium subsp. paratuberculosis
ggaucgucuugcggcc

SEQ ID NO: 884414 - RNA, 13 nt, Mycobacterium avium subsp. paratuberculosis
ggaucgucgccgg

SEQ ID NO: 884415 - RNA, 13 nt, Mycobacterium avium subsp. paratuberculosis
ggaucuccggccg

SEQ ID NO: 884416 - RNA, 20 nt, Mycobacterium avium subsp. paratuberculosis
ggaucucgaccucgucggcg

SEQ ID NO: 884417 - RNA, 13 nt, Mycobacterium avium subsp. paratuberculosis
ggaucucgcgggc

SEQ ID NO: 884418 - RNA, 20 nt, Mycobacterium avium subsp. paratuberculosis
ggaucucgcgggcccgcgcg

SEQ ID NO: 884419 - RNA, 17 nt, Mycobacterium avium subsp. paratuberculosis
ggaucucggugccggug

SEQ ID NO: 884420 - RNA, 20 nt, Mycobacterium avium subsp. paratuberculosis
ggaucucggugccggugaug

SEQ ID NO: 884421 - RNA, 23 nt, Mycobacterium avium subsp. paratuberculosis
ggaucucgucgggaaugucggcg

SEQ ID NO: 884422 - RNA, 21 nt, Mycobacterium avium subsp. paratuberculosis
ggaucugcacgucggcggccg

SEQ ID NO: 884423 - RNA, 23 nt, Mycobacterium avium subsp. paratuberculosis
ggaucugcacgucggcggccgcg

SEQ ID NO: 884424 - RNA, 18 nt, Mycobacterium avium subsp. paratuberculosis
ggaugcccgggccguccg

SEQ ID NO: 884425 - RNA, 22 nt, Mycobacterium avium subsp. paratuberculosis
ggaugcccgggccguccgggug

SEQ ID NO: 884426 - RNA, 13 nt, Mycobacterium avium subsp. paratuberculosis
ggaugcccggggg

SEQ ID NO: 884427 - RNA, 19 nt, Mycobacterium avium subsp. paratuberculosis
ggaugcccgggggauaggg

SEQ ID NO: 884428 - RNA, 18 nt, Mycobacterium avium subsp. paratuberculosis
ggaugccagcagguccgc

SEQ ID NO: 884429 - RNA, 19 nt, Mycobacterium avium subsp. paratuberculosis
ggaugcccaggccggcgag

SEQ ID NO: 884430 - RNA, 19 nt, Mycobacterium avium subsp. paratuberculosis
ggaugccgagcagcucggc

SEQ ID NO: 884431 - RNA, 12 nt, Mycobacterium avium subsp. paratuberculosis
ggaugccgaggu

SEQ ID NO: 884432 - RNA, 20 nt, Mycobacterium avium subsp. paratuberculosis
ggaugccgccggucacggcg

SEQ ID NO: 884433 - RNA, 13 nt, Mycobacterium avium subsp. paratuberculosis
ggaugccgcgcgg

SEQ ID NO: 884434 - RNA, 18 nt, Mycobacterium avium subsp. paratuberculosis
ggaugccgcgcggcgcca

SEQ ID NO: 884435 - RNA, 12 nt, Mycobacterium avium subsp. paratuberculosis
ggaugccggcgc

SEQ ID NO: 884436 - RNA, 15 nt, Mycobacterium avium subsp. paratuberculosis
ggaugccggcgccca

SEQ ID NO: 884437 - RNA, 17 nt, Mycobacterium avium subsp. paratuberculosis
ggaugccggcgcccagc

SEQ ID NO: 884438 - RNA, 22 nt, Mycobacterium avium subsp. paratuberculosis
ggaugcgcuggugcacccgaug

SEQ ID NO: 884439 - RNA, 16 nt, Mycobacterium avium subsp. paratuberculosis
ggaugcggucgaugag

SEQ ID NO: 884440 - RNA, 19 nt, Mycobacterium avium subsp. paratuberculosis
ggaugcggucgucgcccac

SEQ ID NO: 884441 - RNA, 21 nt, Mycobacterium avium subsp. paratuberculosis
ggaugcugcgggucagcagcu

SEQ ID NO: 884442 - RNA, 15 nt, Mycobacterium avium subsp. paratuberculosis
ggaugcuuggucgcg

SEQ ID NO: 884443 - RNA, 15 nt, Mycobacterium avium subsp. paratuberculosis
ggauggcggcguugc

SEQ ID NO: 884444 - RNA, 17 nt, Mycobacterium avium subsp. paratuberculosis
ggauggcguucugcacc

SEQ ID NO: 884445 - RNA, 22 nt, Mycobacterium avium subsp. paratuberculosis
ggauggcgcccggcagccgcuc

SEQ ID NO: 884446 - RNA, 14 nt, Mycobacterium avium subsp. paratuberculosis
ggauggcgccgucg

SEQ ID NO: 884447 - RNA, 15 nt, Mycobacterium avium subsp. paratuberculosis
ggauggcgccgucga

SEQ ID NO: 884448 - RNA, 23 nt, Mycobacterium avium subsp. paratuberculosis
ggaugcguuggccgagcagccgg

SEQ ID NO: 884449 - RNA, 22 nt, Mycobacterium avium subsp. paratuberculosis
ggauggcccgccagaucgccau

SEQ ID NO: 884450 - RNA, 15 nt, Mycobacterium avium subsp. paratuberculosis
gcuccaugaaccggu

SEQ ID NO: 884451 - RNA, 18 nt, Mycobacterium avium subsp. paratuberculosis
gcucggaguaguccagca

SEQ ID NO: 884452 - RNA, 18 nt, Mycobacterium avium subsp. paratuberculosis
gcucggaguucgcccgca

SEQ ID NO: 884453 - RNA, 18 nt, Mycobacterium avium subsp. paratuberculosis
gcucggaguugcgcagcc

SEQ ID NO: 884454 - RNA, 14 nt, Mycobacterium avium subsp. paratuberculosis
gcucggacgacucg

SEQ ID NO: 884455 - RNA, 15 nt, Mycobacterium avium subsp. paratuberculosis
gcucggaggaaccgu

SEQ ID NO: 884456 - RNA, 21 nt, Mycobacterium avium subsp. paratuberculosis
gcucggaggaaccgugcgucc

SEQ ID NO: 884457 - RNA, 14 nt, Mycobacterium avium subsp. paratuberculosis
gcucggcagccccg

SEQ ID NO: 884458 - RNA, 16 nt, Mycobacterium avium subsp. paratuberculosis
gcucggcagccccguc

SEQ ID NO: 884459 - RNA, 21 nt, Mycobacterium avium subsp. paratuberculosis
gcucggcagccccgucggucc

SEQ ID NO: 884460 - RNA, 18 nt, Mycobacterium avium subsp. paratuberculosis
gcucggcgagcugcgggu

SEQ ID NO: 884461 - RNA, 19 nt, Mycobacterium avium subsp. paratuberculosis
gcucggcgagcugcgggug

SEQ ID NO: 884462 - RNA, 14 nt, Mycobacterium avium subsp. paratuberculosis
gcucggcgaccugc

SEQ ID NO: 884463 - RNA, 16 nt, Mycobacterium avium subsp. paratuberculosis
gcucggcgaccugcgg

SEQ ID NO: 884464 - RNA, 20 nt, Mycobacterium avium subsp. paratuberculosis
gcucggcgaccugcggcucg

SEQ ID NO: 884465 - RNA, 18 nt, Mycobacterium avium subsp. paratuberculosis
gcucggccuugagccggu

SEQ ID NO: 884466 - RNA, 12 nt, Mycobacterium avium subsp. paratuberculosis
gcucggcgacgc

SEQ ID NO: 884467 - RNA, 15 nt, Mycobacterium avium subsp. paratuberculosis
gcucggcgaccgccg

SEQ ID NO: 884468 - RNA, 16 nt, Mycobacterium avium subsp. paratuberculosis
gcucggcgaccgccgg

SEQ ID NO: 884469 - RNA, 17 nt, Mycobacterium avium subsp. paratuberculosis
gcucggcgaccgccggu

SEQ ID NO: 884470 - RNA, 22 nt, Mycobacterium avium subsp. paratuberculosis
gcucggcgacaacagcgccgag

SEQ ID NO: 884471 - RNA, 13 nt, Mycobacterium avium subsp. paratuberculosis
gcucggccggccg

SEQ ID NO: 884472 - RNA, 16 nt, Mycobacterium avium subsp. paratuberculosis
gcucggccaccgcgcg

SEQ ID NO: 884473 - RNA, 17 nt, Mycobacterium avium subsp. paratuberculosis
gcucggccaccgcgcgg

SEQ ID NO: 884474 - RNA, 20 nt, Mycobacterium avium subsp. paratuberculosis
gcucggccaccagcgcccgc

SEQ ID NO: 884475 - RNA, 13 nt, Mycobacterium avium subsp. paratuberculosis
gcucggccaccag

SEQ ID NO: 884476 - RNA, 13 nt, Mycobacterium avium subsp. paratuberculosis
gcucggccgauga

SEQ ID NO: 884477 - RNA, 15 nt, Mycobacterium avium subsp. paratuberculosis
gcucggccgcaucgu

SEQ ID NO: 884478 - RNA, 13 nt, Mycobacterium avium subsp. paratuberculosis
gcucggccgccga

SEQ ID NO: 884479 - RNA, 15 nt, Mycobacterium avium subsp. paratuberculosis
gcucggccgccgaca

SEQ ID NO: 884480 - RNA, 14 nt, Mycobacterium avium subsp. paratuberculosis
gcucggccguggcc

SEQ ID NO: 884481 - RNA, 19 nt, Mycobacterium avium subsp. paratuberculosis
gcucggccucaggcgucgg

SEQ ID NO: 884482 - RNA, 13 nt, Mycobacterium avium subsp. paratuberculosis
gcucggcggcguc

SEQ ID NO: 884483 - RNA, 14 nt, Mycobacterium avium subsp. paratuberculosis
gcucggcggcgucg

SEQ ID NO: 884484 - RNA, 20 nt, Mycobacterium avium subsp. paratuberculosis
gcucggcggcgucguaguug

SEQ ID NO: 884485 - RNA, 19 nt, Mycobacterium avium subsp. paratuberculosis
gcucggcggcucagcaacc

SEQ ID NO: 884486 - RNA, 21 nt, Mycobacterium avium subsp. paratuberculosis
gcucggcggccucgccgucga

SEQ ID NO: 884487 - RNA, 19 nt, Mycobacterium avium subsp. paratuberculosis
gcucggcggccgccagcgu

SEQ ID NO: 884488 - RNA, 13 nt, Mycobacterium avium subsp. paratuberculosis
gcucggcggccug

SEQ ID NO: 884489 - RNA, 17 nt, Mycobacterium avium subsp. paratuberculosis
gcucggcggcgacggug

SEQ ID NO: 884490 - RNA, 13 nt, Mycobacterium avium subsp. paratuberculosis
gcucggcggcgca

SEQ ID NO: 884491 - RNA, 15 nt, Mycobacterium avium subsp. paratuberculosis
gcucggcggcgccgu

SEQ ID NO: 884492 - RNA, 20 nt, Mycobacterium avium subsp. paratuberculosis
gcucggcggcgccgucgucg

SEQ ID NO: 884493 - RNA, 13 nt, Mycobacterium avium subsp. paratuberculosis
gcucggcggcgcg

SEQ ID NO: 884494 - RNA, 14 nt, Mycobacterium avium subsp. paratuberculosis
gcucggcggcgcgc

SEQ ID NO: 884495 - RNA, 21 nt, Mycobacterium avium subsp. paratuberculosis
gcucggcgcugucggcgggga

SEQ ID NO: 884496 - RNA, 16 nt, Mycobacterium avium subsp. paratuberculosis
gcucggcgcuccagcg

SEQ ID NO: 884497 - RNA, 17 nt, Mycobacterium avium subsp. paratuberculosis
gcucggcgcuccagcgg

SEQ ID NO: 884498 - RNA, 22 nt, Mycobacterium avium subsp. paratuberculosis
gcucggcgcuccagcgggcggc

SEQ ID NO: 884499 - RNA, 20 nt, Mycobacterium avium subsp. paratuberculosis
gcucggcgcugaacugcucg

SEQ ID NO: 884500 - RNA, 15 nt, Mycobacterium avium subsp. paratuberculosis
gcucggcggccaugu

SEQ ID NO: 884501 - RNA, 12 nt, Mycobacterium avium subsp. paratuberculosis
gcucggcggccc

SEQ ID NO: 884502 - RNA, 13 nt, Mycobacterium avium subsp. paratuberculosis
gcucggcggcccg

SEQ ID NO: 884503 - RNA, 15 nt, Mycobacterium avium subsp. paratuberculosis
gcucggcggcccgca

SEQ ID NO: 884504 - RNA, 17 nt, Mycobacterium avium subsp. paratuberculosis
gcucggcggcgcgcagg

SEQ ID NO: 884505 - RNA, 21 nt, Mycobacterium avium subsp. paratuberculosis
gcucggcggcgcgcaggcgcg

SEQ ID NO: 884506 - RNA, 12 nt, Mycobacterium avium subsp. paratuberculosis
gcucggcggcgg

SEQ ID NO: 884507 - RNA, 22 nt, Mycobacterium avium subsp. paratuberculosis
gcucggcgggcucgcgcuggcg

SEQ ID NO: 884508 - RNA, 19 nt, Mycobacterium avium subsp. paratuberculosis
gcucggcgggucguagccg

SEQ ID NO: 884509 - RNA, 23 nt, Mycobacterium avium subsp. paratuberculosis
gcucggcgggucguagccgucga

SEQ ID NO: 884510 - RNA, 21 nt, Mycobacterium avium subsp. paratuberculosis
gcucggcguauucgucgucgg

SEQ ID NO: 884511 - RNA, 22 nt, Mycobacterium avium subsp. paratuberculosis
gcucggcguauucgucgucggc

SEQ ID NO: 884512 - RNA, 14 nt, Mycobacterium avium subsp. paratuberculosis
gcucggcgucccgc

SEQ ID NO: 884513 - RNA, 17 nt, Mycobacterium avium subsp. paratuberculosis
gcucggcgucccgcgcc

SEQ ID NO: 884514 - RNA, 18 nt, Mycobacterium avium subsp. paratuberculosis
gcucggcgucgcacgugg

SEQ ID NO: 884515 - RNA, 18 nt, Mycobacterium avium subsp. paratuberculosis
gcucggcguggcgcucag

SEQ ID NO: 884516 - RNA, 19 nt, Mycobacterium avium subsp. paratuberculosis
gcucggcguggcgcucagc

SEQ ID NO: 884517 - RNA, 13 nt, Mycobacterium avium subsp. paratuberculosis
gcucggcgugguc

SEQ ID NO: 884518 - RNA, 19 nt, Mycobacterium avium subsp. paratuberculosis
gcucggcguugagccggcg

SEQ ID NO: 884519 - RNA, 14 nt, Mycobacterium avium subsp. paratuberculosis
gcucgggugucgcc

SEQ ID NO: 884520 - RNA, 17 nt, Mycobacterium avium subsp. paratuberculosis
gcucggucaagccggcc

SEQ ID NO: 884521 - RNA, 18 nt, Mycobacterium avium subsp. paratuberculosis
gcucggucaagccggcca

SEQ ID NO: 884522 - RNA, 17 nt, Mycobacterium avium subsp. paratuberculosis
gcucgguaugcggcgac

SEQ ID NO: 884523 - RNA, 14 nt, Mycobacterium avium subsp. paratuberculosis
gcucggucaccagc

SEQ ID NO: 884524 - RNA, 18 nt, Mycobacterium avium subsp. paratuberculosis
gcucggucaccagcggcc

SEQ ID NO: 884525 - RNA, 16 nt, Mycobacterium avium subsp. paratuberculosis
gcucggucaccccgga

SEQ ID NO: 884526 - RNA, 17 nt, Mycobacterium avium subsp. paratuberculosis
gcucggggcucgcggug

SEQ ID NO: 884527 - RNA, 18 nt, Mycobacterium avium subsp. paratuberculosis
gcucgggggugcccggcc

SEQ ID NO: 884528 - RNA, 20 nt, Mycobacterium avium subsp. paratuberculosis
gcucgggguaguucagcgcg

SEQ ID NO: 884529 - RNA, 13 nt, Mycobacterium avium subsp. paratuberculosis
gcucggggucggc

SEQ ID NO: 884530 - RNA, 17 nt, Mycobacterium avium subsp. paratuberculosis
gcucgggcgguggcgcc

SEQ ID NO: 884531 - RNA, 18 nt, Mycobacterium avium subsp. paratuberculosis
gcucgggcgguggcgccg

SEQ ID NO: 884532 - RNA, 20 nt, Mycobacterium avium subsp. paratuberculosis
gcucgggcgguggcgccggg

SEQ ID NO: 884533 - RNA, 21 nt, Mycobacterium avium subsp. paratuberculosis
gcucgggcgcgaacagcgccg

SEQ ID NO: 884534 - RNA, 21 nt, Mycobacterium avium subsp. paratuberculosis
gcucgggaacggucagccgcg

SEQ ID NO: 884535 - RNA, 15 nt, Mycobacterium avium subsp. paratuberculosis
gcucgggcccgcgca

SEQ ID NO: 884536 - RNA, 20 nt, Mycobacterium avium subsp. paratuberculosis
gcucgggcccgcgcaccguc

SEQ ID NO: 884537 - RNA, 14 nt, Mycobacterium avium subsp. paratuberculosis
gcucgggcagcccg

SEQ ID NO: 884538 - RNA, 17 nt, Mycobacterium avium subsp. paratuberculosis
gcucgggcagcccgccg

SEQ ID NO: 884539 - RNA, 16 nt, Mycobacterium avium subsp. paratuberculosis
gcucgggcagcguguc

SEQ ID NO: 884540 - RNA, 18 nt, Mycobacterium avium subsp. paratuberculosis
gcucgggcagcguguccc

SEQ ID NO: 884541 - RNA, 20 nt, Mycobacterium avium subsp. paratuberculosis
gcucgggccauauuucguga

SEQ ID NO: 884542 - RNA, 13 nt, Mycobacterium avium subsp. paratuberculosis
gcucggcucggcc

SEQ ID NO: 884543 - RNA, 16 nt, Mycobacterium avium subsp. paratuberculosis
gcucggcucggccggc

SEQ ID NO: 884544 - RNA, 17 nt, Mycobacterium avium subsp. paratuberculosis
gcucggcucggccggcc

SEQ ID NO: 884545 - RNA, 18 nt, Mycobacterium avium subsp. paratuberculosis
gcucuucagcgcgacagc

SEQ ID NO: 884546 - RNA, 18 nt, Mycobacterium avium subsp. paratuberculosis
gcucuucaggaacccgaa

SEQ ID NO: 884547 - RNA, 13 nt, Mycobacterium avium subsp. paratuberculosis
gcucuucgacgau

SEQ ID NO: 884548 - RNA, 15 nt, Mycobacterium avium subsp. paratuberculosis
gcucuucgcgcgcgg

SEQ ID NO: 884549 - RNA, 23 nt, Mycobacterium avium subsp. paratuberculosis
gcucuucggugguguggaucucc

SEQ ID NO: 884550 - RNA, 11 nt, Mycobacterium avium subsp. paratuberculosis
gcucuggccga

SEQ ID NO: 884551 - RNA, 13 nt, Mycobacterium avium subsp. paratuberculosis
gcucuggccgauc

SEQ ID NO: 884552 - RNA, 16 nt, Mycobacterium avium subsp. paratuberculosis
gcucuguuggccgucg

SEQ ID NO: 884553 - RNA, 23 nt, Mycobacterium avium subsp. paratuberculosis
gcucugacggcucuucggcgccg

SEQ ID NO: 884554 - RNA, 13 nt, Mycobacterium avium subsp. paratuberculosis
gcucugccgggcc

SEQ ID NO: 884555 - RNA, 14 nt, Mycobacterium avium subsp. paratuberculosis
gcucugccgggccg

SEQ ID NO: 884556 - RNA, 15 nt, Mycobacterium avium subsp. paratuberculosis
gcucucgucgucggc

SEQ ID NO: 884557 - RNA, 16 nt, Mycobacterium avium subsp. paratuberculosis
gcucucgucgucggcg

SEQ ID NO: 884558 - RNA, 17 nt, Mycobacterium avium subsp. paratuberculosis
gcucucgucgucggcgg

SEQ ID NO: 884559 - RNA, 18 nt, Mycobacterium avium subsp. paratuberculosis
gcucucgucgucggcggg

SEQ ID NO: 884560 - RNA, 14 nt, Mycobacterium avium subsp. paratuberculosis
gcucgucggcgcgg

SEQ ID NO: 884561 - RNA, 15 nt, Mycobacterium avium subsp. paratuberculosis
gcucgucggcgcggg

SEQ ID NO: 884562 - RNA, 17 nt, Mycobacterium avium subsp. paratuberculosis
gcucgucggcgcgggcc

SEQ ID NO: 884563 - RNA, 19 nt, Mycobacterium avium subsp. paratuberculosis
gcucgucggcgcgggccag

SEQ ID NO: 884564 - RNA, 15 nt, Mycobacterium avium subsp. paratuberculosis
gcucucgccggucag

SEQ ID NO: 884565 - RNA, 15 nt, Mycobacterium avium subsp. paratuberculosis
gcucgucggccagcg

SEQ ID NO: 884566 - RNA, 16 nt, Mycobacterium avium subsp. paratuberculosis
gcucgucggccagcga

SEQ ID NO: 884567 - RNA, 17 nt, Mycobacterium avium subsp. paratuberculosis
gcucgucggccgacucg

SEQ ID NO: 884568 - RNA, 12 nt, Mycobacterium avium subsp. paratuberculosis
gcucgucggcga

SEQ ID NO: 884569 - RNA, 15 nt, Mycobacterium avium subsp. paratuberculosis
gcucgucggcgaaca

SEQ ID NO: 884570 - RNA, 16 nt, Mycobacterium avium subsp. paratuberculosis
gcucggucaggcccag

SEQ ID NO: 884571 - RNA, 20 nt, Mycobacterium avium subsp. paratuberculosis
gcucggucaggcccaggucg

SEQ ID NO: 884572 - RNA, 16 nt, Mycobacterium avium subsp. paratuberculosis
gcucggucagccgggc

SEQ ID NO: 884573 - RNA, 22 nt, Mycobacterium avium subsp. paratuberculosis
gcucggucgcggucggcgcccg

SEQ ID NO: 884574 - RNA, 14 nt, Mycobacterium avium subsp. paratuberculosis
gcucgggugacgcc

SEQ ID NO: 884575 - RNA, 22 nt, Mycobacterium avium subsp. paratuberculosis
gcucggugaugccgagcgccgc

SEQ ID NO: 884576 - RNA, 15 nt, Mycobacterium avium subsp. paratuberculosis
gcucggugaucacca

SEQ ID NO: 884577 - RNA, 17 nt, Mycobacterium avium subsp. paratuberculosis
gcucggugaucaccaug

SEQ ID NO: 884578 - RNA, 18 nt, Mycobacterium avium subsp. paratuberculosis
gcucggugaugaucgccg

SEQ ID NO: 884579 - RNA, 19 nt, Mycobacterium avium subsp. paratuberculosis
gcucggugaugaucgccgg

SEQ ID NO: 884580 - RNA, 21 nt, Mycobacterium avium subsp. paratuberculosis
gcucggugaugaucgccgggu

SEQ ID NO: 884581 - RNA, 21 nt, Mycobacterium avium subsp. paratuberculosis
gcucguaacgccacggcggcc

SEQ ID NO: 884582 - RNA, 22 nt, Mycobacterium avium subsp. paratuberculosis
gcucguaacgccacggcggccg

SEQ ID NO: 884583 - RNA, 18 nt, Mycobacterium avium subsp. paratuberculosis
gcucgguggcgucggcgg

SEQ ID NO: 884584 - RNA, 21 nt, Mycobacterium avium subsp. paratuberculosis
gcucgguggcgucggcggccu

SEQ ID NO: 884585 - RNA, 16 nt, Mycobacterium avium subsp. paratuberculosis
gcucggugcgcauggc

SEQ ID NO: 884586 - RNA, 18 nt, Mycobacterium avium subsp. paratuberculosis
gcucggugcagaccccgg

SEQ ID NO: 884587 - RNA, 14 nt, Mycobacterium avium subsp. paratuberculosis
gcucggugugcggu

SEQ ID NO: 884588 - RNA, 13 nt, Mycobacterium avium subsp. paratuberculosis
gcucgucagcgcg

SEQ ID NO: 884589 - RNA, 14 nt, Mycobacterium avium subsp. paratuberculosis
gcucgucagcgcgg

SEQ ID NO: 884590 - RNA, 19 nt, Mycobacterium avium subsp. paratuberculosis
gcucgucagcgcgggccag

SEQ ID NO: 884591 - RNA, 17 nt, Mycobacterium avium subsp. paratuberculosis
gcucguaguuggggccg

SEQ ID NO: 884592 - RNA, 21 nt, Mycobacterium avium subsp. paratuberculosis
gcucguaguuggggccggccg

SEQ ID NO: 884593 - RNA, 22 nt, Mycobacterium avium subsp. paratuberculosis
gcucguaguuggggccggccgc

SEQ ID NO: 884594 - RNA, 14 nt, Mycobacterium avium subsp. paratuberculosis
gcucguccagcccg

SEQ ID NO: 884595 - RNA, 16 nt, Mycobacterium avium subsp. paratuberculosis
gcucguccagcccggu

SEQ ID NO: 884596 - RNA, 15 nt, Mycobacterium avium subsp. paratuberculosis
gcucguccagcgugc

SEQ ID NO: 884597 - RNA, 17 nt, Mycobacterium avium subsp. paratuberculosis
gcucguccagcgugccg

SEQ ID NO: 884598 - RNA, 13 nt, Mycobacterium avium subsp. paratuberculosis
gcucgucgcggag

SEQ ID NO: 884599 - RNA, 14 nt, Mycobacterium avium subsp. paratuberculosis
gcucgucgccgacc

SEQ ID NO: 884600 - RNA, 14 nt, Mycobacterium avium subsp. paratuberculosis
gcucgucgagcauc

SEQ ID NO: 884601 - RNA, 13 nt, Mycobacterium avium subsp. paratuberculosis
gcucguccuggcg

SEQ ID NO: 884602 - RNA, 15 nt, Mycobacterium avium subsp. paratuberculosis
gcucguccuggcgcu

SEQ ID NO: 884603 - RNA, 17 nt, Mycobacterium avium subsp. paratuberculosis
gcucguccuggcgcugg

SEQ ID NO: 884604 - RNA, 18 nt, Mycobacterium avium subsp. paratuberculosis
gcucguccuggcgcuggu

SEQ ID NO: 884605 - RNA, 17 nt, Mycobacterium avium subsp. paratuberculosis
gcucgucgacgcugacc

SEQ ID NO: 884606 - RNA, 22 nt, Mycobacterium avium subsp. paratuberculosis
gcucgucgacgcugaccguggu

SEQ ID NO: 884607 - RNA, 22 nt, Mycobacterium avium subsp. paratuberculosis
gcucgucgacguccucgcccgg

SEQ ID NO: 884608 - RNA, 20 nt, Mycobacterium avium subsp. paratuberculosis
gcugcaacaacuucggggug

SEQ ID NO: 884609 - RNA, 18 nt, Mycobacterium avium subsp. paratuberculosis
gcugaucgcgauccgggc

SEQ ID NO: 884610 - RNA, 19 nt, Mycobacterium avium subsp. paratuberculosis
gcugaucgcgauccgggcg

SEQ ID NO: 884611 - RNA, 13 nt, Mycobacterium avium subsp. paratuberculosis
gcugaucgaccgg

SEQ ID NO: 884612 - RNA, 17 nt, Mycobacterium avium subsp. paratuberculosis
gcugaucgaguccucgc

SEQ ID NO: 884613 - RNA, 19 nt, Mycobacterium avium subsp. paratuberculosis
gcugaucgaguccucgcgg

SEQ ID NO: 884614 - RNA, 14 nt, Mycobacterium avium subsp. paratuberculosis
gcugaucgcgucga

SEQ ID NO: 884615 - RNA, 18 nt, Mycobacterium avium subsp. paratuberculosis
gcugaucgcgucgacggc

SEQ ID NO: 884616 - RNA, 17 nt, Mycobacterium avium subsp. paratuberculosis
gcugaucggggcccacc

SEQ ID NO: 884617 - RNA, 20 nt, Mycobacterium avium subsp. paratuberculosis
gcugaucggggcccaccccg

SEQ ID NO: 884618 - RNA, 16 nt, Mycobacterium avium subsp. paratuberculosis
gcugaucgcggccggc

SEQ ID NO: 884619 - RNA, 20 nt, Mycobacterium avium subsp. paratuberculosis
gcugauguucaguucgucca

SEQ ID NO: 884620 - RNA, 19 nt, Mycobacterium avium subsp. paratuberculosis
gcugagcgccaggccaugg

SEQ ID NO: 884621 - RNA, 21 nt, Mycobacterium avium subsp. paratuberculosis
gcugagcgccaggccauggcg

SEQ ID NO: 884622 - RNA, 13 nt, Mycobacterium avium subsp. paratuberculosis
gcugagccggccc

SEQ ID NO: 884623 - RNA, 14 nt, Mycobacterium avium subsp. paratuberculosis
gcugagccggcccu

SEQ ID NO: 884624 - RNA, 23 nt, Mycobacterium avium subsp. paratuberculosis
gcugagccggcccugcggccagu

SEQ ID NO: 884625 - RNA, 18 nt, Mycobacterium avium subsp. paratuberculosis
gcugagccgccgagccgg

SEQ ID NO: 884626 - RNA, 21 nt, Mycobacterium avium subsp. paratuberculosis
gcugagccgccgagccggcac

SEQ ID NO: 884627 - RNA, 13 nt, Mycobacterium avium subsp. paratuberculosis
gcugagcgucggu

SEQ ID NO: 884628 - RNA, 18 nt, Mycobacterium avium subsp. paratuberculosis
gcugagcguggugaagca

SEQ ID NO: 884629 - RNA, 23 nt, Mycobacterium avium subsp. paratuberculosis
gcugagcguggugaagcagaacg

SEQ ID NO: 884630 - RNA, 22 nt, Mycobacterium avium subsp. paratuberculosis
gcugagcggguaaccgcagccg

SEQ ID NO: 884631 - RNA, 20 nt, Mycobacterium avium subsp. paratuberculosis
gcugagcgggucggccggcg

SEQ ID NO: 884632 - RNA, 18 nt, Mycobacterium avium subsp. paratuberculosis
gcugagcugcgcccacgu

SEQ ID NO: 884633 - RNA, 19 nt, Mycobacterium avium subsp. paratuberculosis
gcugagcugugccgcggug

SEQ ID NO: 884634 - RNA, 18 nt, Mycobacterium avium subsp. paratuberculosis
gcugagcuucugcccggc

SEQ ID NO: 884635 - RNA, 19 nt, Mycobacterium avium subsp. paratuberculosis
gcugagcuucugcccggcc

SEQ ID NO: 884636 - RNA, 22 nt, Mycobacterium avium subsp. paratuberculosis
gcugagcuucugcccggccagc

SEQ ID NO: 884637 - RNA, 17 nt, Mycobacterium avium subsp. paratuberculosis
gcugaucagccggcgag

SEQ ID NO: 884638 - RNA, 19 nt, Mycobacterium avium subsp. paratuberculosis
gcugaucaugaagucgcgg

SEQ ID NO: 884639 - RNA, 14 nt, Mycobacterium avium subsp. paratuberculosis
gcugauccacgccc

SEQ ID NO: 884640 - RNA, 22 nt, Mycobacterium avium subsp. paratuberculosis
gcugauccacgcccggacccgc

SEQ ID NO: 884641 - RNA, 14 nt, Mycobacterium avium subsp. paratuberculosis
gcugauccagcagc

SEQ ID NO: 884642 - RNA, 17 nt, Mycobacterium avium subsp. paratuberculosis
gcugauccagcagcgcc

SEQ ID NO: 884643 - RNA, 19 nt, Mycobacterium avium subsp. paratuberculosis
gcugaucccacauucggcg

SEQ ID NO: 884644 - RNA, 15 nt, Mycobacterium avium subsp. paratuberculosis
gcugauccccagcgg

SEQ ID NO: 884645 - RNA, 20 nt, Mycobacterium avium subsp. paratuberculosis
gcugauccccagcggcacga

SEQ ID NO: 884646 - RNA, 19 nt, Mycobacterium avium subsp. paratuberculosis
gcugacgucgaaggugaug

SEQ ID NO: 884647 - RNA, 16 nt, Mycobacterium avium subsp. paratuberculosis
gcugacgucgaugccg

SEQ ID NO: 884648 - RNA, 22 nt, Mycobacterium avium subsp. paratuberculosis
gcugacgucgaugccggccagc

SEQ ID NO: 884649 - RNA, 15 nt, Mycobacterium avium subsp. paratuberculosis
gcugacgucgucgcc

SEQ ID NO: 884650 - RNA, 22 nt, Mycobacterium avium subsp. paratuberculosis
gcugacgucgucgcccaccgug

SEQ ID NO: 884651 - RNA, 13 nt, Mycobacterium avium subsp. paratuberculosis
gcugacggucgcc

SEQ ID NO: 884652 - RNA, 20 nt, Mycobacterium avium subsp. paratuberculosis
gcugacgggaccgcacgccg

SEQ ID NO: 884653 - RNA, 19 nt, Mycobacterium avium subsp. paratuberculosis
gcugaagugcacucggcga

SEQ ID NO: 884654 - RNA, 20 nt, Mycobacterium avium subsp. paratuberculosis
gcugaagugcacucggcgau

SEQ ID NO: 884655 - RNA, 16 nt, Mycobacterium avium subsp. paratuberculosis
gcugaaguucaccacc

SEQ ID NO: 884656 - RNA, 17 nt, Mycobacterium avium subsp. paratuberculosis
gcugaaguucaccaccg

SEQ ID NO: 884657 - RNA, 22 nt, Mycobacterium avium subsp. paratuberculosis
gcugaaguucaccaccgcgcug

SEQ ID NO: 884658 - RNA, 23 nt, Mycobacterium avium subsp. paratuberculosis
gcugaaguucaccaccgcgcugc

SEQ ID NO: 884659 - RNA, 15 nt, Mycobacterium avium subsp. paratuberculosis
gcugacgcgaccgcg

SEQ ID NO: 884660 - RNA, 17 nt, Mycobacterium avium subsp. paratuberculosis
gcugacgcgaccgcgcg

SEQ ID NO: 884661 - RNA, 18 nt, Mycobacterium avium subsp. paratuberculosis
gcugacgcgaccgcgcgg

SEQ ID NO: 884662 - RNA, 13 nt, Mycobacterium avium subsp. paratuberculosis
gcugacgccgcgg

SEQ ID NO: 884663 - RNA, 20 nt, Mycobacterium avium subsp. paratuberculosis
gcugacgaugcggccggcgg

SEQ ID NO: 884664 - RNA, 13 nt, Mycobacterium avium subsp. paratuberculosis
gcugacgauggcg

SEQ ID NO: 884665 - RNA, 18 nt, Mycobacterium avium subsp. paratuberculosis
gcugacgauggcgaccgc

SEQ ID NO: 884666 - RNA, 19 nt, Mycobacterium avium subsp. paratuberculosis
gcugacgauggcgaccgcg

SEQ ID NO: 884667 - RNA, 22 nt, Mycobacterium avium subsp. paratuberculosis
gcugacgauggcgaccgcgcag

SEQ ID NO: 884668 - RNA, 14 nt, Mycobacterium avium subsp. paratuberculosis
gcugaaauccgggg

SEQ ID NO: 884669 - RNA, 19 nt, Mycobacterium avium subsp. paratuberculosis
gcugaacgggcagccacgc

SEQ ID NO: 884670 - RNA, 20 nt, Mycobacterium avium subsp. paratuberculosis
gcugaacgggcagccacgcg

SEQ ID NO: 884671 - RNA, 16 nt, Mycobacterium avium subsp. paratuberculosis
gcugaacucgacgucg

SEQ ID NO: 884672 - RNA, 16 nt, Mycobacterium avium subsp. paratuberculosis
gcugaacugcucgacc

SEQ ID NO: 884673 - RNA, 14 nt, Mycobacterium avium subsp. paratuberculosis
gcugaagcccaccg

SEQ ID NO: 884674 - RNA, 16 nt, Mycobacterium avium subsp. paratuberculosis
gcugaagcccaccgcc

SEQ ID NO: 884675 - RNA, 18 nt, Mycobacterium avium subsp. paratuberculosis
gcugaaagcucgcgucga

SEQ ID NO: 884676 - RNA, 17 nt, Mycobacterium avium subsp. paratuberculosis
gcugaagcgcgaccccu

SEQ ID NO: 884677 - RNA, 17 nt, Mycobacterium avium subsp. paratuberculosis
gcugaagccgaacgcgc

SEQ ID NO: 884678 - RNA, 18 nt, Mycobacterium avium subsp. paratuberculosis
gcugccacgguuucgccg

SEQ ID NO: 884679 - RNA, 18 nt, Mycobacterium avium subsp. paratuberculosis
gcugccacguacaccggg

SEQ ID NO: 884680 - RNA, 15 nt, Mycobacterium avium subsp. paratuberculosis
gcugcccgccgcggu

SEQ ID NO: 884681 - RNA, 14 nt, Mycobacterium avium subsp. paratuberculosis
gcugcccgcgacug

SEQ ID NO: 884682 - RNA, 20 nt, Mycobacterium avium subsp. paratuberculosis
gcugcccgcgacugucggcg

SEQ ID NO: 884683 - RNA, 23 nt, Mycobacterium avium subsp. paratuberculosis
gcugcccgcggccgccgccgcgg

SEQ ID NO: 884684 - RNA, 23 nt, Mycobacterium avium subsp. paratuberculosis
gcugcccggaguccggcucggug

SEQ ID NO: 884685 - RNA, 13 nt, Mycobacterium avium subsp. paratuberculosis
gcugcccggcaac

SEQ ID NO: 884686 - RNA, 14 nt, Mycobacterium avium subsp. paratuberculosis
gcugcccggcccgc

SEQ ID NO: 884687 - RNA, 12 nt, Mycobacterium avium subsp. paratuberculosis
gcugcccggcgc

SEQ ID NO: 884688 - RNA, 14 nt, Mycobacterium avium subsp. paratuberculosis
gcugcccggcgcca

SEQ ID NO: 884689 - RNA, 17 nt, Mycobacterium avium subsp. paratuberculosis
gcugcccggcgccacgc

SEQ ID NO: 884690 - RNA, 14 nt, Mycobacterium avium subsp. paratuberculosis
gcugcccggcgcua

SEQ ID NO: 884691 - RNA, 22 nt, Mycobacterium avium subsp. paratuberculosis
gcugcccggcgcuaaagccgac

SEQ ID NO: 884692 - RNA, 18 nt, Mycobacterium avium subsp. paratuberculosis
gcugccccggcgaggcca

SEQ ID NO: 884693 - RNA, 13 nt, Mycobacterium avium subsp. paratuberculosis
gcugcccgacccg

SEQ ID NO: 884694 - RNA, 22 nt, Mycobacterium avium subsp. paratuberculosis
gcugcccgacccgcaccaccgc

SEQ ID NO: 884695 - RNA, 13 nt, Mycobacterium avium subsp. paratuberculosis
gcugcccgagcgg

SEQ ID NO: 884696 - RNA, 17 nt, Mycobacterium avium subsp. paratuberculosis
gcugcccgagcggcgac

SEQ ID NO: 884697 - RNA, 16 nt, Mycobacterium avium subsp. paratuberculosis
gcugcccgccgacgcc

SEQ ID NO: 884698 - RNA, 17 nt, Mycobacterium avium subsp. paratuberculosis
gcugcccgccgacgccc

SEQ ID NO: 884699 - RNA, 17 nt, Mycobacterium avium subsp. paratuberculosis
gcugccgcgcgccgaca

SEQ ID NO: 884700 - RNA, 21 nt, Mycobacterium avium subsp. paratuberculosis
gcugccgcgcgccgacagacc

SEQ ID NO: 884701 - RNA, 19 nt, Mycobacterium avium subsp. paratuberculosis
gcugccgagguacgcgcug

SEQ ID NO: 884702 - RNA, 13 nt, Mycobacterium avium subsp. paratuberculosis
gcugccgacgaug

SEQ ID NO: 884703 - RNA, 15 nt, Mycobacterium avium subsp. paratuberculosis
gcugccgacgauguc

SEQ ID NO: 884704 - RNA, 14 nt, Mycobacterium avium subsp. paratuberculosis
gcugccgaccagga

SEQ ID NO: 884705 - RNA, 19 nt, Mycobacterium avium subsp. paratuberculosis
gcugccgaccucgauggcg

SEQ ID NO: 884706 - RNA, 21 nt, Mycobacterium avium subsp. paratuberculosis
gcugccgagcaccucgucgcc

SEQ ID NO: 884707 - RNA, 22 nt, Mycobacterium avium subsp. paratuberculosis
gcugccgagcaccucgucgccg

SEQ ID NO: 884708 - RNA, 20 nt, Mycobacterium avium subsp. paratuberculosis
gcugcccuuguugacguacc

SEQ ID NO: 884709 - RNA, 19 nt, Mycobacterium avium subsp. paratuberculosis
gcugccgaacaucagccga

SEQ ID NO: 884710 - RNA, 17 nt, Mycobacterium avium subsp. paratuberculosis
gcugcccucggucgccg

SEQ ID NO: 884711 - RNA, 19 nt, Mycobacterium avium subsp. paratuberculosis
gcugcccugaagcugggcg

SEQ ID NO: 884712 - RNA, 13 nt, Mycobacterium avium subsp. paratuberculosis
gcugcccucgguc

SEQ ID NO: 884713 - RNA, 23 nt, Mycobacterium avium subsp. paratuberculosis
gcugcccgggcuguugaccacgg

SEQ ID NO: 884714 - RNA, 14 nt, Mycobacterium avium subsp. paratuberculosis
gcugcccgucgacc

SEQ ID NO: 884715 - RNA, 22 nt, Mycobacterium avium subsp. paratuberculosis
gcugcccgucggaggacaacgc

SEQ ID NO: 884716 - RNA, 23 nt, Mycobacterium avium subsp. paratuberculosis
gcugcacgucacgggccaggcgc

SEQ ID NO: 884717 - RNA, 22 nt, Mycobacterium avium subsp. paratuberculosis
gcugcacguccgccuccgacca

SEQ ID NO: 884718 - RNA, 19 nt, Mycobacterium avium subsp. paratuberculosis
gcugcacgucgccggcgac

SEQ ID NO: 884719 - RNA, 15 nt, Mycobacterium avium subsp. paratuberculosis
gcugcagcagcccga

SEQ ID NO: 884720 - RNA, 15 nt, Mycobacterium avium subsp. paratuberculosis
gcugcagcugcucgu

SEQ ID NO: 884721 - RNA, 14 nt, Mycobacterium avium subsp. paratuberculosis
gcugcagauccgcu

SEQ ID NO: 884722 - RNA, 21 nt, Mycobacterium avium subsp. paratuberculosis
gcugcagaccgaacgucacgg

SEQ ID NO: 884723 - RNA, 23 nt, Mycobacterium avium subsp. paratuberculosis
gcugcacgcguugcagcgccgcg

SEQ ID NO: 884724 - RNA, 15 nt, Mycobacterium avium subsp. paratuberculosis
gcugcacgcugcgca

SEQ ID NO: 884725 - RNA, 14 nt, Mycobacterium avium subsp. paratuberculosis
gcugcacgacgacc

SEQ ID NO: 884726 - RNA, 14 nt, Mycobacterium avium subsp. paratuberculosis
gcugcaaccgguag

SEQ ID NO: 884727 - RNA, 22 nt, Mycobacterium avium subsp. paratuberculosis
gcugcaaccgguccgccgucgg

SEQ ID NO: 884728 - RNA, 15 nt, Mycobacterium avium subsp. paratuberculosis
gcugcaacgcgucgg

SEQ ID NO: 884729 - RNA, 20 nt, Mycobacterium avium subsp. paratuberculosis
gcugcaacgcgucggcgccg

SEQ ID NO: 884730 - RNA, 14 nt, Mycobacterium avium subsp. paratuberculosis
gcugcaccggggcc

SEQ ID NO: 884731 - RNA, 20 nt, Mycobacterium avium subsp. paratuberculosis
gcugcaccggguacaccggc

SEQ ID NO: 884732 - RNA, 13 nt, Mycobacterium avium subsp. paratuberculosis
gcugcauccgcag

SEQ ID NO: 884733 - RNA, 22 nt, Mycobacterium avium subsp. paratuberculosis
gcugcaucuccguggacggcga

SEQ ID NO: 884734 - RNA, 21 nt, Mycobacterium avium subsp. paratuberculosis
gcugcauagucggcccgaucg

SEQ ID NO: 884735 - RNA, 22 nt, Mycobacterium avium subsp. paratuberculosis
gcugcagguugauccggauccg

SEQ ID NO: 884736 - RNA, 15 nt, Mycobacterium avium subsp. paratuberculosis
gcugcaguagccggc

SEQ ID NO: 884737 - RNA, 20 nt, Mycobacterium avium subsp. paratuberculosis
gcugcaggcuggucuggugg

SEQ ID NO: 884738 - RNA, 10 nt, Mycobacterium avium subsp. paratuberculosis
gcugcagggc

SEQ ID NO: 884739 - RNA, 15 nt, Mycobacterium avium subsp. paratuberculosis
gcugcagguggccca

SEQ ID NO: 884740 - RNA, 18 nt, Mycobacterium avium subsp. paratuberculosis
gcugcagguggcccacac

SEQ ID NO: 884741 - RNA, 14 nt, Mycobacterium avium subsp. paratuberculosis
gcugcuucgucgcc

SEQ ID NO: 884742 - RNA, 15 nt, Mycobacterium avium subsp. paratuberculosis
gcugcuucgucgccg

SEQ ID NO: 884743 - RNA, 14 nt, Mycobacterium avium subsp. paratuberculosis
gcugcuugacccgc

SEQ ID NO: 884744 - RNA, 18 nt, Mycobacterium avium subsp. paratuberculosis
gcugcugggacgggucgg

SEQ ID NO: 884745 - RNA, 20 nt, Mycobacterium avium subsp. paratuberculosis
gcugcugggacgggucggcg

SEQ ID NO: 884746 - RNA, 15 nt, Mycobacterium avium subsp. paratuberculosis
gcugcuggcgcuggg

SEQ ID NO: 884747 - RNA, 16 nt, Mycobacterium avium subsp. paratuberculosis
gcugcuggucgacguc

SEQ ID NO: 884748 - RNA, 21 nt, Mycobacterium avium subsp. paratuberculosis
gcugcuguagcucacgguguc

SEQ ID NO: 884749 - RNA, 19 nt, Mycobacterium avium subsp. paratuberculosis
gcuggaaauaggccgggca

SEQ ID NO: 884750 - RNA, 14 nt, Mycobacterium avium subsp. paratuberculosis
gcuggaacagcggg

SEQ ID NO: 884751 - RNA, 20 nt, Mycobacterium avium subsp. paratuberculosis
gcuggaaccgaaucggucga

SEQ ID NO: 884752 - RNA, 22 nt, Mycobacterium avium subsp. paratuberculosis
gcuggaaccgaaucggucgacc

SEQ ID NO: 884753 - RNA, 17 nt, Mycobacterium avium subsp. paratuberculosis
gcuggaacaccacggcc

SEQ ID NO: 884754 - RNA, 19 nt, Mycobacterium avium subsp. paratuberculosis
gcuggaacaccacggccgg

SEQ ID NO: 884755 - RNA, 20 nt, Mycobacterium avium subsp. paratuberculosis
gcuggaacaccacggccggc

SEQ ID NO: 884756 - RNA, 17 nt, Mycobacterium avium subsp. paratuberculosis
gcuggaaguucgcuggc

SEQ ID NO: 884757 - RNA, 17 nt, Mycobacterium avium subsp. paratuberculosis
gcuggaaucccgccucg

SEQ ID NO: 884758 - RNA, 20 nt, Mycobacterium avium subsp. paratuberculosis
gcuggaaucccgccucggcg

SEQ ID NO: 884759 - RNA, 15 nt, Mycobacterium avium subsp. paratuberculosis
gcuggacaccacguc

SEQ ID NO: 884760 - RNA, 20 nt, Mycobacterium avium subsp. paratuberculosis
gcuggacaccacgucgucgg

SEQ ID NO: 884761 - RNA, 21 nt, Mycobacterium avium subsp. paratuberculosis
gcuggacaccacgucgucggc

SEQ ID NO: 884762 - RNA, 22 nt, Mycobacterium avium subsp. paratuberculosis
gcuggacaccacgucgucggcc

SEQ ID NO: 884763 - RNA, 22 nt, Mycobacterium avium subsp. paratuberculosis
gcuggacacccccgauccgccg

SEQ ID NO: 884764 - RNA, 15 nt, Mycobacterium avium subsp. paratuberculosis
gcugcgguuccgggc

SEQ ID NO: 884765 - RNA, 17 nt, Mycobacterium avium subsp. paratuberculosis
gcugcgguuccgggcgc

SEQ ID NO: 884766 - RNA, 18 nt, Mycobacterium avium subsp. paratuberculosis
gcugcgguuccgggcgcu

SEQ ID NO: 884767 - RNA, 19 nt, Mycobacterium avium subsp. paratuberculosis
gcugcucaugagcccucca

SEQ ID NO: 884768 - RNA, 19 nt, Mycobacterium avium subsp. paratuberculosis
gcugcgggucucgcccacc

SEQ ID NO: 884769 - RNA, 14 nt, Mycobacterium avium subsp. paratuberculosis
gcugcggguugcgg

SEQ ID NO: 884770 - RNA, 18 nt, Mycobacterium avium subsp. paratuberculosis
gcugcucgagggccucca

SEQ ID NO: 884771 - RNA, 22 nt, Mycobacterium avium subsp. paratuberculosis
gcugcgguagggcagauaggcg

SEQ ID NO: 884772 - RNA, 19 nt, Mycobacterium avium subsp. paratuberculosis
gcugcuccggguccgcggu

SEQ ID NO: 884773 - RNA, 15 nt, Mycobacterium avium subsp. paratuberculosis
gcugcucgaccucgg

SEQ ID NO: 884774 - RNA, 16 nt, Mycobacterium avium subsp. paratuberculosis
gcugcucgaccucggc

SEQ ID NO: 884775 - RNA, 20 nt, Mycobacterium avium subsp. paratuberculosis
gcugcucgaccucggcgacc

SEQ ID NO: 884776 - RNA, 22 nt, Mycobacterium avium subsp. paratuberculosis
gcugcucguugugcauguggcc

SEQ ID NO: 884777 - RNA, 16 nt, Mycobacterium avium subsp. paratuberculosis
gcugcucugcgcgcgg

SEQ ID NO: 884778 - RNA, 19 nt, Mycobacterium avium subsp. paratuberculosis
gcugcucugcgcgcggugc

SEQ ID NO: 884779 - RNA, 20 nt, Mycobacterium avium subsp. paratuberculosis
gcugcucgcgcugccgcgcg

SEQ ID NO: 884780 - RNA, 19 nt, Mycobacterium avium subsp. paratuberculosis
gcugcucggccaccgcgcg

SEQ ID NO: 884781 - RNA, 22 nt, Mycobacterium avium subsp. paratuberculosis
gcugcucggccaccgcgcggug

SEQ ID NO: 884782 - RNA, 15 nt, Mycobacterium avium subsp. paratuberculosis
gcugcucggcgggcu

SEQ ID NO: 884783 - RNA, 17 nt, Mycobacterium avium subsp. paratuberculosis
gcugcucguccuggcgc

SEQ ID NO: 884784 - RNA, 18 nt, Mycobacterium avium subsp. paratuberculosis
gcugcucgucgcgggcgc

SEQ ID NO: 884785 - RNA, 19 nt, Mycobacterium avium subsp. paratuberculosis
gcugcucgucgcgggcgcc

SEQ ID NO: 884786 - RNA, 17 nt, Mycobacterium avium subsp. paratuberculosis
gcugcgggcgggccgcc

SEQ ID NO: 884787 - RNA, 19 nt, Mycobacterium avium subsp. paratuberculosis
gcugcgggcgggccgccag

SEQ ID NO: 884788 - RNA, 17 nt, Mycobacterium avium subsp. paratuberculosis
gcugcgggucagcagcu

SEQ ID NO: 884789 - RNA, 18 nt, Mycobacterium avium subsp. paratuberculosis
gcugcgggucagcagcuu

SEQ ID NO: 884790 - RNA, 14 nt, Mycobacterium avium subsp. paratuberculosis
gcugcgggaccagc

SEQ ID NO: 884791 - RNA, 14 nt, Mycobacterium avium subsp. paratuberculosis
gcugcgggcaucgc

SEQ ID NO: 884792 - RNA, 19 nt, Mycobacterium avium subsp. paratuberculosis
gcugcgggcaucgcuggug

SEQ ID NO: 884793 - RNA, 21 nt, Mycobacterium avium subsp. paratuberculosis
gcugcgggcaucgcugguggc

SEQ ID NO: 884794 - RNA, 23 nt, Mycobacterium avium subsp. paratuberculosis
gcugcgggcaucgcugguggccg

SEQ ID NO: 884795 - RNA, 15 nt, Mycobacterium avium subsp. paratuberculosis
gcugcgggccaggcg

SEQ ID NO: 884796 - RNA, 16 nt, Mycobacterium avium subsp. paratuberculosis
gcugcgggccaggcgg

SEQ ID NO: 884797 - RNA, 12 nt, Mycobacterium avium subsp. paratuberculosis
gcugccggccga

SEQ ID NO: 884798 - RNA, 13 nt, Mycobacterium avium subsp. paratuberculosis
gcugccggccggc

SEQ ID NO: 884799 - RNA, 14 nt, Mycobacterium avium subsp. paratuberculosis
gcugccggccggca

SEQ ID NO: 884800 - RNA, 21 nt, Mycobacterium avium subsp. paratuberculosis
gcugccggccggggcggcggu

SEQ ID NO: 884801 - RNA, 12 nt, Mycobacterium avium subsp. paratuberculosis
gcugccggccgu

SEQ ID NO: 884802 - RNA, 12 nt, Mycobacterium avium subsp. paratuberculosis
gcugccggcgac

SEQ ID NO: 884803 - RNA, 15 nt, Mycobacterium avium subsp. paratuberculosis
gcugccggcgaccag

SEQ ID NO: 884804 - RNA, 18 nt, Mycobacterium avium subsp. paratuberculosis
gcugccggcgaccagccc

SEQ ID NO: 884805 - RNA, 13 nt, Mycobacterium avium subsp. paratuberculosis
gcugccggcccga

SEQ ID NO: 884806 - RNA, 15 nt, Mycobacterium avium subsp. paratuberculosis
gcugccggcccgaua

SEQ ID NO: 884807 - RNA, 17 nt, Mycobacterium avium subsp. paratuberculosis
gcugccggaacgagccg

SEQ ID NO: 884808 - RNA, 20 nt, Mycobacterium avium subsp. paratuberculosis
gcugccggaacgagccggac

SEQ ID NO: 884809 - RNA, 15 nt, Mycobacterium avium subsp. paratuberculosis
gcugccggaccucga

SEQ ID NO: 884810 - RNA, 20 nt, Mycobacterium avium subsp. paratuberculosis
gcugccggaccucgaccagc

SEQ ID NO: 884811 - RNA, 17 nt, Mycobacterium avium subsp. paratuberculosis
gcugccgcugcgccggc

SEQ ID NO: 884812 - RNA, 17 nt, Mycobacterium avium subsp. paratuberculosis
gcugccgcuggcgucga

SEQ ID NO: 884813 - RNA, 19 nt, Mycobacterium avium subsp. paratuberculosis
gcuggccaccacgggucgg

SEQ ID NO: 884814 - RNA, 22 nt, Mycobacterium avium subsp. paratuberculosis
gcuggccaccacgggucggucg

SEQ ID NO: 884815 - RNA, 21 nt, Mycobacterium avium subsp. paratuberculosis
gcuggccacgauccggggcag

SEQ ID NO: 884816 - RNA, 13 nt, Mycobacterium avium subsp. paratuberculosis
gcuggccagcacc

SEQ ID NO: 884817 - RNA, 14 nt, Mycobacterium avium subsp. paratuberculosis
gcuggccagcacca

SEQ ID NO: 884818 - RNA, 19 nt, Mycobacterium avium subsp. paratuberculosis
gcuggccagcaccagcgcg

SEQ ID NO: 884819 - RNA, 22 nt, Mycobacterium avium subsp. paratuberculosis
gcuggccagcaccagcgcgcgg

SEQ ID NO: 884820 - RNA, 16 nt, Mycobacterium avium subsp. paratuberculosis
gcuggccagcgcgacg

SEQ ID NO: 884821 - RNA, 17 nt, Mycobacterium avium subsp. paratuberculosis
gcuggccaucgcgggug

SEQ ID NO: 884822 - RNA, 15 nt, Mycobacterium avium subsp. paratuberculosis
gcuggccaggcuggc

SEQ ID NO: 884823 - RNA, 19 nt, Mycobacterium avium subsp. paratuberculosis
gcuggccagcgucagggcg

SEQ ID NO: 884824 - RNA, 14 nt, Mycobacterium avium subsp. paratuberculosis
gcuggccgcggcga

SEQ ID NO: 884825 - RNA, 14 nt, Mycobacterium avium subsp. paratuberculosis
gcuggccgcggcca

SEQ ID NO: 884826 - RNA, 19 nt, Mycobacterium avium subsp. paratuberculosis
gcuggccgcggccagcugc

SEQ ID NO: 884827 - RNA, 16 nt, Mycobacterium avium subsp. paratuberculosis
gcuggccgcgcagcgu

SEQ ID NO: 884828 - RNA, 13 nt, Mycobacterium avium subsp. paratuberculosis
gcuggccgcgacg

SEQ ID NO: 884829 - RNA, 14 nt, Mycobacterium avium subsp. paratuberculosis
gcuggccgcccacc

SEQ ID NO: 884830 - RNA, 22 nt, Mycobacterium avium subsp. paratuberculosis
gcuggccgccccgaacagcgcc

SEQ ID NO: 884831 - RNA, 15 nt, Mycobacterium avium subsp. paratuberculosis
gcuggccgcacggug

SEQ ID NO: 884832 - RNA, 22 nt, Mycobacterium avium subsp. paratuberculosis
gcuggccgcacggugcagcagc

SEQ ID NO: 884833 - RNA, 19 nt, Mycobacterium avium subsp. paratuberculosis
gcuggccgaucccggccac

SEQ ID NO: 884834 - RNA, 17 nt, Mycobacterium avium subsp. paratuberculosis
gcuggccgaggccucca

SEQ ID NO: 884835 - RNA, 13 nt, Mycobacterium avium subsp. paratuberculosis
gcuggccgacccc

SEQ ID NO: 884836 - RNA, 14 nt, Mycobacterium avium subsp. paratuberculosis
gcuggccgaccccg

SEQ ID NO: 884837 - RNA, 15 nt, Mycobacterium avium subsp. paratuberculosis
gcuggccgaccccga

SEQ ID NO: 884838 - RNA, 12 nt, Mycobacterium avium subsp. paratuberculosis
gcuggcccggcg

SEQ ID NO: 884839 - RNA, 13 nt, Mycobacterium avium subsp. paratuberculosis
gcuggcccggcgc

SEQ ID NO: 884840 - RNA, 16 nt, Mycobacterium avium subsp. paratuberculosis
gcuggcccggcgcggc

SEQ ID NO: 884841 - RNA, 20 nt, Mycobacterium avium subsp. paratuberculosis
gcuggcccggcgcggcggcg

SEQ ID NO: 884842 - RNA, 23 nt, Mycobacterium avium subsp. paratuberculosis
gcuggccccgguuuucgccucgg

SEQ ID NO: 884843 - RNA, 16 nt, Mycobacterium avium subsp. paratuberculosis
gcuggagaggcccggc

SEQ ID NO: 884844 - RNA, 21 nt, Mycobacterium avium subsp. paratuberculosis
gcuggagaggcccggcagccg

SEQ ID NO: 884845 - RNA, 18 nt, Mycobacterium avium subsp. paratuberculosis
gcuggacguugggguggu

SEQ ID NO: 884846 - RNA, 16 nt, Mycobacterium avium subsp. paratuberculosis
gcuggacggcccgacg

SEQ ID NO: 884847 - RNA, 20 nt, Mycobacterium avium subsp. paratuberculosis
gcuggacggcccgacgacgc

SEQ ID NO: 884848 - RNA, 21 nt, Mycobacterium avium subsp. paratuberculosis
gcuggauguccaggccgucga

SEQ ID NO: 884849 - RNA, 23 nt, Mycobacterium avium subsp. paratuberculosis
gcuggauguccaggccgucgagg

SEQ ID NO: 884850 - RNA, 20 nt, Mycobacterium avium subsp. paratuberculosis
gcuggauggcgcccagcccg

SEQ ID NO: 884851 - RNA, 18 nt, Mycobacterium avium subsp. paratuberculosis
gcuggcaucgucggcgcc

SEQ ID NO: 884852 - RNA, 20 nt, Mycobacterium avium subsp. paratuberculosis
gcuggcaucgucggcgccgg

SEQ ID NO: 884853 - RNA, 15 nt, Mycobacterium avium subsp. paratuberculosis
gcuggcaggucgcgc

SEQ ID NO: 884854 - RNA, 17 nt, Mycobacterium avium subsp. paratuberculosis
gcuggcaggucgcgccg

SEQ ID NO: 884855 - RNA, 19 nt, Mycobacterium avium subsp. paratuberculosis
gcuggcaggucgcgccgga

SEQ ID NO: 884856 - RNA, 23 nt, Mycobacterium avium subsp. paratuberculosis
gcuggcaggucgcgccggagccg

SEQ ID NO: 884857 - RNA, 16 nt, Mycobacterium avium subsp. paratuberculosis
gcuggcguagagccgc

SEQ ID NO: 884858 - RNA, 14 nt, Mycobacterium avium subsp. paratuberculosis
gcuggcguacgcca

SEQ ID NO: 884859 - RNA, 21 nt, Mycobacterium avium subsp. paratuberculosis
gcuggcggggcgugcccggcg

SEQ ID NO: 884860 - RNA, 20 nt, Mycobacterium avium subsp. paratuberculosis
gcuggcgggugguuggccgc

SEQ ID NO: 884861 - RNA, 20 nt, Mycobacterium avium subsp. paratuberculosis
gcuggcguaggacagcagcc

SEQ ID NO: 884862 - RNA, 21 nt, Mycobacterium avium subsp. paratuberculosis
gcuggcguaggacagcagccg

SEQ ID NO: 884863 - RNA, 21 nt, Mycobacterium avium subsp. paratuberculosis
gcuggcgugacagucgagggc

SEQ ID NO: 884864 - RNA, 17 nt, Mycobacterium avium subsp. paratuberculosis
gcuggcgugacgcucga

SEQ ID NO: 884865 - RNA, 17 nt, Mycobacterium avium subsp. paratuberculosis
gcuggcgugacgcucgc

SEQ ID NO: 884866 - RNA, 19 nt, Mycobacterium avium subsp. paratuberculosis
gcuggcgugacgcucgccg

SEQ ID NO: 884867 - RNA, 21 nt, Mycobacterium avium subsp. paratuberculosis
gcuggcgugacgcucgccggc

SEQ ID NO: 884868 - RNA, 22 nt, Mycobacterium avium subsp. paratuberculosis
gcuggcgugacgcucgccggcg

SEQ ID NO: 884869 - RNA, 22 nt, Mycobacterium avium subsp. paratuberculosis
gcuggcgugacgcucggcgccg

SEQ ID NO: 884870 - RNA, 20 nt, Mycobacterium avium subsp. paratuberculosis
gcuggcgugacgcucggcgg

SEQ ID NO: 884871 - RNA, 15 nt, Mycobacterium avium subsp. paratuberculosis
gcuggcgugacgguc

SEQ ID NO: 884872 - RNA, 19 nt, Mycobacterium avium subsp. paratuberculosis
gcuggcgugacggucgacc

SEQ ID NO: 884873 - RNA, 22 nt, Mycobacterium avium subsp. paratuberculosis
gcuggcgugacggucgaccucg

SEQ ID NO: 884874 - RNA, 15 nt, Mycobacterium avium subsp. paratuberculosis
gcugggccagcgcgg

SEQ ID NO: 884875 - RNA, 17 nt, Mycobacterium avium subsp. paratuberculosis
gcugggccagcgcggug

SEQ ID NO: 884876 - RNA, 18 nt, Mycobacterium avium subsp. paratuberculosis
gcugggccagcgcggugg

SEQ ID NO: 884877 - RNA, 19 nt, Mycobacterium avium subsp. paratuberculosis
gcugggccagcgcgguggc

SEQ ID NO: 884878 - RNA, 16 nt, Mycobacterium avium subsp. paratuberculosis
gcuggcgggcgaucgc

SEQ ID NO: 884879 - RNA, 22 nt, Mycobacterium avium subsp. paratuberculosis
gcuggcgggcgaucgccucggc

SEQ ID NO: 884880 - RNA, 23 nt, Mycobacterium avium subsp. paratuberculosis
gcuggcgcgccguaccgcuuggc

SEQ ID NO: 884881 - RNA, 18 nt, Mycobacterium avium subsp. paratuberculosis
gcuggcgcgauagccggu

SEQ ID NO: 884882 - RNA, 13 nt, Mycobacterium avium subsp. paratuberculosis
gcuggcgccggcg

SEQ ID NO: 884883 - RNA, 15 nt, Mycobacterium avium subsp. paratuberculosis
gcuggcgccggcguc

SEQ ID NO: 884884 - RNA, 16 nt, Mycobacterium avium subsp. paratuberculosis
gcuggcgucgaucgcg

SEQ ID NO: 884885 - RNA, 16 nt, Mycobacterium avium subsp. paratuberculosis
gcuggcgucguuggcg

SEQ ID NO: 884886 - RNA, 23 nt, Mycobacterium avium subsp. paratuberculosis
gcugggcccgcgcaucccgucga

SEQ ID NO: 884887 - RNA, 15 nt, Mycobacterium avium subsp. paratuberculosis
gcugggccgccagcc

SEQ ID NO: 884888 - RNA, 14 nt, Mycobacterium avium subsp. paratuberculosis
gcugggccgcggcg

SEQ ID NO: 884889 - RNA, 18 nt, Mycobacterium avium subsp. paratuberculosis
gcugggccccuccagccg

SEQ ID NO: 884890 - RNA, 19 nt, Mycobacterium avium subsp. paratuberculosis
gcugggccccuccagccgc

SEQ ID NO: 884891 - RNA, 20 nt, Mycobacterium avium subsp. paratuberculosis
gcugggccccuccagccgcc

SEQ ID NO: 884892 - RNA, 22 nt, Mycobacterium avium subsp. paratuberculosis
gcugggccccuccagccgccgg

SEQ ID NO: 884893 - RNA, 23 nt, Mycobacterium avium subsp. paratuberculosis
gcugggccccuccagccgccggu

SEQ ID NO: 884894 - RNA, 15 nt, Mycobacterium avium subsp. paratuberculosis
gcugggcgaagccga

SEQ ID NO: 884895 - RNA, 14 nt, Mycobacterium avium subsp. paratuberculosis
gcugggccgggcgg

SEQ ID NO: 884896 - RNA, 22 nt, Mycobacterium avium subsp. paratuberculosis
gcugggcggacgggaccacccg

SEQ ID NO: 884897 - RNA, 19 nt, Mycobacterium avium subsp. paratuberculosis
gcugggcggauccgcgugg

SEQ ID NO: 884898 - RNA, 14 nt, Mycobacterium avium subsp. paratuberculosis
gcugggcggcacca

SEQ ID NO: 884899 - RNA, 16 nt, Mycobacterium avium subsp. paratuberculosis
gcugggcggcaccacc

SEQ ID NO: 884900 - RNA, 21 nt, Mycobacterium avium subsp. paratuberculosis
gcugggcggcgacaucgccga

SEQ ID NO: 884901 - RNA, 18 nt, Mycobacterium avium subsp. paratuberculosis
gcugggcgcccagaugcc

SEQ ID NO: 884902 - RNA, 17 nt, Mycobacterium avium subsp. paratuberculosis
gcugggcuuccacagcc

SEQ ID NO: 884903 - RNA, 19 nt, Mycobacterium avium subsp. paratuberculosis
gcugggcuuccacagcccg

SEQ ID NO: 884904 - RNA, 16 nt, Mycobacterium avium subsp. paratuberculosis
gcugggcguugccggu

SEQ ID NO: 884905 - RNA, 17 nt, Mycobacterium avium subsp. paratuberculosis
gcugggcguugccgguc

SEQ ID NO: 884906 - RNA, 14 nt, Mycobacterium avium subsp. paratuberculosis
gcugggcuaccagc

SEQ ID NO: 884907 - RNA, 15 nt, Mycobacterium avium subsp. paratuberculosis
gcugggcuaccagcc

SEQ ID NO: 884908 - RNA, 23 nt, Mycobacterium avium subsp. paratuberculosis
gcugggcucgagugccggcagcc

SEQ ID NO: 884909 - RNA, 16 nt, Mycobacterium avium subsp. paratuberculosis
gcugggcugccagcga

SEQ ID NO: 884910 - RNA, 16 nt, Mycobacterium avium subsp. paratuberculosis
gcugggcgggcagccg

SEQ ID NO: 884911 - RNA, 14 nt, Mycobacterium avium subsp. paratuberculosis
gcugggcggcgcgc

SEQ ID NO: 884912 - RNA, 14 nt, Mycobacterium avium subsp. paratuberculosis
gcuggccgucggcg

SEQ ID NO: 884913 - RNA, 15 nt, Mycobacterium avium subsp. paratuberculosis
gcuggccgucgucga

SEQ ID NO: 884914 - RNA, 18 nt, Mycobacterium avium subsp. paratuberculosis
gcuggccgugcaccgucg

SEQ ID NO: 884915 - RNA, 20 nt, Mycobacterium avium subsp. paratuberculosis
gcuggccgggcucgagggcg

SEQ ID NO: 884916 - RNA, 13 nt, Mycobacterium avium subsp. paratuberculosis
gcuggccggccac

SEQ ID NO: 884917 - RNA, 14 nt, Mycobacterium avium subsp. paratuberculosis
gcuggccggccacc

SEQ ID NO: 884918 - RNA, 17 nt, Mycobacterium avium subsp. paratuberculosis
gcuggccggccaccagc

SEQ ID NO: 884919 - RNA, 18 nt, Mycobacterium avium subsp. paratuberculosis
gcuggccggccaccagcg

SEQ ID NO: 884920 - RNA, 21 nt, Mycobacterium avium subsp. paratuberculosis
gcuggccggccaccagcggcc

SEQ ID NO: 884921 - RNA, 16 nt, Mycobacterium avium subsp. paratuberculosis
gcuggccggcagcguc

SEQ ID NO: 884922 - RNA, 23 nt, Mycobacterium avium subsp. paratuberculosis
gcuggcgaccaucagccugcggu

SEQ ID NO: 884923 - RNA, 16 nt, Mycobacterium avium subsp. paratuberculosis
gcuggccuugaucggg

SEQ ID NO: 884924 - RNA, 18 nt, Mycobacterium avium subsp. paratuberculosis
gcuggccuugaucgggua

SEQ ID NO: 884925 - RNA, 16 nt, Mycobacterium avium subsp. paratuberculosis
gcuggcgaauccgggc

SEQ ID NO: 884926 - RNA, 20 nt, Mycobacterium avium subsp. paratuberculosis
gcuggcgaugugaucgcggc

SEQ ID NO: 884927 - RNA, 21 nt, Mycobacterium avium subsp. paratuberculosis
gcuggcgaugugaucgcggcc

SEQ ID NO: 884928 - RNA, 18 nt, Mycobacterium avium subsp. paratuberculosis
gcuggcgaucaucgucgu

SEQ ID NO: 884929 - RNA, 22 nt, Mycobacterium avium subsp. paratuberculosis
gcuggcgaucaucgucgucacc

SEQ ID NO: 884930 - RNA, 22 nt, Mycobacterium avium subsp. paratuberculosis
gcuggcgaucaccuugcggccg

SEQ ID NO: 884931 - RNA, 22 nt, Mycobacterium avium subsp. paratuberculosis
gcugggcguacugcucggcgcg

SEQ ID NO: 884932 - RNA, 23 nt, Mycobacterium avium subsp. paratuberculosis
gcugggcguacugcucggcgcgg

SEQ ID NO: 884933 - RNA, 13 nt, Mycobacterium avium subsp. paratuberculosis
gcuggggguggcg

SEQ ID NO: 884934 - RNA, 17 nt, Mycobacterium avium subsp. paratuberculosis
gcuggggguggcgucga

SEQ ID NO: 884935 - RNA, 16 nt, Mycobacterium avium subsp. paratuberculosis
gcuggggucggccagc

SEQ ID NO: 884936 - RNA, 18 nt, Mycobacterium avium subsp. paratuberculosis
gcuggggucggccagcga

SEQ ID NO: 884937 - RNA, 20 nt, Mycobacterium avium subsp. paratuberculosis
gcuggggugcucgaucagcg

SEQ ID NO: 884938 - RNA, 18 nt, Mycobacterium avium subsp. paratuberculosis
gcugguccggccggccga

SEQ ID NO: 884939 - RNA, 12 nt, Mycobacterium avium subsp. paratuberculosis
gcugggucacca

SEQ ID NO: 884940 - RNA, 17 nt, Mycobacterium avium subsp. paratuberculosis
gcugggucaccacgguc

SEQ ID NO: 884941 - RNA, 23 nt, Mycobacterium avium subsp. paratuberculosis
gcuggucgcccaccacgacgacg

SEQ ID NO: 884942 - RNA, 13 nt, Mycobacterium avium subsp. paratuberculosis
gcuggucggcgaa

SEQ ID NO: 884943 - RNA, 17 nt, Mycobacterium avium subsp. paratuberculosis
gcuggucggcgggcagc

SEQ ID NO: 884944 - RNA, 22 nt, Mycobacterium avium subsp. paratuberculosis
gcuggucgaaccgcgagcgcgc

SEQ ID NO: 884945 - RNA, 16 nt, Mycobacterium avium subsp. paratuberculosis
gcuggucgaacgccac

SEQ ID NO: 884946 - RNA, 18 nt, Mycobacterium avium subsp. paratuberculosis
gcuggucgaacgccaccu

SEQ ID NO: 884947 - RNA, 14 nt, Mycobacterium avium subsp. paratuberculosis
gcuggugcgcgccg

SEQ ID NO: 884948 - RNA, 15 nt, Mycobacterium avium subsp. paratuberculosis
gcuggugcgcgccgg

SEQ ID NO: 884949 - RNA, 20 nt, Mycobacterium avium subsp. paratuberculosis
gcuggugcgcgccggcgucg

SEQ ID NO: 884950 - RNA, 15 nt, Mycobacterium avium subsp. paratuberculosis
gcuggugcgggccag

SEQ ID NO: 884951 - RNA, 20 nt, Mycobacterium avium subsp. paratuberculosis
gcuggugcgggccagcacga

SEQ ID NO: 884952 - RNA, 23 nt, Mycobacterium avium subsp. paratuberculosis
gcuggugcugcugccccucgacg

SEQ ID NO: 884953 - RNA, 14 nt, Mycobacterium avium subsp. paratuberculosis
gcuggugccgccgg

SEQ ID NO: 884954 - RNA, 16 nt, Mycobacterium avium subsp. paratuberculosis
gcuggugcgcagcccg

SEQ ID NO: 884955 - RNA, 17 nt, Mycobacterium avium subsp. paratuberculosis
gcuggugcgcagcccgc

SEQ ID NO: 884956 - RNA, 13 nt, Mycobacterium avium subsp. paratuberculosis
gcuggugcagcag

SEQ ID NO: 884957 - RNA, 17 nt, Mycobacterium avium subsp. paratuberculosis
gcuggugcagcagggcg

SEQ ID NO: 884958 - RNA, 20 nt, Mycobacterium avium subsp. paratuberculosis
gcuggugcagcagggcgcgc

SEQ ID NO: 884959 - RNA, 14 nt, Mycobacterium avium subsp. paratuberculosis
gcuggugauggcca

SEQ ID NO: 884960 - RNA, 17 nt, Mycobacterium avium subsp. paratuberculosis
gcuggugauggccaucu

SEQ ID NO: 884961 - RNA, 18 nt, Mycobacterium avium subsp. paratuberculosis
gcuggucucgggcaccac

SEQ ID NO: 884962 - RNA, 20 nt, Mycobacterium avium subsp. paratuberculosis
gcuggucucgggcaccacgc

SEQ ID NO: 884963 - RNA, 15 nt, Mycobacterium avium subsp. paratuberculosis
gcuggucuucggugu

SEQ ID NO: 884964 - RNA, 21 nt, Mycobacterium avium subsp. paratuberculosis
gcuggucuucggugucgcaca

SEQ ID NO: 884965 - RNA, 19 nt, Mycobacterium avium subsp. paratuberculosis
gcuggucuugccgugcagc

SEQ ID NO: 884966 - RNA, 21 nt, Mycobacterium avium subsp. paratuberculosis
gcuggucuugccgugcagcag

SEQ ID NO: 884967 - RNA, 14 nt, Mycobacterium avium subsp. paratuberculosis
gcuggugaacucgc

SEQ ID NO: 884968 - RNA, 17 nt, Mycobacterium avium subsp. paratuberculosis
gcuggugaacucgccga

SEQ ID NO: 884969 - RNA, 22 nt, Mycobacterium avium subsp. paratuberculosis
gcuggugaaguucuccagcacg

SEQ ID NO: 884970 - RNA, 16 nt, Mycobacterium avium subsp. paratuberculosis
gcuggugaggucgcgc

SEQ ID NO: 884971 - RNA, 19 nt, Mycobacterium avium subsp. paratuberculosis
gcugugagcuuccugccaa

SEQ ID NO: 884972 - RNA, 13 nt, Mycobacterium avium subsp. paratuberculosis
gcugugccggcgg

SEQ ID NO: 884973 - RNA, 14 nt, Mycobacterium avium subsp. paratuberculosis
gcugugcgccaugu

SEQ ID NO: 884974 - RNA, 23 nt, Mycobacterium avium subsp. paratuberculosis
gcugugcgcuugggucgccgggu

SEQ ID NO: 884975 - RNA, 14 nt, Mycobacterium avium subsp. paratuberculosis
gcugugcggcccgg

SEQ ID NO: 884976 - RNA, 15 nt, Mycobacterium avium subsp. paratuberculosis
gcugugcggcccggc

SEQ ID NO: 884977 - RNA, 18 nt, Mycobacterium avium subsp. paratuberculosis
gcugucggugugagcggu

SEQ ID NO: 884978 - RNA, 21 nt, Mycobacterium avium subsp. paratuberculosis
gcugucggugugagcggugac

SEQ ID NO: 884979 - RNA, 18 nt, Mycobacterium avium subsp. paratuberculosis
gcugucggugacgaggag

SEQ ID NO: 884980 - RNA, 13 nt, Mycobacterium avium subsp. paratuberculosis
gcugucguagcgg

SEQ ID NO: 884981 - RNA, 13 nt, Mycobacterium avium subsp. paratuberculosis
gcugucgucgccc

SEQ ID NO: 884982 - RNA, 14 nt, Mycobacterium avium subsp. paratuberculosis
gcuguccaccugca

SEQ ID NO: 884983 - RNA, 16 nt, Mycobacterium avium subsp. paratuberculosis
gcuguccaccugcacc

SEQ ID NO: 884984 - RNA, 14 nt, Mycobacterium avium subsp. paratuberculosis
gcugucgcgggccc

SEQ ID NO: 884985 - RNA, 16 nt, Mycobacterium avium subsp. paratuberculosis
gcugucgcgggcccgc

SEQ ID NO: 884986 - RNA, 17 nt, Mycobacterium avium subsp. paratuberculosis
gcugucgcgggucuggc

SEQ ID NO: 884987 - RNA, 18 nt, Mycobacterium avium subsp. paratuberculosis
gcuguccacguccugcca

SEQ ID NO: 884988 - RNA, 16 nt, Mycobacterium avium subsp. paratuberculosis
gcugucggcgcccaga

SEQ ID NO: 884989 - RNA, 19 nt, Mycobacterium avium subsp. paratuberculosis
gcugucggggaccgucccc

SEQ ID NO: 884990 - RNA, 17 nt, Mycobacterium avium subsp. paratuberculosis
gcugucggggucgcggc

SEQ ID NO: 884991 - RNA, 21 nt, Mycobacterium avium subsp. paratuberculosis
gcugucggggucgcggcccgc

SEQ ID NO: 884992 - RNA, 19 nt, Mycobacterium avium subsp. paratuberculosis
gcuguccaccugcaccugg

SEQ ID NO: 884993 - RNA, 16 nt, Mycobacterium avium subsp. paratuberculosis
gcuguaguagccgggg

SEQ ID NO: 884994 - RNA, 19 nt, Mycobacterium avium subsp. paratuberculosis
gcuguaguagccggggacg

SEQ ID NO: 884995 - RNA, 14 nt, Mycobacterium avium subsp. paratuberculosis
gcuguagcggucgu

SEQ ID NO: 884996 - RNA, 15 nt, Mycobacterium avium subsp. paratuberculosis
gcuagaccgauggcg

SEQ ID NO: 884997 - RNA, 17 nt, Mycobacterium avium subsp. paratuberculosis
gcuagacgcgcaccagg

SEQ ID NO: 884998 - RNA, 20 nt, Mycobacterium avium subsp. paratuberculosis
gcuagacgcgcaccagggcc

SEQ ID NO: 884999 - RNA, 16 nt, Mycobacterium avium subsp. paratuberculosis
gcuagcgagcgggcac

SEQ ID NO: 885000 - RNA, 20 nt, Mycobacterium avium subsp. paratuberculosis
gcuagcgagcgggcacgccg

SEQ ID NO: 885001 - RNA, 13 nt, Mycobacterium avium subsp. paratuberculosis
gcuacugccgacg

SEQ ID NO: 885002 - RNA, 20 nt, Mycobacterium avium subsp. paratuberculosis
gcuacuucuucuccauggug

SEQ ID NO: 885003 - RNA, 22 nt, Mycobacterium avium subsp. paratuberculosis
gcuaccuuguugugacacagcc

SEQ ID NO: 885004 - RNA, 23 nt, Mycobacterium avium subsp. paratuberculosis
gcuacgccgaggcgcaggaggcg

SEQ ID NO: 885005 - RNA, 15 nt, Mycobacterium avium subsp. paratuberculosis
gcuacgccggcucgg

SEQ ID NO: 885006 - RNA, 17 nt, Mycobacterium avium subsp. paratuberculosis
gcuacggacgcauccac

SEQ ID NO: 885007 - RNA, 17 nt, Mycobacterium avium subsp. paratuberculosis
gcguugcagcgccgcgg

SEQ ID NO: 885008 - RNA, 18 nt, Mycobacterium avium subsp. paratuberculosis
gcguugcagcgccgcggc

SEQ ID NO: 885009 - RNA, 23 nt, Mycobacterium avium subsp. paratuberculosis
gcguugcagcgccgcggcgcccu

SEQ ID NO: 885010 - RNA, 17 nt, Mycobacterium avium subsp. paratuberculosis
gcguugaugucggccag

SEQ ID NO: 885011 - RNA, 21 nt, Mycobacterium avium subsp. paratuberculosis
gcguugaugucggccaggauc

SEQ ID NO: 885012 - RNA, 15 nt, Mycobacterium avium subsp. paratuberculosis
gcguucgucggcgcg

SEQ ID NO: 885013 - RNA, 16 nt, Mycobacterium avium subsp. paratuberculosis
gcguucgucggcgcgu

SEQ ID NO: 885014 - RNA, 15 nt, Mycobacterium avium subsp. paratuberculosis
gcguugaucgacgga

SEQ ID NO: 885015 - RNA, 16 nt, Mycobacterium avium subsp. paratuberculosis
gcguugaucgacggau

SEQ ID NO: 885016 - RNA, 15 nt, Mycobacterium avium subsp. paratuberculosis
gcguucgucgccggu

SEQ ID NO: 885017 - RNA, 19 nt, Mycobacterium avium subsp. paratuberculosis
gcguucgucgccggugagc

SEQ ID NO: 885018 - RNA, 13 nt, Mycobacterium avium subsp. paratuberculosis
gcguucggcgauc

SEQ ID NO: 885019 - RNA, 17 nt, Mycobacterium avium subsp. paratuberculosis
gcguucggucagcacga

SEQ ID NO: 885020 - RNA, 16 nt, Mycobacterium avium subsp. paratuberculosis
gcguucgggauccucg

SEQ ID NO: 885021 - RNA, 17 nt, Mycobacterium avium subsp. paratuberculosis
gcguucgggauccucgc

SEQ ID NO: 885022 - RNA, 18 nt, Mycobacterium avium subsp. paratuberculosis
gcguucgggauccucgcc

SEQ ID NO: 885023 - RNA, 22 nt, Mycobacterium avium subsp. paratuberculosis
gcguucgggauccucgccgcgg

SEQ ID NO: 885024 - RNA, 15 nt, Mycobacterium avium subsp. paratuberculosis
gcguucgggcccggc

SEQ ID NO: 885025 - RNA, 16 nt, Mycobacterium avium subsp. paratuberculosis
gcguucgggcccggcc

SEQ ID NO: 885026 - RNA, 17 nt, Mycobacterium avium subsp. paratuberculosis
gcguucgggcccggccg

SEQ ID NO: 885027 - RNA, 22 nt, Mycobacterium avium subsp. paratuberculosis
gcguucgggcccggccgccagc

SEQ ID NO: 885028 - RNA, 18 nt, Mycobacterium avium subsp. paratuberculosis
gcguucggacaccucggc

SEQ ID NO: 885029 - RNA, 16 nt, Mycobacterium avium subsp. paratuberculosis
gcuacccggcgaaccg

SEQ ID NO: 885030 - RNA, 22 nt, Mycobacterium avium subsp. paratuberculosis
gcuacccggcgaaccgggacag

SEQ ID NO: 885031 - RNA, 11 nt, Mycobacterium avium subsp. paratuberculosis
gcuaccgcgcg

SEQ ID NO: 885032 - RNA, 19 nt, Mycobacterium avium subsp. paratuberculosis
gcuaccgccgggcgggccg

SEQ ID NO: 885033 - RNA, 16 nt, Mycobacterium avium subsp. paratuberculosis
gcuaccgcgcucaccg

SEQ ID NO: 885034 - RNA, 17 nt, Mycobacterium avium subsp. paratuberculosis
gcuaccgcgcucaccgu

SEQ ID NO: 885035 - RNA, 17 nt, Mycobacterium avium subsp. paratuberculosis
gcguugcauuucggcgu

SEQ ID NO: 885036 - RNA, 16 nt, Mycobacterium avium subsp. paratuberculosis
gcguugcccgucgccu

SEQ ID NO: 885037 - RNA, 20 nt, Mycobacterium avium subsp. paratuberculosis
gcuauuggccgagccgggcg

SEQ ID NO: 885038 - RNA, 14 nt, Mycobacterium avium subsp. paratuberculosis
gcucaacccgggcc

SEQ ID NO: 885039 - RNA, 15 nt, Mycobacterium avium subsp. paratuberculosis
gcucaacccgggccg

SEQ ID NO: 885040 - RNA, 16 nt, Mycobacterium avium subsp. paratuberculosis
gcucaacccgucgcgg

SEQ ID NO: 885041 - RNA, 14 nt, Mycobacterium avium subsp. paratuberculosis
gcucaacggccggc

SEQ ID NO: 885042 - RNA, 15 nt, Mycobacterium avium subsp. paratuberculosis
gcucaacggccggcg

SEQ ID NO: 885043 - RNA, 20 nt, Mycobacterium avium subsp. paratuberculosis
gcucaacggccggcgccgcc

SEQ ID NO: 885044 - RNA, 14 nt, Mycobacterium avium subsp. paratuberculosis
gcucaacggcucca

SEQ ID NO: 885045 - RNA, 15 nt, Mycobacterium avium subsp. paratuberculosis
gcucaaccgcccagc

SEQ ID NO: 885046 - RNA, 19 nt, Mycobacterium avium subsp. paratuberculosis
gcucaacuugaucagcucg

SEQ ID NO: 885047 - RNA, 21 nt, Mycobacterium avium subsp. paratuberculosis
gcucaaugccuuugccguggc

SEQ ID NO: 885048 - RNA, 15 nt, Mycobacterium avium subsp. paratuberculosis
gcucacagcgcggcg

SEQ ID NO: 885049 - RNA, 17 nt, Mycobacterium avium subsp. paratuberculosis
gcucacagcgcggcggu

SEQ ID NO: 885050 - RNA, 15 nt, Mycobacterium avium subsp. paratuberculosis
gcucaccccggccag

SEQ ID NO: 885051 - RNA, 18 nt, Mycobacterium avium subsp. paratuberculosis
gcucacccagcgagaccg

SEQ ID NO: 885052 - RNA, 15 nt, Mycobacterium avium subsp. paratuberculosis
gcucaccgagcuggg

SEQ ID NO: 885053 - RNA, 16 nt, Mycobacterium avium subsp. paratuberculosis
gcucaccgagcugggc

SEQ ID NO: 885054 - RNA, 17 nt, Mycobacterium avium subsp. paratuberculosis
gcucaccgagcugggcc

SEQ ID NO: 885055 - RNA, 20 nt, Mycobacterium avium subsp. paratuberculosis
gcucaccgagcugggccggc

SEQ ID NO: 885056 - RNA, 22 nt, Mycobacterium avium subsp. paratuberculosis
gcucaccgagcugggccggcgc

SEQ ID NO: 885057 - RNA, 12 nt, Mycobacterium avium subsp. paratuberculosis
gcucacccggcc

SEQ ID NO: 885058 - RNA, 14 nt, Mycobacterium avium subsp. paratuberculosis
gcucacccggccca

SEQ ID NO: 885059 - RNA, 20 nt, Mycobacterium avium subsp. paratuberculosis
gcucacccggcccaccggcc

SEQ ID NO: 885060 - RNA, 24 nt, Mycobacterium avium subsp. paratuberculosis
gcucacccggcccaccggcccggc

SEQ ID NO: 885061 - RNA, 11 nt, Mycobacterium avium subsp. paratuberculosis
gcuauccgggg

SEQ ID NO: 885062 - RNA, 17 nt, Mycobacterium avium subsp. paratuberculosis
gcuaucgcccggcgccc

SEQ ID NO: 885063 - RNA, 18 nt, Mycobacterium avium subsp. paratuberculosis
gcuaucgcccggcgcccg

SEQ ID NO: 885064 - RNA, 22 nt, Mycobacterium avium subsp. paratuberculosis
gcuaucgcccggcgcccggccg

SEQ ID NO: 885065 - RNA, 22 nt, Mycobacterium avium subsp. paratuberculosis
gcuagcgugacagucgaccucg

SEQ ID NO: 885066 - RNA, 23 nt, Mycobacterium avium subsp. paratuberculosis
gcuagcgugacagucgaccucgc

SEQ ID NO: 885067 - RNA, 16 nt, Mycobacterium avium subsp. paratuberculosis
gcuagcggcugacccg

SEQ ID NO: 885068 - RNA, 23 nt, Mycobacterium avium subsp. paratuberculosis
gcuagcggcugacccgcccgggu

SEQ ID NO: 885069 - RNA, 13 nt, Mycobacterium avium subsp. paratuberculosis
gcuagcgggcgcg

SEQ ID NO: 885070 - RNA, 22 nt, Mycobacterium avium subsp. paratuberculosis
gcuagcgggcgcgcagccacga

SEQ ID NO: 885071 - RNA, 12 nt, Mycobacterium avium subsp. paratuberculosis
gcuaggcggccg

SEQ ID NO: 885072 - RNA, 14 nt, Mycobacterium avium subsp. paratuberculosis
gcuaggcggccggg

SEQ ID NO: 885073 - RNA, 17 nt, Mycobacterium avium subsp. paratuberculosis
gcuaggcggccgggcgg

SEQ ID NO: 885074 - RNA, 18 nt, Mycobacterium avium subsp. paratuberculosis
gcuaggcucggcagccgg

SEQ ID NO: 885075 - RNA, 16 nt, Mycobacterium avium subsp. paratuberculosis
gcuagcugcgccggcu

SEQ ID NO: 885076 - RNA, 20 nt, Mycobacterium avium subsp. paratuberculosis
gcuaggccagcagcgcggcg

SEQ ID NO: 885077 - RNA, 18 nt, Mycobacterium avium subsp. paratuberculosis
gcuagcuucacgcucggc

SEQ ID NO: 885078 - RNA, 22 nt, Mycobacterium avium subsp. paratuberculosis
gcuagcuucacgcucggcgccg

SEQ ID NO: 885079 - RNA, 20 nt, Mycobacterium avium subsp. paratuberculosis
gcuaggaagccagccguccc

SEQ ID NO: 885080 - RNA, 18 nt, Mycobacterium avium subsp. paratuberculosis
gcuaguuucacgcucggc

SEQ ID NO: 885081 - RNA, 19 nt, Mycobacterium avium subsp. paratuberculosis
gcuaguuucacgcucggcg

SEQ ID NO: 885082 - RNA, 17 nt, Mycobacterium avium subsp. paratuberculosis
gcuagguuuggccagca

SEQ ID NO: 885083 - RNA, 14 nt, Mycobacterium avium subsp. paratuberculosis
gcuagucgcccagc

SEQ ID NO: 885084 - RNA, 20 nt, Mycobacterium avium subsp. paratuberculosis
gcuagucgcccagcagcccg

SEQ ID NO: 885085 - RNA, 17 nt, Mycobacterium avium subsp. paratuberculosis
gcuccacaucugccggc

SEQ ID NO: 885086 - RNA, 16 nt, Mycobacterium avium subsp. paratuberculosis
gcuccaaugcggccga

SEQ ID NO: 885087 - RNA, 20 nt, Mycobacterium avium subsp. paratuberculosis
gcuccaaugcggccgacuug

SEQ ID NO: 885088 - RNA, 15 nt, Mycobacterium avium subsp. paratuberculosis
gcuccaccagcgcgg

SEQ ID NO: 885089 - RNA, 18 nt, Mycobacterium avium subsp. paratuberculosis
gcuccaccagcgcgguga

SEQ ID NO: 885090 - RNA, 13 nt, Mycobacterium avium subsp. paratuberculosis
gcuccaccagguu

SEQ ID NO: 885091 - RNA, 21 nt, Mycobacterium avium subsp. paratuberculosis
gcuccaccagguucgcgcagc

SEQ ID NO: 885092 - RNA, 22 nt, Mycobacterium avium subsp. paratuberculosis
gcuccaccagguucgcgcagcu

SEQ ID NO: 885093 - RNA, 13 nt, Mycobacterium avium subsp. paratuberculosis
gcuccaccgcgcc

SEQ ID NO: 885094 - RNA, 18 nt, Mycobacterium avium subsp. paratuberculosis
gcuccaccgcgccggcgg

SEQ ID NO: 885095 - RNA, 14 nt, Mycobacterium avium subsp. paratuberculosis
gcuccaccgcgucc

SEQ ID NO: 885096 - RNA, 16 nt, Mycobacterium avium subsp. paratuberculosis
gcuccaccgcguccug

SEQ ID NO: 885097 - RNA, 16 nt, Mycobacterium avium subsp. paratuberculosis
gcuccagaugcggugg

SEQ ID NO: 885098 - RNA, 13 nt, Mycobacterium avium subsp. paratuberculosis
gcuccacgccgcc

SEQ ID NO: 885099 - RNA, 14 nt, Mycobacterium avium subsp. paratuberculosis
gcuccacgccgccg

SEQ ID NO: 885100 - RNA, 13 nt, Mycobacterium avium subsp. paratuberculosis
gcuccaccugcgg

SEQ ID NO: 885101 - RNA, 20 nt, Mycobacterium avium subsp. paratuberculosis
gcuccaccugcggcaccucg

SEQ ID NO: 885102 - RNA, 23 nt, Mycobacterium avium subsp. paratuberculosis
gcuccaccugcggcaccucggcc

SEQ ID NO: 885103 - RNA, 14 nt, Mycobacterium avium subsp. paratuberculosis
gcuccagcagcccg

SEQ ID NO: 885104 - RNA, 15 nt, Mycobacterium avium subsp. paratuberculosis
gcuccagcagcccgg

SEQ ID NO: 885105 - RNA, 12 nt, Mycobacterium avium subsp. paratuberculosis
gcuccagcagcg

SEQ ID NO: 885106 - RNA, 16 nt, Mycobacterium avium subsp. paratuberculosis
gcuccagcaggcgcgc

SEQ ID NO: 885107 - RNA, 18 nt, Mycobacterium avium subsp. paratuberculosis
gcuccagcaggcgcgccg

SEQ ID NO: 885108 - RNA, 20 nt, Mycobacterium avium subsp. paratuberculosis
gcuccagcaggcgcgccgag

SEQ ID NO: 885109 - RNA, 13 nt, Mycobacterium avium subsp. paratuberculosis
gcuccagcaggcu

SEQ ID NO: 885110 - RNA, 18 nt, Mycobacterium avium subsp. paratuberculosis
gcuccagccacuccacca

SEQ ID NO: 885111 - RNA, 14 nt, Mycobacterium avium subsp. paratuberculosis
gcuccagcggccac

SEQ ID NO: 885112 - RNA, 18 nt, Mycobacterium avium subsp. paratuberculosis
gcuccagcggguccagcc

SEQ ID NO: 885113 - RNA, 19 nt, Mycobacterium avium subsp. paratuberculosis
gcuccagcggguccagccg

SEQ ID NO: 885114 - RNA, 21 nt, Mycobacterium avium subsp. paratuberculosis
gcuccagcggguccagccgcc

SEQ ID NO: 885115 - RNA, 15 nt, Mycobacterium avium subsp. paratuberculosis
gcuccagcgcccgcc

SEQ ID NO: 885116 - RNA, 16 nt, Mycobacterium avium subsp. paratuberculosis
gcucauacagcggcgc

SEQ ID NO: 885117 - RNA, 17 nt, Mycobacterium avium subsp. paratuberculosis
gcucauacagcggcgcg

SEQ ID NO: 885118 - RNA, 19 nt, Mycobacterium avium subsp. paratuberculosis
gcucagugcacgcucggcg

SEQ ID NO: 885119 - RNA, 20 nt, Mycobacterium avium subsp. paratuberculosis
gcucagugcacgcucggcgc

SEQ ID NO: 885120 - RNA, 12 nt, Mycobacterium avium subsp. paratuberculosis
gcucagguugcg

SEQ ID NO: 885121 - RNA, 20 nt, Mycobacterium avium subsp. paratuberculosis
gcucagguugcgcagcagcc

SEQ ID NO: 885122 - RNA, 13 nt, Mycobacterium avium subsp. paratuberculosis
gcucaucaccggc

SEQ ID NO: 885123 - RNA, 17 nt, Mycobacterium avium subsp. paratuberculosis
gcucaucccgaugucgg

SEQ ID NO: 885124 - RNA, 21 nt, Mycobacterium avium subsp. paratuberculosis
gcucaucccgaugucggcgaa

SEQ ID NO: 885125 - RNA, 19 nt, Mycobacterium avium subsp. paratuberculosis
gcucaucaccggcgcgccg

SEQ ID NO: 885126 - RNA, 20 nt, Mycobacterium avium subsp. paratuberculosis
gcucaucaccggcgcgccgu

SEQ ID NO: 885127 - RNA, 22 nt, Mycobacterium avium subsp. paratuberculosis
gcucaucaccggcgcgccgucc

SEQ ID NO: 885128 - RNA, 18 nt, Mycobacterium avium subsp. paratuberculosis
gcucaucguguccagcau

SEQ ID NO: 885129 - RNA, 21 nt, Mycobacterium avium subsp. paratuberculosis
gcucaugucaaugccgcagcc

SEQ ID NO: 885130 - RNA, 22 nt, Mycobacterium avium subsp. paratuberculosis
gcucaugucaaugccgcagccg

SEQ ID NO: 885131 - RNA, 14 nt, Mycobacterium avium subsp. paratuberculosis
gcucaugcccgcca

SEQ ID NO: 885132 - RNA, 22 nt, Mycobacterium avium subsp. paratuberculosis
gcucaugcccgccacggccagc

SEQ ID NO: 885133 - RNA, 20 nt, Mycobacterium avium subsp. paratuberculosis
gcucaggcguccagccagcg

SEQ ID NO: 885134 - RNA, 21 nt, Mycobacterium avium subsp. paratuberculosis
gcucaggcguccagccagcgu

SEQ ID NO: 885135 - RNA, 16 nt, Mycobacterium avium subsp. paratuberculosis
gcucaggucggccgcg

SEQ ID NO: 885136 - RNA, 17 nt, Mycobacterium avium subsp. paratuberculosis
gcucaggugcgacgccc

SEQ ID NO: 885137 - RNA, 13 nt, Mycobacterium avium subsp. paratuberculosis
gcucagguaggcg

SEQ ID NO: 885138 - RNA, 14 nt, Mycobacterium avium subsp. paratuberculosis
gcucagggugcgcu

SEQ ID NO: 885139 - RNA, 16 nt, Mycobacterium avium subsp. paratuberculosis
gcucaggccgguggcg

SEQ ID NO: 885140 - RNA, 17 nt, Mycobacterium avium subsp. paratuberculosis
gcucaggccgguggcga

SEQ ID NO: 885141 - RNA, 18 nt, Mycobacterium avium subsp. paratuberculosis
gcucaggaucagcagccg

SEQ ID NO: 885142 - RNA, 18 nt, Mycobacterium avium subsp. paratuberculosis
gcucaggaacggccggau

SEQ ID NO: 885143 - RNA, 23 nt, Mycobacterium avium subsp. paratuberculosis
gcucaggaacggccggauggcca

SEQ ID NO: 885144 - RNA, 16 nt, Mycobacterium avium subsp. paratuberculosis
gcucaggacgaacgcu

SEQ ID NO: 885145 - RNA, 20 nt, Mycobacterium avium subsp. paratuberculosis
gcucagcucccgagcaucgc

SEQ ID NO: 885146 - RNA, 13 nt, Mycobacterium avium subsp. paratuberculosis
gcucagcgcggcg

SEQ ID NO: 885147 - RNA, 20 nt, Mycobacterium avium subsp. paratuberculosis
gcucagcugcugcgcggcgg

SEQ ID NO: 885148 - RNA, 21 nt, Mycobacterium avium subsp. paratuberculosis
gcucagcugcugcgcggcggc

SEQ ID NO: 885149 - RNA, 12 nt, Mycobacterium avium subsp. paratuberculosis
gcucagcgggcg

SEQ ID NO: 885150 - RNA, 14 nt, Mycobacterium avium subsp. paratuberculosis
gcucagcgggcggc

SEQ ID NO: 885151 - RNA, 17 nt, Mycobacterium avium subsp. paratuberculosis
gcucagcgggcggccag

SEQ ID NO: 885152 - RNA, 18 nt, Mycobacterium avium subsp. paratuberculosis
gcucagcgggcggccagc

SEQ ID NO: 885153 - RNA, 17 nt, Mycobacterium avium subsp. paratuberculosis
gcucagcggaaccgaca

SEQ ID NO: 885154 - RNA, 13 nt, Mycobacterium avium subsp. paratuberculosis
gcucagcgcggcc

SEQ ID NO: 885155 - RNA, 23 nt, Mycobacterium avium subsp. paratuberculosis
gcucagcgcggccacaccgauca

SEQ ID NO: 885156 - RNA, 19 nt, Mycobacterium avium subsp. paratuberculosis
gcucagcggcagcgucgcc

SEQ ID NO: 885157 - RNA, 15 nt, Mycobacterium avium subsp. paratuberculosis
gcucagcggcaggug

SEQ ID NO: 885158 - RNA, 19 nt, Mycobacterium avium subsp. paratuberculosis
gcucagcggcaggugcgcc

SEQ ID NO: 885159 - RNA, 15 nt, Mycobacterium avium subsp. paratuberculosis
gcucagcggccaucg

SEQ ID NO: 885160 - RNA, 21 nt, Mycobacterium avium subsp. paratuberculosis
gcucagcggccaucgccgcca

SEQ ID NO: 885161 - RNA, 14 nt, Mycobacterium avium subsp. paratuberculosis
gcucagccguucgc

SEQ ID NO: 885162 - RNA, 18 nt, Mycobacterium avium subsp. paratuberculosis
gcucagccgaagccggcg

SEQ ID NO: 885163 - RNA, 23 nt, Mycobacterium avium subsp. paratuberculosis
gcucagccgaagccggcgcaggu

SEQ ID NO: 885164 - RNA, 13 nt, Mycobacterium avium subsp. paratuberculosis
gcucagccgcacg

SEQ ID NO: 885165 - RNA, 14 nt, Mycobacterium avium subsp. paratuberculosis
gcucagccgcacgg

SEQ ID NO: 885166 - RNA, 14 nt, Mycobacterium avium subsp. paratuberculosis
gcucagccgccugg

SEQ ID NO: 885167 - RNA, 19 nt, Mycobacterium avium subsp. paratuberculosis
gcucagcgauugcggccgc

SEQ ID NO: 885168 - RNA, 20 nt, Mycobacterium avium subsp. paratuberculosis
gcucagcgauugcggccgcc

SEQ ID NO: 885169 - RNA, 22 nt, Mycobacterium avium subsp. paratuberculosis
gcucagcgauugcggccgccgg

SEQ ID NO: 885170 - RNA, 24 nt, Mycobacterium avium subsp. paratuberculosis
gcucagcgauugcggccgccggcc

SEQ ID NO: 885171 - RNA, 13 nt, Mycobacterium avium subsp. paratuberculosis
gcucagcgcaccg

SEQ ID NO: 885172 - RNA, 15 nt, Mycobacterium avium subsp. paratuberculosis
gcucagcgcaccgcc

SEQ ID NO: 885173 - RNA, 16 nt, Mycobacterium avium subsp. paratuberculosis
gcucagcgcaccgccg

SEQ ID NO: 885174 - RNA, 20 nt, Mycobacterium avium subsp. paratuberculosis
gcucagcgcaccgccgucgg

SEQ ID NO: 885175 - RNA, 18 nt, Mycobacterium avium subsp. paratuberculosis
gcucagcgcgacgugccg

SEQ ID NO: 885176 - RNA, 23 nt, Mycobacterium avium subsp. paratuberculosis
gcucagcgcgacgugccggcgau

SEQ ID NO: 885177 - RNA, 15 nt, Mycobacterium avium subsp. paratuberculosis
gcucaccgggcucgg

SEQ ID NO: 885178 - RNA, 15 nt, Mycobacterium avium subsp. paratuberculosis
gcucaccugcggccc

SEQ ID NO: 885179 - RNA, 17 nt, Mycobacterium avium subsp. paratuberculosis
gcucaccgccgaugaug

SEQ ID NO: 885180 - RNA, 19 nt, Mycobacterium avium subsp. paratuberculosis
gcucaccgcgaugauggcg

SEQ ID NO: 885181 - RNA, 13 nt, Mycobacterium avium subsp. paratuberculosis
gcucaccggccag

SEQ ID NO: 885182 - RNA, 17 nt, Mycobacterium avium subsp. paratuberculosis
gcucacgacuccuggcc

SEQ ID NO: 885183 - RNA, 21 nt, Mycobacterium avium subsp. paratuberculosis
gcucaccgacaagggccgggc

SEQ ID NO: 885184 - RNA, 13 nt, Mycobacterium avium subsp. paratuberculosis
gcucagcagcacc

SEQ ID NO: 885185 - RNA, 15 nt, Mycobacterium avium subsp. paratuberculosis
gcucagcagcaccgc

SEQ ID NO: 885186 - RNA, 19 nt, Mycobacterium avium subsp. paratuberculosis
gcucagcacgcggaucgcg

SEQ ID NO: 885187 - RNA, 15 nt, Mycobacterium avium subsp. paratuberculosis
gcucagacugccgag

SEQ ID NO: 885188 - RNA, 18 nt, Mycobacterium avium subsp. paratuberculosis
gcucagacugccgagcau

SEQ ID NO: 885189 - RNA, 14 nt, Mycobacterium avium subsp. paratuberculosis
gcucagcccggcgc

SEQ ID NO: 885190 - RNA, 20 nt, Mycobacterium avium subsp. paratuberculosis
gcucagcccgauucagccgg

SEQ ID NO: 885191 - RNA, 22 nt, Mycobacterium avium subsp. paratuberculosis
gcucagcccgauucagccggcg

SEQ ID NO: 885192 - RNA, 16 nt, Mycobacterium avium subsp. paratuberculosis
gcucagccacgccggc

SEQ ID NO: 885193 - RNA, 17 nt, Mycobacterium avium subsp. paratuberculosis
gcucagccacgccggca

SEQ ID NO: 885194 - RNA, 23 nt, Mycobacterium avium subsp. paratuberculosis
gcucacucgucuugcagccgggg

SEQ ID NO: 885195 - RNA, 16 nt, Mycobacterium avium subsp. paratuberculosis
gcucacggugucggcg

SEQ ID NO: 885196 - RNA, 20 nt, Mycobacterium avium subsp. paratuberculosis
gcucacggugucggcgguga

SEQ ID NO: 885197 - RNA, 23 nt, Mycobacterium avium subsp. paratuberculosis
gcguuacacccauucacgcagcu

SEQ ID NO: 885198 - RNA, 24 nt, Mycobacterium avium subsp. paratuberculosis
gcguuacacccauucacgcagcug

SEQ ID NO: 885199 - RNA, 19 nt, Mycobacterium avium subsp. paratuberculosis
gcguguugagcucgcggcg

SEQ ID NO: 885200 - RNA, 14 nt, Mycobacterium avium subsp. paratuberculosis
gcguguuggacgcc

SEQ ID NO: 885201 - RNA, 18 nt, Mycobacterium avium subsp. paratuberculosis
gcguguuggacgcccgcu

SEQ ID NO: 885202 - RNA, 17 nt, Mycobacterium avium subsp. paratuberculosis
gcgugucacuacccgcg

SEQ ID NO: 885203 - RNA, 18 nt, Mycobacterium avium subsp. paratuberculosis
gcguguaguacugcucga

SEQ ID NO: 885204 - RNA, 20 nt, Mycobacterium avium subsp. paratuberculosis
gcguguaguacugcucgacg

SEQ ID NO: 885205 - RNA, 21 nt, Mycobacterium avium subsp. paratuberculosis
gcguguaguccaggucgaucu

SEQ ID NO: 885206 - RNA, 12 nt, Mycobacterium avium subsp. paratuberculosis
gcguuccagcau

SEQ ID NO: 885207 - RNA, 17 nt, Mycobacterium avium subsp. paratuberculosis
gcguuccagcacccggc

SEQ ID NO: 885208 - RNA, 20 nt, Mycobacterium avium subsp. paratuberculosis
gcguuccagcacccggccca

SEQ ID NO: 885209 - RNA, 19 nt, Mycobacterium avium subsp. paratuberculosis
gcguucagggugcaggccc

SEQ ID NO: 885210 - RNA, 15 nt, Mycobacterium avium subsp. paratuberculosis
gcguuccaggugugc

SEQ ID NO: 885211 - RNA, 22 nt, Mycobacterium avium subsp. paratuberculosis
gcguuccaggugugccgcuggu

SEQ ID NO: 885212 - RNA, 16 nt, Mycobacterium avium subsp. paratuberculosis
gcguuccagguucagc

SEQ ID NO: 885213 - RNA, 22 nt, Mycobacterium avium subsp. paratuberculosis
gcguuccagguucagcccggcg

SEQ ID NO: 885214 - RNA, 15 nt, Mycobacterium avium subsp. paratuberculosis
gcguucccagcccgg

SEQ ID NO: 885215 - RNA, 15 nt, Mycobacterium avium subsp. paratuberculosis
gcguuccccggcgug

SEQ ID NO: 885216 - RNA, 17 nt, Mycobacterium avium subsp. paratuberculosis
gcguuccaucagcgccc

SEQ ID NO: 885217 - RNA, 15 nt, Mycobacterium avium subsp. paratuberculosis
gcguucgcguucggg

SEQ ID NO: 885218 - RNA, 22 nt, Mycobacterium avium subsp. paratuberculosis
gcguucggccaguucggguccg

SEQ ID NO: 885219 - RNA, 14 nt, Mycobacterium avium subsp. paratuberculosis
gcguggcucggccc

SEQ ID NO: 885220 - RNA, 15 nt, Mycobacterium avium subsp. paratuberculosis
gcguggcucggcccg

SEQ ID NO: 885221 - RNA, 22 nt, Mycobacterium avium subsp. paratuberculosis
gcguggcugaggccgccccggc

SEQ ID NO: 885222 - RNA, 14 nt, Mycobacterium avium subsp. paratuberculosis
gcguggcgggccag

SEQ ID NO: 885223 - RNA, 13 nt, Mycobacterium avium subsp. paratuberculosis
gcguggcgucggc

SEQ ID NO: 885224 - RNA, 17 nt, Mycobacterium avium subsp. paratuberculosis
gcguggcgucggcgcgc

SEQ ID NO: 885225 - RNA, 15 nt, Mycobacterium avium subsp. paratuberculosis
gcguggcgucgguga

SEQ ID NO: 885226 - RNA, 23 nt, Mycobacterium avium subsp. paratuberculosis
gcguggcggaagcgcguucaggg

SEQ ID NO: 885227 - RNA, 16 nt, Mycobacterium avium subsp. paratuberculosis
gcguggcgcacagcgu

SEQ ID NO: 885228 - RNA, 13 nt, Mycobacterium avium subsp. paratuberculosis
gcgugggcccuca

SEQ ID NO: 885229 - RNA, 21 nt, Mycobacterium avium subsp. paratuberculosis
gcgugggcccucagugcgggu

SEQ ID NO: 885230 - RNA, 14 nt, Mycobacterium avium subsp. paratuberculosis
gcgugggccgcagc

SEQ ID NO: 885231 - RNA, 19 nt, Mycobacterium avium subsp. paratuberculosis
gcgugggccgcagcgcggc

SEQ ID NO: 885232 - RNA, 20 nt, Mycobacterium avium subsp. paratuberculosis
gcgugggcaccccgaucagg

SEQ ID NO: 885233 - RNA, 21 nt, Mycobacterium avium subsp. paratuberculosis
gcguggggacccccucgucga

SEQ ID NO: 885234 - RNA, 19 nt, Mycobacterium avium subsp. paratuberculosis
gcguggguguccuugcgca

SEQ ID NO: 885235 - RNA, 15 nt, Mycobacterium avium subsp. paratuberculosis
gcgugggggccaugu

SEQ ID NO: 885236 - RNA, 18 nt, Mycobacterium avium subsp. paratuberculosis
gcgugggguucccggccg

SEQ ID NO: 885237 - RNA, 13 nt, Mycobacterium avium subsp. paratuberculosis
gcguggucgccgu

SEQ ID NO: 885238 - RNA, 14 nt, Mycobacterium avium subsp. paratuberculosis
gcguggucgccguu

SEQ ID NO: 885239 - RNA, 13 nt, Mycobacterium avium subsp. paratuberculosis
gcguggucgcgca

SEQ ID NO: 885240 - RNA, 15 nt, Mycobacterium avium subsp. paratuberculosis
gcguggucgcgcagc

SEQ ID NO: 885241 - RNA, 21 nt, Mycobacterium avium subsp. paratuberculosis
gcguggucacccgcagcccga

SEQ ID NO: 885242 - RNA, 16 nt, Mycobacterium avium subsp. paratuberculosis
gcguggucagcgucuc

SEQ ID NO: 885243 - RNA, 20 nt, Mycobacterium avium subsp. paratuberculosis
gcguggucagcgucucgccg

SEQ ID NO: 885244 - RNA, 21 nt, Mycobacterium avium subsp. paratuberculosis
gcguggucagcgucucgccgg

SEQ ID NO: 885245 - RNA, 22 nt, Mycobacterium avium subsp. paratuberculosis
gcguggugggcagaugcccgcu

SEQ ID NO: 885246 - RNA, 15 nt, Mycobacterium avium subsp. paratuberculosis
gcguggugcgcccgu

SEQ ID NO: 885247 - RNA, 15 nt, Mycobacterium avium subsp. paratuberculosis
gcguggugcucacgc

SEQ ID NO: 885248 - RNA, 13 nt, Mycobacterium avium subsp. paratuberculosis
gcguggucggcgc

SEQ ID NO: 885249 - RNA, 14 nt, Mycobacterium avium subsp. paratuberculosis
gcguggucggcgcg

SEQ ID NO: 885250 - RNA, 19 nt, Mycobacterium avium subsp. paratuberculosis
gcguggucuccuggccgcc

SEQ ID NO: 885251 - RNA, 23 nt, Mycobacterium avium subsp. paratuberculosis
gcguggugaagcagaacgccauc

SEQ ID NO: 885252 - RNA, 13 nt, Mycobacterium avium subsp. paratuberculosis
gcgugacggccgc

SEQ ID NO: 885253 - RNA, 20 nt, Mycobacterium avium subsp. paratuberculosis
gcgugcacacccgcagcgac

SEQ ID NO: 885254 - RNA, 21 nt, Mycobacterium avium subsp. paratuberculosis
gcgugcacacccgcagcgacc

SEQ ID NO: 885255 - RNA, 15 nt, Mycobacterium avium subsp. paratuberculosis
gcgugcacaggccgc

SEQ ID NO: 885256 - RNA, 12 nt, Mycobacterium avium subsp. paratuberculosis
gcgugcacccgg

SEQ ID NO: 885257 - RNA, 15 nt, Mycobacterium avium subsp. paratuberculosis
gcgugcacccgguuc

SEQ ID NO: 885258 - RNA, 15 nt, Mycobacterium avium subsp. paratuberculosis
gcgugcaccgcccgc

SEQ ID NO: 885259 - RNA, 17 nt, Mycobacterium avium subsp. paratuberculosis
gcgugcaccgcccgcgc

SEQ ID NO: 885260 - RNA, 16 nt, Mycobacterium avium subsp. paratuberculosis
gcgugcacgaacgcgg

SEQ ID NO: 885261 - RNA, 22 nt, Mycobacterium avium subsp. paratuberculosis
gcgugcacgaacgcggccagcg

SEQ ID NO: 885262 - RNA, 15 nt, Mycobacterium avium subsp. paratuberculosis
gcgugacggccgcgg

SEQ ID NO: 885263 - RNA, 17 nt, Mycobacterium avium subsp. paratuberculosis
gcgugacggccgcggcg

SEQ ID NO: 885264 - RNA, 16 nt, Mycobacterium avium subsp. paratuberculosis
gcgugacggcggggcg

SEQ ID NO: 885265 - RNA, 17 nt, Mycobacterium avium subsp. paratuberculosis
gcgugacggcggggcgg

SEQ ID NO: 885266 - RNA, 18 nt, Mycobacterium avium subsp. paratuberculosis
gcgugacggcggggcgga

SEQ ID NO: 885267 - RNA, 14 nt, Mycobacterium avium subsp. paratuberculosis
gcgugacgcucgac

SEQ ID NO: 885268 - RNA, 15 nt, Mycobacterium avium subsp. paratuberculosis
gcgugacgcucgacg

SEQ ID NO: 885269 - RNA, 21 nt, Mycobacterium avium subsp. paratuberculosis
gcgugacgcucgacggccggc

SEQ ID NO: 885270 - RNA, 17 nt, Mycobacterium avium subsp. paratuberculosis
gcgugacgcucgaggcc

SEQ ID NO: 885271 - RNA, 17 nt, Mycobacterium avium subsp. paratuberculosis
gcgugacgcucgccggc

SEQ ID NO: 885272 - RNA, 18 nt, Mycobacterium avium subsp. paratuberculosis
gcgugacgcucgccggcg

SEQ ID NO: 885273 - RNA, 15 nt, Mycobacterium avium subsp. paratuberculosis
gcgugacgcucgcgu

SEQ ID NO: 885274 - RNA, 13 nt, Mycobacterium avium subsp. paratuberculosis
gcgugacgcucgg

SEQ ID NO: 885275 - RNA, 22 nt, Mycobacterium avium subsp. paratuberculosis
gcgugacgcucggccguggccg

SEQ ID NO: 885276 - RNA, 15 nt, Mycobacterium avium subsp. paratuberculosis
gcgugacgcucggcg

SEQ ID NO: 885277 - RNA, 21 nt, Mycobacterium avium subsp. paratuberculosis
gcgugacgcucggcgccgcgg

SEQ ID NO: 885278 - RNA, 19 nt, Mycobacterium avium subsp. paratuberculosis
gcgugacgcucggcgccgg

SEQ ID NO: 885279 - RNA, 14 nt, Mycobacterium avium subsp. paratuberculosis
gcgugacgcucggg

SEQ ID NO: 885280 - RNA, 22 nt, Mycobacterium avium subsp. paratuberculosis
gcgugacgcucgggcuucggcg

SEQ ID NO: 885281 - RNA, 19 nt, Mycobacterium avium subsp. paratuberculosis
gcgugcaggauccgcucga

SEQ ID NO: 885282 - RNA, 20 nt, Mycobacterium avium subsp. paratuberculosis
gcgugcaggauccgcucgac

SEQ ID NO: 885283 - RNA, 21 nt, Mycobacterium avium subsp. paratuberculosis
gcgugcaggauccgcucgacg

SEQ ID NO: 885284 - RNA, 15 nt, Mycobacterium avium subsp. paratuberculosis
gcgugcaggccgcgg

SEQ ID NO: 885285 - RNA, 17 nt, Mycobacterium avium subsp. paratuberculosis
gcgugcaggccgcgggu

SEQ ID NO: 885286 - RNA, 18 nt, Mycobacterium avium subsp. paratuberculosis
gcgugcaggccgcgggug

SEQ ID NO: 885287 - RNA, 20 nt, Mycobacterium avium subsp. paratuberculosis
gcgugcaggccgcggguggc

SEQ ID NO: 885288 - RNA, 14 nt, Mycobacterium avium subsp. paratuberculosis
gcgugcagcgcggc

SEQ ID NO: 885289 - RNA, 13 nt, Mycobacterium avium subsp. paratuberculosis
gcgugcagccgca

SEQ ID NO: 885290 - RNA, 14 nt, Mycobacterium avium subsp. paratuberculosis
gcgugcagccgggc

SEQ ID NO: 885291 - RNA, 15 nt, Mycobacterium avium subsp. paratuberculosis
gcgugcagccgggcg

SEQ ID NO: 885292 - RNA, 17 nt, Mycobacterium avium subsp. paratuberculosis
gcgugcagccgggcggc

SEQ ID NO: 885293 - RNA, 22 nt, Mycobacterium avium subsp. paratuberculosis
gcgugcagccgggcggcgccga

SEQ ID NO: 885294 - RNA, 20 nt, Mycobacterium avium subsp. paratuberculosis
gcgugcagacaaccggugug

SEQ ID NO: 885295 - RNA, 19 nt, Mycobacterium avium subsp. paratuberculosis
gcgugcagcacgcccucgg

SEQ ID NO: 885296 - RNA, 17 nt, Mycobacterium avium subsp. paratuberculosis
gcgugacgcgcgugacg

SEQ ID NO: 885297 - RNA, 21 nt, Mycobacterium avium subsp. paratuberculosis
gcgugacgcgcgugacggcgg

SEQ ID NO: 885298 - RNA, 14 nt, Mycobacterium avium subsp. paratuberculosis
gcgugacgcccggc

SEQ ID NO: 885299 - RNA, 15 nt, Mycobacterium avium subsp. paratuberculosis
gcgugacgcccggcg

SEQ ID NO: 885300 - RNA, 19 nt, Mycobacterium avium subsp. paratuberculosis
gcgugacgcccggcgccgg

SEQ ID NO: 885301 - RNA, 22 nt, Mycobacterium avium subsp. paratuberculosis
gcgugacgcccggcgccggcgg

SEQ ID NO: 885302 - RNA, 14 nt, Mycobacterium avium subsp. paratuberculosis
gcgugacgccgggc

SEQ ID NO: 885303 - RNA, 16 nt, Mycobacterium avium subsp. paratuberculosis
gcgugacgccgggccg

SEQ ID NO: 885304 - RNA, 17 nt, Mycobacterium avium subsp. paratuberculosis
gcgugacgccgggccgc

SEQ ID NO: 885305 - RNA, 19 nt, Mycobacterium avium subsp. paratuberculosis
gcgugacgccgggccgccg

SEQ ID NO: 885306 - RNA, 16 nt, Mycobacterium avium subsp. paratuberculosis
gcgucgugcggccggc

SEQ ID NO: 885307 - RNA, 14 nt, Mycobacterium avium subsp. paratuberculosis
gcgugaccucgacg

SEQ ID NO: 885308 - RNA, 17 nt, Mycobacterium avium subsp. paratuberculosis
gcgugaccugcugggcg

SEQ ID NO: 885309 - RNA, 23 nt, Mycobacterium avium subsp. paratuberculosis
gcgucucccgggugcgcgucgcg

SEQ ID NO: 885310 - RNA, 15 nt, Mycobacterium avium subsp. paratuberculosis
gcgucuccucgaccg

SEQ ID NO: 885311 - RNA, 16 nt, Mycobacterium avium subsp. paratuberculosis
gcgucuccucgaccgc

SEQ ID NO: 885312 - RNA, 17 nt, Mycobacterium avium subsp. paratuberculosis
gcgucuccucgaccgcc

SEQ ID NO: 885313 - RNA, 13 nt, Mycobacterium avium subsp. paratuberculosis
gcgucucgaucga

SEQ ID NO: 885314 - RNA, 17 nt, Mycobacterium avium subsp. paratuberculosis
gcgucucgaucgacgac

SEQ ID NO: 885315 - RNA, 21 nt, Mycobacterium avium subsp. paratuberculosis
gcgucucgaucgacgacgcca

SEQ ID NO: 885316 - RNA, 22 nt, Mycobacterium avium subsp. paratuberculosis
gcgucucgaucgacgacgccag

SEQ ID NO: 885317 - RNA, 23 nt, Mycobacterium avium subsp. paratuberculosis
gcgucucgaucgacgacgccagc

SEQ ID NO: 885318 - RNA, 22 nt, Mycobacterium avium subsp. paratuberculosis
gcgucucgaugaccucgcgggu

SEQ ID NO: 885319 - RNA, 13 nt, Mycobacterium avium subsp. paratuberculosis
gcgucucgaugag

SEQ ID NO: 885320 - RNA, 13 nt, Mycobacterium avium subsp. paratuberculosis
gcgucucgaaccg

SEQ ID NO: 885321 - RNA, 15 nt, Mycobacterium avium subsp. paratuberculosis
gcgucucgaccgcgg

SEQ ID NO: 885322 - RNA, 20 nt, Mycobacterium avium subsp. paratuberculosis
gcgucucgaccgcgguggcg

SEQ ID NO: 885323 - RNA, 17 nt, Mycobacterium avium subsp. paratuberculosis
gcgucucgacggcgccg

SEQ ID NO: 885324 - RNA, 18 nt, Mycobacterium avium subsp. paratuberculosis
gcgucucgacggcgccga

SEQ ID NO: 885325 - RNA, 21 nt, Mycobacterium avium subsp. paratuberculosis
gcgucgugcaacucccgcgcc

SEQ ID NO: 885326 - RNA, 23 nt, Mycobacterium avium subsp. paratuberculosis
gcgucucgccggggaacaccggc

SEQ ID NO: 885327 - RNA, 13 nt, Mycobacterium avium subsp. paratuberculosis
gcguggcgccggc

SEQ ID NO: 885328 - RNA, 14 nt, Mycobacterium avium subsp. paratuberculosis
gcguggcgccggcg

SEQ ID NO: 885329 - RNA, 17 nt, Mycobacterium avium subsp. paratuberculosis
gcguggcgccggcgcgc

SEQ ID NO: 885330 - RNA, 15 nt, Mycobacterium avium subsp. paratuberculosis
gcguggccugggcga

SEQ ID NO: 885331 - RNA, 22 nt, Mycobacterium avium subsp. paratuberculosis
gcguggccguccgaaucguuga

SEQ ID NO: 885332 - RNA, 15 nt, Mycobacterium avium subsp. paratuberculosis
gcguggccucccggu

SEQ ID NO: 885333 - RNA, 13 nt, Mycobacterium avium subsp. paratuberculosis
gcguggccggcag

SEQ ID NO: 885334 - RNA, 16 nt, Mycobacterium avium subsp. paratuberculosis
gcguggcccagccggu

SEQ ID NO: 885335 - RNA, 17 nt, Mycobacterium avium subsp. paratuberculosis
gcguggcccagccggug

SEQ ID NO: 885336 - RNA, 19 nt, Mycobacterium avium subsp. paratuberculosis
gcguggcccagccggugcg

SEQ ID NO: 885337 - RNA, 13 nt, Mycobacterium avium subsp. paratuberculosis
gcgugcuugccga

SEQ ID NO: 885338 - RNA, 14 nt, Mycobacterium avium subsp. paratuberculosis
gcgugcuugccgau

SEQ ID NO: 885339 - RNA, 16 nt, Mycobacterium avium subsp. paratuberculosis
gcgugcuugccgaugu

SEQ ID NO: 885340 - RNA, 20 nt, Mycobacterium avium subsp. paratuberculosis
gcgugcuuuugcgucugcuc

SEQ ID NO: 885341 - RNA, 22 nt, Mycobacterium avium subsp. paratuberculosis
gcgugcuuuugcgucugcucgc

SEQ ID NO: 885342 - RNA, 15 nt, Mycobacterium avium subsp. paratuberculosis
gcgugcugggccacg

SEQ ID NO: 885343 - RNA, 23 nt, Mycobacterium avium subsp. paratuberculosis
gcgugcuggggguggcgucgacg

SEQ ID NO: 885344 - RNA, 17 nt, Mycobacterium avium subsp. paratuberculosis
gcgugcuguugcaggug

SEQ ID NO: 885345 - RNA, 14 nt, Mycobacterium avium subsp. paratuberculosis
gcgugcucgaugaa

SEQ ID NO: 885346 - RNA, 20 nt, Mycobacterium avium subsp. paratuberculosis
gcgugcuccagcaggcgcgc

SEQ ID NO: 885347 - RNA, 14 nt, Mycobacterium avium subsp. paratuberculosis
gcgugcucggccac

SEQ ID NO: 885348 - RNA, 15 nt, Mycobacterium avium subsp. paratuberculosis
gcgugcucggccacg

SEQ ID NO: 885349 - RNA, 18 nt, Mycobacterium avium subsp. paratuberculosis
gcgugcugacgucgucgc

SEQ ID NO: 885350 - RNA, 19 nt, Mycobacterium avium subsp. paratuberculosis
gcgugcugacgucgucgcc

SEQ ID NO: 885351 - RNA, 13 nt, Mycobacterium avium subsp. paratuberculosis
gcgugcccgccga

SEQ ID NO: 885352 - RNA, 14 nt, Mycobacterium avium subsp. paratuberculosis
gcgugcccgccgac

SEQ ID NO: 885353 - RNA, 13 nt, Mycobacterium avium subsp. paratuberculosis
gcgugcccgcgcc

SEQ ID NO: 885354 - RNA, 14 nt, Mycobacterium avium subsp. paratuberculosis
gcgugcccgcgccc

SEQ ID NO: 885355 - RNA, 20 nt, Mycobacterium avium subsp. paratuberculosis
gcgugcccgcgcccaccugg

SEQ ID NO: 885356 - RNA, 17 nt, Mycobacterium avium subsp. paratuberculosis
gcgugcccggaucgccg

SEQ ID NO: 885357 - RNA, 14 nt, Mycobacterium avium subsp. paratuberculosis
gcgugcccggccag

SEQ ID NO: 885358 - RNA, 12 nt, Mycobacterium avium subsp. paratuberculosis
gcgugcccggcg

SEQ ID NO: 885359 - RNA, 13 nt, Mycobacterium avium subsp. paratuberculosis
gcgugcccggcgc

SEQ ID NO: 885360 - RNA, 15 nt, Mycobacterium avium subsp. paratuberculosis
gcgugcccggcgccg

SEQ ID NO: 885361 - RNA, 16 nt, Mycobacterium avium subsp. paratuberculosis
gcgugcccggcgccga

SEQ ID NO: 885362 - RNA, 17 nt, Mycobacterium avium subsp. paratuberculosis
gcgugcgucaucgcgcu

SEQ ID NO: 885363 - RNA, 14 nt, Mycobacterium avium subsp. paratuberculosis
gcgugccagcagcu

SEQ ID NO: 885364 - RNA, 19 nt, Mycobacterium avium subsp. paratuberculosis
gcgugccaagcguauccgg

SEQ ID NO: 885365 - RNA, 23 nt, Mycobacterium avium subsp. paratuberculosis
gcgugccaagcguauccggccag

SEQ ID NO: 885366 - RNA, 16 nt, Mycobacterium avium subsp. paratuberculosis
gcgugccacagcauga

SEQ ID NO: 885367 - RNA, 13 nt, Mycobacterium avium subsp. paratuberculosis
gcgugccaccgcu

SEQ ID NO: 885368 - RNA, 16 nt, Mycobacterium avium subsp. paratuberculosis
gcgugacgucgacguu

SEQ ID NO: 885369 - RNA, 16 nt, Mycobacterium avium subsp. paratuberculosis
gcgguuuuggucggca

SEQ ID NO: 885370 - RNA, 14 nt, Mycobacterium avium subsp. paratuberculosis
gcgguugaccgccg

SEQ ID NO: 885371 - RNA, 17 nt, Mycobacterium avium subsp. paratuberculosis
gcgguugucggucaggc

SEQ ID NO: 885372 - RNA, 23 nt, Mycobacterium avium subsp. paratuberculosis
gcgguugucggucaggcacucga

SEQ ID NO: 885373 - RNA, 18 nt, Mycobacterium avium subsp. paratuberculosis
gcgguuuccggcgauucg

SEQ ID NO: 885374 - RNA, 22 nt, Mycobacterium avium subsp. paratuberculosis
gcgguucgucgcggcggcccgu

SEQ ID NO: 885375 - RNA, 20 nt, Mycobacterium avium subsp. paratuberculosis
gcgguucggaguccaccggc

SEQ ID NO: 885376 - RNA, 21 nt, Mycobacterium avium subsp. paratuberculosis
gcgguucggaguccaccggcg

SEQ ID NO: 885377 - RNA, 23 nt, Mycobacterium avium subsp. paratuberculosis
gcgguucggaguccaccggcgga

SEQ ID NO: 885378 - RNA, 20 nt, Mycobacterium avium subsp. paratuberculosis
gcgguucgaucuccucggcg

SEQ ID NO: 885379 - RNA, 21 nt, Mycobacterium avium subsp. paratuberculosis
gcgguucgaucucgucgggug

SEQ ID NO: 885380 - RNA, 13 nt, Mycobacterium avium subsp. paratuberculosis
gcgguucggcgac

SEQ ID NO: 885381 - RNA, 19 nt, Mycobacterium avium subsp. paratuberculosis
gcgguucggcgacgcuggu

SEQ ID NO: 885382 - RNA, 16 nt, Mycobacterium avium subsp. paratuberculosis
gcgguuccagaccggc

SEQ ID NO: 885383 - RNA, 19 nt, Mycobacterium avium subsp. paratuberculosis
gcgguuccagaccggcggc

SEQ ID NO: 885384 - RNA, 18 nt, Mycobacterium avium subsp. paratuberculosis
gcgguuccggcgugcagc

SEQ ID NO: 885385 - RNA, 23 nt, Mycobacterium avium subsp. paratuberculosis
gcgguuccggcgugcagcacgcc

SEQ ID NO: 885386 - RNA, 21 nt, Mycobacterium avium subsp. paratuberculosis
gcgguucgauaccguccgcgc

SEQ ID NO: 885387 - RNA, 22 nt, Mycobacterium avium subsp. paratuberculosis
gcgguucgauaccguccgcgcc

SEQ ID NO: 885388 - RNA, 24 nt, Mycobacterium avium subsp. paratuberculosis
gcguccgagcagcagccgcagcgg

SEQ ID NO: 885389 - RNA, 16 nt, Mycobacterium avium subsp. paratuberculosis
gcguccgaggcgguuc

SEQ ID NO: 885390 - RNA, 18 nt, Mycobacterium avium subsp. paratuberculosis
gcguccgaggcgguuccg

SEQ ID NO: 885391 - RNA, 20 nt, Mycobacterium avium subsp. paratuberculosis
gcguccgcaagcaccucgcg

SEQ ID NO: 885392 - RNA, 12 nt, Mycobacterium avium subsp. paratuberculosis
gcguccgccggc

SEQ ID NO: 885393 - RNA, 13 nt, Mycobacterium avium subsp. paratuberculosis
gcguccgccggcg

SEQ ID NO: 885394 - RNA, 14 nt, Mycobacterium avium subsp. paratuberculosis
gcguccgccggcgg

SEQ ID NO: 885395 - RNA, 15 nt, Mycobacterium avium subsp. paratuberculosis
gcguccgccggcggu

SEQ ID NO: 885396 - RNA, 23 nt, Mycobacterium avium subsp. paratuberculosis
gcguccgcgaucgucucgucgag

SEQ ID NO: 885397 - RNA, 14 nt, Mycobacterium avium subsp. paratuberculosis
gcguaaccggcggc

SEQ ID NO: 885398 - RNA, 19 nt, Mycobacterium avium subsp. paratuberculosis
gcguccgggcgcugcgcgg

SEQ ID NO: 885399 - RNA, 12 nt, Mycobacterium avium subsp. paratuberculosis
gcguccggcccg

SEQ ID NO: 885400 - RNA, 14 nt, Mycobacterium avium subsp. paratuberculosis
gcguccggcccggc

SEQ ID NO: 885401 - RNA, 16 nt, Mycobacterium avium subsp. paratuberculosis
gcguccggcccggcgu

SEQ ID NO: 885402 - RNA, 17 nt, Mycobacterium avium subsp. paratuberculosis
gcguccggcccggcguc

SEQ ID NO: 885403 - RNA, 19 nt, Mycobacterium avium subsp. paratuberculosis
gcguccggagaaccgcucg

SEQ ID NO: 885404 - RNA, 19 nt, Mycobacterium avium subsp. paratuberculosis
gcguccggaggugccggcc

SEQ ID NO: 885405 - RNA, 17 nt, Mycobacterium avium subsp. paratuberculosis
gcguccgcgucgucgag

SEQ ID NO: 885406 - RNA, 18 nt, Mycobacterium avium subsp. paratuberculosis
gcguccgcgucgucgagg

SEQ ID NO: 885407 - RNA, 22 nt, Mycobacterium avium subsp. paratuberculosis
gcguccgcgucgucgaggcgga

SEQ ID NO: 885408 - RNA, 13 nt, Mycobacterium avium subsp. paratuberculosis
gcguccgcgggcg

SEQ ID NO: 885409 - RNA, 14 nt, Mycobacterium avium subsp. paratuberculosis
gcguccgcgggcgg

SEQ ID NO: 885410 - RNA, 19 nt, Mycobacterium avium subsp. paratuberculosis
gcguccgcgguuucaccgu

SEQ ID NO: 885411 - RNA, 14 nt, Mycobacterium avium subsp. paratuberculosis
gcguccgcggccgc

SEQ ID NO: 885412 - RNA, 18 nt, Mycobacterium avium subsp. paratuberculosis
gcguccgcggccgcggcg

SEQ ID NO: 885413 - RNA, 13 nt, Mycobacterium avium subsp. paratuberculosis
gcgucgacgucgg

SEQ ID NO: 885414 - RNA, 15 nt, Mycobacterium avium subsp. paratuberculosis
gcgucgacgacggcg

SEQ ID NO: 885415 - RNA, 18 nt, Mycobacterium avium subsp. paratuberculosis
gcgucgacgacggcgccg

SEQ ID NO: 885416 - RNA, 22 nt, Mycobacterium avium subsp. paratuberculosis
gcgucgacgauggcguccaccg

SEQ ID NO: 885417 - RNA, 21 nt, Mycobacterium avium subsp. paratuberculosis
gcgucgacgauggucuggaug

SEQ ID NO: 885418 - RNA, 17 nt, Mycobacterium avium subsp. paratuberculosis
gcgucgacgccgcugcc

SEQ ID NO: 885419 - RNA, 19 nt, Mycobacterium avium subsp. paratuberculosis
gcgucgacgccgcugccgg

SEQ ID NO: 885420 - RNA, 23 nt, Mycobacterium avium subsp. paratuberculosis
gcgucgacgccgcugccggggug

SEQ ID NO: 885421 - RNA, 11 nt, Mycobacterium avium subsp. paratuberculosis
gcgucgacgcg

SEQ ID NO: 885422 - RNA, 15 nt, Mycobacterium avium subsp. paratuberculosis
gcgucgacgcgcugc

SEQ ID NO: 885423 - RNA, 17 nt, Mycobacterium avium subsp. paratuberculosis
gcgucgacgcggugaca

SEQ ID NO: 885424 - RNA, 16 nt, Mycobacterium avium subsp. paratuberculosis
gcgucgacggcaagca

SEQ ID NO: 885425 - RNA, 15 nt, Mycobacterium avium subsp. paratuberculosis
gcgucgacggcgccg

SEQ ID NO: 885426 - RNA, 16 nt, Mycobacterium avium subsp. paratuberculosis
gcgucgacggcgccgg

SEQ ID NO: 885427 - RNA, 18 nt, Mycobacterium avium subsp. paratuberculosis
gcgucgacggcgccggac

SEQ ID NO: 885428 - RNA, 14 nt, Mycobacterium avium subsp. paratuberculosis
gcgucgacggcgug

SEQ ID NO: 885429 - RNA, 12 nt, Mycobacterium avium subsp. paratuberculosis
gcgucgaccgcc

SEQ ID NO: 885430 - RNA, 12 nt, Mycobacterium avium subsp. paratuberculosis
gcgucgaccagc

SEQ ID NO: 885431 - RNA, 13 nt, Mycobacterium avium subsp. paratuberculosis
gcgucgaccagcc

SEQ ID NO: 885432 - RNA, 14 nt, Mycobacterium avium subsp. paratuberculosis
gcgucgaccagccg

SEQ ID NO: 885433 - RNA, 16 nt, Mycobacterium avium subsp. paratuberculosis
gcgucgaccagccgca

SEQ ID NO: 885434 - RNA, 19 nt, Mycobacterium avium subsp. paratuberculosis
gcgucgaccgccccgccgg

SEQ ID NO: 885435 - RNA, 23 nt, Mycobacterium avium subsp. paratuberculosis
gcgucgaccgccccgccgguguc

SEQ ID NO: 885436 - RNA, 13 nt, Mycobacterium avium subsp. paratuberculosis
gcgucgaccgccg

SEQ ID NO: 885437 - RNA, 14 nt, Mycobacterium avium subsp. paratuberculosis
gcgucgaccgccgc

SEQ ID NO: 885438 - RNA, 19 nt, Mycobacterium avium subsp. paratuberculosis
gcgucgaccgccgcgaacg

SEQ ID NO: 885439 - RNA, 20 nt, Mycobacterium avium subsp. paratuberculosis
gcgucgacaccccgcucggc

SEQ ID NO: 885440 - RNA, 14 nt, Mycobacterium avium subsp. paratuberculosis
gcgucgacacccgg

SEQ ID NO: 885441 - RNA, 16 nt, Mycobacterium avium subsp. paratuberculosis
gcgucgacacccgggc

SEQ ID NO: 885442 - RNA, 17 nt, Mycobacterium avium subsp. paratuberculosis
gcgucgacacccgggcg

SEQ ID NO: 885443 - RNA, 14 nt, Mycobacterium avium subsp. paratuberculosis
gcgucgaccaccgc

SEQ ID NO: 885444 - RNA, 16 nt, Mycobacterium avium subsp. paratuberculosis
gcgucgaccaccgccg

SEQ ID NO: 885445 - RNA, 18 nt, Mycobacterium avium subsp. paratuberculosis
gcgucgaccaccgccggc

SEQ ID NO: 885446 - RNA, 23 nt, Mycobacterium avium subsp. paratuberculosis
gcgucgaccaccgccggcccggc

SEQ ID NO: 885447 - RNA, 22 nt, Mycobacterium avium subsp. paratuberculosis
gcgucgaacggcgucuggccgg

SEQ ID NO: 885448 - RNA, 18 nt, Mycobacterium avium subsp. paratuberculosis
gcgucgaacgggccgggc

SEQ ID NO: 885449 - RNA, 21 nt, Mycobacterium avium subsp. paratuberculosis
gcgucgaagaagucguucagc

SEQ ID NO: 885450 - RNA, 20 nt, Mycobacterium avium subsp. paratuberculosis
gcgucgaaauccacgaugcc

SEQ ID NO: 885451 - RNA, 22 nt, Mycobacterium avium subsp. paratuberculosis
gcgucgaaauccacgaugccgg

SEQ ID NO: 885452 - RNA, 24 nt, Mycobacterium avium subsp. paratuberculosis
gcgucgaaauccacgaugccgggc

SEQ ID NO: 885453 - RNA, 22 nt, Mycobacterium avium subsp. paratuberculosis
gcgucgaacagccgggccgccc

SEQ ID NO: 885454 - RNA, 18 nt, Mycobacterium avium subsp. paratuberculosis
gcgucgaaauagcggcgc

SEQ ID NO: 885455 - RNA, 21 nt, Mycobacterium avium subsp. paratuberculosis
gcgucgaaauagcggcgcacc

SEQ ID NO: 885456 - RNA, 17 nt, Mycobacterium avium subsp. paratuberculosis
gcguccuugcccgaggu

SEQ ID NO: 885457 - RNA, 22 nt, Mycobacterium avium subsp. paratuberculosis
gcguccuugccgaucagcguca

SEQ ID NO: 885458 - RNA, 15 nt, Mycobacterium avium subsp. paratuberculosis
gcguccuucuccgcc

SEQ ID NO: 885459 - RNA, 17 nt, Mycobacterium avium subsp. paratuberculosis
gcguccuucuccgccgg

SEQ ID NO: 885460 - RNA, 23 nt, Mycobacterium avium subsp. paratuberculosis
gcguccuugaaggagggccgaac

SEQ ID NO: 885461 - RNA, 19 nt, Mycobacterium avium subsp. paratuberculosis
gcguccuccucguccgcgg

SEQ ID NO: 885462 - RNA, 18 nt, Mycobacterium avium subsp. paratuberculosis
gcguccucgucgaugccg

SEQ ID NO: 885463 - RNA, 18 nt, Mycobacterium avium subsp. paratuberculosis
gcguccugcagcagccgg

SEQ ID NO: 885464 - RNA, 20 nt, Mycobacterium avium subsp. paratuberculosis
gcguccugcagcagccggac

SEQ ID NO: 885465 - RNA, 14 nt, Mycobacterium avium subsp. paratuberculosis
gcguccugcagcgc

SEQ ID NO: 885466 - RNA, 19 nt, Mycobacterium avium subsp. paratuberculosis
gcguccugcagcgccgucc

SEQ ID NO: 885467 - RNA, 16 nt, Mycobacterium avium subsp. paratuberculosis
gcguccugcaggcagg

SEQ ID NO: 885468 - RNA, 20 nt, Mycobacterium avium subsp. paratuberculosis
gcguccugcaggcaggccgg

SEQ ID NO: 885469 - RNA, 21 nt, Mycobacterium avium subsp. paratuberculosis
gcguccugcaggcaggccggc

SEQ ID NO: 885470 - RNA, 22 nt, Mycobacterium avium subsp. paratuberculosis
gcguccugcaggcaggccggca

SEQ ID NO: 885471 - RNA, 19 nt, Mycobacterium avium subsp. paratuberculosis
gcguccguagugcucggcg

SEQ ID NO: 885472 - RNA, 20 nt, Mycobacterium avium subsp. paratuberculosis
gcguccguagugcucggcgu

SEQ ID NO: 885473 - RNA, 12 nt, Mycobacterium avium subsp. paratuberculosis
gcguccgugccg

SEQ ID NO: 885474 - RNA, 13 nt, Mycobacterium avium subsp. paratuberculosis
gcguccucgacca

SEQ ID NO: 885475 - RNA, 14 nt, Mycobacterium avium subsp. paratuberculosis
gcguccucgacgcc

SEQ ID NO: 885476 - RNA, 15 nt, Mycobacterium avium subsp. paratuberculosis
gcguccucgacgccg

SEQ ID NO: 885477 - RNA, 16 nt, Mycobacterium avium subsp. paratuberculosis
gcguccucgacgccgc

SEQ ID NO: 885478 - RNA, 19 nt, Mycobacterium avium subsp. paratuberculosis
gcguccucgacgguggagc

SEQ ID NO: 885479 - RNA, 13 nt, Mycobacterium avium subsp. paratuberculosis
gcguccucgauga

SEQ ID NO: 885480 - RNA, 16 nt, Mycobacterium avium subsp. paratuberculosis
gcguccucgaugacgc

SEQ ID NO: 885481 - RNA, 18 nt, Mycobacterium avium subsp. paratuberculosis
gcguccucgaugacgccg

SEQ ID NO: 885482 - RNA, 21 nt, Mycobacterium avium subsp. paratuberculosis
gcguccucgaugacgccggac

SEQ ID NO: 885483 - RNA, 22 nt, Mycobacterium avium subsp. paratuberculosis
gcgucguccgacaccaccugca

SEQ ID NO: 885484 - RNA, 23 nt, Mycobacterium avium subsp. paratuberculosis
gcgucguccgacaccaccugcac

SEQ ID NO: 885485 - RNA, 22 nt, Mycobacterium avium subsp. paratuberculosis
gcgucguccaugcccgcccacg

SEQ ID NO: 885486 - RNA, 18 nt, Mycobacterium avium subsp. paratuberculosis
gcgucggcgggcgugccg

SEQ ID NO: 885487 - RNA, 13 nt, Mycobacterium avium subsp. paratuberculosis
gcgucggcggucg

SEQ ID NO: 885488 - RNA, 18 nt, Mycobacterium avium subsp. paratuberculosis
gcgucggcggucgccagc

SEQ ID NO: 885489 - RNA, 14 nt, Mycobacterium avium subsp. paratuberculosis
gcgucggcgguggu

SEQ ID NO: 885490 - RNA, 22 nt, Mycobacterium avium subsp. paratuberculosis
gcgucggcggugguccgcgcga

SEQ ID NO: 885491 - RNA, 18 nt, Mycobacterium avium subsp. paratuberculosis
gcgucggcguccaugcuc

SEQ ID NO: 885492 - RNA, 18 nt, Mycobacterium avium subsp. paratuberculosis
gcgucggcgucgaacggc

SEQ ID NO: 885493 - RNA, 20 nt, Mycobacterium avium subsp. paratuberculosis
gcgucggcgucgaacggcgu

SEQ ID NO: 885494 - RNA, 14 nt, Mycobacterium avium subsp. paratuberculosis
gcgucggcgucggg

SEQ ID NO: 885495 - RNA, 20 nt, Mycobacterium avium subsp. paratuberculosis
gcgucggcgugcccgccgac

SEQ ID NO: 885496 - RNA, 13 nt, Mycobacterium avium subsp. paratuberculosis
gcgucggcgcgug

SEQ ID NO: 885497 - RNA, 21 nt, Mycobacterium avium subsp. paratuberculosis
gcgucggcgcuggccagcgcg

SEQ ID NO: 885498 - RNA, 20 nt, Mycobacterium avium subsp. paratuberculosis
gcgucggcggcggcggccgc

SEQ ID NO: 885499 - RNA, 18 nt, Mycobacterium avium subsp. paratuberculosis
gcgucgugccgagcguga

SEQ ID NO: 885500 - RNA, 19 nt, Mycobacterium avium subsp. paratuberculosis
gcgucgugccgagcgugaa

SEQ ID NO: 885501 - RNA, 17 nt, Mycobacterium avium subsp. paratuberculosis
gcgucgucuuggccugc

SEQ ID NO: 885502 - RNA, 13 nt, Mycobacterium avium subsp. paratuberculosis
gcgucgucgauga

SEQ ID NO: 885503 - RNA, 18 nt, Mycobacterium avium subsp. paratuberculosis
gcgucgucggcggcgacg

SEQ ID NO: 885504 - RNA, 22 nt, Mycobacterium avium subsp. paratuberculosis
gcgucgucggcggcgacgugcc

SEQ ID NO: 885505 - RNA, 23 nt, Mycobacterium avium subsp. paratuberculosis
gcgucgucggucaggccggcgcc

SEQ ID NO: 885506 - RNA, 15 nt, Mycobacterium avium subsp. paratuberculosis
gcgucgucgucgacc

SEQ ID NO: 885507 - RNA, 18 nt, Mycobacterium avium subsp. paratuberculosis
gcgucgucgucgaccguc

SEQ ID NO: 885508 - RNA, 14 nt, Mycobacterium avium subsp. paratuberculosis
gcgucgucgucgag

SEQ ID NO: 885509 - RNA, 22 nt, Mycobacterium avium subsp. paratuberculosis
gcgucgucgucgagccgcucgc

SEQ ID NO: 885510 - RNA, 16 nt, Mycobacterium avium subsp. paratuberculosis
gcgucgucgagcaccg

SEQ ID NO: 885511 - RNA, 18 nt, Mycobacterium avium subsp. paratuberculosis
gcgucgucgagcaccggc

SEQ ID NO: 885512 - RNA, 19 nt, Mycobacterium avium subsp. paratuberculosis
gcgucgucgagcaccggca

SEQ ID NO: 885513 - RNA, 20 nt, Mycobacterium avium subsp. paratuberculosis
gcgucgucgaugaacaucgc

SEQ ID NO: 885514 - RNA, 19 nt, Mycobacterium avium subsp. paratuberculosis
gcgucgucgauggccacca

SEQ ID NO: 885515 - RNA, 13 nt, Mycobacterium avium subsp. paratuberculosis
gcgucgucgccga

SEQ ID NO: 885516 - RNA, 22 nt, Mycobacterium avium subsp. paratuberculosis
gcgucgucgccguggcggcccg

SEQ ID NO: 885517 - RNA, 13 nt, Mycobacterium avium subsp. paratuberculosis
gcgucgucggccc

SEQ ID NO: 885518 - RNA, 17 nt, Mycobacterium avium subsp. paratuberculosis
gcgucgucggccggcuc

SEQ ID NO: 885519 - RNA, 13 nt, Mycobacterium avium subsp. paratuberculosis
gcgucggcggccu

SEQ ID NO: 885520 - RNA, 14 nt, Mycobacterium avium subsp. paratuberculosis
gcgucggcggccug

SEQ ID NO: 885521 - RNA, 15 nt, Mycobacterium avium subsp. paratuberculosis
gcgucggcggccugc

SEQ ID NO: 885522 - RNA, 23 nt, Mycobacterium avium subsp. paratuberculosis
gcgucggcggccugcuccagcga

SEQ ID NO: 885523 - RNA, 20 nt, Mycobacterium avium subsp. paratuberculosis
gcgucggcggccugcucgca

SEQ ID NO: 885524 - RNA, 16 nt, Mycobacterium avium subsp. paratuberculosis
gcgucggcggccuuga

SEQ ID NO: 885525 - RNA, 16 nt, Mycobacterium avium subsp. paratuberculosis
gcgucggcgccggauc

SEQ ID NO: 885526 - RNA, 14 nt, Mycobacterium avium subsp. paratuberculosis
gcgucggcgccggc

SEQ ID NO: 885527 - RNA, 13 nt, Mycobacterium avium subsp. paratuberculosis
gcgucggcgcgca

SEQ ID NO: 885528 - RNA, 15 nt, Mycobacterium avium subsp. paratuberculosis
gcgucggacgccagu

SEQ ID NO: 885529 - RNA, 13 nt, Mycobacterium avium subsp. paratuberculosis
gcgucggcgaucu

SEQ ID NO: 885530 - RNA, 22 nt, Mycobacterium avium subsp. paratuberculosis
gcgucggcgaucucggucaccg

SEQ ID NO: 885531 - RNA, 23 nt, Mycobacterium avium subsp. paratuberculosis
gcgucggcgauguccuugucgcu

SEQ ID NO: 885532 - RNA, 15 nt, Mycobacterium avium subsp. paratuberculosis
gcgucgcugggcagc

SEQ ID NO: 885533 - RNA, 19 nt, Mycobacterium avium subsp. paratuberculosis
gcgucggaauacagcagcu

SEQ ID NO: 885534 - RNA, 20 nt, Mycobacterium avium subsp. paratuberculosis
gcgucggacaugccggcgcc

SEQ ID NO: 885535 - RNA, 21 nt, Mycobacterium avium subsp. paratuberculosis
gcgucggacaugccggcgccg

SEQ ID NO: 885536 - RNA, 22 nt, Mycobacterium avium subsp. paratuberculosis
gcgucggacaugccggcgccga

SEQ ID NO: 885537 - RNA, 15 nt, Mycobacterium avium subsp. paratuberculosis
gcgucggaccccgau

SEQ ID NO: 885538 - RNA, 20 nt, Mycobacterium avium subsp. paratuberculosis
gcgucgcggcgcacccgggc

SEQ ID NO: 885539 - RNA, 22 nt, Mycobacterium avium subsp. paratuberculosis
gcgucgcggcgcacccgggcag

SEQ ID NO: 885540 - RNA, 16 nt, Mycobacterium avium subsp. paratuberculosis
gcgucgcggucggcgu

SEQ ID NO: 885541 - RNA, 23 nt, Mycobacterium avium subsp. paratuberculosis
gcgucgcggugaaguugccgccg

SEQ ID NO: 885542 - RNA, 19 nt, Mycobacterium avium subsp. paratuberculosis
gcgucgcccaucaccagca

SEQ ID NO: 885543 - RNA, 20 nt, Mycobacterium avium subsp. paratuberculosis
gcgucgcccaucaccagcag

SEQ ID NO: 885544 - RNA, 22 nt, Mycobacterium avium subsp. paratuberculosis
gcgucgcgccgccgcgucgugc

SEQ ID NO: 885545 - RNA, 21 nt, Mycobacterium avium subsp. paratuberculosis
gcgucgcgccagcgguccagc

SEQ ID NO: 885546 - RNA, 14 nt, Mycobacterium avium subsp. paratuberculosis
gcgucgcgcccggc

SEQ ID NO: 885547 - RNA, 16 nt, Mycobacterium avium subsp. paratuberculosis
gcgucgcgcccggcgu

SEQ ID NO: 885548 - RNA, 17 nt, Mycobacterium avium subsp. paratuberculosis
gcgucgcgcccggcguc

SEQ ID NO: 885549 - RNA, 13 nt, Mycobacterium avium subsp. paratuberculosis
gcgucgcgccgcc

SEQ ID NO: 885550 - RNA, 14 nt, Mycobacterium avium subsp. paratuberculosis
gcgucgcgccgcca

SEQ ID NO: 885551 - RNA, 22 nt, Mycobacterium avium subsp. paratuberculosis
gcgucgccaauccggcgggccu

SEQ ID NO: 885552 - RNA, 21 nt, Mycobacterium avium subsp. paratuberculosis
gcgucgcagugccggugcagc

SEQ ID NO: 885553 - RNA, 19 nt, Mycobacterium avium subsp. paratuberculosis
gcgucgcagaucccgccgg

SEQ ID NO: 885554 - RNA, 22 nt, Mycobacterium avium subsp. paratuberculosis
gcgucgcagaucccgccggcgg

SEQ ID NO: 885555 - RNA, 17 nt, Mycobacterium avium subsp. paratuberculosis
gcgucgccagccgccgg

SEQ ID NO: 885556 - RNA, 18 nt, Mycobacterium avium subsp. paratuberculosis
gcgucgccagccgccggc

SEQ ID NO: 885557 - RNA, 22 nt, Mycobacterium avium subsp. paratuberculosis
gcgucgccagccgccggcucag

SEQ ID NO: 885558 - RNA, 15 nt, Mycobacterium avium subsp. paratuberculosis
gcgucgccaccaccu

SEQ ID NO: 885559 - RNA, 19 nt, Mycobacterium avium subsp. paratuberculosis
gcgucgccaugccgucgcg

SEQ ID NO: 885560 - RNA, 12 nt, Mycobacterium avium subsp. paratuberculosis
gcgucgcccacg

SEQ ID NO: 885561 - RNA, 13 nt, Mycobacterium avium subsp. paratuberculosis
gcgucgcccacgc

SEQ ID NO: 885562 - RNA, 17 nt, Mycobacterium avium subsp. paratuberculosis
gcgucgcccacgccggu

SEQ ID NO: 885563 - RNA, 16 nt, Mycobacterium avium subsp. paratuberculosis
gcgucgcacagcgccg

SEQ ID NO: 885564 - RNA, 17 nt, Mycobacterium avium subsp. paratuberculosis
gcgucgcacagcgccgc

SEQ ID NO: 885565 - RNA, 17 nt, Mycobacterium avium subsp. paratuberculosis
gcgucgaugucgcccgg

SEQ ID NO: 885566 - RNA, 20 nt, Mycobacterium avium subsp. paratuberculosis
gcgucgaugucgcccggcgc

SEQ ID NO: 885567 - RNA, 21 nt, Mycobacterium avium subsp. paratuberculosis
gcgucgaugucgcccggcgcg

SEQ ID NO: 885568 - RNA, 19 nt, Mycobacterium avium subsp. paratuberculosis
gcgucgaugucgucgucga

SEQ ID NO: 885569 - RNA, 22 nt, Mycobacterium avium subsp. paratuberculosis
gcgucgaugucgucgucgacgc

SEQ ID NO: 885570 - RNA, 20 nt, Mycobacterium avium subsp. paratuberculosis
gcgucgaugugggccgcagc

SEQ ID NO: 885571 - RNA, 15 nt, Mycobacterium avium subsp. paratuberculosis
gcgucgaugcgggcc

SEQ ID NO: 885572 - RNA, 17 nt, Mycobacterium avium subsp. paratuberculosis
gcgucgaugcgggcccg

SEQ ID NO: 885573 - RNA, 19 nt, Mycobacterium avium subsp. paratuberculosis
gcgucgaugcgggcccgca

SEQ ID NO: 885574 - RNA, 16 nt, Mycobacterium avium subsp. paratuberculosis
gcgucgaugcgcgcca

SEQ ID NO: 885575 - RNA, 17 nt, Mycobacterium avium subsp. paratuberculosis
gcgucgaugcgcgccac

SEQ ID NO: 885576 - RNA, 18 nt, Mycobacterium avium subsp. paratuberculosis
gcgucgaugcgcgccacc

SEQ ID NO: 885577 - RNA, 19 nt, Mycobacterium avium subsp. paratuberculosis
gcgucgaugcgcgccacca

SEQ ID NO: 885578 - RNA, 23 nt, Mycobacterium avium subsp. paratuberculosis
gcgucgaugcgcgccaccaggcg

SEQ ID NO: 885579 - RNA, 14 nt, Mycobacterium avium subsp. paratuberculosis
gcgucgaugccgau

SEQ ID NO: 885580 - RNA, 17 nt, Mycobacterium avium subsp. paratuberculosis
gcgucgaugccggcgau

SEQ ID NO: 885581 - RNA, 23 nt, Mycobacterium avium subsp. paratuberculosis
gcgucgaugccggcgauccgcgc

SEQ ID NO: 885582 - RNA, 16 nt, Mycobacterium avium subsp. paratuberculosis
gcgucgaugaccucgc

SEQ ID NO: 885583 - RNA, 17 nt, Mycobacterium avium subsp. paratuberculosis
gcgucgaugaccucgcg

SEQ ID NO: 885584 - RNA, 14 nt, Mycobacterium avium subsp. paratuberculosis
gcgucgaucgccgu

SEQ ID NO: 885585 - RNA, 19 nt, Mycobacterium avium subsp. paratuberculosis
gcgucgaucgccgucacgu

SEQ ID NO: 885586 - RNA, 16 nt, Mycobacterium avium subsp. paratuberculosis
gcgucgaucagcgcgc

SEQ ID NO: 885587 - RNA, 19 nt, Mycobacterium avium subsp. paratuberculosis
gcgucgaucagcgcgccgc

SEQ ID NO: 885588 - RNA, 20 nt, Mycobacterium avium subsp. paratuberculosis
gcgucgaucagcgcgccgcc

SEQ ID NO: 885589 - RNA, 15 nt, Mycobacterium avium subsp. paratuberculosis
gcgucgaguucgccg

SEQ ID NO: 885590 - RNA, 22 nt, Mycobacterium avium subsp. paratuberculosis
gcgucgaguucgccgucgacgg

SEQ ID NO: 885591 - RNA, 17 nt, Mycobacterium avium subsp. paratuberculosis
gcgucgagcguggggcc

SEQ ID NO: 885592 - RNA, 15 nt, Mycobacterium avium subsp. paratuberculosis
gcgucgaggucgcgc

SEQ ID NO: 885593 - RNA, 22 nt, Mycobacterium avium subsp. paratuberculosis
gcgucgaggucgucgggcgccg

SEQ ID NO: 885594 - RNA, 13 nt, Mycobacterium avium subsp. paratuberculosis
gcgucgagcgcgu

SEQ ID NO: 885595 - RNA, 14 nt, Mycobacterium avium subsp. paratuberculosis
gcgucgagcgcguc

SEQ ID NO: 885596 - RNA, 13 nt, Mycobacterium avium subsp. paratuberculosis
gcgucgagcagca

SEQ ID NO: 885597 - RNA, 15 nt, Mycobacterium avium subsp. paratuberculosis
gcgucgagcagcacc

SEQ ID NO: 885598 - RNA, 15 nt, Mycobacterium avium subsp. paratuberculosis
gcgucgagcaccugg

SEQ ID NO: 885599 - RNA, 19 nt, Mycobacterium avium subsp. paratuberculosis
gcgucgacgucgggcacgg

SEQ ID NO: 885600 - RNA, 21 nt, Mycobacterium avium subsp. paratuberculosis
gcgucgacgucgggcacgguc

SEQ ID NO: 885601 - RNA, 14 nt, Mycobacterium avium subsp. paratuberculosis
gcgucgacgugcgc

SEQ ID NO: 885602 - RNA, 13 nt, Mycobacterium avium subsp. paratuberculosis
gcgucgacguucg

SEQ ID NO: 885603 - RNA, 17 nt, Mycobacterium avium subsp. paratuberculosis
gcgucgacguucgccgc

SEQ ID NO: 885604 - RNA, 18 nt, Mycobacterium avium subsp. paratuberculosis
gcgucgacguucgccgcc

SEQ ID NO: 885605 - RNA, 14 nt, Mycobacterium avium subsp. paratuberculosis
gcgucgacugcacc

SEQ ID NO: 885606 - RNA, 16 nt, Mycobacterium avium subsp. paratuberculosis
gcgucgacugcaccga

SEQ ID NO: 885607 - RNA, 17 nt, Mycobacterium avium subsp. paratuberculosis
gcgucgacugcaccgac

SEQ ID NO: 885608 - RNA, 18 nt, Mycobacterium avium subsp. paratuberculosis
gcgucgacugcaccgacu

SEQ ID NO: 885609 - RNA, 20 nt, Mycobacterium avium subsp. paratuberculosis
gcgguaaagucuucggcgau

SEQ ID NO: 885610 - RNA, 15 nt, Mycobacterium avium subsp. paratuberculosis
gcgguaaccacccgu

SEQ ID NO: 885611 - RNA, 15 nt, Mycobacterium avium subsp. paratuberculosis
gcggguuuggccgcg

SEQ ID NO: 885612 - RNA, 16 nt, Mycobacterium avium subsp. paratuberculosis
gcggguuuggccgcgg

SEQ ID NO: 885613 - RNA, 23 nt, Mycobacterium avium subsp. paratuberculosis
gcggguuucgaggaucugggcgg

SEQ ID NO: 885614 - RNA, 15 nt, Mycobacterium avium subsp. paratuberculosis
gcggguuggugucga

SEQ ID NO: 885615 - RNA, 23 nt, Mycobacterium avium subsp. paratuberculosis
gcggguuggucccgaucaccuug

SEQ ID NO: 885616 - RNA, 21 nt, Mycobacterium avium subsp. paratuberculosis
gcggguugucgucgucggcga

SEQ ID NO: 885617 - RNA, 20 nt, Mycobacterium avium subsp. paratuberculosis
gcggguugcugagccgccga

SEQ ID NO: 885618 - RNA, 19 nt, Mycobacterium avium subsp. paratuberculosis
gcggguguuucggucggcg

SEQ ID NO: 885619 - RNA, 14 nt, Mycobacterium avium subsp. paratuberculosis
gcgggugucgcccu

SEQ ID NO: 885620 - RNA, 21 nt, Mycobacterium avium subsp. paratuberculosis
gcgggugcucagccuagccuu

SEQ ID NO: 885621 - RNA, 21 nt, Mycobacterium avium subsp. paratuberculosis
gcgggugguguggcgucggcc

SEQ ID NO: 885622 - RNA, 15 nt, Mycobacterium avium subsp. paratuberculosis
gcgggugguuggccg

SEQ ID NO: 885623 - RNA, 17 nt, Mycobacterium avium subsp. paratuberculosis
gcggguguauucgccca

SEQ ID NO: 885624 - RNA, 16 nt, Mycobacterium avium subsp. paratuberculosis
gcggguucacccuggc

SEQ ID NO: 885625 - RNA, 18 nt, Mycobacterium avium subsp. paratuberculosis
gcggguucacccuggcga

SEQ ID NO: 885626 - RNA, 20 nt, Mycobacterium avium subsp. paratuberculosis
gcggguucacccuggcgaac

SEQ ID NO: 885627 - RNA, 20 nt, Mycobacterium avium subsp. paratuberculosis
gcggguggccuucaucaccg

SEQ ID NO: 885628 - RNA, 21 nt, Mycobacterium avium subsp. paratuberculosis
gcggguggccuucaucaccgc

SEQ ID NO: 885629 - RNA, 16 nt, Mycobacterium avium subsp. paratuberculosis
gcggguggcgccacag

SEQ ID NO: 885630 - RNA, 16 nt, Mycobacterium avium subsp. paratuberculosis
gcggguggcggccggg

SEQ ID NO: 885631 - RNA, 19 nt, Mycobacterium avium subsp. paratuberculosis
gcggguggcggccggggug

SEQ ID NO: 885632 - RNA, 15 nt, Mycobacterium avium subsp. paratuberculosis
gcggguggccggguc

SEQ ID NO: 885633 - RNA, 16 nt, Mycobacterium avium subsp. paratuberculosis
gcggguggccgggucg

SEQ ID NO: 885634 - RNA, 19 nt, Mycobacterium avium subsp. paratuberculosis
gcggguggaucuugacggc

SEQ ID NO: 885635 - RNA, 20 nt, Mycobacterium avium subsp. paratuberculosis
gcggguggaucuugacggcg

SEQ ID NO: 885636 - RNA, 15 nt, Mycobacterium avium subsp. paratuberculosis
gcgggugcugggcgg

SEQ ID NO: 885637 - RNA, 20 nt, Mycobacterium avium subsp. paratuberculosis
gcgggugaagaucacguuca

SEQ ID NO: 885638 - RNA, 19 nt, Mycobacterium avium subsp. paratuberculosis
gcgggugcgcucgacggcc

SEQ ID NO: 885639 - RNA, 17 nt, Mycobacterium avium subsp. paratuberculosis
gcgggugcggcacggca

SEQ ID NO: 885640 - RNA, 14 nt, Mycobacterium avium subsp. paratuberculosis
gcgggugcggccag

SEQ ID NO: 885641 - RNA, 16 nt, Mycobacterium avium subsp. paratuberculosis
gcgggugcggccagcg

SEQ ID NO: 885642 - RNA, 17 nt, Mycobacterium avium subsp. paratuberculosis
gcgggugcggccagcgc

SEQ ID NO: 885643 - RNA, 13 nt, Mycobacterium avium subsp. paratuberculosis
gcgggugcggccc

SEQ ID NO: 885644 - RNA, 14 nt, Mycobacterium avium subsp. paratuberculosis
gcgggugcggccca

SEQ ID NO: 885645 - RNA, 17 nt, Mycobacterium avium subsp. paratuberculosis
gcgggugcgggcguccu

SEQ ID NO: 885646 - RNA, 21 nt, Mycobacterium avium subsp. paratuberculosis
gcgggugaccggcgccggguc

SEQ ID NO: 885647 - RNA, 22 nt, Mycobacterium avium subsp. paratuberculosis
gcgggugaccggcgccgggucg

SEQ ID NO: 885648 - RNA, 14 nt, Mycobacterium avium subsp. paratuberculosis
gcgggugacgauca

SEQ ID NO: 885649 - RNA, 21 nt, Mycobacterium avium subsp. paratuberculosis
gcgggugacgaucaccgcugc

SEQ ID NO: 885650 - RNA, 21 nt, Mycobacterium avium subsp. paratuberculosis
gcgggucuggcucggcaccag

SEQ ID NO: 885651 - RNA, 12 nt, Mycobacterium avium subsp. paratuberculosis
gcgggucgucga

SEQ ID NO: 885652 - RNA, 12 nt, Mycobacterium avium subsp. paratuberculosis
gcgggucucgcc

SEQ ID NO: 885653 - RNA, 14 nt, Mycobacterium avium subsp. paratuberculosis
gcgggucucgccca

SEQ ID NO: 885654 - RNA, 16 nt, Mycobacterium avium subsp. paratuberculosis
gcgggucucgcccacc

SEQ ID NO: 885655 - RNA, 14 nt, Mycobacterium avium subsp. paratuberculosis
gcgggucggcgccg

SEQ ID NO: 885656 - RNA, 18 nt, Mycobacterium avium subsp. paratuberculosis
gcgggucggcgccggcca

SEQ ID NO: 885657 - RNA, 20 nt, Mycobacterium avium subsp. paratuberculosis
gcgggucggcgccggccagc

SEQ ID NO: 885658 - RNA, 17 nt, Mycobacterium avium subsp. paratuberculosis
gcgggucggcgucaccc

SEQ ID NO: 885659 - RNA, 12 nt, Mycobacterium avium subsp. paratuberculosis
gcgggucggugg

SEQ ID NO: 885660 - RNA, 17 nt, Mycobacterium avium subsp. paratuberculosis
gcgggucggugggcagc

SEQ ID NO: 885661 - RNA, 14 nt, Mycobacterium avium subsp. paratuberculosis
gcgggucgguggug

SEQ ID NO: 885662 - RNA, 20 nt, Mycobacterium avium subsp. paratuberculosis
gcgggucgguggugaucgcg

SEQ ID NO: 885663 - RNA, 21 nt, Mycobacterium avium subsp. paratuberculosis
gcgggucgguggugaucgcgg

SEQ ID NO: 885664 - RNA, 21 nt, Mycobacterium avium subsp. paratuberculosis
gcgggugccuucuuggcggcg

SEQ ID NO: 885665 - RNA, 14 nt, Mycobacterium avium subsp. paratuberculosis
gcgggugcgacggc

SEQ ID NO: 885666 - RNA, 16 nt, Mycobacterium avium subsp. paratuberculosis
gcgggugcgacggcaa

SEQ ID NO: 885667 - RNA, 14 nt, Mycobacterium avium subsp. paratuberculosis
gcgggugccgaaca

SEQ ID NO: 885668 - RNA, 20 nt, Mycobacterium avium subsp. paratuberculosis
gcgggugccgaacacguaca

SEQ ID NO: 885669 - RNA, 11 nt, Mycobacterium avium subsp. paratuberculosis
gcgggugaugc

SEQ ID NO: 885670 - RNA, 17 nt, Mycobacterium avium subsp. paratuberculosis
gcgggugcagccggauc

SEQ ID NO: 885671 - RNA, 20 nt, Mycobacterium avium subsp. paratuberculosis
gcgggugcagccggaucucg

SEQ ID NO: 885672 - RNA, 23 nt, Mycobacterium avium subsp. paratuberculosis
gcgggugaucuuggccuccaccg

SEQ ID NO: 885673 - RNA, 24 nt, Mycobacterium avium subsp. paratuberculosis
gcgggugaucuuggccuccaccgg

SEQ ID NO: 885674 - RNA, 24 nt, Mycobacterium avium subsp. paratuberculosis
gcgggugagaaagucgaucuggcg

SEQ ID NO: 885675 - RNA, 14 nt, Mycobacterium avium subsp. paratuberculosis
gcgggugagccggu

SEQ ID NO: 885676 - RNA, 17 nt, Mycobacterium avium subsp. paratuberculosis
gcgggugagccggucga

SEQ ID NO: 885677 - RNA, 13 nt, Mycobacterium avium subsp. paratuberculosis
gcgggugaggacg

SEQ ID NO: 885678 - RNA, 18 nt, Mycobacterium avium subsp. paratuberculosis
gcgggugaggacgcccgg

SEQ ID NO: 885679 - RNA, 19 nt, Mycobacterium avium subsp. paratuberculosis
gcgggugaggacgcccggc

SEQ ID NO: 885680 - RNA, 20 nt, Mycobacterium avium subsp. paratuberculosis
gcgggugaggacgcccggcg

SEQ ID NO: 885681 - RNA, 20 nt, Mycobacterium avium subsp. paratuberculosis
gcgggugaggggcgcgcgcc

SEQ ID NO: 885682 - RNA, 17 nt, Mycobacterium avium subsp. paratuberculosis
gcgggugauccagcccu

SEQ ID NO: 885683 - RNA, 13 nt, Mycobacterium avium subsp. paratuberculosis
gcgggucgcgcug

SEQ ID NO: 885684 - RNA, 13 nt, Mycobacterium avium subsp. paratuberculosis
gcgggucgcggcc

SEQ ID NO: 885685 - RNA, 19 nt, Mycobacterium avium subsp. paratuberculosis
gcgggucgcggcccaccgc

SEQ ID NO: 885686 - RNA, 20 nt, Mycobacterium avium subsp. paratuberculosis
gcgggucgcuggccgcgacg

SEQ ID NO: 885687 - RNA, 13 nt, Mycobacterium avium subsp. paratuberculosis
gcgggucggccgg

SEQ ID NO: 885688 - RNA, 14 nt, Mycobacterium avium subsp. paratuberculosis
gcgggucggccggc

SEQ ID NO: 885689 - RNA, 20 nt, Mycobacterium avium subsp. paratuberculosis
gcgggucggccggcggggcg

SEQ ID NO: 885690 - RNA, 14 nt, Mycobacterium avium subsp. paratuberculosis
gcgggucggcgacg

SEQ ID NO: 885691 - RNA, 16 nt, Mycobacterium avium subsp. paratuberculosis
gcgggucggcgacggc

SEQ ID NO: 885692 - RNA, 14 nt, Mycobacterium avium subsp. paratuberculosis
gcgggucgucgacg

SEQ ID NO: 885693 - RNA, 17 nt, Mycobacterium avium subsp. paratuberculosis
gcgggucgucgacgucg

SEQ ID NO: 885694 - RNA, 14 nt, Mycobacterium avium subsp. paratuberculosis
gcgggucgucggcc

SEQ ID NO: 885695 - RNA, 15 nt, Mycobacterium avium subsp. paratuberculosis
gcgggucgucggccu

SEQ ID NO: 885696 - RNA, 13 nt, Mycobacterium avium subsp. paratuberculosis
gcgggucgucggg

SEQ ID NO: 885697 - RNA, 15 nt, Mycobacterium avium subsp. paratuberculosis
gcgggucgucgggcc

SEQ ID NO: 885698 - RNA, 23 nt, Mycobacterium avium subsp. paratuberculosis
gcgggucgucguucucgggggcg

SEQ ID NO: 885699 - RNA, 22 nt, Mycobacterium avium subsp. paratuberculosis
gcgggucgugcaucggcgccug

SEQ ID NO: 885700 - RNA, 17 nt, Mycobacterium avium subsp. paratuberculosis
gcgggucguuggcggcg

SEQ ID NO: 885701 - RNA, 21 nt, Mycobacterium avium subsp. paratuberculosis
gcgggucguuuggugguggcg

SEQ ID NO: 885702 - RNA, 14 nt, Mycobacterium avium subsp. paratuberculosis
gcgggucucgaacc

SEQ ID NO: 885703 - RNA, 17 nt, Mycobacterium avium subsp. paratuberculosis
gcgggucucgaaccggg

SEQ ID NO: 885704 - RNA, 19 nt, Mycobacterium avium subsp. paratuberculosis
gcgggucucgaaccgggcg

SEQ ID NO: 885705 - RNA, 20 nt, Mycobacterium avium subsp. paratuberculosis
gcgggucucgaaccgggcgg

SEQ ID NO: 885706 - RNA, 16 nt, Mycobacterium avium subsp. paratuberculosis
gcggguccugcaaccg

SEQ ID NO: 885707 - RNA, 14 nt, Mycobacterium avium subsp. paratuberculosis
gcggguccgccccg

SEQ ID NO: 885708 - RNA, 15 nt, Mycobacterium avium subsp. paratuberculosis
gcggguccagccgcc

SEQ ID NO: 885709 - RNA, 17 nt, Mycobacterium avium subsp. paratuberculosis
gcggguccagccgccgg

SEQ ID NO: 885710 - RNA, 20 nt, Mycobacterium avium subsp. paratuberculosis
gcggguccagccgccggcgg

SEQ ID NO: 885711 - RNA, 14 nt, Mycobacterium avium subsp. paratuberculosis
gcggguccaucgcc

SEQ ID NO: 885712 - RNA, 17 nt, Mycobacterium avium subsp. paratuberculosis
gcggguccaucgccucg

SEQ ID NO: 885713 - RNA, 13 nt, Mycobacterium avium subsp. paratuberculosis
gcgggucagcacc

SEQ ID NO: 885714 - RNA, 19 nt, Mycobacterium avium subsp. paratuberculosis
gcgggucagcacccgcagc

SEQ ID NO: 885715 - RNA, 17 nt, Mycobacterium avium subsp. paratuberculosis
gcgggucagcgugcuca

SEQ ID NO: 885716 - RNA, 19 nt, Mycobacterium avium subsp. paratuberculosis
gcgggucagcuccaccugc

SEQ ID NO: 885717 - RNA, 20 nt, Mycobacterium avium subsp. paratuberculosis
gcgggucagcuccaccugcg

SEQ ID NO: 885718 - RNA, 23 nt, Mycobacterium avium subsp. paratuberculosis
gcgggucagcuccaccugcggca

SEQ ID NO: 885719 - RNA, 22 nt, Mycobacterium avium subsp. paratuberculosis
gcgggucagcagcgucugcgcc

SEQ ID NO: 885720 - RNA, 12 nt, Mycobacterium avium subsp. paratuberculosis
gcggggugccca

SEQ ID NO: 885721 - RNA, 15 nt, Mycobacterium avium subsp. paratuberculosis
gcggggugacgcccg

SEQ ID NO: 885722 - RNA, 17 nt, Mycobacterium avium subsp. paratuberculosis
gcggggugacgcccguc

SEQ ID NO: 885723 - RNA, 21 nt, Mycobacterium avium subsp. paratuberculosis
gcggggugagcaccgcgacca

SEQ ID NO: 885724 - RNA, 23 nt, Mycobacterium avium subsp. paratuberculosis
gcggggguucguugcgccgccag

SEQ ID NO: 885725 - RNA, 14 nt, Mycobacterium avium subsp. paratuberculosis
gcggggucgggccg

SEQ ID NO: 885726 - RNA, 16 nt, Mycobacterium avium subsp. paratuberculosis
gcggggucgggccgga

SEQ ID NO: 885727 - RNA, 19 nt, Mycobacterium avium subsp. paratuberculosis
gcggggggagaggcgcggc

SEQ ID NO: 885728 - RNA, 22 nt, Mycobacterium avium subsp. paratuberculosis
gcggggggagggucgguggccc

SEQ ID NO: 885729 - RNA, 23 nt, Mycobacterium avium subsp. paratuberculosis
gcggggggagggucgguggccca

SEQ ID NO: 885730 - RNA, 16 nt, Mycobacterium avium subsp. paratuberculosis
gcggggggcgagccgg

SEQ ID NO: 885731 - RNA, 21 nt, Mycobacterium avium subsp. paratuberculosis
gcggggucccaauccucgccg

SEQ ID NO: 885732 - RNA, 12 nt, Mycobacterium avium subsp. paratuberculosis
gcggggucggcc

SEQ ID NO: 885733 - RNA, 13 nt, Mycobacterium avium subsp. paratuberculosis
gcggggucggcca

SEQ ID NO: 885734 - RNA, 14 nt, Mycobacterium avium subsp. paratuberculosis
gcggggucggccag

SEQ ID NO: 885735 - RNA, 21 nt, Mycobacterium avium subsp. paratuberculosis
gcggggcagcagugucgggcc

SEQ ID NO: 885736 - RNA, 17 nt, Mycobacterium avium subsp. paratuberculosis
gcggggcguugcccguc

SEQ ID NO: 885737 - RNA, 21 nt, Mycobacterium avium subsp. paratuberculosis
gcgggggauccgccugcgcgg

SEQ ID NO: 885738 - RNA, 15 nt, Mycobacterium avium subsp. paratuberculosis
gcgggggccgccgcg

SEQ ID NO: 885739 - RNA, 13 nt, Mycobacterium avium subsp. paratuberculosis
gcgggggccgcga

SEQ ID NO: 885740 - RNA, 16 nt, Mycobacterium avium subsp. paratuberculosis
gcgggggcgagaccgu

SEQ ID NO: 885741 - RNA, 11 nt, Mycobacterium avium subsp. paratuberculosis
gcgggggcgcg

SEQ ID NO: 885742 - RNA, 13 nt, Mycobacterium avium subsp. paratuberculosis
gcgggggcggccg

SEQ ID NO: 885743 - RNA, 14 nt, Mycobacterium avium subsp. paratuberculosis
gcgggggcggccgg

SEQ ID NO: 885744 - RNA, 21 nt, Mycobacterium avium subsp. paratuberculosis
gcggggcgccgacagucgcgg

SEQ ID NO: 885745 - RNA, 15 nt, Mycobacterium avium subsp. paratuberculosis
gcggggccggcggcg

SEQ ID NO: 885746 - RNA, 16 nt, Mycobacterium avium subsp. paratuberculosis
gcggggcgcguucggg

SEQ ID NO: 885747 - RNA, 16 nt, Mycobacterium avium subsp. paratuberculosis
gcggggcguccagcga

SEQ ID NO: 885748 - RNA, 16 nt, Mycobacterium avium subsp. paratuberculosis
gcggggcgucgaugcg

SEQ ID NO: 885749 - RNA, 18 nt, Mycobacterium avium subsp. paratuberculosis
gcggggcggaugcgcugg

SEQ ID NO: 885750 - RNA, 20 nt, Mycobacterium avium subsp. paratuberculosis
gcggggcggccgccgggccg

SEQ ID NO: 885751 - RNA, 21 nt, Mycobacterium avium subsp. paratuberculosis
gcggggcggccgccgggccgg

SEQ ID NO: 885752 - RNA, 17 nt, Mycobacterium avium subsp. paratuberculosis
gcggggcggcggcgccg

SEQ ID NO: 885753 - RNA, 14 nt, Mycobacterium avium subsp. paratuberculosis
gcggggcggcggga

SEQ ID NO: 885754 - RNA, 21 nt, Mycobacterium avium subsp. paratuberculosis
gcggggugguagacagcgugg

SEQ ID NO: 885755 - RNA, 16 nt, Mycobacterium avium subsp. paratuberculosis
gcggggugucgaccca

SEQ ID NO: 885756 - RNA, 19 nt, Mycobacterium avium subsp. paratuberculosis
gcggggugucgacccaggu

SEQ ID NO: 885757 - RNA, 17 nt, Mycobacterium avium subsp. paratuberculosis
gcggggugugcggcacg

SEQ ID NO: 885758 - RNA, 21 nt, Mycobacterium avium subsp. paratuberculosis
gcgggguguggcugucgggga

SEQ ID NO: 885759 - RNA, 21 nt, Mycobacterium avium subsp. paratuberculosis
gcgggguguucaccgcgccgg

SEQ ID NO: 885760 - RNA, 23 nt, Mycobacterium avium subsp. paratuberculosis
gcgggguguucaccgcgccgggc

SEQ ID NO: 885761 - RNA, 23 nt, Mycobacterium avium subsp. paratuberculosis
gcggguaaccgcagccgggugcg

SEQ ID NO: 885762 - RNA, 20 nt, Mycobacterium avium subsp. paratuberculosis
gcggguagaaccagcccggc

SEQ ID NO: 885763 - RNA, 15 nt, Mycobacterium avium subsp. paratuberculosis
gcggguacagccgca

SEQ ID NO: 885764 - RNA, 16 nt, Mycobacterium avium subsp. paratuberculosis
gcggguacggcggccg

SEQ ID NO: 885765 - RNA, 20 nt, Mycobacterium avium subsp. paratuberculosis
gcggguacggcggccgcgga

SEQ ID NO: 885766 - RNA, 21 nt, Mycobacterium avium subsp. paratuberculosis
gcggguacggucggccguaca

SEQ ID NO: 885767 - RNA, 14 nt, Mycobacterium avium subsp. paratuberculosis
gcggguaugucggc

SEQ ID NO: 885768 - RNA, 17 nt, Mycobacterium avium subsp. paratuberculosis
gcggguaugucggcgac

SEQ ID NO: 885769 - RNA, 21 nt, Mycobacterium avium subsp. paratuberculosis
gcggguaugucggcgacccgc

SEQ ID NO: 885770 - RNA, 20 nt, Mycobacterium avium subsp. paratuberculosis
gcggguauccgugaccccgg

SEQ ID NO: 885771 - RNA, 20 nt, Mycobacterium avium subsp. paratuberculosis
gcgggucacacccucggccc

SEQ ID NO: 885772 - RNA, 22 nt, Mycobacterium avium subsp. paratuberculosis
gcggguagaaccagcccggccc

SEQ ID NO: 885773 - RNA, 21 nt, Mycobacterium avium subsp. paratuberculosis
gcggguagacguucuccccgc

SEQ ID NO: 885774 - RNA, 18 nt, Mycobacterium avium subsp. paratuberculosis
gcggguagcccgucgacg

SEQ ID NO: 885775 - RNA, 22 nt, Mycobacterium avium subsp. paratuberculosis
gcggguagcccgucgacgggcc

SEQ ID NO: 885776 - RNA, 14 nt, Mycobacterium avium subsp. paratuberculosis
gcggguaggcgccg

SEQ ID NO: 885777 - RNA, 15 nt, Mycobacterium avium subsp. paratuberculosis
gcggguaggcgccga

SEQ ID NO: 885778 - RNA, 15 nt, Mycobacterium avium subsp. paratuberculosis
gcggguaggcgucgc

SEQ ID NO: 885779 - RNA, 16 nt, Mycobacterium avium subsp. paratuberculosis
gcggguaggcgucgcg

SEQ ID NO: 885780 - RNA, 17 nt, Mycobacterium avium subsp. paratuberculosis
gcggguaggcgucgcgc

SEQ ID NO: 885781 - RNA, 18 nt, Mycobacterium avium subsp. paratuberculosis
gcggguaggcgucgcgca

SEQ ID NO: 885782 - RNA, 20 nt, Mycobacterium avium subsp. paratuberculosis
gcggguaguucuucgucagg

SEQ ID NO: 885783 - RNA, 18 nt, Mycobacterium avium subsp. paratuberculosis
gcggggaggcccagcccg

SEQ ID NO: 885784 - RNA, 19 nt, Mycobacterium avium subsp. paratuberculosis
gcggggaggcccagcccgc

SEQ ID NO: 885785 - RNA, 16 nt, Mycobacterium avium subsp. paratuberculosis
gcgggcugacgucgaa

SEQ ID NO: 885786 - RNA, 15 nt, Mycobacterium avium subsp. paratuberculosis
gcggggacagugcgg

SEQ ID NO: 885787 - RNA, 21 nt, Mycobacterium avium subsp. paratuberculosis
gcggggacagugcgggcucga

SEQ ID NO: 885788 - RNA, 13 nt, Mycobacterium avium subsp. paratuberculosis
gcgggcucgaaca

SEQ ID NO: 885789 - RNA, 13 nt, Mycobacterium avium subsp. paratuberculosis
gcgggcucgagcc

SEQ ID NO: 885790 - RNA, 17 nt, Mycobacterium avium subsp. paratuberculosis
gcgggcucgagccccag

SEQ ID NO: 885791 - RNA, 18 nt, Mycobacterium avium subsp. paratuberculosis
gcgggcucgccggcccga

SEQ ID NO: 885792 - RNA, 15 nt, Mycobacterium avium subsp. paratuberculosis
gcgggcucgcgcugg

SEQ ID NO: 885793 - RNA, 16 nt, Mycobacterium avium subsp. paratuberculosis
gcgggcucggacgacu

SEQ ID NO: 885794 - RNA, 16 nt, Mycobacterium avium subsp. paratuberculosis
gcgggcucggaguugc

SEQ ID NO: 885795 - RNA, 22 nt, Mycobacterium avium subsp. paratuberculosis
gcgggcuaaugcaucgaugccg

SEQ ID NO: 885796 - RNA, 15 nt, Mycobacterium avium subsp. paratuberculosis
gcgggcuaggcucgg

SEQ ID NO: 885797 - RNA, 17 nt, Mycobacterium avium subsp. paratuberculosis
gcgggcucccgcucgcc

SEQ ID NO: 885798 - RNA, 19 nt, Mycobacterium avium subsp. paratuberculosis
gcggggcgagcuggccgcc

SEQ ID NO: 885799 - RNA, 15 nt, Mycobacterium avium subsp. paratuberculosis
gcggggccuccacca

SEQ ID NO: 885800 - RNA, 17 nt, Mycobacterium avium subsp. paratuberculosis
gcggggccuccaccagc

SEQ ID NO: 885801 - RNA, 20 nt, Mycobacterium avium subsp. paratuberculosis
gcggggccucgucgccgcgg

SEQ ID NO: 885802 - RNA, 16 nt, Mycobacterium avium subsp. paratuberculosis
gcggggccugcgggac

SEQ ID NO: 885803 - RNA, 17 nt, Mycobacterium avium subsp. paratuberculosis
gcggggcgaacccggcg

SEQ ID NO: 885804 - RNA, 23 nt, Mycobacterium avium subsp. paratuberculosis
gcggggcgaacccggcgcccggc

SEQ ID NO: 885805 - RNA, 17 nt, Mycobacterium avium subsp. paratuberculosis
gcggggccgcggccggc

SEQ ID NO: 885806 - RNA, 18 nt, Mycobacterium avium subsp. paratuberculosis
gcggggccgcggccggca

SEQ ID NO: 885807 - RNA, 12 nt, Mycobacterium avium subsp. paratuberculosis
gcggggccggcg

SEQ ID NO: 885808 - RNA, 15 nt, Mycobacterium avium subsp. paratuberculosis
gcggggccggcgcgg

SEQ ID NO: 885809 - RNA, 13 nt, Mycobacterium avium subsp. paratuberculosis
gcggggccggcgg

SEQ ID NO: 885810 - RNA, 15 nt, Mycobacterium avium subsp. paratuberculosis
gcggggcccgggccg

SEQ ID NO: 885811 - RNA, 16 nt, Mycobacterium avium subsp. paratuberculosis
gcggggcccgggccgg

SEQ ID NO: 885812 - RNA, 19 nt, Mycobacterium avium subsp. paratuberculosis
gcggggcccgggccggagg

SEQ ID NO: 885813 - RNA, 15 nt, Mycobacterium avium subsp. paratuberculosis
gcggggccaccaggc

SEQ ID NO: 885814 - RNA, 17 nt, Mycobacterium avium subsp. paratuberculosis
gcgggccaccggcgcca

SEQ ID NO: 885815 - RNA, 18 nt, Mycobacterium avium subsp. paratuberculosis
gcgggccaccggcgccag

SEQ ID NO: 885816 - RNA, 20 nt, Mycobacterium avium subsp. paratuberculosis
gcgggccaccggcgccaggu

SEQ ID NO: 885817 - RNA, 23 nt, Mycobacterium avium subsp. paratuberculosis
gcgggcacuuaacaccucgccuc

SEQ ID NO: 885818 - RNA, 20 nt, Mycobacterium avium subsp. paratuberculosis
gcgggcacuucguccaucgu

SEQ ID NO: 885819 - RNA, 22 nt, Mycobacterium avium subsp. paratuberculosis
gcgggccagacugcgcaccgcc

SEQ ID NO: 885820 - RNA, 13 nt, Mycobacterium avium subsp. paratuberculosis
gcgggccagaugg

SEQ ID NO: 885821 - RNA, 18 nt, Mycobacterium avium subsp. paratuberculosis
gcgggccaccgucccggu

SEQ ID NO: 885822 - RNA, 13 nt, Mycobacterium avium subsp. paratuberculosis
gcgggccacgcag

SEQ ID NO: 885823 - RNA, 13 nt, Mycobacterium avium subsp. paratuberculosis
gcgggccagcagc

SEQ ID NO: 885824 - RNA, 16 nt, Mycobacterium avium subsp. paratuberculosis
gcgggccagcagcagc

SEQ ID NO: 885825 - RNA, 14 nt, Mycobacterium avium subsp. paratuberculosis
gcgggccagcagcc

SEQ ID NO: 885826 - RNA, 18 nt, Mycobacterium avium subsp. paratuberculosis
gcgggccagcagccgcgc

SEQ ID NO: 885827 - RNA, 19 nt, Mycobacterium avium subsp. paratuberculosis
gcgggccagcagccggguc

SEQ ID NO: 885828 - RNA, 22 nt, Mycobacterium avium subsp. paratuberculosis
gcgggccagcaguucguccacg

SEQ ID NO: 885829 - RNA, 18 nt, Mycobacterium avium subsp. paratuberculosis
gcgggccagcacgacccc

SEQ ID NO: 885830 - RNA, 20 nt, Mycobacterium avium subsp. paratuberculosis
gcgggccagcacgaccccgc

SEQ ID NO: 885831 - RNA, 15 nt, Mycobacterium avium subsp. paratuberculosis
gcgggccagccaggu

SEQ ID NO: 885832 - RNA, 22 nt, Mycobacterium avium subsp. paratuberculosis
gcgggccagcgcaucggucacc

SEQ ID NO: 885833 - RNA, 14 nt, Mycobacterium avium subsp. paratuberculosis
gcgggccagcgccu

SEQ ID NO: 885834 - RNA, 20 nt, Mycobacterium avium subsp. paratuberculosis
gcgggccagcgccuucggcg

SEQ ID NO: 885835 - RNA, 22 nt, Mycobacterium avium subsp. paratuberculosis
gcgggccagcgccuucggcgcc

SEQ ID NO: 885836 - RNA, 12 nt, Mycobacterium avium subsp. paratuberculosis
gcgggccagcuc

SEQ ID NO: 885837 - RNA, 23 nt, Mycobacterium avium subsp. paratuberculosis
gcgggccagcucgaacaccgucg

SEQ ID NO: 885838 - RNA, 24 nt, Mycobacterium avium subsp. paratuberculosis
gcgggccagcucgaacaccgucga

SEQ ID NO: 885839 - RNA, 17 nt, Mycobacterium avium subsp. paratuberculosis
gcgggccagcucgaacc

SEQ ID NO: 885840 - RNA, 20 nt, Mycobacterium avium subsp. paratuberculosis
gcgggccagcucgaaccugg

SEQ ID NO: 885841 - RNA, 15 nt, Mycobacterium avium subsp. paratuberculosis
gcgggccagcuuguu

SEQ ID NO: 885842 - RNA, 19 nt, Mycobacterium avium subsp. paratuberculosis
gcgggccaggcacggcccg

SEQ ID NO: 885843 - RNA, 19 nt, Mycobacterium avium subsp. paratuberculosis
gcgggccaucgacuccagc

SEQ ID NO: 885844 - RNA, 20 nt, Mycobacterium avium subsp. paratuberculosis
gcgggcgugccgaacggcgc

SEQ ID NO: 885845 - RNA, 13 nt, Mycobacterium avium subsp. paratuberculosis
gcgggcgugcggu

SEQ ID NO: 885846 - RNA, 16 nt, Mycobacterium avium subsp. paratuberculosis
gcgggcguucaucacc

SEQ ID NO: 885847 - RNA, 18 nt, Mycobacterium avium subsp. paratuberculosis
gcgggcguucaucaccug

SEQ ID NO: 885848 - RNA, 23 nt, Mycobacterium avium subsp. paratuberculosis
gcgggcguucaucaccuggucgg

SEQ ID NO: 885849 - RNA, 14 nt, Mycobacterium avium subsp. paratuberculosis
gcgggcguggcggu

SEQ ID NO: 885850 - RNA, 19 nt, Mycobacterium avium subsp. paratuberculosis
gcgggcguggcggucggug

SEQ ID NO: 885851 - RNA, 17 nt, Mycobacterium avium subsp. paratuberculosis
gcgggccagggcgagga

SEQ ID NO: 885852 - RNA, 14 nt, Mycobacterium avium subsp. paratuberculosis
gcgggcccaccgcc

SEQ ID NO: 885853 - RNA, 18 nt, Mycobacterium avium subsp. paratuberculosis
gcgggcccaccgccacca

SEQ ID NO: 885854 - RNA, 19 nt, Mycobacterium avium subsp. paratuberculosis
gcgggcccaccgccaccag

SEQ ID NO: 885855 - RNA, 15 nt, Mycobacterium avium subsp. paratuberculosis
gcgggcguccugcgg

SEQ ID NO: 885856 - RNA, 16 nt, Mycobacterium avium subsp. paratuberculosis
gcgggcguccugcggg

SEQ ID NO: 885857 - RNA, 17 nt, Mycobacterium avium subsp. paratuberculosis
gcgggcguccugcgggg

SEQ ID NO: 885858 - RNA, 21 nt, Mycobacterium avium subsp. paratuberculosis
gcggugugcuggccagcacca

SEQ ID NO: 885859 - RNA, 21 nt, Mycobacterium avium subsp. paratuberculosis
gcggugugggcgauggcggcg

SEQ ID NO: 885860 - RNA, 22 nt, Mycobacterium avium subsp. paratuberculosis
gcggugugggcgauggcggcgu

SEQ ID NO: 885861 - RNA, 22 nt, Mycobacterium avium subsp. paratuberculosis
gcgguguucgagggcgcggcgu

SEQ ID NO: 885862 - RNA, 17 nt, Mycobacterium avium subsp. paratuberculosis
gcgguguucgauaucgc

SEQ ID NO: 885863 - RNA, 21 nt, Mycobacterium avium subsp. paratuberculosis
gcgguguugagcgcguugcgg

SEQ ID NO: 885864 - RNA, 16 nt, Mycobacterium avium subsp. paratuberculosis
gcgguguuuggccgcg

SEQ ID NO: 885865 - RNA, 17 nt, Mycobacterium avium subsp. paratuberculosis
gcgguguuuggccgcgc

SEQ ID NO: 885866 - RNA, 20 nt, Mycobacterium avium subsp. paratuberculosis
gcgguguuuggccgcgcagc

SEQ ID NO: 885867 - RNA, 15 nt, Mycobacterium avium subsp. paratuberculosis
gcggugugcccggcg

SEQ ID NO: 885868 - RNA, 19 nt, Mycobacterium avium subsp. paratuberculosis
gcgguggucagcaccggcg

SEQ ID NO: 885869 - RNA, 21 nt, Mycobacterium avium subsp. paratuberculosis
gcggugugcggcagcucggcg

SEQ ID NO: 885870 - RNA, 16 nt, Mycobacterium avium subsp. paratuberculosis
gcggugugcggcggcu

SEQ ID NO: 885871 - RNA, 14 nt, Mycobacterium avium subsp. paratuberculosis
gcgguggguccgcc

SEQ ID NO: 885872 - RNA, 16 nt, Mycobacterium avium subsp. paratuberculosis
gcgguggguccgccgg

SEQ ID NO: 885873 - RNA, 18 nt, Mycobacterium avium subsp. paratuberculosis
gcgguggguccgccgggc

SEQ ID NO: 885874 - RNA, 15 nt, Mycobacterium avium subsp. paratuberculosis
gcggugguccgcgcg

SEQ ID NO: 885875 - RNA, 19 nt, Mycobacterium avium subsp. paratuberculosis
gcggugguccgcgcgacca

SEQ ID NO: 885876 - RNA, 13 nt, Mycobacterium avium subsp. paratuberculosis
gcggugucggcgu

SEQ ID NO: 885877 - RNA, 16 nt, Mycobacterium avium subsp. paratuberculosis
gcggugucggcgucga

SEQ ID NO: 885878 - RNA, 21 nt, Mycobacterium avium subsp. paratuberculosis
gcggugucggcgucgaucgcc

SEQ ID NO: 885879 - RNA, 13 nt, Mycobacterium avium subsp. paratuberculosis
gcggugucggugc

SEQ ID NO: 885880 - RNA, 21 nt, Mycobacterium avium subsp. paratuberculosis
gcggugucggugccgagcacg

SEQ ID NO: 885881 - RNA, 22 nt, Mycobacterium avium subsp. paratuberculosis
gcggugucggugccgagcacgc

SEQ ID NO: 885882 - RNA, 20 nt, Mycobacterium avium subsp. paratuberculosis
gcggugucguaguugcgcgc

SEQ ID NO: 885883 - RNA, 21 nt, Mycobacterium avium subsp. paratuberculosis
gcggugucguaguugcgcgcc

SEQ ID NO: 885884 - RNA, 14 nt, Mycobacterium avium subsp. paratuberculosis
gcgguggggccgaa

SEQ ID NO: 885885 - RNA, 15 nt, Mycobacterium avium subsp. paratuberculosis
gcggugggcucggcg

SEQ ID NO: 885886 - RNA, 16 nt, Mycobacterium avium subsp. paratuberculosis
gcggugggcucggcgc

SEQ ID NO: 885887 - RNA, 17 nt, Mycobacterium avium subsp. paratuberculosis
gcggugggcucggcgcc

SEQ ID NO: 885888 - RNA, 18 nt, Mycobacterium avium subsp. paratuberculosis
gcggugggcucggcgccg

SEQ ID NO: 885889 - RNA, 19 nt, Mycobacterium avium subsp. paratuberculosis
gcggugggcucggcgccga

SEQ ID NO: 885890 - RNA, 21 nt, Mycobacterium avium subsp. paratuberculosis
gcggugggcgcugguccucgg

SEQ ID NO: 885891 - RNA, 13 nt, Mycobacterium avium subsp. paratuberculosis
gcggugggcggcg

SEQ ID NO: 885892 - RNA, 16 nt, Mycobacterium avium subsp. paratuberculosis
gcggugggcaccagca

SEQ ID NO: 885893 - RNA, 18 nt, Mycobacterium avium subsp. paratuberculosis
gcggugggcaccagcagc

SEQ ID NO: 885894 - RNA, 23 nt, Mycobacterium avium subsp. paratuberculosis
gcggugccggccagaucgacgcc

SEQ ID NO: 885895 - RNA, 12 nt, Mycobacterium avium subsp. paratuberculosis
gcggugccgcag

SEQ ID NO: 885896 - RNA, 20 nt, Mycobacterium avium subsp. paratuberculosis
gcggugccgcagcucgauca

SEQ ID NO: 885897 - RNA, 14 nt, Mycobacterium avium subsp. paratuberculosis
gcggugccgggcca

SEQ ID NO: 885898 - RNA, 15 nt, Mycobacterium avium subsp. paratuberculosis
gcggugccgggccag

SEQ ID NO: 885899 - RNA, 14 nt, Mycobacterium avium subsp. paratuberculosis
gcggugccgcggcg

SEQ ID NO: 885900 - RNA, 18 nt, Mycobacterium avium subsp. paratuberculosis
gcggugccgcggcggcgc

SEQ ID NO: 885901 - RNA, 14 nt, Mycobacterium avium subsp. paratuberculosis
gcggugccgcccgg

SEQ ID NO: 885902 - RNA, 15 nt, Mycobacterium avium subsp. paratuberculosis
gcggugccgcccgga

SEQ ID NO: 885903 - RNA, 18 nt, Mycobacterium avium subsp. paratuberculosis
gcggugccgaccugggcg

SEQ ID NO: 885904 - RNA, 17 nt, Mycobacterium avium subsp. paratuberculosis
gcggugcccagccaggc

SEQ ID NO: 885905 - RNA, 22 nt, Mycobacterium avium subsp. paratuberculosis
gcggugcccagccaggccgccg

SEQ ID NO: 885906 - RNA, 23 nt, Mycobacterium avium subsp. paratuberculosis
gcggugcccagccaggccgccgg

SEQ ID NO: 885907 - RNA, 15 nt, Mycobacterium avium subsp. paratuberculosis
gcggugcccggaacg

SEQ ID NO: 885908 - RNA, 14 nt, Mycobacterium avium subsp. paratuberculosis
gcggucuucgaaca

SEQ ID NO: 885909 - RNA, 18 nt, Mycobacterium avium subsp. paratuberculosis
gcggugaauugggcgagu

SEQ ID NO: 885910 - RNA, 17 nt, Mycobacterium avium subsp. paratuberculosis
gcggugacacccagggc

SEQ ID NO: 885911 - RNA, 16 nt, Mycobacterium avium subsp. paratuberculosis
gcggugacaucgccac

SEQ ID NO: 885912 - RNA, 18 nt, Mycobacterium avium subsp. paratuberculosis
gcggugacaucgccaccu

SEQ ID NO: 885913 - RNA, 19 nt, Mycobacterium avium subsp. paratuberculosis
gcggugacaucgccaccug

SEQ ID NO: 885914 - RNA, 20 nt, Mycobacterium avium subsp. paratuberculosis
gcggugacaucgccaccugg

SEQ ID NO: 885915 - RNA, 15 nt, Mycobacterium avium subsp. paratuberculosis
gcggugacaugcccg

SEQ ID NO: 885916 - RNA, 18 nt, Mycobacterium avium subsp. paratuberculosis
gcggugacaugcccgggc

SEQ ID NO: 885917 - RNA, 16 nt, Mycobacterium avium subsp. paratuberculosis
gcggucuucuuggccg

SEQ ID NO: 885918 - RNA, 17 nt, Mycobacterium avium subsp. paratuberculosis
gcggucuucuuggccgc

SEQ ID NO: 885919 - RNA, 19 nt, Mycobacterium avium subsp. paratuberculosis
gcggucuucuuggccgcgc

SEQ ID NO: 885920 - RNA, 22 nt, Mycobacterium avium subsp. paratuberculosis
gcggucuucuuggccgcgccgc

SEQ ID NO: 885921 - RNA, 16 nt, Mycobacterium avium subsp. paratuberculosis
gcggucuuggcggcca

SEQ ID NO: 885922 - RNA, 19 nt, Mycobacterium avium subsp. paratuberculosis
gcggucuuggcggccagcg

SEQ ID NO: 885923 - RNA, 20 nt, Mycobacterium avium subsp. paratuberculosis
gcggucuuggcggccagcgc

SEQ ID NO: 885924 - RNA, 21 nt, Mycobacterium avium subsp. paratuberculosis
gcggucuuggcggccagcgcc

SEQ ID NO: 885925 - RNA, 15 nt, Mycobacterium avium subsp. paratuberculosis
gcggucgcggaaccg

SEQ ID NO: 885926 - RNA, 15 nt, Mycobacterium avium subsp. paratuberculosis
gcggucgcggcgccg

SEQ ID NO: 885927 - RNA, 19 nt, Mycobacterium avium subsp. paratuberculosis
gcggucgcggcgccgguuu

SEQ ID NO: 885928 - RNA, 20 nt, Mycobacterium avium subsp. paratuberculosis
gcggucgcgggacaacacga

SEQ ID NO: 885929 - RNA, 16 nt, Mycobacterium avium subsp. paratuberculosis
gcggucgcgucgucgg

SEQ ID NO: 885930 - RNA, 17 nt, Mycobacterium avium subsp. paratuberculosis
gcggucgcgucgucggc

SEQ ID NO: 885931 - RNA, 18 nt, Mycobacterium avium subsp. paratuberculosis
gcggucgcgucgucggcg

SEQ ID NO: 885932 - RNA, 18 nt, Mycobacterium avium subsp. paratuberculosis
gcggucgcugaccccgcu

SEQ ID NO: 885933 - RNA, 14 nt, Mycobacterium avium subsp. paratuberculosis
gcggucgcugcagc

SEQ ID NO: 885934 - RNA, 23 nt, Mycobacterium avium subsp. paratuberculosis
gcggucgcugcagcggcggccag

SEQ ID NO: 885935 - RNA, 14 nt, Mycobacterium avium subsp. paratuberculosis
gcggucggacgcgg

SEQ ID NO: 885936 - RNA, 15 nt, Mycobacterium avium subsp. paratuberculosis
gcggucggacgcggg

SEQ ID NO: 885937 - RNA, 15 nt, Mycobacterium avium subsp. paratuberculosis
gcggucggcaacccg

SEQ ID NO: 885938 - RNA, 18 nt, Mycobacterium avium subsp. paratuberculosis
gcggucggcaacccgacc

SEQ ID NO: 885939 - RNA, 20 nt, Mycobacterium avium subsp. paratuberculosis
gcggucggcaacccgaccuc

SEQ ID NO: 885940 - RNA, 23 nt, Mycobacterium avium subsp. paratuberculosis
gcggucggcaacccgaccucguc

SEQ ID NO: 885941 - RNA, 17 nt, Mycobacterium avium subsp. paratuberculosis
gcggucggcauagcgcc

SEQ ID NO: 885942 - RNA, 13 nt, Mycobacterium avium subsp. paratuberculosis
gcggugaacgcgg

SEQ ID NO: 885943 - RNA, 15 nt, Mycobacterium avium subsp. paratuberculosis
gcggugaccacgccg

SEQ ID NO: 885944 - RNA, 17 nt, Mycobacterium avium subsp. paratuberculosis
gcggugaccacgccgug

SEQ ID NO: 885945 - RNA, 20 nt, Mycobacterium avium subsp. paratuberculosis
gcggugaccacgccgugccc

SEQ ID NO: 885946 - RNA, 23 nt, Mycobacterium avium subsp. paratuberculosis
gcggugaccacgccgugcccggc

SEQ ID NO: 885947 - RNA, 14 nt, Mycobacterium avium subsp. paratuberculosis
gcggugaaguugcc

SEQ ID NO: 885948 - RNA, 19 nt, Mycobacterium avium subsp. paratuberculosis
gcggugaaguugccgccgc

SEQ ID NO: 885949 - RNA, 22 nt, Mycobacterium avium subsp. paratuberculosis
gcggugaccucgagcaccggcg

SEQ ID NO: 885950 - RNA, 23 nt, Mycobacterium avium subsp. paratuberculosis
gcggugaccucgagcaccggcgg

SEQ ID NO: 885951 - RNA, 18 nt, Mycobacterium avium subsp. paratuberculosis
gcggugaccuugcgggcg

SEQ ID NO: 885952 - RNA, 14 nt, Mycobacterium avium subsp. paratuberculosis
gcggugaccgcccg

SEQ ID NO: 885953 - RNA, 15 nt, Mycobacterium avium subsp. paratuberculosis
gcggugaccgcccgc

SEQ ID NO: 885954 - RNA, 21 nt, Mycobacterium avium subsp. paratuberculosis
gcggugaccgcccgcucgacg

SEQ ID NO: 885955 - RNA, 22 nt, Mycobacterium avium subsp. paratuberculosis
gcggugaccgcccgcucgacgg

SEQ ID NO: 885956 - RNA, 13 nt, Mycobacterium avium subsp. paratuberculosis
gcggugaccgccg

SEQ ID NO: 885957 - RNA, 13 nt, Mycobacterium avium subsp. paratuberculosis
gcggugaccgcgc

SEQ ID NO: 885958 - RNA, 14 nt, Mycobacterium avium subsp. paratuberculosis
gcggugaccgcgcc

SEQ ID NO: 885959 - RNA, 16 nt, Mycobacterium avium subsp. paratuberculosis
gcggugaccgcggccu

SEQ ID NO: 885960 - RNA, 13 nt, Mycobacterium avium subsp. paratuberculosis
gcggugcaucguc

SEQ ID NO: 885961 - RNA, 18 nt, Mycobacterium avium subsp. paratuberculosis
gcggugcaucgucgcggc

SEQ ID NO: 885962 - RNA, 19 nt, Mycobacterium avium subsp. paratuberculosis
gcggugcaucgucgcggcg

SEQ ID NO: 885963 - RNA, 20 nt, Mycobacterium avium subsp. paratuberculosis
gcggugcaucgucgcggcgg

SEQ ID NO: 885964 - RNA, 17 nt, Mycobacterium avium subsp. paratuberculosis
gcggugagcgcgccggc

SEQ ID NO: 885965 - RNA, 18 nt, Mycobacterium avium subsp. paratuberculosis
gcggugagcggccgcagc

SEQ ID NO: 885966 - RNA, 21 nt, Mycobacterium avium subsp. paratuberculosis
gcggugagcugaucgcgucga

SEQ ID NO: 885967 - RNA, 23 nt, Mycobacterium avium subsp. paratuberculosis
gcggugcagggucagcagcaccc

SEQ ID NO: 885968 - RNA, 14 nt, Mycobacterium avium subsp. paratuberculosis
gcggugacgcgccg

SEQ ID NO: 885969 - RNA, 15 nt, Mycobacterium avium subsp. paratuberculosis
gcggugacgcgccgg

SEQ ID NO: 885970 - RNA, 16 nt, Mycobacterium avium subsp. paratuberculosis
gcggugacgcgccggc

SEQ ID NO: 885971 - RNA, 19 nt, Mycobacterium avium subsp. paratuberculosis
gcggugacgaugaugucgg

SEQ ID NO: 885972 - RNA, 19 nt, Mycobacterium avium subsp. paratuberculosis
gcggugacguuccagccgu

SEQ ID NO: 885973 - RNA, 18 nt, Mycobacterium avium subsp. paratuberculosis
gcggugagcaccggaucg

SEQ ID NO: 885974 - RNA, 19 nt, Mycobacterium avium subsp. paratuberculosis
gcggugagcaccggaucga

SEQ ID NO: 885975 - RNA, 15 nt, Mycobacterium avium subsp. paratuberculosis
gcggugagcagcaug

SEQ ID NO: 885976 - RNA, 14 nt, Mycobacterium avium subsp. paratuberculosis
gcggugagccgcca

SEQ ID NO: 885977 - RNA, 17 nt, Mycobacterium avium subsp. paratuberculosis
gcggugagccgccacag

SEQ ID NO: 885978 - RNA, 18 nt, Mycobacterium avium subsp. paratuberculosis
gcggugagccgccacagc

SEQ ID NO: 885979 - RNA, 16 nt, Mycobacterium avium subsp. paratuberculosis
gcgguacgcgccgcgc

SEQ ID NO: 885980 - RNA, 20 nt, Mycobacterium avium subsp. paratuberculosis
gcgguacgcgccgcgcgccc

SEQ ID NO: 885981 - RNA, 20 nt, Mycobacterium avium subsp. paratuberculosis
gcgguaccgaacgacgagcc

SEQ ID NO: 885982 - RNA, 22 nt, Mycobacterium avium subsp. paratuberculosis
gcgguaccgaacgacgagccgu

SEQ ID NO: 885983 - RNA, 19 nt, Mycobacterium avium subsp. paratuberculosis
gcgguaccgaugaccaccg

SEQ ID NO: 885984 - RNA, 17 nt, Mycobacterium avium subsp. paratuberculosis
gcgguaccgccgaucgu

SEQ ID NO: 885985 - RNA, 20 nt, Mycobacterium avium subsp. paratuberculosis
gcgguaccgccgaucgugac

SEQ ID NO: 885986 - RNA, 15 nt, Mycobacterium avium subsp. paratuberculosis
gcgguacaucccgcc

SEQ ID NO: 885987 - RNA, 16 nt, Mycobacterium avium subsp. paratuberculosis
gcgguacaucccgccg

SEQ ID NO: 885988 - RNA, 16 nt, Mycobacterium avium subsp. paratuberculosis
gcgguacacguggccg

SEQ ID NO: 885989 - RNA, 16 nt, Mycobacterium avium subsp. paratuberculosis
gcgguagaugucgggu

SEQ ID NO: 885990 - RNA, 19 nt, Mycobacterium avium subsp. paratuberculosis
gcgguagaugucggguccg

SEQ ID NO: 885991 - RNA, 23 nt, Mycobacterium avium subsp. paratuberculosis
gcgguagaaccaacgcggcgccg

SEQ ID NO: 885992 - RNA, 24 nt, Mycobacterium avium subsp. paratuberculosis
gcgguagaaccaacgcggcgccgg

SEQ ID NO: 885993 - RNA, 16 nt, Mycobacterium avium subsp. paratuberculosis
gcgguagacaccgccg

SEQ ID NO: 885994 - RNA, 17 nt, Mycobacterium avium subsp. paratuberculosis
gcgguaggugccggccg

SEQ ID NO: 885995 - RNA, 18 nt, Mycobacterium avium subsp. paratuberculosis
gcgguagucgggauaggg

SEQ ID NO: 885996 - RNA, 17 nt, Mycobacterium avium subsp. paratuberculosis
gcggucaacaccgggau

SEQ ID NO: 885997 - RNA, 23 nt, Mycobacterium avium subsp. paratuberculosis
gcggucaacaccgggauccggcg

SEQ ID NO: 885998 - RNA, 23 nt, Mycobacterium avium subsp. paratuberculosis
gcggucaacacgaagccgguguc

SEQ ID NO: 885999 - RNA, 17 nt, Mycobacterium avium subsp. paratuberculosis
gcgguauccgaucauca

SEQ ID NO: 886000 - RNA, 17 nt, Mycobacterium avium subsp. paratuberculosis
gcgguaugcccgggccg

SEQ ID NO: 886001 - RNA, 20 nt, Mycobacterium avium subsp. paratuberculosis
gcgguaugcccgggccguca

SEQ ID NO: 886002 - RNA, 13 nt, Mycobacterium avium subsp. paratuberculosis
gcggucccggcgg

SEQ ID NO: 886003 - RNA, 16 nt, Mycobacterium avium subsp. paratuberculosis
gcggucccggcggacc

SEQ ID NO: 886004 - RNA, 18 nt, Mycobacterium avium subsp. paratuberculosis
gcggucccgugcgccgcc

SEQ ID NO: 886005 - RNA, 20 nt, Mycobacterium avium subsp. paratuberculosis
gcgguccagcuugucguagc

SEQ ID NO: 886006 - RNA, 22 nt, Mycobacterium avium subsp. paratuberculosis
gcgguccagcuugucguagcgg

SEQ ID NO: 886007 - RNA, 22 nt, Mycobacterium avium subsp. paratuberculosis
gcgguccaggauccgcaccggg

SEQ ID NO: 886008 - RNA, 22 nt, Mycobacterium avium subsp. paratuberculosis
gcgguccauccagcgccgcagc

SEQ ID NO: 886009 - RNA, 17 nt, Mycobacterium avium subsp. paratuberculosis
gcgguccaucuccagcu

SEQ ID NO: 886010 - RNA, 16 nt, Mycobacterium avium subsp. paratuberculosis
gcgguccacggucagc

SEQ ID NO: 886011 - RNA, 23 nt, Mycobacterium avium subsp. paratuberculosis
gcgguccacggucagcgcgucgg

SEQ ID NO: 886012 - RNA, 18 nt, Mycobacterium avium subsp. paratuberculosis
gcgguccacgguggcgcc

SEQ ID NO: 886013 - RNA, 20 nt, Mycobacterium avium subsp. paratuberculosis
gcgguccacgguggcgccga

SEQ ID NO: 886014 - RNA, 15 nt, Mycobacterium avium subsp. paratuberculosis
gcgguccacguuggc

SEQ ID NO: 886015 - RNA, 13 nt, Mycobacterium avium subsp. paratuberculosis
gcggucgccccag

SEQ ID NO: 886016 - RNA, 17 nt, Mycobacterium avium subsp. paratuberculosis
gcggucgccccggccgc

SEQ ID NO: 886017 - RNA, 16 nt, Mycobacterium avium subsp. paratuberculosis
gcggucgccgcccacg

SEQ ID NO: 886018 - RNA, 17 nt, Mycobacterium avium subsp. paratuberculosis
gcggucgccgcccacgc

SEQ ID NO: 886019 - RNA, 19 nt, Mycobacterium avium subsp. paratuberculosis
gcggucgccaccaccagcg

SEQ ID NO: 886020 - RNA, 22 nt, Mycobacterium avium subsp. paratuberculosis
gcggucgccaccaccagcgggc

SEQ ID NO: 886021 - RNA, 19 nt, Mycobacterium avium subsp. paratuberculosis
gcggucgccacucgggcgg

SEQ ID NO: 886022 - RNA, 14 nt, Mycobacterium avium subsp. paratuberculosis
gcggucgccagcgc

SEQ ID NO: 886023 - RNA, 18 nt, Mycobacterium avium subsp. paratuberculosis
gcggucgccagcgccacg

SEQ ID NO: 886024 - RNA, 16 nt, Mycobacterium avium subsp. paratuberculosis
gcggucgcgcgccggc

SEQ ID NO: 886025 - RNA, 17 nt, Mycobacterium avium subsp. paratuberculosis
gcggucgcgcgccggcg

SEQ ID NO: 886026 - RNA, 20 nt, Mycobacterium avium subsp. paratuberculosis
gcggucgcgcgccggcgcag

SEQ ID NO: 886027 - RNA, 21 nt, Mycobacterium avium subsp. paratuberculosis
gcggucgcgcgccggcgcagc

SEQ ID NO: 886028 - RNA, 13 nt, Mycobacterium avium subsp. paratuberculosis
gcggucgcgcagc

SEQ ID NO: 886029 - RNA, 14 nt, Mycobacterium avium subsp. paratuberculosis
gcggucgcgcagcc

SEQ ID NO: 886030 - RNA, 17 nt, Mycobacterium avium subsp. paratuberculosis
gcggucgcgcagccgcc

SEQ ID NO: 886031 - RNA, 19 nt, Mycobacterium avium subsp. paratuberculosis
gcggucgcgcagccgccgg

SEQ ID NO: 886032 - RNA, 16 nt, Mycobacterium avium subsp. paratuberculosis
gcggucgcgcagccgg

SEQ ID NO: 886033 - RNA, 18 nt, Mycobacterium avium subsp. paratuberculosis
gcggucgcgcagccgggc

SEQ ID NO: 886034 - RNA, 20 nt, Mycobacterium avium subsp. paratuberculosis
gcggucgcgcagccgggcgg

SEQ ID NO: 886035 - RNA, 16 nt, Mycobacterium avium subsp. paratuberculosis
gcggucgcgccagacg

SEQ ID NO: 886036 - RNA, 16 nt, Mycobacterium avium subsp. paratuberculosis
gcggucgcaggccgcc

SEQ ID NO: 886037 - RNA, 20 nt, Mycobacterium avium subsp. paratuberculosis
gcggucgcaggccgcccggc

SEQ ID NO: 886038 - RNA, 17 nt, Mycobacterium avium subsp. paratuberculosis
gcggucgcaggcgagcc

SEQ ID NO: 886039 - RNA, 14 nt, Mycobacterium avium subsp. paratuberculosis
gcggucgaugacgc

SEQ ID NO: 886040 - RNA, 20 nt, Mycobacterium avium subsp. paratuberculosis
gcggucgaugacgccgcgcc

SEQ ID NO: 886041 - RNA, 21 nt, Mycobacterium avium subsp. paratuberculosis
gcggucgaugacgccgcgccg

SEQ ID NO: 886042 - RNA, 23 nt, Mycobacterium avium subsp. paratuberculosis
gcggucgaugacgccgcgccgcc

SEQ ID NO: 886043 - RNA, 16 nt, Mycobacterium avium subsp. paratuberculosis
gcggucgaugagcugg

SEQ ID NO: 886044 - RNA, 17 nt, Mycobacterium avium subsp. paratuberculosis
gcggucgaugagcuggu

SEQ ID NO: 886045 - RNA, 15 nt, Mycobacterium avium subsp. paratuberculosis
gcgguccgccgcagc

SEQ ID NO: 886046 - RNA, 22 nt, Mycobacterium avium subsp. paratuberculosis
gcgguccgccgcagcggcgccg

SEQ ID NO: 886047 - RNA, 18 nt, Mycobacterium avium subsp. paratuberculosis
gcggucgaucaacaccaa

SEQ ID NO: 886048 - RNA, 20 nt, Mycobacterium avium subsp. paratuberculosis
gcgggaucagcuccucgcgg

SEQ ID NO: 886049 - RNA, 22 nt, Mycobacterium avium subsp. paratuberculosis
gcgggaucggaccgcaccacca

SEQ ID NO: 886050 - RNA, 13 nt, Mycobacterium avium subsp. paratuberculosis
gcgggaucggccg

SEQ ID NO: 886051 - RNA, 15 nt, Mycobacterium avium subsp. paratuberculosis
gcgggaucggugccg

SEQ ID NO: 886052 - RNA, 16 nt, Mycobacterium avium subsp. paratuberculosis
gcgggaucggugccga

SEQ ID NO: 886053 - RNA, 19 nt, Mycobacterium avium subsp. paratuberculosis
gcgggaucggugccgacgg

SEQ ID NO: 886054 - RNA, 14 nt, Mycobacterium avium subsp. paratuberculosis
gcgggauccccacc

SEQ ID NO: 886055 - RNA, 16 nt, Mycobacterium avium subsp. paratuberculosis
gcgggauccccaccgu

SEQ ID NO: 886056 - RNA, 20 nt, Mycobacterium avium subsp. paratuberculosis
gcgggauccccaccgugacg

SEQ ID NO: 886057 - RNA, 22 nt, Mycobacterium avium subsp. paratuberculosis
gcgggaucccgcagccgcgacg

SEQ ID NO: 886058 - RNA, 23 nt, Mycobacterium avium subsp. paratuberculosis
gcgggaucccgcagccgcgacgg

SEQ ID NO: 886059 - RNA, 23 nt, Mycobacterium avium subsp. paratuberculosis
gcgggaaaccaccugccgcaacg

SEQ ID NO: 886060 - RNA, 15 nt, Mycobacterium avium subsp. paratuberculosis
gcgggaacaccacgu

SEQ ID NO: 886061 - RNA, 18 nt, Mycobacterium avium subsp. paratuberculosis
gcgggaacaccacgucgu

SEQ ID NO: 886062 - RNA, 24 nt, Mycobacterium avium subsp. paratuberculosis
gcgggaacgaucggcuccagcgcc

SEQ ID NO: 886063 - RNA, 21 nt, Mycobacterium avium subsp. paratuberculosis
gcgggcaaucgcugcgcccgc

SEQ ID NO: 886064 - RNA, 20 nt, Mycobacterium avium subsp. paratuberculosis
gcgggcaccgucgucgcacc

SEQ ID NO: 886065 - RNA, 13 nt, Mycobacterium avium subsp. paratuberculosis
gcgggcaccucga

SEQ ID NO: 886066 - RNA, 18 nt, Mycobacterium avium subsp. paratuberculosis
gcgggcaccucgaugccg

SEQ ID NO: 886067 - RNA, 17 nt, Mycobacterium avium subsp. paratuberculosis
gcgggcaccucggccag

SEQ ID NO: 886068 - RNA, 13 nt, Mycobacterium avium subsp. paratuberculosis
gcgggcacgccgc

SEQ ID NO: 886069 - RNA, 14 nt, Mycobacterium avium subsp. paratuberculosis
gcgggcacgccgcc

SEQ ID NO: 886070 - RNA, 19 nt, Mycobacterium avium subsp. paratuberculosis
gcgggcacgccgccgcgaa

SEQ ID NO: 886071 - RNA, 13 nt, Mycobacterium avium subsp. paratuberculosis
gcgggcacggcga

SEQ ID NO: 886072 - RNA, 16 nt, Mycobacterium avium subsp. paratuberculosis
gcgggcacggcgaugu

SEQ ID NO: 886073 - RNA, 15 nt, Mycobacterium avium subsp. paratuberculosis
gcgggcacgucgcgc

SEQ ID NO: 886074 - RNA, 18 nt, Mycobacterium avium subsp. paratuberculosis
gcgggcacgucgcgcggg

SEQ ID NO: 886075 - RNA, 21 nt, Mycobacterium avium subsp. paratuberculosis
gcgggcacgucgcgcgggguc

SEQ ID NO: 886076 - RNA, 22 nt, Mycobacterium avium subsp. paratuberculosis
gcgggcacgucgcgcggggucg

SEQ ID NO: 886077 - RNA, 18 nt, Mycobacterium avium subsp. paratuberculosis
gcgggauucgcgcaccuu

SEQ ID NO: 886078 - RNA, 18 nt, Mycobacterium avium subsp. paratuberculosis
gcgggauuggcgccacug

SEQ ID NO: 886079 - RNA, 18 nt, Mycobacterium avium subsp. paratuberculosis
gcgggaugcuuggucgcg

SEQ ID NO: 886080 - RNA, 23 nt, Mycobacterium avium subsp. paratuberculosis
gcggcuggguggacaccuuggcg

SEQ ID NO: 886081 - RNA, 19 nt, Mycobacterium avium subsp. paratuberculosis
gcggcugggucggucccga

SEQ ID NO: 886082 - RNA, 20 nt, Mycobacterium avium subsp. paratuberculosis
gcggcugggucggucccgac

SEQ ID NO: 886083 - RNA, 17 nt, Mycobacterium avium subsp. paratuberculosis
gcggcugggcagccgcg

SEQ ID NO: 886084 - RNA, 21 nt, Mycobacterium avium subsp. paratuberculosis
gcggcugggcagccgcgcgug

SEQ ID NO: 886085 - RNA, 15 nt, Mycobacterium avium subsp. paratuberculosis
gcggcugggccgcgg

SEQ ID NO: 886086 - RNA, 21 nt, Mycobacterium avium subsp. paratuberculosis
gcggcuggccgucgucgaggc

SEQ ID NO: 886087 - RNA, 17 nt, Mycobacterium avium subsp. paratuberculosis
gcggcuggugccgccgg

SEQ ID NO: 886088 - RNA, 18 nt, Mycobacterium avium subsp. paratuberculosis
gcggcuggugccgccggc

SEQ ID NO: 886089 - RNA, 15 nt, Mycobacterium avium subsp. paratuberculosis
gcggcuguagcaccc

SEQ ID NO: 886090 - RNA, 16 nt, Mycobacterium avium subsp. paratuberculosis
gcggcuguagcacccg

SEQ ID NO: 886091 - RNA, 21 nt, Mycobacterium avium subsp. paratuberculosis
gcggcuguagcacccggccgg

SEQ ID NO: 886092 - RNA, 22 nt, Mycobacterium avium subsp. paratuberculosis
gcggcuguagcacccggccggc

SEQ ID NO: 886093 - RNA, 22 nt, Mycobacterium avium subsp. paratuberculosis
gcggcugugaucgcugacgccg

SEQ ID NO: 886094 - RNA, 15 nt, Mycobacterium avium subsp. paratuberculosis
gcggcugcucgaacc

SEQ ID NO: 886095 - RNA, 16 nt, Mycobacterium avium subsp. paratuberculosis
gcggcugcucgaaccg

SEQ ID NO: 886096 - RNA, 20 nt, Mycobacterium avium subsp. paratuberculosis
gcggcugcucgaaccgcgag

SEQ ID NO: 886097 - RNA, 24 nt, Mycobacterium avium subsp. paratuberculosis
gcggcugcccaggaucaccgggac

SEQ ID NO: 886098 - RNA, 20 nt, Mycobacterium avium subsp. paratuberculosis
gcggcugcgcguucggcgcc

SEQ ID NO: 886099 - RNA, 19 nt, Mycobacterium avium subsp. paratuberculosis
gcggcugcgcacguagccc

SEQ ID NO: 886100 - RNA, 14 nt, Mycobacterium avium subsp. paratuberculosis
gcggcugccggcca

SEQ ID NO: 886101 - RNA, 13 nt, Mycobacterium avium subsp. paratuberculosis
gcggcugccggug

SEQ ID NO: 886102 - RNA, 14 nt, Mycobacterium avium subsp. paratuberculosis
gcggcuggcccggc

SEQ ID NO: 886103 - RNA, 15 nt, Mycobacterium avium subsp. paratuberculosis
gcggcuggcccggcg

SEQ ID NO: 886104 - RNA, 21 nt, Mycobacterium avium subsp. paratuberculosis
gcggcuggcccggcgcggcgg

SEQ ID NO: 886105 - RNA, 13 nt, Mycobacterium avium subsp. paratuberculosis
gcggcuggccgcg

SEQ ID NO: 886106 - RNA, 15 nt, Mycobacterium avium subsp. paratuberculosis
gcggcuggccgcggc

SEQ ID NO: 886107 - RNA, 16 nt, Mycobacterium avium subsp. paratuberculosis
gcggcuggccgcggcg

SEQ ID NO: 886108 - RNA, 21 nt, Mycobacterium avium subsp. paratuberculosis
gcggcggugagccgccacagc

SEQ ID NO: 886109 - RNA, 16 nt, Mycobacterium avium subsp. paratuberculosis
gcggcggugaucgccg

SEQ ID NO: 886110 - RNA, 15 nt, Mycobacterium avium subsp. paratuberculosis
gcggcggugaucucg

SEQ ID NO: 886111 - RNA, 19 nt, Mycobacterium avium subsp. paratuberculosis
gcggcggucuucuuggccg

SEQ ID NO: 886112 - RNA, 23 nt, Mycobacterium avium subsp. paratuberculosis
gcggcggucuucuuggccgcgcc

SEQ ID NO: 886113 - RNA, 13 nt, Mycobacterium avium subsp. paratuberculosis
gcggcggucgcca

SEQ ID NO: 886114 - RNA, 14 nt, Mycobacterium avium subsp. paratuberculosis
gcggcggucgccac

SEQ ID NO: 886115 - RNA, 21 nt, Mycobacterium avium subsp. paratuberculosis
gcggcggucgccacucgggcg

SEQ ID NO: 886116 - RNA, 16 nt, Mycobacterium avium subsp. paratuberculosis
gcggcggucgcgcgcc

SEQ ID NO: 886117 - RNA, 13 nt, Mycobacterium avium subsp. paratuberculosis
gcggcggucggcg

SEQ ID NO: 886118 - RNA, 16 nt, Mycobacterium avium subsp. paratuberculosis
gcggcggucggcgccg

SEQ ID NO: 886119 - RNA, 19 nt, Mycobacterium avium subsp. paratuberculosis
gcggcggucacgcccgggu

SEQ ID NO: 886120 - RNA, 21 nt, Mycobacterium avium subsp. paratuberculosis
gcggcggucagguucgccacg

SEQ ID NO: 886121 - RNA, 14 nt, Mycobacterium avium subsp. paratuberculosis
gcggcgguccccga

SEQ ID NO: 886122 - RNA, 18 nt, Mycobacterium avium subsp. paratuberculosis
gcggcgguccccgaagcg

SEQ ID NO: 886123 - RNA, 21 nt, Mycobacterium avium subsp. paratuberculosis
gcggcgguccgcccggaccag

SEQ ID NO: 886124 - RNA, 17 nt, Mycobacterium avium subsp. paratuberculosis
gcggcgguccguucggc

SEQ ID NO: 886125 - RNA, 18 nt, Mycobacterium avium subsp. paratuberculosis
gcggcgguccguucggcg

SEQ ID NO: 886126 - RNA, 20 nt, Mycobacterium avium subsp. paratuberculosis
gcggcgguugcucgucggcc

SEQ ID NO: 886127 - RNA, 16 nt, Mycobacterium avium subsp. paratuberculosis
gcggcggugggcuggg

SEQ ID NO: 886128 - RNA, 15 nt, Mycobacterium avium subsp. paratuberculosis
gcggcggugucgccc

SEQ ID NO: 886129 - RNA, 16 nt, Mycobacterium avium subsp. paratuberculosis
gcggcggugucgccca

SEQ ID NO: 886130 - RNA, 18 nt, Mycobacterium avium subsp. paratuberculosis
gcggcggugucgcccagc

SEQ ID NO: 886131 - RNA, 17 nt, Mycobacterium avium subsp. paratuberculosis
gcggcggugcgcagccg

SEQ ID NO: 886132 - RNA, 21 nt, Mycobacterium avium subsp. paratuberculosis
gcggcggugacgaugucgaug

SEQ ID NO: 886133 - RNA, 20 nt, Mycobacterium avium subsp. paratuberculosis
gcggcggugccgcaggcgaa

SEQ ID NO: 886134 - RNA, 14 nt, Mycobacterium avium subsp. paratuberculosis
gcggcggugccggu

SEQ ID NO: 886135 - RNA, 16 nt, Mycobacterium avium subsp. paratuberculosis
gcggcggugcgucggg

SEQ ID NO: 886136 - RNA, 17 nt, Mycobacterium avium subsp. paratuberculosis
gcggcggugcgucgggc

SEQ ID NO: 886137 - RNA, 21 nt, Mycobacterium avium subsp. paratuberculosis
gcggcggugcgucgggcgccg

SEQ ID NO: 886138 - RNA, 18 nt, Mycobacterium avium subsp. paratuberculosis
gcggcggugcucgcgccg

SEQ ID NO: 886139 - RNA, 22 nt, Mycobacterium avium subsp. paratuberculosis
gcggcggugcucucgucgucgg

SEQ ID NO: 886140 - RNA, 15 nt, Mycobacterium avium subsp. paratuberculosis
gcggcgguggccugc

SEQ ID NO: 886141 - RNA, 21 nt, Mycobacterium avium subsp. paratuberculosis
gcggcgguggccugcccggcg

SEQ ID NO: 886142 - RNA, 22 nt, Mycobacterium avium subsp. paratuberculosis
gcggcgguggccuggucgaaca

SEQ ID NO: 886143 - RNA, 21 nt, Mycobacterium avium subsp. paratuberculosis
gcggcgguauucgucacccca

SEQ ID NO: 886144 - RNA, 22 nt, Mycobacterium avium subsp. paratuberculosis
gcggcggcaaccagcuccggca

SEQ ID NO: 886145 - RNA, 23 nt, Mycobacterium avium subsp. paratuberculosis
gcggcggacgauguccgccggcc

SEQ ID NO: 886146 - RNA, 14 nt, Mycobacterium avium subsp. paratuberculosis
gcggcggaucagca

SEQ ID NO: 886147 - RNA, 17 nt, Mycobacterium avium subsp. paratuberculosis
gcggcggaucagcaccg

SEQ ID NO: 886148 - RNA, 18 nt, Mycobacterium avium subsp. paratuberculosis
gcggcggaucagcaccga

SEQ ID NO: 886149 - RNA, 19 nt, Mycobacterium avium subsp. paratuberculosis
gcggcggaucagcaccgac

SEQ ID NO: 886150 - RNA, 22 nt, Mycobacterium avium subsp. paratuberculosis
gcggcggaucagcaccgacgcg

SEQ ID NO: 886151 - RNA, 19 nt, Mycobacterium avium subsp. paratuberculosis
gcggcggauccagcaccgc

SEQ ID NO: 886152 - RNA, 20 nt, Mycobacterium avium subsp. paratuberculosis
gcggcggauccagcaccgcc

SEQ ID NO: 886153 - RNA, 23 nt, Mycobacterium avium subsp. paratuberculosis
gcggcgcuuucgaagugacgccg

SEQ ID NO: 886154 - RNA, 17 nt, Mycobacterium avium subsp. paratuberculosis
gcggcggaacucgauga

SEQ ID NO: 886155 - RNA, 19 nt, Mycobacterium avium subsp. paratuberculosis
gcggcggaacucgaugauc

SEQ ID NO: 886156 - RNA, 14 nt, Mycobacterium avium subsp. paratuberculosis
gcggcggaaucgca

SEQ ID NO: 886157 - RNA, 21 nt, Mycobacterium avium subsp. paratuberculosis
gcggcggaccgucggugucga

SEQ ID NO: 886158 - RNA, 17 nt, Mycobacterium avium subsp. paratuberculosis
gcggcggaggccugcgc

SEQ ID NO: 886159 - RNA, 19 nt, Mycobacterium avium subsp. paratuberculosis
gcggcggaggccugcgcgg

SEQ ID NO: 886160 - RNA, 14 nt, Mycobacterium avium subsp. paratuberculosis
gcggcggaggggcc

SEQ ID NO: 886161 - RNA, 21 nt, Mycobacterium avium subsp. paratuberculosis
gcggcggaggucagcggcccg

SEQ ID NO: 886162 - RNA, 14 nt, Mycobacterium avium subsp. paratuberculosis
gcggcgucggccug

SEQ ID NO: 886163 - RNA, 21 nt, Mycobacterium avium subsp. paratuberculosis
gcggcgucggccugcccgcgg

SEQ ID NO: 886164 - RNA, 12 nt, Mycobacterium avium subsp. paratuberculosis
gcggcgucggcg

SEQ ID NO: 886165 - RNA, 12 nt, Mycobacterium avium subsp. paratuberculosis
gcggcgucgaug

SEQ ID NO: 886166 - RNA, 16 nt, Mycobacterium avium subsp. paratuberculosis
gcggcguccucgacca

SEQ ID NO: 886167 - RNA, 22 nt, Mycobacterium avium subsp. paratuberculosis
gcggcguccucgaugacgccgg

SEQ ID NO: 886168 - RNA, 17 nt, Mycobacterium avium subsp. paratuberculosis
gcggcgucgagcaccuc

SEQ ID NO: 886169 - RNA, 22 nt, Mycobacterium avium subsp. paratuberculosis
gcggcgucgaguucgccgucga

SEQ ID NO: 886170 - RNA, 14 nt, Mycobacterium avium subsp. paratuberculosis
gcggcgucgaccgc

SEQ ID NO: 886171 - RNA, 15 nt, Mycobacterium avium subsp. paratuberculosis
gcggcgucggcgacg

SEQ ID NO: 886172 - RNA, 17 nt, Mycobacterium avium subsp. paratuberculosis
gcggcgucggcgacggc

SEQ ID NO: 886173 - RNA, 13 nt, Mycobacterium avium subsp. paratuberculosis
gcggcgucggcgu

SEQ ID NO: 886174 - RNA, 16 nt, Mycobacterium avium subsp. paratuberculosis
gcggcgucggcgucca

SEQ ID NO: 886175 - RNA, 21 nt, Mycobacterium avium subsp. paratuberculosis
gcggcgucgggauggucgauc

SEQ ID NO: 886176 - RNA, 22 nt, Mycobacterium avium subsp. paratuberculosis
gcggcgucgggauggucgaucc

SEQ ID NO: 886177 - RNA, 14 nt, Mycobacterium avium subsp. paratuberculosis
gcggcgucgggcgg

SEQ ID NO: 886178 - RNA, 23 nt, Mycobacterium avium subsp. paratuberculosis
gcggcgucggguagggcgccguc

SEQ ID NO: 886179 - RNA, 23 nt, Mycobacterium avium subsp. paratuberculosis
gcggcgucguagacgcugccgcu

SEQ ID NO: 886180 - RNA, 13 nt, Mycobacterium avium subsp. paratuberculosis
gcggcgucguagu

SEQ ID NO: 886181 - RNA, 20 nt, Mycobacterium avium subsp. paratuberculosis
gcggcgucgucgccguggcg

SEQ ID NO: 886182 - RNA, 13 nt, Mycobacterium avium subsp. paratuberculosis
gcggcugcagcag

SEQ ID NO: 886183 - RNA, 16 nt, Mycobacterium avium subsp. paratuberculosis
gcggcugcagcagaug

SEQ ID NO: 886184 - RNA, 21 nt, Mycobacterium avium subsp. paratuberculosis
gcggcugcaucaugccgccca

SEQ ID NO: 886185 - RNA, 18 nt, Mycobacterium avium subsp. paratuberculosis
gcggcugaucagccggcg

SEQ ID NO: 886186 - RNA, 21 nt, Mycobacterium avium subsp. paratuberculosis
gcggcugaucagccggcgagc

SEQ ID NO: 886187 - RNA, 15 nt, Mycobacterium avium subsp. paratuberculosis
gcggcuccgagcgga

SEQ ID NO: 886188 - RNA, 15 nt, Mycobacterium avium subsp. paratuberculosis
gcggcugacccgccc

SEQ ID NO: 886189 - RNA, 17 nt, Mycobacterium avium subsp. paratuberculosis
gcggcugaaccaccgcg

SEQ ID NO: 886190 - RNA, 19 nt, Mycobacterium avium subsp. paratuberculosis
gcggcugaaccaccgcgcc

SEQ ID NO: 886191 - RNA, 20 nt, Mycobacterium avium subsp. paratuberculosis
gcggcugaaccaccgcgccc

SEQ ID NO: 886192 - RNA, 22 nt, Mycobacterium avium subsp. paratuberculosis
gcggcugaaccaccgcgcccac

SEQ ID NO: 886193 - RNA, 12 nt, Mycobacterium avium subsp. paratuberculosis
gcggcucccacc

SEQ ID NO: 886194 - RNA, 16 nt, Mycobacterium avium subsp. paratuberculosis
gcggcucacagcgcgg

SEQ ID NO: 886195 - RNA, 18 nt, Mycobacterium avium subsp. paratuberculosis
gcggcucacagcgcggcg

SEQ ID NO: 886196 - RNA, 19 nt, Mycobacterium avium subsp. paratuberculosis
gcggcucacagcgcggcgg

SEQ ID NO: 886197 - RNA, 20 nt, Mycobacterium avium subsp. paratuberculosis
gcggcucagcaacccgccga

SEQ ID NO: 886198 - RNA, 15 nt, Mycobacterium avium subsp. paratuberculosis
gcggcuccagcagcg

SEQ ID NO: 886199 - RNA, 23 nt, Mycobacterium avium subsp. paratuberculosis
gcggcuccagcagcggcucggcc

SEQ ID NO: 886200 - RNA, 15 nt, Mycobacterium avium subsp. paratuberculosis
gcggcuaguuggccg

SEQ ID NO: 886201 - RNA, 19 nt, Mycobacterium avium subsp. paratuberculosis
gcggcuaguuggccggcuu

SEQ ID NO: 886202 - RNA, 21 nt, Mycobacterium avium subsp. paratuberculosis
gcggcgaucuuugcggccgug

SEQ ID NO: 886203 - RNA, 16 nt, Mycobacterium avium subsp. paratuberculosis
gcggcgaugcgcggcc

SEQ ID NO: 886204 - RNA, 18 nt, Mycobacterium avium subsp. paratuberculosis
gcggcgaugcgcggcccg

SEQ ID NO: 886205 - RNA, 17 nt, Mycobacterium avium subsp. paratuberculosis
gcggcgaugcgcuccag

SEQ ID NO: 886206 - RNA, 13 nt, Mycobacterium avium subsp. paratuberculosis
gcggcgauggacg

SEQ ID NO: 886207 - RNA, 17 nt, Mycobacterium avium subsp. paratuberculosis
gcggcgauggacgucca

SEQ ID NO: 886208 - RNA, 21 nt, Mycobacterium avium subsp. paratuberculosis
gcggcgauggacguccagcgg

SEQ ID NO: 886209 - RNA, 19 nt, Mycobacterium avium subsp. paratuberculosis
gcggcgaugcccacagcca

SEQ ID NO: 886210 - RNA, 16 nt, Mycobacterium avium subsp. paratuberculosis
gcggcgauggcccgcu

SEQ ID NO: 886211 - RNA, 19 nt, Mycobacterium avium subsp. paratuberculosis
gcggcgauggcccgcugcg

SEQ ID NO: 886212 - RNA, 13 nt, Mycobacterium avium subsp. paratuberculosis
gcggcgauggccg

SEQ ID NO: 886213 - RNA, 17 nt, Mycobacterium avium subsp. paratuberculosis
gcggcgaucucggcggc

SEQ ID NO: 886214 - RNA, 19 nt, Mycobacterium avium subsp. paratuberculosis
gcggcgaucucggcggccg

SEQ ID NO: 886215 - RNA, 11 nt, Mycobacterium avium subsp. paratuberculosis
gcggcgaucgg

SEQ ID NO: 886216 - RNA, 14 nt, Mycobacterium avium subsp. paratuberculosis
gcggcgaucggcgg

SEQ ID NO: 886217 - RNA, 17 nt, Mycobacterium avium subsp. paratuberculosis
gcggcgaucgggucacc

SEQ ID NO: 886218 - RNA, 22 nt, Mycobacterium avium subsp. paratuberculosis
gcggcgaucgggucaccggccg

SEQ ID NO: 886219 - RNA, 11 nt, Mycobacterium avium subsp. paratuberculosis
gcggcgaucgu

SEQ ID NO: 886220 - RNA, 20 nt, Mycobacterium avium subsp. paratuberculosis
gcggcgaucaccgccgcggc

SEQ ID NO: 886221 - RNA, 13 nt, Mycobacterium avium subsp. paratuberculosis
gcggcgaucgccg

SEQ ID NO: 886222 - RNA, 15 nt, Mycobacterium avium subsp. paratuberculosis
gcggcgaucgccgug

SEQ ID NO: 886223 - RNA, 16 nt, Mycobacterium avium subsp. paratuberculosis
gcggcgauccggccgg

SEQ ID NO: 886224 - RNA, 17 nt, Mycobacterium avium subsp. paratuberculosis
gcggcgauccggccggc

SEQ ID NO: 886225 - RNA, 18 nt, Mycobacterium avium subsp. paratuberculosis
gcggcgauccggccggcg

SEQ ID NO: 886226 - RNA, 21 nt, Mycobacterium avium subsp. paratuberculosis
gcggcgauccggccggcggcg

SEQ ID NO: 886227 - RNA, 22 nt, Mycobacterium avium subsp. paratuberculosis
gcggcgaucgagggggucauca

SEQ ID NO: 886228 - RNA, 16 nt, Mycobacterium avium subsp. paratuberculosis
gcggcgaucagcagca

SEQ ID NO: 886229 - RNA, 17 nt, Mycobacterium avium subsp. paratuberculosis
gcggcgaucagcagcac

SEQ ID NO: 886230 - RNA, 18 nt, Mycobacterium avium subsp. paratuberculosis
gcggcgaucagcagcacc

SEQ ID NO: 886231 - RNA, 21 nt, Mycobacterium avium subsp. paratuberculosis
gcggcgaucagcagcacccgg

SEQ ID NO: 886232 - RNA, 23 nt, Mycobacterium avium subsp. paratuberculosis
gcggcgaucagcagcacccgggc

SEQ ID NO: 886233 - RNA, 18 nt, Mycobacterium avium subsp. paratuberculosis
gcggcgaucagcccggcc

SEQ ID NO: 886234 - RNA, 21 nt, Mycobacterium avium subsp. paratuberculosis
gcggcgaucagcccggcccgc

SEQ ID NO: 886235 - RNA, 22 nt, Mycobacterium avium subsp. paratuberculosis
gcggcgaucagcccggcccgca

SEQ ID NO: 886236 - RNA, 13 nt, Mycobacterium avium subsp. paratuberculosis
gcggcgaugauca

SEQ ID NO: 886237 - RNA, 21 nt, Mycobacterium avium subsp. paratuberculosis
gcggcgcagggcggccggcca

SEQ ID NO: 886238 - RNA, 19 nt, Mycobacterium avium subsp. paratuberculosis
gcggcgcaugaucgcccgc

SEQ ID NO: 886239 - RNA, 13 nt, Mycobacterium avium subsp. paratuberculosis
gcggcgccaccgg

SEQ ID NO: 886240 - RNA, 18 nt, Mycobacterium avium subsp. paratuberculosis
gcggcgccaccggcuggc

SEQ ID NO: 886241 - RNA, 19 nt, Mycobacterium avium subsp. paratuberculosis
gcggcgccaccggcuggcc

SEQ ID NO: 886242 - RNA, 20 nt, Mycobacterium avium subsp. paratuberculosis
gcggcgccaccggcuggccg

SEQ ID NO: 886243 - RNA, 21 nt, Mycobacterium avium subsp. paratuberculosis
gcggcgccaccggcuggccgg

SEQ ID NO: 886244 - RNA, 14 nt, Mycobacterium avium subsp. paratuberculosis
gcggcgccaccggg

SEQ ID NO: 886245 - RNA, 16 nt, Mycobacterium avium subsp. paratuberculosis
gcggcgccaccgggac

SEQ ID NO: 886246 - RNA, 15 nt, Mycobacterium avium subsp. paratuberculosis
gcggcgccacguggu

SEQ ID NO: 886247 - RNA, 17 nt, Mycobacterium avium subsp. paratuberculosis
gcggcgccacguggucg

SEQ ID NO: 886248 - RNA, 18 nt, Mycobacterium avium subsp. paratuberculosis
gcggcgccgaaccgggug

SEQ ID NO: 886249 - RNA, 18 nt, Mycobacterium avium subsp. paratuberculosis
gcggcgccgaacucggcg

SEQ ID NO: 886250 - RNA, 19 nt, Mycobacterium avium subsp. paratuberculosis
gcggcgcagguccggcagc

SEQ ID NO: 886251 - RNA, 14 nt, Mycobacterium avium subsp. paratuberculosis
gcggcgcagucgau

SEQ ID NO: 886252 - RNA, 15 nt, Mycobacterium avium subsp. paratuberculosis
gcggcgcaggcgcgc

SEQ ID NO: 886253 - RNA, 14 nt, Mycobacterium avium subsp. paratuberculosis
gcggcgaugguguc

SEQ ID NO: 886254 - RNA, 14 nt, Mycobacterium avium subsp. paratuberculosis
gcggcgcaggccgg

SEQ ID NO: 886255 - RNA, 15 nt, Mycobacterium avium subsp. paratuberculosis
gcggcgcagcgcgau

SEQ ID NO: 886256 - RNA, 13 nt, Mycobacterium avium subsp. paratuberculosis
gcggcgcagcguc

SEQ ID NO: 886257 - RNA, 23 nt, Mycobacterium avium subsp. paratuberculosis
gcggcgcagcgucucgaucgacg

SEQ ID NO: 886258 - RNA, 12 nt, Mycobacterium avium subsp. paratuberculosis
gcggcgcagcuc

SEQ ID NO: 886259 - RNA, 13 nt, Mycobacterium avium subsp. paratuberculosis
gcggcgcagcucg

SEQ ID NO: 886260 - RNA, 20 nt, Mycobacterium avium subsp. paratuberculosis
gcggcgcagcucgcgcagcu

SEQ ID NO: 886261 - RNA, 14 nt, Mycobacterium avium subsp. paratuberculosis
gcggcgcugaugcc

SEQ ID NO: 886262 - RNA, 15 nt, Mycobacterium avium subsp. paratuberculosis
gcggcgcugaugccg

SEQ ID NO: 886263 - RNA, 14 nt, Mycobacterium avium subsp. paratuberculosis
gcggcgcugcagca

SEQ ID NO: 886264 - RNA, 15 nt, Mycobacterium avium subsp. paratuberculosis
gcggcgcugcagcag

SEQ ID NO: 886265 - RNA, 23 nt, Mycobacterium avium subsp. paratuberculosis
gcggcgcugcagcagcccgauca

SEQ ID NO: 886266 - RNA, 18 nt, Mycobacterium avium subsp. paratuberculosis
gcggcgcugccccagcca

SEQ ID NO: 886267 - RNA, 21 nt, Mycobacterium avium subsp. paratuberculosis
gcggcgcugccgccggccucg

SEQ ID NO: 886268 - RNA, 13 nt, Mycobacterium avium subsp. paratuberculosis
gcggcgcugccgg

SEQ ID NO: 886269 - RNA, 14 nt, Mycobacterium avium subsp. paratuberculosis
gcggcgcugccggu

SEQ ID NO: 886270 - RNA, 15 nt, Mycobacterium avium subsp. paratuberculosis
gcggcgcugccggug

SEQ ID NO: 886271 - RNA, 15 nt, Mycobacterium avium subsp. paratuberculosis
gcggcgcugcgccgu

SEQ ID NO: 886272 - RNA, 14 nt, Mycobacterium avium subsp. paratuberculosis
gcggcgcuggucgg

SEQ ID NO: 886273 - RNA, 21 nt, Mycobacterium avium subsp. paratuberculosis
gcggcgcuucgggugcgggug

SEQ ID NO: 886274 - RNA, 16 nt, Mycobacterium avium subsp. paratuberculosis
gcggcgcuugaccucg

SEQ ID NO: 886275 - RNA, 23 nt, Mycobacterium avium subsp. paratuberculosis
gcggcgcuugaccucgccgagca

SEQ ID NO: 886276 - RNA, 21 nt, Mycobacterium avium subsp. paratuberculosis
gcggcgcuugacgaacgccac

SEQ ID NO: 886277 - RNA, 13 nt, Mycobacterium avium subsp. paratuberculosis
gcggcgcucagcg

SEQ ID NO: 886278 - RNA, 14 nt, Mycobacterium avium subsp. paratuberculosis
gcggcgcucagcgc

SEQ ID NO: 886279 - RNA, 22 nt, Mycobacterium avium subsp. paratuberculosis
gcggcgcucagcgcggcgggcc

SEQ ID NO: 886280 - RNA, 21 nt, Mycobacterium avium subsp. paratuberculosis
gcggcgcgaggcgcggggcgc

SEQ ID NO: 886281 - RNA, 15 nt, Mycobacterium avium subsp. paratuberculosis
gcggcgcgaucgucg

SEQ ID NO: 886282 - RNA, 17 nt, Mycobacterium avium subsp. paratuberculosis
gcggcgcgaucgucgac

SEQ ID NO: 886283 - RNA, 19 nt, Mycobacterium avium subsp. paratuberculosis
gcggcgcgaucgucgacca

SEQ ID NO: 886284 - RNA, 22 nt, Mycobacterium avium subsp. paratuberculosis
gcggcgcgaucgucgaccacca

SEQ ID NO: 886285 - RNA, 18 nt, Mycobacterium avium subsp. paratuberculosis
gcggcgcgaugaucgccg

SEQ ID NO: 886286 - RNA, 22 nt, Mycobacterium avium subsp. paratuberculosis
gcggcgccguuucggacgagcc

SEQ ID NO: 886287 - RNA, 14 nt, Mycobacterium avium subsp. paratuberculosis
gcggcgcgacaccg

SEQ ID NO: 886288 - RNA, 19 nt, Mycobacterium avium subsp. paratuberculosis
gcggcgccguagguggcca

SEQ ID NO: 886289 - RNA, 22 nt, Mycobacterium avium subsp. paratuberculosis
gcggcgccguagguggccauga

SEQ ID NO: 886290 - RNA, 15 nt, Mycobacterium avium subsp. paratuberculosis
gcggcgccguugacc

SEQ ID NO: 886291 - RNA, 14 nt, Mycobacterium avium subsp. paratuberculosis
gcggcgccgucgcc

SEQ ID NO: 886292 - RNA, 15 nt, Mycobacterium avium subsp. paratuberculosis
gcggcgccgucgccg

SEQ ID NO: 886293 - RNA, 16 nt, Mycobacterium avium subsp. paratuberculosis
gcggcgccgucgccga

SEQ ID NO: 886294 - RNA, 19 nt, Mycobacterium avium subsp. paratuberculosis
gcggcgccgucgccgauca

SEQ ID NO: 886295 - RNA, 18 nt, Mycobacterium avium subsp. paratuberculosis
gcggcgccgggucaccgg

SEQ ID NO: 886296 - RNA, 15 nt, Mycobacterium avium subsp. paratuberculosis
gcggcgccgggaucg

SEQ ID NO: 886297 - RNA, 13 nt, Mycobacterium avium subsp. paratuberculosis
gcggcgccgggca

SEQ ID NO: 886298 - RNA, 13 nt, Mycobacterium avium subsp. paratuberculosis
gcggcgccgggcg

SEQ ID NO: 886299 - RNA, 18 nt, Mycobacterium avium subsp. paratuberculosis
gcggcgccggaggccagc

SEQ ID NO: 886300 - RNA, 14 nt, Mycobacterium avium subsp. paratuberculosis
gcggcgccggccgg

SEQ ID NO: 886301 - RNA, 15 nt, Mycobacterium avium subsp. paratuberculosis
gcggcgccggccggg

SEQ ID NO: 886302 - RNA, 14 nt, Mycobacterium avium subsp. paratuberculosis
gcggcgccggaugc

SEQ ID NO: 886303 - RNA, 23 nt, Mycobacterium avium subsp. paratuberculosis
gcggcgccggaugccagcagguc

SEQ ID NO: 886304 - RNA, 17 nt, Mycobacterium avium subsp. paratuberculosis
gcggcgccggaugggcg

SEQ ID NO: 886305 - RNA, 15 nt, Mycobacterium avium subsp. paratuberculosis
gcggcgccgcccggc

SEQ ID NO: 886306 - RNA, 16 nt, Mycobacterium avium subsp. paratuberculosis
gcggcgccgcccggcg

SEQ ID NO: 886307 - RNA, 13 nt, Mycobacterium avium subsp. paratuberculosis
gcggcgccgcggc

SEQ ID NO: 886308 - RNA, 19 nt, Mycobacterium avium subsp. paratuberculosis
gcggcgccgcggcccugca

SEQ ID NO: 886309 - RNA, 14 nt, Mycobacterium avium subsp. paratuberculosis
gcggcgccgcggcg

SEQ ID NO: 886310 - RNA, 16 nt, Mycobacterium avium subsp. paratuberculosis
gcggcgccgcguacca

SEQ ID NO: 886311 - RNA, 16 nt, Mycobacterium avium subsp. paratuberculosis
gcggcgccgcagcacg

SEQ ID NO: 886312 - RNA, 15 nt, Mycobacterium avium subsp. paratuberculosis
gcggcgccgccacgg

SEQ ID NO: 886313 - RNA, 19 nt, Mycobacterium avium subsp. paratuberculosis
gcggcgccgccacggcacg

SEQ ID NO: 886314 - RNA, 14 nt, Mycobacterium avium subsp. paratuberculosis
gcggcagggccacc

SEQ ID NO: 886315 - RNA, 15 nt, Mycobacterium avium subsp. paratuberculosis
gcggcagggccaccg

SEQ ID NO: 886316 - RNA, 15 nt, Mycobacterium avium subsp. paratuberculosis
gcggcagggccagca

SEQ ID NO: 886317 - RNA, 16 nt, Mycobacterium avium subsp. paratuberculosis
gcggcagggccagcac

SEQ ID NO: 886318 - RNA, 17 nt, Mycobacterium avium subsp. paratuberculosis
gcggcaggcgacccgca

SEQ ID NO: 886319 - RNA, 15 nt, Mycobacterium avium subsp. paratuberculosis
gcggcaggcgcccca

SEQ ID NO: 886320 - RNA, 18 nt, Mycobacterium avium subsp. paratuberculosis
gcggcaggcgccccagcu

SEQ ID NO: 886321 - RNA, 16 nt, Mycobacterium avium subsp. paratuberculosis
gcggcgaaccagcaug

SEQ ID NO: 886322 - RNA, 16 nt, Mycobacterium avium subsp. paratuberculosis
gcggcgaacccgagca

SEQ ID NO: 886323 - RNA, 22 nt, Mycobacterium avium subsp. paratuberculosis
gcggcgaacccgagcaccccgg

SEQ ID NO: 886324 - RNA, 17 nt, Mycobacterium avium subsp. paratuberculosis
gcggcagguugcgcugg

SEQ ID NO: 886325 - RNA, 14 nt, Mycobacterium avium subsp. paratuberculosis
gcggcagguugggg

SEQ ID NO: 886326 - RNA, 20 nt, Mycobacterium avium subsp. paratuberculosis
gcggcagguuggggacggcg

SEQ ID NO: 886327 - RNA, 19 nt, Mycobacterium avium subsp. paratuberculosis
gcggcaguagcgcaccggu

SEQ ID NO: 886328 - RNA, 23 nt, Mycobacterium avium subsp. paratuberculosis
gcggcagguggauugucggccgc

SEQ ID NO: 886329 - RNA, 20 nt, Mycobacterium avium subsp. paratuberculosis
gcggcaggugaaggugcccc

SEQ ID NO: 886330 - RNA, 22 nt, Mycobacterium avium subsp. paratuberculosis
gcggcaggugaaggugccccac

SEQ ID NO: 886331 - RNA, 14 nt, Mycobacterium avium subsp. paratuberculosis
gcggcagguaggcg

SEQ ID NO: 886332 - RNA, 17 nt, Mycobacterium avium subsp. paratuberculosis
gcggcagguaggcgccg

SEQ ID NO: 886333 - RNA, 18 nt, Mycobacterium avium subsp. paratuberculosis
gcggcagguaggcgccgc

SEQ ID NO: 886334 - RNA, 19 nt, Mycobacterium avium subsp. paratuberculosis
gcggcagguaggcgccgcu

SEQ ID NO: 886335 - RNA, 23 nt, Mycobacterium avium subsp. paratuberculosis
gcggcagguaggcgccgcucgac

SEQ ID NO: 886336 - RNA, 23 nt, Mycobacterium avium subsp. paratuberculosis
gcggcaggucccaggccaggauc

SEQ ID NO: 886337 - RNA, 14 nt, Mycobacterium avium subsp. paratuberculosis
gcggcaggucggcc

SEQ ID NO: 886338 - RNA, 16 nt, Mycobacterium avium subsp. paratuberculosis
gcggcaggucggccag

SEQ ID NO: 886339 - RNA, 17 nt, Mycobacterium avium subsp. paratuberculosis
gcggcaggucggccagc

SEQ ID NO: 886340 - RNA, 18 nt, Mycobacterium avium subsp. paratuberculosis
gcggcaggucggccagcg

SEQ ID NO: 886341 - RNA, 22 nt, Mycobacterium avium subsp. paratuberculosis
gcggcaggucggccagcgccgc

SEQ ID NO: 886342 - RNA, 15 nt, Mycobacterium avium subsp. paratuberculosis
gcggcaggucggcgg

SEQ ID NO: 886343 - RNA, 16 nt, Mycobacterium avium subsp. paratuberculosis
gcggcgacagcggccu

SEQ ID NO: 886344 - RNA, 14 nt, Mycobacterium avium subsp. paratuberculosis
gcggcgacacgccg

SEQ ID NO: 886345 - RNA, 15 nt, Mycobacterium avium subsp. paratuberculosis
gcggcgacacgccga

SEQ ID NO: 886346 - RNA, 16 nt, Mycobacterium avium subsp. paratuberculosis
gcggcgacacgccgac

SEQ ID NO: 886347 - RNA, 19 nt, Mycobacterium avium subsp. paratuberculosis
gcggcgacacgccgacgau

SEQ ID NO: 886348 - RNA, 13 nt, Mycobacterium avium subsp. paratuberculosis
gcggcgacaucgc

SEQ ID NO: 886349 - RNA, 15 nt, Mycobacterium avium subsp. paratuberculosis
gcggcgaccaccacc

SEQ ID NO: 886350 - RNA, 17 nt, Mycobacterium avium subsp. paratuberculosis
gcggcgaccaccaccgc

SEQ ID NO: 886351 - RNA, 20 nt, Mycobacterium avium subsp. paratuberculosis
gcggcgaccaccaccgccca

SEQ ID NO: 886352 - RNA, 19 nt, Mycobacterium avium subsp. paratuberculosis
gcggcgaaguugcgguuga

SEQ ID NO: 886353 - RNA, 19 nt, Mycobacterium avium subsp. paratuberculosis
gcggcgaaucgguccggcg

SEQ ID NO: 886354 - RNA, 14 nt, Mycobacterium avium subsp. paratuberculosis
gcggcgacacccag

SEQ ID NO: 886355 - RNA, 15 nt, Mycobacterium avium subsp. paratuberculosis
gcggcgacacccagc

SEQ ID NO: 886356 - RNA, 19 nt, Mycobacterium avium subsp. paratuberculosis
gcggcgacacccagcggcg

SEQ ID NO: 886357 - RNA, 24 nt, Mycobacterium avium subsp. paratuberculosis
gcggcgacacccagcggcgcggcc

SEQ ID NO: 886358 - RNA, 14 nt, Mycobacterium avium subsp. paratuberculosis
gcggcgaaccgggc

SEQ ID NO: 886359 - RNA, 15 nt, Mycobacterium avium subsp. paratuberculosis
gcggcgaacgccgcc

SEQ ID NO: 886360 - RNA, 15 nt, Mycobacterium avium subsp. paratuberculosis
gcggcgaacgcgcgg

SEQ ID NO: 886361 - RNA, 17 nt, Mycobacterium avium subsp. paratuberculosis
gcggcgaacgcgcgguc

SEQ ID NO: 886362 - RNA, 16 nt, Mycobacterium avium subsp. paratuberculosis
gcggcgaaggcauccc

SEQ ID NO: 886363 - RNA, 17 nt, Mycobacterium avium subsp. paratuberculosis
gcggcgaaggcaucccg

SEQ ID NO: 886364 - RNA, 16 nt, Mycobacterium avium subsp. paratuberculosis
gcggcgaaggccagcg

SEQ ID NO: 886365 - RNA, 17 nt, Mycobacterium avium subsp. paratuberculosis
gcggcgaaggccagcga

SEQ ID NO: 886366 - RNA, 18 nt, Mycobacterium avium subsp. paratuberculosis
gcggcgaaggccagcgau

SEQ ID NO: 886367 - RNA, 19 nt, Mycobacterium avium subsp. paratuberculosis
gcggcgaaggccagcgaua

SEQ ID NO: 886368 - RNA, 16 nt, Mycobacterium avium subsp. paratuberculosis
gcggcgaagacgucgg

SEQ ID NO: 886369 - RNA, 19 nt, Mycobacterium avium subsp. paratuberculosis
gcggcgaagacgucggcgc

SEQ ID NO: 886370 - RNA, 22 nt, Mycobacterium avium subsp. paratuberculosis
gcggcgaagacgucggcgcggu

SEQ ID NO: 886371 - RNA, 15 nt, Mycobacterium avium subsp. paratuberculosis
gcggcgaagccggcc

SEQ ID NO: 886372 - RNA, 16 nt, Mycobacterium avium subsp. paratuberculosis
gcggcgaagccggccc

SEQ ID NO: 886373 - RNA, 18 nt, Mycobacterium avium subsp. paratuberculosis
gcggcgaagccggccccg

SEQ ID NO: 886374 - RNA, 17 nt, Mycobacterium avium subsp. paratuberculosis
gcggcgacuccagcagc

SEQ ID NO: 886375 - RNA, 19 nt, Mycobacterium avium subsp. paratuberculosis
gcggcgacuccagcagcgc

SEQ ID NO: 886376 - RNA, 21 nt, Mycobacterium avium subsp. paratuberculosis
gcggcgagauuggccucggcg

SEQ ID NO: 886377 - RNA, 21 nt, Mycobacterium avium subsp. paratuberculosis
gcggcgacgugaucggcggcc

SEQ ID NO: 886378 - RNA, 15 nt, Mycobacterium avium subsp. paratuberculosis
gcggcgacgugccgg

SEQ ID NO: 886379 - RNA, 16 nt, Mycobacterium avium subsp. paratuberculosis
gcggcgacgugccggc

SEQ ID NO: 886380 - RNA, 17 nt, Mycobacterium avium subsp. paratuberculosis
gcggcgacgugccggcg

SEQ ID NO: 886381 - RNA, 19 nt, Mycobacterium avium subsp. paratuberculosis
gcggcgagcugaucggcgu

SEQ ID NO: 886382 - RNA, 20 nt, Mycobacterium avium subsp. paratuberculosis
gcggcgaggaacucagcgcc

SEQ ID NO: 886383 - RNA, 22 nt, Mycobacterium avium subsp. paratuberculosis
gcggcgaggaacucagcgccca

SEQ ID NO: 886384 - RNA, 23 nt, Mycobacterium avium subsp. paratuberculosis
gcggcgaggaacucagcgcccag

SEQ ID NO: 886385 - RNA, 23 nt, Mycobacterium avium subsp. paratuberculosis
gcggcgaggacgucgucgacguc

SEQ ID NO: 886386 - RNA, 14 nt, Mycobacterium avium subsp. paratuberculosis
gcggcgagccggcc

SEQ ID NO: 886387 - RNA, 16 nt, Mycobacterium avium subsp. paratuberculosis
gcggcgagccggccgu

SEQ ID NO: 886388 - RNA, 14 nt, Mycobacterium avium subsp. paratuberculosis
gcggcgagcagcgc

SEQ ID NO: 886389 - RNA, 18 nt, Mycobacterium avium subsp. paratuberculosis
gcggcgagcagcgcgaug

SEQ ID NO: 886390 - RNA, 17 nt, Mycobacterium avium subsp. paratuberculosis
gcggcgaguucggcggc

SEQ ID NO: 886391 - RNA, 21 nt, Mycobacterium avium subsp. paratuberculosis
gcggcgaguucggcggcccgc

SEQ ID NO: 886392 - RNA, 21 nt, Mycobacterium avium subsp. paratuberculosis
gcggcgaguucugguaggcgg

SEQ ID NO: 886393 - RNA, 15 nt, Mycobacterium avium subsp. paratuberculosis
gcggcgagucccggc

SEQ ID NO: 886394 - RNA, 21 nt, Mycobacterium avium subsp. paratuberculosis
gcggcgagucccggcgcacca

SEQ ID NO: 886395 - RNA, 15 nt, Mycobacterium avium subsp. paratuberculosis
gcggcgaguccggcc

SEQ ID NO: 886396 - RNA, 23 nt, Mycobacterium avium subsp. paratuberculosis
gcggcgaguccggccaggucgcc

SEQ ID NO: 886397 - RNA, 12 nt, Mycobacterium avium subsp. paratuberculosis
gcggcgaucacc

SEQ ID NO: 886398 - RNA, 16 nt, Mycobacterium avium subsp. paratuberculosis
gcggcgacggccgucc

SEQ ID NO: 886399 - RNA, 13 nt, Mycobacterium avium subsp. paratuberculosis
gcggcgacggcga

SEQ ID NO: 886400 - RNA, 15 nt, Mycobacterium avium subsp. paratuberculosis
gcggcgacggcgacg

SEQ ID NO: 886401 - RNA, 15 nt, Mycobacterium avium subsp. paratuberculosis
gcggcgacggcgucg

SEQ ID NO: 886402 - RNA, 20 nt, Mycobacterium avium subsp. paratuberculosis
gcggcgacggcgucggcggc

SEQ ID NO: 886403 - RNA, 16 nt, Mycobacterium avium subsp. paratuberculosis
gcggcgacgguggcgg

SEQ ID NO: 886404 - RNA, 12 nt, Mycobacterium avium subsp. paratuberculosis
gcggcgacgucg

SEQ ID NO: 886405 - RNA, 14 nt, Mycobacterium avium subsp. paratuberculosis
gcggcgacgucgac

SEQ ID NO: 886406 - RNA, 22 nt, Mycobacterium avium subsp. paratuberculosis
gcggcgacgucgacggcagcgc

SEQ ID NO: 886407 - RNA, 14 nt, Mycobacterium avium subsp. paratuberculosis
gcggcgacgucgug

SEQ ID NO: 886408 - RNA, 16 nt, Mycobacterium avium subsp. paratuberculosis
gcggcgacgucgugca

SEQ ID NO: 886409 - RNA, 20 nt, Mycobacterium avium subsp. paratuberculosis
gcggcgacgucgugcacgcc

SEQ ID NO: 886410 - RNA, 21 nt, Mycobacterium avium subsp. paratuberculosis
gcggcgacgucguggcccgga

SEQ ID NO: 886411 - RNA, 15 nt, Mycobacterium avium subsp. paratuberculosis
gcggcgacgaucggc

SEQ ID NO: 886412 - RNA, 16 nt, Mycobacterium avium subsp. paratuberculosis
gcggcgacgaucggcu

SEQ ID NO: 886413 - RNA, 18 nt, Mycobacterium avium subsp. paratuberculosis
gcggcgacgaucggcucg

SEQ ID NO: 886414 - RNA, 21 nt, Mycobacterium avium subsp. paratuberculosis
gcggcgaccuguuuggccagc

SEQ ID NO: 886415 - RNA, 20 nt, Mycobacterium avium subsp. paratuberculosis
gcggcgaccuugcggcgcga

SEQ ID NO: 886416 - RNA, 21 nt, Mycobacterium avium subsp. paratuberculosis
gcggcgaccuugcggcgcgau

SEQ ID NO: 886417 - RNA, 17 nt, Mycobacterium avium subsp. paratuberculosis
gcggcgacgaacgccgg

SEQ ID NO: 886418 - RNA, 24 nt, Mycobacterium avium subsp. paratuberculosis
gcggcgacgaacgccggcaucagc

SEQ ID NO: 886419 - RNA, 14 nt, Mycobacterium avium subsp. paratuberculosis
gcggcgaccggggc

SEQ ID NO: 886420 - RNA, 16 nt, Mycobacterium avium subsp. paratuberculosis
gcggcgaccggggcgg

SEQ ID NO: 886421 - RNA, 13 nt, Mycobacterium avium subsp. paratuberculosis
gcggcgaccgcga

SEQ ID NO: 886422 - RNA, 19 nt, Mycobacterium avium subsp. paratuberculosis
gcggcgaccgcgacgauca

SEQ ID NO: 886423 - RNA, 18 nt, Mycobacterium avium subsp. paratuberculosis
gcggcgacccgcuucgcc

SEQ ID NO: 886424 - RNA, 19 nt, Mycobacterium avium subsp. paratuberculosis
gcggcgacccgcuucgccc

SEQ ID NO: 886425 - RNA, 20 nt, Mycobacterium avium subsp. paratuberculosis
gcggcgacccgcuucgcccg

SEQ ID NO: 886426 - RNA, 13 nt, Mycobacterium avium subsp. paratuberculosis
gcggcgacccgga

SEQ ID NO: 886427 - RNA, 13 nt, Mycobacterium avium subsp. paratuberculosis
gcggcgaccaccu

SEQ ID NO: 886428 - RNA, 20 nt, Mycobacterium avium subsp. paratuberculosis
gcggcgaccaccucggcgac

SEQ ID NO: 886429 - RNA, 22 nt, Mycobacterium avium subsp. paratuberculosis
gcggcgaccaccucggcgacga

SEQ ID NO: 886430 - RNA, 21 nt, Mycobacterium avium subsp. paratuberculosis
gcggcgaccacgaacaccggc

SEQ ID NO: 886431 - RNA, 17 nt, Mycobacterium avium subsp. paratuberculosis
gcggcagauggucucga

SEQ ID NO: 886432 - RNA, 18 nt, Mycobacterium avium subsp. paratuberculosis
gcggcacggugcgggugc

SEQ ID NO: 886433 - RNA, 22 nt, Mycobacterium avium subsp. paratuberculosis
gcggcacggugcgggugccgaa

SEQ ID NO: 886434 - RNA, 16 nt, Mycobacterium avium subsp. paratuberculosis
gcggcacgguuggccg

SEQ ID NO: 886435 - RNA, 19 nt, Mycobacterium avium subsp. paratuberculosis
gcggcacgguuggccggcc

SEQ ID NO: 886436 - RNA, 19 nt, Mycobacterium avium subsp. paratuberculosis
gcggcacgcugcgccagcc

SEQ ID NO: 886437 - RNA, 20 nt, Mycobacterium avium subsp. paratuberculosis
gcggcacgcugcgccagccg

SEQ ID NO: 886438 - RNA, 21 nt, Mycobacterium avium subsp. paratuberculosis
gcggcagccagccuggcggcg

SEQ ID NO: 886439 - RNA, 15 nt, Mycobacterium avium subsp. paratuberculosis
gcggcagccaggcgu

SEQ ID NO: 886440 - RNA, 14 nt, Mycobacterium avium subsp. paratuberculosis
gcggcagccacggc

SEQ ID NO: 886441 - RNA, 15 nt, Mycobacterium avium subsp. paratuberculosis
gcggcagccacggca

SEQ ID NO: 886442 - RNA, 21 nt, Mycobacterium avium subsp. paratuberculosis
gcggcagcagcccgucccggc

SEQ ID NO: 886443 - RNA, 20 nt, Mycobacterium avium subsp. paratuberculosis
gcggcagcagcugcgucggc

SEQ ID NO: 886444 - RNA, 23 nt, Mycobacterium avium subsp. paratuberculosis
gcggcagcacaccuuccaccacc

SEQ ID NO: 886445 - RNA, 12 nt, Mycobacterium avium subsp. paratuberculosis
gcggcagcacgu

SEQ ID NO: 886446 - RNA, 13 nt, Mycobacterium avium subsp. paratuberculosis
gcggcagcacguc

SEQ ID NO: 886447 - RNA, 18 nt, Mycobacterium avium subsp. paratuberculosis
gcggcagcacguccccgg

SEQ ID NO: 886448 - RNA, 14 nt, Mycobacterium avium subsp. paratuberculosis
gcggcagcagcacc

SEQ ID NO: 886449 - RNA, 15 nt, Mycobacterium avium subsp. paratuberculosis
gcggcagcagcacca

SEQ ID NO: 886450 - RNA, 17 nt, Mycobacterium avium subsp. paratuberculosis
gcggcagcagcaccagc

SEQ ID NO: 886451 - RNA, 19 nt, Mycobacterium avium subsp. paratuberculosis
gcggcagcagcaccagcgu

SEQ ID NO: 886452 - RNA, 20 nt, Mycobacterium avium subsp. paratuberculosis
gcggcagcagcaccagcgug

SEQ ID NO: 886453 - RNA, 22 nt, Mycobacterium avium subsp. paratuberculosis
gcggcagcagcaccagcguggc

SEQ ID NO: 886454 - RNA, 23 nt, Mycobacterium avium subsp. paratuberculosis
gcggcagccuuuccacaucugcu

SEQ ID NO: 886455 - RNA, 17 nt, Mycobacterium avium subsp. paratuberculosis
gcggcagcgacagcgcg

SEQ ID NO: 886456 - RNA, 14 nt, Mycobacterium avium subsp. paratuberculosis
gcggcagcgaggcg

SEQ ID NO: 886457 - RNA, 18 nt, Mycobacterium avium subsp. paratuberculosis
gcggcagcgaggcgcgca

SEQ ID NO: 886458 - RNA, 19 nt, Mycobacterium avium subsp. paratuberculosis
gcggcagcgaggcgcgcag

SEQ ID NO: 886459 - RNA, 20 nt, Mycobacterium avium subsp. paratuberculosis
gcggcagcgaggcgcgcagg

SEQ ID NO: 886460 - RNA, 14 nt, Mycobacterium avium subsp. paratuberculosis
gcggcagccgggcg

SEQ ID NO: 886461 - RNA, 14 nt, Mycobacterium avium subsp. paratuberculosis
gcggcagcgccagc

SEQ ID NO: 886462 - RNA, 19 nt, Mycobacterium avium subsp. paratuberculosis
gcggcagcgcgcccugagg

SEQ ID NO: 886463 - RNA, 14 nt, Mycobacterium avium subsp. paratuberculosis
gcggcagcucggcg

SEQ ID NO: 886464 - RNA, 23 nt, Mycobacterium avium subsp. paratuberculosis
gcggcaggaaccgggucagcacc

SEQ ID NO: 886465 - RNA, 17 nt, Mycobacterium avium subsp. paratuberculosis
gcggcaggaauuccagc

SEQ ID NO: 886466 - RNA, 19 nt, Mycobacterium avium subsp. paratuberculosis
gcggcaggaauuccagcga

SEQ ID NO: 886467 - RNA, 22 nt, Mycobacterium avium subsp. paratuberculosis
gcggcaggaauuccagcgacaa

SEQ ID NO: 886468 - RNA, 17 nt, Mycobacterium avium subsp. paratuberculosis
gcggcagcucggcggcc

SEQ ID NO: 886469 - RNA, 18 nt, Mycobacterium avium subsp. paratuberculosis
gcggcagcucggcggccc

SEQ ID NO: 886470 - RNA, 18 nt, Mycobacterium avium subsp. paratuberculosis
gcggcagcgucgccagcc

SEQ ID NO: 886471 - RNA, 16 nt, Mycobacterium avium subsp. paratuberculosis
gcggcaccaacccgau

SEQ ID NO: 886472 - RNA, 16 nt, Mycobacterium avium subsp. paratuberculosis
gcggcaccaccagcgu

SEQ ID NO: 886473 - RNA, 17 nt, Mycobacterium avium subsp. paratuberculosis
gcggcaccaccagcgug

SEQ ID NO: 886474 - RNA, 14 nt, Mycobacterium avium subsp. paratuberculosis
gcggcacaggcgaa

SEQ ID NO: 886475 - RNA, 21 nt, Mycobacterium avium subsp. paratuberculosis
gcggcacaggcgaaucggcgc

SEQ ID NO: 886476 - RNA, 14 nt, Mycobacterium avium subsp. paratuberculosis
gcggcaccacccgc

SEQ ID NO: 886477 - RNA, 22 nt, Mycobacterium avium subsp. paratuberculosis
gcggcaccacccgcggccggcc

SEQ ID NO: 886478 - RNA, 23 nt, Mycobacterium avium subsp. paratuberculosis
gcggcaccacccgcggccggccc

SEQ ID NO: 886479 - RNA, 18 nt, Mycobacterium avium subsp. paratuberculosis
gcggcaccacgcugugcu

SEQ ID NO: 886480 - RNA, 21 nt, Mycobacterium avium subsp. paratuberculosis
gcggcaccacgcugugcucga

SEQ ID NO: 886481 - RNA, 13 nt, Mycobacterium avium subsp. paratuberculosis
gcggcaccaggua

SEQ ID NO: 886482 - RNA, 22 nt, Mycobacterium avium subsp. paratuberculosis
gcggcaccagguucacgucggg

SEQ ID NO: 886483 - RNA, 16 nt, Mycobacterium avium subsp. paratuberculosis
gcggcaccagucgcgc

SEQ ID NO: 886484 - RNA, 19 nt, Mycobacterium avium subsp. paratuberculosis
gcggcaccagucgcgcagc

SEQ ID NO: 886485 - RNA, 15 nt, Mycobacterium avium subsp. paratuberculosis
gcggcaccagcccgc

SEQ ID NO: 886486 - RNA, 17 nt, Mycobacterium avium subsp. paratuberculosis
gcggcaccagcccgccg

SEQ ID NO: 886487 - RNA, 18 nt, Mycobacterium avium subsp. paratuberculosis
gcggcacccgguccggcc

SEQ ID NO: 886488 - RNA, 19 nt, Mycobacterium avium subsp. paratuberculosis
gcggcacccgguccggccc

SEQ ID NO: 886489 - RNA, 15 nt, Mycobacterium avium subsp. paratuberculosis
gcggcaccgaucggc

SEQ ID NO: 886490 - RNA, 14 nt, Mycobacterium avium subsp. paratuberculosis
gcggcaccgccgcg

SEQ ID NO: 886491 - RNA, 15 nt, Mycobacterium avium subsp. paratuberculosis
gcggcaccgccgcgg

SEQ ID NO: 886492 - RNA, 17 nt, Mycobacterium avium subsp. paratuberculosis
gcggcaccgccgcggug

SEQ ID NO: 886493 - RNA, 18 nt, Mycobacterium avium subsp. paratuberculosis
gcggcaccgccgcggugg

SEQ ID NO: 886494 - RNA, 21 nt, Mycobacterium avium subsp. paratuberculosis
gcggcaccgccgcgguggguc

SEQ ID NO: 886495 - RNA, 13 nt, Mycobacterium avium subsp. paratuberculosis
gcggcaccgccau

SEQ ID NO: 886496 - RNA, 21 nt, Mycobacterium avium subsp. paratuberculosis
gcggcaccgccaucggcaucg

SEQ ID NO: 886497 - RNA, 22 nt, Mycobacterium avium subsp. paratuberculosis
gcggcaccgccaucggcaucgc

SEQ ID NO: 886498 - RNA, 13 nt, Mycobacterium avium subsp. paratuberculosis
gcggcaccgcccg

SEQ ID NO: 886499 - RNA, 12 nt, Mycobacterium avium subsp. paratuberculosis
gcggcaccgccg

SEQ ID NO: 886500 - RNA, 13 nt, Mycobacterium avium subsp. paratuberculosis
gcggcaccgccgc

SEQ ID NO: 886501 - RNA, 13 nt, Mycobacterium avium subsp. paratuberculosis
gcggcacgccgcu

SEQ ID NO: 886502 - RNA, 17 nt, Mycobacterium avium subsp. paratuberculosis
gcggcacgccgcucguc

SEQ ID NO: 886503 - RNA, 19 nt, Mycobacterium avium subsp. paratuberculosis
gcggcacgccgcucgucgg

SEQ ID NO: 886504 - RNA, 16 nt, Mycobacterium avium subsp. paratuberculosis
gcggcacgcgucaccg

SEQ ID NO: 886505 - RNA, 16 nt, Mycobacterium avium subsp. paratuberculosis
gcggcacgggcaccga

SEQ ID NO: 886506 - RNA, 19 nt, Mycobacterium avium subsp. paratuberculosis
gcggcacgggcaccgacga

SEQ ID NO: 886507 - RNA, 13 nt, Mycobacterium avium subsp. paratuberculosis
gcggcacgggccg

SEQ ID NO: 886508 - RNA, 14 nt, Mycobacterium avium subsp. paratuberculosis
gcggcacgccgacc

SEQ ID NO: 886509 - RNA, 15 nt, Mycobacterium avium subsp. paratuberculosis
gcggcacgccgacca

SEQ ID NO: 886510 - RNA, 19 nt, Mycobacterium avium subsp. paratuberculosis
gcggcacgccgaccacccc

SEQ ID NO: 886511 - RNA, 22 nt, Mycobacterium avium subsp. paratuberculosis
gcggcacgccgaccacccccag

SEQ ID NO: 886512 - RNA, 19 nt, Mycobacterium avium subsp. paratuberculosis
gcggcacgaucucgaccag

SEQ ID NO: 886513 - RNA, 18 nt, Mycobacterium avium subsp. paratuberculosis
gcggcacgaucggcagcg

SEQ ID NO: 886514 - RNA, 15 nt, Mycobacterium avium subsp. paratuberculosis
gcggcacgaucggca

SEQ ID NO: 886515 - RNA, 13 nt, Mycobacterium avium subsp. paratuberculosis
gcggcaccucggc

SEQ ID NO: 886516 - RNA, 18 nt, Mycobacterium avium subsp. paratuberculosis
gcggcaccuucaccgacc

SEQ ID NO: 886517 - RNA, 20 nt, Mycobacterium avium subsp. paratuberculosis
gcggcaccuucaccgaccag

SEQ ID NO: 886518 - RNA, 22 nt, Mycobacterium avium subsp. paratuberculosis
gcggcaccuucaccgaccagcu

SEQ ID NO: 886519 - RNA, 15 nt, Mycobacterium avium subsp. paratuberculosis
gcggcaccucggccu

SEQ ID NO: 886520 - RNA, 21 nt, Mycobacterium avium subsp. paratuberculosis
gcggcaccucggccuugacca

SEQ ID NO: 886521 - RNA, 16 nt, Mycobacterium avium subsp. paratuberculosis
gcggcaccgcggcucg

SEQ ID NO: 886522 - RNA, 20 nt, Mycobacterium avium subsp. paratuberculosis
gcggcaccgcggcucggucg

SEQ ID NO: 886523 - RNA, 22 nt, Mycobacterium avium subsp. paratuberculosis
gcggcaccgcggcucggucgcg

SEQ ID NO: 886524 - RNA, 13 nt, Mycobacterium avium subsp. paratuberculosis
gcggcaccgcugc

SEQ ID NO: 886525 - RNA, 16 nt, Mycobacterium avium subsp. paratuberculosis
gcggcaccgcugccgg

SEQ ID NO: 886526 - RNA, 17 nt, Mycobacterium avium subsp. paratuberculosis
gcggcaccgcugccggc

SEQ ID NO: 886527 - RNA, 21 nt, Mycobacterium avium subsp. paratuberculosis
gcggcaccgcugccggccgaa

SEQ ID NO: 886528 - RNA, 12 nt, Mycobacterium avium subsp. paratuberculosis
gcggcaccgcca

SEQ ID NO: 886529 - RNA, 18 nt, Mycobacterium avium subsp. paratuberculosis
gcggcaccgucaccgacg

SEQ ID NO: 886530 - RNA, 21 nt, Mycobacterium avium subsp. paratuberculosis
gcggcaccgucaccgacggcu

SEQ ID NO: 886531 - RNA, 15 nt, Mycobacterium avium subsp. paratuberculosis
gcggcaccuccagcc

SEQ ID NO: 886532 - RNA, 17 nt, Mycobacterium avium subsp. paratuberculosis
gcggcaccuccagcccg

SEQ ID NO: 886533 - RNA, 20 nt, Mycobacterium avium subsp. paratuberculosis
gcggcaccuccagcccggcg

SEQ ID NO: 886534 - RNA, 23 nt, Mycobacterium avium subsp. paratuberculosis
gcggcaccuccagcccggcgaug

SEQ ID NO: 886535 - RNA, 16 nt, Mycobacterium avium subsp. paratuberculosis
gcggcaacggccauga

SEQ ID NO: 886536 - RNA, 15 nt, Mycobacterium avium subsp. paratuberculosis
gcggcaacggguugc

SEQ ID NO: 886537 - RNA, 17 nt, Mycobacterium avium subsp. paratuberculosis
gcggcaacugggcggcc

SEQ ID NO: 886538 - RNA, 18 nt, Mycobacterium avium subsp. paratuberculosis
gcggcaacugggcggccu

SEQ ID NO: 886539 - RNA, 21 nt, Mycobacterium avium subsp. paratuberculosis
gcggcaacugggcggccugca

SEQ ID NO: 886540 - RNA, 14 nt, Mycobacterium avium subsp. paratuberculosis
gcggcacaccagcg

SEQ ID NO: 886541 - RNA, 20 nt, Mycobacterium avium subsp. paratuberculosis
gcggcacaccagcguucguc

SEQ ID NO: 886542 - RNA, 20 nt, Mycobacterium avium subsp. paratuberculosis
gcggcaauugaauucgacca

SEQ ID NO: 886543 - RNA, 12 nt, Mycobacterium avium subsp. paratuberculosis
gcggcacaccgc

SEQ ID NO: 886544 - RNA, 13 nt, Mycobacterium avium subsp. paratuberculosis
gcggcacaccgcg

SEQ ID NO: 886545 - RNA, 14 nt, Mycobacterium avium subsp. paratuberculosis
gcggcacaccgcgc

SEQ ID NO: 886546 - RNA, 17 nt, Mycobacterium avium subsp. paratuberculosis
gcggcacaccgcgcgaa

SEQ ID NO: 886547 - RNA, 19 nt, Mycobacterium avium subsp. paratuberculosis
gcggcacaccgcgcgaacg

SEQ ID NO: 886548 - RNA, 23 nt, Mycobacterium avium subsp. paratuberculosis
gcggcaaccagcuccggcaacga

SEQ ID NO: 886549 - RNA, 12 nt, Mycobacterium avium subsp. paratuberculosis
gcggcaacccga

SEQ ID NO: 886550 - RNA, 18 nt, Mycobacterium avium subsp. paratuberculosis
gcggcaacccgaucgccg

SEQ ID NO: 886551 - RNA, 14 nt, Mycobacterium avium subsp. paratuberculosis
gcggcaacacgccg

SEQ ID NO: 886552 - RNA, 15 nt, Mycobacterium avium subsp. paratuberculosis
gcggcaacacgccgg

SEQ ID NO: 886553 - RNA, 16 nt, Mycobacterium avium subsp. paratuberculosis
gcggcaacacgccggc

SEQ ID NO: 886554 - RNA, 17 nt, Mycobacterium avium subsp. paratuberculosis
gcggcaacacgccggcg

SEQ ID NO: 886555 - RNA, 20 nt, Mycobacterium avium subsp. paratuberculosis
gcggcaacacgccggcggcc

SEQ ID NO: 886556 - RNA, 16 nt, Mycobacterium avium subsp. paratuberculosis
gcggcaacagcaccag

SEQ ID NO: 886557 - RNA, 19 nt, Mycobacterium avium subsp. paratuberculosis
gcggcaacagcaccagcac

SEQ ID NO: 886558 - RNA, 21 nt, Mycobacterium avium subsp. paratuberculosis
gcggcaaagcguugccgcgcg

SEQ ID NO: 886559 - RNA, 17 nt, Mycobacterium avium subsp. paratuberculosis
gcggcaaagggcuaggu

SEQ ID NO: 886560 - RNA, 18 nt, Mycobacterium avium subsp. paratuberculosis
gcggcaaaacgcugggcg

SEQ ID NO: 886561 - RNA, 14 nt, Mycobacterium avium subsp. paratuberculosis
gcggauuggucggg

SEQ ID NO: 886562 - RNA, 20 nt, Mycobacterium avium subsp. paratuberculosis
gcggauuggucgggcacagc

SEQ ID NO: 886563 - RNA, 16 nt, Mycobacterium avium subsp. paratuberculosis
gcggauuggugccgau

SEQ ID NO: 886564 - RNA, 20 nt, Mycobacterium avium subsp. paratuberculosis
gcggauuggugccgaucacc

SEQ ID NO: 886565 - RNA, 17 nt, Mycobacterium avium subsp. paratuberculosis
gcggaucgucaccgacc

SEQ ID NO: 886566 - RNA, 17 nt, Mycobacterium avium subsp. paratuberculosis
gcggaucgggcguggcg

SEQ ID NO: 886567 - RNA, 15 nt, Mycobacterium avium subsp. paratuberculosis
gcggaucggugcagg

SEQ ID NO: 886568 - RNA, 19 nt, Mycobacterium avium subsp. paratuberculosis
gcggaucggugcaggccgc

SEQ ID NO: 886569 - RNA, 21 nt, Mycobacterium avium subsp. paratuberculosis
gcggaucggugcaggccgcga

SEQ ID NO: 886570 - RNA, 24 nt, Mycobacterium avium subsp. paratuberculosis
gcggaucggugcaggccgcgacgg

SEQ ID NO: 886571 - RNA, 19 nt, Mycobacterium avium subsp. paratuberculosis
gcggaucgguggacgcggu

SEQ ID NO: 886572 - RNA, 24 nt, Mycobacterium avium subsp. paratuberculosis
gcggaucggcccgaucucgcgcgg

SEQ ID NO: 886573 - RNA, 21 nt, Mycobacterium avium subsp. paratuberculosis
gcggaucgcguaguccagcac

SEQ ID NO: 886574 - RNA, 20 nt, Mycobacterium avium subsp. paratuberculosis
gcggaucggcggcgacggcg

SEQ ID NO: 886575 - RNA, 16 nt, Mycobacterium avium subsp. paratuberculosis
gcggaucgcgcugacc

SEQ ID NO: 886576 - RNA, 22 nt, Mycobacterium avium subsp. paratuberculosis
gcggaucgcgcugaccaggccg

SEQ ID NO: 886577 - RNA, 13 nt, Mycobacterium avium subsp. paratuberculosis
gcggaucgcgcug

SEQ ID NO: 886578 - RNA, 21 nt, Mycobacterium avium subsp. paratuberculosis
gcggaucuucuccgccacauc

SEQ ID NO: 886579 - RNA, 13 nt, Mycobacterium avium subsp. paratuberculosis
gcggaucucgacc

SEQ ID NO: 886580 - RNA, 23 nt, Mycobacterium avium subsp. paratuberculosis
gcggaucucgaccucgucggcgg

SEQ ID NO: 886581 - RNA, 14 nt, Mycobacterium avium subsp. paratuberculosis
gcggaugaccaggu

SEQ ID NO: 886582 - RNA, 19 nt, Mycobacterium avium subsp. paratuberculosis
gcggaugaccaggucgccg

SEQ ID NO: 886583 - RNA, 20 nt, Mycobacterium avium subsp. paratuberculosis
gcggaugaccaggucgccgg

SEQ ID NO: 886584 - RNA, 23 nt, Mycobacterium avium subsp. paratuberculosis
gcggaugacgggugcucagguug

SEQ ID NO: 886585 - RNA, 19 nt, Mycobacterium avium subsp. paratuberculosis
gcggaugacgugcaccacc

SEQ ID NO: 886586 - RNA, 20 nt, Mycobacterium avium subsp. paratuberculosis
gcggaucucggugagcagaa

SEQ ID NO: 886587 - RNA, 17 nt, Mycobacterium avium subsp. paratuberculosis
gcggauggccucggcga

SEQ ID NO: 886588 - RNA, 18 nt, Mycobacterium avium subsp. paratuberculosis
gcggauggccucggcgau

SEQ ID NO: 886589 - RNA, 16 nt, Mycobacterium avium subsp. paratuberculosis
gcggauggcgacggcg

SEQ ID NO: 886590 - RNA, 18 nt, Mycobacterium avium subsp. paratuberculosis
gcggauggcgacggcgac

SEQ ID NO: 886591 - RNA, 14 nt, Mycobacterium avium subsp. paratuberculosis
gcggauggcgcccu

SEQ ID NO: 886592 - RNA, 19 nt, Mycobacterium avium subsp. paratuberculosis
gcggaugcccaggccggcg

SEQ ID NO: 886593 - RNA, 20 nt, Mycobacterium avium subsp. paratuberculosis
gcggaugcccaggccggcga

SEQ ID NO: 886594 - RNA, 14 nt, Mycobacterium avium subsp. paratuberculosis
gcggaugcccgccg

SEQ ID NO: 886595 - RNA, 15 nt, Mycobacterium avium subsp. paratuberculosis
gcggaugcccgccgg

SEQ ID NO: 886596 - RNA, 19 nt, Mycobacterium avium subsp. paratuberculosis
gcggaugcccgccggcguc

SEQ ID NO: 886597 - RNA, 20 nt, Mycobacterium avium subsp. paratuberculosis
gcggaugcccgccggcgucu

SEQ ID NO: 886598 - RNA, 16 nt, Mycobacterium avium subsp. paratuberculosis
gcggaugaugguggcc

SEQ ID NO: 886599 - RNA, 17 nt, Mycobacterium avium subsp. paratuberculosis
gcggaugaugguggcca

SEQ ID NO: 886600 - RNA, 20 nt, Mycobacterium avium subsp. paratuberculosis
gcggauucucgcucugccgg

SEQ ID NO: 886601 - RNA, 14 nt, Mycobacterium avium subsp. paratuberculosis
gcggauugaccagc

SEQ ID NO: 886602 - RNA, 18 nt, Mycobacterium avium subsp. paratuberculosis
gcggauugaccagcacgu

SEQ ID NO: 886603 - RNA, 21 nt, Mycobacterium avium subsp. paratuberculosis
gcggauuccagcgcgaccgcc

SEQ ID NO: 886604 - RNA, 14 nt, Mycobacterium avium subsp. paratuberculosis
gcggauguccgacc

SEQ ID NO: 886605 - RNA, 15 nt, Mycobacterium avium subsp. paratuberculosis
gcggauguccgaccg

SEQ ID NO: 886606 - RNA, 14 nt, Mycobacterium avium subsp. paratuberculosis
gcggaugucggugu

SEQ ID NO: 886607 - RNA, 19 nt, Mycobacterium avium subsp. paratuberculosis
gcggacggguugggcgcca

SEQ ID NO: 886608 - RNA, 21 nt, Mycobacterium avium subsp. paratuberculosis
gcggacggguugggcgccagc

SEQ ID NO: 886609 - RNA, 22 nt, Mycobacterium avium subsp. paratuberculosis
gcggacggguugggcgccagca

SEQ ID NO: 886610 - RNA, 20 nt, Mycobacterium avium subsp. paratuberculosis
gcggacggucgccgacguag

SEQ ID NO: 886611 - RNA, 21 nt, Mycobacterium avium subsp. paratuberculosis
gcggacuggcugagcagcacc

SEQ ID NO: 886612 - RNA, 13 nt, Mycobacterium avium subsp. paratuberculosis
gcggacucggcga

SEQ ID NO: 886613 - RNA, 17 nt, Mycobacterium avium subsp. paratuberculosis
gcggacugcccgaccgc

SEQ ID NO: 886614 - RNA, 20 nt, Mycobacterium avium subsp. paratuberculosis
gcggacugcccgaccgcgcc

SEQ ID NO: 886615 - RNA, 21 nt, Mycobacterium avium subsp. paratuberculosis
gcggacugcccgaccgcgccg

SEQ ID NO: 886616 - RNA, 14 nt, Mycobacterium avium subsp. paratuberculosis
gcggacgggccgca

SEQ ID NO: 886617 - RNA, 18 nt, Mycobacterium avium subsp. paratuberculosis
gcggacgggccgcauccg

SEQ ID NO: 886618 - RNA, 22 nt, Mycobacterium avium subsp. paratuberculosis
gcggacggaucgagucccgcgc

SEQ ID NO: 886619 - RNA, 23 nt, Mycobacterium avium subsp. paratuberculosis
gcggacggaucgagucccgcgcg

SEQ ID NO: 886620 - RNA, 15 nt, Mycobacterium avium subsp. paratuberculosis
gcggacgggaccacc

SEQ ID NO: 886621 - RNA, 14 nt, Mycobacterium avium subsp. paratuberculosis
gcggacggccagcc

SEQ ID NO: 886622 - RNA, 21 nt, Mycobacterium avium subsp. paratuberculosis
gcggacggccagcccgucggg

SEQ ID NO: 886623 - RNA, 22 nt, Mycobacterium avium subsp. paratuberculosis
gcggacggcgaacuuggccgac

SEQ ID NO: 886624 - RNA, 18 nt, Mycobacterium avium subsp. paratuberculosis
gcggacgauguccgccgg

SEQ ID NO: 886625 - RNA, 13 nt, Mycobacterium avium subsp. paratuberculosis
gcggacgcggcca

SEQ ID NO: 886626 - RNA, 15 nt, Mycobacterium avium subsp. paratuberculosis
gcggacgcggccagc

SEQ ID NO: 886627 - RNA, 20 nt, Mycobacterium avium subsp. paratuberculosis
gcggacgcggccagcgcccg

SEQ ID NO: 886628 - RNA, 14 nt, Mycobacterium avium subsp. paratuberculosis
gcggacgcggcgga

SEQ ID NO: 886629 - RNA, 13 nt, Mycobacterium avium subsp. paratuberculosis
gcggacgcguuga

SEQ ID NO: 886630 - RNA, 17 nt, Mycobacterium avium subsp. paratuberculosis
gcggacuggugggcguc

SEQ ID NO: 886631 - RNA, 19 nt, Mycobacterium avium subsp. paratuberculosis
gcggacuggugggcgucgu

SEQ ID NO: 886632 - RNA, 17 nt, Mycobacterium avium subsp. paratuberculosis
gcggagaaggugucgca

SEQ ID NO: 886633 - RNA, 15 nt, Mycobacterium avium subsp. paratuberculosis
gcggagccggccgcc

SEQ ID NO: 886634 - RNA, 16 nt, Mycobacterium avium subsp. paratuberculosis
gcggagccggccgccg

SEQ ID NO: 886635 - RNA, 23 nt, Mycobacterium avium subsp. paratuberculosis
gcggagaugcuggugacgccgcu

SEQ ID NO: 886636 - RNA, 22 nt, Mycobacterium avium subsp. paratuberculosis
gcggagaugguggucaccacca

SEQ ID NO: 886637 - RNA, 16 nt, Mycobacterium avium subsp. paratuberculosis
gcggaggucagcggcc

SEQ ID NO: 886638 - RNA, 21 nt, Mycobacterium avium subsp. paratuberculosis
gcggaggucauggcgaccgcg

SEQ ID NO: 886639 - RNA, 20 nt, Mycobacterium avium subsp. paratuberculosis
gcggaggcgagcagccgggu

SEQ ID NO: 886640 - RNA, 22 nt, Mycobacterium avium subsp. paratuberculosis
gcggaggcgagcagccgggugc

SEQ ID NO: 886641 - RNA, 15 nt, Mycobacterium avium subsp. paratuberculosis
gcggagcgucgcgau

SEQ ID NO: 886642 - RNA, 22 nt, Mycobacterium avium subsp. paratuberculosis
gcggaggaguuuuucggggugg

SEQ ID NO: 886643 - RNA, 18 nt, Mycobacterium avium subsp. paratuberculosis
gcggaggaugccggccag

SEQ ID NO: 886644 - RNA, 16 nt, Mycobacterium avium subsp. paratuberculosis
gcggaggccugcgcgg

SEQ ID NO: 886645 - RNA, 19 nt, Mycobacterium avium subsp. paratuberculosis
gcggaggccugcgcggccg

SEQ ID NO: 886646 - RNA, 20 nt, Mycobacterium avium subsp. paratuberculosis
gcggaucacaucggacaucg

SEQ ID NO: 886647 - RNA, 15 nt, Mycobacterium avium subsp. paratuberculosis
gcggaucaggucggu

SEQ ID NO: 886648 - RNA, 18 nt, Mycobacterium avium subsp. paratuberculosis
gcggaucaguaccggcga

SEQ ID NO: 886649 - RNA, 21 nt, Mycobacterium avium subsp. paratuberculosis
gcggaucaguaccggcgaugc

SEQ ID NO: 886650 - RNA, 13 nt, Mycobacterium avium subsp. paratuberculosis
gcggaucagcacc

SEQ ID NO: 886651 - RNA, 17 nt, Mycobacterium avium subsp. paratuberculosis
gcggaucagcaccgacg

SEQ ID NO: 886652 - RNA, 21 nt, Mycobacterium avium subsp. paratuberculosis
gcggaucagcaggaccgggau

SEQ ID NO: 886653 - RNA, 16 nt, Mycobacterium avium subsp. paratuberculosis
gcggauccccgcgcug

SEQ ID NO: 886654 - RNA, 21 nt, Mycobacterium avium subsp. paratuberculosis
gcggauccgcagcugaucggg

SEQ ID NO: 886655 - RNA, 14 nt, Mycobacterium avium subsp. paratuberculosis
gcggauccgcgugg

SEQ ID NO: 886656 - RNA, 15 nt, Mycobacterium avium subsp. paratuberculosis
gcggauccgcguggc

SEQ ID NO: 886657 - RNA, 23 nt, Mycobacterium avium subsp. paratuberculosis
gcggauccgggccggcgucgcgg

SEQ ID NO: 886658 - RNA, 18 nt, Mycobacterium avium subsp. paratuberculosis
gcggauccucaguccgcc

SEQ ID NO: 886659 - RNA, 20 nt, Mycobacterium avium subsp. paratuberculosis
gcggaucgaacagggcggcg

SEQ ID NO: 886660 - RNA, 21 nt, Mycobacterium avium subsp. paratuberculosis
gcggaucgagguagcgugcgc

SEQ ID NO: 886661 - RNA, 23 nt, Mycobacterium avium subsp. paratuberculosis
gcggagucguagucgaugcccgc

SEQ ID NO: 886662 - RNA, 15 nt, Mycobacterium avium subsp. paratuberculosis
gcggagugaccgcca

SEQ ID NO: 886663 - RNA, 20 nt, Mycobacterium avium subsp. paratuberculosis
gcggagugaccgccagcacc

SEQ ID NO: 886664 - RNA, 21 nt, Mycobacterium avium subsp. paratuberculosis
gcggagugaccgccagcaccg

SEQ ID NO: 886665 - RNA, 22 nt, Mycobacterium avium subsp. paratuberculosis
gcggagugaccgccagcaccgc

SEQ ID NO: 886666 - RNA, 23 nt, Mycobacterium avium subsp. paratuberculosis
gcggagugaccgccagcaccgcg

SEQ ID NO: 886667 - RNA, 16 nt, Mycobacterium avium subsp. paratuberculosis
gcggauagaggcggcg

SEQ ID NO: 886668 - RNA, 15 nt, Mycobacterium avium subsp. paratuberculosis
gcggauacgcccggc

SEQ ID NO: 886669 - RNA, 21 nt, Mycobacterium avium subsp. paratuberculosis
gcggacccagcuccucggcca

SEQ ID NO: 886670 - RNA, 22 nt, Mycobacterium avium subsp. paratuberculosis
gcggacccagcuccucggccag

SEQ ID NO: 886671 - RNA, 23 nt, Mycobacterium avium subsp. paratuberculosis
gcggacccagcuccucggccagc

SEQ ID NO: 886672 - RNA, 15 nt, Mycobacterium avium subsp. paratuberculosis
gcggacccggaggcg

SEQ ID NO: 886673 - RNA, 18 nt, Mycobacterium avium subsp. paratuberculosis
gcggacccggucggccgc

SEQ ID NO: 886674 - RNA, 15 nt, Mycobacterium avium subsp. paratuberculosis
gcggacccguugggc

SEQ ID NO: 886675 - RNA, 14 nt, Mycobacterium avium subsp. paratuberculosis
gcggacccuggcca

SEQ ID NO: 886676 - RNA, 18 nt, Mycobacterium avium subsp. paratuberculosis
gcggacccuggccagcac

SEQ ID NO: 886677 - RNA, 21 nt, Mycobacterium avium subsp. paratuberculosis
gcggacccuggccagcaccgc

SEQ ID NO: 886678 - RNA, 18 nt, Mycobacterium avium subsp. paratuberculosis
gcggacccuucagccaga

SEQ ID NO: 886679 - RNA, 20 nt, Mycobacterium avium subsp. paratuberculosis
gcggaccgcacccccagcuc

SEQ ID NO: 886680 - RNA, 14 nt, Mycobacterium avium subsp. paratuberculosis
gcggaccggcggcc

SEQ ID NO: 886681 - RNA, 15 nt, Mycobacterium avium subsp. paratuberculosis
gcggaccggcggccg

SEQ ID NO: 886682 - RNA, 19 nt, Mycobacterium avium subsp. paratuberculosis
gcggaccggcggccgccau

SEQ ID NO: 886683 - RNA, 15 nt, Mycobacterium avium subsp. paratuberculosis
gcggacgacggccag

SEQ ID NO: 886684 - RNA, 23 nt, Mycobacterium avium subsp. paratuberculosis
gcggaccugggugcgccacugcg

SEQ ID NO: 886685 - RNA, 22 nt, Mycobacterium avium subsp. paratuberculosis
gcggaccggcgauuucggccgu

SEQ ID NO: 886686 - RNA, 21 nt, Mycobacterium avium subsp. paratuberculosis
gcggaccgucggugucgaaga

SEQ ID NO: 886687 - RNA, 15 nt, Mycobacterium avium subsp. paratuberculosis
gcggaccccagcgug

SEQ ID NO: 886688 - RNA, 17 nt, Mycobacterium avium subsp. paratuberculosis
gcggacaccagucgcac

SEQ ID NO: 886689 - RNA, 14 nt, Mycobacterium avium subsp. paratuberculosis
gcggaaugcucgac

SEQ ID NO: 886690 - RNA, 13 nt, Mycobacterium avium subsp. paratuberculosis
gcggacagcacgu

SEQ ID NO: 886691 - RNA, 19 nt, Mycobacterium avium subsp. paratuberculosis
gcggacacgcggacccgua

SEQ ID NO: 886692 - RNA, 17 nt, Mycobacterium avium subsp. paratuberculosis
gcggacacgaacgacgc

SEQ ID NO: 886693 - RNA, 19 nt, Mycobacterium avium subsp. paratuberculosis
gcggacacgaacgacgcgg

SEQ ID NO: 886694 - RNA, 22 nt, Mycobacterium avium subsp. paratuberculosis
gcggaccaucuacgaccucgaa

SEQ ID NO: 886695 - RNA, 13 nt, Mycobacterium avium subsp. paratuberculosis
gcggaccaccgcg

SEQ ID NO: 886696 - RNA, 22 nt, Mycobacterium avium subsp. paratuberculosis
gcggaccaccgcgugcgagccg

SEQ ID NO: 886697 - RNA, 21 nt, Mycobacterium avium subsp. paratuberculosis
gcggacauucugcacgacgaa

SEQ ID NO: 886698 - RNA, 16 nt, Mycobacterium avium subsp. paratuberculosis
gcggacagccccgagc

SEQ ID NO: 886699 - RNA, 18 nt, Mycobacterium avium subsp. paratuberculosis
gcggacagccccgagccg

SEQ ID NO: 886700 - RNA, 22 nt, Mycobacterium avium subsp. paratuberculosis
gcggacagccccgagccgcgga

SEQ ID NO: 886701 - RNA, 15 nt, Mycobacterium avium subsp. paratuberculosis
gcggacagcgcggug

SEQ ID NO: 886702 - RNA, 15 nt, Mycobacterium avium subsp. paratuberculosis
gcggacagcucgccg

SEQ ID NO: 886703 - RNA, 14 nt, Mycobacterium avium subsp. paratuberculosis
gcggacagggcggc

SEQ ID NO: 886704 - RNA, 15 nt, Mycobacterium avium subsp. paratuberculosis
gcggacagggcggcg

SEQ ID NO: 886705 - RNA, 17 nt, Mycobacterium avium subsp. paratuberculosis
gcggacaucgccucggc

SEQ ID NO: 886706 - RNA, 16 nt, Mycobacterium avium subsp. paratuberculosis
gcggaaguacaccggu

SEQ ID NO: 886707 - RNA, 15 nt, Mycobacterium avium subsp. paratuberculosis
gcggaaugaacgcgg

SEQ ID NO: 886708 - RNA, 16 nt, Mycobacterium avium subsp. paratuberculosis
gcggaaugaacgcggc

SEQ ID NO: 886709 - RNA, 23 nt, Mycobacterium avium subsp. paratuberculosis
gcggaagcugccguugcgccagc

SEQ ID NO: 886710 - RNA, 13 nt, Mycobacterium avium subsp. paratuberculosis
gcggaaggccagc

SEQ ID NO: 886711 - RNA, 20 nt, Mycobacterium avium subsp. paratuberculosis
gcggaaggcccccggcucga

SEQ ID NO: 886712 - RNA, 22 nt, Mycobacterium avium subsp. paratuberculosis
gcggaaggcccccggcucgauc

SEQ ID NO: 886713 - RNA, 14 nt, Mycobacterium avium subsp. paratuberculosis
gcggaaggccgcgc

SEQ ID NO: 886714 - RNA, 16 nt, Mycobacterium avium subsp. paratuberculosis
gcggaaggccgcgcgg

SEQ ID NO: 886715 - RNA, 22 nt, Mycobacterium avium subsp. paratuberculosis
gcggaaggccgcgcgggcggcg

SEQ ID NO: 886716 - RNA, 23 nt, Mycobacterium avium subsp. paratuberculosis
gcggaaggccgcgcgggcggcgu

SEQ ID NO: 886717 - RNA, 23 nt, Mycobacterium avium subsp. paratuberculosis
gcggaagaaguucucgcacccgg

SEQ ID NO: 886718 - RNA, 14 nt, Mycobacterium avium subsp. paratuberculosis
gcggaacgcgccgg

SEQ ID NO: 886719 - RNA, 18 nt, Mycobacterium avium subsp. paratuberculosis
gcggaacagcgucgccga

SEQ ID NO: 886720 - RNA, 22 nt, Mycobacterium avium subsp. paratuberculosis
gcggaacaccgccuugcccggc

SEQ ID NO: 886721 - RNA, 16 nt, Mycobacterium avium subsp. paratuberculosis
gcggaacccacgugcg

SEQ ID NO: 886722 - RNA, 21 nt, Mycobacterium avium subsp. paratuberculosis
gcggaacccacgugcggcgcc

SEQ ID NO: 886723 - RNA, 18 nt, Mycobacterium avium subsp. paratuberculosis
gcggaaccgacaccucgc

SEQ ID NO: 886724 - RNA, 21 nt, Mycobacterium avium subsp. paratuberculosis
gcggaaccgacaccucgccgu

SEQ ID NO: 886725 - RNA, 18 nt, Mycobacterium avium subsp. paratuberculosis
gcggaaccggccggggcg

SEQ ID NO: 886726 - RNA, 21 nt, Mycobacterium avium subsp. paratuberculosis
gcggaaccggccggggcgcca

SEQ ID NO: 886727 - RNA, 22 nt, Mycobacterium avium subsp. paratuberculosis
gcggaaccgggccgcuggccgc

SEQ ID NO: 886728 - RNA, 13 nt, Mycobacterium avium subsp. paratuberculosis
gcggaaccggggg

SEQ ID NO: 886729 - RNA, 19 nt, Mycobacterium avium subsp. paratuberculosis
gcggaaccgggggccguca

SEQ ID NO: 886730 - RNA, 21 nt, Mycobacterium avium subsp. paratuberculosis
gcggaaccguagaccaccucg

SEQ ID NO: 886731 - RNA, 16 nt, Mycobacterium avium subsp. paratuberculosis
gcggaaccguugcagc

SEQ ID NO: 886732 - RNA, 14 nt, Mycobacterium avium subsp. paratuberculosis
gcggaacagccggc

SEQ ID NO: 886733 - RNA, 19 nt, Mycobacterium avium subsp. paratuberculosis
gcggaacagccggcucagg

SEQ ID NO: 886734 - RNA, 15 nt, Mycobacterium avium subsp. paratuberculosis
gcgcugggagcgggc

SEQ ID NO: 886735 - RNA, 13 nt, Mycobacterium avium subsp. paratuberculosis
gcgcuggcggcca

SEQ ID NO: 886736 - RNA, 16 nt, Mycobacterium avium subsp. paratuberculosis
gcgcuggcggccaucg

SEQ ID NO: 886737 - RNA, 22 nt, Mycobacterium avium subsp. paratuberculosis
gcgcuggcggccaucgccgcgg

SEQ ID NO: 886738 - RNA, 18 nt, Mycobacterium avium subsp. paratuberculosis
gcgcguucaagccgccga

SEQ ID NO: 886739 - RNA, 20 nt, Mycobacterium avium subsp. paratuberculosis
gcgcguucaagccgccgauc

SEQ ID NO: 886740 - RNA, 15 nt, Mycobacterium avium subsp. paratuberculosis
gcgcguucagggugc

SEQ ID NO: 886741 - RNA, 15 nt, Mycobacterium avium subsp. paratuberculosis
gcgcguuccagcacg

SEQ ID NO: 886742 - RNA, 21 nt, Mycobacterium avium subsp. paratuberculosis
gcgcguuccagcacgcccaga

SEQ ID NO: 886743 - RNA, 21 nt, Mycobacterium avium subsp. paratuberculosis
gcgcguuccaucagcgcccgc

SEQ ID NO: 886744 - RNA, 14 nt, Mycobacterium avium subsp. paratuberculosis
gcgcguuccagcac

SEQ ID NO: 886745 - RNA, 20 nt, Mycobacterium avium subsp. paratuberculosis
gcgcuaccgcgcucaccguc

SEQ ID NO: 886746 - RNA, 21 nt, Mycobacterium avium subsp. paratuberculosis
gcgcuaccaggcgugcacccg

SEQ ID NO: 886747 - RNA, 16 nt, Mycobacterium avium subsp. paratuberculosis
gcgcguucggcgccac

SEQ ID NO: 886748 - RNA, 18 nt, Mycobacterium avium subsp. paratuberculosis
gcgcguucggcgccaccc

SEQ ID NO: 886749 - RNA, 19 nt, Mycobacterium avium subsp. paratuberculosis
gcgcguucuccaccgcgcg

SEQ ID NO: 886750 - RNA, 16 nt, Mycobacterium avium subsp. paratuberculosis
gcgcguugaagcugac

SEQ ID NO: 886751 - RNA, 17 nt, Mycobacterium avium subsp. paratuberculosis
gcgcguugaagcugacg

SEQ ID NO: 886752 - RNA, 19 nt, Mycobacterium avium subsp. paratuberculosis
gcgcguggucccacaccac

SEQ ID NO: 886753 - RNA, 16 nt, Mycobacterium avium subsp. paratuberculosis
gcgcguggggcgucgc

SEQ ID NO: 886754 - RNA, 20 nt, Mycobacterium avium subsp. paratuberculosis
gcgcguggggcgucgccgcc

SEQ ID NO: 886755 - RNA, 18 nt, Mycobacterium avium subsp. paratuberculosis
gcgcgugggccaacgcga

SEQ ID NO: 886756 - RNA, 16 nt, Mycobacterium avium subsp. paratuberculosis
gcgcgugcugggggug

SEQ ID NO: 886757 - RNA, 19 nt, Mycobacterium avium subsp. paratuberculosis
gcgcgugcuguugcaggug

SEQ ID NO: 886758 - RNA, 14 nt, Mycobacterium avium subsp. paratuberculosis
gcgcgugcggggug

SEQ ID NO: 886759 - RNA, 12 nt, Mycobacterium avium subsp. paratuberculosis
gcgcgugcgccg

SEQ ID NO: 886760 - RNA, 13 nt, Mycobacterium avium subsp. paratuberculosis
gcgcgugcgccgc

SEQ ID NO: 886761 - RNA, 22 nt, Mycobacterium avium subsp. paratuberculosis
gcgcgugcgccgcggcggcucg

SEQ ID NO: 886762 - RNA, 21 nt, Mycobacterium avium subsp. paratuberculosis
gcgcguccauggucgagccgc

SEQ ID NO: 886763 - RNA, 20 nt, Mycobacterium avium subsp. paratuberculosis
gcgcguccaggugcgccgcc

SEQ ID NO: 886764 - RNA, 23 nt, Mycobacterium avium subsp. paratuberculosis
gcgcguccacuccaauacggccc

SEQ ID NO: 886765 - RNA, 13 nt, Mycobacterium avium subsp. paratuberculosis
gcgcuacgccggc

SEQ ID NO: 886766 - RNA, 19 nt, Mycobacterium avium subsp. paratuberculosis
gcgcuagcugcgccggcuu

SEQ ID NO: 886767 - RNA, 18 nt, Mycobacterium avium subsp. paratuberculosis
gcgcuaggacgcgggccu

SEQ ID NO: 886768 - RNA, 21 nt, Mycobacterium avium subsp. paratuberculosis
gcgcucaucguguccagcaug

SEQ ID NO: 886769 - RNA, 21 nt, Mycobacterium avium subsp. paratuberculosis
gcgcucagugcacgcucggcg

SEQ ID NO: 886770 - RNA, 21 nt, Mycobacterium avium subsp. paratuberculosis
gcgcucagcgcggcgggccag

SEQ ID NO: 886771 - RNA, 12 nt, Mycobacterium avium subsp. paratuberculosis
gcgcucagcggc

SEQ ID NO: 886772 - RNA, 19 nt, Mycobacterium avium subsp. paratuberculosis
gcgcucagcggcagcgucg

SEQ ID NO: 886773 - RNA, 20 nt, Mycobacterium avium subsp. paratuberculosis
gcgcucagcggcagcgucgc

SEQ ID NO: 886774 - RNA, 15 nt, Mycobacterium avium subsp. paratuberculosis
gcgcucgaccucggc

SEQ ID NO: 886775 - RNA, 16 nt, Mycobacterium avium subsp. paratuberculosis
gcgcucgaccucggcg

SEQ ID NO: 886776 - RNA, 20 nt, Mycobacterium avium subsp. paratuberculosis
gcgcucgaccucggcggcca

SEQ ID NO: 886777 - RNA, 15 nt, Mycobacterium avium subsp. paratuberculosis
gcgcucgacgaggcg

SEQ ID NO: 886778 - RNA, 20 nt, Mycobacterium avium subsp. paratuberculosis
gcgcucgacgaugucgacgc

SEQ ID NO: 886779 - RNA, 14 nt, Mycobacterium avium subsp. paratuberculosis
gcgcucgacggccu

SEQ ID NO: 886780 - RNA, 17 nt, Mycobacterium avium subsp. paratuberculosis
gcgcucgacggccugca

SEQ ID NO: 886781 - RNA, 21 nt, Mycobacterium avium subsp. paratuberculosis
gcgcucgaacucaccgguggc

SEQ ID NO: 886782 - RNA, 22 nt, Mycobacterium avium subsp. paratuberculosis
gcgcucgaacucaccgguggcc

SEQ ID NO: 886783 - RNA, 13 nt, Mycobacterium avium subsp. paratuberculosis
gcgcuccucgacg

SEQ ID NO: 886784 - RNA, 15 nt, Mycobacterium avium subsp. paratuberculosis
gcgcuccugcagcgc

SEQ ID NO: 886785 - RNA, 16 nt, Mycobacterium avium subsp. paratuberculosis
gcgcuccugccagcgg

SEQ ID NO: 886786 - RNA, 19 nt, Mycobacterium avium subsp. paratuberculosis
gcgcuccugccagcggcgc

SEQ ID NO: 886787 - RNA, 20 nt, Mycobacterium avium subsp. paratuberculosis
gcgcuccugccagcggcgca

SEQ ID NO: 886788 - RNA, 21 nt, Mycobacterium avium subsp. paratuberculosis
gcgcuccugccagcggcgcaa

SEQ ID NO: 886789 - RNA, 12 nt, Mycobacterium avium subsp. paratuberculosis
gcgcuccuggcc

SEQ ID NO: 886790 - RNA, 17 nt, Mycobacterium avium subsp. paratuberculosis
gcgcuccuggccggacg

SEQ ID NO: 886791 - RNA, 20 nt, Mycobacterium avium subsp. paratuberculosis
gcgcucaucaggcggccggc

SEQ ID NO: 886792 - RNA, 13 nt, Mycobacterium avium subsp. paratuberculosis
gcgcuccaccacc

SEQ ID NO: 886793 - RNA, 14 nt, Mycobacterium avium subsp. paratuberculosis
gcgcuccaccaccg

SEQ ID NO: 886794 - RNA, 23 nt, Mycobacterium avium subsp. paratuberculosis
gcgcuccaccagguucgcgcagc

SEQ ID NO: 886795 - RNA, 17 nt, Mycobacterium avium subsp. paratuberculosis
gcgcugcgcuucgagca

SEQ ID NO: 886796 - RNA, 15 nt, Mycobacterium avium subsp. paratuberculosis
gcgcugccgccggcc

SEQ ID NO: 886797 - RNA, 12 nt, Mycobacterium avium subsp. paratuberculosis
gcgcugcggcgu

SEQ ID NO: 886798 - RNA, 17 nt, Mycobacterium avium subsp. paratuberculosis
gcgcugcuguugcucgg

SEQ ID NO: 886799 - RNA, 23 nt, Mycobacterium avium subsp. paratuberculosis
gcgcugcuuagccccucccacca

SEQ ID NO: 886800 - RNA, 16 nt, Mycobacterium avium subsp. paratuberculosis
gcgcugcccgucgacc

SEQ ID NO: 886801 - RNA, 23 nt, Mycobacterium avium subsp. paratuberculosis
gcgcugcccgucgaccuccucga

SEQ ID NO: 886802 - RNA, 16 nt, Mycobacterium avium subsp. paratuberculosis
gcgcugcccagcgcgg

SEQ ID NO: 886803 - RNA, 18 nt, Mycobacterium avium subsp. paratuberculosis
gcgcugcccgccgcggug

SEQ ID NO: 886804 - RNA, 13 nt, Mycobacterium avium subsp. paratuberculosis
gcgcugccgacga

SEQ ID NO: 886805 - RNA, 21 nt, Mycobacterium avium subsp. paratuberculosis
gcgcugccgacgaugucggcu

SEQ ID NO: 886806 - RNA, 19 nt, Mycobacterium avium subsp. paratuberculosis
gcgcugccgagcaccucgu

SEQ ID NO: 886807 - RNA, 20 nt, Mycobacterium avium subsp. paratuberculosis
gcgcugccgagcaccucguc

SEQ ID NO: 886808 - RNA, 21 nt, Mycobacterium avium subsp. paratuberculosis
gcgcugccgagcaccucgucg

SEQ ID NO: 886809 - RNA, 23 nt, Mycobacterium avium subsp. paratuberculosis
gcgcugccgagcaccucgucgcc

SEQ ID NO: 886810 - RNA, 14 nt, Mycobacterium avium subsp. paratuberculosis
gcgcugcgcggugg

SEQ ID NO: 886811 - RNA, 16 nt, Mycobacterium avium subsp. paratuberculosis
gcgcugcgcgguggcg

SEQ ID NO: 886812 - RNA, 16 nt, Mycobacterium avium subsp. paratuberculosis
gcgcugccccagccac

SEQ ID NO: 886813 - RNA, 19 nt, Mycobacterium avium subsp. paratuberculosis
gcgcugccccagccacagc

SEQ ID NO: 886814 - RNA, 14 nt, Mycobacterium avium subsp. paratuberculosis
gcgcugcccgccgc

SEQ ID NO: 886815 - RNA, 17 nt, Mycobacterium avium subsp. paratuberculosis
gcgcugccagggccggg

SEQ ID NO: 886816 - RNA, 14 nt, Mycobacterium avium subsp. paratuberculosis
gcgcugcagcaugg

SEQ ID NO: 886817 - RNA, 18 nt, Mycobacterium avium subsp. paratuberculosis
gcgcugcaugccgguguc

SEQ ID NO: 886818 - RNA, 14 nt, Mycobacterium avium subsp. paratuberculosis
gcgcugaccagcgu

SEQ ID NO: 886819 - RNA, 22 nt, Mycobacterium avium subsp. paratuberculosis
gcgcugaccagcgugaccucga

SEQ ID NO: 886820 - RNA, 16 nt, Mycobacterium avium subsp. paratuberculosis
gcgcugaccaggccgu

SEQ ID NO: 886821 - RNA, 22 nt, Mycobacterium avium subsp. paratuberculosis
gcgcugaauucuguugucggcu

SEQ ID NO: 886822 - RNA, 15 nt, Mycobacterium avium subsp. paratuberculosis
gcgcucgccgcgcgg

SEQ ID NO: 886823 - RNA, 16 nt, Mycobacterium avium subsp. paratuberculosis
gcgcucgccgcgcggc

SEQ ID NO: 886824 - RNA, 21 nt, Mycobacterium avium subsp. paratuberculosis
gcgcucgccgcgcggcccgcg

SEQ ID NO: 886825 - RNA, 14 nt, Mycobacterium avium subsp. paratuberculosis
gcgcucggccagca

SEQ ID NO: 886826 - RNA, 20 nt, Mycobacterium avium subsp. paratuberculosis
gcgcucggccagcagugcca

SEQ ID NO: 886827 - RNA, 14 nt, Mycobacterium avium subsp. paratuberculosis
gcgcucgccgucgg

SEQ ID NO: 886828 - RNA, 16 nt, Mycobacterium avium subsp. paratuberculosis
gcgcucgccgucggcc

SEQ ID NO: 886829 - RNA, 18 nt, Mycobacterium avium subsp. paratuberculosis
gcgcucgccgucggccag

SEQ ID NO: 886830 - RNA, 19 nt, Mycobacterium avium subsp. paratuberculosis
gcgcucgccgucggccagc

SEQ ID NO: 886831 - RNA, 16 nt, Mycobacterium avium subsp. paratuberculosis
gcgcucgcaccagcgc

SEQ ID NO: 886832 - RNA, 17 nt, Mycobacterium avium subsp. paratuberculosis
gcgcucgcacaacccgc

SEQ ID NO: 886833 - RNA, 21 nt, Mycobacterium avium subsp. paratuberculosis
gcgcucgcacaacccgcccgg

SEQ ID NO: 886834 - RNA, 12 nt, Mycobacterium avium subsp. paratuberculosis
gcgcucgcacca

SEQ ID NO: 886835 - RNA, 22 nt, Mycobacterium avium subsp. paratuberculosis
gcgcucgauggaauucgucggc

SEQ ID NO: 886836 - RNA, 24 nt, Mycobacterium avium subsp. paratuberculosis
gcgcucgauggaauucgucggcgg

SEQ ID NO: 886837 - RNA, 19 nt, Mycobacterium avium subsp. paratuberculosis
gcgcucuugggcggccggc

SEQ ID NO: 886838 - RNA, 20 nt, Mycobacterium avium subsp. paratuberculosis
gcgcucuugggcggccggcu

SEQ ID NO: 886839 - RNA, 21 nt, Mycobacterium avium subsp. paratuberculosis
gcgcucuugggcggccggcuu

SEQ ID NO: 886840 - RNA, 22 nt, Mycobacterium avium subsp. paratuberculosis
gcgcucuugggcggccggcuuc

SEQ ID NO: 886841 - RNA, 16 nt, Mycobacterium avium subsp. paratuberculosis
gcgcugaacgcggugg

SEQ ID NO: 886842 - RNA, 13 nt, Mycobacterium avium subsp. paratuberculosis
gcgcugaacugcu

SEQ ID NO: 886843 - RNA, 16 nt, Mycobacterium avium subsp. paratuberculosis
gcgcugaacugcucga

SEQ ID NO: 886844 - RNA, 15 nt, Mycobacterium avium subsp. paratuberculosis
gcgcugaagcgcgac

SEQ ID NO: 886845 - RNA, 19 nt, Mycobacterium avium subsp. paratuberculosis
gcgcugaagcgcgaccccu

SEQ ID NO: 886846 - RNA, 16 nt, Mycobacterium avium subsp. paratuberculosis
gcgcucuucgggcugc

SEQ ID NO: 886847 - RNA, 19 nt, Mycobacterium avium subsp. paratuberculosis
gcgcucuguuggccgucgc

SEQ ID NO: 886848 - RNA, 13 nt, Mycobacterium avium subsp. paratuberculosis
gcgcucggccggg

SEQ ID NO: 886849 - RNA, 14 nt, Mycobacterium avium subsp. paratuberculosis
gcgcucggcguugg

SEQ ID NO: 886850 - RNA, 13 nt, Mycobacterium avium subsp. paratuberculosis
gcgcucggccauc

SEQ ID NO: 886851 - RNA, 12 nt, Mycobacterium avium subsp. paratuberculosis
gcgcucggcgac

SEQ ID NO: 886852 - RNA, 14 nt, Mycobacterium avium subsp. paratuberculosis
gcgcucggcgaccg

SEQ ID NO: 886853 - RNA, 16 nt, Mycobacterium avium subsp. paratuberculosis
gcgcucggcgaccgcc

SEQ ID NO: 886854 - RNA, 18 nt, Mycobacterium avium subsp. paratuberculosis
gcgcucggcgaccgccgg

SEQ ID NO: 886855 - RNA, 14 nt, Mycobacterium avium subsp. paratuberculosis
gcgcucggcgacga

SEQ ID NO: 886856 - RNA, 21 nt, Mycobacterium avium subsp. paratuberculosis
gcgcgguccacgguggcgccg

SEQ ID NO: 886857 - RNA, 13 nt, Mycobacterium avium subsp. paratuberculosis
gcgcggucggugg

SEQ ID NO: 886858 - RNA, 20 nt, Mycobacterium avium subsp. paratuberculosis
gcgcggugggcggcgggagc

SEQ ID NO: 886859 - RNA, 22 nt, Mycobacterium avium subsp. paratuberculosis
gcgcggucgcaggcgagccggu

SEQ ID NO: 886860 - RNA, 15 nt, Mycobacterium avium subsp. paratuberculosis
gcgcggucgccacca

SEQ ID NO: 886861 - RNA, 22 nt, Mycobacterium avium subsp. paratuberculosis
gcgcggucgccaccaccagcgg

SEQ ID NO: 886862 - RNA, 21 nt, Mycobacterium avium subsp. paratuberculosis
gcgcgguggucagcaccggcg

SEQ ID NO: 886863 - RNA, 22 nt, Mycobacterium avium subsp. paratuberculosis
gcgcgguggucagcaccggcgu

SEQ ID NO: 886864 - RNA, 21 nt, Mycobacterium avium subsp. paratuberculosis
gcgcgguggucagcggcgcca

SEQ ID NO: 886865 - RNA, 12 nt, Mycobacterium avium subsp. paratuberculosis
gcgcggucaaca

SEQ ID NO: 886866 - RNA, 14 nt, Mycobacterium avium subsp. paratuberculosis
gcgcggucaacacc

SEQ ID NO: 886867 - RNA, 18 nt, Mycobacterium avium subsp. paratuberculosis
gcgcggggccggcgcggu

SEQ ID NO: 886868 - RNA, 20 nt, Mycobacterium avium subsp. paratuberculosis
gcgcggggccggcgcggugg

SEQ ID NO: 886869 - RNA, 22 nt, Mycobacterium avium subsp. paratuberculosis
gcgcgguaaagucuucggcgau

SEQ ID NO: 886870 - RNA, 23 nt, Mycobacterium avium subsp. paratuberculosis
gcgcgguaaagucuucggcgaug

SEQ ID NO: 886871 - RNA, 14 nt, Mycobacterium avium subsp. paratuberculosis
gcgcggggcggccg

SEQ ID NO: 886872 - RNA, 13 nt, Mycobacterium avium subsp. paratuberculosis
gcgcgucagccgu

SEQ ID NO: 886873 - RNA, 19 nt, Mycobacterium avium subsp. paratuberculosis
gcgcgucauggccgucggg

SEQ ID NO: 886874 - RNA, 14 nt, Mycobacterium avium subsp. paratuberculosis
gcgcguccaaccgc

SEQ ID NO: 886875 - RNA, 20 nt, Mycobacterium avium subsp. paratuberculosis
gcgcgucacgcuggcgugac

SEQ ID NO: 886876 - RNA, 21 nt, Mycobacterium avium subsp. paratuberculosis
gcgcgucacgcuggcgugacg

SEQ ID NO: 886877 - RNA, 18 nt, Mycobacterium avium subsp. paratuberculosis
gcgcguauuccagcgcca

SEQ ID NO: 886878 - RNA, 22 nt, Mycobacterium avium subsp. paratuberculosis
gcgcguauuccagcgccagcga

SEQ ID NO: 886879 - RNA, 18 nt, Mycobacterium avium subsp. paratuberculosis
gcgcgguuuccggcgauu

SEQ ID NO: 886880 - RNA, 21 nt, Mycobacterium avium subsp. paratuberculosis
gcgcgguuuccggcgauucga

SEQ ID NO: 886881 - RNA, 16 nt, Mycobacterium avium subsp. paratuberculosis
gcgcgguugcccgcac

SEQ ID NO: 886882 - RNA, 18 nt, Mycobacterium avium subsp. paratuberculosis
gcgcgguugcccgcaccc

SEQ ID NO: 886883 - RNA, 20 nt, Mycobacterium avium subsp. paratuberculosis
gcgcgguucuuggcguagug

SEQ ID NO: 886884 - RNA, 19 nt, Mycobacterium avium subsp. paratuberculosis
gcgcgguugaccgccgaca

SEQ ID NO: 886885 - RNA, 20 nt, Mycobacterium avium subsp. paratuberculosis
gcgcgguugaccgccgacac

SEQ ID NO: 886886 - RNA, 17 nt, Mycobacterium avium subsp. paratuberculosis
gcgcgguugcgguuguc

SEQ ID NO: 886887 - RNA, 21 nt, Mycobacterium avium subsp. paratuberculosis
gcgcggugugcggcggcucgu

SEQ ID NO: 886888 - RNA, 16 nt, Mycobacterium avium subsp. paratuberculosis
gcgcggugugggcgau

SEQ ID NO: 886889 - RNA, 21 nt, Mycobacterium avium subsp. paratuberculosis
gcgcgguguuuggccgcgcag

SEQ ID NO: 886890 - RNA, 15 nt, Mycobacterium avium subsp. paratuberculosis
gcgcgguuccggcgu

SEQ ID NO: 886891 - RNA, 16 nt, Mycobacterium avium subsp. paratuberculosis
gcgcgguuccggcgug

SEQ ID NO: 886892 - RNA, 23 nt, Mycobacterium avium subsp. paratuberculosis
gcgcgguuccggcgugcagcacg

SEQ ID NO: 886893 - RNA, 18 nt, Mycobacterium avium subsp. paratuberculosis
gcgcgguguacagcgcgc

SEQ ID NO: 886894 - RNA, 19 nt, Mycobacterium avium subsp. paratuberculosis
gcgcgguguacagcgcgcc

SEQ ID NO: 886895 - RNA, 19 nt, Mycobacterium avium subsp. paratuberculosis
gcgcggugucgacgucggu

SEQ ID NO: 886896 - RNA, 22 nt, Mycobacterium avium subsp. paratuberculosis
gcgcggugucgacgucgguggu

SEQ ID NO: 886897 - RNA, 15 nt, Mycobacterium avium subsp. paratuberculosis
gcgcggcgguccagc

SEQ ID NO: 886898 - RNA, 20 nt, Mycobacterium avium subsp. paratuberculosis
gcgcggcgguccagcgagcc

SEQ ID NO: 886899 - RNA, 14 nt, Mycobacterium avium subsp. paratuberculosis
gcgcggcggccucg

SEQ ID NO: 886900 - RNA, 18 nt, Mycobacterium avium subsp. paratuberculosis
gcgcggcggccucggugg

SEQ ID NO: 886901 - RNA, 14 nt, Mycobacterium avium subsp. paratuberculosis
gcgcggcggugcuc

SEQ ID NO: 886902 - RNA, 15 nt, Mycobacterium avium subsp. paratuberculosis
gcgcggcggugcucg

SEQ ID NO: 886903 - RNA, 13 nt, Mycobacterium avium subsp. paratuberculosis
gcgcggcgguguc

SEQ ID NO: 886904 - RNA, 17 nt, Mycobacterium avium subsp. paratuberculosis
gcgcggcggugucggug

SEQ ID NO: 886905 - RNA, 12 nt, Mycobacterium avium subsp. paratuberculosis
gcgcggcgggcc

SEQ ID NO: 886906 - RNA, 14 nt, Mycobacterium avium subsp. paratuberculosis
gcgcggcgggccag

SEQ ID NO: 886907 - RNA, 13 nt, Mycobacterium avium subsp. paratuberculosis
gcgcggcgggccc

SEQ ID NO: 886908 - RNA, 14 nt, Mycobacterium avium subsp. paratuberculosis
gcgcggcgggcccg

SEQ ID NO: 886909 - RNA, 16 nt, Mycobacterium avium subsp. paratuberculosis
gcgcggcgggcccgca

SEQ ID NO: 886910 - RNA, 13 nt, Mycobacterium avium subsp. paratuberculosis
gcgcggcgggcga

SEQ ID NO: 886911 - RNA, 14 nt, Mycobacterium avium subsp. paratuberculosis
gcgcggcgccgcgu

SEQ ID NO: 886912 - RNA, 11 nt, Mycobacterium avium subsp. paratuberculosis
gcgcggcggcc

SEQ ID NO: 886913 - RNA, 15 nt, Mycobacterium avium subsp. paratuberculosis
gcgcggcggccaacg

SEQ ID NO: 886914 - RNA, 18 nt, Mycobacterium avium subsp. paratuberculosis
gcgcggcggccaccgcgc

SEQ ID NO: 886915 - RNA, 21 nt, Mycobacterium avium subsp. paratuberculosis
gcgcggcggccaccucggcgg

SEQ ID NO: 886916 - RNA, 14 nt, Mycobacterium avium subsp. paratuberculosis
gcgcggcggccagc

SEQ ID NO: 886917 - RNA, 14 nt, Mycobacterium avium subsp. paratuberculosis
gcgcggcggauguc

SEQ ID NO: 886918 - RNA, 17 nt, Mycobacterium avium subsp. paratuberculosis
gcgcggcggcaaccagc

SEQ ID NO: 886919 - RNA, 23 nt, Mycobacterium avium subsp. paratuberculosis
gcgcggcggcaaccagcuccggc

SEQ ID NO: 886920 - RNA, 18 nt, Mycobacterium avium subsp. paratuberculosis
gcgcggcggaggucagcg

SEQ ID NO: 886921 - RNA, 21 nt, Mycobacterium avium subsp. paratuberculosis
gcgcggcggaggucagcggcc

SEQ ID NO: 886922 - RNA, 12 nt, Mycobacterium avium subsp. paratuberculosis
gcgcggcggccg

SEQ ID NO: 886923 - RNA, 14 nt, Mycobacterium avium subsp. paratuberculosis
gcgcggcggcgccg

SEQ ID NO: 886924 - RNA, 22 nt, Mycobacterium avium subsp. paratuberculosis
gcgcggcggcgccgucgccgau

SEQ ID NO: 886925 - RNA, 17 nt, Mycobacterium avium subsp. paratuberculosis
gcgcggcggcgacgucg

SEQ ID NO: 886926 - RNA, 21 nt, Mycobacterium avium subsp. paratuberculosis
gcgcggcggcgacgucgacgg

SEQ ID NO: 886927 - RNA, 12 nt, Mycobacterium avium subsp. paratuberculosis
gcgcggcggcgc

SEQ ID NO: 886928 - RNA, 17 nt, Mycobacterium avium subsp. paratuberculosis
gcgcgggcugcagggcc

SEQ ID NO: 886929 - RNA, 15 nt, Mycobacterium avium subsp. paratuberculosis
gcgcggggccaccag

SEQ ID NO: 886930 - RNA, 16 nt, Mycobacterium avium subsp. paratuberculosis
gcgcgggcguccacga

SEQ ID NO: 886931 - RNA, 14 nt, Mycobacterium avium subsp. paratuberculosis
gcgcgggcguccuc

SEQ ID NO: 886932 - RNA, 20 nt, Mycobacterium avium subsp. paratuberculosis
gcgcgggcguccucgucggc

SEQ ID NO: 886933 - RNA, 22 nt, Mycobacterium avium subsp. paratuberculosis
gcgcgggcguccucgucggcga

SEQ ID NO: 886934 - RNA, 14 nt, Mycobacterium avium subsp. paratuberculosis
gcgcgggcggcguc

SEQ ID NO: 886935 - RNA, 17 nt, Mycobacterium avium subsp. paratuberculosis
gcgcgggcggcgucggc

SEQ ID NO: 886936 - RNA, 15 nt, Mycobacterium avium subsp. paratuberculosis
gcgcgggcgcggcca

SEQ ID NO: 886937 - RNA, 13 nt, Mycobacterium avium subsp. paratuberculosis
gcgcgggcgcccg

SEQ ID NO: 886938 - RNA, 12 nt, Mycobacterium avium subsp. paratuberculosis
gcgcgggcgauu

SEQ ID NO: 886939 - RNA, 22 nt, Mycobacterium avium subsp. paratuberculosis
gcgcgggcgauuucgucggcgg

SEQ ID NO: 886940 - RNA, 14 nt, Mycobacterium avium subsp. paratuberculosis
gcgcgggcgaccug

SEQ ID NO: 886941 - RNA, 21 nt, Mycobacterium avium subsp. paratuberculosis
gcgcgggccuaggaccccggc

SEQ ID NO: 886942 - RNA, 23 nt, Mycobacterium avium subsp. paratuberculosis
gcgcgggccuaggaccccggcug

SEQ ID NO: 886943 - RNA, 19 nt, Mycobacterium avium subsp. paratuberculosis
gcgcggcguucuccagcac

SEQ ID NO: 886944 - RNA, 23 nt, Mycobacterium avium subsp. paratuberculosis
gcgcggcguucuccagcacccgc

SEQ ID NO: 886945 - RNA, 20 nt, Mycobacterium avium subsp. paratuberculosis
gcgcggcucacagcgcggcg

SEQ ID NO: 886946 - RNA, 18 nt, Mycobacterium avium subsp. paratuberculosis
gcgcggcguucagcagcg

SEQ ID NO: 886947 - RNA, 21 nt, Mycobacterium avium subsp. paratuberculosis
gcgcggcggucgcgcgccggc

SEQ ID NO: 886948 - RNA, 14 nt, Mycobacterium avium subsp. paratuberculosis
gcgcggcggugagc

SEQ ID NO: 886949 - RNA, 12 nt, Mycobacterium avium subsp. paratuberculosis
gcgcggcggugc

SEQ ID NO: 886950 - RNA, 18 nt, Mycobacterium avium subsp. paratuberculosis
gcgcggcguagccgccgg

SEQ ID NO: 886951 - RNA, 14 nt, Mycobacterium avium subsp. paratuberculosis
gcgcggcgucaggg

SEQ ID NO: 886952 - RNA, 23 nt, Mycobacterium avium subsp. paratuberculosis
gcgcggcgaacccgagcaccccg

SEQ ID NO: 886953 - RNA, 19 nt, Mycobacterium avium subsp. paratuberculosis
gcgcggccugcagcaccga

SEQ ID NO: 886954 - RNA, 17 nt, Mycobacterium avium subsp. paratuberculosis
gcgcggccuccagccgc

SEQ ID NO: 886955 - RNA, 23 nt, Mycobacterium avium subsp. paratuberculosis
gcgcggccuccagccgcgcggcc

SEQ ID NO: 886956 - RNA, 14 nt, Mycobacterium avium subsp. paratuberculosis
gcgcggccggccga

SEQ ID NO: 886957 - RNA, 17 nt, Mycobacterium avium subsp. paratuberculosis
gcgcggccggugcgcgu

SEQ ID NO: 886958 - RNA, 22 nt, Mycobacterium avium subsp. paratuberculosis
gcgcggccggugcgcgucagcc

SEQ ID NO: 886959 - RNA, 13 nt, Mycobacterium avium subsp. paratuberculosis
gcgcggccggcgu

SEQ ID NO: 886960 - RNA, 14 nt, Mycobacterium avium subsp. paratuberculosis
gcgcggccggcgug

SEQ ID NO: 886961 - RNA, 12 nt, Mycobacterium avium subsp. paratuberculosis
gcgcggccggcc

SEQ ID NO: 886962 - RNA, 14 nt, Mycobacterium avium subsp. paratuberculosis
gcgcggccggccac

SEQ ID NO: 886963 - RNA, 16 nt, Mycobacterium avium subsp. paratuberculosis
gcgcggccggccacgc

SEQ ID NO: 886964 - RNA, 18 nt, Mycobacterium avium subsp. paratuberculosis
gcgcggccgcgucggcgg

SEQ ID NO: 886965 - RNA, 20 nt, Mycobacterium avium subsp. paratuberculosis
gcgcggccgcaugucgaccu

SEQ ID NO: 886966 - RNA, 13 nt, Mycobacterium avium subsp. paratuberculosis
gcgcggccgccag

SEQ ID NO: 886967 - RNA, 19 nt, Mycobacterium avium subsp. paratuberculosis
gcgcggccgcccagcccgc

SEQ ID NO: 886968 - RNA, 12 nt, Mycobacterium avium subsp. paratuberculosis
gcgcggccgccu

SEQ ID NO: 886969 - RNA, 13 nt, Mycobacterium avium subsp. paratuberculosis
gcgcggccgcgac

SEQ ID NO: 886970 - RNA, 14 nt, Mycobacterium avium subsp. paratuberculosis
gcgcggccgcgacu

SEQ ID NO: 886971 - RNA, 20 nt, Mycobacterium avium subsp. paratuberculosis
gcgcggccgauucggcgccg

SEQ ID NO: 886972 - RNA, 11 nt, Mycobacterium avium subsp. paratuberculosis
gcgcggccgca

SEQ ID NO: 886973 - RNA, 16 nt, Mycobacterium avium subsp. paratuberculosis
gcgcggcccguacucg

SEQ ID NO: 886974 - RNA, 15 nt, Mycobacterium avium subsp. paratuberculosis
gcgcggcccggcccg

SEQ ID NO: 886975 - RNA, 13 nt, Mycobacterium avium subsp. paratuberculosis
gcgcggcccgcga

SEQ ID NO: 886976 - RNA, 13 nt, Mycobacterium avium subsp. paratuberculosis
gcgcggcccgcgg

SEQ ID NO: 886977 - RNA, 14 nt, Mycobacterium avium subsp. paratuberculosis
gcgcggcccgcggc

SEQ ID NO: 886978 - RNA, 16 nt, Mycobacterium avium subsp. paratuberculosis
gcgcggcccgcggcgu

SEQ ID NO: 886979 - RNA, 12 nt, Mycobacterium avium subsp. paratuberculosis
gcgcggcccggc

SEQ ID NO: 886980 - RNA, 15 nt, Mycobacterium avium subsp. paratuberculosis
gcgcggcccaguucg

SEQ ID NO: 886981 - RNA, 15 nt, Mycobacterium avium subsp. paratuberculosis
gcgcggcccgccgaa

SEQ ID NO: 886982 - RNA, 13 nt, Mycobacterium avium subsp. paratuberculosis
gcgcggccagcgg

SEQ ID NO: 886983 - RNA, 18 nt, Mycobacterium avium subsp. paratuberculosis
gcgcggccagcggcgccg

SEQ ID NO: 886984 - RNA, 20 nt, Mycobacterium avium subsp. paratuberculosis
gcgcggccagcugaacacga

SEQ ID NO: 886985 - RNA, 20 nt, Mycobacterium avium subsp. paratuberculosis
gcgcggccagccccgggaac

SEQ ID NO: 886986 - RNA, 12 nt, Mycobacterium avium subsp. paratuberculosis
gcgcggcccagg

SEQ ID NO: 886987 - RNA, 13 nt, Mycobacterium avium subsp. paratuberculosis
gcgcggcccaggg

SEQ ID NO: 886988 - RNA, 18 nt, Mycobacterium avium subsp. paratuberculosis
gcgcggcgcggagccggc

SEQ ID NO: 886989 - RNA, 15 nt, Mycobacterium avium subsp. paratuberculosis
gcgcggcgcccccgc

SEQ ID NO: 886990 - RNA, 13 nt, Mycobacterium avium subsp. paratuberculosis
gcgcggcgcccag

SEQ ID NO: 886991 - RNA, 20 nt, Mycobacterium avium subsp. paratuberculosis
gcgcggcgcagcgcgauguc

SEQ ID NO: 886992 - RNA, 13 nt, Mycobacterium avium subsp. paratuberculosis
gcgcggcgcaccg

SEQ ID NO: 886993 - RNA, 18 nt, Mycobacterium avium subsp. paratuberculosis
gcgcggcgcaccgagucg

SEQ ID NO: 886994 - RNA, 14 nt, Mycobacterium avium subsp. paratuberculosis
gcgcggcgcaccgc

SEQ ID NO: 886995 - RNA, 19 nt, Mycobacterium avium subsp. paratuberculosis
gcgcggcgaucucggcggc

SEQ ID NO: 886996 - RNA, 22 nt, Mycobacterium avium subsp. paratuberculosis
gcgcggcgaugaccgccugcgg

SEQ ID NO: 886997 - RNA, 12 nt, Mycobacterium avium subsp. paratuberculosis
gcgcggcgaugc

SEQ ID NO: 886998 - RNA, 21 nt, Mycobacterium avium subsp. paratuberculosis
gcgcggcgaugcgcuccagca

SEQ ID NO: 886999 - RNA, 18 nt, Mycobacterium avium subsp. paratuberculosis
gcgcggcgauggccgaca

SEQ ID NO: 887000 - RNA, 18 nt, Mycobacterium avium subsp. paratuberculosis
gcgcggcgaucagcagca

SEQ ID NO: 887001 - RNA, 18 nt, Mycobacterium avium subsp. paratuberculosis
gcgcggcgacggcgaacg

SEQ ID NO: 887002 - RNA, 14 nt, Mycobacterium avium subsp. paratuberculosis
gcgcggcgacggug

SEQ ID NO: 887003 - RNA, 17 nt, Mycobacterium avium subsp. paratuberculosis
gcgcggcgacgguggcg

SEQ ID NO: 887004 - RNA, 15 nt, Mycobacterium avium subsp. paratuberculosis
gcgcggcgaccaccu

SEQ ID NO: 887005 - RNA, 12 nt, Mycobacterium avium subsp. paratuberculosis
gcgcggccagcg

SEQ ID NO: 887006 - RNA, 13 nt, Mycobacterium avium subsp. paratuberculosis
gcgcggccacccc

SEQ ID NO: 887007 - RNA, 17 nt, Mycobacterium avium subsp. paratuberculosis
gcgcggccagcacgguc

SEQ ID NO: 887008 - RNA, 15 nt, Mycobacterium avium subsp. paratuberculosis
gcgcggccaccucca

SEQ ID NO: 887009 - RNA, 17 nt, Mycobacterium avium subsp. paratuberculosis
gcgcggccaccuccagc

SEQ ID NO: 887010 - RNA, 17 nt, Mycobacterium avium subsp. paratuberculosis
gcgcggccaccagcgcg

SEQ ID NO: 887011 - RNA, 18 nt, Mycobacterium avium subsp. paratuberculosis
gcgcggccaccagcgcgg

SEQ ID NO: 887012 - RNA, 20 nt, Mycobacterium avium subsp. paratuberculosis
gcgcggcauggcuggcggca

SEQ ID NO: 887013 - RNA, 23 nt, Mycobacterium avium subsp. paratuberculosis
gcgcggcauggcuggcggcaacg

SEQ ID NO: 887014 - RNA, 18 nt, Mycobacterium avium subsp. paratuberculosis
gcgcggccacaccgauca

SEQ ID NO: 887015 - RNA, 12 nt, Mycobacterium avium subsp. paratuberculosis
gcgcggccacca

SEQ ID NO: 887016 - RNA, 22 nt, Mycobacterium avium subsp. paratuberculosis
gcgcggccaccaccacggccau

SEQ ID NO: 887017 - RNA, 15 nt, Mycobacterium avium subsp. paratuberculosis
gcgcggccaccacga

SEQ ID NO: 887018 - RNA, 14 nt, Mycobacterium avium subsp. paratuberculosis
gcgcggcaucggcg

SEQ ID NO: 887019 - RNA, 19 nt, Mycobacterium avium subsp. paratuberculosis
gcgcggcaucggcgacggc

SEQ ID NO: 887020 - RNA, 12 nt, Mycobacterium avium subsp. paratuberculosis
gcgcggcaucgu

SEQ ID NO: 887021 - RNA, 13 nt, Mycobacterium avium subsp. paratuberculosis
gcgcggcaucguc

SEQ ID NO: 887022 - RNA, 21 nt, Mycobacterium avium subsp. paratuberculosis
gcgcggcaucgucaccucgag

SEQ ID NO: 887023 - RNA, 20 nt, Mycobacterium avium subsp. paratuberculosis
gcgcggcaguccgccggaga

SEQ ID NO: 887024 - RNA, 14 nt, Mycobacterium avium subsp. paratuberculosis
gcgcgccccggccc

SEQ ID NO: 887025 - RNA, 17 nt, Mycobacterium avium subsp. paratuberculosis
gcgcgccccggcccggc

SEQ ID NO: 887026 - RNA, 20 nt, Mycobacterium avium subsp. paratuberculosis
gcgcgccccggcccggcgaa

SEQ ID NO: 887027 - RNA, 20 nt, Mycobacterium avium subsp. paratuberculosis
gcgcgccccggucccgccgg

SEQ ID NO: 887028 - RNA, 21 nt, Mycobacterium avium subsp. paratuberculosis
gcgcgccccggucccgccggu

SEQ ID NO: 887029 - RNA, 22 nt, Mycobacterium avium subsp. paratuberculosis
gcgcgccccagccccucgccgg

SEQ ID NO: 887030 - RNA, 13 nt, Mycobacterium avium subsp. paratuberculosis
gcgcgcccacccg

SEQ ID NO: 887031 - RNA, 19 nt, Mycobacterium avium subsp. paratuberculosis
gcgcgcccacccgcgccgg

SEQ ID NO: 887032 - RNA, 15 nt, Mycobacterium avium subsp. paratuberculosis
gcgcgcagccacgag

SEQ ID NO: 887033 - RNA, 17 nt, Mycobacterium avium subsp. paratuberculosis
gcgccagcuccagcagc

SEQ ID NO: 887034 - RNA, 19 nt, Mycobacterium avium subsp. paratuberculosis
gcgccagcuccagcagccc

SEQ ID NO: 887035 - RNA, 22 nt, Mycobacterium avium subsp. paratuberculosis
gcgccagcuccagcagcccggg

SEQ ID NO: 887036 - RNA, 19 nt, Mycobacterium avium subsp. paratuberculosis
gcgccagcguggcgaacgc

SEQ ID NO: 887037 - RNA, 15 nt, Mycobacterium avium subsp. paratuberculosis
gcgccagcguggcca

SEQ ID NO: 887038 - RNA, 18 nt, Mycobacterium avium subsp. paratuberculosis
gcgccagcguggccagca

SEQ ID NO: 887039 - RNA, 15 nt, Mycobacterium avium subsp. paratuberculosis
gcgccagcucggcgg

SEQ ID NO: 887040 - RNA, 17 nt, Mycobacterium avium subsp. paratuberculosis
gcgccagcucggcggcc

SEQ ID NO: 887041 - RNA, 18 nt, Mycobacterium avium subsp. paratuberculosis
gcgccagcucggcggccg

SEQ ID NO: 887042 - RNA, 20 nt, Mycobacterium avium subsp. paratuberculosis
gcgccagcgugaacagcgcc

SEQ ID NO: 887043 - RNA, 22 nt, Mycobacterium avium subsp. paratuberculosis
gcgccauccccgcuucggcucg

SEQ ID NO: 887044 - RNA, 16 nt, Mycobacterium avium subsp. paratuberculosis
gcgccauccgcagccc

SEQ ID NO: 887045 - RNA, 19 nt, Mycobacterium avium subsp. paratuberculosis
gcgccauccgcagcccguc

SEQ ID NO: 887046 - RNA, 21 nt, Mycobacterium avium subsp. paratuberculosis
gcgccauccgcagcccgucga

SEQ ID NO: 887047 - RNA, 13 nt, Mycobacterium avium subsp. paratuberculosis
gcgccauccgcca

SEQ ID NO: 887048 - RNA, 16 nt, Mycobacterium avium subsp. paratuberculosis
gcgccauccgccaccc

SEQ ID NO: 887049 - RNA, 13 nt, Mycobacterium avium subsp. paratuberculosis
gcgccagcucggc

SEQ ID NO: 887050 - RNA, 17 nt, Mycobacterium avium subsp. paratuberculosis
gcgccagggucuggccc

SEQ ID NO: 887051 - RNA, 22 nt, Mycobacterium avium subsp. paratuberculosis
gcgccagggucuggcccggugc

SEQ ID NO: 887052 - RNA, 15 nt, Mycobacterium avium subsp. paratuberculosis
gcgccagcccgguga

SEQ ID NO: 887053 - RNA, 21 nt, Mycobacterium avium subsp. paratuberculosis
gcgccagcccggugaucgccg

SEQ ID NO: 887054 - RNA, 14 nt, Mycobacterium avium subsp. paratuberculosis
gcgccagccgcacc

SEQ ID NO: 887055 - RNA, 20 nt, Mycobacterium avium subsp. paratuberculosis
gcgccagccgccgccgacca

SEQ ID NO: 887056 - RNA, 13 nt, Mycobacterium avium subsp. paratuberculosis
gcgccagcaugcc

SEQ ID NO: 887057 - RNA, 14 nt, Mycobacterium avium subsp. paratuberculosis
gcgccagcggccga

SEQ ID NO: 887058 - RNA, 14 nt, Mycobacterium avium subsp. paratuberculosis
gcgccagcggucca

SEQ ID NO: 887059 - RNA, 19 nt, Mycobacterium avium subsp. paratuberculosis
gcgccagcgguccagcgug

SEQ ID NO: 887060 - RNA, 15 nt, Mycobacterium avium subsp. paratuberculosis
gcgccagcccgccga

SEQ ID NO: 887061 - RNA, 12 nt, Mycobacterium avium subsp. paratuberculosis
gcgccagcccgc

SEQ ID NO: 887062 - RNA, 20 nt, Mycobacterium avium subsp. paratuberculosis
gcgccagcccgcccagcgcc

SEQ ID NO: 887063 - RNA, 22 nt, Mycobacterium avium subsp. paratuberculosis
gcgccagcccgcccagcgccac

SEQ ID NO: 887064 - RNA, 13 nt, Mycobacterium avium subsp. paratuberculosis
gcgccagcagggc

SEQ ID NO: 887065 - RNA, 16 nt, Mycobacterium avium subsp. paratuberculosis
gcgccagcagcggcac

SEQ ID NO: 887066 - RNA, 21 nt, Mycobacterium avium subsp. paratuberculosis
gcgccagcagcggcacccggu

SEQ ID NO: 887067 - RNA, 18 nt, Mycobacterium avium subsp. paratuberculosis
gcgccagcagcagcgcgg

SEQ ID NO: 887068 - RNA, 19 nt, Mycobacterium avium subsp. paratuberculosis
gcgccagcagcagcgcggc

SEQ ID NO: 887069 - RNA, 22 nt, Mycobacterium avium subsp. paratuberculosis
gcgccagcagcagcgcggcaug

SEQ ID NO: 887070 - RNA, 13 nt, Mycobacterium avium subsp. paratuberculosis
gcgccacgccgcg

SEQ ID NO: 887071 - RNA, 22 nt, Mycobacterium avium subsp. paratuberculosis
gcgccacgccgcgauccgggca

SEQ ID NO: 887072 - RNA, 15 nt, Mycobacterium avium subsp. paratuberculosis
gcgccacgccccggc

SEQ ID NO: 887073 - RNA, 18 nt, Mycobacterium avium subsp. paratuberculosis
gcgccacgccccggcgcc

SEQ ID NO: 887074 - RNA, 21 nt, Mycobacterium avium subsp. paratuberculosis
gcgccacgccccggcgccguc

SEQ ID NO: 887075 - RNA, 19 nt, Mycobacterium avium subsp. paratuberculosis
gcgccacgacugcgcggcc

SEQ ID NO: 887076 - RNA, 20 nt, Mycobacterium avium subsp. paratuberculosis
gcgccacgacugcgcggccg

SEQ ID NO: 887077 - RNA, 22 nt, Mycobacterium avium subsp. paratuberculosis
gcgccacgacugcgcggccggc

SEQ ID NO: 887078 - RNA, 23 nt, Mycobacterium avium subsp. paratuberculosis
gcgccacgacugcgcggccggcg

SEQ ID NO: 887079 - RNA, 18 nt, Mycobacterium avium subsp. paratuberculosis
gcgccacgcacaccgcgc

SEQ ID NO: 887080 - RNA, 13 nt, Mycobacterium avium subsp. paratuberculosis
gcgccacgaccag

SEQ ID NO: 887081 - RNA, 20 nt, Mycobacterium avium subsp. paratuberculosis
gcgccacgaccagcggcagc

SEQ ID NO: 887082 - RNA, 22 nt, Mycobacterium avium subsp. paratuberculosis
gcgccacgacguacccccgcac

SEQ ID NO: 887083 - RNA, 13 nt, Mycobacterium avium subsp. paratuberculosis
gcgccaccggcug

SEQ ID NO: 887084 - RNA, 18 nt, Mycobacterium avium subsp. paratuberculosis
gcgccaccggcuggccgg

SEQ ID NO: 887085 - RNA, 22 nt, Mycobacterium avium subsp. paratuberculosis
gcgccaccgcggggcugggcgc

SEQ ID NO: 887086 - RNA, 19 nt, Mycobacterium avium subsp. paratuberculosis
gcgccaccagcaccgggaa

SEQ ID NO: 887087 - RNA, 20 nt, Mycobacterium avium subsp. paratuberculosis
gcgccaccggguaagugucg

SEQ ID NO: 887088 - RNA, 15 nt, Mycobacterium avium subsp. paratuberculosis
gcgccaccgacacca

SEQ ID NO: 887089 - RNA, 19 nt, Mycobacterium avium subsp. paratuberculosis
gcgccaccgacaccaccgg

SEQ ID NO: 887090 - RNA, 21 nt, Mycobacterium avium subsp. paratuberculosis
gcgccaccgacaccaccggcc

SEQ ID NO: 887091 - RNA, 12 nt, Mycobacterium avium subsp. paratuberculosis
gcgccaccgagg

SEQ ID NO: 887092 - RNA, 21 nt, Mycobacterium avium subsp. paratuberculosis
gcgcauguaggacaccccggc

SEQ ID NO: 887093 - RNA, 20 nt, Mycobacterium avium subsp. paratuberculosis
gcgccaacaacucgacgcuc

SEQ ID NO: 887094 - RNA, 23 nt, Mycobacterium avium subsp. paratuberculosis
gcgccaacaacucgacgcucggc

SEQ ID NO: 887095 - RNA, 19 nt, Mycobacterium avium subsp. paratuberculosis
gcgccaaccuguuuggcug

SEQ ID NO: 887096 - RNA, 21 nt, Mycobacterium avium subsp. paratuberculosis
gcgccaacgaggcacggcccg

SEQ ID NO: 887097 - RNA, 21 nt, Mycobacterium avium subsp. paratuberculosis
gcgccaacugaauuccuggcc

SEQ ID NO: 887098 - RNA, 23 nt, Mycobacterium avium subsp. paratuberculosis
gcgccaacugaauuccuggccgg

SEQ ID NO: 887099 - RNA, 13 nt, Mycobacterium avium subsp. paratuberculosis
gcgccacaccgaa

SEQ ID NO: 887100 - RNA, 13 nt, Mycobacterium avium subsp. paratuberculosis
gcgccaccagcac

SEQ ID NO: 887101 - RNA, 21 nt, Mycobacterium avium subsp. paratuberculosis
gcgccaccagccacaccgccg

SEQ ID NO: 887102 - RNA, 15 nt, Mycobacterium avium subsp. paratuberculosis
gcgccaccaggcggu

SEQ ID NO: 887103 - RNA, 19 nt, Mycobacterium avium subsp. paratuberculosis
gcgccaccccgaacccggc

SEQ ID NO: 887104 - RNA, 20 nt, Mycobacterium avium subsp. paratuberculosis
gcgccaccccgaacccggcc

SEQ ID NO: 887105 - RNA, 22 nt, Mycobacterium avium subsp. paratuberculosis
gcgccaccccgaacccggccag

SEQ ID NO: 887106 - RNA, 12 nt, Mycobacterium avium subsp. paratuberculosis
gcgccacccgca

SEQ ID NO: 887107 - RNA, 16 nt, Mycobacterium avium subsp. paratuberculosis
gcgccacccgcaugcu

SEQ ID NO: 887108 - RNA, 22 nt, Mycobacterium avium subsp. paratuberculosis
gcgccacaauggauccgaucag

SEQ ID NO: 887109 - RNA, 18 nt, Mycobacterium avium subsp. paratuberculosis
gcgccaaugguuuucguc

SEQ ID NO: 887110 - RNA, 14 nt, Mycobacterium avium subsp. paratuberculosis
gcgccacagcagca

SEQ ID NO: 887111 - RNA, 18 nt, Mycobacterium avium subsp. paratuberculosis
gcgccacagcagcaccag

SEQ ID NO: 887112 - RNA, 20 nt, Mycobacterium avium subsp. paratuberculosis
gcgccacagcagcaccagcg

SEQ ID NO: 887113 - RNA, 22 nt, Mycobacterium avium subsp. paratuberculosis
gcgccacagcagcaccagcgcg

SEQ ID NO: 887114 - RNA, 12 nt, Mycobacterium avium subsp. paratuberculosis
gcgccacaucag

SEQ ID NO: 887115 - RNA, 15 nt, Mycobacterium avium subsp. paratuberculosis
gcgccacaucagcuc

SEQ ID NO: 887116 - RNA, 18 nt, Mycobacterium avium subsp. paratuberculosis
gcgccacaucagcucggc

SEQ ID NO: 887117 - RNA, 20 nt, Mycobacterium avium subsp. paratuberculosis
gcgccacaucagcucggcgg

SEQ ID NO: 887118 - RNA, 17 nt, Mycobacterium avium subsp. paratuberculosis
gcgccacaacuggccgg

SEQ ID NO: 887119 - RNA, 20 nt, Mycobacterium avium subsp. paratuberculosis
gcgccacaacuggccgggau

SEQ ID NO: 887120 - RNA, 20 nt, Mycobacterium avium subsp. paratuberculosis
gcgcaccagauucaccagcg

SEQ ID NO: 887121 - RNA, 23 nt, Mycobacterium avium subsp. paratuberculosis
gcgcaccagauucaccagcgccu

SEQ ID NO: 887122 - RNA, 12 nt, Mycobacterium avium subsp. paratuberculosis
gcgcaccagcuc

SEQ ID NO: 887123 - RNA, 15 nt, Mycobacterium avium subsp. paratuberculosis
gcgcaccagcucggc

SEQ ID NO: 887124 - RNA, 16 nt, Mycobacterium avium subsp. paratuberculosis
gcgcaccagcucggcg

SEQ ID NO: 887125 - RNA, 22 nt, Mycobacterium avium subsp. paratuberculosis
gcgcaccagcugauucgcggug

SEQ ID NO: 887126 - RNA, 23 nt, Mycobacterium avium subsp. paratuberculosis
gcgcaccaggcgccacagcagca

SEQ ID NO: 887127 - RNA, 22 nt, Mycobacterium avium subsp. paratuberculosis
gcgcaccacgaccuccgugccg

SEQ ID NO: 887128 - RNA, 15 nt, Mycobacterium avium subsp. paratuberculosis
gcgcaccacgguggc

SEQ ID NO: 887129 - RNA, 12 nt, Mycobacterium avium subsp. paratuberculosis
gcgcaccacguc

SEQ ID NO: 887130 - RNA, 16 nt, Mycobacterium avium subsp. paratuberculosis
gcgcaccacgucgggu

SEQ ID NO: 887131 - RNA, 23 nt, Mycobacterium avium subsp. paratuberculosis
gcgcaccacgucggguucgccgg

SEQ ID NO: 887132 - RNA, 15 nt, Mycobacterium avium subsp. paratuberculosis
gcgcaugccagacca

SEQ ID NO: 887133 - RNA, 17 nt, Mycobacterium avium subsp. paratuberculosis
gcgcaugccagaccaca

SEQ ID NO: 887134 - RNA, 17 nt, Mycobacterium avium subsp. paratuberculosis
gcgcaccagggccgcga

SEQ ID NO: 887135 - RNA, 20 nt, Mycobacterium avium subsp. paratuberculosis
gcgcaugaccgauccgccgg

SEQ ID NO: 887136 - RNA, 22 nt, Mycobacterium avium subsp. paratuberculosis
gcgcaugaccgauccgccggcg

SEQ ID NO: 887137 - RNA, 20 nt, Mycobacterium avium subsp. paratuberculosis
gcgcaugacggccugcacca

SEQ ID NO: 887138 - RNA, 21 nt, Mycobacterium avium subsp. paratuberculosis
gcgcaugacggccugcaccac

SEQ ID NO: 887139 - RNA, 23 nt, Mycobacterium avium subsp. paratuberculosis
gcgcaccagggugucgucgcgca

SEQ ID NO: 887140 - RNA, 14 nt, Mycobacterium avium subsp. paratuberculosis
gcgcauucggcgac

SEQ ID NO: 887141 - RNA, 17 nt, Mycobacterium avium subsp. paratuberculosis
gcgcauucggcgacgcu

SEQ ID NO: 887142 - RNA, 14 nt, Mycobacterium avium subsp. paratuberculosis
gcgcauucaccagc

SEQ ID NO: 887143 - RNA, 17 nt, Mycobacterium avium subsp. paratuberculosis
gcgcauucaccagcugu

SEQ ID NO: 887144 - RNA, 15 nt, Mycobacterium avium subsp. paratuberculosis
gcgcauggagaugcu

SEQ ID NO: 887145 - RNA, 16 nt, Mycobacterium avium subsp. paratuberculosis
gcgcauggcgugcuga

SEQ ID NO: 887146 - RNA, 14 nt, Mycobacterium avium subsp. paratuberculosis
gcgcauggucaggu

SEQ ID NO: 887147 - RNA, 17 nt, Mycobacterium avium subsp. paratuberculosis
gcgcaugaugcccaggc

SEQ ID NO: 887148 - RNA, 23 nt, Mycobacterium avium subsp. paratuberculosis
gcgcaugccgaacaacagggccg

SEQ ID NO: 887149 - RNA, 17 nt, Mycobacterium avium subsp. paratuberculosis
gcgcccgcccggacacc

SEQ ID NO: 887150 - RNA, 19 nt, Mycobacterium avium subsp. paratuberculosis
gcgcccgccgcguacaccg

SEQ ID NO: 887151 - RNA, 21 nt, Mycobacterium avium subsp. paratuberculosis
gcgcccgccgcguacaccggc

SEQ ID NO: 887152 - RNA, 16 nt, Mycobacterium avium subsp. paratuberculosis
gcgcccgccggcccag

SEQ ID NO: 887153 - RNA, 17 nt, Mycobacterium avium subsp. paratuberculosis
gcgcccgccggcccagc

SEQ ID NO: 887154 - RNA, 19 nt, Mycobacterium avium subsp. paratuberculosis
gcgcccgccggcccagcuc

SEQ ID NO: 887155 - RNA, 22 nt, Mycobacterium avium subsp. paratuberculosis
gcgcccgccggcccagcuccac

SEQ ID NO: 887156 - RNA, 23 nt, Mycobacterium avium subsp. paratuberculosis
gcgcccgccggcccagcuccacg

SEQ ID NO: 887157 - RNA, 18 nt, Mycobacterium avium subsp. paratuberculosis
gcgcccgcgaacacgcga

SEQ ID NO: 887158 - RNA, 13 nt, Mycobacterium avium subsp. paratuberculosis
gcgcccgcgccac

SEQ ID NO: 887159 - RNA, 17 nt, Mycobacterium avium subsp. paratuberculosis
gcgcccgcgccaccccg

SEQ ID NO: 887160 - RNA, 12 nt, Mycobacterium avium subsp. paratuberculosis
gcgcccgcgcga

SEQ ID NO: 887161 - RNA, 21 nt, Mycobacterium avium subsp. paratuberculosis
gcgcccggccagccggccgcu

SEQ ID NO: 887162 - RNA, 17 nt, Mycobacterium avium subsp. paratuberculosis
gcgcccggccagccggu

SEQ ID NO: 887163 - RNA, 15 nt, Mycobacterium avium subsp. paratuberculosis
gcgcccggcgucggu

SEQ ID NO: 887164 - RNA, 19 nt, Mycobacterium avium subsp. paratuberculosis
gcgcccggcgucggugguc

SEQ ID NO: 887165 - RNA, 18 nt, Mycobacterium avium subsp. paratuberculosis
gcgcccggcgcccggcgc

SEQ ID NO: 887166 - RNA, 19 nt, Mycobacterium avium subsp. paratuberculosis
gcgcccggcgcccggcgcg

SEQ ID NO: 887167 - RNA, 13 nt, Mycobacterium avium subsp. paratuberculosis
gcgcccggcgccg

SEQ ID NO: 887168 - RNA, 18 nt, Mycobacterium avium subsp. paratuberculosis
gcgcccggcgccggcccg

SEQ ID NO: 887169 - RNA, 13 nt, Mycobacterium avium subsp. paratuberculosis
gcgcccggcgcgc

SEQ ID NO: 887170 - RNA, 16 nt, Mycobacterium avium subsp. paratuberculosis
gcgcccggcgcgccac

SEQ ID NO: 887171 - RNA, 16 nt, Mycobacterium avium subsp. paratuberculosis
gcgcccggcgaccacc

SEQ ID NO: 887172 - RNA, 22 nt, Mycobacterium avium subsp. paratuberculosis
gcgcccggcgaccaccagccgc

SEQ ID NO: 887173 - RNA, 12 nt, Mycobacterium avium subsp. paratuberculosis
gcgcccggccau

SEQ ID NO: 887174 - RNA, 15 nt, Mycobacterium avium subsp. paratuberculosis
gcgcccggcccagcc

SEQ ID NO: 887175 - RNA, 14 nt, Mycobacterium avium subsp. paratuberculosis
gcgcccuccacguc

SEQ ID NO: 887176 - RNA, 21 nt, Mycobacterium avium subsp. paratuberculosis
gcgcccucgaugcgcaccgug

SEQ ID NO: 887177 - RNA, 15 nt, Mycobacterium avium subsp. paratuberculosis
gcgcccucgccggcg

SEQ ID NO: 887178 - RNA, 21 nt, Mycobacterium avium subsp. paratuberculosis
gcgcccucgccggcggcgccc

SEQ ID NO: 887179 - RNA, 17 nt, Mycobacterium avium subsp. paratuberculosis
gcgcccuagucgacgcc

SEQ ID NO: 887180 - RNA, 12 nt, Mycobacterium avium subsp. paratuberculosis
gcgcccucggcg

SEQ ID NO: 887181 - RNA, 15 nt, Mycobacterium avium subsp. paratuberculosis
gcgcccucggcgauc

SEQ ID NO: 887182 - RNA, 16 nt, Mycobacterium avium subsp. paratuberculosis
gcgcccugcacccagc

SEQ ID NO: 887183 - RNA, 17 nt, Mycobacterium avium subsp. paratuberculosis
gcgcccugcacccagcc

SEQ ID NO: 887184 - RNA, 13 nt, Mycobacterium avium subsp. paratuberculosis
gcgcccugcacga

SEQ ID NO: 887185 - RNA, 16 nt, Mycobacterium avium subsp. paratuberculosis
gcgcccugcacgaaca

SEQ ID NO: 887186 - RNA, 16 nt, Mycobacterium avium subsp. paratuberculosis
gcgcccugcgagcccg

SEQ ID NO: 887187 - RNA, 15 nt, Mycobacterium avium subsp. paratuberculosis
gcgcccugcgcgccc

SEQ ID NO: 887188 - RNA, 12 nt, Mycobacterium avium subsp. paratuberculosis
gcgcccugcugg

SEQ ID NO: 887189 - RNA, 15 nt, Mycobacterium avium subsp. paratuberculosis
gcgcccuggaucgcg

SEQ ID NO: 887190 - RNA, 17 nt, Mycobacterium avium subsp. paratuberculosis
gcgcccuggaucgcgcc

SEQ ID NO: 887191 - RNA, 18 nt, Mycobacterium avium subsp. paratuberculosis
gcgcccuggaucgcgccu

SEQ ID NO: 887192 - RNA, 17 nt, Mycobacterium avium subsp. paratuberculosis
gcgcccugaggcccggu

SEQ ID NO: 887193 - RNA, 16 nt, Mycobacterium avium subsp. paratuberculosis
gcgcccgucgagcguc

SEQ ID NO: 887194 - RNA, 22 nt, Mycobacterium avium subsp. paratuberculosis
gcgcccgucgagcgucacgccg

SEQ ID NO: 887195 - RNA, 20 nt, Mycobacterium avium subsp. paratuberculosis
gcgcccgucgagcgucauuc

SEQ ID NO: 887196 - RNA, 13 nt, Mycobacterium avium subsp. paratuberculosis
gcgcccgucggug

SEQ ID NO: 887197 - RNA, 14 nt, Mycobacterium avium subsp. paratuberculosis
gcgcccgucgucgc

SEQ ID NO: 887198 - RNA, 22 nt, Mycobacterium avium subsp. paratuberculosis
gcgcccguagccgcgguucggc

SEQ ID NO: 887199 - RNA, 15 nt, Mycobacterium avium subsp. paratuberculosis
gcgcccgucacgcug

SEQ ID NO: 887200 - RNA, 13 nt, Mycobacterium avium subsp. paratuberculosis
gcgcccggccggc

SEQ ID NO: 887201 - RNA, 15 nt, Mycobacterium avium subsp. paratuberculosis
gcgcccgggccagga

SEQ ID NO: 887202 - RNA, 16 nt, Mycobacterium avium subsp. paratuberculosis
gcgcccggcuccccga

SEQ ID NO: 887203 - RNA, 20 nt, Mycobacterium avium subsp. paratuberculosis
gcgcccggcuccccgaccac

SEQ ID NO: 887204 - RNA, 12 nt, Mycobacterium avium subsp. paratuberculosis
gcgcccgggugg

SEQ ID NO: 887205 - RNA, 14 nt, Mycobacterium avium subsp. paratuberculosis
gcgcccgggugggc

SEQ ID NO: 887206 - RNA, 22 nt, Mycobacterium avium subsp. paratuberculosis
gcgcccgggcguucccgcgcgc

SEQ ID NO: 887207 - RNA, 19 nt, Mycobacterium avium subsp. paratuberculosis
gcgcccggucaggaacccg

SEQ ID NO: 887208 - RNA, 17 nt, Mycobacterium avium subsp. paratuberculosis
gcgccccuggcgucggg

SEQ ID NO: 887209 - RNA, 16 nt, Mycobacterium avium subsp. paratuberculosis
gcgcccccgcgacguc

SEQ ID NO: 887210 - RNA, 22 nt, Mycobacterium avium subsp. paratuberculosis
gcgccccggcgcagcgccgcgc

SEQ ID NO: 887211 - RNA, 12 nt, Mycobacterium avium subsp. paratuberculosis
gcgccccggucc

SEQ ID NO: 887212 - RNA, 13 nt, Mycobacterium avium subsp. paratuberculosis
gcgccccgguccg

SEQ ID NO: 887213 - RNA, 21 nt, Mycobacterium avium subsp. paratuberculosis
gcgccccgguccggcugaacg

SEQ ID NO: 887214 - RNA, 15 nt, Mycobacterium avium subsp. paratuberculosis
gcgcccgccccgacg

SEQ ID NO: 887215 - RNA, 14 nt, Mycobacterium avium subsp. paratuberculosis
gcgcccgcccggcc

SEQ ID NO: 887216 - RNA, 19 nt, Mycobacterium avium subsp. paratuberculosis
gcgcccgcccggcccggcg

SEQ ID NO: 887217 - RNA, 21 nt, Mycobacterium avium subsp. paratuberculosis
gcgcccgcccggcccggcgcg

SEQ ID NO: 887218 - RNA, 12 nt, Mycobacterium avium subsp. paratuberculosis
gcgcccgccgaa

SEQ ID NO: 887219 - RNA, 20 nt, Mycobacterium avium subsp. paratuberculosis
gcgcccgccgaacaccggca

SEQ ID NO: 887220 - RNA, 21 nt, Mycobacterium avium subsp. paratuberculosis
gcgcccgccgaacaccggcag

SEQ ID NO: 887221 - RNA, 22 nt, Mycobacterium avium subsp. paratuberculosis
gcgcccgccgaacaccggcagc

SEQ ID NO: 887222 - RNA, 18 nt, Mycobacterium avium subsp. paratuberculosis
gcgcccgccgccaccacg

SEQ ID NO: 887223 - RNA, 23 nt, Mycobacterium avium subsp. paratuberculosis
gcgcccgccgccaccacggcagu

SEQ ID NO: 887224 - RNA, 16 nt, Mycobacterium avium subsp. paratuberculosis
gcgccccggcccggcg

SEQ ID NO: 887225 - RNA, 17 nt, Mycobacterium avium subsp. paratuberculosis
gcgccccggcccggcga

SEQ ID NO: 887226 - RNA, 16 nt, Mycobacterium avium subsp. paratuberculosis
gcgccccggcgcgccu

SEQ ID NO: 887227 - RNA, 20 nt, Mycobacterium avium subsp. paratuberculosis
gcgccccggcgcgccugcgc

SEQ ID NO: 887228 - RNA, 22 nt, Mycobacterium avium subsp. paratuberculosis
gcgccccggcgcgccugcgcgg

SEQ ID NO: 887229 - RNA, 14 nt, Mycobacterium avium subsp. paratuberculosis
gcgccccggcggcc

SEQ ID NO: 887230 - RNA, 13 nt, Mycobacterium avium subsp. paratuberculosis
gcgccccggcggg

SEQ ID NO: 887231 - RNA, 14 nt, Mycobacterium avium subsp. paratuberculosis
gcgccccggcgggc

SEQ ID NO: 887232 - RNA, 14 nt, Mycobacterium avium subsp. paratuberculosis
gcgccccggcgucg

SEQ ID NO: 887233 - RNA, 16 nt, Mycobacterium avium subsp. paratuberculosis
gcgccccggcgucgau

SEQ ID NO: 887234 - RNA, 18 nt, Mycobacterium avium subsp. paratuberculosis
gcgccccgacaucgccau

SEQ ID NO: 887235 - RNA, 19 nt, Mycobacterium avium subsp. paratuberculosis
gcgccccgacaucgccauc

SEQ ID NO: 887236 - RNA, 15 nt, Mycobacterium avium subsp. paratuberculosis
gcgccccgagcagcg

SEQ ID NO: 887237 - RNA, 19 nt, Mycobacterium avium subsp. paratuberculosis
gcgccccgagcagcggguc

SEQ ID NO: 887238 - RNA, 19 nt, Mycobacterium avium subsp. paratuberculosis
gcgccaugaacuccgacuc

SEQ ID NO: 887239 - RNA, 23 nt, Mycobacterium avium subsp. paratuberculosis
gcgccaucuucacgugcgcggcg

SEQ ID NO: 887240 - RNA, 14 nt, Mycobacterium avium subsp. paratuberculosis
gcgccaugcugccc

SEQ ID NO: 887241 - RNA, 15 nt, Mycobacterium avium subsp. paratuberculosis
gcgccaugcugcccu

SEQ ID NO: 887242 - RNA, 14 nt, Mycobacterium avium subsp. paratuberculosis
gcgccaugcgccgc

SEQ ID NO: 887243 - RNA, 16 nt, Mycobacterium avium subsp. paratuberculosis
gcgccaugcgccgcgc

SEQ ID NO: 887244 - RNA, 12 nt, Mycobacterium avium subsp. paratuberculosis
gcgccaugcgcc

SEQ ID NO: 887245 - RNA, 13 nt, Mycobacterium avium subsp. paratuberculosis
gcgccaugccgcc

SEQ ID NO: 887246 - RNA, 15 nt, Mycobacterium avium subsp. paratuberculosis
gcgccaugccgccga

SEQ ID NO: 887247 - RNA, 17 nt, Mycobacterium avium subsp. paratuberculosis
gcgccaugccgccgacc

SEQ ID NO: 887248 - RNA, 21 nt, Mycobacterium avium subsp. paratuberculosis
gcgccaugccgccgaccgccg

SEQ ID NO: 887249 - RNA, 12 nt, Mycobacterium avium subsp. paratuberculosis
gcgccgccacgc

SEQ ID NO: 887250 - RNA, 16 nt, Mycobacterium avium subsp. paratuberculosis
gcgccgccacgcggcg

SEQ ID NO: 887251 - RNA, 17 nt, Mycobacterium avium subsp. paratuberculosis
gcgccgccacgcggcgc

SEQ ID NO: 887252 - RNA, 20 nt, Mycobacterium avium subsp. paratuberculosis
gcgccgccacgcggcgcgca

SEQ ID NO: 887253 - RNA, 21 nt, Mycobacterium avium subsp. paratuberculosis
gcgccgccacggcacgucgag

SEQ ID NO: 887254 - RNA, 16 nt, Mycobacterium avium subsp. paratuberculosis
gcgccgccacggccac

SEQ ID NO: 887255 - RNA, 14 nt, Mycobacterium avium subsp. paratuberculosis
gcgccgccaccggc

SEQ ID NO: 887256 - RNA, 20 nt, Mycobacterium avium subsp. paratuberculosis
gcgccgccagcaaccccgcg

SEQ ID NO: 887257 - RNA, 21 nt, Mycobacterium avium subsp. paratuberculosis
gcgccgccagcaaccccgcgg

SEQ ID NO: 887258 - RNA, 15 nt, Mycobacterium avium subsp. paratuberculosis
gcgccgcccacaccg

SEQ ID NO: 887259 - RNA, 17 nt, Mycobacterium avium subsp. paratuberculosis
gcgccgcccacaccgac

SEQ ID NO: 887260 - RNA, 16 nt, Mycobacterium avium subsp. paratuberculosis
gcgccgcccaccagca

SEQ ID NO: 887261 - RNA, 17 nt, Mycobacterium avium subsp. paratuberculosis
gcgccgcccaccagcac

SEQ ID NO: 887262 - RNA, 18 nt, Mycobacterium avium subsp. paratuberculosis
gcgccgcccaccuuccca

SEQ ID NO: 887263 - RNA, 12 nt, Mycobacterium avium subsp. paratuberculosis
gcgccgccaggg

SEQ ID NO: 887264 - RNA, 20 nt, Mycobacterium avium subsp. paratuberculosis
gcgccgccagggcgcggcgc

SEQ ID NO: 887265 - RNA, 16 nt, Mycobacterium avium subsp. paratuberculosis
gcgccgcacugcacgg

SEQ ID NO: 887266 - RNA, 17 nt, Mycobacterium avium subsp. paratuberculosis
gcgccgcacugcacggc

SEQ ID NO: 887267 - RNA, 21 nt, Mycobacterium avium subsp. paratuberculosis
gcgccgcacugcacggccucg

SEQ ID NO: 887268 - RNA, 17 nt, Mycobacterium avium subsp. paratuberculosis
gcgccgcacagccggcg

SEQ ID NO: 887269 - RNA, 20 nt, Mycobacterium avium subsp. paratuberculosis
gcgccgcaccucgccgaucu

SEQ ID NO: 887270 - RNA, 18 nt, Mycobacterium avium subsp. paratuberculosis
gcgccgcagcggcgccgg

SEQ ID NO: 887271 - RNA, 23 nt, Mycobacterium avium subsp. paratuberculosis
gcgccgcagcggugaucgcguca

SEQ ID NO: 887272 - RNA, 13 nt, Mycobacterium avium subsp. paratuberculosis
gcgccgcagcgcg

SEQ ID NO: 887273 - RNA, 14 nt, Mycobacterium avium subsp. paratuberculosis
gcgccgcagcgcgc

SEQ ID NO: 887274 - RNA, 23 nt, Mycobacterium avium subsp. paratuberculosis
gcgccgcagcgcgcgcucgguca

SEQ ID NO: 887275 - RNA, 16 nt, Mycobacterium avium subsp. paratuberculosis
gcgccgcaacggcgca

SEQ ID NO: 887276 - RNA, 19 nt, Mycobacterium avium subsp. paratuberculosis
gcgccgaucugaccgagca

SEQ ID NO: 887277 - RNA, 22 nt, Mycobacterium avium subsp. paratuberculosis
gcgccgaucugaccgagcagcg

SEQ ID NO: 887278 - RNA, 16 nt, Mycobacterium avium subsp. paratuberculosis
gcgccgaucugcucgg

SEQ ID NO: 887279 - RNA, 23 nt, Mycobacterium avium subsp. paratuberculosis
gcgccgauccggcuccacagcag

SEQ ID NO: 887280 - RNA, 12 nt, Mycobacterium avium subsp. paratuberculosis
gcgccgaucgag

SEQ ID NO: 887281 - RNA, 14 nt, Mycobacterium avium subsp. paratuberculosis
gcgccgaucgccca

SEQ ID NO: 887282 - RNA, 16 nt, Mycobacterium avium subsp. paratuberculosis
gcgccgaucgcccagu

SEQ ID NO: 887283 - RNA, 14 nt, Mycobacterium avium subsp. paratuberculosis
gcgccgaucgcgcg

SEQ ID NO: 887284 - RNA, 15 nt, Mycobacterium avium subsp. paratuberculosis
gcgccgaucgcgcgc

SEQ ID NO: 887285 - RNA, 17 nt, Mycobacterium avium subsp. paratuberculosis
gcgccgaucgcgcgcag

SEQ ID NO: 887286 - RNA, 23 nt, Mycobacterium avium subsp. paratuberculosis
gcgcccugguugauccagcggcg

SEQ ID NO: 887287 - RNA, 17 nt, Mycobacterium avium subsp. paratuberculosis
gcgcccuugccgaugcc

SEQ ID NO: 887288 - RNA, 18 nt, Mycobacterium avium subsp. paratuberculosis
gcgcccuugccgaugccg

SEQ ID NO: 887289 - RNA, 20 nt, Mycobacterium avium subsp. paratuberculosis
gcgcccuugccgaugccggc

SEQ ID NO: 887290 - RNA, 21 nt, Mycobacterium avium subsp. paratuberculosis
gcgccgaaaaacgcgacggcc

SEQ ID NO: 887291 - RNA, 14 nt, Mycobacterium avium subsp. paratuberculosis
gcgcccuucggcgc

SEQ ID NO: 887292 - RNA, 20 nt, Mycobacterium avium subsp. paratuberculosis
gcgcccuucuucgcgggugc

SEQ ID NO: 887293 - RNA, 19 nt, Mycobacterium avium subsp. paratuberculosis
gcgcccuugagcacgguga

SEQ ID NO: 887294 - RNA, 21 nt, Mycobacterium avium subsp. paratuberculosis
gcgcccuugagcacggugauc

SEQ ID NO: 887295 - RNA, 16 nt, Mycobacterium avium subsp. paratuberculosis
gcgcccuugagcucgg

SEQ ID NO: 887296 - RNA, 17 nt, Mycobacterium avium subsp. paratuberculosis
gcgcccuugagcucggc

SEQ ID NO: 887297 - RNA, 18 nt, Mycobacterium avium subsp. paratuberculosis
gcgcccuugagcucggcc

SEQ ID NO: 887298 - RNA, 21 nt, Mycobacterium avium subsp. paratuberculosis
gcgcccuugagcuucccggcg

SEQ ID NO: 887299 - RNA, 14 nt, Mycobacterium avium subsp. paratuberculosis
gcgccgaacaacgg

SEQ ID NO: 887300 - RNA, 15 nt, Mycobacterium avium subsp. paratuberculosis
gcgccgaacaacggc

SEQ ID NO: 887301 - RNA, 16 nt, Mycobacterium avium subsp. paratuberculosis
gcgccgaacaacggcg

SEQ ID NO: 887302 - RNA, 19 nt, Mycobacterium avium subsp. paratuberculosis
gcgccgaacaccugcggcg

SEQ ID NO: 887303 - RNA, 23 nt, Mycobacterium avium subsp. paratuberculosis
gcgccgaacaccugcggcggcag

SEQ ID NO: 887304 - RNA, 15 nt, Mycobacterium avium subsp. paratuberculosis
gcgccgaacaccacg

SEQ ID NO: 887305 - RNA, 18 nt, Mycobacterium avium subsp. paratuberculosis
gcgccgaacaccacgccg

SEQ ID NO: 887306 - RNA, 14 nt, Mycobacterium avium subsp. paratuberculosis
gcgccgaccucggc

SEQ ID NO: 887307 - RNA, 16 nt, Mycobacterium avium subsp. paratuberculosis
gcgccgaccucggcca

SEQ ID NO: 887308 - RNA, 17 nt, Mycobacterium avium subsp. paratuberculosis
gcgccgaccucggccag

SEQ ID NO: 887309 - RNA, 18 nt, Mycobacterium avium subsp. paratuberculosis
gcgccgaccucggccagc

SEQ ID NO: 887310 - RNA, 21 nt, Mycobacterium avium subsp. paratuberculosis
gcgccgaccucggccagcgug

SEQ ID NO: 887311 - RNA, 16 nt, Mycobacterium avium subsp. paratuberculosis
gcgccgaccucgucgg

SEQ ID NO: 887312 - RNA, 18 nt, Mycobacterium avium subsp. paratuberculosis
gcgccgaccucgucggcg

SEQ ID NO: 887313 - RNA, 19 nt, Mycobacterium avium subsp. paratuberculosis
gcgccgaccucgucggcgg

SEQ ID NO: 887314 - RNA, 20 nt, Mycobacterium avium subsp. paratuberculosis
gcgccgaccucgucggcggu

SEQ ID NO: 887315 - RNA, 21 nt, Mycobacterium avium subsp. paratuberculosis
gcgccgaacagaugccugccc

SEQ ID NO: 887316 - RNA, 15 nt, Mycobacterium avium subsp. paratuberculosis
gcgccgaccuggucg

SEQ ID NO: 887317 - RNA, 18 nt, Mycobacterium avium subsp. paratuberculosis
gcgccgaccuggucgccg

SEQ ID NO: 887318 - RNA, 15 nt, Mycobacterium avium subsp. paratuberculosis
gcgccgacgaccagu

SEQ ID NO: 887319 - RNA, 15 nt, Mycobacterium avium subsp. paratuberculosis
gcgccgacgacgucg

SEQ ID NO: 887320 - RNA, 20 nt, Mycobacterium avium subsp. paratuberculosis
gcgccgacgacgucgcgcag

SEQ ID NO: 887321 - RNA, 21 nt, Mycobacterium avium subsp. paratuberculosis
gcgccgacuugaucgcggcgu

SEQ ID NO: 887322 - RNA, 22 nt, Mycobacterium avium subsp. paratuberculosis
gcgccgacuugaucgcggcgua

SEQ ID NO: 887323 - RNA, 23 nt, Mycobacterium avium subsp. paratuberculosis
gcgccgacuugaucgcggcguag

SEQ ID NO: 887324 - RNA, 17 nt, Mycobacterium avium subsp. paratuberculosis
gcgccgacuuggugcca

SEQ ID NO: 887325 - RNA, 21 nt, Mycobacterium avium subsp. paratuberculosis
gcgccgacuuggugccaugcc

SEQ ID NO: 887326 - RNA, 17 nt, Mycobacterium avium subsp. paratuberculosis
gcgccgagacacauucg

SEQ ID NO: 887327 - RNA, 21 nt, Mycobacterium avium subsp. paratuberculosis
gcgccgagacacauucgcgug

SEQ ID NO: 887328 - RNA, 15 nt, Mycobacterium avium subsp. paratuberculosis
gcgccgagaccagcc

SEQ ID NO: 887329 - RNA, 17 nt, Mycobacterium avium subsp. paratuberculosis
gcgccgagaccagccag

SEQ ID NO: 887330 - RNA, 18 nt, Mycobacterium avium subsp. paratuberculosis
gcgccgagaccagccaga

SEQ ID NO: 887331 - RNA, 12 nt, Mycobacterium avium subsp. paratuberculosis
gcgccgacgggc

SEQ ID NO: 887332 - RNA, 13 nt, Mycobacterium avium subsp. paratuberculosis
gcgccgacgggcc

SEQ ID NO: 887333 - RNA, 15 nt, Mycobacterium avium subsp. paratuberculosis
gcgccgacgggcccg

SEQ ID NO: 887334 - RNA, 18 nt, Mycobacterium avium subsp. paratuberculosis
gcgccgacgaucccggcg

SEQ ID NO: 887335 - RNA, 20 nt, Mycobacterium avium subsp. paratuberculosis
gcgccgacgaucccggcgag

SEQ ID NO: 887336 - RNA, 24 nt, Mycobacterium avium subsp. paratuberculosis
gcgccgacgaucccggcgagcacg

SEQ ID NO: 887337 - RNA, 17 nt, Mycobacterium avium subsp. paratuberculosis
gcgccgacggccagcag

SEQ ID NO: 887338 - RNA, 17 nt, Mycobacterium avium subsp. paratuberculosis
gcgccgacggccgcgcc

SEQ ID NO: 887339 - RNA, 14 nt, Mycobacterium avium subsp. paratuberculosis
gcgccgacggccag

SEQ ID NO: 887340 - RNA, 19 nt, Mycobacterium avium subsp. paratuberculosis
gcgccgaucacgccggugg

SEQ ID NO: 887341 - RNA, 22 nt, Mycobacterium avium subsp. paratuberculosis
gcgccgaucacgccgguggaca

SEQ ID NO: 887342 - RNA, 15 nt, Mycobacterium avium subsp. paratuberculosis
gcgccgacgggguuc

SEQ ID NO: 887343 - RNA, 15 nt, Mycobacterium avium subsp. paratuberculosis
gcgccgacgucaggg

SEQ ID NO: 887344 - RNA, 15 nt, Mycobacterium avium subsp. paratuberculosis
gcgccgaguccgggc

SEQ ID NO: 887345 - RNA, 19 nt, Mycobacterium avium subsp. paratuberculosis
gcgccgaguccgggccgcc

SEQ ID NO: 887346 - RNA, 22 nt, Mycobacterium avium subsp. paratuberculosis
gcgccgaguccgggccgccggc

SEQ ID NO: 887347 - RNA, 21 nt, Mycobacterium avium subsp. paratuberculosis
gcgccgaggugcugucgucgc

SEQ ID NO: 887348 - RNA, 14 nt, Mycobacterium avium subsp. paratuberculosis
gcgccgagguggcc

SEQ ID NO: 887349 - RNA, 19 nt, Mycobacterium avium subsp. paratuberculosis
gcgccgagguggcccgcca

SEQ ID NO: 887350 - RNA, 15 nt, Mycobacterium avium subsp. paratuberculosis
gcgccgagguggccg

SEQ ID NO: 887351 - RNA, 17 nt, Mycobacterium avium subsp. paratuberculosis
gcgccgagguggccgcc

SEQ ID NO: 887352 - RNA, 22 nt, Mycobacterium avium subsp. paratuberculosis
gcgccgagguggccgccagcac

SEQ ID NO: 887353 - RNA, 17 nt, Mycobacterium avium subsp. paratuberculosis
gcgccguaccgcuuggc

SEQ ID NO: 887354 - RNA, 16 nt, Mycobacterium avium subsp. paratuberculosis
gcgccguagcggccca

SEQ ID NO: 887355 - RNA, 16 nt, Mycobacterium avium subsp. paratuberculosis
gcgccguagcgguauc

SEQ ID NO: 887356 - RNA, 15 nt, Mycobacterium avium subsp. paratuberculosis
gcgccguaggccgcg

SEQ ID NO: 887357 - RNA, 16 nt, Mycobacterium avium subsp. paratuberculosis
gcgccguaggccgcgc

SEQ ID NO: 887358 - RNA, 21 nt, Mycobacterium avium subsp. paratuberculosis
gcgccggucguagcgucgggg

SEQ ID NO: 887359 - RNA, 17 nt, Mycobacterium avium subsp. paratuberculosis
gcgccgguuucgucggu

SEQ ID NO: 887360 - RNA, 15 nt, Mycobacterium avium subsp. paratuberculosis
gcgccgguguucggc

SEQ ID NO: 887361 - RNA, 17 nt, Mycobacterium avium subsp. paratuberculosis
gcgccgguguucggcgc

SEQ ID NO: 887362 - RNA, 22 nt, Mycobacterium avium subsp. paratuberculosis
gcgccgguguucggcgccagcc

SEQ ID NO: 887363 - RNA, 13 nt, Mycobacterium avium subsp. paratuberculosis
gcgccgguucgcu

SEQ ID NO: 887364 - RNA, 18 nt, Mycobacterium avium subsp. paratuberculosis
gcgccgguucgcuggcgg

SEQ ID NO: 887365 - RNA, 22 nt, Mycobacterium avium subsp. paratuberculosis
gcgccgguucgcuggcggccag

SEQ ID NO: 887366 - RNA, 17 nt, Mycobacterium avium subsp. paratuberculosis
gcgccgguggugucgac

SEQ ID NO: 887367 - RNA, 19 nt, Mycobacterium avium subsp. paratuberculosis
gcgccgguggugucgacgg

SEQ ID NO: 887368 - RNA, 14 nt, Mycobacterium avium subsp. paratuberculosis
gcgccggugccgca

SEQ ID NO: 887369 - RNA, 18 nt, Mycobacterium avium subsp. paratuberculosis
gcgccggugccgcagccg

SEQ ID NO: 887370 - RNA, 22 nt, Mycobacterium avium subsp. paratuberculosis
gcgccggucguuacgacucggc

SEQ ID NO: 887371 - RNA, 20 nt, Mycobacterium avium subsp. paratuberculosis
gcgccggugaagaucgcccg

SEQ ID NO: 887372 - RNA, 22 nt, Mycobacterium avium subsp. paratuberculosis
gcgccggugaagaucgcccgcc

SEQ ID NO: 887373 - RNA, 22 nt, Mycobacterium avium subsp. paratuberculosis
gcgccggugaccccgucgaacg

SEQ ID NO: 887374 - RNA, 17 nt, Mycobacterium avium subsp. paratuberculosis
gcgccgucaccggcugc

SEQ ID NO: 887375 - RNA, 15 nt, Mycobacterium avium subsp. paratuberculosis
gcgccgucgauggcg

SEQ ID NO: 887376 - RNA, 19 nt, Mycobacterium avium subsp. paratuberculosis
gcgccgucgauggcgcggc

SEQ ID NO: 887377 - RNA, 20 nt, Mycobacterium avium subsp. paratuberculosis
gcgccgucgauggcgcggcc

SEQ ID NO: 887378 - RNA, 22 nt, Mycobacterium avium subsp. paratuberculosis
gcgccgucgauggcgcggccca

SEQ ID NO: 887379 - RNA, 15 nt, Mycobacterium avium subsp. paratuberculosis
gcgccgucggcgaug

SEQ ID NO: 887380 - RNA, 16 nt, Mycobacterium avium subsp. paratuberculosis
gcgccgucggcgaugc

SEQ ID NO: 887381 - RNA, 20 nt, Mycobacterium avium subsp. paratuberculosis
gcgccgucggcguucagcgg

SEQ ID NO: 887382 - RNA, 12 nt, Mycobacterium avium subsp. paratuberculosis
gcgccgucggcc

SEQ ID NO: 887383 - RNA, 14 nt, Mycobacterium avium subsp. paratuberculosis
gcgccgucggcgau

SEQ ID NO: 887384 - RNA, 13 nt, Mycobacterium avium subsp. paratuberculosis
gcgccgucgaucc

SEQ ID NO: 887385 - RNA, 20 nt, Mycobacterium avium subsp. paratuberculosis
gcgccgucgucgagcaccac

SEQ ID NO: 887386 - RNA, 13 nt, Mycobacterium avium subsp. paratuberculosis
gcgccgucgucgu

SEQ ID NO: 887387 - RNA, 16 nt, Mycobacterium avium subsp. paratuberculosis
gcgccgucgucgucgc

SEQ ID NO: 887388 - RNA, 17 nt, Mycobacterium avium subsp. paratuberculosis
gcgccgucgucgucggc

SEQ ID NO: 887389 - RNA, 14 nt, Mycobacterium avium subsp. paratuberculosis
gcgccgucgaccag

SEQ ID NO: 887390 - RNA, 15 nt, Mycobacterium avium subsp. paratuberculosis
gcgccgucgaccagc

SEQ ID NO: 887391 - RNA, 18 nt, Mycobacterium avium subsp. paratuberculosis
gcgccgucgaccagcuug

SEQ ID NO: 887392 - RNA, 19 nt, Mycobacterium avium subsp. paratuberculosis
gcgccguccgcggcggcca

SEQ ID NO: 887393 - RNA, 21 nt, Mycobacterium avium subsp. paratuberculosis
gcgccguccgcggcggccagg

SEQ ID NO: 887394 - RNA, 16 nt, Mycobacterium avium subsp. paratuberculosis
gcgccguccggccacg

SEQ ID NO: 887395 - RNA, 18 nt, Mycobacterium avium subsp. paratuberculosis
gcgccguccggccacgac

SEQ ID NO: 887396 - RNA, 12 nt, Mycobacterium avium subsp. paratuberculosis
gcgccgucgccg

SEQ ID NO: 887397 - RNA, 13 nt, Mycobacterium avium subsp. paratuberculosis
gcgccgucgccga

SEQ ID NO: 887398 - RNA, 14 nt, Mycobacterium avium subsp. paratuberculosis
gcgccgucgccgac

SEQ ID NO: 887399 - RNA, 14 nt, Mycobacterium avium subsp. paratuberculosis
gcgccgucgccgau

SEQ ID NO: 887400 - RNA, 22 nt, Mycobacterium avium subsp. paratuberculosis
gcgccgucgccgaucaccugac

SEQ ID NO: 887401 - RNA, 16 nt, Mycobacterium avium subsp. paratuberculosis
gcgccgucgccgccgu

SEQ ID NO: 887402 - RNA, 24 nt, Mycobacterium avium subsp. paratuberculosis
gcgccgucgccggacucgaucgcc

SEQ ID NO: 887403 - RNA, 13 nt, Mycobacterium avium subsp. paratuberculosis
gcgccgucccagc

SEQ ID NO: 887404 - RNA, 16 nt, Mycobacterium avium subsp. paratuberculosis
gcgccgucccagccgg

SEQ ID NO: 887405 - RNA, 17 nt, Mycobacterium avium subsp. paratuberculosis
gcgccgucccagccgga

SEQ ID NO: 887406 - RNA, 18 nt, Mycobacterium avium subsp. paratuberculosis
gcgccgucccagccggac

SEQ ID NO: 887407 - RNA, 14 nt, Mycobacterium avium subsp. paratuberculosis
gcgccguccgcacc

SEQ ID NO: 887408 - RNA, 17 nt, Mycobacterium avium subsp. paratuberculosis
gcgccguccgcaccgcg

SEQ ID NO: 887409 - RNA, 23 nt, Mycobacterium avium subsp. paratuberculosis
gcgccguccgcaccgcgacgaga

SEQ ID NO: 887410 - RNA, 16 nt, Mycobacterium avium subsp. paratuberculosis
gcgccgucaucaccgc

SEQ ID NO: 887411 - RNA, 18 nt, Mycobacterium avium subsp. paratuberculosis
gcgccgucaucaccgccg

SEQ ID NO: 887412 - RNA, 21 nt, Mycobacterium avium subsp. paratuberculosis
gcgccgucaucaccgccgagg

SEQ ID NO: 887413 - RNA, 15 nt, Mycobacterium avium subsp. paratuberculosis
gcgccgucaucgaca

SEQ ID NO: 887414 - RNA, 18 nt, Mycobacterium avium subsp. paratuberculosis
gcgccgucaucgacaccg

SEQ ID NO: 887415 - RNA, 15 nt, Mycobacterium avium subsp. paratuberculosis
gcgccguccagcucg

SEQ ID NO: 887416 - RNA, 19 nt, Mycobacterium avium subsp. paratuberculosis
gcgccggucgacgcggggc

SEQ ID NO: 887417 - RNA, 13 nt, Mycobacterium avium subsp. paratuberculosis
gcgccgguccggc

SEQ ID NO: 887418 - RNA, 14 nt, Mycobacterium avium subsp. paratuberculosis
gcgccgguccggcc

SEQ ID NO: 887419 - RNA, 15 nt, Mycobacterium avium subsp. paratuberculosis
gcgccgguccggccc

SEQ ID NO: 887420 - RNA, 23 nt, Mycobacterium avium subsp. paratuberculosis
gcgccgguccggcccuggucggc

SEQ ID NO: 887421 - RNA, 16 nt, Mycobacterium avium subsp. paratuberculosis
gcgccggucccgcggc

SEQ ID NO: 887422 - RNA, 18 nt, Mycobacterium avium subsp. paratuberculosis
gcgccggucccgcggcgg

SEQ ID NO: 887423 - RNA, 22 nt, Mycobacterium avium subsp. paratuberculosis
gcgccggucccgcggcggcgcc

SEQ ID NO: 887424 - RNA, 23 nt, Mycobacterium avium subsp. paratuberculosis
gcgccggucccgcggcggcgcca

SEQ ID NO: 887425 - RNA, 18 nt, Mycobacterium avium subsp. paratuberculosis
gcgccggucagaccccgu

SEQ ID NO: 887426 - RNA, 23 nt, Mycobacterium avium subsp. paratuberculosis
gcgccggucagaccccguaccag

SEQ ID NO: 887427 - RNA, 16 nt, Mycobacterium avium subsp. paratuberculosis
gcgccggucagcggca

SEQ ID NO: 887428 - RNA, 18 nt, Mycobacterium avium subsp. paratuberculosis
gcgccggguggccggggc

SEQ ID NO: 887429 - RNA, 22 nt, Mycobacterium avium subsp. paratuberculosis
gcgccgguauauucgcgaugga

SEQ ID NO: 887430 - RNA, 21 nt, Mycobacterium avium subsp. paratuberculosis
gcgccgguaucgagcaccagc

SEQ ID NO: 887431 - RNA, 22 nt, Mycobacterium avium subsp. paratuberculosis
gcgccgguaucgagcaccagca

SEQ ID NO: 887432 - RNA, 12 nt, Mycobacterium avium subsp. paratuberculosis
gcgccggggccg

SEQ ID NO: 887433 - RNA, 15 nt, Mycobacterium avium subsp. paratuberculosis
gcgccggggccgcgg

SEQ ID NO: 887434 - RNA, 17 nt, Mycobacterium avium subsp. paratuberculosis
gcgccggggccgcggcu

SEQ ID NO: 887435 - RNA, 20 nt, Mycobacterium avium subsp. paratuberculosis
gcgccgguaggccgcgccga

SEQ ID NO: 887436 - RNA, 14 nt, Mycobacterium avium subsp. paratuberculosis
gcgccgguaggcgc

SEQ ID NO: 887437 - RNA, 18 nt, Mycobacterium avium subsp. paratuberculosis
gcgccgguaggcgcgggu

SEQ ID NO: 887438 - RNA, 19 nt, Mycobacterium avium subsp. paratuberculosis
gcgccgguaggcgcgggug

SEQ ID NO: 887439 - RNA, 18 nt, Mycobacterium avium subsp. paratuberculosis
gcgccgguaggcggccag

SEQ ID NO: 887440 - RNA, 22 nt, Mycobacterium avium subsp. paratuberculosis
gcgccgguaggcggccagcgcc

SEQ ID NO: 887441 - RNA, 20 nt, Mycobacterium avium subsp. paratuberculosis
gcgccggguugcaggcgccc

SEQ ID NO: 887442 - RNA, 20 nt, Mycobacterium avium subsp. paratuberculosis
gcgccgguaaugggcgaucg

SEQ ID NO: 887443 - RNA, 21 nt, Mycobacterium avium subsp. paratuberculosis
gcgccgguaaugggcgaucga

SEQ ID NO: 887444 - RNA, 23 nt, Mycobacterium avium subsp. paratuberculosis
gcgccgguaaugggcgaucgauc

SEQ ID NO: 887445 - RNA, 16 nt, Mycobacterium avium subsp. paratuberculosis
gcgccgguagcgacac

SEQ ID NO: 887446 - RNA, 12 nt, Mycobacterium avium subsp. paratuberculosis
gcgccgggucgc

SEQ ID NO: 887447 - RNA, 16 nt, Mycobacterium avium subsp. paratuberculosis
gcgccgggucgcggua

SEQ ID NO: 887448 - RNA, 17 nt, Mycobacterium avium subsp. paratuberculosis
gcgccgggucgcggugg

SEQ ID NO: 887449 - RNA, 18 nt, Mycobacterium avium subsp. paratuberculosis
gcgccgggguccucucgg

SEQ ID NO: 887450 - RNA, 22 nt, Mycobacterium avium subsp. paratuberculosis
gcgccgggguccucucggcgcc

SEQ ID NO: 887451 - RNA, 16 nt, Mycobacterium avium subsp. paratuberculosis
gcgccggggugggcca

SEQ ID NO: 887452 - RNA, 19 nt, Mycobacterium avium subsp. paratuberculosis
gcgccgggguguccagcgg

SEQ ID NO: 887453 - RNA, 15 nt, Mycobacterium avium subsp. paratuberculosis
gcgccgggucaccgg

SEQ ID NO: 887454 - RNA, 16 nt, Mycobacterium avium subsp. paratuberculosis
gcgccgggucaccgga

SEQ ID NO: 887455 - RNA, 17 nt, Mycobacterium avium subsp. paratuberculosis
gcgccgggucaccggau

SEQ ID NO: 887456 - RNA, 23 nt, Mycobacterium avium subsp. paratuberculosis
gcgccgggucaccggaugcaccg

SEQ ID NO: 887457 - RNA, 21 nt, Mycobacterium avium subsp. paratuberculosis
gcgccgggucauccccgugcg

SEQ ID NO: 887458 - RNA, 11 nt, Mycobacterium avium subsp. paratuberculosis
gcgccgggucc

SEQ ID NO: 887459 - RNA, 14 nt, Mycobacterium avium subsp. paratuberculosis
gcgccggguccagc

SEQ ID NO: 887460 - RNA, 15 nt, Mycobacterium avium subsp. paratuberculosis
gcgccggguccagcc

SEQ ID NO: 887461 - RNA, 16 nt, Mycobacterium avium subsp. paratuberculosis
gcgccggguccagccg

SEQ ID NO: 887462 - RNA, 17 nt, Mycobacterium avium subsp. paratuberculosis
gcgccggguccagccgc

SEQ ID NO: 887463 - RNA, 19 nt, Mycobacterium avium subsp. paratuberculosis
gcgccggguccagccgcgg

SEQ ID NO: 887464 - RNA, 18 nt, Mycobacterium avium subsp. paratuberculosis
gcgccgggcguugcccgc

SEQ ID NO: 887465 - RNA, 22 nt, Mycobacterium avium subsp. paratuberculosis
gcgccgggcggcccgccucggc

SEQ ID NO: 887466 - RNA, 16 nt, Mycobacterium avium subsp. paratuberculosis
gcgccgggcggccucg

SEQ ID NO: 887467 - RNA, 13 nt, Mycobacterium avium subsp. paratuberculosis
gcgccgggcgggc

SEQ ID NO: 887468 - RNA, 21 nt, Mycobacterium avium subsp. paratuberculosis
gcgccgggcgaagucgccggc

SEQ ID NO: 887469 - RNA, 14 nt, Mycobacterium avium subsp. paratuberculosis
gcgccgggcgcccg

SEQ ID NO: 887470 - RNA, 15 nt, Mycobacterium avium subsp. paratuberculosis
gcgccgggcgcccga

SEQ ID NO: 887471 - RNA, 21 nt, Mycobacterium avium subsp. paratuberculosis
gcgccgggcgcccgagccgca

SEQ ID NO: 887472 - RNA, 14 nt, Mycobacterium avium subsp. paratuberculosis
gcgccgggcccggu

SEQ ID NO: 887473 - RNA, 16 nt, Mycobacterium avium subsp. paratuberculosis
gcgccgggcccggucc

SEQ ID NO: 887474 - RNA, 17 nt, Mycobacterium avium subsp. paratuberculosis
gcgccgggcagcccggg

SEQ ID NO: 887475 - RNA, 16 nt, Mycobacterium avium subsp. paratuberculosis
gcgccgggaucggcag

SEQ ID NO: 887476 - RNA, 21 nt, Mycobacterium avium subsp. paratuberculosis
gcgccgggaucggcagcgcgc

SEQ ID NO: 887477 - RNA, 17 nt, Mycobacterium avium subsp. paratuberculosis
gcgccgggcaacagcgc

SEQ ID NO: 887478 - RNA, 19 nt, Mycobacterium avium subsp. paratuberculosis
gcgccgggcaacagcgcgc

SEQ ID NO: 887479 - RNA, 12 nt, Mycobacterium avium subsp. paratuberculosis
gcgccgggcacc

SEQ ID NO: 887480 - RNA, 16 nt, Mycobacterium avium subsp. paratuberculosis
gcgccgggcaccacca

SEQ ID NO: 887481 - RNA, 22 nt, Mycobacterium avium subsp. paratuberculosis
gcgccgggcaccaccaccgaca

SEQ ID NO: 887482 - RNA, 15 nt, Mycobacterium avium subsp. paratuberculosis
gcgccgggcagcccg

SEQ ID NO: 887483 - RNA, 15 nt, Mycobacterium avium subsp. paratuberculosis
gcgccggcggcggcg

SEQ ID NO: 887484 - RNA, 19 nt, Mycobacterium avium subsp. paratuberculosis
gcgccggcuccaccgcgcc

SEQ ID NO: 887485 - RNA, 17 nt, Mycobacterium avium subsp. paratuberculosis
gcgccggcugcccgcga

SEQ ID NO: 887486 - RNA, 19 nt, Mycobacterium avium subsp. paratuberculosis
gcgccggcugcccgcgacu

SEQ ID NO: 887487 - RNA, 18 nt, Mycobacterium avium subsp. paratuberculosis
gcgccggcggugcggcgg

SEQ ID NO: 887488 - RNA, 15 nt, Mycobacterium avium subsp. paratuberculosis
gcgccggcggugucg

SEQ ID NO: 887489 - RNA, 17 nt, Mycobacterium avium subsp. paratuberculosis
gcgccggcggugucgag

SEQ ID NO: 887490 - RNA, 18 nt, Mycobacterium avium subsp. paratuberculosis
gcgccggcguccagcgcc

SEQ ID NO: 887491 - RNA, 21 nt, Mycobacterium avium subsp. paratuberculosis
gcgccggcgguaugcccgggc

SEQ ID NO: 887492 - RNA, 12 nt, Mycobacterium avium subsp. paratuberculosis
gcgccggcggug

SEQ ID NO: 887493 - RNA, 14 nt, Mycobacterium avium subsp. paratuberculosis
gcgccggcgucggu

SEQ ID NO: 887494 - RNA, 18 nt, Mycobacterium avium subsp. paratuberculosis
gcgccggcgugucggcgc

SEQ ID NO: 887495 - RNA, 20 nt, Mycobacterium avium subsp. paratuberculosis
gcgccggcgugucggcgcca

SEQ ID NO: 887496 - RNA, 20 nt, Mycobacterium avium subsp. paratuberculosis
gcgccggcgggugagccggu

SEQ ID NO: 887497 - RNA, 14 nt, Mycobacterium avium subsp. paratuberculosis
gcgccggcggccac

SEQ ID NO: 887498 - RNA, 16 nt, Mycobacterium avium subsp. paratuberculosis
gcgccggcggccacgc

SEQ ID NO: 887499 - RNA, 13 nt, Mycobacterium avium subsp. paratuberculosis
gcgccggcggccg

SEQ ID NO: 887500 - RNA, 16 nt, Mycobacterium avium subsp. paratuberculosis
gcgccggcggccgcga

SEQ ID NO: 887501 - RNA, 18 nt, Mycobacterium avium subsp. paratuberculosis
gcgccggcggccgcgacg

SEQ ID NO: 887502 - RNA, 19 nt, Mycobacterium avium subsp. paratuberculosis
gcgccggcggccgcgacgg

SEQ ID NO: 887503 - RNA, 14 nt, Mycobacterium avium subsp. paratuberculosis
gcgccggcgcgggc

SEQ ID NO: 887504 - RNA, 15 nt, Mycobacterium avium subsp. paratuberculosis
gcgccggcgcgggca

SEQ ID NO: 887505 - RNA, 16 nt, Mycobacterium avium subsp. paratuberculosis
gcgccggcgcgggcau

SEQ ID NO: 887506 - RNA, 23 nt, Mycobacterium avium subsp. paratuberculosis
gcgccggcgcgggggcggccuga

SEQ ID NO: 887507 - RNA, 15 nt, Mycobacterium avium subsp. paratuberculosis
gcgccggcccgcggc

SEQ ID NO: 887508 - RNA, 13 nt, Mycobacterium avium subsp. paratuberculosis
gcgccggcgcggc

SEQ ID NO: 887509 - RNA, 17 nt, Mycobacterium avium subsp. paratuberculosis
gcgccggcgcgcgagcg

SEQ ID NO: 887510 - RNA, 12 nt, Mycobacterium avium subsp. paratuberculosis
gcgccggcgaug

SEQ ID NO: 887511 - RNA, 13 nt, Mycobacterium avium subsp. paratuberculosis
gcgccggcgauga

SEQ ID NO: 887512 - RNA, 21 nt, Mycobacterium avium subsp. paratuberculosis
gcgccggcgaugaacacgccg

SEQ ID NO: 887513 - RNA, 17 nt, Mycobacterium avium subsp. paratuberculosis
gcgccggcgcacaucgu

SEQ ID NO: 887514 - RNA, 20 nt, Mycobacterium avium subsp. paratuberculosis
gcgccggcgcagcggcccga

SEQ ID NO: 887515 - RNA, 13 nt, Mycobacterium avium subsp. paratuberculosis
gcgccggcgcgca

SEQ ID NO: 887516 - RNA, 20 nt, Mycobacterium avium subsp. paratuberculosis
gcgccggcgcgcaacagcgu

SEQ ID NO: 887517 - RNA, 14 nt, Mycobacterium avium subsp. paratuberculosis
gcgccggcgcgcag

SEQ ID NO: 887518 - RNA, 21 nt, Mycobacterium avium subsp. paratuberculosis
gcgccggccuuggcccgcgcc

SEQ ID NO: 887519 - RNA, 20 nt, Mycobacterium avium subsp. paratuberculosis
gcgccggcgauaggcggcca

SEQ ID NO: 887520 - RNA, 14 nt, Mycobacterium avium subsp. paratuberculosis
gcgccggccggcgc

SEQ ID NO: 887521 - RNA, 20 nt, Mycobacterium avium subsp. paratuberculosis
gcgccggccggcgcgugcgc

SEQ ID NO: 887522 - RNA, 13 nt, Mycobacterium avium subsp. paratuberculosis
gcgccggccgggc

SEQ ID NO: 887523 - RNA, 22 nt, Mycobacterium avium subsp. paratuberculosis
gcgccggccggacagaucgccc

SEQ ID NO: 887524 - RNA, 14 nt, Mycobacterium avium subsp. paratuberculosis
gcgccggccggagc

SEQ ID NO: 887525 - RNA, 15 nt, Mycobacterium avium subsp. paratuberculosis
gcgccggccggagcg

SEQ ID NO: 887526 - RNA, 13 nt, Mycobacterium avium subsp. paratuberculosis
gcgccggccggca

SEQ ID NO: 887527 - RNA, 13 nt, Mycobacterium avium subsp. paratuberculosis
gcgccggccgccg

SEQ ID NO: 887528 - RNA, 17 nt, Mycobacterium avium subsp. paratuberculosis
gcgccggccgccgcgau

SEQ ID NO: 887529 - RNA, 15 nt, Mycobacterium avium subsp. paratuberculosis
gcgccggccgccgga

SEQ ID NO: 887530 - RNA, 18 nt, Mycobacterium avium subsp. paratuberculosis
gcgccggccagcggcuug

SEQ ID NO: 887531 - RNA, 22 nt, Mycobacterium avium subsp. paratuberculosis
gcgccggccagcggcuuggccg

SEQ ID NO: 887532 - RNA, 15 nt, Mycobacterium avium subsp. paratuberculosis
gcgccggccagccgg

SEQ ID NO: 887533 - RNA, 16 nt, Mycobacterium avium subsp. paratuberculosis
gcgccggccagccggc

SEQ ID NO: 887534 - RNA, 15 nt, Mycobacterium avium subsp. paratuberculosis
gcgccggccagcggc

SEQ ID NO: 887535 - RNA, 15 nt, Mycobacterium avium subsp. paratuberculosis
gcgccggccagcacc

SEQ ID NO: 887536 - RNA, 16 nt, Mycobacterium avium subsp. paratuberculosis
gcgccggccagcacca

SEQ ID NO: 887537 - RNA, 18 nt, Mycobacterium avium subsp. paratuberculosis
gcgccggccagcaccacg

SEQ ID NO: 887538 - RNA, 22 nt, Mycobacterium avium subsp. paratuberculosis
gcgccggccagcaccacgguga

SEQ ID NO: 887539 - RNA, 21 nt, Mycobacterium avium subsp. paratuberculosis
gcgccggccagcacggccagc

SEQ ID NO: 887540 - RNA, 19 nt, Mycobacterium avium subsp. paratuberculosis
gcgccggccagcacggcgg

SEQ ID NO: 887541 - RNA, 14 nt, Mycobacterium avium subsp. paratuberculosis
gcgccggccagcag

SEQ ID NO: 887542 - RNA, 17 nt, Mycobacterium avium subsp. paratuberculosis
gcgccggccagcagcag

SEQ ID NO: 887543 - RNA, 19 nt, Mycobacterium avium subsp. paratuberculosis
gcgccggccagcagcaggu

SEQ ID NO: 887544 - RNA, 18 nt, Mycobacterium avium subsp. paratuberculosis
gcgccggcagcggccgca

SEQ ID NO: 887545 - RNA, 20 nt, Mycobacterium avium subsp. paratuberculosis
gcgccggcauccagcacggc

SEQ ID NO: 887546 - RNA, 22 nt, Mycobacterium avium subsp. paratuberculosis
gcgccggcauccagcacggccg

SEQ ID NO: 887547 - RNA, 19 nt, Mycobacterium avium subsp. paratuberculosis
gcgccggcacucgucgugg

SEQ ID NO: 887548 - RNA, 22 nt, Mycobacterium avium subsp. paratuberculosis
gcgccggcacugcugcccgcga

SEQ ID NO: 887549 - RNA, 23 nt, Mycobacterium avium subsp. paratuberculosis
gcgccggcacugcugcccgcgac

SEQ ID NO: 887550 - RNA, 23 nt, Mycobacterium avium subsp. paratuberculosis
gcgccggcagauugguucggccg

SEQ ID NO: 887551 - RNA, 17 nt, Mycobacterium avium subsp. paratuberculosis
gcgccggauucggcgcg

SEQ ID NO: 887552 - RNA, 18 nt, Mycobacterium avium subsp. paratuberculosis
gcgccggauucggcgcgg

SEQ ID NO: 887553 - RNA, 20 nt, Mycobacterium avium subsp. paratuberculosis
gcgccggauucggcgcggcu

SEQ ID NO: 887554 - RNA, 20 nt, Mycobacterium avium subsp. paratuberculosis
gcgccggcaacaacgccagc

SEQ ID NO: 887555 - RNA, 15 nt, Mycobacterium avium subsp. paratuberculosis
gcgccggcaccagca

SEQ ID NO: 887556 - RNA, 18 nt, Mycobacterium avium subsp. paratuberculosis
gcgccggcagcaaccggc

SEQ ID NO: 887557 - RNA, 19 nt, Mycobacterium avium subsp. paratuberculosis
gcgccggcagcaaccggcg

SEQ ID NO: 887558 - RNA, 21 nt, Mycobacterium avium subsp. paratuberculosis
gcgccggcagcaaccggcggc

SEQ ID NO: 887559 - RNA, 17 nt, Mycobacterium avium subsp. paratuberculosis
gcgccggaugcugcgca

SEQ ID NO: 887560 - RNA, 18 nt, Mycobacterium avium subsp. paratuberculosis
gcgccggaugggcgcacg

SEQ ID NO: 887561 - RNA, 16 nt, Mycobacterium avium subsp. paratuberculosis
gcgccggaugguccgc

SEQ ID NO: 887562 - RNA, 14 nt, Mycobacterium avium subsp. paratuberculosis
gcgccggaucggcc

SEQ ID NO: 887563 - RNA, 22 nt, Mycobacterium avium subsp. paratuberculosis
gcgccggaucggcccccgggcc

SEQ ID NO: 887564 - RNA, 19 nt, Mycobacterium avium subsp. paratuberculosis
gcgccgccgcgcaggccgc

SEQ ID NO: 887565 - RNA, 21 nt, Mycobacterium avium subsp. paratuberculosis
gcgccgccgcgcaggccgccg

SEQ ID NO: 887566 - RNA, 22 nt, Mycobacterium avium subsp. paratuberculosis
gcgccgccgcgcaggccgccga

SEQ ID NO: 887567 - RNA, 14 nt, Mycobacterium avium subsp. paratuberculosis
gcgccgccgccgcc

SEQ ID NO: 887568 - RNA, 18 nt, Mycobacterium avium subsp. paratuberculosis
gcgccgccgccgcccacg

SEQ ID NO: 887569 - RNA, 14 nt, Mycobacterium avium subsp. paratuberculosis
gcgccgccgccagc

SEQ ID NO: 887570 - RNA, 16 nt, Mycobacterium avium subsp. paratuberculosis
gcgccgccgccagcca

SEQ ID NO: 887571 - RNA, 17 nt, Mycobacterium avium subsp. paratuberculosis
gcgccgccgccagccag

SEQ ID NO: 887572 - RNA, 14 nt, Mycobacterium avium subsp. paratuberculosis
gcgccgccgagcaa

SEQ ID NO: 887573 - RNA, 14 nt, Mycobacterium avium subsp. paratuberculosis
gcgccgcccgggcg

SEQ ID NO: 887574 - RNA, 15 nt, Mycobacterium avium subsp. paratuberculosis
gcgccgcccucgccg

SEQ ID NO: 887575 - RNA, 23 nt, Mycobacterium avium subsp. paratuberculosis
gcgccgcccucgccgaaccgggg

SEQ ID NO: 887576 - RNA, 12 nt, Mycobacterium avium subsp. paratuberculosis
gcgccgcccggc

SEQ ID NO: 887577 - RNA, 13 nt, Mycobacterium avium subsp. paratuberculosis
gcgccgcccggcg

SEQ ID NO: 887578 - RNA, 14 nt, Mycobacterium avium subsp. paratuberculosis
gcgccgcccggcga

SEQ ID NO: 887579 - RNA, 16 nt, Mycobacterium avium subsp. paratuberculosis
gcgccgcccggcgaua

SEQ ID NO: 887580 - RNA, 16 nt, Mycobacterium avium subsp. paratuberculosis
gcgccgcccggcgauc

SEQ ID NO: 887581 - RNA, 14 nt, Mycobacterium avium subsp. paratuberculosis
gcgccgcccagcgg

SEQ ID NO: 887582 - RNA, 19 nt, Mycobacterium avium subsp. paratuberculosis
gcgccgcccagcggccccg

SEQ ID NO: 887583 - RNA, 15 nt, Mycobacterium avium subsp. paratuberculosis
gcgccgcccagcggu

SEQ ID NO: 887584 - RNA, 16 nt, Mycobacterium avium subsp. paratuberculosis
gcgccgcccccgcggc

SEQ ID NO: 887585 - RNA, 18 nt, Mycobacterium avium subsp. paratuberculosis
gcgccgcccccgcggcgu

SEQ ID NO: 887586 - RNA, 20 nt, Mycobacterium avium subsp. paratuberculosis
gcgccgcccccgcggcgucc

SEQ ID NO: 887587 - RNA, 22 nt, Mycobacterium avium subsp. paratuberculosis
gcgccgcccgcaccugcgcgcc

SEQ ID NO: 887588 - RNA, 18 nt, Mycobacterium avium subsp. paratuberculosis
gcgccuggcgcagggcgu

SEQ ID NO: 887589 - RNA, 16 nt, Mycobacterium avium subsp. paratuberculosis
gcgccuuugacguucg

SEQ ID NO: 887590 - RNA, 17 nt, Mycobacterium avium subsp. paratuberculosis
gcgccuuugacguucgc

SEQ ID NO: 887591 - RNA, 18 nt, Mycobacterium avium subsp. paratuberculosis
gcgccuuuugcacccgcc

SEQ ID NO: 887592 - RNA, 20 nt, Mycobacterium avium subsp. paratuberculosis
gcgccuuuugcacccgccau

SEQ ID NO: 887593 - RNA, 22 nt, Mycobacterium avium subsp. paratuberculosis
gcgccuuuugcacccgccaugg

SEQ ID NO: 887594 - RNA, 14 nt, Mycobacterium avium subsp. paratuberculosis
gcgcgaacaaucgc

SEQ ID NO: 887595 - RNA, 19 nt, Mycobacterium avium subsp. paratuberculosis
gcgcgaacaaucgcugcga

SEQ ID NO: 887596 - RNA, 19 nt, Mycobacterium avium subsp. paratuberculosis
gcgcgaaagcagcaacggc

SEQ ID NO: 887597 - RNA, 22 nt, Mycobacterium avium subsp. paratuberculosis
gcgcgaaaaccagcaccggcac

SEQ ID NO: 887598 - RNA, 15 nt, Mycobacterium avium subsp. paratuberculosis
gcgcgaaacccccgg

SEQ ID NO: 887599 - RNA, 14 nt, Mycobacterium avium subsp. paratuberculosis
gcgcgaaccgggcc

SEQ ID NO: 887600 - RNA, 15 nt, Mycobacterium avium subsp. paratuberculosis
gcgcgaaccgggcca

SEQ ID NO: 887601 - RNA, 16 nt, Mycobacterium avium subsp. paratuberculosis
gcgcgaaccgggccag

SEQ ID NO: 887602 - RNA, 13 nt, Mycobacterium avium subsp. paratuberculosis
gcgcgaagcuggg

SEQ ID NO: 887603 - RNA, 19 nt, Mycobacterium avium subsp. paratuberculosis
gcgcgaagguggcgccggu

SEQ ID NO: 887604 - RNA, 22 nt, Mycobacterium avium subsp. paratuberculosis
gcgcgaagucccacugcccgua

SEQ ID NO: 887605 - RNA, 19 nt, Mycobacterium avium subsp. paratuberculosis
gcgcgaaucccggccucgu

SEQ ID NO: 887606 - RNA, 15 nt, Mycobacterium avium subsp. paratuberculosis
gcgcgaacagcgaag

SEQ ID NO: 887607 - RNA, 21 nt, Mycobacterium avium subsp. paratuberculosis
gcgcgaacagcgaagccacgg

SEQ ID NO: 887608 - RNA, 22 nt, Mycobacterium avium subsp. paratuberculosis
gcgcgaacagcgaagccacgga

SEQ ID NO: 887609 - RNA, 17 nt, Mycobacterium avium subsp. paratuberculosis
gcgcgaacagcgccgac

SEQ ID NO: 887610 - RNA, 18 nt, Mycobacterium avium subsp. paratuberculosis
gcgcgaacagcgccgacu

SEQ ID NO: 887611 - RNA, 19 nt, Mycobacterium avium subsp. paratuberculosis
gcgcgaacagcgcggccac

SEQ ID NO: 887612 - RNA, 20 nt, Mycobacterium avium subsp. paratuberculosis
gcgcgaacagcgcggccacc

SEQ ID NO: 887613 - RNA, 21 nt, Mycobacterium avium subsp. paratuberculosis
gcgcgaacagcgcggccacca

SEQ ID NO: 887614 - RNA, 19 nt, Mycobacterium avium subsp. paratuberculosis
gcgcgaaaggcccaccgcu

SEQ ID NO: 887615 - RNA, 20 nt, Mycobacterium avium subsp. paratuberculosis
gcgcgaaaggcccaccgcug

SEQ ID NO: 887616 - RNA, 12 nt, Mycobacterium avium subsp. paratuberculosis
gcgccugcggug

SEQ ID NO: 887617 - RNA, 15 nt, Mycobacterium avium subsp. paratuberculosis
gcgccugcgcggcgg

SEQ ID NO: 887618 - RNA, 17 nt, Mycobacterium avium subsp. paratuberculosis
gcgccugcgcggcggcg

SEQ ID NO: 887619 - RNA, 22 nt, Mycobacterium avium subsp. paratuberculosis
gcgccgugaacugugcggugcg

SEQ ID NO: 887620 - RNA, 22 nt, Mycobacterium avium subsp. paratuberculosis
gcgccgugaagggcccgccggu

SEQ ID NO: 887621 - RNA, 15 nt, Mycobacterium avium subsp. paratuberculosis
gcgccgugcagcacg

SEQ ID NO: 887622 - RNA, 18 nt, Mycobacterium avium subsp. paratuberculosis
gcgccgugcagcacgccg

SEQ ID NO: 887623 - RNA, 19 nt, Mycobacterium avium subsp. paratuberculosis
gcgccgugcagcacgccgc

SEQ ID NO: 887624 - RNA, 15 nt, Mycobacterium avium subsp. paratuberculosis
gcgccgugcaggaug

SEQ ID NO: 887625 - RNA, 13 nt, Mycobacterium avium subsp. paratuberculosis
gcgccgugcccaa

SEQ ID NO: 887626 - RNA, 16 nt, Mycobacterium avium subsp. paratuberculosis
gcgccgucuccggcgu

SEQ ID NO: 887627 - RNA, 17 nt, Mycobacterium avium subsp. paratuberculosis
gcgccgucuccggcgua

SEQ ID NO: 887628 - RNA, 17 nt, Mycobacterium avium subsp. paratuberculosis
gcgccgucuccucgacc

SEQ ID NO: 887629 - RNA, 19 nt, Mycobacterium avium subsp. paratuberculosis
gcgccgucuccucgaccag

SEQ ID NO: 887630 - RNA, 20 nt, Mycobacterium avium subsp. paratuberculosis
gcgccgucuccucgaccagc

SEQ ID NO: 887631 - RNA, 21 nt, Mycobacterium avium subsp. paratuberculosis
gcgccgucuccucgaccagcg

SEQ ID NO: 887632 - RNA, 23 nt, Mycobacterium avium subsp. paratuberculosis
gcgccgucuccucgaccagcgcg

SEQ ID NO: 887633 - RNA, 15 nt, Mycobacterium avium subsp. paratuberculosis
gcgccgucucgaccc

SEQ ID NO: 887634 - RNA, 16 nt, Mycobacterium avium subsp. paratuberculosis
gcgccgucucgacccg

SEQ ID NO: 887635 - RNA, 18 nt, Mycobacterium avium subsp. paratuberculosis
gcgccgucucgacccggg

SEQ ID NO: 887636 - RNA, 22 nt, Mycobacterium avium subsp. paratuberculosis
gcgccgucucgacccgggccag

SEQ ID NO: 887637 - RNA, 17 nt, Mycobacterium avium subsp. paratuberculosis
gcgccugcaccggcgac

SEQ ID NO: 887638 - RNA, 21 nt, Mycobacterium avium subsp. paratuberculosis
gcgccugcaccggcgacggcg

SEQ ID NO: 887639 - RNA, 23 nt, Mycobacterium avium subsp. paratuberculosis
gcgccugcaccggcgacggcggu

SEQ ID NO: 887640 - RNA, 12 nt, Mycobacterium avium subsp. paratuberculosis
gcgccugauccg

SEQ ID NO: 887641 - RNA, 16 nt, Mycobacterium avium subsp. paratuberculosis
gcgccugauccgcggu

SEQ ID NO: 887642 - RNA, 23 nt, Mycobacterium avium subsp. paratuberculosis
gcgccugauccgcggucagacga

SEQ ID NO: 887643 - RNA, 21 nt, Mycobacterium avium subsp. paratuberculosis
gcgccgugcgccagcgaccgc

SEQ ID NO: 887644 - RNA, 17 nt, Mycobacterium avium subsp. paratuberculosis
gcgccgugccgcgcggc

SEQ ID NO: 887645 - RNA, 14 nt, Mycobacterium avium subsp. paratuberculosis
gcgcgauagccggu

SEQ ID NO: 887646 - RNA, 16 nt, Mycobacterium avium subsp. paratuberculosis
gcgcgaucaggcugcc

SEQ ID NO: 887647 - RNA, 15 nt, Mycobacterium avium subsp. paratuberculosis
gcgcgaucagcgccg

SEQ ID NO: 887648 - RNA, 16 nt, Mycobacterium avium subsp. paratuberculosis
gcgcgaucagcgccgu

SEQ ID NO: 887649 - RNA, 17 nt, Mycobacterium avium subsp. paratuberculosis
gcgcgaucagcgccguc

SEQ ID NO: 887650 - RNA, 17 nt, Mycobacterium avium subsp. paratuberculosis
gcgcgaucaggccggcc

SEQ ID NO: 887651 - RNA, 20 nt, Mycobacterium avium subsp. paratuberculosis
gcgcgaucaggccggccacc

SEQ ID NO: 887652 - RNA, 21 nt, Mycobacterium avium subsp. paratuberculosis
gcgcgaucaggccggccacca

SEQ ID NO: 887653 - RNA, 16 nt, Mycobacterium avium subsp. paratuberculosis
gcgcgaucgucgacca

SEQ ID NO: 887654 - RNA, 22 nt, Mycobacterium avium subsp. paratuberculosis
gcgcgaucuccgucaccguggu

SEQ ID NO: 887655 - RNA, 21 nt, Mycobacterium avium subsp. paratuberculosis
gcgcgaugaucgccggcgccg

SEQ ID NO: 887656 - RNA, 13 nt, Mycobacterium avium subsp. paratuberculosis
gcgcgaucgccgg

SEQ ID NO: 887657 - RNA, 14 nt, Mycobacterium avium subsp. paratuberculosis
gcgcgaucgccggu

SEQ ID NO: 887658 - RNA, 15 nt, Mycobacterium avium subsp. paratuberculosis
gcgcgaucgccggug

SEQ ID NO: 887659 - RNA, 12 nt, Mycobacterium avium subsp. paratuberculosis
gcgcgaucggcc

SEQ ID NO: 887660 - RNA, 13 nt, Mycobacterium avium subsp. paratuberculosis
gcgcgaucggccg

SEQ ID NO: 887661 - RNA, 18 nt, Mycobacterium avium subsp. paratuberculosis
gcgcgaucggccgcugcc

SEQ ID NO: 887662 - RNA, 13 nt, Mycobacterium avium subsp. paratuberculosis
gcgcgaucggcga

SEQ ID NO: 887663 - RNA, 20 nt, Mycobacterium avium subsp. paratuberculosis
gcgcgaucgguguccagccg

SEQ ID NO: 887664 - RNA, 21 nt, Mycobacterium avium subsp. paratuberculosis
gcgcgaucgguguccagccgc

SEQ ID NO: 887665 - RNA, 22 nt, Mycobacterium avium subsp. paratuberculosis
gcgcgaucgguguccagccgca

SEQ ID NO: 887666 - RNA, 15 nt, Mycobacterium avium subsp. paratuberculosis
gcgcgacaccgcggc

SEQ ID NO: 887667 - RNA, 16 nt, Mycobacterium avium subsp. paratuberculosis
gcgcgacaccgcggcg

SEQ ID NO: 887668 - RNA, 14 nt, Mycobacterium avium subsp. paratuberculosis
gcgcgacaccggac

SEQ ID NO: 887669 - RNA, 21 nt, Mycobacterium avium subsp. paratuberculosis
gcgcgacaccggacugcuugg

SEQ ID NO: 887670 - RNA, 20 nt, Mycobacterium avium subsp. paratuberculosis
gcgcgaauuccucagcgccc

SEQ ID NO: 887671 - RNA, 13 nt, Mycobacterium avium subsp. paratuberculosis
gcgcgacagccaa

SEQ ID NO: 887672 - RNA, 21 nt, Mycobacterium avium subsp. paratuberculosis
gcgcgacaucaccgcgggcgc

SEQ ID NO: 887673 - RNA, 15 nt, Mycobacterium avium subsp. paratuberculosis
gcgcgacaucgccgg

SEQ ID NO: 887674 - RNA, 18 nt, Mycobacterium avium subsp. paratuberculosis
gcgcgacaucgccggcga

SEQ ID NO: 887675 - RNA, 23 nt, Mycobacterium avium subsp. paratuberculosis
gcgcgacaucgccggcgaccgug

SEQ ID NO: 887676 - RNA, 19 nt, Mycobacterium avium subsp. paratuberculosis
gcgcgaccaaacgcagcgu

SEQ ID NO: 887677 - RNA, 18 nt, Mycobacterium avium subsp. paratuberculosis
gcgcgagcgucacgcugg

SEQ ID NO: 887678 - RNA, 20 nt, Mycobacterium avium subsp. paratuberculosis
gcgcgagcgucacgcuggcg

SEQ ID NO: 887679 - RNA, 15 nt, Mycobacterium avium subsp. paratuberculosis
gcgcgagucgagcac

SEQ ID NO: 887680 - RNA, 23 nt, Mycobacterium avium subsp. paratuberculosis
gcgcgagucgagcaccgcgacca

SEQ ID NO: 887681 - RNA, 16 nt, Mycobacterium avium subsp. paratuberculosis
gcgcgaggucgacgga

SEQ ID NO: 887682 - RNA, 13 nt, Mycobacterium avium subsp. paratuberculosis
gcgcgaggcgcga

SEQ ID NO: 887683 - RNA, 16 nt, Mycobacterium avium subsp. paratuberculosis
gcgcgaggcgcggggc

SEQ ID NO: 887684 - RNA, 19 nt, Mycobacterium avium subsp. paratuberculosis
gcgcgaggaggggucggug

SEQ ID NO: 887685 - RNA, 20 nt, Mycobacterium avium subsp. paratuberculosis
gcgcgaggaggggucggugc

SEQ ID NO: 887686 - RNA, 19 nt, Mycobacterium avium subsp. paratuberculosis
gcgcgaggcggguaggcgu

SEQ ID NO: 887687 - RNA, 21 nt, Mycobacterium avium subsp. paratuberculosis
gcgcgaggcggguaggcgucg

SEQ ID NO: 887688 - RNA, 20 nt, Mycobacterium avium subsp. paratuberculosis
gcgcgcagaacaccaccgcc

SEQ ID NO: 887689 - RNA, 22 nt, Mycobacterium avium subsp. paratuberculosis
gcgcgcagaacaccaccgccag

SEQ ID NO: 887690 - RNA, 15 nt, Mycobacterium avium subsp. paratuberculosis
gcgcgcaacgacgaa

SEQ ID NO: 887691 - RNA, 23 nt, Mycobacterium avium subsp. paratuberculosis
gcgcgcaacgauucacccagcga

SEQ ID NO: 887692 - RNA, 21 nt, Mycobacterium avium subsp. paratuberculosis
gcgcgcacguuggcggccagc

SEQ ID NO: 887693 - RNA, 15 nt, Mycobacterium avium subsp. paratuberculosis
gcgcgcagcaggcgc

SEQ ID NO: 887694 - RNA, 19 nt, Mycobacterium avium subsp. paratuberculosis
gcgcgcagcaggcgccggu

SEQ ID NO: 887695 - RNA, 15 nt, Mycobacterium avium subsp. paratuberculosis
gcgcgcagaucgucg

SEQ ID NO: 887696 - RNA, 18 nt, Mycobacterium avium subsp. paratuberculosis
gcgcgcagaucgucgacc

SEQ ID NO: 887697 - RNA, 21 nt, Mycobacterium avium subsp. paratuberculosis
gcgcgcagaucgucgaccugc

SEQ ID NO: 887698 - RNA, 12 nt, Mycobacterium avium subsp. paratuberculosis
gcgcgcagcacc

SEQ ID NO: 887699 - RNA, 13 nt, Mycobacterium avium subsp. paratuberculosis
gcgcgcagcacca

SEQ ID NO: 887700 - RNA, 15 nt, Mycobacterium avium subsp. paratuberculosis
gcgcgcagcaccagc

SEQ ID NO: 887701 - RNA, 17 nt, Mycobacterium avium subsp. paratuberculosis
gcgcgcagcaccagcuc

SEQ ID NO: 887702 - RNA, 21 nt, Mycobacterium avium subsp. paratuberculosis
gcgcgcaacagcgucucgacg

SEQ ID NO: 887703 - RNA, 15 nt, Mycobacterium avium subsp. paratuberculosis
gcgcgaugucgacgg

SEQ ID NO: 887704 - RNA, 18 nt, Mycobacterium avium subsp. paratuberculosis
gcgcgauggacagcagcc

SEQ ID NO: 887705 - RNA, 19 nt, Mycobacterium avium subsp. paratuberculosis
gcgcgauggacagcagcca

SEQ ID NO: 887706 - RNA, 20 nt, Mycobacterium avium subsp. paratuberculosis
gcgcgauggcgugccggcgc

SEQ ID NO: 887707 - RNA, 21 nt, Mycobacterium avium subsp. paratuberculosis
gcgcgauggcgugccggcgcu

SEQ ID NO: 887708 - RNA, 22 nt, Mycobacterium avium subsp. paratuberculosis
gcgcgauggcgugccggcgcug

SEQ ID NO: 887709 - RNA, 12 nt, Mycobacterium avium subsp. paratuberculosis
gcgcgaugcggc

SEQ ID NO: 887710 - RNA, 14 nt, Mycobacterium avium subsp. paratuberculosis
gcgcgaugcggcuc

SEQ ID NO: 887711 - RNA, 13 nt, Mycobacterium avium subsp. paratuberculosis
gcgcgaugcgggc

SEQ ID NO: 887712 - RNA, 17 nt, Mycobacterium avium subsp. paratuberculosis
gcgcgaugcgggcgccg

SEQ ID NO: 887713 - RNA, 20 nt, Mycobacterium avium subsp. paratuberculosis
gcgcgaugcgggcgccgaac

SEQ ID NO: 887714 - RNA, 20 nt, Mycobacterium avium subsp. paratuberculosis
gcgcgaugcuauucgggcca

SEQ ID NO: 887715 - RNA, 13 nt, Mycobacterium avium subsp. paratuberculosis
gcgcgccagcgug

SEQ ID NO: 887716 - RNA, 22 nt, Mycobacterium avium subsp. paratuberculosis
gcgcgccacgacguacccccgc

SEQ ID NO: 887717 - RNA, 15 nt, Mycobacterium avium subsp. paratuberculosis
gcgcgcaggcacucg

SEQ ID NO: 887718 - RNA, 18 nt, Mycobacterium avium subsp. paratuberculosis
gcgcgcaggccccggcgc

SEQ ID NO: 887719 - RNA, 13 nt, Mycobacterium avium subsp. paratuberculosis
gcgcgcagcgugu

SEQ ID NO: 887720 - RNA, 15 nt, Mycobacterium avium subsp. paratuberculosis
gcgcgcagcgugugc

SEQ ID NO: 887721 - RNA, 19 nt, Mycobacterium avium subsp. paratuberculosis
gcgcgcagcucgcgcagcc

SEQ ID NO: 887722 - RNA, 13 nt, Mycobacterium avium subsp. paratuberculosis
gcgcgcagccggc

SEQ ID NO: 887723 - RNA, 15 nt, Mycobacterium avium subsp. paratuberculosis
gcgcgcagccggccg

SEQ ID NO: 887724 - RNA, 21 nt, Mycobacterium avium subsp. paratuberculosis
gcgcgcagccggccguccacg

SEQ ID NO: 887725 - RNA, 23 nt, Mycobacterium avium subsp. paratuberculosis
gcgcgcagccagucgccggccag

SEQ ID NO: 887726 - RNA, 14 nt, Mycobacterium avium subsp. paratuberculosis
gcgcgcagcccagc

SEQ ID NO: 887727 - RNA, 17 nt, Mycobacterium avium subsp. paratuberculosis
gcgcgcagcccagccag

SEQ ID NO: 887728 - RNA, 22 nt, Mycobacterium avium subsp. paratuberculosis
gcgaauucggugaucgcggugg

SEQ ID NO: 887729 - RNA, 16 nt, Mycobacterium avium subsp. paratuberculosis
gcgacaaaggaggggc

SEQ ID NO: 887730 - RNA, 21 nt, Mycobacterium avium subsp. paratuberculosis
gcgacaaaggaggggcgcggc

SEQ ID NO: 887731 - RNA, 14 nt, Mycobacterium avium subsp. paratuberculosis
gcgaaugucgacca

SEQ ID NO: 887732 - RNA, 18 nt, Mycobacterium avium subsp. paratuberculosis
gcgaaugucgaccaccgg

SEQ ID NO: 887733 - RNA, 20 nt, Mycobacterium avium subsp. paratuberculosis
gcgaaugucgaccaccgggu

SEQ ID NO: 887734 - RNA, 16 nt, Mycobacterium avium subsp. paratuberculosis
gcgaaucggcgcacag

SEQ ID NO: 887735 - RNA, 17 nt, Mycobacterium avium subsp. paratuberculosis
gcgaaucggcgcacagc

SEQ ID NO: 887736 - RNA, 18 nt, Mycobacterium avium subsp. paratuberculosis
gcgaaucggcgcacagcu

SEQ ID NO: 887737 - RNA, 14 nt, Mycobacterium avium subsp. paratuberculosis
gcgaaucggggucg

SEQ ID NO: 887738 - RNA, 15 nt, Mycobacterium avium subsp. paratuberculosis
gcgaaucgguccggc

SEQ ID NO: 887739 - RNA, 16 nt, Mycobacterium avium subsp. paratuberculosis
gcgaaucgguccggcg

SEQ ID NO: 887740 - RNA, 16 nt, Mycobacterium avium subsp. paratuberculosis
gcgaaugcggccaugu

SEQ ID NO: 887741 - RNA, 16 nt, Mycobacterium avium subsp. paratuberculosis
gcgaaucugucgaugg

SEQ ID NO: 887742 - RNA, 17 nt, Mycobacterium avium subsp. paratuberculosis
gcgaaucugucgauggc

SEQ ID NO: 887743 - RNA, 14 nt, Mycobacterium avium subsp. paratuberculosis
gcgaaucgucggcg

SEQ ID NO: 887744 - RNA, 16 nt, Mycobacterium avium subsp. paratuberculosis
gcgaaucgucggcgau

SEQ ID NO: 887745 - RNA, 13 nt, Mycobacterium avium subsp. paratuberculosis
gcgaaugacgcgc

SEQ ID NO: 887746 - RNA, 17 nt, Mycobacterium avium subsp. paratuberculosis
gcgaauauuucgccgau

SEQ ID NO: 887747 - RNA, 18 nt, Mycobacterium avium subsp. paratuberculosis
gcgaauauuucgccgauc

SEQ ID NO: 887748 - RNA, 16 nt, Mycobacterium avium subsp. paratuberculosis
gcgaauacaccgucca

SEQ ID NO: 887749 - RNA, 16 nt, Mycobacterium avium subsp. paratuberculosis
gcgaauaccagggcga

SEQ ID NO: 887750 - RNA, 18 nt, Mycobacterium avium subsp. paratuberculosis
gcgaauaccaucaacccg

SEQ ID NO: 887751 - RNA, 15 nt, Mycobacterium avium subsp. paratuberculosis
gcgaauacccgccca

SEQ ID NO: 887752 - RNA, 17 nt, Mycobacterium avium subsp. paratuberculosis
gcgaauacccgcccagc

SEQ ID NO: 887753 - RNA, 19 nt, Mycobacterium avium subsp. paratuberculosis
gcgaauacccgcccagcac

SEQ ID NO: 887754 - RNA, 13 nt, Mycobacterium avium subsp. paratuberculosis
gcgaaucagcagc

SEQ ID NO: 887755 - RNA, 17 nt, Mycobacterium avium subsp. paratuberculosis
gcgaaucccggccucgu

SEQ ID NO: 887756 - RNA, 15 nt, Mycobacterium avium subsp. paratuberculosis
gcgaauccgaccggc

SEQ ID NO: 887757 - RNA, 18 nt, Mycobacterium avium subsp. paratuberculosis
gcgaauccgaccggcuca

SEQ ID NO: 887758 - RNA, 19 nt, Mycobacterium avium subsp. paratuberculosis
gcgaauccgauugcggcgc

SEQ ID NO: 887759 - RNA, 20 nt, Mycobacterium avium subsp. paratuberculosis
gcgaauccgggugucgacgc

SEQ ID NO: 887760 - RNA, 21 nt, Mycobacterium avium subsp. paratuberculosis
gcgaauccgggugucgacgcc

SEQ ID NO: 887761 - RNA, 22 nt, Mycobacterium avium subsp. paratuberculosis
gcgaauccgggugucgacgccg

SEQ ID NO: 887762 - RNA, 19 nt, Mycobacterium avium subsp. paratuberculosis
gcgaaucgauaacgcgcgc

SEQ ID NO: 887763 - RNA, 13 nt, Mycobacterium avium subsp. paratuberculosis
gccuugcgggccg

SEQ ID NO: 887764 - RNA, 14 nt, Mycobacterium avium subsp. paratuberculosis
gccuugggccgguc

SEQ ID NO: 887765 - RNA, 21 nt, Mycobacterium avium subsp. paratuberculosis
gccuuggugauccggggcacg

SEQ ID NO: 887766 - RNA, 15 nt, Mycobacterium avium subsp. paratuberculosis
gccuuggcggcgugg

SEQ ID NO: 887767 - RNA, 14 nt, Mycobacterium avium subsp. paratuberculosis
gccuuggcucgggc

SEQ ID NO: 887768 - RNA, 18 nt, Mycobacterium avium subsp. paratuberculosis
gccuuguggucgaucccg

SEQ ID NO: 887769 - RNA, 18 nt, Mycobacterium avium subsp. paratuberculosis
gccuugucggcgaugucg

SEQ ID NO: 887770 - RNA, 18 nt, Mycobacterium avium subsp. paratuberculosis
gcgaaggcggcgucgaug

SEQ ID NO: 887771 - RNA, 15 nt, Mycobacterium avium subsp. paratuberculosis
gcgaaggccagcgau

SEQ ID NO: 887772 - RNA, 19 nt, Mycobacterium avium subsp. paratuberculosis
gcgaaguuggucaccacca

SEQ ID NO: 887773 - RNA, 14 nt, Mycobacterium avium subsp. paratuberculosis
gcgaaguagccggc

SEQ ID NO: 887774 - RNA, 17 nt, Mycobacterium avium subsp. paratuberculosis
gcgaagucccacugccc

SEQ ID NO: 887775 - RNA, 13 nt, Mycobacterium avium subsp. paratuberculosis
gcgaaguucggca

SEQ ID NO: 887776 - RNA, 16 nt, Mycobacterium avium subsp. paratuberculosis
gcgaaguucggcaucc

SEQ ID NO: 887777 - RNA, 13 nt, Mycobacterium avium subsp. paratuberculosis
gcgaagucgccgc

SEQ ID NO: 887778 - RNA, 15 nt, Mycobacterium avium subsp. paratuberculosis
gcgaagucgccgccc

SEQ ID NO: 887779 - RNA, 21 nt, Mycobacterium avium subsp. paratuberculosis
gcgaagucgccgcccgggccg

SEQ ID NO: 887780 - RNA, 15 nt, Mycobacterium avium subsp. paratuberculosis
gcgaagucgccggcc

SEQ ID NO: 887781 - RNA, 15 nt, Mycobacterium avium subsp. paratuberculosis
gcgaaggcgcgcagg

SEQ ID NO: 887782 - RNA, 22 nt, Mycobacterium avium subsp. paratuberculosis
gcgaaggucugaaaugccgggc

SEQ ID NO: 887783 - RNA, 16 nt, Mycobacterium avium subsp. paratuberculosis
gcgaaggugccccgcu

SEQ ID NO: 887784 - RNA, 15 nt, Mycobacterium avium subsp. paratuberculosis
gcgaaggugccgcga

SEQ ID NO: 887785 - RNA, 17 nt, Mycobacterium avium subsp. paratuberculosis
gcgaagguggcacgcca

SEQ ID NO: 887786 - RNA, 14 nt, Mycobacterium avium subsp. paratuberculosis
gcgaagguggcgcc

SEQ ID NO: 887787 - RNA, 18 nt, Mycobacterium avium subsp. paratuberculosis
gcgaagguggcgccggua

SEQ ID NO: 887788 - RNA, 16 nt, Mycobacterium avium subsp. paratuberculosis
gcgaagguggcgucgg

SEQ ID NO: 887789 - RNA, 19 nt, Mycobacterium avium subsp. paratuberculosis
gcgaaggugggcagcgcca

SEQ ID NO: 887790 - RNA, 14 nt, Mycobacterium avium subsp. paratuberculosis
gcgacaacaggcga

SEQ ID NO: 887791 - RNA, 15 nt, Mycobacterium avium subsp. paratuberculosis
gcgacaacagcgccg

SEQ ID NO: 887792 - RNA, 16 nt, Mycobacterium avium subsp. paratuberculosis
gcgacaacagcgccga

SEQ ID NO: 887793 - RNA, 23 nt, Mycobacterium avium subsp. paratuberculosis
gcgacaacagcgccgagacgugg

SEQ ID NO: 887794 - RNA, 18 nt, Mycobacterium avium subsp. paratuberculosis
gcgacacggaaaccgcug

SEQ ID NO: 887795 - RNA, 22 nt, Mycobacterium avium subsp. paratuberculosis
gcgacacggaaaccgcugcggc

SEQ ID NO: 887796 - RNA, 23 nt, Mycobacterium avium subsp. paratuberculosis
gcgacacggaaaccgcugcggca

SEQ ID NO: 887797 - RNA, 14 nt, Mycobacterium avium subsp. paratuberculosis
gcgacacgccgacg

SEQ ID NO: 887798 - RNA, 17 nt, Mycobacterium avium subsp. paratuberculosis
gcgacacgccgacgauc

SEQ ID NO: 887799 - RNA, 23 nt, Mycobacterium avium subsp. paratuberculosis
gcgacacgccgacgauccgcgcc

SEQ ID NO: 887800 - RNA, 13 nt, Mycobacterium avium subsp. paratuberculosis
gcgacagcagcgu

SEQ ID NO: 887801 - RNA, 15 nt, Mycobacterium avium subsp. paratuberculosis
gcgacagcagcgugg

SEQ ID NO: 887802 - RNA, 14 nt, Mycobacterium avium subsp. paratuberculosis
gcgacagcacgggc

SEQ ID NO: 887803 - RNA, 13 nt, Mycobacterium avium subsp. paratuberculosis
gcgacagcacccg

SEQ ID NO: 887804 - RNA, 14 nt, Mycobacterium avium subsp. paratuberculosis
gcgacagcacccgc

SEQ ID NO: 887805 - RNA, 15 nt, Mycobacterium avium subsp. paratuberculosis
gcgacagcacccgcu

SEQ ID NO: 887806 - RNA, 16 nt, Mycobacterium avium subsp. paratuberculosis
gcgacagcacccgcug

SEQ ID NO: 887807 - RNA, 21 nt, Mycobacterium avium subsp. paratuberculosis
gcgacagcacccgcugcagcc

SEQ ID NO: 887808 - RNA, 14 nt, Mycobacterium avium subsp. paratuberculosis
gcgacacguccagc

SEQ ID NO: 887809 - RNA, 13 nt, Mycobacterium avium subsp. paratuberculosis
gcgacacgucgac

SEQ ID NO: 887810 - RNA, 14 nt, Mycobacterium avium subsp. paratuberculosis
gcgacacgucgaca

SEQ ID NO: 887811 - RNA, 19 nt, Mycobacterium avium subsp. paratuberculosis
gcgacagaaaucgcgcaga

SEQ ID NO: 887812 - RNA, 16 nt, Mycobacterium avium subsp. paratuberculosis
gcgacagccgcccggc

SEQ ID NO: 887813 - RNA, 17 nt, Mycobacterium avium subsp. paratuberculosis
gcgacagccgcccggcg

SEQ ID NO: 887814 - RNA, 23 nt, Mycobacterium avium subsp. paratuberculosis
gcgacagccgggaaucgagggcg

SEQ ID NO: 887815 - RNA, 15 nt, Mycobacterium avium subsp. paratuberculosis
gcgacaucaccgcgg

SEQ ID NO: 887816 - RNA, 20 nt, Mycobacterium avium subsp. paratuberculosis
gcgacaucaccgcgggcgcg

SEQ ID NO: 887817 - RNA, 23 nt, Mycobacterium avium subsp. paratuberculosis
gcgacaucaccgcgggcgcgccg

SEQ ID NO: 887818 - RNA, 14 nt, Mycobacterium avium subsp. paratuberculosis
gcgacaucgccggc

SEQ ID NO: 887819 - RNA, 15 nt, Mycobacterium avium subsp. paratuberculosis
gcgacaucgccggcg

SEQ ID NO: 887820 - RNA, 19 nt, Mycobacterium avium subsp. paratuberculosis
gcgacaucgccggcgaccg

SEQ ID NO: 887821 - RNA, 13 nt, Mycobacterium avium subsp. paratuberculosis
gcgacaucggcgc

SEQ ID NO: 887822 - RNA, 14 nt, Mycobacterium avium subsp. paratuberculosis
gcgacaucggcgcc

SEQ ID NO: 887823 - RNA, 18 nt, Mycobacterium avium subsp. paratuberculosis
gcgacauggucgggcgca

SEQ ID NO: 887824 - RNA, 18 nt, Mycobacterium avium subsp. paratuberculosis
gcgacaugcgcagcgccc

SEQ ID NO: 887825 - RNA, 22 nt, Mycobacterium avium subsp. paratuberculosis
gcgacaugcgcagcgcccaggc

SEQ ID NO: 887826 - RNA, 14 nt, Mycobacterium avium subsp. paratuberculosis
gcgacaucggugac

SEQ ID NO: 887827 - RNA, 16 nt, Mycobacterium avium subsp. paratuberculosis
gcgacaucggugaccg

SEQ ID NO: 887828 - RNA, 18 nt, Mycobacterium avium subsp. paratuberculosis
gcgacaucggugaccguc

SEQ ID NO: 887829 - RNA, 21 nt, Mycobacterium avium subsp. paratuberculosis
gcgacaucggugaccgucgcc

SEQ ID NO: 887830 - RNA, 15 nt, Mycobacterium avium subsp. paratuberculosis
gcgacaucucgguga

SEQ ID NO: 887831 - RNA, 15 nt, Mycobacterium avium subsp. paratuberculosis
gcgacaugaccaccg

SEQ ID NO: 887832 - RNA, 17 nt, Mycobacterium avium subsp. paratuberculosis
gcgacaugaccaccgcg

SEQ ID NO: 887833 - RNA, 20 nt, Mycobacterium avium subsp. paratuberculosis
gcgacaugaccaccgcgucg

SEQ ID NO: 887834 - RNA, 21 nt, Mycobacterium avium subsp. paratuberculosis
gcgacaugaccaccgcgucgg

SEQ ID NO: 887835 - RNA, 19 nt, Mycobacterium avium subsp. paratuberculosis
gcgaccagcgacggcaggu

SEQ ID NO: 887836 - RNA, 21 nt, Mycobacterium avium subsp. paratuberculosis
gcgaccagcgagcccagcugc

SEQ ID NO: 887837 - RNA, 21 nt, Mycobacterium avium subsp. paratuberculosis
gcgaccagauaggccagcgcg

SEQ ID NO: 887838 - RNA, 17 nt, Mycobacterium avium subsp. paratuberculosis
gcgaccagcaggucgag

SEQ ID NO: 887839 - RNA, 19 nt, Mycobacterium avium subsp. paratuberculosis
gcgaccagccccucgacca

SEQ ID NO: 887840 - RNA, 21 nt, Mycobacterium avium subsp. paratuberculosis
gcgaccagccccucgaccacc

SEQ ID NO: 887841 - RNA, 14 nt, Mycobacterium avium subsp. paratuberculosis
gcgaccaggcccag

SEQ ID NO: 887842 - RNA, 17 nt, Mycobacterium avium subsp. paratuberculosis
gcgaccagcgcgccggc

SEQ ID NO: 887843 - RNA, 19 nt, Mycobacterium avium subsp. paratuberculosis
gcgaccagcgcgccggcca

SEQ ID NO: 887844 - RNA, 13 nt, Mycobacterium avium subsp. paratuberculosis
gcgaccagcggca

SEQ ID NO: 887845 - RNA, 22 nt, Mycobacterium avium subsp. paratuberculosis
gcgaccagcggcagcagcacca

SEQ ID NO: 887846 - RNA, 16 nt, Mycobacterium avium subsp. paratuberculosis
gcgaccaugcccagca

SEQ ID NO: 887847 - RNA, 23 nt, Mycobacterium avium subsp. paratuberculosis
gcgaccaugcccagcaguccggc

SEQ ID NO: 887848 - RNA, 15 nt, Mycobacterium avium subsp. paratuberculosis
gcgaccaugcccggc

SEQ ID NO: 887849 - RNA, 17 nt, Mycobacterium avium subsp. paratuberculosis
gcgaccaugcccggcgc

SEQ ID NO: 887850 - RNA, 16 nt, Mycobacterium avium subsp. paratuberculosis
gcgaccaugccgcggg

SEQ ID NO: 887851 - RNA, 17 nt, Mycobacterium avium subsp. paratuberculosis
gcgaccaugccgcgggc

SEQ ID NO: 887852 - RNA, 18 nt, Mycobacterium avium subsp. paratuberculosis
gcgaccaugccgcgggcc

SEQ ID NO: 887853 - RNA, 18 nt, Mycobacterium avium subsp. paratuberculosis
gcgaccagguucucggug

SEQ ID NO: 887854 - RNA, 15 nt, Mycobacterium avium subsp. paratuberculosis
gcgaccaguaggcca

SEQ ID NO: 887855 - RNA, 17 nt, Mycobacterium avium subsp. paratuberculosis
gcgaccaguaggccagc

SEQ ID NO: 887856 - RNA, 13 nt, Mycobacterium avium subsp. paratuberculosis
gcgaccagugcac

SEQ ID NO: 887857 - RNA, 17 nt, Mycobacterium avium subsp. paratuberculosis
gcgaccaucagcccggu

SEQ ID NO: 887858 - RNA, 20 nt, Mycobacterium avium subsp. paratuberculosis
gcgaccaucagccugcggug

SEQ ID NO: 887859 - RNA, 12 nt, Mycobacterium avium subsp. paratuberculosis
gcgaccauccac

SEQ ID NO: 887860 - RNA, 21 nt, Mycobacterium avium subsp. paratuberculosis
gcgaccauccacucgggccag

SEQ ID NO: 887861 - RNA, 22 nt, Mycobacterium avium subsp. paratuberculosis
gcgaccauccacucgggccagc

SEQ ID NO: 887862 - RNA, 13 nt, Mycobacterium avium subsp. paratuberculosis
gcgaccggccauc

SEQ ID NO: 887863 - RNA, 23 nt, Mycobacterium avium subsp. paratuberculosis
gcgaccggccaucuccugcacgc

SEQ ID NO: 887864 - RNA, 13 nt, Mycobacterium avium subsp. paratuberculosis
gcgaccggcccca

SEQ ID NO: 887865 - RNA, 20 nt, Mycobacterium avium subsp. paratuberculosis
gcgaccggccccaacggcgu

SEQ ID NO: 887866 - RNA, 13 nt, Mycobacterium avium subsp. paratuberculosis
gcgaccggcccga

SEQ ID NO: 887867 - RNA, 13 nt, Mycobacterium avium subsp. paratuberculosis
gcgaccgcggccg

SEQ ID NO: 887868 - RNA, 14 nt, Mycobacterium avium subsp. paratuberculosis
gcgaccgcggccgc

SEQ ID NO: 887869 - RNA, 15 nt, Mycobacterium avium subsp. paratuberculosis
gcgaccgcggccgcg

SEQ ID NO: 887870 - RNA, 20 nt, Mycobacterium avium subsp. paratuberculosis
gcgaccgcggccgcgacggu

SEQ ID NO: 887871 - RNA, 16 nt, Mycobacterium avium subsp. paratuberculosis
gcgaccgcgucgacgg

SEQ ID NO: 887872 - RNA, 13 nt, Mycobacterium avium subsp. paratuberculosis
gcgaccgcggaug

SEQ ID NO: 887873 - RNA, 12 nt, Mycobacterium avium subsp. paratuberculosis
gcgaccgcggcc

SEQ ID NO: 887874 - RNA, 13 nt, Mycobacterium avium subsp. paratuberculosis
gcgacccaccguc

SEQ ID NO: 887875 - RNA, 16 nt, Mycobacterium avium subsp. paratuberculosis
gcgacccaccgucgaa

SEQ ID NO: 887876 - RNA, 18 nt, Mycobacterium avium subsp. paratuberculosis
gcgacccaccgucgaaga

SEQ ID NO: 887877 - RNA, 16 nt, Mycobacterium avium subsp. paratuberculosis
gcgaccgcgcgcggcg

SEQ ID NO: 887878 - RNA, 21 nt, Mycobacterium avium subsp. paratuberculosis
gcgaccgcgcgcggcgccgcg

SEQ ID NO: 887879 - RNA, 19 nt, Mycobacterium avium subsp. paratuberculosis
gcgaccgccuugucggcga

SEQ ID NO: 887880 - RNA, 23 nt, Mycobacterium avium subsp. paratuberculosis
gcgaccgccuugucggcgauguc

SEQ ID NO: 887881 - RNA, 14 nt, Mycobacterium avium subsp. paratuberculosis
gcgaccgcgcaggc

SEQ ID NO: 887882 - RNA, 17 nt, Mycobacterium avium subsp. paratuberculosis
gcgaccgcgcaggcggc

SEQ ID NO: 887883 - RNA, 13 nt, Mycobacterium avium subsp. paratuberculosis
gcgaccgccucgu

SEQ ID NO: 887884 - RNA, 24 nt, Mycobacterium avium subsp. paratuberculosis
gcgaccgccucgucgggaacgcga

SEQ ID NO: 887885 - RNA, 13 nt, Mycobacterium avium subsp. paratuberculosis
gcgaccgcgacga

SEQ ID NO: 887886 - RNA, 14 nt, Mycobacterium avium subsp. paratuberculosis
gcgaccgcgacggu

SEQ ID NO: 887887 - RNA, 17 nt, Mycobacterium avium subsp. paratuberculosis
gcgaccgcgaugcgaca

SEQ ID NO: 887888 - RNA, 20 nt, Mycobacterium avium subsp. paratuberculosis
gcgaccgcgaugcgacaccg

SEQ ID NO: 887889 - RNA, 22 nt, Mycobacterium avium subsp. paratuberculosis
gcgaccugcggcucgucggcga

SEQ ID NO: 887890 - RNA, 14 nt, Mycobacterium avium subsp. paratuberculosis
gcgaccugcgggcc

SEQ ID NO: 887891 - RNA, 15 nt, Mycobacterium avium subsp. paratuberculosis
gcgaccugcgggccc

SEQ ID NO: 887892 - RNA, 19 nt, Mycobacterium avium subsp. paratuberculosis
gcgaccugcgggcccaccg

SEQ ID NO: 887893 - RNA, 13 nt, Mycobacterium avium subsp. paratuberculosis
gcgaccucggugg

SEQ ID NO: 887894 - RNA, 13 nt, Mycobacterium avium subsp. paratuberculosis
gcgaccucguggu

SEQ ID NO: 887895 - RNA, 13 nt, Mycobacterium avium subsp. paratuberculosis
gcgaccgguccgc

SEQ ID NO: 887896 - RNA, 15 nt, Mycobacterium avium subsp. paratuberculosis
gcgaccgguccgugc

SEQ ID NO: 887897 - RNA, 19 nt, Mycobacterium avium subsp. paratuberculosis
gcgaccgguccgugccacg

SEQ ID NO: 887898 - RNA, 13 nt, Mycobacterium avium subsp. paratuberculosis
gcgaccgucagca

SEQ ID NO: 887899 - RNA, 19 nt, Mycobacterium avium subsp. paratuberculosis
gcgaccgucagcagggccu

SEQ ID NO: 887900 - RNA, 16 nt, Mycobacterium avium subsp. paratuberculosis
gcgaccgucgggacgg

SEQ ID NO: 887901 - RNA, 19 nt, Mycobacterium avium subsp. paratuberculosis
gcgaccgucgggacggcca

SEQ ID NO: 887902 - RNA, 21 nt, Mycobacterium avium subsp. paratuberculosis
gcgaccgucgggacggccagc

SEQ ID NO: 887903 - RNA, 16 nt, Mycobacterium avium subsp. paratuberculosis
gcgacgcugugcucgg

SEQ ID NO: 887904 - RNA, 22 nt, Mycobacterium avium subsp. paratuberculosis
gcgaccugauuucaucgcggcg

SEQ ID NO: 887905 - RNA, 20 nt, Mycobacterium avium subsp. paratuberculosis
gcgaccugcaucucgacccg

SEQ ID NO: 887906 - RNA, 19 nt, Mycobacterium avium subsp. paratuberculosis
gcgaccugcuuggcggccu

SEQ ID NO: 887907 - RNA, 21 nt, Mycobacterium avium subsp. paratuberculosis
gcgaccugcuuggcggccugc

SEQ ID NO: 887908 - RNA, 16 nt, Mycobacterium avium subsp. paratuberculosis
gcgaccuggacgccgc

SEQ ID NO: 887909 - RNA, 19 nt, Mycobacterium avium subsp. paratuberculosis
gcgaccuggugcucgaugc

SEQ ID NO: 887910 - RNA, 21 nt, Mycobacterium avium subsp. paratuberculosis
gcgaccugguccaccgcggcg

SEQ ID NO: 887911 - RNA, 16 nt, Mycobacterium avium subsp. paratuberculosis
gcgacggcaccgccgg

SEQ ID NO: 887912 - RNA, 21 nt, Mycobacterium avium subsp. paratuberculosis
gcgacggcaccgccggcggcc

SEQ ID NO: 887913 - RNA, 22 nt, Mycobacterium avium subsp. paratuberculosis
gcgacggcaccgccggcggccu

SEQ ID NO: 887914 - RNA, 21 nt, Mycobacterium avium subsp. paratuberculosis
gcgacggcagcgcgauccggg

SEQ ID NO: 887915 - RNA, 22 nt, Mycobacterium avium subsp. paratuberculosis
gcgacggaucggccgcgucggg

SEQ ID NO: 887916 - RNA, 16 nt, Mycobacterium avium subsp. paratuberculosis
gcgacggcaauccggc

SEQ ID NO: 887917 - RNA, 20 nt, Mycobacterium avium subsp. paratuberculosis
gcgacggcaauccggccccg

SEQ ID NO: 887918 - RNA, 16 nt, Mycobacterium avium subsp. paratuberculosis
gcgacggcaggucggu

SEQ ID NO: 887919 - RNA, 18 nt, Mycobacterium avium subsp. paratuberculosis
gcgacggcaggucggugc

SEQ ID NO: 887920 - RNA, 21 nt, Mycobacterium avium subsp. paratuberculosis
gcgacggcauugcagcggaug

SEQ ID NO: 887921 - RNA, 12 nt, Mycobacterium avium subsp. paratuberculosis
gcgacggccagc

SEQ ID NO: 887922 - RNA, 15 nt, Mycobacterium avium subsp. paratuberculosis
gcgacggccagcgcg

SEQ ID NO: 887923 - RNA, 16 nt, Mycobacterium avium subsp. paratuberculosis
gcgacggccagcgcgg

SEQ ID NO: 887924 - RNA, 14 nt, Mycobacterium avium subsp. paratuberculosis
gcgacggcggcgac

SEQ ID NO: 887925 - RNA, 18 nt, Mycobacterium avium subsp. paratuberculosis
gcgacggucaguccgggu

SEQ ID NO: 887926 - RNA, 16 nt, Mycobacterium avium subsp. paratuberculosis
gcgacgggcucggcgu

SEQ ID NO: 887927 - RNA, 20 nt, Mycobacterium avium subsp. paratuberculosis
gcgacgguuguucagcccgg

SEQ ID NO: 887928 - RNA, 13 nt, Mycobacterium avium subsp. paratuberculosis
gcgacggucgugc

SEQ ID NO: 887929 - RNA, 17 nt, Mycobacterium avium subsp. paratuberculosis
gcgacggucgugcuggg

SEQ ID NO: 887930 - RNA, 15 nt, Mycobacterium avium subsp. paratuberculosis
gcgacggucugccgg

SEQ ID NO: 887931 - RNA, 21 nt, Mycobacterium avium subsp. paratuberculosis
gcgacggugcaugcgcuggcg

SEQ ID NO: 887932 - RNA, 22 nt, Mycobacterium avium subsp. paratuberculosis
gcgacggugcaugcgcuggcga

SEQ ID NO: 887933 - RNA, 17 nt, Mycobacterium avium subsp. paratuberculosis
gcgacgguggacccgac

SEQ ID NO: 887934 - RNA, 12 nt, Mycobacterium avium subsp. paratuberculosis
gcgacgguggcg

SEQ ID NO: 887935 - RNA, 13 nt, Mycobacterium avium subsp. paratuberculosis
gcgacgguggcgc

SEQ ID NO: 887936 - RNA, 18 nt, Mycobacterium avium subsp. paratuberculosis
gcgacgguggcgcccagc

SEQ ID NO: 887937 - RNA, 16 nt, Mycobacterium avium subsp. paratuberculosis
gcgacgguggcggcga

SEQ ID NO: 887938 - RNA, 20 nt, Mycobacterium avium subsp. paratuberculosis
gcgacgguggcggcgauguc

SEQ ID NO: 887939 - RNA, 22 nt, Mycobacterium avium subsp. paratuberculosis
gcgacgguguccgcggcgucgg

SEQ ID NO: 887940 - RNA, 23 nt, Mycobacterium avium subsp. paratuberculosis
gcgacgguguccgcggcgucggg

SEQ ID NO: 887941 - RNA, 19 nt, Mycobacterium avium subsp. paratuberculosis
gcgacgggcaugccgucgg

SEQ ID NO: 887942 - RNA, 22 nt, Mycobacterium avium subsp. paratuberculosis
gcgacgggcaugccgucggcgc

SEQ ID NO: 887943 - RNA, 23 nt, Mycobacterium avium subsp. paratuberculosis
gcgacgggcaugccgucggcgcc

SEQ ID NO: 887944 - RNA, 13 nt, Mycobacterium avium subsp. paratuberculosis
gcgacgggccgau

SEQ ID NO: 887945 - RNA, 14 nt, Mycobacterium avium subsp. paratuberculosis
gcgacgggccgggc

SEQ ID NO: 887946 - RNA, 19 nt, Mycobacterium avium subsp. paratuberculosis
gcgacgggccgggcacguc

SEQ ID NO: 887947 - RNA, 18 nt, Mycobacterium avium subsp. paratuberculosis
gcgacggcguugcuggcg

SEQ ID NO: 887948 - RNA, 14 nt, Mycobacterium avium subsp. paratuberculosis
gcgacgggcacccg

SEQ ID NO: 887949 - RNA, 16 nt, Mycobacterium avium subsp. paratuberculosis
gcgacgggcacccgcg

SEQ ID NO: 887950 - RNA, 19 nt, Mycobacterium avium subsp. paratuberculosis
gcgacgggcacccgcgcgu

SEQ ID NO: 887951 - RNA, 21 nt, Mycobacterium avium subsp. paratuberculosis
gcgacgggcacccgcgcgucg

SEQ ID NO: 887952 - RNA, 16 nt, Mycobacterium avium subsp. paratuberculosis
gcgacggcgucggcga

SEQ ID NO: 887953 - RNA, 17 nt, Mycobacterium avium subsp. paratuberculosis
gcgacggcgucggcgag

SEQ ID NO: 887954 - RNA, 16 nt, Mycobacterium avium subsp. paratuberculosis
gcgacggcgucggcgg

SEQ ID NO: 887955 - RNA, 17 nt, Mycobacterium avium subsp. paratuberculosis
gcgacggcguccagcug

SEQ ID NO: 887956 - RNA, 16 nt, Mycobacterium avium subsp. paratuberculosis
gcgacggcguccgggc

SEQ ID NO: 887957 - RNA, 13 nt, Mycobacterium avium subsp. paratuberculosis
gcgacggcggggu

SEQ ID NO: 887958 - RNA, 18 nt, Mycobacterium avium subsp. paratuberculosis
gcgacggcggggugcgcg

SEQ ID NO: 887959 - RNA, 12 nt, Mycobacterium avium subsp. paratuberculosis
gcgacggcggug

SEQ ID NO: 887960 - RNA, 22 nt, Mycobacterium avium subsp. paratuberculosis
gcgacggcggugggcucggcca

SEQ ID NO: 887961 - RNA, 23 nt, Mycobacterium avium subsp. paratuberculosis
gcgacggcggugggcucggccau

SEQ ID NO: 887962 - RNA, 13 nt, Mycobacterium avium subsp. paratuberculosis
gcgacguggcgca

SEQ ID NO: 887963 - RNA, 17 nt, Mycobacterium avium subsp. paratuberculosis
gcgacgugaucggcggc

SEQ ID NO: 887964 - RNA, 19 nt, Mycobacterium avium subsp. paratuberculosis
gcgacgugaucggcggccu

SEQ ID NO: 887965 - RNA, 15 nt, Mycobacterium avium subsp. paratuberculosis
gcgacgugauggucg

SEQ ID NO: 887966 - RNA, 21 nt, Mycobacterium avium subsp. paratuberculosis
gcgacgugauggucgucgugg

SEQ ID NO: 887967 - RNA, 22 nt, Mycobacterium avium subsp. paratuberculosis
gcgacgugauggucgucguggu

SEQ ID NO: 887968 - RNA, 13 nt, Mycobacterium avium subsp. paratuberculosis
gcgacgugccggc

SEQ ID NO: 887969 - RNA, 14 nt, Mycobacterium avium subsp. paratuberculosis
gcgacgugccggcg

SEQ ID NO: 887970 - RNA, 15 nt, Mycobacterium avium subsp. paratuberculosis
gcgacgugccggcgg

SEQ ID NO: 887971 - RNA, 16 nt, Mycobacterium avium subsp. paratuberculosis
gcgacgugccggcggc

SEQ ID NO: 887972 - RNA, 20 nt, Mycobacterium avium subsp. paratuberculosis
gcgacgugccggcggcaggu

SEQ ID NO: 887973 - RNA, 16 nt, Mycobacterium avium subsp. paratuberculosis
gcgacgucgaacgcgu

SEQ ID NO: 887974 - RNA, 15 nt, Mycobacterium avium subsp. paratuberculosis
gcgacgucgaccgcg

SEQ ID NO: 887975 - RNA, 19 nt, Mycobacterium avium subsp. paratuberculosis
gcgacgucgaccgcgacga

SEQ ID NO: 887976 - RNA, 12 nt, Mycobacterium avium subsp. paratuberculosis
gcgacgucgacg

SEQ ID NO: 887977 - RNA, 21 nt, Mycobacterium avium subsp. paratuberculosis
gcgacgucgacggcagcgcua

SEQ ID NO: 887978 - RNA, 15 nt, Mycobacterium avium subsp. paratuberculosis
gcgacguacagcgag

SEQ ID NO: 887979 - RNA, 22 nt, Mycobacterium avium subsp. paratuberculosis
gcgacguacagcgagccgucga

SEQ ID NO: 887980 - RNA, 24 nt, Mycobacterium avium subsp. paratuberculosis
gcgacgucaggucgaccggcucgc

SEQ ID NO: 887981 - RNA, 17 nt, Mycobacterium avium subsp. paratuberculosis
gcgacguccaucgggac

SEQ ID NO: 887982 - RNA, 22 nt, Mycobacterium avium subsp. paratuberculosis
gcgacguccaucgggaccgcgg

SEQ ID NO: 887983 - RNA, 14 nt, Mycobacterium avium subsp. paratuberculosis
gcgacgucggagau

SEQ ID NO: 887984 - RNA, 19 nt, Mycobacterium avium subsp. paratuberculosis
gcgacgucggggucgucgc

SEQ ID NO: 887985 - RNA, 23 nt, Mycobacterium avium subsp. paratuberculosis
gcgacgucgguguagucggcgau

SEQ ID NO: 887986 - RNA, 15 nt, Mycobacterium avium subsp. paratuberculosis
gcgacgucgucgccc

SEQ ID NO: 887987 - RNA, 21 nt, Mycobacterium avium subsp. paratuberculosis
gcgacgucgucgcccacccgc

SEQ ID NO: 887988 - RNA, 13 nt, Mycobacterium avium subsp. paratuberculosis
gcgacgucguggc

SEQ ID NO: 887989 - RNA, 19 nt, Mycobacterium avium subsp. paratuberculosis
gcgacgucguggcccggau

SEQ ID NO: 887990 - RNA, 14 nt, Mycobacterium avium subsp. paratuberculosis
gcgacgucgccggc

SEQ ID NO: 887991 - RNA, 15 nt, Mycobacterium avium subsp. paratuberculosis
gcgacgucgccggcc

SEQ ID NO: 887992 - RNA, 16 nt, Mycobacterium avium subsp. paratuberculosis
gcgacgucgccggccu

SEQ ID NO: 887993 - RNA, 17 nt, Mycobacterium avium subsp. paratuberculosis
gcgacgucgccggccug

SEQ ID NO: 887994 - RNA, 20 nt, Mycobacterium avium subsp. paratuberculosis
gcgacgucugcggcucggcg

SEQ ID NO: 887995 - RNA, 22 nt, Mycobacterium avium subsp. paratuberculosis
gcgacgucugcggcucggcgcu

SEQ ID NO: 887996 - RNA, 16 nt, Mycobacterium avium subsp. paratuberculosis
gcgacuccagcagcgc

SEQ ID NO: 887997 - RNA, 13 nt, Mycobacterium avium subsp. paratuberculosis
gcgacuccggcgc

SEQ ID NO: 887998 - RNA, 17 nt, Mycobacterium avium subsp. paratuberculosis
gcgacuccggcgccggu

SEQ ID NO: 887999 - RNA, 21 nt, Mycobacterium avium subsp. paratuberculosis
gcgacuccggcgccggucagc

SEQ ID NO: 888000 - RNA, 13 nt, Mycobacterium avium subsp. paratuberculosis
gcgacuccugacg

SEQ ID NO: 888001 - RNA, 22 nt, Mycobacterium avium subsp. paratuberculosis
gcgacguucgauugcaccaccg

SEQ ID NO: 888002 - RNA, 14 nt, Mycobacterium avium subsp. paratuberculosis
gcgacuccagcgcg

SEQ ID NO: 888003 - RNA, 20 nt, Mycobacterium avium subsp. paratuberculosis
gcgacuccagcgcgaucaac

SEQ ID NO: 888004 - RNA, 14 nt, Mycobacterium avium subsp. paratuberculosis
gcgacucgaccccg

SEQ ID NO: 888005 - RNA, 16 nt, Mycobacterium avium subsp. paratuberculosis
gcgacucgaccccgcc

SEQ ID NO: 888006 - RNA, 19 nt, Mycobacterium avium subsp. paratuberculosis
gcgacucgaccccgcccag

SEQ ID NO: 888007 - RNA, 18 nt, Mycobacterium avium subsp. paratuberculosis
gcgagaccucccggcgcc

SEQ ID NO: 888008 - RNA, 19 nt, Mycobacterium avium subsp. paratuberculosis
gcgagaccucccggcgcca

SEQ ID NO: 888009 - RNA, 14 nt, Mycobacterium avium subsp. paratuberculosis
gcgacucggccagg

SEQ ID NO: 888010 - RNA, 19 nt, Mycobacterium avium subsp. paratuberculosis
gcgagaagucgccgacgcc

SEQ ID NO: 888011 - RNA, 13 nt, Mycobacterium avium subsp. paratuberculosis
gcgagaccggcac

SEQ ID NO: 888012 - RNA, 14 nt, Mycobacterium avium subsp. paratuberculosis
gcgagaccggcacg

SEQ ID NO: 888013 - RNA, 15 nt, Mycobacterium avium subsp. paratuberculosis
gcgagaccgucggug

SEQ ID NO: 888014 - RNA, 15 nt, Mycobacterium avium subsp. paratuberculosis
gcgagaucagcgcca

SEQ ID NO: 888015 - RNA, 18 nt, Mycobacterium avium subsp. paratuberculosis
gcgagaucagcgccaugc

SEQ ID NO: 888016 - RNA, 23 nt, Mycobacterium avium subsp. paratuberculosis
gcgagaguaucgccacgccgacc

SEQ ID NO: 888017 - RNA, 24 nt, Mycobacterium avium subsp. paratuberculosis
gcgagaguaucgccacgccgacca

SEQ ID NO: 888018 - RNA, 22 nt, Mycobacterium avium subsp. paratuberculosis
gcgagagugcaacuagcgacgg

SEQ ID NO: 888019 - RNA, 17 nt, Mycobacterium avium subsp. paratuberculosis
gcgagaucaacaccgcg

SEQ ID NO: 888020 - RNA, 18 nt, Mycobacterium avium subsp. paratuberculosis
gcgagaugaucagccgcc

SEQ ID NO: 888021 - RNA, 19 nt, Mycobacterium avium subsp. paratuberculosis
gcgagaugaucagccgccc

SEQ ID NO: 888022 - RNA, 21 nt, Mycobacterium avium subsp. paratuberculosis
gcgagaugaucagccgcccga

SEQ ID NO: 888023 - RNA, 20 nt, Mycobacterium avium subsp. paratuberculosis
gcgagaucccgguucccggc

SEQ ID NO: 888024 - RNA, 19 nt, Mycobacterium avium subsp. paratuberculosis
gcgagauuggccucggcgc

SEQ ID NO: 888025 - RNA, 20 nt, Mycobacterium avium subsp. paratuberculosis
gcgagauuggccucggcgcg

SEQ ID NO: 888026 - RNA, 21 nt, Mycobacterium avium subsp. paratuberculosis
gcgagcacacccucaccccgc

SEQ ID NO: 888027 - RNA, 23 nt, Mycobacterium avium subsp. paratuberculosis
gcgagcacacccucaccccgccc

SEQ ID NO: 888028 - RNA, 21 nt, Mycobacterium avium subsp. paratuberculosis
gcgagcacaggaacgcgacgg

SEQ ID NO: 888029 - RNA, 22 nt, Mycobacterium avium subsp. paratuberculosis
gcgaggggguggguccggucag

SEQ ID NO: 888030 - RNA, 18 nt, Mycobacterium avium subsp. paratuberculosis
gcgagguaauggugggcg

SEQ ID NO: 888031 - RNA, 19 nt, Mycobacterium avium subsp. paratuberculosis
gcgagguaauggugggcgu

SEQ ID NO: 888032 - RNA, 14 nt, Mycobacterium avium subsp. paratuberculosis
gcgagguagaccgc

SEQ ID NO: 888033 - RNA, 18 nt, Mycobacterium avium subsp. paratuberculosis
gcgaggcggucggcggag

SEQ ID NO: 888034 - RNA, 20 nt, Mycobacterium avium subsp. paratuberculosis
gcgaggcggguaggcgucgc

SEQ ID NO: 888035 - RNA, 22 nt, Mycobacterium avium subsp. paratuberculosis
gcgaggcggguaggcgucgcgc

SEQ ID NO: 888036 - RNA, 12 nt, Mycobacterium avium subsp. paratuberculosis
gcgaggcgggca

SEQ ID NO: 888037 - RNA, 12 nt, Mycobacterium avium subsp. paratuberculosis
gcgaggcgaugg

SEQ ID NO: 888038 - RNA, 19 nt, Mycobacterium avium subsp. paratuberculosis
gcgaggcgcgaaagcgcga

SEQ ID NO: 888039 - RNA, 20 nt, Mycobacterium avium subsp. paratuberculosis
gcgaggcgcgcagguagccg

SEQ ID NO: 888040 - RNA, 14 nt, Mycobacterium avium subsp. paratuberculosis
gcgaggccucgccg

SEQ ID NO: 888041 - RNA, 18 nt, Mycobacterium avium subsp. paratuberculosis
gcgaggccucgccgcugg

SEQ ID NO: 888042 - RNA, 14 nt, Mycobacterium avium subsp. paratuberculosis
gcgagcgguuggcg

SEQ ID NO: 888043 - RNA, 18 nt, Mycobacterium avium subsp. paratuberculosis
gcgagcgucgccgcgugg

SEQ ID NO: 888044 - RNA, 16 nt, Mycobacterium avium subsp. paratuberculosis
gcgagcucaggccggc

SEQ ID NO: 888045 - RNA, 18 nt, Mycobacterium avium subsp. paratuberculosis
gcgagcucaggccggccu

SEQ ID NO: 888046 - RNA, 14 nt, Mycobacterium avium subsp. paratuberculosis
gcgagcucgcggcc

SEQ ID NO: 888047 - RNA, 20 nt, Mycobacterium avium subsp. paratuberculosis
gcgagcucguucucggcgaa

SEQ ID NO: 888048 - RNA, 14 nt, Mycobacterium avium subsp. paratuberculosis
gcgagcugaccggc

SEQ ID NO: 888049 - RNA, 15 nt, Mycobacterium avium subsp. paratuberculosis
gcgagcugaccggcc

SEQ ID NO: 888050 - RNA, 16 nt, Mycobacterium avium subsp. paratuberculosis
gcgagcugaccggcca

SEQ ID NO: 888051 - RNA, 17 nt, Mycobacterium avium subsp. paratuberculosis
gcgagcugaccggccac

SEQ ID NO: 888052 - RNA, 18 nt, Mycobacterium avium subsp. paratuberculosis
gcgagcugaccggccacc

SEQ ID NO: 888053 - RNA, 15 nt, Mycobacterium avium subsp. paratuberculosis
gcgagcugaucggcg

SEQ ID NO: 888054 - RNA, 21 nt, Mycobacterium avium subsp. paratuberculosis
gcgagcugccccuucgcgaca

SEQ ID NO: 888055 - RNA, 12 nt, Mycobacterium avium subsp. paratuberculosis
gcgagcugccgg

SEQ ID NO: 888056 - RNA, 13 nt, Mycobacterium avium subsp. paratuberculosis
gcgagcugccggc

SEQ ID NO: 888057 - RNA, 20 nt, Mycobacterium avium subsp. paratuberculosis
gcgaggauuucgcucagccg

SEQ ID NO: 888058 - RNA, 22 nt, Mycobacterium avium subsp. paratuberculosis
gcgagcgggugaaucgacaccg

SEQ ID NO: 888059 - RNA, 21 nt, Mycobacterium avium subsp. paratuberculosis
gcgagcgcguucuccaccgcg

SEQ ID NO: 888060 - RNA, 14 nt, Mycobacterium avium subsp. paratuberculosis
gcgagcgcuaccgc

SEQ ID NO: 888061 - RNA, 16 nt, Mycobacterium avium subsp. paratuberculosis
gcgagcgcuaccgcgc

SEQ ID NO: 888062 - RNA, 18 nt, Mycobacterium avium subsp. paratuberculosis
gcgagcgcuucgggagca

SEQ ID NO: 888063 - RNA, 16 nt, Mycobacterium avium subsp. paratuberculosis
gcgagcggcaccuugg

SEQ ID NO: 888064 - RNA, 22 nt, Mycobacterium avium subsp. paratuberculosis
gcgagcggcaccuuggugagca

SEQ ID NO: 888065 - RNA, 15 nt, Mycobacterium avium subsp. paratuberculosis
gcgagcaccgugccg

SEQ ID NO: 888066 - RNA, 19 nt, Mycobacterium avium subsp. paratuberculosis
gcgagcaccgugccgucgg

SEQ ID NO: 888067 - RNA, 22 nt, Mycobacterium avium subsp. paratuberculosis
gcgagcaccgugccgucggcgu

SEQ ID NO: 888068 - RNA, 15 nt, Mycobacterium avium subsp. paratuberculosis
gcgagcacgacgucg

SEQ ID NO: 888069 - RNA, 16 nt, Mycobacterium avium subsp. paratuberculosis
gcgagcacgccgccgg

SEQ ID NO: 888070 - RNA, 13 nt, Mycobacterium avium subsp. paratuberculosis
gcgagcaccgcga

SEQ ID NO: 888071 - RNA, 19 nt, Mycobacterium avium subsp. paratuberculosis
gcgagcaccgcgaucgccg

SEQ ID NO: 888072 - RNA, 20 nt, Mycobacterium avium subsp. paratuberculosis
gcgauugguggcccggucgu

SEQ ID NO: 888073 - RNA, 16 nt, Mycobacterium avium subsp. paratuberculosis
gcgauuucgucggcgg

SEQ ID NO: 888074 - RNA, 14 nt, Mycobacterium avium subsp. paratuberculosis
gcgauugcacaccg

SEQ ID NO: 888075 - RNA, 14 nt, Mycobacterium avium subsp. paratuberculosis
gcgauugcggccgc

SEQ ID NO: 888076 - RNA, 20 nt, Mycobacterium avium subsp. paratuberculosis
gcgauugcggccgccggcca

SEQ ID NO: 888077 - RNA, 19 nt, Mycobacterium avium subsp. paratuberculosis
gcgauguggguggucagcg

SEQ ID NO: 888078 - RNA, 22 nt, Mycobacterium avium subsp. paratuberculosis
gcgauguggguggucagcgcgg

SEQ ID NO: 888079 - RNA, 16 nt, Mycobacterium avium subsp. paratuberculosis
gcgauuaggucggugg

SEQ ID NO: 888080 - RNA, 19 nt, Mycobacterium avium subsp. paratuberculosis
gcgauucccggaugcugcg

SEQ ID NO: 888081 - RNA, 19 nt, Mycobacterium avium subsp. paratuberculosis
gcgauucgguaccagggca

SEQ ID NO: 888082 - RNA, 15 nt, Mycobacterium avium subsp. paratuberculosis
gcgauucgucgucgu

SEQ ID NO: 888083 - RNA, 20 nt, Mycobacterium avium subsp. paratuberculosis
gcgauucgucgucguuggcc

SEQ ID NO: 888084 - RNA, 16 nt, Mycobacterium avium subsp. paratuberculosis
gcgaugggcgcgauca

SEQ ID NO: 888085 - RNA, 15 nt, Mycobacterium avium subsp. paratuberculosis
gcgaugggugaucgc

SEQ ID NO: 888086 - RNA, 21 nt, Mycobacterium avium subsp. paratuberculosis
gcgaugggugaucgcggcccg

SEQ ID NO: 888087 - RNA, 20 nt, Mycobacterium avium subsp. paratuberculosis
gcgauggugaugugcggcgc

SEQ ID NO: 888088 - RNA, 22 nt, Mycobacterium avium subsp. paratuberculosis
gcgauggugccgaagcgccgca

SEQ ID NO: 888089 - RNA, 16 nt, Mycobacterium avium subsp. paratuberculosis
gcgauggugccgccgg

SEQ ID NO: 888090 - RNA, 16 nt, Mycobacterium avium subsp. paratuberculosis
gcgauggugccggcca

SEQ ID NO: 888091 - RNA, 21 nt, Mycobacterium avium subsp. paratuberculosis
gcgaugugccacuucgacggc

SEQ ID NO: 888092 - RNA, 13 nt, Mycobacterium avium subsp. paratuberculosis
gcgaugucggugc

SEQ ID NO: 888093 - RNA, 19 nt, Mycobacterium avium subsp. paratuberculosis
gcgauguccgacagcccgc

SEQ ID NO: 888094 - RNA, 14 nt, Mycobacterium avium subsp. paratuberculosis
gcgaugucgacgga

SEQ ID NO: 888095 - RNA, 15 nt, Mycobacterium avium subsp. paratuberculosis
gcgaugucgacgugg

SEQ ID NO: 888096 - RNA, 15 nt, Mycobacterium avium subsp. paratuberculosis
gcgauguaggugcgc

SEQ ID NO: 888097 - RNA, 18 nt, Mycobacterium avium subsp. paratuberculosis
gcgauggugcugcccggc

SEQ ID NO: 888098 - RNA, 12 nt, Mycobacterium avium subsp. paratuberculosis
gcgaugguggcg

SEQ ID NO: 888099 - RNA, 13 nt, Mycobacterium avium subsp. paratuberculosis
gcgaugguggcgu

SEQ ID NO: 888100 - RNA, 19 nt, Mycobacterium avium subsp. paratuberculosis
gcgauggugggcagccggc

SEQ ID NO: 888101 - RNA, 14 nt, Mycobacterium avium subsp. paratuberculosis
gcgaugguggucgc

SEQ ID NO: 888102 - RNA, 17 nt, Mycobacterium avium subsp. paratuberculosis
gcgaugguggucgccgu

SEQ ID NO: 888103 - RNA, 20 nt, Mycobacterium avium subsp. paratuberculosis
gcgauguagcggacgggccg

SEQ ID NO: 888104 - RNA, 19 nt, Mycobacterium avium subsp. paratuberculosis
gcgauggaagcgcccgcgc

SEQ ID NO: 888105 - RNA, 15 nt, Mycobacterium avium subsp. paratuberculosis
gcgauggacguccag

SEQ ID NO: 888106 - RNA, 20 nt, Mycobacterium avium subsp. paratuberculosis
gcgauggacguccagcggcc

SEQ ID NO: 888107 - RNA, 15 nt, Mycobacterium avium subsp. paratuberculosis
gcgauggcccgcugc

SEQ ID NO: 888108 - RNA, 17 nt, Mycobacterium avium subsp. paratuberculosis
gcgauggcaacgccggu

SEQ ID NO: 888109 - RNA, 12 nt, Mycobacterium avium subsp. paratuberculosis
gcgauggcggcg

SEQ ID NO: 888110 - RNA, 23 nt, Mycobacterium avium subsp. paratuberculosis
gcgauggccuccgacccguccag

SEQ ID NO: 888111 - RNA, 16 nt, Mycobacterium avium subsp. paratuberculosis
gcgauggccugcucgc

SEQ ID NO: 888112 - RNA, 17 nt, Mycobacterium avium subsp. paratuberculosis
gcgauggcggcgucgag

SEQ ID NO: 888113 - RNA, 16 nt, Mycobacterium avium subsp. paratuberculosis
gcgauggcgggccgcu

SEQ ID NO: 888114 - RNA, 15 nt, Mycobacterium avium subsp. paratuberculosis
gcgauggcggguugg

SEQ ID NO: 888115 - RNA, 21 nt, Mycobacterium avium subsp. paratuberculosis
gcgauggcggguuggugucga

SEQ ID NO: 888116 - RNA, 12 nt, Mycobacterium avium subsp. paratuberculosis
gcgauggcgucg

SEQ ID NO: 888117 - RNA, 14 nt, Mycobacterium avium subsp. paratuberculosis
gcgauggcgucggc

SEQ ID NO: 888118 - RNA, 16 nt, Mycobacterium avium subsp. paratuberculosis
gcgauggcgucggcca

SEQ ID NO: 888119 - RNA, 17 nt, Mycobacterium avium subsp. paratuberculosis
gcgauggcgucggccag

SEQ ID NO: 888120 - RNA, 18 nt, Mycobacterium avium subsp. paratuberculosis
gcgauggcgugccggcgc

SEQ ID NO: 888121 - RNA, 16 nt, Mycobacterium avium subsp. paratuberculosis
gcgauggcgcggccgg

SEQ ID NO: 888122 - RNA, 16 nt, Mycobacterium avium subsp. paratuberculosis
gcgauggcgcuggccg

SEQ ID NO: 888123 - RNA, 19 nt, Mycobacterium avium subsp. paratuberculosis
gcgcacaacgaggcccgga

SEQ ID NO: 888124 - RNA, 15 nt, Mycobacterium avium subsp. paratuberculosis
gcgcacacggccucg

SEQ ID NO: 888125 - RNA, 22 nt, Mycobacterium avium subsp. paratuberculosis
gcgcacacggccucgcccagcg

SEQ ID NO: 888126 - RNA, 22 nt, Mycobacterium avium subsp. paratuberculosis
gcgcacagcuaggucguggcgc

SEQ ID NO: 888127 - RNA, 18 nt, Mycobacterium avium subsp. paratuberculosis
gcgcacaggaacgcgucg

SEQ ID NO: 888128 - RNA, 13 nt, Mycobacterium avium subsp. paratuberculosis
gcgcacagcgcca

SEQ ID NO: 888129 - RNA, 22 nt, Mycobacterium avium subsp. paratuberculosis
gcgcacaauucggucagcgcgu

SEQ ID NO: 888130 - RNA, 17 nt, Mycobacterium avium subsp. paratuberculosis
gcgcacacaccguaccg

SEQ ID NO: 888131 - RNA, 21 nt, Mycobacterium avium subsp. paratuberculosis
gcgcacacaccguaccgagga

SEQ ID NO: 888132 - RNA, 20 nt, Mycobacterium avium subsp. paratuberculosis
gcgcacacagcagcagcacc

SEQ ID NO: 888133 - RNA, 21 nt, Mycobacterium avium subsp. paratuberculosis
gcgcacacagcagcagcacca

SEQ ID NO: 888134 - RNA, 13 nt, Mycobacterium avium subsp. paratuberculosis
gcgcacaacagcc

SEQ ID NO: 888135 - RNA, 23 nt, Mycobacterium avium subsp. paratuberculosis
gcgcaccaccagcucgucgccga

SEQ ID NO: 888136 - RNA, 22 nt, Mycobacterium avium subsp. paratuberculosis
gcgcaccaaccggccccgagcg

SEQ ID NO: 888137 - RNA, 16 nt, Mycobacterium avium subsp. paratuberculosis
gcgcaccaccucgauc

SEQ ID NO: 888138 - RNA, 17 nt, Mycobacterium avium subsp. paratuberculosis
gcgcaccaccucggcga

SEQ ID NO: 888139 - RNA, 18 nt, Mycobacterium avium subsp. paratuberculosis
gcgcaccaccucggcgau

SEQ ID NO: 888140 - RNA, 17 nt, Mycobacterium avium subsp. paratuberculosis
gcgcacaucguggcgac

SEQ ID NO: 888141 - RNA, 19 nt, Mycobacterium avium subsp. paratuberculosis
gcgcacaucguggcgacga

SEQ ID NO: 888142 - RNA, 13 nt, Mycobacterium avium subsp. paratuberculosis
gcgcacaucacgg

SEQ ID NO: 888143 - RNA, 19 nt, Mycobacterium avium subsp. paratuberculosis
gcgcacaucacgguggccg

SEQ ID NO: 888144 - RNA, 21 nt, Mycobacterium avium subsp. paratuberculosis
gcgcacaucacgguggccgcc

SEQ ID NO: 888145 - RNA, 22 nt, Mycobacterium avium subsp. paratuberculosis
gcgcacaucacgguggccgcca

SEQ ID NO: 888146 - RNA, 14 nt, Mycobacterium avium subsp. paratuberculosis
gcgcacagcgccac

SEQ ID NO: 888147 - RNA, 20 nt, Mycobacterium avium subsp. paratuberculosis
gcgcaaucaaaaaccccgcu

SEQ ID NO: 888148 - RNA, 17 nt, Mycobacterium avium subsp. paratuberculosis
gcgcaauccugcccggu

SEQ ID NO: 888149 - RNA, 21 nt, Mycobacterium avium subsp. paratuberculosis
gcgcaaucggggccgacccgc

SEQ ID NO: 888150 - RNA, 22 nt, Mycobacterium avium subsp. paratuberculosis
gcgcaaugccaucgucacuucg

SEQ ID NO: 888151 - RNA, 19 nt, Mycobacterium avium subsp. paratuberculosis
gcgcaauacccgaccagca

SEQ ID NO: 888152 - RNA, 20 nt, Mycobacterium avium subsp. paratuberculosis
gcgcaauacccgaccagcac

SEQ ID NO: 888153 - RNA, 15 nt, Mycobacterium avium subsp. paratuberculosis
gcgcaaccgggccgc

SEQ ID NO: 888154 - RNA, 15 nt, Mycobacterium avium subsp. paratuberculosis
gcgcaaccgcggcgg

SEQ ID NO: 888155 - RNA, 14 nt, Mycobacterium avium subsp. paratuberculosis
gcgcaacaccggau

SEQ ID NO: 888156 - RNA, 21 nt, Mycobacterium avium subsp. paratuberculosis
gcgcaacaccggauuucgcca

SEQ ID NO: 888157 - RNA, 17 nt, Mycobacterium avium subsp. paratuberculosis
gcgcaacagcaccucgu

SEQ ID NO: 888158 - RNA, 19 nt, Mycobacterium avium subsp. paratuberculosis
gcgcaacagcgucucgacg

SEQ ID NO: 888159 - RNA, 22 nt, Mycobacterium avium subsp. paratuberculosis
gcgcaacagcgugcacacccgc

SEQ ID NO: 888160 - RNA, 19 nt, Mycobacterium avium subsp. paratuberculosis
gcgcaacaccucggcgacg

SEQ ID NO: 888161 - RNA, 16 nt, Mycobacterium avium subsp. paratuberculosis
gcgcaagcaccggcug

SEQ ID NO: 888162 - RNA, 21 nt, Mycobacterium avium subsp. paratuberculosis
gcgcaagcaccggcuggccga

SEQ ID NO: 888163 - RNA, 19 nt, Mycobacterium avium subsp. paratuberculosis
gcgcaacguguacucggcg

SEQ ID NO: 888164 - RNA, 23 nt, Mycobacterium avium subsp. paratuberculosis
gcgcaacgcuuucgggucgacga

SEQ ID NO: 888165 - RNA, 17 nt, Mycobacterium avium subsp. paratuberculosis
gcgcaacugggugguca

SEQ ID NO: 888166 - RNA, 15 nt, Mycobacterium avium subsp. paratuberculosis
gcgcaacggcgucga

SEQ ID NO: 888167 - RNA, 19 nt, Mycobacterium avium subsp. paratuberculosis
gcgcaacucguccagcguc

SEQ ID NO: 888168 - RNA, 20 nt, Mycobacterium avium subsp. paratuberculosis
gcgcaacucguccagcgucg

SEQ ID NO: 888169 - RNA, 12 nt, Mycobacterium avium subsp. paratuberculosis
gcgaucgccgac

SEQ ID NO: 888170 - RNA, 24 nt, Mycobacterium avium subsp. paratuberculosis
gcgauccgcaggccgucgccgguc

SEQ ID NO: 888171 - RNA, 13 nt, Mycobacterium avium subsp. paratuberculosis
gcgaucgccagcg

SEQ ID NO: 888172 - RNA, 15 nt, Mycobacterium avium subsp. paratuberculosis
gcgaucgccagcgcg

SEQ ID NO: 888173 - RNA, 22 nt, Mycobacterium avium subsp. paratuberculosis
gcgaucgccagcgcggugucga

SEQ ID NO: 888174 - RNA, 21 nt, Mycobacterium avium subsp. paratuberculosis
gcgaucgccgggauggugagc

SEQ ID NO: 888175 - RNA, 13 nt, Mycobacterium avium subsp. paratuberculosis
gcgaucgccgggg

SEQ ID NO: 888176 - RNA, 15 nt, Mycobacterium avium subsp. paratuberculosis
gcgaucgccggugcg

SEQ ID NO: 888177 - RNA, 17 nt, Mycobacterium avium subsp. paratuberculosis
gcgaucgccggugcggc

SEQ ID NO: 888178 - RNA, 21 nt, Mycobacterium avium subsp. paratuberculosis
gcgaucgccggugcggccgcg

SEQ ID NO: 888179 - RNA, 13 nt, Mycobacterium avium subsp. paratuberculosis
gcgaucgccgacg

SEQ ID NO: 888180 - RNA, 14 nt, Mycobacterium avium subsp. paratuberculosis
gcgaucgccgacgu

SEQ ID NO: 888181 - RNA, 16 nt, Mycobacterium avium subsp. paratuberculosis
gcgaucgccgacgucg

SEQ ID NO: 888182 - RNA, 17 nt, Mycobacterium avium subsp. paratuberculosis
gcgaucgccgauccggc

SEQ ID NO: 888183 - RNA, 20 nt, Mycobacterium avium subsp. paratuberculosis
gcgaucgccgauccggcgcc

SEQ ID NO: 888184 - RNA, 15 nt, Mycobacterium avium subsp. paratuberculosis
gcgaucgccaacgcg

SEQ ID NO: 888185 - RNA, 13 nt, Mycobacterium avium subsp. paratuberculosis
gcgaucgccguga

SEQ ID NO: 888186 - RNA, 16 nt, Mycobacterium avium subsp. paratuberculosis
gcgaucgccucggccu

SEQ ID NO: 888187 - RNA, 14 nt, Mycobacterium avium subsp. paratuberculosis
gcgaucgcggccac

SEQ ID NO: 888188 - RNA, 16 nt, Mycobacterium avium subsp. paratuberculosis
gcgaucgcgagcaggg

SEQ ID NO: 888189 - RNA, 16 nt, Mycobacterium avium subsp. paratuberculosis
gcgaucggccgcugcc

SEQ ID NO: 888190 - RNA, 17 nt, Mycobacterium avium subsp. paratuberculosis
gcgaucggccgcugcgg

SEQ ID NO: 888191 - RNA, 15 nt, Mycobacterium avium subsp. paratuberculosis
gcgaucggcgccacg

SEQ ID NO: 888192 - RNA, 16 nt, Mycobacterium avium subsp. paratuberculosis
gcgaucggcgccacga

SEQ ID NO: 888193 - RNA, 22 nt, Mycobacterium avium subsp. paratuberculosis
gcgaucggcgccacgaccagcg

SEQ ID NO: 888194 - RNA, 17 nt, Mycobacterium avium subsp. paratuberculosis
gcgaucggcgcggcgaa

SEQ ID NO: 888195 - RNA, 16 nt, Mycobacterium avium subsp. paratuberculosis
gcgaucggcgguccgc

SEQ ID NO: 888196 - RNA, 17 nt, Mycobacterium avium subsp. paratuberculosis
gcgaucggcgguccgcc

SEQ ID NO: 888197 - RNA, 24 nt, Mycobacterium avium subsp. paratuberculosis
gcgaucggcgguccgccgcagcgg

SEQ ID NO: 888198 - RNA, 16 nt, Mycobacterium avium subsp. paratuberculosis
gcgaucgacagcucca

SEQ ID NO: 888199 - RNA, 16 nt, Mycobacterium avium subsp. paratuberculosis
gcgaucgacgucacca

SEQ ID NO: 888200 - RNA, 21 nt, Mycobacterium avium subsp. paratuberculosis
gcgaucgaggaucucccgggu

SEQ ID NO: 888201 - RNA, 23 nt, Mycobacterium avium subsp. paratuberculosis
gcgaucgaggugauguuggccgc

SEQ ID NO: 888202 - RNA, 22 nt, Mycobacterium avium subsp. paratuberculosis
gcgaucgaucccuuggcggcgg

SEQ ID NO: 888203 - RNA, 16 nt, Mycobacterium avium subsp. paratuberculosis
gcgaucgaugcccagc

SEQ ID NO: 888204 - RNA, 18 nt, Mycobacterium avium subsp. paratuberculosis
gcgaucgaugcccagcgc

SEQ ID NO: 888205 - RNA, 19 nt, Mycobacterium avium subsp. paratuberculosis
gcgaucgaugcccagcgcg

SEQ ID NO: 888206 - RNA, 20 nt, Mycobacterium avium subsp. paratuberculosis
gcgaucgaugcccagcgcgc

SEQ ID NO: 888207 - RNA, 22 nt, Mycobacterium avium subsp. paratuberculosis
gcgaucgaugcccagcgcgcgg

SEQ ID NO: 888208 - RNA, 13 nt, Mycobacterium avium subsp. paratuberculosis
gcgauccgggcau

SEQ ID NO: 888209 - RNA, 14 nt, Mycobacterium avium subsp. paratuberculosis
gcgauccgggcgcc

SEQ ID NO: 888210 - RNA, 19 nt, Mycobacterium avium subsp. paratuberculosis
gcgauccgggcgccggccg

SEQ ID NO: 888211 - RNA, 22 nt, Mycobacterium avium subsp. paratuberculosis
gcgauccgggcgccggccggcg

SEQ ID NO: 888212 - RNA, 12 nt, Mycobacterium avium subsp. paratuberculosis
gcgauccggccg

SEQ ID NO: 888213 - RNA, 14 nt, Mycobacterium avium subsp. paratuberculosis
gcgauccgcgcggc

SEQ ID NO: 888214 - RNA, 17 nt, Mycobacterium avium subsp. paratuberculosis
gcgauccgcgcgucggg

SEQ ID NO: 888215 - RNA, 20 nt, Mycobacterium avium subsp. paratuberculosis
gcgauccagguguaccagug

SEQ ID NO: 888216 - RNA, 15 nt, Mycobacterium avium subsp. paratuberculosis
gcgaucagguccgga

SEQ ID NO: 888217 - RNA, 18 nt, Mycobacterium avium subsp. paratuberculosis
gcgaucaguauggagaaa

SEQ ID NO: 888218 - RNA, 22 nt, Mycobacterium avium subsp. paratuberculosis
gcgaucagggcccacagcagcc

SEQ ID NO: 888219 - RNA, 23 nt, Mycobacterium avium subsp. paratuberculosis
gcgaucagggcccacagcagccg

SEQ ID NO: 888220 - RNA, 16 nt, Mycobacterium avium subsp. paratuberculosis
gcgaucagggccgcgg

SEQ ID NO: 888221 - RNA, 18 nt, Mycobacterium avium subsp. paratuberculosis
gcgaucagggccgcggcc

SEQ ID NO: 888222 - RNA, 20 nt, Mycobacterium avium subsp. paratuberculosis
gcgaucagggccgcggccgc

SEQ ID NO: 888223 - RNA, 15 nt, Mycobacterium avium subsp. paratuberculosis
gcgaucagggcggcg

SEQ ID NO: 888224 - RNA, 21 nt, Mycobacterium avium subsp. paratuberculosis
gcgaucagggcggcgccgcgg

SEQ ID NO: 888225 - RNA, 22 nt, Mycobacterium avium subsp. paratuberculosis
gcgaucagggcggcgccgcggc

SEQ ID NO: 888226 - RNA, 21 nt, Mycobacterium avium subsp. paratuberculosis
gcgauccacuccgaggucagc

SEQ ID NO: 888227 - RNA, 18 nt, Mycobacterium avium subsp. paratuberculosis
gcgauccagcgcuggccg

SEQ ID NO: 888228 - RNA, 21 nt, Mycobacterium avium subsp. paratuberculosis
gcgaucagcgcgcacagcgcc

SEQ ID NO: 888229 - RNA, 15 nt, Mycobacterium avium subsp. paratuberculosis
gcgaucagaugcucg

SEQ ID NO: 888230 - RNA, 19 nt, Mycobacterium avium subsp. paratuberculosis
gcgaucagaugcucgucgg

SEQ ID NO: 888231 - RNA, 14 nt, Mycobacterium avium subsp. paratuberculosis
gcgaucagccccag

SEQ ID NO: 888232 - RNA, 22 nt, Mycobacterium avium subsp. paratuberculosis
gcgaucagccccagggugcgcc

SEQ ID NO: 888233 - RNA, 19 nt, Mycobacterium avium subsp. paratuberculosis
gcgaucagcccgcccacca

SEQ ID NO: 888234 - RNA, 15 nt, Mycobacterium avium subsp. paratuberculosis
gcgaucagcccggcc

SEQ ID NO: 888235 - RNA, 17 nt, Mycobacterium avium subsp. paratuberculosis
gcgaucagcccggcccg

SEQ ID NO: 888236 - RNA, 18 nt, Mycobacterium avium subsp. paratuberculosis
gcgaucagcccggcccgc

SEQ ID NO: 888237 - RNA, 23 nt, Mycobacterium avium subsp. paratuberculosis
gcgaucagcucguggcgggcccg

SEQ ID NO: 888238 - RNA, 13 nt, Mycobacterium avium subsp. paratuberculosis
gcgaucagcugcc

SEQ ID NO: 888239 - RNA, 16 nt, Mycobacterium avium subsp. paratuberculosis
gcgaucagcugcucgu

SEQ ID NO: 888240 - RNA, 19 nt, Mycobacterium avium subsp. paratuberculosis
gcgaucaggccggccacca

SEQ ID NO: 888241 - RNA, 22 nt, Mycobacterium avium subsp. paratuberculosis
gcgaucaggccggccaccaggu

SEQ ID NO: 888242 - RNA, 19 nt, Mycobacterium avium subsp. paratuberculosis
gcgaucaccuugcggccgg

SEQ ID NO: 888243 - RNA, 21 nt, Mycobacterium avium subsp. paratuberculosis
gcgaucaccuugcggccggcg

SEQ ID NO: 888244 - RNA, 23 nt, Mycobacterium avium subsp. paratuberculosis
gcgaucaccuugcggccggcggc

SEQ ID NO: 888245 - RNA, 24 nt, Mycobacterium avium subsp. paratuberculosis
gcgaucaccuugcggccggcggcg

SEQ ID NO: 888246 - RNA, 12 nt, Mycobacterium avium subsp. paratuberculosis
gcgaggugcgcc

SEQ ID NO: 888247 - RNA, 18 nt, Mycobacterium avium subsp. paratuberculosis
gcgaucagcagcacccgg

SEQ ID NO: 888248 - RNA, 20 nt, Mycobacterium avium subsp. paratuberculosis
gcgaucagcagcacccgggc

SEQ ID NO: 888249 - RNA, 23 nt, Mycobacterium avium subsp. paratuberculosis
gcgaucagcagcacccgggccug

SEQ ID NO: 888250 - RNA, 13 nt, Mycobacterium avium subsp. paratuberculosis
gcgaucacguucu

SEQ ID NO: 888251 - RNA, 18 nt, Mycobacterium avium subsp. paratuberculosis
gcgaucacguucucggcg

SEQ ID NO: 888252 - RNA, 14 nt, Mycobacterium avium subsp. paratuberculosis
gcgaucaccgccgc

SEQ ID NO: 888253 - RNA, 16 nt, Mycobacterium avium subsp. paratuberculosis
gcgaucaccgccgcgg

SEQ ID NO: 888254 - RNA, 22 nt, Mycobacterium avium subsp. paratuberculosis
gcgaucaccgccgcggcgacca

SEQ ID NO: 888255 - RNA, 12 nt, Mycobacterium avium subsp. paratuberculosis
gcgaucaccgcg

SEQ ID NO: 888256 - RNA, 16 nt, Mycobacterium avium subsp. paratuberculosis
gcgaucaccgcggcca

SEQ ID NO: 888257 - RNA, 17 nt, Mycobacterium avium subsp. paratuberculosis
gcgaucaccgcggccac

SEQ ID NO: 888258 - RNA, 22 nt, Mycobacterium avium subsp. paratuberculosis
gcgaucaccgcggccaccuggg

SEQ ID NO: 888259 - RNA, 15 nt, Mycobacterium avium subsp. paratuberculosis
gcgaucaccgcggcg

SEQ ID NO: 888260 - RNA, 21 nt, Mycobacterium avium subsp. paratuberculosis
gcgaucaccgcguucucggcg

SEQ ID NO: 888261 - RNA, 19 nt, Mycobacterium avium subsp. paratuberculosis
gcgaggucaccaacgcgaa

SEQ ID NO: 888262 - RNA, 13 nt, Mycobacterium avium subsp. paratuberculosis
gcgaggucgucga

SEQ ID NO: 888263 - RNA, 19 nt, Mycobacterium avium subsp. paratuberculosis
gcgaggucgucgagggcca

SEQ ID NO: 888264 - RNA, 16 nt, Mycobacterium avium subsp. paratuberculosis
gcgaggucguucgaca

SEQ ID NO: 888265 - RNA, 16 nt, Mycobacterium avium subsp. paratuberculosis
gcgagguccuugcgga

SEQ ID NO: 888266 - RNA, 16 nt, Mycobacterium avium subsp. paratuberculosis
gcgaugaacacgccga

SEQ ID NO: 888267 - RNA, 16 nt, Mycobacterium avium subsp. paratuberculosis
gcgaucuuugcggccg

SEQ ID NO: 888268 - RNA, 21 nt, Mycobacterium avium subsp. paratuberculosis
gcgaucuuugcggccguggcg

SEQ ID NO: 888269 - RNA, 18 nt, Mycobacterium avium subsp. paratuberculosis
gcgaucuugccgccgcgg

SEQ ID NO: 888270 - RNA, 19 nt, Mycobacterium avium subsp. paratuberculosis
gcgaucuugccgccgcgga

SEQ ID NO: 888271 - RNA, 17 nt, Mycobacterium avium subsp. paratuberculosis
gcgaugaagccccggac

SEQ ID NO: 888272 - RNA, 24 nt, Mycobacterium avium subsp. paratuberculosis
gcgaugacgaauuccgcaccgguc

SEQ ID NO: 888273 - RNA, 15 nt, Mycobacterium avium subsp. paratuberculosis
gcgaugaccagcgcg

SEQ ID NO: 888274 - RNA, 16 nt, Mycobacterium avium subsp. paratuberculosis
gcgaugaccagcgcga

SEQ ID NO: 888275 - RNA, 18 nt, Mycobacterium avium subsp. paratuberculosis
gcgaucucuucgaugccg

SEQ ID NO: 888276 - RNA, 22 nt, Mycobacterium avium subsp. paratuberculosis
gcgaucucuucgaugccggugg

SEQ ID NO: 888277 - RNA, 23 nt, Mycobacterium avium subsp. paratuberculosis
gcgaucugcucggugucgaucga

SEQ ID NO: 888278 - RNA, 21 nt, Mycobacterium avium subsp. paratuberculosis
gcgaucuccagcggccgggcg

SEQ ID NO: 888279 - RNA, 15 nt, Mycobacterium avium subsp. paratuberculosis
gcgaucucgucgcgc

SEQ ID NO: 888280 - RNA, 14 nt, Mycobacterium avium subsp. paratuberculosis
gcgaucucgauggc

SEQ ID NO: 888281 - RNA, 22 nt, Mycobacterium avium subsp. paratuberculosis
gcgaucucgauggccucgucga

SEQ ID NO: 888282 - RNA, 22 nt, Mycobacterium avium subsp. paratuberculosis
gcgaucucgauguagagcggga

SEQ ID NO: 888283 - RNA, 19 nt, Mycobacterium avium subsp. paratuberculosis
gcgaucucgccgaaggccg

SEQ ID NO: 888284 - RNA, 19 nt, Mycobacterium avium subsp. paratuberculosis
gcgaucucggcggacucgg

SEQ ID NO: 888285 - RNA, 15 nt, Mycobacterium avium subsp. paratuberculosis
gcgaucucggcggcc

SEQ ID NO: 888286 - RNA, 17 nt, Mycobacterium avium subsp. paratuberculosis
gcgaucucggucaccga

SEQ ID NO: 888287 - RNA, 21 nt, Mycobacterium avium subsp. paratuberculosis
gcgaucucggucaccgagcgg

SEQ ID NO: 888288 - RNA, 13 nt, Mycobacterium avium subsp. paratuberculosis
gcgaucgucgccg

SEQ ID NO: 888289 - RNA, 16 nt, Mycobacterium avium subsp. paratuberculosis
gcgaucgucucgucga

SEQ ID NO: 888290 - RNA, 19 nt, Mycobacterium avium subsp. paratuberculosis
gcgaucuccuuguugacga

SEQ ID NO: 888291 - RNA, 16 nt, Mycobacterium avium subsp. paratuberculosis
gcgaucgggucaccgg

SEQ ID NO: 888292 - RNA, 18 nt, Mycobacterium avium subsp. paratuberculosis
gcgaucgggucaccggcc

SEQ ID NO: 888293 - RNA, 20 nt, Mycobacterium avium subsp. paratuberculosis
gcgaucgggucaccggccga

SEQ ID NO: 888294 - RNA, 20 nt, Mycobacterium avium subsp. paratuberculosis
gcgaucggugaacccgccgg

SEQ ID NO: 888295 - RNA, 22 nt, Mycobacterium avium subsp. paratuberculosis
gcgaucgguguccagccgcacg

SEQ ID NO: 888296 - RNA, 22 nt, Mycobacterium avium subsp. paratuberculosis
gcgaucgucaggucuucggucg

SEQ ID NO: 888297 - RNA, 19 nt, Mycobacterium avium subsp. paratuberculosis
gcgaucgucgaccaccacg

SEQ ID NO: 888298 - RNA, 20 nt, Mycobacterium avium subsp. paratuberculosis
gcgaucgucgaccaccacga

SEQ ID NO: 888299 - RNA, 21 nt, Mycobacterium avium subsp. paratuberculosis
gcgaucgucgaccaccacgac

SEQ ID NO: 888300 - RNA, 14 nt, Mycobacterium avium subsp. paratuberculosis
gcgaugcggugguc

SEQ ID NO: 888301 - RNA, 14 nt, Mycobacterium avium subsp. paratuberculosis
gcgaugcgccgucu

SEQ ID NO: 888302 - RNA, 17 nt, Mycobacterium avium subsp. paratuberculosis
gcgaugcggcccggcca

SEQ ID NO: 888303 - RNA, 18 nt, Mycobacterium avium subsp. paratuberculosis
gcgaugcggcccggccac

SEQ ID NO: 888304 - RNA, 16 nt, Mycobacterium avium subsp. paratuberculosis
gcgaugcgggcgccga

SEQ ID NO: 888305 - RNA, 17 nt, Mycobacterium avium subsp. paratuberculosis
gcgaugcgggcgccgaa

SEQ ID NO: 888306 - RNA, 19 nt, Mycobacterium avium subsp. paratuberculosis
gcgaugcgcuccagcaggc

SEQ ID NO: 888307 - RNA, 20 nt, Mycobacterium avium subsp. paratuberculosis
gcgaugccgugcugggcgga

SEQ ID NO: 888308 - RNA, 16 nt, Mycobacterium avium subsp. paratuberculosis
gcgaugccggccaggc

SEQ ID NO: 888309 - RNA, 16 nt, Mycobacterium avium subsp. paratuberculosis
gcgaugccuuccucgg

SEQ ID NO: 888310 - RNA, 19 nt, Mycobacterium avium subsp. paratuberculosis
gcgaugccuuccucggcgc

SEQ ID NO: 888311 - RNA, 13 nt, Mycobacterium avium subsp. paratuberculosis
gcgaugcgcacca

SEQ ID NO: 888312 - RNA, 16 nt, Mycobacterium avium subsp. paratuberculosis
gcgaugcgcaccauca

SEQ ID NO: 888313 - RNA, 22 nt, Mycobacterium avium subsp. paratuberculosis
gcgaugccggaaaaguucggcg

SEQ ID NO: 888314 - RNA, 23 nt, Mycobacterium avium subsp. paratuberculosis
gcgaugcccgugaucgccacggc

SEQ ID NO: 888315 - RNA, 14 nt, Mycobacterium avium subsp. paratuberculosis
gcgaugcccgccgg

SEQ ID NO: 888316 - RNA, 16 nt, Mycobacterium avium subsp. paratuberculosis
gcgaugcccgccggcc

SEQ ID NO: 888317 - RNA, 18 nt, Mycobacterium avium subsp. paratuberculosis
gcgaugauggcgucgacg

SEQ ID NO: 888318 - RNA, 19 nt, Mycobacterium avium subsp. paratuberculosis
gcgaugauggucaccgucg

SEQ ID NO: 888319 - RNA, 16 nt, Mycobacterium avium subsp. paratuberculosis
gcgaugaucgccggcg

SEQ ID NO: 888320 - RNA, 20 nt, Mycobacterium avium subsp. paratuberculosis
gcgaugaucgccggcgccgg

SEQ ID NO: 888321 - RNA, 20 nt, Mycobacterium avium subsp. paratuberculosis
gcgaugaugagcaagucggc

SEQ ID NO: 888322 - RNA, 22 nt, Mycobacterium avium subsp. paratuberculosis
gcgaugaucacacccacgaacg

SEQ ID NO: 888323 - RNA, 20 nt, Mycobacterium avium subsp. paratuberculosis
gcgaugaucaccucggugau

SEQ ID NO: 888324 - RNA, 18 nt, Mycobacterium avium subsp. paratuberculosis
gcgaugaucagcucgcgc

SEQ ID NO: 888325 - RNA, 19 nt, Mycobacterium avium subsp. paratuberculosis
gcgaugaucagcucgcgca

SEQ ID NO: 888326 - RNA, 17 nt, Mycobacterium avium subsp. paratuberculosis
gcgaugauccgcggcgc

SEQ ID NO: 888327 - RNA, 19 nt, Mycobacterium avium subsp. paratuberculosis
gcgaugauccgcggcgccg

SEQ ID NO: 888328 - RNA, 22 nt, Mycobacterium avium subsp. paratuberculosis
gcgaugauccgcggcgccgggc

SEQ ID NO: 888329 - RNA, 20 nt, Mycobacterium avium subsp. paratuberculosis
gcgaugccagcgcaccgggc

SEQ ID NO: 888330 - RNA, 19 nt, Mycobacterium avium subsp. paratuberculosis
gcgaugcccaagccggcca

SEQ ID NO: 888331 - RNA, 20 nt, Mycobacterium avium subsp. paratuberculosis
gcgaugcccaagccggccag

SEQ ID NO: 888332 - RNA, 20 nt, Mycobacterium avium subsp. paratuberculosis
gcgaugcccacagccaggug

SEQ ID NO: 888333 - RNA, 16 nt, Mycobacterium avium subsp. paratuberculosis
gcgaugcagaacagcc

SEQ ID NO: 888334 - RNA, 24 nt, Mycobacterium avium subsp. paratuberculosis
gcgaugcagaacagccgguccgac

SEQ ID NO: 888335 - RNA, 17 nt, Mycobacterium avium subsp. paratuberculosis
gcgaugcaacaccgaac

SEQ ID NO: 888336 - RNA, 18 nt, Mycobacterium avium subsp. paratuberculosis
gcgaugcaacaccgaacg

SEQ ID NO: 888337 - RNA, 19 nt, Mycobacterium avium subsp. paratuberculosis
gccuucuccagcuccucgg

SEQ ID NO: 888338 - RNA, 23 nt, Mycobacterium avium subsp. paratuberculosis
gccuucgaugcccuccagcaccg

SEQ ID NO: 888339 - RNA, 14 nt, Mycobacterium avium subsp. paratuberculosis
gccuucgccgcacg

SEQ ID NO: 888340 - RNA, 15 nt, Mycobacterium avium subsp. paratuberculosis
gccuucggcgccagc

SEQ ID NO: 888341 - RNA, 19 nt, Mycobacterium avium subsp. paratuberculosis
gccuucggcgccagcccgc

SEQ ID NO: 888342 - RNA, 13 nt, Mycobacterium avium subsp. paratuberculosis
gccuugcgguugg

SEQ ID NO: 888343 - RNA, 15 nt, Mycobacterium avium subsp. paratuberculosis
gccuugcgggccgga

SEQ ID NO: 888344 - RNA, 16 nt, Mycobacterium avium subsp. paratuberculosis
gccuucucgcgcaccg

SEQ ID NO: 888345 - RNA, 22 nt, Mycobacterium avium subsp. paratuberculosis
gccuucucgccguuuugccgcc

SEQ ID NO: 888346 - RNA, 17 nt, Mycobacterium avium subsp. paratuberculosis
gccuuggcgcgcucggu

SEQ ID NO: 888347 - RNA, 17 nt, Mycobacterium avium subsp. paratuberculosis
gccuuggccguaggucg

SEQ ID NO: 888348 - RNA, 15 nt, Mycobacterium avium subsp. paratuberculosis
gccuuggccaccacg

SEQ ID NO: 888349 - RNA, 15 nt, Mycobacterium avium subsp. paratuberculosis
gccuuggccaccgcc

SEQ ID NO: 888350 - RNA, 16 nt, Mycobacterium avium subsp. paratuberculosis
gccuuggccacgucga

SEQ ID NO: 888351 - RNA, 14 nt, Mycobacterium avium subsp. paratuberculosis
gccuuggcccgcgc

SEQ ID NO: 888352 - RNA, 22 nt, Mycobacterium avium subsp. paratuberculosis
gccuuggcccgcgcccgcucga

SEQ ID NO: 888353 - RNA, 15 nt, Mycobacterium avium subsp. paratuberculosis
gccuuggcccgcgcg

SEQ ID NO: 888354 - RNA, 16 nt, Mycobacterium avium subsp. paratuberculosis
gccuugcuggcggccu

SEQ ID NO: 888355 - RNA, 18 nt, Mycobacterium avium subsp. paratuberculosis
gccuugcugacgccgcgg

SEQ ID NO: 888356 - RNA, 23 nt, Mycobacterium avium subsp. paratuberculosis
gccuugcugacgccgcggugcag

SEQ ID NO: 888357 - RNA, 16 nt, Mycobacterium avium subsp. paratuberculosis
gccuugcugagccggc

SEQ ID NO: 888358 - RNA, 15 nt, Mycobacterium avium subsp. paratuberculosis
gccuggucggccggc

SEQ ID NO: 888359 - RNA, 20 nt, Mycobacterium avium subsp. paratuberculosis
gccugguacagcaccgccgc

SEQ ID NO: 888360 - RNA, 15 nt, Mycobacterium avium subsp. paratuberculosis
gccugguaggccgcc

SEQ ID NO: 888361 - RNA, 19 nt, Mycobacterium avium subsp. paratuberculosis
gccugggugcgcggcgccg

SEQ ID NO: 888362 - RNA, 17 nt, Mycobacterium avium subsp. paratuberculosis
gccuucgacggccggcc

SEQ ID NO: 888363 - RNA, 22 nt, Mycobacterium avium subsp. paratuberculosis
gccuuccucggcgcucgccgcg

SEQ ID NO: 888364 - RNA, 22 nt, Mycobacterium avium subsp. paratuberculosis
gccuucgacccgguggcccggu

SEQ ID NO: 888365 - RNA, 13 nt, Mycobacterium avium subsp. paratuberculosis
gccuuagcccggc

SEQ ID NO: 888366 - RNA, 12 nt, Mycobacterium avium subsp. paratuberculosis
gccuuacgccgg

SEQ ID NO: 888367 - RNA, 18 nt, Mycobacterium avium subsp. paratuberculosis
gccugcccagcggcacgg

SEQ ID NO: 888368 - RNA, 14 nt, Mycobacterium avium subsp. paratuberculosis
gccugcccgggcgc

SEQ ID NO: 888369 - RNA, 21 nt, Mycobacterium avium subsp. paratuberculosis
gccugcgucacuccucgaucu

SEQ ID NO: 888370 - RNA, 17 nt, Mycobacterium avium subsp. paratuberculosis
gccugcgggcgccggcu

SEQ ID NO: 888371 - RNA, 19 nt, Mycobacterium avium subsp. paratuberculosis
gccugcgggacgccguuga

SEQ ID NO: 888372 - RNA, 14 nt, Mycobacterium avium subsp. paratuberculosis
gccugcgggcccag

SEQ ID NO: 888373 - RNA, 16 nt, Mycobacterium avium subsp. paratuberculosis
gccugcgggcccagcu

SEQ ID NO: 888374 - RNA, 19 nt, Mycobacterium avium subsp. paratuberculosis
gccugcgggcccagcucgg

SEQ ID NO: 888375 - RNA, 18 nt, Mycobacterium avium subsp. paratuberculosis
gccugcuucucgccgucg

SEQ ID NO: 888376 - RNA, 22 nt, Mycobacterium avium subsp. paratuberculosis
gccugcuugaugaugccggccg

SEQ ID NO: 888377 - RNA, 19 nt, Mycobacterium avium subsp. paratuberculosis
gccugcuugggcagcagcu

SEQ ID NO: 888378 - RNA, 20 nt, Mycobacterium avium subsp. paratuberculosis
gccugcuugggcagcagcuc

SEQ ID NO: 888379 - RNA, 23 nt, Mycobacterium avium subsp. paratuberculosis
gccugcuugggcagcagcucgau

SEQ ID NO: 888380 - RNA, 19 nt, Mycobacterium avium subsp. paratuberculosis
gccugcuccagcgagucga

SEQ ID NO: 888381 - RNA, 23 nt, Mycobacterium avium subsp. paratuberculosis
gccugcuccagcgagucgaagcc

SEQ ID NO: 888382 - RNA, 18 nt, Mycobacterium avium subsp. paratuberculosis
gccugcccggcggugccg

SEQ ID NO: 888383 - RNA, 24 nt, Mycobacterium avium subsp. paratuberculosis
gccugccccccuugagccgguccg

SEQ ID NO: 888384 - RNA, 15 nt, Mycobacterium avium subsp. paratuberculosis
gccugccaccgcgaa

SEQ ID NO: 888385 - RNA, 16 nt, Mycobacterium avium subsp. paratuberculosis
gccugcuuuucggccg

SEQ ID NO: 888386 - RNA, 17 nt, Mycobacterium avium subsp. paratuberculosis
gccugcuuuucggccga

SEQ ID NO: 888387 - RNA, 15 nt, Mycobacterium avium subsp. paratuberculosis
gccuggaaccggguc

SEQ ID NO: 888388 - RNA, 20 nt, Mycobacterium avium subsp. paratuberculosis
gccuggaagaugacccgccu

SEQ ID NO: 888389 - RNA, 19 nt, Mycobacterium avium subsp. paratuberculosis
gccuggaaaccccucagcc

SEQ ID NO: 888390 - RNA, 20 nt, Mycobacterium avium subsp. paratuberculosis
gccuggaaaccccucagccg

SEQ ID NO: 888391 - RNA, 15 nt, Mycobacterium avium subsp. paratuberculosis
gccuggacgacgucg

SEQ ID NO: 888392 - RNA, 16 nt, Mycobacterium avium subsp. paratuberculosis
gccuggacgacgucga

SEQ ID NO: 888393 - RNA, 16 nt, Mycobacterium avium subsp. paratuberculosis
gccuggcagcugccga

SEQ ID NO: 888394 - RNA, 17 nt, Mycobacterium avium subsp. paratuberculosis
gccuggccaccucgacg

SEQ ID NO: 888395 - RNA, 16 nt, Mycobacterium avium subsp. paratuberculosis
gccuggaugccgcccu

SEQ ID NO: 888396 - RNA, 21 nt, Mycobacterium avium subsp. paratuberculosis
gccugggucaaaacaacgcgc

SEQ ID NO: 888397 - RNA, 18 nt, Mycobacterium avium subsp. paratuberculosis
gccugggcguacagcggc

SEQ ID NO: 888398 - RNA, 15 nt, Mycobacterium avium subsp. paratuberculosis
gccugggccucgucc

SEQ ID NO: 888399 - RNA, 17 nt, Mycobacterium avium subsp. paratuberculosis
gccugauacgacguccg

SEQ ID NO: 888400 - RNA, 21 nt, Mycobacterium avium subsp. paratuberculosis
gccugacugagucaagccggc

SEQ ID NO: 888401 - RNA, 22 nt, Mycobacterium avium subsp. paratuberculosis
gccugacuucugaaccgaaggg

SEQ ID NO: 888402 - RNA, 14 nt, Mycobacterium avium subsp. paratuberculosis
gccugagacgacgc

SEQ ID NO: 888403 - RNA, 15 nt, Mycobacterium avium subsp. paratuberculosis
gccugagacgacgcc

SEQ ID NO: 888404 - RNA, 12 nt, Mycobacterium avium subsp. paratuberculosis
gccugagcccgc

SEQ ID NO: 888405 - RNA, 14 nt, Mycobacterium avium subsp. paratuberculosis
gccugagccgccgg

SEQ ID NO: 888406 - RNA, 19 nt, Mycobacterium avium subsp. paratuberculosis
gccugacgggagucgggcc

SEQ ID NO: 888407 - RNA, 14 nt, Mycobacterium avium subsp. paratuberculosis
gccugaaccagcuc

SEQ ID NO: 888408 - RNA, 15 nt, Mycobacterium avium subsp. paratuberculosis
gccugacccggccgu

SEQ ID NO: 888409 - RNA, 17 nt, Mycobacterium avium subsp. paratuberculosis
gccugacccggccgugc

SEQ ID NO: 888410 - RNA, 22 nt, Mycobacterium avium subsp. paratuberculosis
gccugcagcaccgaaccggcgg

SEQ ID NO: 888411 - RNA, 18 nt, Mycobacterium avium subsp. paratuberculosis
gccugcagcaacucgcgc

SEQ ID NO: 888412 - RNA, 19 nt, Mycobacterium avium subsp. paratuberculosis
gccugcagcaacucgcgcu

SEQ ID NO: 888413 - RNA, 15 nt, Mycobacterium avium subsp. paratuberculosis
gccugcacggugccg

SEQ ID NO: 888414 - RNA, 14 nt, Mycobacterium avium subsp. paratuberculosis
gccugcacggugcg

SEQ ID NO: 888415 - RNA, 16 nt, Mycobacterium avium subsp. paratuberculosis
gccugcacggugcgcc

SEQ ID NO: 888416 - RNA, 14 nt, Mycobacterium avium subsp. paratuberculosis
gccugcacgucggc

SEQ ID NO: 888417 - RNA, 19 nt, Mycobacterium avium subsp. paratuberculosis
gccugcacgucggcgcgca

SEQ ID NO: 888418 - RNA, 13 nt, Mycobacterium avium subsp. paratuberculosis
gccugcaccucgg

SEQ ID NO: 888419 - RNA, 13 nt, Mycobacterium avium subsp. paratuberculosis
gccugcagccgcc

SEQ ID NO: 888420 - RNA, 15 nt, Mycobacterium avium subsp. paratuberculosis
gccugcagccgccgc

SEQ ID NO: 888421 - RNA, 13 nt, Mycobacterium avium subsp. paratuberculosis
gccugcaacuggu

SEQ ID NO: 888422 - RNA, 17 nt, Mycobacterium avium subsp. paratuberculosis
gccugcaccuugcccgu

SEQ ID NO: 888423 - RNA, 19 nt, Mycobacterium avium subsp. paratuberculosis
gccugcaccuugcccgucg

SEQ ID NO: 888424 - RNA, 23 nt, Mycobacterium avium subsp. paratuberculosis
gccugcaccuugcccgucgcguc

SEQ ID NO: 888425 - RNA, 23 nt, Mycobacterium avium subsp. paratuberculosis
gccugcacgaaauaaccgcgcgg

SEQ ID NO: 888426 - RNA, 15 nt, Mycobacterium avium subsp. paratuberculosis
gccugcacgaagucg

SEQ ID NO: 888427 - RNA, 16 nt, Mycobacterium avium subsp. paratuberculosis
gccugcacgaagucga

SEQ ID NO: 888428 - RNA, 20 nt, Mycobacterium avium subsp. paratuberculosis
gccugcacgaagucgaccgc

SEQ ID NO: 888429 - RNA, 21 nt, Mycobacterium avium subsp. paratuberculosis
gccugcacgaagucgaccgcg

SEQ ID NO: 888430 - RNA, 22 nt, Mycobacterium avium subsp. paratuberculosis
gccugcacgaagucgaccgcgg

SEQ ID NO: 888431 - RNA, 23 nt, Mycobacterium avium subsp. paratuberculosis
gccugcaccaccacacccagcgc

SEQ ID NO: 888432 - RNA, 15 nt, Mycobacterium avium subsp. paratuberculosis
gccugcacccagguc

SEQ ID NO: 888433 - RNA, 23 nt, Mycobacterium avium subsp. paratuberculosis
gccugcacccaggucaugguggc

SEQ ID NO: 888434 - RNA, 13 nt, Mycobacterium avium subsp. paratuberculosis
gccugcaccggcg

SEQ ID NO: 888435 - RNA, 14 nt, Mycobacterium avium subsp. paratuberculosis
gccugaugccgguc

SEQ ID NO: 888436 - RNA, 15 nt, Mycobacterium avium subsp. paratuberculosis
gccucuucgucggcc

SEQ ID NO: 888437 - RNA, 17 nt, Mycobacterium avium subsp. paratuberculosis
gccucucgucgacgaug

SEQ ID NO: 888438 - RNA, 14 nt, Mycobacterium avium subsp. paratuberculosis
gccucuucggcgcg

SEQ ID NO: 888439 - RNA, 16 nt, Mycobacterium avium subsp. paratuberculosis
gccucuucggcgcgcc

SEQ ID NO: 888440 - RNA, 17 nt, Mycobacterium avium subsp. paratuberculosis
gccucguuggccagcuc

SEQ ID NO: 888441 - RNA, 18 nt, Mycobacterium avium subsp. paratuberculosis
gccucguuggccagcucg

SEQ ID NO: 888442 - RNA, 20 nt, Mycobacterium avium subsp. paratuberculosis
gccucguuggccagcucggc

SEQ ID NO: 888443 - RNA, 14 nt, Mycobacterium avium subsp. paratuberculosis
gccucgucgcggaa

SEQ ID NO: 888444 - RNA, 16 nt, Mycobacterium avium subsp. paratuberculosis
gccucgucgaugucgg

SEQ ID NO: 888445 - RNA, 19 nt, Mycobacterium avium subsp. paratuberculosis
gccucgucgaugucggcgg

SEQ ID NO: 888446 - RNA, 13 nt, Mycobacterium avium subsp. paratuberculosis
gccucgucggcga

SEQ ID NO: 888447 - RNA, 18 nt, Mycobacterium avium subsp. paratuberculosis
gccucgucggcgagcagc

SEQ ID NO: 888448 - RNA, 13 nt, Mycobacterium avium subsp. paratuberculosis
gccucgucggcgc

SEQ ID NO: 888449 - RNA, 14 nt, Mycobacterium avium subsp. paratuberculosis
gccucgucggcgcc

SEQ ID NO: 888450 - RNA, 18 nt, Mycobacterium avium subsp. paratuberculosis
gccucgucgggaacgcga

SEQ ID NO: 888451 - RNA, 20 nt, Mycobacterium avium subsp. paratuberculosis
gccucgugcaaggccugcgc

SEQ ID NO: 888452 - RNA, 22 nt, Mycobacterium avium subsp. paratuberculosis
gccucgugcaugugcucggcga

SEQ ID NO: 888453 - RNA, 16 nt, Mycobacterium avium subsp. paratuberculosis
gccucgucgacgucgg

SEQ ID NO: 888454 - RNA, 15 nt, Mycobacterium avium subsp. paratuberculosis
gccucgguggcggug

SEQ ID NO: 888455 - RNA, 18 nt, Mycobacterium avium subsp. paratuberculosis
gccucgguggcgguggcc

SEQ ID NO: 888456 - RNA, 19 nt, Mycobacterium avium subsp. paratuberculosis
gccucgguggcgguggcca

SEQ ID NO: 888457 - RNA, 15 nt, Mycobacterium avium subsp. paratuberculosis
gccucgguggucgac

SEQ ID NO: 888458 - RNA, 18 nt, Mycobacterium avium subsp. paratuberculosis
gccucgguggucgacgag

SEQ ID NO: 888459 - RNA, 22 nt, Mycobacterium avium subsp. paratuberculosis
gccucgguggucgacgagcccg

SEQ ID NO: 888460 - RNA, 14 nt, Mycobacterium avium subsp. paratuberculosis
gccucgguggucgc

SEQ ID NO: 888461 - RNA, 18 nt, Mycobacterium avium subsp. paratuberculosis
gccucgguucugcagcga

SEQ ID NO: 888462 - RNA, 12 nt, Mycobacterium avium subsp. paratuberculosis
gccucggucgcg

SEQ ID NO: 888463 - RNA, 22 nt, Mycobacterium avium subsp. paratuberculosis
gccucggucgcgugaccggcgg

SEQ ID NO: 888464 - RNA, 18 nt, Mycobacterium avium subsp. paratuberculosis
gccucggugagcagcucg

SEQ ID NO: 888465 - RNA, 19 nt, Mycobacterium avium subsp. paratuberculosis
gccucggugagcagcucgg

SEQ ID NO: 888466 - RNA, 22 nt, Mycobacterium avium subsp. paratuberculosis
gccucggugagcagcucgguca

SEQ ID NO: 888467 - RNA, 15 nt, Mycobacterium avium subsp. paratuberculosis
gccucggugcggaac

SEQ ID NO: 888468 - RNA, 21 nt, Mycobacterium avium subsp. paratuberculosis
gccucgggcgacgacgcgguc

SEQ ID NO: 888469 - RNA, 12 nt, Mycobacterium avium subsp. paratuberculosis
gccucgggccgg

SEQ ID NO: 888470 - RNA, 19 nt, Mycobacterium avium subsp. paratuberculosis
gccucgggccggcagccgg

SEQ ID NO: 888471 - RNA, 21 nt, Mycobacterium avium subsp. paratuberculosis
gccucgggccggcagccggcc

SEQ ID NO: 888472 - RNA, 15 nt, Mycobacterium avium subsp. paratuberculosis
gccucggcgguggcc

SEQ ID NO: 888473 - RNA, 19 nt, Mycobacterium avium subsp. paratuberculosis
gccucggcgucaccgcggg

SEQ ID NO: 888474 - RNA, 20 nt, Mycobacterium avium subsp. paratuberculosis
gccucggcgucaccgcgggu

SEQ ID NO: 888475 - RNA, 21 nt, Mycobacterium avium subsp. paratuberculosis
gccucggcgucaccgcgggug

SEQ ID NO: 888476 - RNA, 19 nt, Mycobacterium avium subsp. paratuberculosis
gccucggcgucccggcguc

SEQ ID NO: 888477 - RNA, 24 nt, Mycobacterium avium subsp. paratuberculosis
gccucggcgucccggcgucucggc

SEQ ID NO: 888478 - RNA, 18 nt, Mycobacterium avium subsp. paratuberculosis
gccuccagguucgccgcc

SEQ ID NO: 888479 - RNA, 19 nt, Mycobacterium avium subsp. paratuberculosis
gccuccagguucgccgccc

SEQ ID NO: 888480 - RNA, 14 nt, Mycobacterium avium subsp. paratuberculosis
gccucccacagguc

SEQ ID NO: 888481 - RNA, 22 nt, Mycobacterium avium subsp. paratuberculosis
gccuccauucgggccagcgccg

SEQ ID NO: 888482 - RNA, 15 nt, Mycobacterium avium subsp. paratuberculosis
gccucccacucgucg

SEQ ID NO: 888483 - RNA, 16 nt, Mycobacterium avium subsp. paratuberculosis
gccucccacucgucga

SEQ ID NO: 888484 - RNA, 18 nt, Mycobacterium avium subsp. paratuberculosis
gccuccagcuuugccagc

SEQ ID NO: 888485 - RNA, 21 nt, Mycobacterium avium subsp. paratuberculosis
gccucggaggccaccgcgccg

SEQ ID NO: 888486 - RNA, 22 nt, Mycobacterium avium subsp. paratuberculosis
gccucggaucccggggcgcgcu

SEQ ID NO: 888487 - RNA, 16 nt, Mycobacterium avium subsp. paratuberculosis
gccucggcaccgugcc

SEQ ID NO: 888488 - RNA, 19 nt, Mycobacterium avium subsp. paratuberculosis
gccuccgaauccagcgcgc

SEQ ID NO: 888489 - RNA, 20 nt, Mycobacterium avium subsp. paratuberculosis
gccuccgaauccagcgcgcc

SEQ ID NO: 888490 - RNA, 22 nt, Mycobacterium avium subsp. paratuberculosis
gccuccgaauccagcgcgccgc

SEQ ID NO: 888491 - RNA, 23 nt, Mycobacterium avium subsp. paratuberculosis
gccuccgaauccagcgcgccgcu

SEQ ID NO: 888492 - RNA, 14 nt, Mycobacterium avium subsp. paratuberculosis
gccuccgacagccg

SEQ ID NO: 888493 - RNA, 15 nt, Mycobacterium avium subsp. paratuberculosis
gccuccgagauggac

SEQ ID NO: 888494 - RNA, 18 nt, Mycobacterium avium subsp. paratuberculosis
gccuccgagauggacagc

SEQ ID NO: 888495 - RNA, 16 nt, Mycobacterium avium subsp. paratuberculosis
gccuccgagcggcgca

SEQ ID NO: 888496 - RNA, 22 nt, Mycobacterium avium subsp. paratuberculosis
gccuccgccaccuccuccgguc

SEQ ID NO: 888497 - RNA, 18 nt, Mycobacterium avium subsp. paratuberculosis
gccucccccuugccggug

SEQ ID NO: 888498 - RNA, 19 nt, Mycobacterium avium subsp. paratuberculosis
gccucccgcagcgccagcg

SEQ ID NO: 888499 - RNA, 14 nt, Mycobacterium avium subsp. paratuberculosis
gccuccccauccgc

SEQ ID NO: 888500 - RNA, 14 nt, Mycobacterium avium subsp. paratuberculosis
gccucccccacccg

SEQ ID NO: 888501 - RNA, 15 nt, Mycobacterium avium subsp. paratuberculosis
gccucccccacccgc

SEQ ID NO: 888502 - RNA, 18 nt, Mycobacterium avium subsp. paratuberculosis
gccucccccacccgcacg

SEQ ID NO: 888503 - RNA, 23 nt, Mycobacterium avium subsp. paratuberculosis
gccucggccaccagaugccgggc

SEQ ID NO: 888504 - RNA, 13 nt, Mycobacterium avium subsp. paratuberculosis
gccucggccaccu

SEQ ID NO: 888505 - RNA, 20 nt, Mycobacterium avium subsp. paratuberculosis
gccucggccaccuugcgcgg

SEQ ID NO: 888506 - RNA, 13 nt, Mycobacterium avium subsp. paratuberculosis
gccucggccucgu

SEQ ID NO: 888507 - RNA, 19 nt, Mycobacterium avium subsp. paratuberculosis
gccucggccucgucgacgu

SEQ ID NO: 888508 - RNA, 18 nt, Mycobacterium avium subsp. paratuberculosis
gccucggccugcgcccgg

SEQ ID NO: 888509 - RNA, 21 nt, Mycobacterium avium subsp. paratuberculosis
gccucggccuuggccaccgcc

SEQ ID NO: 888510 - RNA, 23 nt, Mycobacterium avium subsp. paratuberculosis
gccucggccuuggccaccgccug

SEQ ID NO: 888511 - RNA, 13 nt, Mycobacterium avium subsp. paratuberculosis
gccucggccgcgg

SEQ ID NO: 888512 - RNA, 14 nt, Mycobacterium avium subsp. paratuberculosis
gccucggccgcggu

SEQ ID NO: 888513 - RNA, 17 nt, Mycobacterium avium subsp. paratuberculosis
gccucggccgcggucuc

SEQ ID NO: 888514 - RNA, 23 nt, Mycobacterium avium subsp. paratuberculosis
gccucggccgcggucucgaccga

SEQ ID NO: 888515 - RNA, 13 nt, Mycobacterium avium subsp. paratuberculosis
gccucggcggccc

SEQ ID NO: 888516 - RNA, 14 nt, Mycobacterium avium subsp. paratuberculosis
gccucggcggccgc

SEQ ID NO: 888517 - RNA, 15 nt, Mycobacterium avium subsp. paratuberculosis
gccucggcggccgcc

SEQ ID NO: 888518 - RNA, 17 nt, Mycobacterium avium subsp. paratuberculosis
gccucggcggccgcccg

SEQ ID NO: 888519 - RNA, 16 nt, Mycobacterium avium subsp. paratuberculosis
gccucggcggccggga

SEQ ID NO: 888520 - RNA, 14 nt, Mycobacterium avium subsp. paratuberculosis
gccucggcgcgggc

SEQ ID NO: 888521 - RNA, 19 nt, Mycobacterium avium subsp. paratuberculosis
gccucggcgcugcccgccg

SEQ ID NO: 888522 - RNA, 21 nt, Mycobacterium avium subsp. paratuberculosis
gccucggcgcugcccgccgcg

SEQ ID NO: 888523 - RNA, 14 nt, Mycobacterium avium subsp. paratuberculosis
gccucggcggaguc

SEQ ID NO: 888524 - RNA, 15 nt, Mycobacterium avium subsp. paratuberculosis
gccucggcgccucgg

SEQ ID NO: 888525 - RNA, 16 nt, Mycobacterium avium subsp. paratuberculosis
gccucggcgagccgcu

SEQ ID NO: 888526 - RNA, 15 nt, Mycobacterium avium subsp. paratuberculosis
gccucggcgaucggc

SEQ ID NO: 888527 - RNA, 19 nt, Mycobacterium avium subsp. paratuberculosis
gccucggcgaucggccgcu

SEQ ID NO: 888528 - RNA, 13 nt, Mycobacterium avium subsp. paratuberculosis
gccucggcgaugc

SEQ ID NO: 888529 - RNA, 17 nt, Mycobacterium avium subsp. paratuberculosis
gccguagaauccgccgu

SEQ ID NO: 888530 - RNA, 20 nt, Mycobacterium avium subsp. paratuberculosis
gccguagaauccgccguuga

SEQ ID NO: 888531 - RNA, 23 nt, Mycobacterium avium subsp. paratuberculosis
gccguagaucacgccggugagca

SEQ ID NO: 888532 - RNA, 17 nt, Mycobacterium avium subsp. paratuberculosis
gccguagaccagcauca

SEQ ID NO: 888533 - RNA, 17 nt, Mycobacterium avium subsp. paratuberculosis
gccguagacggucaggu

SEQ ID NO: 888534 - RNA, 18 nt, Mycobacterium avium subsp. paratuberculosis
gccguagagccguuuggc

SEQ ID NO: 888535 - RNA, 15 nt, Mycobacterium avium subsp. paratuberculosis
gccguagcggacgac

SEQ ID NO: 888536 - RNA, 21 nt, Mycobacterium avium subsp. paratuberculosis
gccguagcggacgacggccag

SEQ ID NO: 888537 - RNA, 23 nt, Mycobacterium avium subsp. paratuberculosis
gccguagcggcucgccaccucgg

SEQ ID NO: 888538 - RNA, 20 nt, Mycobacterium avium subsp. paratuberculosis
gccguagcgcaugaugccca

SEQ ID NO: 888539 - RNA, 14 nt, Mycobacterium avium subsp. paratuberculosis
gccguagcgccggc

SEQ ID NO: 888540 - RNA, 21 nt, Mycobacterium avium subsp. paratuberculosis
gccguagcgccggcaacaacg

SEQ ID NO: 888541 - RNA, 16 nt, Mycobacterium avium subsp. paratuberculosis
gccguagcggucgccc

SEQ ID NO: 888542 - RNA, 17 nt, Mycobacterium avium subsp. paratuberculosis
gccguagcggucgcccc

SEQ ID NO: 888543 - RNA, 22 nt, Mycobacterium avium subsp. paratuberculosis
gccguagcggucgccccagaac

SEQ ID NO: 888544 - RNA, 17 nt, Mycobacterium avium subsp. paratuberculosis
gccguagcguugccggc

SEQ ID NO: 888545 - RNA, 21 nt, Mycobacterium avium subsp. paratuberculosis
gccguagcguugccggccgaa

SEQ ID NO: 888546 - RNA, 15 nt, Mycobacterium avium subsp. paratuberculosis
gccguagaucgucga

SEQ ID NO: 888547 - RNA, 16 nt, Mycobacterium avium subsp. paratuberculosis
gccguagccggaccgc

SEQ ID NO: 888548 - RNA, 14 nt, Mycobacterium avium subsp. paratuberculosis
gccguagccggcgg

SEQ ID NO: 888549 - RNA, 15 nt, Mycobacterium avium subsp. paratuberculosis
gccguagccggcggu

SEQ ID NO: 888550 - RNA, 13 nt, Mycobacterium avium subsp. paratuberculosis
gccguagccguag

SEQ ID NO: 888551 - RNA, 13 nt, Mycobacterium avium subsp. paratuberculosis
gccguaaccgccg

SEQ ID NO: 888552 - RNA, 19 nt, Mycobacterium avium subsp. paratuberculosis
gccguaaguggcgccgcgg

SEQ ID NO: 888553 - RNA, 19 nt, Mycobacterium avium subsp. paratuberculosis
gccguacagcugguccggc

SEQ ID NO: 888554 - RNA, 22 nt, Mycobacterium avium subsp. paratuberculosis
gccguacagcugguccggccgg

SEQ ID NO: 888555 - RNA, 23 nt, Mycobacterium avium subsp. paratuberculosis
gccguacagcugguccggccggc

SEQ ID NO: 888556 - RNA, 19 nt, Mycobacterium avium subsp. paratuberculosis
gccguaccgauccgcgggc

SEQ ID NO: 888557 - RNA, 21 nt, Mycobacterium avium subsp. paratuberculosis
gccguaccgcuuggcccaccg

SEQ ID NO: 888558 - RNA, 22 nt, Mycobacterium avium subsp. paratuberculosis
gccguaccgcuuggcccaccga

SEQ ID NO: 888559 - RNA, 16 nt, Mycobacterium avium subsp. paratuberculosis
gccguacacggcggcg

SEQ ID NO: 888560 - RNA, 17 nt, Mycobacterium avium subsp. paratuberculosis
gccguacgcgccggcca

SEQ ID NO: 888561 - RNA, 13 nt, Mycobacterium avium subsp. paratuberculosis
gccguacgcgguu

SEQ ID NO: 888562 - RNA, 21 nt, Mycobacterium avium subsp. paratuberculosis
gccguacgcgguucgugcgca

SEQ ID NO: 888563 - RNA, 19 nt, Mycobacterium avium subsp. paratuberculosis
gccgggagugcuggacggc

SEQ ID NO: 888564 - RNA, 16 nt, Mycobacterium avium subsp. paratuberculosis
gccgggaaugucgcgc

SEQ ID NO: 888565 - RNA, 22 nt, Mycobacterium avium subsp. paratuberculosis
gccgggaaugucgcgcagcauc

SEQ ID NO: 888566 - RNA, 18 nt, Mycobacterium avium subsp. paratuberculosis
gccgggaagcgaagcggg

SEQ ID NO: 888567 - RNA, 16 nt, Mycobacterium avium subsp. paratuberculosis
gccgggaaucgagggc

SEQ ID NO: 888568 - RNA, 18 nt, Mycobacterium avium subsp. paratuberculosis
gccgggaaucgagggcgc

SEQ ID NO: 888569 - RNA, 20 nt, Mycobacterium avium subsp. paratuberculosis
gccgggaaucgagggcgcgc

SEQ ID NO: 888570 - RNA, 17 nt, Mycobacterium avium subsp. paratuberculosis
gccgggauauucgccca

SEQ ID NO: 888571 - RNA, 20 nt, Mycobacterium avium subsp. paratuberculosis
gccgggauauucgcccagcg

SEQ ID NO: 888572 - RNA, 21 nt, Mycobacterium avium subsp. paratuberculosis
gccgggauauucgcccagcgg

SEQ ID NO: 888573 - RNA, 13 nt, Mycobacterium avium subsp. paratuberculosis
gccgggaucacac

SEQ ID NO: 888574 - RNA, 19 nt, Mycobacterium avium subsp. paratuberculosis
gccgggauagagcaccgcg

SEQ ID NO: 888575 - RNA, 19 nt, Mycobacterium avium subsp. paratuberculosis
gccgggaucggcagcgcgc

SEQ ID NO: 888576 - RNA, 14 nt, Mycobacterium avium subsp. paratuberculosis
gccgggaucggcgg

SEQ ID NO: 888577 - RNA, 15 nt, Mycobacterium avium subsp. paratuberculosis
gccgguuucgucggu

SEQ ID NO: 888578 - RNA, 20 nt, Mycobacterium avium subsp. paratuberculosis
gccgguuguugcgguccagg

SEQ ID NO: 888579 - RNA, 22 nt, Mycobacterium avium subsp. paratuberculosis
gccgguuuccaggacgaugcgc

SEQ ID NO: 888580 - RNA, 24 nt, Mycobacterium avium subsp. paratuberculosis
gccgguuuccaggacgaugcgcgc

SEQ ID NO: 888581 - RNA, 14 nt, Mycobacterium avium subsp. paratuberculosis
gccgguuggugcgc

SEQ ID NO: 888582 - RNA, 15 nt, Mycobacterium avium subsp. paratuberculosis
gccgguuggcggccg

SEQ ID NO: 888583 - RNA, 17 nt, Mycobacterium avium subsp. paratuberculosis
gccgguuggcggccggg

SEQ ID NO: 888584 - RNA, 24 nt, Mycobacterium avium subsp. paratuberculosis
gccgguuggcggccgggucgagcg

SEQ ID NO: 888585 - RNA, 14 nt, Mycobacterium avium subsp. paratuberculosis
gccgguugcggugg

SEQ ID NO: 888586 - RNA, 19 nt, Mycobacterium avium subsp. paratuberculosis
gccgguugcgguggccgau

SEQ ID NO: 888587 - RNA, 22 nt, Mycobacterium avium subsp. paratuberculosis
gccgguugcgguugccccaccc

SEQ ID NO: 888588 - RNA, 20 nt, Mycobacterium avium subsp. paratuberculosis
gccgguugccuuuccgcgcg

SEQ ID NO: 888589 - RNA, 21 nt, Mycobacterium avium subsp. paratuberculosis
gccgguugccuuuccgcgcgg

SEQ ID NO: 888590 - RNA, 23 nt, Mycobacterium avium subsp. paratuberculosis
gccgguugccuuuccgcgcggcg

SEQ ID NO: 888591 - RNA, 18 nt, Mycobacterium avium subsp. paratuberculosis
gccgguucgucccgcgcg

SEQ ID NO: 888592 - RNA, 19 nt, Mycobacterium avium subsp. paratuberculosis
gccgguucgucccgcgcgg

SEQ ID NO: 888593 - RNA, 16 nt, Mycobacterium avium subsp. paratuberculosis
gccgguugaucacccg

SEQ ID NO: 888594 - RNA, 17 nt, Mycobacterium avium subsp. paratuberculosis
gccgguugaucacccgg

SEQ ID NO: 888595 - RNA, 15 nt, Mycobacterium avium subsp. paratuberculosis
gccgucaucaccgcc

SEQ ID NO: 888596 - RNA, 21 nt, Mycobacterium avium subsp. paratuberculosis
gccgucaucaccgccgagggc

SEQ ID NO: 888597 - RNA, 13 nt, Mycobacterium avium subsp. paratuberculosis
gccgucagugcgc

SEQ ID NO: 888598 - RNA, 20 nt, Mycobacterium avium subsp. paratuberculosis
gccgucagugcgcauucggc

SEQ ID NO: 888599 - RNA, 17 nt, Mycobacterium avium subsp. paratuberculosis
gccgucaucgacaccga

SEQ ID NO: 888600 - RNA, 15 nt, Mycobacterium avium subsp. paratuberculosis
gccgucaucgccgac

SEQ ID NO: 888601 - RNA, 17 nt, Mycobacterium avium subsp. paratuberculosis
gccgucaucgccgacgg

SEQ ID NO: 888602 - RNA, 18 nt, Mycobacterium avium subsp. paratuberculosis
gccgucaucgccgacggu

SEQ ID NO: 888603 - RNA, 15 nt, Mycobacterium avium subsp. paratuberculosis
gccgucaucggcgga

SEQ ID NO: 888604 - RNA, 17 nt, Mycobacterium avium subsp. paratuberculosis
gccgucaggaacgccgg

SEQ ID NO: 888605 - RNA, 19 nt, Mycobacterium avium subsp. paratuberculosis
gccgucaggagugcucggc

SEQ ID NO: 888606 - RNA, 20 nt, Mycobacterium avium subsp. paratuberculosis
gccgucaggagugcucggcg

SEQ ID NO: 888607 - RNA, 21 nt, Mycobacterium avium subsp. paratuberculosis
gccgucaggagugcucggcgu

SEQ ID NO: 888608 - RNA, 23 nt, Mycobacterium avium subsp. paratuberculosis
gccgucaggagugcucggcguug

SEQ ID NO: 888609 - RNA, 17 nt, Mycobacterium avium subsp. paratuberculosis
gccguaggucgggucga

SEQ ID NO: 888610 - RNA, 14 nt, Mycobacterium avium subsp. paratuberculosis
gccguaggccaggu

SEQ ID NO: 888611 - RNA, 22 nt, Mycobacterium avium subsp. paratuberculosis
gccguaggccagguucaggcug

SEQ ID NO: 888612 - RNA, 17 nt, Mycobacterium avium subsp. paratuberculosis
gccguaggccgcgcuga

SEQ ID NO: 888613 - RNA, 19 nt, Mycobacterium avium subsp. paratuberculosis
gccguaggacaggaacggg

SEQ ID NO: 888614 - RNA, 23 nt, Mycobacterium avium subsp. paratuberculosis
gccguaggacaggaacgggccgg

SEQ ID NO: 888615 - RNA, 13 nt, Mycobacterium avium subsp. paratuberculosis
gccguccgacgug

SEQ ID NO: 888616 - RNA, 15 nt, Mycobacterium avium subsp. paratuberculosis
gccguccgcaccgcg

SEQ ID NO: 888617 - RNA, 16 nt, Mycobacterium avium subsp. paratuberculosis
gccguccgcaccgcga

SEQ ID NO: 888618 - RNA, 23 nt, Mycobacterium avium subsp. paratuberculosis
gccgucgaccccgccggcccggu

SEQ ID NO: 888619 - RNA, 12 nt, Mycobacterium avium subsp. paratuberculosis
gccgucgacccg

SEQ ID NO: 888620 - RNA, 13 nt, Mycobacterium avium subsp. paratuberculosis
gccgucccggacg

SEQ ID NO: 888621 - RNA, 17 nt, Mycobacterium avium subsp. paratuberculosis
gccgucccggacgcugc

SEQ ID NO: 888622 - RNA, 19 nt, Mycobacterium avium subsp. paratuberculosis
gccgucccggacgcugcgg

SEQ ID NO: 888623 - RNA, 15 nt, Mycobacterium avium subsp. paratuberculosis
gccgucccgucacgg

SEQ ID NO: 888624 - RNA, 18 nt, Mycobacterium avium subsp. paratuberculosis
gccgucccgucacggcug

SEQ ID NO: 888625 - RNA, 18 nt, Mycobacterium avium subsp. paratuberculosis
gccgucccguccgacggc

SEQ ID NO: 888626 - RNA, 16 nt, Mycobacterium avium subsp. paratuberculosis
gccgucccaccggcga

SEQ ID NO: 888627 - RNA, 21 nt, Mycobacterium avium subsp. paratuberculosis
gccgucccagccggacagcgg

SEQ ID NO: 888628 - RNA, 14 nt, Mycobacterium avium subsp. paratuberculosis
gccgucccaggaca

SEQ ID NO: 888629 - RNA, 16 nt, Mycobacterium avium subsp. paratuberculosis
gccguccccgcgcggc

SEQ ID NO: 888630 - RNA, 20 nt, Mycobacterium avium subsp. paratuberculosis
gccguccccgcgcggcucgc

SEQ ID NO: 888631 - RNA, 14 nt, Mycobacterium avium subsp. paratuberculosis
gccgucaugguguc

SEQ ID NO: 888632 - RNA, 14 nt, Mycobacterium avium subsp. paratuberculosis
gccgucccgccguc

SEQ ID NO: 888633 - RNA, 19 nt, Mycobacterium avium subsp. paratuberculosis
gccguccaugaaccacugc

SEQ ID NO: 888634 - RNA, 20 nt, Mycobacterium avium subsp. paratuberculosis
gccguccaugaaccacugcg

SEQ ID NO: 888635 - RNA, 14 nt, Mycobacterium avium subsp. paratuberculosis
gccguccccaccga

SEQ ID NO: 888636 - RNA, 20 nt, Mycobacterium avium subsp. paratuberculosis
gccgucccccgagcgggccu

SEQ ID NO: 888637 - RNA, 11 nt, Mycobacterium avium subsp. paratuberculosis
gccgucggcgg

SEQ ID NO: 888638 - RNA, 14 nt, Mycobacterium avium subsp. paratuberculosis
gccgucggcggccu

SEQ ID NO: 888639 - RNA, 20 nt, Mycobacterium avium subsp. paratuberculosis
gccgucggcggccuugaacg

SEQ ID NO: 888640 - RNA, 16 nt, Mycobacterium avium subsp. paratuberculosis
gccgucggcgggaugg

SEQ ID NO: 888641 - RNA, 15 nt, Mycobacterium avium subsp. paratuberculosis
gccgucggcgcggcc

SEQ ID NO: 888642 - RNA, 20 nt, Mycobacterium avium subsp. paratuberculosis
gccgucggcgcggccggauc

SEQ ID NO: 888643 - RNA, 13 nt, Mycobacterium avium subsp. paratuberculosis
gccgucggccugc

SEQ ID NO: 888644 - RNA, 21 nt, Mycobacterium avium subsp. paratuberculosis
gccgucggccugcgcugcggc

SEQ ID NO: 888645 - RNA, 13 nt, Mycobacterium avium subsp. paratuberculosis
gccgucggcgaug

SEQ ID NO: 888646 - RNA, 15 nt, Mycobacterium avium subsp. paratuberculosis
gccgucggcgaugcg

SEQ ID NO: 888647 - RNA, 18 nt, Mycobacterium avium subsp. paratuberculosis
gccgucggcgaugcggug

SEQ ID NO: 888648 - RNA, 22 nt, Mycobacterium avium subsp. paratuberculosis
gccgucggcgaugcgguggucg

SEQ ID NO: 888649 - RNA, 16 nt, Mycobacterium avium subsp. paratuberculosis
gccgucggcgcccggc

SEQ ID NO: 888650 - RNA, 17 nt, Mycobacterium avium subsp. paratuberculosis
gccgucggcgccgccga

SEQ ID NO: 888651 - RNA, 18 nt, Mycobacterium avium subsp. paratuberculosis
gccgucggcgccgccgag

SEQ ID NO: 888652 - RNA, 13 nt, Mycobacterium avium subsp. paratuberculosis
gccgucggccgcc

SEQ ID NO: 888653 - RNA, 15 nt, Mycobacterium avium subsp. paratuberculosis
gccgucggcccacgg

SEQ ID NO: 888654 - RNA, 14 nt, Mycobacterium avium subsp. paratuberculosis
gccgucgcgaucgc

SEQ ID NO: 888655 - RNA, 16 nt, Mycobacterium avium subsp. paratuberculosis
gccgucgcgaucgcgg

SEQ ID NO: 888656 - RNA, 20 nt, Mycobacterium avium subsp. paratuberculosis
gccgucgcgaucgcggucca

SEQ ID NO: 888657 - RNA, 12 nt, Mycobacterium avium subsp. paratuberculosis
gccgucgcgcac

SEQ ID NO: 888658 - RNA, 17 nt, Mycobacterium avium subsp. paratuberculosis
gccgucgccgcacgccc

SEQ ID NO: 888659 - RNA, 13 nt, Mycobacterium avium subsp. paratuberculosis
gccgucgccucgc

SEQ ID NO: 888660 - RNA, 19 nt, Mycobacterium avium subsp. paratuberculosis
gccgucgccucgcccucgg

SEQ ID NO: 888661 - RNA, 17 nt, Mycobacterium avium subsp. paratuberculosis
gccgucgccgaucaccu

SEQ ID NO: 888662 - RNA, 18 nt, Mycobacterium avium subsp. paratuberculosis
gccgucgccgaucaccug

SEQ ID NO: 888663 - RNA, 21 nt, Mycobacterium avium subsp. paratuberculosis
gccgucgccgaucaccugaca

SEQ ID NO: 888664 - RNA, 13 nt, Mycobacterium avium subsp. paratuberculosis
gccgucgccgggc

SEQ ID NO: 888665 - RNA, 14 nt, Mycobacterium avium subsp. paratuberculosis
gccgucgccgggcg

SEQ ID NO: 888666 - RNA, 20 nt, Mycobacterium avium subsp. paratuberculosis
gccgucgccgggcggggugg

SEQ ID NO: 888667 - RNA, 12 nt, Mycobacterium avium subsp. paratuberculosis
gccgucgccgcg

SEQ ID NO: 888668 - RNA, 15 nt, Mycobacterium avium subsp. paratuberculosis
gccgucgccgcgccc

SEQ ID NO: 888669 - RNA, 16 nt, Mycobacterium avium subsp. paratuberculosis
gccgucgccgcgcccg

SEQ ID NO: 888670 - RNA, 22 nt, Mycobacterium avium subsp. paratuberculosis
gccgucgccgcgcccgccggcc

SEQ ID NO: 888671 - RNA, 11 nt, Mycobacterium avium subsp. paratuberculosis
gccgucgccgg

SEQ ID NO: 888672 - RNA, 14 nt, Mycobacterium avium subsp. paratuberculosis
gccgucgccggacu

SEQ ID NO: 888673 - RNA, 20 nt, Mycobacterium avium subsp. paratuberculosis
gccgucgccggacucgaucg

SEQ ID NO: 888674 - RNA, 14 nt, Mycobacterium avium subsp. paratuberculosis
gccgucgccgaagu

SEQ ID NO: 888675 - RNA, 23 nt, Mycobacterium avium subsp. paratuberculosis
gccgucgccgaaguuccagccga

SEQ ID NO: 888676 - RNA, 12 nt, Mycobacterium avium subsp. paratuberculosis
gccgucgccgac

SEQ ID NO: 888677 - RNA, 20 nt, Mycobacterium avium subsp. paratuberculosis
gccgucgaggaauccggucc

SEQ ID NO: 888678 - RNA, 20 nt, Mycobacterium avium subsp. paratuberculosis
gccgucgaggcgcugcagca

SEQ ID NO: 888679 - RNA, 13 nt, Mycobacterium avium subsp. paratuberculosis
gccgucgaccggg

SEQ ID NO: 888680 - RNA, 15 nt, Mycobacterium avium subsp. paratuberculosis
gccgucgaccggguc

SEQ ID NO: 888681 - RNA, 20 nt, Mycobacterium avium subsp. paratuberculosis
gccgucgacgaccaccacca

SEQ ID NO: 888682 - RNA, 17 nt, Mycobacterium avium subsp. paratuberculosis
gccgucgacgacgaacu

SEQ ID NO: 888683 - RNA, 21 nt, Mycobacterium avium subsp. paratuberculosis
gccgucgacgaucugcacacg

SEQ ID NO: 888684 - RNA, 16 nt, Mycobacterium avium subsp. paratuberculosis
gccgucgacgcgugcg

SEQ ID NO: 888685 - RNA, 23 nt, Mycobacterium avium subsp. paratuberculosis
gccguguugacguaacacccugc

SEQ ID NO: 888686 - RNA, 16 nt, Mycobacterium avium subsp. paratuberculosis
gccguguaggccgcgc

SEQ ID NO: 888687 - RNA, 21 nt, Mycobacterium avium subsp. paratuberculosis
gccguguaggccgcgcuggcc

SEQ ID NO: 888688 - RNA, 14 nt, Mycobacterium avium subsp. paratuberculosis
gccgugguuggcga

SEQ ID NO: 888689 - RNA, 15 nt, Mycobacterium avium subsp. paratuberculosis
gccguggucggcgaa

SEQ ID NO: 888690 - RNA, 16 nt, Mycobacterium avium subsp. paratuberculosis
gccguggucggcgaac

SEQ ID NO: 888691 - RNA, 14 nt, Mycobacterium avium subsp. paratuberculosis
gccguggucggugc

SEQ ID NO: 888692 - RNA, 15 nt, Mycobacterium avium subsp. paratuberculosis
gccguggucggugcc

SEQ ID NO: 888693 - RNA, 18 nt, Mycobacterium avium subsp. paratuberculosis
gccgugugcgcaucggcg

SEQ ID NO: 888694 - RNA, 21 nt, Mycobacterium avium subsp. paratuberculosis
gccgugugcgcaucggcgacg

SEQ ID NO: 888695 - RNA, 23 nt, Mycobacterium avium subsp. paratuberculosis
gccgugugcgcaucggcgacgcc

SEQ ID NO: 888696 - RNA, 16 nt, Mycobacterium avium subsp. paratuberculosis
gccguggcaccgggug

SEQ ID NO: 888697 - RNA, 14 nt, Mycobacterium avium subsp. paratuberculosis
gccguggcagggcc

SEQ ID NO: 888698 - RNA, 21 nt, Mycobacterium avium subsp. paratuberculosis
gccguggcagggccagcagcc

SEQ ID NO: 888699 - RNA, 17 nt, Mycobacterium avium subsp. paratuberculosis
gccguggccgucacgcu

SEQ ID NO: 888700 - RNA, 14 nt, Mycobacterium avium subsp. paratuberculosis
gccguggcgaacuc

SEQ ID NO: 888701 - RNA, 18 nt, Mycobacterium avium subsp. paratuberculosis
gccguggcgaacucgacg

SEQ ID NO: 888702 - RNA, 13 nt, Mycobacterium avium subsp. paratuberculosis
gccguggcccgcc

SEQ ID NO: 888703 - RNA, 14 nt, Mycobacterium avium subsp. paratuberculosis
gccguggcccgccc

SEQ ID NO: 888704 - RNA, 18 nt, Mycobacterium avium subsp. paratuberculosis
gccguggcccggucggag

SEQ ID NO: 888705 - RNA, 14 nt, Mycobacterium avium subsp. paratuberculosis
gccguggcggcccg

SEQ ID NO: 888706 - RNA, 15 nt, Mycobacterium avium subsp. paratuberculosis
gccguggcggcccga

SEQ ID NO: 888707 - RNA, 13 nt, Mycobacterium avium subsp. paratuberculosis
gccguggcggcgg

SEQ ID NO: 888708 - RNA, 14 nt, Mycobacterium avium subsp. paratuberculosis
gccguggcggcggg

SEQ ID NO: 888709 - RNA, 18 nt, Mycobacterium avium subsp. paratuberculosis
gccguggcggcgggccag

SEQ ID NO: 888710 - RNA, 23 nt, Mycobacterium avium subsp. paratuberculosis
gccguggcggcgggccagcucgu

SEQ ID NO: 888711 - RNA, 15 nt, Mycobacterium avium subsp. paratuberculosis
gccguggcggcggug

SEQ ID NO: 888712 - RNA, 14 nt, Mycobacterium avium subsp. paratuberculosis
gccgugggggucga

SEQ ID NO: 888713 - RNA, 22 nt, Mycobacterium avium subsp. paratuberculosis
gccgugggggucgacccgccgc

SEQ ID NO: 888714 - RNA, 17 nt, Mycobacterium avium subsp. paratuberculosis
gccgugggugccgacga

SEQ ID NO: 888715 - RNA, 21 nt, Mycobacterium avium subsp. paratuberculosis
gccgugggugccgacgagcuc

SEQ ID NO: 888716 - RNA, 19 nt, Mycobacterium avium subsp. paratuberculosis
gccguggucaacggcaccg

SEQ ID NO: 888717 - RNA, 22 nt, Mycobacterium avium subsp. paratuberculosis
gccguggucaacggcaccgaca

SEQ ID NO: 888718 - RNA, 13 nt, Mycobacterium avium subsp. paratuberculosis
gccgugguccagc

SEQ ID NO: 888719 - RNA, 15 nt, Mycobacterium avium subsp. paratuberculosis
gccgugguccagccg

SEQ ID NO: 888720 - RNA, 18 nt, Mycobacterium avium subsp. paratuberculosis
gccgucgggacgcggcag

SEQ ID NO: 888721 - RNA, 22 nt, Mycobacterium avium subsp. paratuberculosis
gccgucgggacgcggcaggcgc

SEQ ID NO: 888722 - RNA, 13 nt, Mycobacterium avium subsp. paratuberculosis
gccgucggggaug

SEQ ID NO: 888723 - RNA, 13 nt, Mycobacterium avium subsp. paratuberculosis
gccgucggggcgu

SEQ ID NO: 888724 - RNA, 16 nt, Mycobacterium avium subsp. paratuberculosis
gccgucggggcgucgg

SEQ ID NO: 888725 - RNA, 20 nt, Mycobacterium avium subsp. paratuberculosis
gccgucggggcgucggcggc

SEQ ID NO: 888726 - RNA, 16 nt, Mycobacterium avium subsp. paratuberculosis
gccgucggcgucgacg

SEQ ID NO: 888727 - RNA, 14 nt, Mycobacterium avium subsp. paratuberculosis
gccgucggcgucgg

SEQ ID NO: 888728 - RNA, 16 nt, Mycobacterium avium subsp. paratuberculosis
gccgucggcguucagc

SEQ ID NO: 888729 - RNA, 15 nt, Mycobacterium avium subsp. paratuberculosis
gccgucgggucggcg

SEQ ID NO: 888730 - RNA, 17 nt, Mycobacterium avium subsp. paratuberculosis
gccgucggggucgcgcc

SEQ ID NO: 888731 - RNA, 18 nt, Mycobacterium avium subsp. paratuberculosis
gccgucggggucgcgccg

SEQ ID NO: 888732 - RNA, 20 nt, Mycobacterium avium subsp. paratuberculosis
gccgucggggucgcgccggu

SEQ ID NO: 888733 - RNA, 20 nt, Mycobacterium avium subsp. paratuberculosis
gccgucggggugcggucggc

SEQ ID NO: 888734 - RNA, 17 nt, Mycobacterium avium subsp. paratuberculosis
gccgugcagcgcccagc

SEQ ID NO: 888735 - RNA, 18 nt, Mycobacterium avium subsp. paratuberculosis
gccgugcagcgcccagcc

SEQ ID NO: 888736 - RNA, 24 nt, Mycobacterium avium subsp. paratuberculosis
gccgugcagcgcccagccgagccg

SEQ ID NO: 888737 - RNA, 14 nt, Mycobacterium avium subsp. paratuberculosis
gccgucgguguagc

SEQ ID NO: 888738 - RNA, 14 nt, Mycobacterium avium subsp. paratuberculosis
gccgucgguggucc

SEQ ID NO: 888739 - RNA, 24 nt, Mycobacterium avium subsp. paratuberculosis
gccgucggugguccagucgauagu

SEQ ID NO: 888740 - RNA, 13 nt, Mycobacterium avium subsp. paratuberculosis
gccgucggcgucg

SEQ ID NO: 888741 - RNA, 22 nt, Mycobacterium avium subsp. paratuberculosis
gccgucggugaugacguagucg

SEQ ID NO: 888742 - RNA, 22 nt, Mycobacterium avium subsp. paratuberculosis
gccgucggugcgcuccucgacg

SEQ ID NO: 888743 - RNA, 23 nt, Mycobacterium avium subsp. paratuberculosis
gccgucggugcgcuccucgacgu

SEQ ID NO: 888744 - RNA, 22 nt, Mycobacterium avium subsp. paratuberculosis
gccgucggugcgguaggugccg

SEQ ID NO: 888745 - RNA, 11 nt, Mycobacterium avium subsp. paratuberculosis
gccgucggugg

SEQ ID NO: 888746 - RNA, 14 nt, Mycobacterium avium subsp. paratuberculosis
gccgucgguggccg

SEQ ID NO: 888747 - RNA, 16 nt, Mycobacterium avium subsp. paratuberculosis
gccgucgguggccggu

SEQ ID NO: 888748 - RNA, 17 nt, Mycobacterium avium subsp. paratuberculosis
gccgucgguggccggua

SEQ ID NO: 888749 - RNA, 13 nt, Mycobacterium avium subsp. paratuberculosis
gccgugccgcgcg

SEQ ID NO: 888750 - RNA, 21 nt, Mycobacterium avium subsp. paratuberculosis
gccguggaagauguugccgcc

SEQ ID NO: 888751 - RNA, 12 nt, Mycobacterium avium subsp. paratuberculosis
gccgugcugggc

SEQ ID NO: 888752 - RNA, 13 nt, Mycobacterium avium subsp. paratuberculosis
gccgugcugggcg

SEQ ID NO: 888753 - RNA, 14 nt, Mycobacterium avium subsp. paratuberculosis
gccgugccgcgcgg

SEQ ID NO: 888754 - RNA, 13 nt, Mycobacterium avium subsp. paratuberculosis
gccgugccggacc

SEQ ID NO: 888755 - RNA, 14 nt, Mycobacterium avium subsp. paratuberculosis
gccgugccggaccg

SEQ ID NO: 888756 - RNA, 15 nt, Mycobacterium avium subsp. paratuberculosis
gccgugccggaccgc

SEQ ID NO: 888757 - RNA, 17 nt, Mycobacterium avium subsp. paratuberculosis
gccgugccggaccgcgc

SEQ ID NO: 888758 - RNA, 13 nt, Mycobacterium avium subsp. paratuberculosis
gccgugcccgcgg

SEQ ID NO: 888759 - RNA, 14 nt, Mycobacterium avium subsp. paratuberculosis
gccgugcccgcggg

SEQ ID NO: 888760 - RNA, 18 nt, Mycobacterium avium subsp. paratuberculosis
gccgugccgauuccagca

SEQ ID NO: 888761 - RNA, 15 nt, Mycobacterium avium subsp. paratuberculosis
gccgugccagccggc

SEQ ID NO: 888762 - RNA, 17 nt, Mycobacterium avium subsp. paratuberculosis
gccgugccagccggccg

SEQ ID NO: 888763 - RNA, 21 nt, Mycobacterium avium subsp. paratuberculosis
gccgugcaucgggcgcucggc

SEQ ID NO: 888764 - RNA, 22 nt, Mycobacterium avium subsp. paratuberculosis
gccgugcccaacacgccccgac

SEQ ID NO: 888765 - RNA, 21 nt, Mycobacterium avium subsp. paratuberculosis
gccgugcccaauagcacccgc

SEQ ID NO: 888766 - RNA, 23 nt, Mycobacterium avium subsp. paratuberculosis
gccuaauucguuguuggcggugg

SEQ ID NO: 888767 - RNA, 16 nt, Mycobacterium avium subsp. paratuberculosis
gccguuuugccgccga

SEQ ID NO: 888768 - RNA, 17 nt, Mycobacterium avium subsp. paratuberculosis
gccguuuugccgccgag

SEQ ID NO: 888769 - RNA, 14 nt, Mycobacterium avium subsp. paratuberculosis
gccguucucgcgca

SEQ ID NO: 888770 - RNA, 16 nt, Mycobacterium avium subsp. paratuberculosis
gccguucucgcgcagg

SEQ ID NO: 888771 - RNA, 15 nt, Mycobacterium avium subsp. paratuberculosis
gccguuucagcagcg

SEQ ID NO: 888772 - RNA, 18 nt, Mycobacterium avium subsp. paratuberculosis
gccguuugaugccguccg

SEQ ID NO: 888773 - RNA, 16 nt, Mycobacterium avium subsp. paratuberculosis
gccguuuggcgccgcc

SEQ ID NO: 888774 - RNA, 18 nt, Mycobacterium avium subsp. paratuberculosis
gccguuuggcgccgccca

SEQ ID NO: 888775 - RNA, 23 nt, Mycobacterium avium subsp. paratuberculosis
gccguuccagggugucgacgaug

SEQ ID NO: 888776 - RNA, 20 nt, Mycobacterium avium subsp. paratuberculosis
gccguucguagggacugcgc

SEQ ID NO: 888777 - RNA, 14 nt, Mycobacterium avium subsp. paratuberculosis
gccguucggccagc

SEQ ID NO: 888778 - RNA, 17 nt, Mycobacterium avium subsp. paratuberculosis
gccguucggccagcgcc

SEQ ID NO: 888779 - RNA, 22 nt, Mycobacterium avium subsp. paratuberculosis
gccguucggccagcgccgccag

SEQ ID NO: 888780 - RNA, 14 nt, Mycobacterium avium subsp. paratuberculosis
gccguucgccggcc

SEQ ID NO: 888781 - RNA, 20 nt, Mycobacterium avium subsp. paratuberculosis
gccguucgccggccagcacg

SEQ ID NO: 888782 - RNA, 15 nt, Mycobacterium avium subsp. paratuberculosis
gccguucgccggcga

SEQ ID NO: 888783 - RNA, 17 nt, Mycobacterium avium subsp. paratuberculosis
gccguucgccggcgacg

SEQ ID NO: 888784 - RNA, 19 nt, Mycobacterium avium subsp. paratuberculosis
gccguucgccggcgacggc

SEQ ID NO: 888785 - RNA, 21 nt, Mycobacterium avium subsp. paratuberculosis
gccguucgcgcacggcgcgca

SEQ ID NO: 888786 - RNA, 19 nt, Mycobacterium avium subsp. paratuberculosis
gccguucccggcagaacga

SEQ ID NO: 888787 - RNA, 15 nt, Mycobacterium avium subsp. paratuberculosis
gccguuccaucgggc

SEQ ID NO: 888788 - RNA, 18 nt, Mycobacterium avium subsp. paratuberculosis
gccguuccaucgggccca

SEQ ID NO: 888789 - RNA, 14 nt, Mycobacterium avium subsp. paratuberculosis
gccguuccagccgg

SEQ ID NO: 888790 - RNA, 15 nt, Mycobacterium avium subsp. paratuberculosis
gccguuccagccggc

SEQ ID NO: 888791 - RNA, 17 nt, Mycobacterium avium subsp. paratuberculosis
gccguuccagccggccc

SEQ ID NO: 888792 - RNA, 14 nt, Mycobacterium avium subsp. paratuberculosis
gccguucaggucga

SEQ ID NO: 888793 - RNA, 14 nt, Mycobacterium avium subsp. paratuberculosis
gccguucagcgcgg

SEQ ID NO: 888794 - RNA, 21 nt, Mycobacterium avium subsp. paratuberculosis
gccguucagcgggcgguugcc

SEQ ID NO: 888795 - RNA, 17 nt, Mycobacterium avium subsp. paratuberculosis
gccuacaggugccggcg

SEQ ID NO: 888796 - RNA, 19 nt, Mycobacterium avium subsp. paratuberculosis
gccuacaggugccggcggc

SEQ ID NO: 888797 - RNA, 14 nt, Mycobacterium avium subsp. paratuberculosis
gccuaccggguggc

SEQ ID NO: 888798 - RNA, 19 nt, Mycobacterium avium subsp. paratuberculosis
gccuaccggguggccagca

SEQ ID NO: 888799 - RNA, 22 nt, Mycobacterium avium subsp. paratuberculosis
gccuaccggguggccagcacca

SEQ ID NO: 888800 - RNA, 19 nt, Mycobacterium avium subsp. paratuberculosis
gccuacgacauccugcgca

SEQ ID NO: 888801 - RNA, 15 nt, Mycobacterium avium subsp. paratuberculosis
gccucaggcgucggu

SEQ ID NO: 888802 - RNA, 19 nt, Mycobacterium avium subsp. paratuberculosis
gccucaggcugacgccacg

SEQ ID NO: 888803 - RNA, 15 nt, Mycobacterium avium subsp. paratuberculosis
gccucagggcgcgcu

SEQ ID NO: 888804 - RNA, 21 nt, Mycobacterium avium subsp. paratuberculosis
gccucagcgcgcaacgacgaa

SEQ ID NO: 888805 - RNA, 12 nt, Mycobacterium avium subsp. paratuberculosis
gccuacggcgcc

SEQ ID NO: 888806 - RNA, 13 nt, Mycobacterium avium subsp. paratuberculosis
gccuacggcgccg

SEQ ID NO: 888807 - RNA, 15 nt, Mycobacterium avium subsp. paratuberculosis
gccuacggcgccggu

SEQ ID NO: 888808 - RNA, 20 nt, Mycobacterium avium subsp. paratuberculosis
gccucaugccagacgcgcac

SEQ ID NO: 888809 - RNA, 21 nt, Mycobacterium avium subsp. paratuberculosis
gccuccaacccaaccugugcc

SEQ ID NO: 888810 - RNA, 18 nt, Mycobacterium avium subsp. paratuberculosis
gccuccacauacgcggcg

SEQ ID NO: 888811 - RNA, 20 nt, Mycobacterium avium subsp. paratuberculosis
gccuccacauacgcggcggc

SEQ ID NO: 888812 - RNA, 21 nt, Mycobacterium avium subsp. paratuberculosis
gccuccacauacgcggcggcc

SEQ ID NO: 888813 - RNA, 13 nt, Mycobacterium avium subsp. paratuberculosis
gccuccaccagcg

SEQ ID NO: 888814 - RNA, 19 nt, Mycobacterium avium subsp. paratuberculosis
gccucaguccgacgcgacg

SEQ ID NO: 888815 - RNA, 13 nt, Mycobacterium avium subsp. paratuberculosis
gccuccagccagc

SEQ ID NO: 888816 - RNA, 17 nt, Mycobacterium avium subsp. paratuberculosis
gccuccagccagcgcgc

SEQ ID NO: 888817 - RNA, 19 nt, Mycobacterium avium subsp. paratuberculosis
gccuccagccagcgcgcga

SEQ ID NO: 888818 - RNA, 20 nt, Mycobacterium avium subsp. paratuberculosis
gccuccagccagcgcgcgau

SEQ ID NO: 888819 - RNA, 13 nt, Mycobacterium avium subsp. paratuberculosis
gccuccagccgcg

SEQ ID NO: 888820 - RNA, 14 nt, Mycobacterium avium subsp. paratuberculosis
gccuccagccgcgc

SEQ ID NO: 888821 - RNA, 13 nt, Mycobacterium avium subsp. paratuberculosis
gccuccagccgcu

SEQ ID NO: 888822 - RNA, 14 nt, Mycobacterium avium subsp. paratuberculosis
gccuccagccgcuc

SEQ ID NO: 888823 - RNA, 17 nt, Mycobacterium avium subsp. paratuberculosis
gccuccagccgcuccgc

SEQ ID NO: 888824 - RNA, 13 nt, Mycobacterium avium subsp. paratuberculosis
gccuccagccggc

SEQ ID NO: 888825 - RNA, 16 nt, Mycobacterium avium subsp. paratuberculosis
gccuccaccagcggcg

SEQ ID NO: 888826 - RNA, 22 nt, Mycobacterium avium subsp. paratuberculosis
gccuccaccagcggcgcgucgc

SEQ ID NO: 888827 - RNA, 18 nt, Mycobacterium avium subsp. paratuberculosis
gccuccaccggcaaucgg

SEQ ID NO: 888828 - RNA, 21 nt, Mycobacterium avium subsp. paratuberculosis
gccuccaccggcaaucgggac

SEQ ID NO: 888829 - RNA, 18 nt, Mycobacterium avium subsp. paratuberculosis
gccuccacgucaccgacg

SEQ ID NO: 888830 - RNA, 19 nt, Mycobacterium avium subsp. paratuberculosis
gccuccacgucaccgacgc

SEQ ID NO: 888831 - RNA, 14 nt, Mycobacterium avium subsp. paratuberculosis
ucggauggugccca

SEQ ID NO: 888832 - RNA, 18 nt, Mycobacterium avium subsp. paratuberculosis
ucggaucgaaggcgugcu

SEQ ID NO: 888833 - RNA, 18 nt, Mycobacterium avium subsp. paratuberculosis
ucggaugaccaagccccg

SEQ ID NO: 888834 - RNA, 19 nt, Mycobacterium avium subsp. paratuberculosis
ucggauucggguggcgucg

SEQ ID NO: 888835 - RNA, 12 nt, Mycobacterium avium subsp. paratuberculosis
ucggauucgucg

SEQ ID NO: 888836 - RNA, 14 nt, Mycobacterium avium subsp. paratuberculosis
ucggauucgucggu

SEQ ID NO: 888837 - RNA, 17 nt, Mycobacterium avium subsp. paratuberculosis
ucggauucgucggucac

SEQ ID NO: 888838 - RNA, 17 nt, Mycobacterium avium subsp. paratuberculosis
ucggcagccccgucggu

SEQ ID NO: 888839 - RNA, 23 nt, Mycobacterium avium subsp. paratuberculosis
ucggcagcccggaggcgaugcgg

SEQ ID NO: 888840 - RNA, 17 nt, Mycobacterium avium subsp. paratuberculosis
ucggcagcaccggcagc

SEQ ID NO: 888841 - RNA, 17 nt, Mycobacterium avium subsp. paratuberculosis
ucggcaucgcgcgcggc

SEQ ID NO: 888842 - RNA, 20 nt, Mycobacterium avium subsp. paratuberculosis
ucggcaucgcgcgcggcgac

SEQ ID NO: 888843 - RNA, 14 nt, Mycobacterium avium subsp. paratuberculosis
ucggcaguccgcgc

SEQ ID NO: 888844 - RNA, 20 nt, Mycobacterium avium subsp. paratuberculosis
ucggcaguugcacuuucgcg

SEQ ID NO: 888845 - RNA, 15 nt, Mycobacterium avium subsp. paratuberculosis
ucggcaggucgucga

SEQ ID NO: 888846 - RNA, 17 nt, Mycobacterium avium subsp. paratuberculosis
ucggcagguugucgcug

SEQ ID NO: 888847 - RNA, 20 nt, Mycobacterium avium subsp. paratuberculosis
ucggcaguagcacuuucgcg

SEQ ID NO: 888848 - RNA, 12 nt, Mycobacterium avium subsp. paratuberculosis
ucggcaggcggg

SEQ ID NO: 888849 - RNA, 13 nt, Mycobacterium avium subsp. paratuberculosis
ucggcaggauccg

SEQ ID NO: 888850 - RNA, 19 nt, Mycobacterium avium subsp. paratuberculosis
ucggcaggauccggacgac

SEQ ID NO: 888851 - RNA, 23 nt, Mycobacterium avium subsp. paratuberculosis
ucggcaggauccggucgaucacc

SEQ ID NO: 888852 - RNA, 23 nt, Mycobacterium avium subsp. paratuberculosis
ucggcagcugaagugcacucggc

SEQ ID NO: 888853 - RNA, 22 nt, Mycobacterium avium subsp. paratuberculosis
ucggcaggaaagcgcuuucgcu

SEQ ID NO: 888854 - RNA, 20 nt, Mycobacterium avium subsp. paratuberculosis
ucggcaggaaguucuucgcg

SEQ ID NO: 888855 - RNA, 15 nt, Mycobacterium avium subsp. paratuberculosis
ucggccagcgagucc

SEQ ID NO: 888856 - RNA, 16 nt, Mycobacterium avium subsp. paratuberculosis
ucggccagccggggga

SEQ ID NO: 888857 - RNA, 21 nt, Mycobacterium avium subsp. paratuberculosis
ucggccagccgggggaucacc

SEQ ID NO: 888858 - RNA, 18 nt, Mycobacterium avium subsp. paratuberculosis
ucggccagcgccgcccgg

SEQ ID NO: 888859 - RNA, 23 nt, Mycobacterium avium subsp. paratuberculosis
ucggccagcgccgcccgggcggc

SEQ ID NO: 888860 - RNA, 15 nt, Mycobacterium avium subsp. paratuberculosis
ucggccagcgccgcc

SEQ ID NO: 888861 - RNA, 17 nt, Mycobacterium avium subsp. paratuberculosis
ucggccagcgcgccgca

SEQ ID NO: 888862 - RNA, 20 nt, Mycobacterium avium subsp. paratuberculosis
ucggccagcgcgccgcacag

SEQ ID NO: 888863 - RNA, 17 nt, Mycobacterium avium subsp. paratuberculosis
ucggccagcgcgcgcag

SEQ ID NO: 888864 - RNA, 20 nt, Mycobacterium avium subsp. paratuberculosis
ucggccagccacgccgacac

SEQ ID NO: 888865 - RNA, 22 nt, Mycobacterium avium subsp. paratuberculosis
ucggccagccacgccgacaccg

SEQ ID NO: 888866 - RNA, 19 nt, Mycobacterium avium subsp. paratuberculosis
ucggccagcaggucgaagg

SEQ ID NO: 888867 - RNA, 22 nt, Mycobacterium avium subsp. paratuberculosis
ucggccagcaggucgucgacgu

SEQ ID NO: 888868 - RNA, 23 nt, Mycobacterium avium subsp. paratuberculosis
ucggccagcaggucgucgacguc

SEQ ID NO: 888869 - RNA, 21 nt, Mycobacterium avium subsp. paratuberculosis
ucggccagcagcgcgucgcgg

SEQ ID NO: 888870 - RNA, 15 nt, Mycobacterium avium subsp. paratuberculosis
ucggccagcgcgcgg

SEQ ID NO: 888871 - RNA, 16 nt, Mycobacterium avium subsp. paratuberculosis
ucggccagcgcggccg

SEQ ID NO: 888872 - RNA, 15 nt, Mycobacterium avium subsp. paratuberculosis
ucggccagcgcggcg

SEQ ID NO: 888873 - RNA, 17 nt, Mycobacterium avium subsp. paratuberculosis
ucggccauccgggcggc

SEQ ID NO: 888874 - RNA, 18 nt, Mycobacterium avium subsp. paratuberculosis
ucggccauccgggcggca

SEQ ID NO: 888875 - RNA, 22 nt, Mycobacterium avium subsp. paratuberculosis
ucggccaucgacuccaccaccu

SEQ ID NO: 888876 - RNA, 17 nt, Mycobacterium avium subsp. paratuberculosis
ucggccagcgcggcggc

SEQ ID NO: 888877 - RNA, 14 nt, Mycobacterium avium subsp. paratuberculosis
ucggccagcgcggu

SEQ ID NO: 888878 - RNA, 22 nt, Mycobacterium avium subsp. paratuberculosis
ucggccagcgcggugugcggcg

SEQ ID NO: 888879 - RNA, 21 nt, Mycobacterium avium subsp. paratuberculosis
ucggccagcgcgucggccagc

SEQ ID NO: 888880 - RNA, 22 nt, Mycobacterium avium subsp. paratuberculosis
ucggccagcgcgucggccagca

SEQ ID NO: 888881 - RNA, 12 nt, Mycobacterium avium subsp. paratuberculosis
ucggccagcggc

SEQ ID NO: 888882 - RNA, 13 nt, Mycobacterium avium subsp. paratuberculosis
ucggccagcggca

SEQ ID NO: 888883 - RNA, 13 nt, Mycobacterium avium subsp. paratuberculosis
ucggcccggccaa

SEQ ID NO: 888884 - RNA, 19 nt, Mycobacterium avium subsp. paratuberculosis
ucggccggauucucgcccg

SEQ ID NO: 888885 - RNA, 20 nt, Mycobacterium avium subsp. paratuberculosis
ucggccggauucucgcccgg

SEQ ID NO: 888886 - RNA, 12 nt, Mycobacterium avium subsp. paratuberculosis
ucggccggcacc

SEQ ID NO: 888887 - RNA, 14 nt, Mycobacterium avium subsp. paratuberculosis
ucggccggcaccuc

SEQ ID NO: 888888 - RNA, 13 nt, Mycobacterium avium subsp. paratuberculosis
ucggccggcagcg

SEQ ID NO: 888889 - RNA, 13 nt, Mycobacterium avium subsp. paratuberculosis
ucggccggcaggc

SEQ ID NO: 888890 - RNA, 21 nt, Mycobacterium avium subsp. paratuberculosis
ucggccggccccgcccggcgc

SEQ ID NO: 888891 - RNA, 22 nt, Mycobacterium avium subsp. paratuberculosis
ucggccggccccgcccggcgcg

SEQ ID NO: 888892 - RNA, 19 nt, Mycobacterium avium subsp. paratuberculosis
ucggccggcagcggugccg

SEQ ID NO: 888893 - RNA, 22 nt, Mycobacterium avium subsp. paratuberculosis
ucggccggcuugaucucgaccu

SEQ ID NO: 888894 - RNA, 20 nt, Mycobacterium avium subsp. paratuberculosis
ucggccgggagauacggucg

SEQ ID NO: 888895 - RNA, 12 nt, Mycobacterium avium subsp. paratuberculosis
ucggccggcggg

SEQ ID NO: 888896 - RNA, 13 nt, Mycobacterium avium subsp. paratuberculosis
ucggccggggcga

SEQ ID NO: 888897 - RNA, 14 nt, Mycobacterium avium subsp. paratuberculosis
ucggccggggcgac

SEQ ID NO: 888898 - RNA, 19 nt, Mycobacterium avium subsp. paratuberculosis
ucggccggggcgaccagua

SEQ ID NO: 888899 - RNA, 13 nt, Mycobacterium avium subsp. paratuberculosis
ucggccgggggcg

SEQ ID NO: 888900 - RNA, 19 nt, Mycobacterium avium subsp. paratuberculosis
ucggccgggggcgcgggcg

SEQ ID NO: 888901 - RNA, 22 nt, Mycobacterium avium subsp. paratuberculosis
ucggccgggggcgcgggcggca

SEQ ID NO: 888902 - RNA, 19 nt, Mycobacterium avium subsp. paratuberculosis
ucggcccgaucucgcgcgg

SEQ ID NO: 888903 - RNA, 23 nt, Mycobacterium avium subsp. paratuberculosis
ucggcccgccaguucccggccag

SEQ ID NO: 888904 - RNA, 14 nt, Mycobacterium avium subsp. paratuberculosis
ucggcccgccgggc

SEQ ID NO: 888905 - RNA, 16 nt, Mycobacterium avium subsp. paratuberculosis
ucggcccgccgggccg

SEQ ID NO: 888906 - RNA, 17 nt, Mycobacterium avium subsp. paratuberculosis
ucggcccgccgggcgcc

SEQ ID NO: 888907 - RNA, 15 nt, Mycobacterium avium subsp. paratuberculosis
ucggcccgcuccccg

SEQ ID NO: 888908 - RNA, 23 nt, Mycobacterium avium subsp. paratuberculosis
ucggcccgcuccccguugcggag

SEQ ID NO: 888909 - RNA, 18 nt, Mycobacterium avium subsp. paratuberculosis
ucggcccgcugcgcggcc

SEQ ID NO: 888910 - RNA, 14 nt, Mycobacterium avium subsp. paratuberculosis
ucggcccgcugcgg

SEQ ID NO: 888911 - RNA, 16 nt, Mycobacterium avium subsp. paratuberculosis
ucggcccgcugcggcu

SEQ ID NO: 888912 - RNA, 20 nt, Mycobacterium avium subsp. paratuberculosis
ucggcccgcugcggcuggga

SEQ ID NO: 888913 - RNA, 17 nt, Mycobacterium avium subsp. paratuberculosis
ucggcccccgggcccga

SEQ ID NO: 888914 - RNA, 15 nt, Mycobacterium avium subsp. paratuberculosis
ucggccccgcgcauc

SEQ ID NO: 888915 - RNA, 23 nt, Mycobacterium avium subsp. paratuberculosis
ucggccccgcgcaucggucagca

SEQ ID NO: 888916 - RNA, 13 nt, Mycobacterium avium subsp. paratuberculosis
ucggccccggccg

SEQ ID NO: 888917 - RNA, 22 nt, Mycobacterium avium subsp. paratuberculosis
ucggcccagacgaugucgucgc

SEQ ID NO: 888918 - RNA, 21 nt, Mycobacterium avium subsp. paratuberculosis
ucggcccgagugugcauccug

SEQ ID NO: 888919 - RNA, 13 nt, Mycobacterium avium subsp. paratuberculosis
ucggaaucggcgc

SEQ ID NO: 888920 - RNA, 18 nt, Mycobacterium avium subsp. paratuberculosis
ucggacaccucggccagc

SEQ ID NO: 888921 - RNA, 19 nt, Mycobacterium avium subsp. paratuberculosis
ucggacaccucggccagcg

SEQ ID NO: 888922 - RNA, 21 nt, Mycobacterium avium subsp. paratuberculosis
ucggacaccucggccagcgcc

SEQ ID NO: 888923 - RNA, 22 nt, Mycobacterium avium subsp. paratuberculosis
ucggacaccucggccagcgccg

SEQ ID NO: 888924 - RNA, 14 nt, Mycobacterium avium subsp. paratuberculosis
ucggacacggcgcc

SEQ ID NO: 888925 - RNA, 15 nt, Mycobacterium avium subsp. paratuberculosis
ucggacaugccggcg

SEQ ID NO: 888926 - RNA, 16 nt, Mycobacterium avium subsp. paratuberculosis
ucggacaugccggcgc

SEQ ID NO: 888927 - RNA, 17 nt, Mycobacterium avium subsp. paratuberculosis
ucggacaugccggcgcc

SEQ ID NO: 888928 - RNA, 18 nt, Mycobacterium avium subsp. paratuberculosis
ucggacaugccggcgccg

SEQ ID NO: 888929 - RNA, 17 nt, Mycobacterium avium subsp. paratuberculosis
ucggagacguggcggcg

SEQ ID NO: 888930 - RNA, 19 nt, Mycobacterium avium subsp. paratuberculosis
ucggagacguggcggcggu

SEQ ID NO: 888931 - RNA, 23 nt, Mycobacterium avium subsp. paratuberculosis
ucggagacguugccgcacaccgc

SEQ ID NO: 888932 - RNA, 22 nt, Mycobacterium avium subsp. paratuberculosis
ucggaaaagugggucagccacg

SEQ ID NO: 888933 - RNA, 20 nt, Mycobacterium avium subsp. paratuberculosis
ucgcuguccucgagcgcguc

SEQ ID NO: 888934 - RNA, 22 nt, Mycobacterium avium subsp. paratuberculosis
ucggaguggaacagccggauca

SEQ ID NO: 888935 - RNA, 23 nt, Mycobacterium avium subsp. paratuberculosis
ucggaguggaacagccggaucag

SEQ ID NO: 888936 - RNA, 15 nt, Mycobacterium avium subsp. paratuberculosis
ucggaguccaccggc

SEQ ID NO: 888937 - RNA, 14 nt, Mycobacterium avium subsp. paratuberculosis
ucggagccgucggu

SEQ ID NO: 888938 - RNA, 16 nt, Mycobacterium avium subsp. paratuberculosis
ucggagcgcuccacca

SEQ ID NO: 888939 - RNA, 15 nt, Mycobacterium avium subsp. paratuberculosis
ucggagaucaccggc

SEQ ID NO: 888940 - RNA, 16 nt, Mycobacterium avium subsp. paratuberculosis
ucggaggaaccgugcg

SEQ ID NO: 888941 - RNA, 17 nt, Mycobacterium avium subsp. paratuberculosis
ucggaggacaacgcguc

SEQ ID NO: 888942 - RNA, 14 nt, Mycobacterium avium subsp. paratuberculosis
ucggaggccaccgc

SEQ ID NO: 888943 - RNA, 20 nt, Mycobacterium avium subsp. paratuberculosis
ucggaggucagcagggugac

SEQ ID NO: 888944 - RNA, 20 nt, Mycobacterium avium subsp. paratuberculosis
ucggaggugccgcgcggcag

SEQ ID NO: 888945 - RNA, 20 nt, Mycobacterium avium subsp. paratuberculosis
ucggacagguggccgaucag

SEQ ID NO: 888946 - RNA, 19 nt, Mycobacterium avium subsp. paratuberculosis
ucggacagcagcaccggca

SEQ ID NO: 888947 - RNA, 20 nt, Mycobacterium avium subsp. paratuberculosis
ucggagaugauggccgcgcc

SEQ ID NO: 888948 - RNA, 15 nt, Mycobacterium avium subsp. paratuberculosis
ucggagaugcgggcc

SEQ ID NO: 888949 - RNA, 20 nt, Mycobacterium avium subsp. paratuberculosis
ucggagaugcgggccaccgu

SEQ ID NO: 888950 - RNA, 18 nt, Mycobacterium avium subsp. paratuberculosis
ucggagcaaauccggcag

SEQ ID NO: 888951 - RNA, 21 nt, Mycobacterium avium subsp. paratuberculosis
ucgcugcaguagccggccagc

SEQ ID NO: 888952 - RNA, 15 nt, Mycobacterium avium subsp. paratuberculosis
ucgcugcagcggcgg

SEQ ID NO: 888953 - RNA, 16 nt, Mycobacterium avium subsp. paratuberculosis
ucgcugcagcggcggc

SEQ ID NO: 888954 - RNA, 14 nt, Mycobacterium avium subsp. paratuberculosis
ucgcugccccggcg

SEQ ID NO: 888955 - RNA, 20 nt, Mycobacterium avium subsp. paratuberculosis
ucgcugcccucggucgccga

SEQ ID NO: 888956 - RNA, 23 nt, Mycobacterium avium subsp. paratuberculosis
ucgcugcccucggucgccgaauc

SEQ ID NO: 888957 - RNA, 12 nt, Mycobacterium avium subsp. paratuberculosis
ucgcugccgccg

SEQ ID NO: 888958 - RNA, 13 nt, Mycobacterium avium subsp. paratuberculosis
ucgcugccgccgc

SEQ ID NO: 888959 - RNA, 21 nt, Mycobacterium avium subsp. paratuberculosis
ucgcugagcaauucggugacg

SEQ ID NO: 888960 - RNA, 20 nt, Mycobacterium avium subsp. paratuberculosis
ucgcugagcgggacgcgcag

SEQ ID NO: 888961 - RNA, 17 nt, Mycobacterium avium subsp. paratuberculosis
ucgcugaucugcggcac

SEQ ID NO: 888962 - RNA, 13 nt, Mycobacterium avium subsp. paratuberculosis
ucgcuggccgcga

SEQ ID NO: 888963 - RNA, 22 nt, Mycobacterium avium subsp. paratuberculosis
ucgcugggcucgagugccggca

SEQ ID NO: 888964 - RNA, 13 nt, Mycobacterium avium subsp. paratuberculosis
ucgcuggucgcga

SEQ ID NO: 888965 - RNA, 21 nt, Mycobacterium avium subsp. paratuberculosis
ucgcugguggccgacgugccg

SEQ ID NO: 888966 - RNA, 17 nt, Mycobacterium avium subsp. paratuberculosis
ucgcuguagagcaguuc

SEQ ID NO: 888967 - RNA, 13 nt, Mycobacterium avium subsp. paratuberculosis
ucgcugacgccga

SEQ ID NO: 888968 - RNA, 18 nt, Mycobacterium avium subsp. paratuberculosis
ucgcugaccccgcucggc

SEQ ID NO: 888969 - RNA, 19 nt, Mycobacterium avium subsp. paratuberculosis
ucgcugaccccgcucggcg

SEQ ID NO: 888970 - RNA, 19 nt, Mycobacterium avium subsp. paratuberculosis
ucgcugacccgccgcaaca

SEQ ID NO: 888971 - RNA, 16 nt, Mycobacterium avium subsp. paratuberculosis
ucgcugacccgggcgg

SEQ ID NO: 888972 - RNA, 14 nt, Mycobacterium avium subsp. paratuberculosis
ucgcugaccgccau

SEQ ID NO: 888973 - RNA, 15 nt, Mycobacterium avium subsp. paratuberculosis
ucgcgggcugcggcg

SEQ ID NO: 888974 - RNA, 16 nt, Mycobacterium avium subsp. paratuberculosis
ucgcgggcugcggcga

SEQ ID NO: 888975 - RNA, 13 nt, Mycobacterium avium subsp. paratuberculosis
ucgcgggcgaccu

SEQ ID NO: 888976 - RNA, 17 nt, Mycobacterium avium subsp. paratuberculosis
ucgcgggcgaugcggcc

SEQ ID NO: 888977 - RNA, 20 nt, Mycobacterium avium subsp. paratuberculosis
ucgcgggcgccgaagauggc

SEQ ID NO: 888978 - RNA, 17 nt, Mycobacterium avium subsp. paratuberculosis
ucgcgggcgccgagucc

SEQ ID NO: 888979 - RNA, 13 nt, Mycobacterium avium subsp. paratuberculosis
ucgcgggcggcgc

SEQ ID NO: 888980 - RNA, 21 nt, Mycobacterium avium subsp. paratuberculosis
ucgcgggcggggcgccgacag

SEQ ID NO: 888981 - RNA, 23 nt, Mycobacterium avium subsp. paratuberculosis
ucgcgggcgucgggcagcagcuc

SEQ ID NO: 888982 - RNA, 20 nt, Mycobacterium avium subsp. paratuberculosis
ucgcgggacaacaccaccuc

SEQ ID NO: 888983 - RNA, 17 nt, Mycobacterium avium subsp. paratuberculosis
ucgcgggacaacacgau

SEQ ID NO: 888984 - RNA, 19 nt, Mycobacterium avium subsp. paratuberculosis
ucgcgggacaacacgaucg

SEQ ID NO: 888985 - RNA, 16 nt, Mycobacterium avium subsp. paratuberculosis
ucgcgggacggcggcg

SEQ ID NO: 888986 - RNA, 22 nt, Mycobacterium avium subsp. paratuberculosis
ucgcgggacggcggcgaguucg

SEQ ID NO: 888987 - RNA, 20 nt, Mycobacterium avium subsp. paratuberculosis
ucgcgggaguggccggcguc

SEQ ID NO: 888988 - RNA, 20 nt, Mycobacterium avium subsp. paratuberculosis
ucgcgggaucggccggcgag

SEQ ID NO: 888989 - RNA, 15 nt, Mycobacterium avium subsp. paratuberculosis
ucgcgggcagccggc

SEQ ID NO: 888990 - RNA, 16 nt, Mycobacterium avium subsp. paratuberculosis
ucgcgggcagccggcg

SEQ ID NO: 888991 - RNA, 17 nt, Mycobacterium avium subsp. paratuberculosis
ucgcgggcagccggcgc

SEQ ID NO: 888992 - RNA, 19 nt, Mycobacterium avium subsp. paratuberculosis
ucgcgggccugcucgucgg

SEQ ID NO: 888993 - RNA, 16 nt, Mycobacterium avium subsp. paratuberculosis
ucgcgggccacagcgg

SEQ ID NO: 888994 - RNA, 18 nt, Mycobacterium avium subsp. paratuberculosis
ucgcgggccacagcggcg

SEQ ID NO: 888995 - RNA, 18 nt, Mycobacterium avium subsp. paratuberculosis
ucgcgggccaccgcggcg

SEQ ID NO: 888996 - RNA, 16 nt, Mycobacterium avium subsp. paratuberculosis
ucgcgggcccgcgccg

SEQ ID NO: 888997 - RNA, 19 nt, Mycobacterium avium subsp. paratuberculosis
ucgcgggcccgcgccgcgu

SEQ ID NO: 888998 - RNA, 20 nt, Mycobacterium avium subsp. paratuberculosis
ucgcgggcccgcgccgcguc

SEQ ID NO: 888999 - RNA, 18 nt, Mycobacterium avium subsp. paratuberculosis
ucgcgggcccgcgcggcg

SEQ ID NO: 889000 - RNA, 20 nt, Mycobacterium avium subsp. paratuberculosis
ucgcgggcccgcgcggcggu

SEQ ID NO: 889001 - RNA, 22 nt, Mycobacterium avium subsp. paratuberculosis
ucgcgggcccgcguaaccggcg

SEQ ID NO: 889002 - RNA, 16 nt, Mycobacterium avium subsp. paratuberculosis
ucggcggucugucgcg

SEQ ID NO: 889003 - RNA, 20 nt, Mycobacterium avium subsp. paratuberculosis
ucggcggucuuggcggccag

SEQ ID NO: 889004 - RNA, 16 nt, Mycobacterium avium subsp. paratuberculosis
ucggcggugccgagcc

SEQ ID NO: 889005 - RNA, 20 nt, Mycobacterium avium subsp. paratuberculosis
ucggcggugccguccucggc

SEQ ID NO: 889006 - RNA, 22 nt, Mycobacterium avium subsp. paratuberculosis
ucggcggugguccgcgcgacca

SEQ ID NO: 889007 - RNA, 21 nt, Mycobacterium avium subsp. paratuberculosis
ucggcguacaggccgucgggg

SEQ ID NO: 889008 - RNA, 20 nt, Mycobacterium avium subsp. paratuberculosis
ucggcguagggcagcccgag

SEQ ID NO: 889009 - RNA, 18 nt, Mycobacterium avium subsp. paratuberculosis
ucggcggucgccagcgcc

SEQ ID NO: 889010 - RNA, 19 nt, Mycobacterium avium subsp. paratuberculosis
ucggcggucgccagcgcca

SEQ ID NO: 889011 - RNA, 22 nt, Mycobacterium avium subsp. paratuberculosis
ucggcggucgccagcgccacgc

SEQ ID NO: 889012 - RNA, 18 nt, Mycobacterium avium subsp. paratuberculosis
ucggcgggucacucgacc

SEQ ID NO: 889013 - RNA, 13 nt, Mycobacterium avium subsp. paratuberculosis
ucggcgggcgcgc

SEQ ID NO: 889014 - RNA, 21 nt, Mycobacterium avium subsp. paratuberculosis
ucggcggggaagggcuccccg

SEQ ID NO: 889015 - RNA, 17 nt, Mycobacterium avium subsp. paratuberculosis
ucggcggggaaggugcg

SEQ ID NO: 889016 - RNA, 22 nt, Mycobacterium avium subsp. paratuberculosis
ucggcggggaaggugcgggcgg

SEQ ID NO: 889017 - RNA, 15 nt, Mycobacterium avium subsp. paratuberculosis
ucggcgggcaccucg

SEQ ID NO: 889018 - RNA, 18 nt, Mycobacterium avium subsp. paratuberculosis
ucggcgggccgcccggcg

SEQ ID NO: 889019 - RNA, 20 nt, Mycobacterium avium subsp. paratuberculosis
ucggcgggccgcccggcgcg

SEQ ID NO: 889020 - RNA, 20 nt, Mycobacterium avium subsp. paratuberculosis
ucggcggguagaaccagccc

SEQ ID NO: 889021 - RNA, 17 nt, Mycobacterium avium subsp. paratuberculosis
ucggcggcgcgcugcag

SEQ ID NO: 889022 - RNA, 16 nt, Mycobacterium avium subsp. paratuberculosis
ucggcggcgcggccca

SEQ ID NO: 889023 - RNA, 11 nt, Mycobacterium avium subsp. paratuberculosis
ucggcggcgcg

SEQ ID NO: 889024 - RNA, 12 nt, Mycobacterium avium subsp. paratuberculosis
ucggcggcgcgc

SEQ ID NO: 889025 - RNA, 13 nt, Mycobacterium avium subsp. paratuberculosis
ucggcggcgcgca

SEQ ID NO: 889026 - RNA, 13 nt, Mycobacterium avium subsp. paratuberculosis
ucggcggcggccu

SEQ ID NO: 889027 - RNA, 20 nt, Mycobacterium avium subsp. paratuberculosis
ucggcggcggccugcaccuc

SEQ ID NO: 889028 - RNA, 14 nt, Mycobacterium avium subsp. paratuberculosis
ucggcggcggcgcg

SEQ ID NO: 889029 - RNA, 18 nt, Mycobacterium avium subsp. paratuberculosis
ucggcggcggcgcgccgg

SEQ ID NO: 889030 - RNA, 21 nt, Mycobacterium avium subsp. paratuberculosis
ucggcggcggcgcgccggccg

SEQ ID NO: 889031 - RNA, 22 nt, Mycobacterium avium subsp. paratuberculosis
ucggcggcggcgcgccggccgg

SEQ ID NO: 889032 - RNA, 14 nt, Mycobacterium avium subsp. paratuberculosis
ucggcggcggcggc

SEQ ID NO: 889033 - RNA, 16 nt, Mycobacterium avium subsp. paratuberculosis
ucggcggcgggcaggc

SEQ ID NO: 889034 - RNA, 19 nt, Mycobacterium avium subsp. paratuberculosis
ucggcggcgggcaggcuca

SEQ ID NO: 889035 - RNA, 13 nt, Mycobacterium avium subsp. paratuberculosis
ucggcggcgagga

SEQ ID NO: 889036 - RNA, 22 nt, Mycobacterium avium subsp. paratuberculosis
ucggcggcgaggacgucgucga

SEQ ID NO: 889037 - RNA, 18 nt, Mycobacterium avium subsp. paratuberculosis
ucggcggcgauccggccg

SEQ ID NO: 889038 - RNA, 20 nt, Mycobacterium avium subsp. paratuberculosis
ucggcggcgauccggccggc

SEQ ID NO: 889039 - RNA, 22 nt, Mycobacterium avium subsp. paratuberculosis
ucggcggcgauccggccggcgg

SEQ ID NO: 889040 - RNA, 19 nt, Mycobacterium avium subsp. paratuberculosis
ucggcggccugcggcggca

SEQ ID NO: 889041 - RNA, 14 nt, Mycobacterium avium subsp. paratuberculosis
ucggcggcgcaggc

SEQ ID NO: 889042 - RNA, 17 nt, Mycobacterium avium subsp. paratuberculosis
ucggcggcgcaggcgcg

SEQ ID NO: 889043 - RNA, 12 nt, Mycobacterium avium subsp. paratuberculosis
ucggcggcgccg

SEQ ID NO: 889044 - RNA, 19 nt, Mycobacterium avium subsp. paratuberculosis
ucggcggcgacggcgacca

SEQ ID NO: 889045 - RNA, 15 nt, Mycobacterium avium subsp. paratuberculosis
ucggcggcgccgucg

SEQ ID NO: 889046 - RNA, 19 nt, Mycobacterium avium subsp. paratuberculosis
ucggcggcgcgcaggcgcg

SEQ ID NO: 889047 - RNA, 12 nt, Mycobacterium avium subsp. paratuberculosis
ucggcggcgucg

SEQ ID NO: 889048 - RNA, 22 nt, Mycobacterium avium subsp. paratuberculosis
ucggcggcucaggggaucucgg

SEQ ID NO: 889049 - RNA, 19 nt, Mycobacterium avium subsp. paratuberculosis
ucggcggcugaaccaccgc

SEQ ID NO: 889050 - RNA, 17 nt, Mycobacterium avium subsp. paratuberculosis
ucggcgggacccgcgac

SEQ ID NO: 889051 - RNA, 14 nt, Mycobacterium avium subsp. paratuberculosis
ucggcgggagccgg

SEQ ID NO: 889052 - RNA, 18 nt, Mycobacterium avium subsp. paratuberculosis
ucggcgggagccggcggc

SEQ ID NO: 889053 - RNA, 19 nt, Mycobacterium avium subsp. paratuberculosis
ucggcgggagccggcggcg

SEQ ID NO: 889054 - RNA, 21 nt, Mycobacterium avium subsp. paratuberculosis
ucggcgggagccggcggcggu

SEQ ID NO: 889055 - RNA, 19 nt, Mycobacterium avium subsp. paratuberculosis
ucggcgggaucggaccgca

SEQ ID NO: 889056 - RNA, 22 nt, Mycobacterium avium subsp. paratuberculosis
ucggcgggauggguggucaccg

SEQ ID NO: 889057 - RNA, 23 nt, Mycobacterium avium subsp. paratuberculosis
ucggcgggauggguggucaccgu

SEQ ID NO: 889058 - RNA, 15 nt, Mycobacterium avium subsp. paratuberculosis
ucggcguccgcggcg

SEQ ID NO: 889059 - RNA, 17 nt, Mycobacterium avium subsp. paratuberculosis
ucggcgucgaacggcgu

SEQ ID NO: 889060 - RNA, 14 nt, Mycobacterium avium subsp. paratuberculosis
ucggcguccccggc

SEQ ID NO: 889061 - RNA, 15 nt, Mycobacterium avium subsp. paratuberculosis
ucggcguccccggcg

SEQ ID NO: 889062 - RNA, 16 nt, Mycobacterium avium subsp. paratuberculosis
ucggcgucccggcguc

SEQ ID NO: 889063 - RNA, 19 nt, Mycobacterium avium subsp. paratuberculosis
ucggcgucccggcgucucg

SEQ ID NO: 889064 - RNA, 20 nt, Mycobacterium avium subsp. paratuberculosis
ucggcgucccggcgucucgg

SEQ ID NO: 889065 - RNA, 18 nt, Mycobacterium avium subsp. paratuberculosis
ucggcgguuucggugccg

SEQ ID NO: 889066 - RNA, 17 nt, Mycobacterium avium subsp. paratuberculosis
ucggcgucaucgacuug

SEQ ID NO: 889067 - RNA, 17 nt, Mycobacterium avium subsp. paratuberculosis
ucggcguccagcgcggu

SEQ ID NO: 889068 - RNA, 22 nt, Mycobacterium avium subsp. paratuberculosis
ucggcguccagcgcggugagca

SEQ ID NO: 889069 - RNA, 20 nt, Mycobacterium avium subsp. paratuberculosis
ucggcguccaugcucuugcg

SEQ ID NO: 889070 - RNA, 21 nt, Mycobacterium avium subsp. paratuberculosis
ucggcguauucgucgucggcc

SEQ ID NO: 889071 - RNA, 15 nt, Mycobacterium avium subsp. paratuberculosis
ucggcgucaccaggc

SEQ ID NO: 889072 - RNA, 19 nt, Mycobacterium avium subsp. paratuberculosis
ucggcgucaccccaccgag

SEQ ID NO: 889073 - RNA, 22 nt, Mycobacterium avium subsp. paratuberculosis
ucggcguagcggaagcugccgu

SEQ ID NO: 889074 - RNA, 20 nt, Mycobacterium avium subsp. paratuberculosis
ucggcgucacucuggcguga

SEQ ID NO: 889075 - RNA, 18 nt, Mycobacterium avium subsp. paratuberculosis
ucggcgucguacagcagc

SEQ ID NO: 889076 - RNA, 23 nt, Mycobacterium avium subsp. paratuberculosis
ucggcgucgggccgggggcggcg

SEQ ID NO: 889077 - RNA, 13 nt, Mycobacterium avium subsp. paratuberculosis
ucggcgucgggcg

SEQ ID NO: 889078 - RNA, 19 nt, Mycobacterium avium subsp. paratuberculosis
ucggcgucucggcgucucg

SEQ ID NO: 889079 - RNA, 16 nt, Mycobacterium avium subsp. paratuberculosis
ucggcgucgacgacgg

SEQ ID NO: 889080 - RNA, 13 nt, Mycobacterium avium subsp. paratuberculosis
ucggcgucgaucg

SEQ ID NO: 889081 - RNA, 24 nt, Mycobacterium avium subsp. paratuberculosis
ucggcgucgaugucgucgucgacg

SEQ ID NO: 889082 - RNA, 15 nt, Mycobacterium avium subsp. paratuberculosis
ucggcgucgcacgug

SEQ ID NO: 889083 - RNA, 17 nt, Mycobacterium avium subsp. paratuberculosis
ucggcgucgccgagccg

SEQ ID NO: 889084 - RNA, 19 nt, Mycobacterium avium subsp. paratuberculosis
ucggcgucgccgagccgcg

SEQ ID NO: 889085 - RNA, 20 nt, Mycobacterium avium subsp. paratuberculosis
ucggcgucgccgagccgcgc

SEQ ID NO: 889086 - RNA, 12 nt, Mycobacterium avium subsp. paratuberculosis
ucggcgucggcc

SEQ ID NO: 889087 - RNA, 16 nt, Mycobacterium avium subsp. paratuberculosis
ucggcgucggccaccg

SEQ ID NO: 889088 - RNA, 18 nt, Mycobacterium avium subsp. paratuberculosis
ucggcgucggccaccgcg

SEQ ID NO: 889089 - RNA, 14 nt, Mycobacterium avium subsp. paratuberculosis
ucggcgucggcgcg

SEQ ID NO: 889090 - RNA, 22 nt, Mycobacterium avium subsp. paratuberculosis
ucggcuagcagcuccggucggc

SEQ ID NO: 889091 - RNA, 23 nt, Mycobacterium avium subsp. paratuberculosis
ucggcuagcagcuccggucggcg

SEQ ID NO: 889092 - RNA, 19 nt, Mycobacterium avium subsp. paratuberculosis
ucggcuagcggcugacccg

SEQ ID NO: 889093 - RNA, 20 nt, Mycobacterium avium subsp. paratuberculosis
ucggcguugguccacacguc

SEQ ID NO: 889094 - RNA, 22 nt, Mycobacterium avium subsp. paratuberculosis
ucggcguugguccacacguccu

SEQ ID NO: 889095 - RNA, 13 nt, Mycobacterium avium subsp. paratuberculosis
ucggcguugagcc

SEQ ID NO: 889096 - RNA, 17 nt, Mycobacterium avium subsp. paratuberculosis
ucggcguugagccggcg

SEQ ID NO: 889097 - RNA, 18 nt, Mycobacterium avium subsp. paratuberculosis
ucggcguugagccggcgc

SEQ ID NO: 889098 - RNA, 15 nt, Mycobacterium avium subsp. paratuberculosis
ucggcguggccgucc

SEQ ID NO: 889099 - RNA, 18 nt, Mycobacterium avium subsp. paratuberculosis
ucggcguggcgcucagcg

SEQ ID NO: 889100 - RNA, 21 nt, Mycobacterium avium subsp. paratuberculosis
ucggcguggcgcucagcggca

SEQ ID NO: 889101 - RNA, 22 nt, Mycobacterium avium subsp. paratuberculosis
ucggcguggcgcucagcggcag

SEQ ID NO: 889102 - RNA, 15 nt, Mycobacterium avium subsp. paratuberculosis
ucggcgugucgggug

SEQ ID NO: 889103 - RNA, 23 nt, Mycobacterium avium subsp. paratuberculosis
ucggcgugucgggugcuuucgcg

SEQ ID NO: 889104 - RNA, 23 nt, Mycobacterium avium subsp. paratuberculosis
ucggcgugucgugugcgugacgu

SEQ ID NO: 889105 - RNA, 20 nt, Mycobacterium avium subsp. paratuberculosis
ucggcguguuccuugcggcc

SEQ ID NO: 889106 - RNA, 22 nt, Mycobacterium avium subsp. paratuberculosis
ucggcguguuccuugcggccgc

SEQ ID NO: 889107 - RNA, 23 nt, Mycobacterium avium subsp. paratuberculosis
ucggcguguuccuugcggccgcc

SEQ ID NO: 889108 - RNA, 14 nt, Mycobacterium avium subsp. paratuberculosis
ucggcguucagcgg

SEQ ID NO: 889109 - RNA, 15 nt, Mycobacterium avium subsp. paratuberculosis
ucggcguucagcggc

SEQ ID NO: 889110 - RNA, 23 nt, Mycobacterium avium subsp. paratuberculosis
ucggcgugaauccucagcacggc

SEQ ID NO: 889111 - RNA, 15 nt, Mycobacterium avium subsp. paratuberculosis
ucggcgugcccgccg

SEQ ID NO: 889112 - RNA, 19 nt, Mycobacterium avium subsp. paratuberculosis
ucggcgugcccgccgacca

SEQ ID NO: 889113 - RNA, 21 nt, Mycobacterium avium subsp. paratuberculosis
ucggcgugcucggccacgacg

SEQ ID NO: 889114 - RNA, 17 nt, Mycobacterium avium subsp. paratuberculosis
ucggcgugcucgucgcg

SEQ ID NO: 889115 - RNA, 18 nt, Mycobacterium avium subsp. paratuberculosis
ucggcgugcucgucgcgg

SEQ ID NO: 889116 - RNA, 16 nt, Mycobacterium avium subsp. paratuberculosis
ucggcgcugucggcgg

SEQ ID NO: 889117 - RNA, 17 nt, Mycobacterium avium subsp. paratuberculosis
ucggcggaagcucaucg

SEQ ID NO: 889118 - RNA, 19 nt, Mycobacterium avium subsp. paratuberculosis
ucggcgcuccagcgggcgg

SEQ ID NO: 889119 - RNA, 21 nt, Mycobacterium avium subsp. paratuberculosis
ucggcgcuccagcgggcggcg

SEQ ID NO: 889120 - RNA, 13 nt, Mycobacterium avium subsp. paratuberculosis
ucggcgcucgcgg

SEQ ID NO: 889121 - RNA, 20 nt, Mycobacterium avium subsp. paratuberculosis
ucggcgcguuggccgagggg

SEQ ID NO: 889122 - RNA, 15 nt, Mycobacterium avium subsp. paratuberculosis
ucggcgcugaacugc

SEQ ID NO: 889123 - RNA, 16 nt, Mycobacterium avium subsp. paratuberculosis
ucggcgcugcccgccg

SEQ ID NO: 889124 - RNA, 21 nt, Mycobacterium avium subsp. paratuberculosis
ucggcgcuggccagcgcgacg

SEQ ID NO: 889125 - RNA, 18 nt, Mycobacterium avium subsp. paratuberculosis
ucggcgcgguccacgguc

SEQ ID NO: 889126 - RNA, 20 nt, Mycobacterium avium subsp. paratuberculosis
ucggcgcgguccacggucag

SEQ ID NO: 889127 - RNA, 22 nt, Mycobacterium avium subsp. paratuberculosis
ucggcgcggucgcaggcgagcc

SEQ ID NO: 889128 - RNA, 23 nt, Mycobacterium avium subsp. paratuberculosis
ucggcgcgucguacaccucgguc

SEQ ID NO: 889129 - RNA, 20 nt, Mycobacterium avium subsp. paratuberculosis
ucggcgcgucguccgacacc

SEQ ID NO: 889130 - RNA, 13 nt, Mycobacterium avium subsp. paratuberculosis
ucggcgccgagca

SEQ ID NO: 889131 - RNA, 14 nt, Mycobacterium avium subsp. paratuberculosis
ucggcgccgagcac

SEQ ID NO: 889132 - RNA, 13 nt, Mycobacterium avium subsp. paratuberculosis
ucggcgccgagcg

SEQ ID NO: 889133 - RNA, 16 nt, Mycobacterium avium subsp. paratuberculosis
ucggcgccgagcguca

SEQ ID NO: 889134 - RNA, 14 nt, Mycobacterium avium subsp. paratuberculosis
ucggcgccgaucac

SEQ ID NO: 889135 - RNA, 13 nt, Mycobacterium avium subsp. paratuberculosis
ucggcgcgggcca

SEQ ID NO: 889136 - RNA, 14 nt, Mycobacterium avium subsp. paratuberculosis
ucggcgcgggccag

SEQ ID NO: 889137 - RNA, 16 nt, Mycobacterium avium subsp. paratuberculosis
ucggcgcgggccagca

SEQ ID NO: 889138 - RNA, 22 nt, Mycobacterium avium subsp. paratuberculosis
ucggcgcgggccagcagcagca

SEQ ID NO: 889139 - RNA, 18 nt, Mycobacterium avium subsp. paratuberculosis
ucggcgcggggccaccag

SEQ ID NO: 889140 - RNA, 20 nt, Mycobacterium avium subsp. paratuberculosis
ucggcgcggggccaccaggc

SEQ ID NO: 889141 - RNA, 16 nt, Mycobacterium avium subsp. paratuberculosis
ucggcgcccucgccga

SEQ ID NO: 889142 - RNA, 17 nt, Mycobacterium avium subsp. paratuberculosis
ucggcgcccucggcgau

SEQ ID NO: 889143 - RNA, 21 nt, Mycobacterium avium subsp. paratuberculosis
ucggcgccgaccucggccagc

SEQ ID NO: 889144 - RNA, 17 nt, Mycobacterium avium subsp. paratuberculosis
ucggcgccgacggccag

SEQ ID NO: 889145 - RNA, 22 nt, Mycobacterium avium subsp. paratuberculosis
ucggcgcccgcuccggcggacc

SEQ ID NO: 889146 - RNA, 19 nt, Mycobacterium avium subsp. paratuberculosis
ucggcgcccggcaccggga

SEQ ID NO: 889147 - RNA, 15 nt, Mycobacterium avium subsp. paratuberculosis
ucggcgcccggccca

SEQ ID NO: 889148 - RNA, 20 nt, Mycobacterium avium subsp. paratuberculosis
ucggcgcccggcccagccgc

SEQ ID NO: 889149 - RNA, 22 nt, Mycobacterium avium subsp. paratuberculosis
ucggcgcccggcccagccgcug

SEQ ID NO: 889150 - RNA, 15 nt, Mycobacterium avium subsp. paratuberculosis
ucggcggaacggucg

SEQ ID NO: 889151 - RNA, 20 nt, Mycobacterium avium subsp. paratuberculosis
ucggcggaacggucggggcg

SEQ ID NO: 889152 - RNA, 18 nt, Mycobacterium avium subsp. paratuberculosis
ucggcggcaccgcccggg

SEQ ID NO: 889153 - RNA, 16 nt, Mycobacterium avium subsp. paratuberculosis
ucggcggacucggcga

SEQ ID NO: 889154 - RNA, 22 nt, Mycobacterium avium subsp. paratuberculosis
ucggcggcaaagcguugccgcg

SEQ ID NO: 889155 - RNA, 12 nt, Mycobacterium avium subsp. paratuberculosis
ucggcggcccgc

SEQ ID NO: 889156 - RNA, 21 nt, Mycobacterium avium subsp. paratuberculosis
ucggcggcccgcaggaucgag

SEQ ID NO: 889157 - RNA, 13 nt, Mycobacterium avium subsp. paratuberculosis
ucggcggcccgcc

SEQ ID NO: 889158 - RNA, 13 nt, Mycobacterium avium subsp. paratuberculosis
ucggcggcccgcu

SEQ ID NO: 889159 - RNA, 17 nt, Mycobacterium avium subsp. paratuberculosis
ucggcggccagcgcgac

SEQ ID NO: 889160 - RNA, 18 nt, Mycobacterium avium subsp. paratuberculosis
ucggcggccagcgcgacg

SEQ ID NO: 889161 - RNA, 19 nt, Mycobacterium avium subsp. paratuberculosis
ucggcggccagcgcgacgc

SEQ ID NO: 889162 - RNA, 19 nt, Mycobacterium avium subsp. paratuberculosis
ucggcggccaccagccggc

SEQ ID NO: 889163 - RNA, 23 nt, Mycobacterium avium subsp. paratuberculosis
ucggcggccaccagccggccggc

SEQ ID NO: 889164 - RNA, 21 nt, Mycobacterium avium subsp. paratuberculosis
ucggcggccuuuuccggcgac

SEQ ID NO: 889165 - RNA, 13 nt, Mycobacterium avium subsp. paratuberculosis
ucggcggcgaaca

SEQ ID NO: 889166 - RNA, 18 nt, Mycobacterium avium subsp. paratuberculosis
ucggcggccucgccgucg

SEQ ID NO: 889167 - RNA, 20 nt, Mycobacterium avium subsp. paratuberculosis
ucggcggccgagcgcaccgc

SEQ ID NO: 889168 - RNA, 22 nt, Mycobacterium avium subsp. paratuberculosis
ucggcggccgaggaaagcucgc

SEQ ID NO: 889169 - RNA, 14 nt, Mycobacterium avium subsp. paratuberculosis
ucggcggccgccag

SEQ ID NO: 889170 - RNA, 12 nt, Mycobacterium avium subsp. paratuberculosis
ucggcggccggg

SEQ ID NO: 889171 - RNA, 17 nt, Mycobacterium avium subsp. paratuberculosis
ucggcgagguagaccgc

SEQ ID NO: 889172 - RNA, 17 nt, Mycobacterium avium subsp. paratuberculosis
ucggcgaggucgucgag

SEQ ID NO: 889173 - RNA, 18 nt, Mycobacterium avium subsp. paratuberculosis
ucggcgaggucgucgagg

SEQ ID NO: 889174 - RNA, 23 nt, Mycobacterium avium subsp. paratuberculosis
ucggcgaggucgucgagggccac

SEQ ID NO: 889175 - RNA, 17 nt, Mycobacterium avium subsp. paratuberculosis
ucggcgagugaggccga

SEQ ID NO: 889176 - RNA, 22 nt, Mycobacterium avium subsp. paratuberculosis
ucggcgagcagcugcagcgucg

SEQ ID NO: 889177 - RNA, 20 nt, Mycobacterium avium subsp. paratuberculosis
ucggccugcagcucggugcg

SEQ ID NO: 889178 - RNA, 23 nt, Mycobacterium avium subsp. paratuberculosis
ucggcgagcuugccuugcgccca

SEQ ID NO: 889179 - RNA, 19 nt, Mycobacterium avium subsp. paratuberculosis
ucggcgagcuuggcgggcg

SEQ ID NO: 889180 - RNA, 19 nt, Mycobacterium avium subsp. paratuberculosis
ucggcgccccacgccuggc

SEQ ID NO: 889181 - RNA, 21 nt, Mycobacterium avium subsp. paratuberculosis
ucggcgccccccugcucgcug

SEQ ID NO: 889182 - RNA, 19 nt, Mycobacterium avium subsp. paratuberculosis
ucggcgccccgcccgcgac

SEQ ID NO: 889183 - RNA, 13 nt, Mycobacterium avium subsp. paratuberculosis
ucggcgccccggc

SEQ ID NO: 889184 - RNA, 16 nt, Mycobacterium avium subsp. paratuberculosis
ucggcgccccggcgcu

SEQ ID NO: 889185 - RNA, 17 nt, Mycobacterium avium subsp. paratuberculosis
ucggcgcccaccgcggc

SEQ ID NO: 889186 - RNA, 22 nt, Mycobacterium avium subsp. paratuberculosis
ucggcgcccaccgcggcgcgcg

SEQ ID NO: 889187 - RNA, 19 nt, Mycobacterium avium subsp. paratuberculosis
ucggcgccaacaacucgac

SEQ ID NO: 889188 - RNA, 22 nt, Mycobacterium avium subsp. paratuberculosis
ucggcgccaacaacucgacgcu

SEQ ID NO: 889189 - RNA, 16 nt, Mycobacterium avium subsp. paratuberculosis
ucggcgccaccccggg

SEQ ID NO: 889190 - RNA, 18 nt, Mycobacterium avium subsp. paratuberculosis
ucggcgccagcccgccga

SEQ ID NO: 889191 - RNA, 18 nt, Mycobacterium avium subsp. paratuberculosis
ucggcgauccgggcacgc

SEQ ID NO: 889192 - RNA, 11 nt, Mycobacterium avium subsp. paratuberculosis
ucggcgaucgc

SEQ ID NO: 889193 - RNA, 14 nt, Mycobacterium avium subsp. paratuberculosis
ucggcgaucaccgc

SEQ ID NO: 889194 - RNA, 12 nt, Mycobacterium avium subsp. paratuberculosis
ucggcgaucagc

SEQ ID NO: 889195 - RNA, 14 nt, Mycobacterium avium subsp. paratuberculosis
ucggcgaucagcug

SEQ ID NO: 889196 - RNA, 15 nt, Mycobacterium avium subsp. paratuberculosis
ucggccugcgcccgg

SEQ ID NO: 889197 - RNA, 20 nt, Mycobacterium avium subsp. paratuberculosis
ucggccugcgcugcggccaa

SEQ ID NO: 889198 - RNA, 23 nt, Mycobacterium avium subsp. paratuberculosis
ucggccugcgucacuccucgauc

SEQ ID NO: 889199 - RNA, 19 nt, Mycobacterium avium subsp. paratuberculosis
ucggcgagcagccgcgccg

SEQ ID NO: 889200 - RNA, 19 nt, Mycobacterium avium subsp. paratuberculosis
ucggccugcacgucggcgc

SEQ ID NO: 889201 - RNA, 20 nt, Mycobacterium avium subsp. paratuberculosis
ucggccugcacgucggcgcg

SEQ ID NO: 889202 - RNA, 22 nt, Mycobacterium avium subsp. paratuberculosis
ucggccugcacgucggcgcgca

SEQ ID NO: 889203 - RNA, 14 nt, Mycobacterium avium subsp. paratuberculosis
ucggccucggcggc

SEQ ID NO: 889204 - RNA, 18 nt, Mycobacterium avium subsp. paratuberculosis
ucggccucgucgacgucg

SEQ ID NO: 889205 - RNA, 16 nt, Mycobacterium avium subsp. paratuberculosis
ucggccuccagccggc

SEQ ID NO: 889206 - RNA, 22 nt, Mycobacterium avium subsp. paratuberculosis
ucggccucaggcgucggucagc

SEQ ID NO: 889207 - RNA, 23 nt, Mycobacterium avium subsp. paratuberculosis
ucggccucaggcgucggucagca

SEQ ID NO: 889208 - RNA, 20 nt, Mycobacterium avium subsp. paratuberculosis
ucggccgugaucucgugccg

SEQ ID NO: 889209 - RNA, 19 nt, Mycobacterium avium subsp. paratuberculosis
ucggccguggccgucacgc

SEQ ID NO: 889210 - RNA, 20 nt, Mycobacterium avium subsp. paratuberculosis
ucggccguggccgucacgcu

SEQ ID NO: 889211 - RNA, 13 nt, Mycobacterium avium subsp. paratuberculosis
ucggccgucggcg

SEQ ID NO: 889212 - RNA, 15 nt, Mycobacterium avium subsp. paratuberculosis
ucggccgucggcgcc

SEQ ID NO: 889213 - RNA, 16 nt, Mycobacterium avium subsp. paratuberculosis
ucggccgucggcgccg

SEQ ID NO: 889214 - RNA, 22 nt, Mycobacterium avium subsp. paratuberculosis
ucggccgguccgaucguccggc

SEQ ID NO: 889215 - RNA, 17 nt, Mycobacterium avium subsp. paratuberculosis
ucggccgguccgugcac

SEQ ID NO: 889216 - RNA, 14 nt, Mycobacterium avium subsp. paratuberculosis
ucggccgggccggc

SEQ ID NO: 889217 - RNA, 16 nt, Mycobacterium avium subsp. paratuberculosis
ucggccgggcugccca

SEQ ID NO: 889218 - RNA, 13 nt, Mycobacterium avium subsp. paratuberculosis
ucggccggguccu

SEQ ID NO: 889219 - RNA, 21 nt, Mycobacterium avium subsp. paratuberculosis
ucggccgggucgcaggcagca

SEQ ID NO: 889220 - RNA, 14 nt, Mycobacterium avium subsp. paratuberculosis
ucggccgggucgua

SEQ ID NO: 889221 - RNA, 19 nt, Mycobacterium avium subsp. paratuberculosis
ucgcacuagguccggcgcg

SEQ ID NO: 889222 - RNA, 23 nt, Mycobacterium avium subsp. paratuberculosis
ucgcacuagguccggcgcgacca

SEQ ID NO: 889223 - RNA, 17 nt, Mycobacterium avium subsp. paratuberculosis
ucgcagacguagcacca

SEQ ID NO: 889224 - RNA, 22 nt, Mycobacterium avium subsp. paratuberculosis
ucgcaccggcgccucgaugcgg

SEQ ID NO: 889225 - RNA, 15 nt, Mycobacterium avium subsp. paratuberculosis
ucgccaguccggcgc

SEQ ID NO: 889226 - RNA, 19 nt, Mycobacterium avium subsp. paratuberculosis
ucgccaguccggcgccgac

SEQ ID NO: 889227 - RNA, 19 nt, Mycobacterium avium subsp. paratuberculosis
ucgccaggcguugcaccgc

SEQ ID NO: 889228 - RNA, 14 nt, Mycobacterium avium subsp. paratuberculosis
ucgcccagccggcg

SEQ ID NO: 889229 - RNA, 16 nt, Mycobacterium avium subsp. paratuberculosis
ucgcccagccggcgga

SEQ ID NO: 889230 - RNA, 13 nt, Mycobacterium avium subsp. paratuberculosis
ucgcccagcgcag

SEQ ID NO: 889231 - RNA, 19 nt, Mycobacterium avium subsp. paratuberculosis
ucgcccagcgcagcgccuc

SEQ ID NO: 889232 - RNA, 21 nt, Mycobacterium avium subsp. paratuberculosis
ucgcccagcgcagcgccucgg

SEQ ID NO: 889233 - RNA, 15 nt, Mycobacterium avium subsp. paratuberculosis
ucgcccagcgccgcg

SEQ ID NO: 889234 - RNA, 17 nt, Mycobacterium avium subsp. paratuberculosis
ucgcccagcgccgcggc

SEQ ID NO: 889235 - RNA, 18 nt, Mycobacterium avium subsp. paratuberculosis
ucgcccagcgccgcggcg

SEQ ID NO: 889236 - RNA, 16 nt, Mycobacterium avium subsp. paratuberculosis
ucgcccagcggcacga

SEQ ID NO: 889237 - RNA, 18 nt, Mycobacterium avium subsp. paratuberculosis
ucgcccagcgugucggcg

SEQ ID NO: 889238 - RNA, 21 nt, Mycobacterium avium subsp. paratuberculosis
ucgcccagcgugucggcgauc

SEQ ID NO: 889239 - RNA, 23 nt, Mycobacterium avium subsp. paratuberculosis
ucgcccagcgugucggcgaucgc

SEQ ID NO: 889240 - RNA, 14 nt, Mycobacterium avium subsp. paratuberculosis
ucgcccagcgcggc

SEQ ID NO: 889241 - RNA, 17 nt, Mycobacterium avium subsp. paratuberculosis
ucgcccagcgcggcggc

SEQ ID NO: 889242 - RNA, 18 nt, Mycobacterium avium subsp. paratuberculosis
ucgcccagcgcggcggcc

SEQ ID NO: 889243 - RNA, 12 nt, Mycobacterium avium subsp. paratuberculosis
ucgccaugccgu

SEQ ID NO: 889244 - RNA, 16 nt, Mycobacterium avium subsp. paratuberculosis
ucgccaugcgaccacg

SEQ ID NO: 889245 - RNA, 22 nt, Mycobacterium avium subsp. paratuberculosis
ucgcccagcagcccggccagcc

SEQ ID NO: 889246 - RNA, 13 nt, Mycobacterium avium subsp. paratuberculosis
ucgcccgccgacg

SEQ ID NO: 889247 - RNA, 14 nt, Mycobacterium avium subsp. paratuberculosis
ucgcccgccgacgg

SEQ ID NO: 889248 - RNA, 18 nt, Mycobacterium avium subsp. paratuberculosis
ucgcccgccgacggcugc

SEQ ID NO: 889249 - RNA, 24 nt, Mycobacterium avium subsp. paratuberculosis
ucgcccaucaccagcagacccgac

SEQ ID NO: 889250 - RNA, 20 nt, Mycobacterium avium subsp. paratuberculosis
ucgcccggaaaaagcguugc

SEQ ID NO: 889251 - RNA, 12 nt, Mycobacterium avium subsp. paratuberculosis
ucgcccgccgcg

SEQ ID NO: 889252 - RNA, 14 nt, Mycobacterium avium subsp. paratuberculosis
ucgcccgccgcgac

SEQ ID NO: 889253 - RNA, 15 nt, Mycobacterium avium subsp. paratuberculosis
ucgcccgccgcgagc

SEQ ID NO: 889254 - RNA, 23 nt, Mycobacterium avium subsp. paratuberculosis
ucgcccgcgugggcaccccgauc

SEQ ID NO: 889255 - RNA, 19 nt, Mycobacterium avium subsp. paratuberculosis
ucgcccgcguugcggcgca

SEQ ID NO: 889256 - RNA, 14 nt, Mycobacterium avium subsp. paratuberculosis
ucgcccgcuccgcg

SEQ ID NO: 889257 - RNA, 23 nt, Mycobacterium avium subsp. paratuberculosis
ucgcccggcuccacgaugcccgu

SEQ ID NO: 889258 - RNA, 12 nt, Mycobacterium avium subsp. paratuberculosis
ucgcccggcggc

SEQ ID NO: 889259 - RNA, 12 nt, Mycobacterium avium subsp. paratuberculosis
ucgcccggcgcg

SEQ ID NO: 889260 - RNA, 17 nt, Mycobacterium avium subsp. paratuberculosis
ucgcccggcgcggcauc

SEQ ID NO: 889261 - RNA, 12 nt, Mycobacterium avium subsp. paratuberculosis
ucgcccgggugc

SEQ ID NO: 889262 - RNA, 21 nt, Mycobacterium avium subsp. paratuberculosis
ucgcccgggcuaucgcccggc

SEQ ID NO: 889263 - RNA, 19 nt, Mycobacterium avium subsp. paratuberculosis
ucgccgaaccgggcgcgca

SEQ ID NO: 889264 - RNA, 16 nt, Mycobacterium avium subsp. paratuberculosis
ucgccgaacgccacca

SEQ ID NO: 889265 - RNA, 16 nt, Mycobacterium avium subsp. paratuberculosis
ucgccgaaaugccgug

SEQ ID NO: 889266 - RNA, 19 nt, Mycobacterium avium subsp. paratuberculosis
ucgccgaaaugccgugcca

SEQ ID NO: 889267 - RNA, 14 nt, Mycobacterium avium subsp. paratuberculosis
ucgccgaacgccuc

SEQ ID NO: 889268 - RNA, 19 nt, Mycobacterium avium subsp. paratuberculosis
ucgccgaacgugcgcggcg

SEQ ID NO: 889269 - RNA, 21 nt, Mycobacterium avium subsp. paratuberculosis
ucgccgaacgugcgcggcgcg

SEQ ID NO: 889270 - RNA, 20 nt, Mycobacterium avium subsp. paratuberculosis
ucgccgagccguaggccagg

SEQ ID NO: 889271 - RNA, 12 nt, Mycobacterium avium subsp. paratuberculosis
ucgccgacaccg

SEQ ID NO: 889272 - RNA, 14 nt, Mycobacterium avium subsp. paratuberculosis
ucgccgagccgcac

SEQ ID NO: 889273 - RNA, 13 nt, Mycobacterium avium subsp. paratuberculosis
ucgccgagccgcg

SEQ ID NO: 889274 - RNA, 15 nt, Mycobacterium avium subsp. paratuberculosis
ucgccgagccgcgcc

SEQ ID NO: 889275 - RNA, 19 nt, Mycobacterium avium subsp. paratuberculosis
ucgccgaccagcaggacgc

SEQ ID NO: 889276 - RNA, 23 nt, Mycobacterium avium subsp. paratuberculosis
ucgccgaccagcaggacgcgccc

SEQ ID NO: 889277 - RNA, 21 nt, Mycobacterium avium subsp. paratuberculosis
ucgccgaccagccgaggcgcu

SEQ ID NO: 889278 - RNA, 17 nt, Mycobacterium avium subsp. paratuberculosis
ucgccgagcacaccguc

SEQ ID NO: 889279 - RNA, 18 nt, Mycobacterium avium subsp. paratuberculosis
ucgccgagcacaccgucg

SEQ ID NO: 889280 - RNA, 15 nt, Mycobacterium avium subsp. paratuberculosis
ucgccgagcagaucg

SEQ ID NO: 889281 - RNA, 20 nt, Mycobacterium avium subsp. paratuberculosis
ucgccgaaguuccagccgau

SEQ ID NO: 889282 - RNA, 18 nt, Mycobacterium avium subsp. paratuberculosis
ucgccgaauccggcgggg

SEQ ID NO: 889283 - RNA, 16 nt, Mycobacterium avium subsp. paratuberculosis
ucgccgacagcgucgu

SEQ ID NO: 889284 - RNA, 19 nt, Mycobacterium avium subsp. paratuberculosis
ucgccgacagcgucgucca

SEQ ID NO: 889285 - RNA, 14 nt, Mycobacterium avium subsp. paratuberculosis
ucgccgggcccgcu

SEQ ID NO: 889286 - RNA, 18 nt, Mycobacterium avium subsp. paratuberculosis
ucgccgggcugcacgcug

SEQ ID NO: 889287 - RNA, 22 nt, Mycobacterium avium subsp. paratuberculosis
ucgccgggcuggccgucggcga

SEQ ID NO: 889288 - RNA, 15 nt, Mycobacterium avium subsp. paratuberculosis
ucgccggggaacacc

SEQ ID NO: 889289 - RNA, 18 nt, Mycobacterium avium subsp. paratuberculosis
ucgccggggaacaccggc

SEQ ID NO: 889290 - RNA, 19 nt, Mycobacterium avium subsp. paratuberculosis
ucgccggggaacaccggcg

SEQ ID NO: 889291 - RNA, 15 nt, Mycobacterium avium subsp. paratuberculosis
ucgccggggcgcuga

SEQ ID NO: 889292 - RNA, 17 nt, Mycobacterium avium subsp. paratuberculosis
ucgccggggucgcgcgc

SEQ ID NO: 889293 - RNA, 13 nt, Mycobacterium avium subsp. paratuberculosis
ucgccggccgcgg

SEQ ID NO: 889294 - RNA, 17 nt, Mycobacterium avium subsp. paratuberculosis
ucgccggcugacugccg

SEQ ID NO: 889295 - RNA, 20 nt, Mycobacterium avium subsp. paratuberculosis
ucgccggcugacugccggcg

SEQ ID NO: 889296 - RNA, 18 nt, Mycobacterium avium subsp. paratuberculosis
ucgccggcuuaccgaccu

SEQ ID NO: 889297 - RNA, 21 nt, Mycobacterium avium subsp. paratuberculosis
ucgccggccgccagcgcccgc

SEQ ID NO: 889298 - RNA, 15 nt, Mycobacterium avium subsp. paratuberculosis
ucgccggccgccgug

SEQ ID NO: 889299 - RNA, 13 nt, Mycobacterium avium subsp. paratuberculosis
ucgccggccagca

SEQ ID NO: 889300 - RNA, 19 nt, Mycobacterium avium subsp. paratuberculosis
ucgccggccagcacgccgu

SEQ ID NO: 889301 - RNA, 13 nt, Mycobacterium avium subsp. paratuberculosis
ucgccggccaggc

SEQ ID NO: 889302 - RNA, 22 nt, Mycobacterium avium subsp. paratuberculosis
ucgccggauguguugcgcacca

SEQ ID NO: 889303 - RNA, 16 nt, Mycobacterium avium subsp. paratuberculosis
ucgccggaucgagcac

SEQ ID NO: 889304 - RNA, 18 nt, Mycobacterium avium subsp. paratuberculosis
ucgccggaucgagcaccc

SEQ ID NO: 889305 - RNA, 14 nt, Mycobacterium avium subsp. paratuberculosis
ucgccggaucgccg

SEQ ID NO: 889306 - RNA, 21 nt, Mycobacterium avium subsp. paratuberculosis
ucgccggaucggucucggugg

SEQ ID NO: 889307 - RNA, 23 nt, Mycobacterium avium subsp. paratuberculosis
ucgccgcggaccccagcgugacg

SEQ ID NO: 889308 - RNA, 16 nt, Mycobacterium avium subsp. paratuberculosis
ucgccgcggccacgcu

SEQ ID NO: 889309 - RNA, 18 nt, Mycobacterium avium subsp. paratuberculosis
ucgccgcggccacgcucg

SEQ ID NO: 889310 - RNA, 14 nt, Mycobacterium avium subsp. paratuberculosis
ucgccgcggcgauc

SEQ ID NO: 889311 - RNA, 18 nt, Mycobacterium avium subsp. paratuberculosis
ucgccggagagcccgucg

SEQ ID NO: 889312 - RNA, 16 nt, Mycobacterium avium subsp. paratuberculosis
ucgccggaggcgauca

SEQ ID NO: 889313 - RNA, 21 nt, Mycobacterium avium subsp. paratuberculosis
ucgccgcgcguuccagcacgc

SEQ ID NO: 889314 - RNA, 22 nt, Mycobacterium avium subsp. paratuberculosis
ucgccgcgcucaacccgggccg

SEQ ID NO: 889315 - RNA, 22 nt, Mycobacterium avium subsp. paratuberculosis
ucgccgcgcuugcgaccgccgc

SEQ ID NO: 889316 - RNA, 23 nt, Mycobacterium avium subsp. paratuberculosis
ucgccgcgcuugcgaccgccgcu

SEQ ID NO: 889317 - RNA, 19 nt, Mycobacterium avium subsp. paratuberculosis
ucgccgcgcggcccgcgac

SEQ ID NO: 889318 - RNA, 14 nt, Mycobacterium avium subsp. paratuberculosis
ucgccgcgcgcguc

SEQ ID NO: 889319 - RNA, 19 nt, Mycobacterium avium subsp. paratuberculosis
ucgccgcgcgcgucgacgu

SEQ ID NO: 889320 - RNA, 20 nt, Mycobacterium avium subsp. paratuberculosis
ucgccgcgcgcgucgacguu

SEQ ID NO: 889321 - RNA, 23 nt, Mycobacterium avium subsp. paratuberculosis
ucgccgcgcgcgucgacguucgc

SEQ ID NO: 889322 - RNA, 16 nt, Mycobacterium avium subsp. paratuberculosis
ucgccgcgccagcacc

SEQ ID NO: 889323 - RNA, 18 nt, Mycobacterium avium subsp. paratuberculosis
ucgccgcgccagcaccuc

SEQ ID NO: 889324 - RNA, 19 nt, Mycobacterium avium subsp. paratuberculosis
ucgccgcgccagcaccucg

SEQ ID NO: 889325 - RNA, 21 nt, Mycobacterium avium subsp. paratuberculosis
ucgccgcgccagcaccucggc

SEQ ID NO: 889326 - RNA, 23 nt, Mycobacterium avium subsp. paratuberculosis
ucgccgcgccagccgccgccgac

SEQ ID NO: 889327 - RNA, 14 nt, Mycobacterium avium subsp. paratuberculosis
ucgccgcgcccagc

SEQ ID NO: 889328 - RNA, 15 nt, Mycobacterium avium subsp. paratuberculosis
ucgccgcgcccagca

SEQ ID NO: 889329 - RNA, 19 nt, Mycobacterium avium subsp. paratuberculosis
ucgccgcgcccagcacguc

SEQ ID NO: 889330 - RNA, 15 nt, Mycobacterium avium subsp. paratuberculosis
ucgccgcgcccgccg

SEQ ID NO: 889331 - RNA, 13 nt, Mycobacterium avium subsp. paratuberculosis
ucgccgcgccgcc

SEQ ID NO: 889332 - RNA, 14 nt, Mycobacterium avium subsp. paratuberculosis
ucgccgcgccgccg

SEQ ID NO: 889333 - RNA, 19 nt, Mycobacterium avium subsp. paratuberculosis
ucgccgcgcauucaccagc

SEQ ID NO: 889334 - RNA, 14 nt, Mycobacterium avium subsp. paratuberculosis
ucgccgcaggcguc

SEQ ID NO: 889335 - RNA, 15 nt, Mycobacterium avium subsp. paratuberculosis
ucgccgaucgcccgg

SEQ ID NO: 889336 - RNA, 17 nt, Mycobacterium avium subsp. paratuberculosis
ucgccgaugcgccgcac

SEQ ID NO: 889337 - RNA, 19 nt, Mycobacterium avium subsp. paratuberculosis
ucgccgaucucgaccagcg

SEQ ID NO: 889338 - RNA, 17 nt, Mycobacterium avium subsp. paratuberculosis
ucgccgaucucggccaa

SEQ ID NO: 889339 - RNA, 20 nt, Mycobacterium avium subsp. paratuberculosis
ucgccgaucucggccaaccg

SEQ ID NO: 889340 - RNA, 17 nt, Mycobacterium avium subsp. paratuberculosis
ucgccgaucuggcgcag

SEQ ID NO: 889341 - RNA, 16 nt, Mycobacterium avium subsp. paratuberculosis
ucgccgaucugucgcg

SEQ ID NO: 889342 - RNA, 19 nt, Mycobacterium avium subsp. paratuberculosis
ucgccgaucuuggcgagcu

SEQ ID NO: 889343 - RNA, 15 nt, Mycobacterium avium subsp. paratuberculosis
ucgccgaugacguug

SEQ ID NO: 889344 - RNA, 17 nt, Mycobacterium avium subsp. paratuberculosis
ucgccgaugacguugcg

SEQ ID NO: 889345 - RNA, 22 nt, Mycobacterium avium subsp. paratuberculosis
ucgccgaugacguugcgcgcca

SEQ ID NO: 889346 - RNA, 17 nt, Mycobacterium avium subsp. paratuberculosis
ucgccgauggagaccuc

SEQ ID NO: 889347 - RNA, 14 nt, Mycobacterium avium subsp. paratuberculosis
ucgccgauggugac

SEQ ID NO: 889348 - RNA, 18 nt, Mycobacterium avium subsp. paratuberculosis
ucgccgaugucggccggu

SEQ ID NO: 889349 - RNA, 16 nt, Mycobacterium avium subsp. paratuberculosis
ucgccgauguggcggg

SEQ ID NO: 889350 - RNA, 18 nt, Mycobacterium avium subsp. paratuberculosis
ucgccgauguggcgggcg

SEQ ID NO: 889351 - RNA, 11 nt, Mycobacterium avium subsp. paratuberculosis
ucgccgcaacc

SEQ ID NO: 889352 - RNA, 15 nt, Mycobacterium avium subsp. paratuberculosis
ucgccgagcucgaug

SEQ ID NO: 889353 - RNA, 23 nt, Mycobacterium avium subsp. paratuberculosis
ucgccgaggaaccggcagccggc

SEQ ID NO: 889354 - RNA, 18 nt, Mycobacterium avium subsp. paratuberculosis
ucgccgagggcgacgaug

SEQ ID NO: 889355 - RNA, 23 nt, Mycobacterium avium subsp. paratuberculosis
ucgccgagggcgacgaugccggc

SEQ ID NO: 889356 - RNA, 22 nt, Mycobacterium avium subsp. paratuberculosis
ucgccgagguagccgcgcacca

SEQ ID NO: 889357 - RNA, 21 nt, Mycobacterium avium subsp. paratuberculosis
ucgccgaucaccugacagacc

SEQ ID NO: 889358 - RNA, 20 nt, Mycobacterium avium subsp. paratuberculosis
ucgccgaucagcaccagguu

SEQ ID NO: 889359 - RNA, 15 nt, Mycobacterium avium subsp. paratuberculosis
ucgccgauccggcgc

SEQ ID NO: 889360 - RNA, 17 nt, Mycobacterium avium subsp. paratuberculosis
ucgccgauccgggcggc

SEQ ID NO: 889361 - RNA, 12 nt, Mycobacterium avium subsp. paratuberculosis
ucgccgccagca

SEQ ID NO: 889362 - RNA, 14 nt, Mycobacterium avium subsp. paratuberculosis
ucgccgccgggcgc

SEQ ID NO: 889363 - RNA, 21 nt, Mycobacterium avium subsp. paratuberculosis
ucgccgccggugaagaucagc

SEQ ID NO: 889364 - RNA, 14 nt, Mycobacterium avium subsp. paratuberculosis
ucgccgccguccag

SEQ ID NO: 889365 - RNA, 19 nt, Mycobacterium avium subsp. paratuberculosis
ucgccgcgcaucaucgccc

SEQ ID NO: 889366 - RNA, 22 nt, Mycobacterium avium subsp. paratuberculosis
ucgccgcgcagcaccgcgucgg

SEQ ID NO: 889367 - RNA, 14 nt, Mycobacterium avium subsp. paratuberculosis
ucgccgcgacccgg

SEQ ID NO: 889368 - RNA, 21 nt, Mycobacterium avium subsp. paratuberculosis
ucgccguacgcgccggccagc

SEQ ID NO: 889369 - RNA, 18 nt, Mycobacterium avium subsp. paratuberculosis
ucgccguagaauccgccg

SEQ ID NO: 889370 - RNA, 19 nt, Mycobacterium avium subsp. paratuberculosis
ucgccguagaauccgccgu

SEQ ID NO: 889371 - RNA, 19 nt, Mycobacterium avium subsp. paratuberculosis
ucgccgguggugcaccggu

SEQ ID NO: 889372 - RNA, 24 nt, Mycobacterium avium subsp. paratuberculosis
ucgccggugugaucgagcaccagc

SEQ ID NO: 889373 - RNA, 20 nt, Mycobacterium avium subsp. paratuberculosis
ucgccgucacugcacgcacg

SEQ ID NO: 889374 - RNA, 22 nt, Mycobacterium avium subsp. paratuberculosis
ucgccgucacugcacgcacggc

SEQ ID NO: 889375 - RNA, 18 nt, Mycobacterium avium subsp. paratuberculosis
ucgccgucacaccgcggc

SEQ ID NO: 889376 - RNA, 20 nt, Mycobacterium avium subsp. paratuberculosis
ucgccgucacaccgcggcca

SEQ ID NO: 889377 - RNA, 21 nt, Mycobacterium avium subsp. paratuberculosis
ucgcgacgagcgggccgauca

SEQ ID NO: 889378 - RNA, 22 nt, Mycobacterium avium subsp. paratuberculosis
ucgcgacgagcgggccgaucag

SEQ ID NO: 889379 - RNA, 13 nt, Mycobacterium avium subsp. paratuberculosis
ucgccggucuggu

SEQ ID NO: 889380 - RNA, 19 nt, Mycobacterium avium subsp. paratuberculosis
ucgccggugaccgcgccgg

SEQ ID NO: 889381 - RNA, 20 nt, Mycobacterium avium subsp. paratuberculosis
ucgccggugaccgcgccggu

SEQ ID NO: 889382 - RNA, 15 nt, Mycobacterium avium subsp. paratuberculosis
ucgccggugcggccg

SEQ ID NO: 889383 - RNA, 16 nt, Mycobacterium avium subsp. paratuberculosis
ucgccggugcggccgc

SEQ ID NO: 889384 - RNA, 15 nt, Mycobacterium avium subsp. paratuberculosis
ucgccggugcgggcu

SEQ ID NO: 889385 - RNA, 16 nt, Mycobacterium avium subsp. paratuberculosis
ucgccgguggccgccg

SEQ ID NO: 889386 - RNA, 17 nt, Mycobacterium avium subsp. paratuberculosis
ucgccggucagcgcauc

SEQ ID NO: 889387 - RNA, 17 nt, Mycobacterium avium subsp. paratuberculosis
ucgccgguaccgccggc

SEQ ID NO: 889388 - RNA, 19 nt, Mycobacterium avium subsp. paratuberculosis
ucgccgguaccgccggcca

SEQ ID NO: 889389 - RNA, 20 nt, Mycobacterium avium subsp. paratuberculosis
ucgccgguaccgccggccag

SEQ ID NO: 889390 - RNA, 22 nt, Mycobacterium avium subsp. paratuberculosis
ucgccgguaccgccggccaggc

SEQ ID NO: 889391 - RNA, 14 nt, Mycobacterium avium subsp. paratuberculosis
ucgcgcaccgcggc

SEQ ID NO: 889392 - RNA, 15 nt, Mycobacterium avium subsp. paratuberculosis
ucgcgcaccagcucg

SEQ ID NO: 889393 - RNA, 19 nt, Mycobacterium avium subsp. paratuberculosis
ucgcgcaccagggccugca

SEQ ID NO: 889394 - RNA, 14 nt, Mycobacterium avium subsp. paratuberculosis
ucgcgcaccauccg

SEQ ID NO: 889395 - RNA, 18 nt, Mycobacterium avium subsp. paratuberculosis
ucgcgcaccauccgcgac

SEQ ID NO: 889396 - RNA, 22 nt, Mycobacterium avium subsp. paratuberculosis
ucgcgcaccauccgcgacgcca

SEQ ID NO: 889397 - RNA, 23 nt, Mycobacterium avium subsp. paratuberculosis
ucgcgcaccauccgcgacgccag

SEQ ID NO: 889398 - RNA, 16 nt, Mycobacterium avium subsp. paratuberculosis
ucgcgcacccagccgc

SEQ ID NO: 889399 - RNA, 17 nt, Mycobacterium avium subsp. paratuberculosis
ucgcgcacccgcacgug

SEQ ID NO: 889400 - RNA, 14 nt, Mycobacterium avium subsp. paratuberculosis
ucgcgcaccaccuc

SEQ ID NO: 889401 - RNA, 15 nt, Mycobacterium avium subsp. paratuberculosis
ucgcgcaccaccucg

SEQ ID NO: 889402 - RNA, 17 nt, Mycobacterium avium subsp. paratuberculosis
ucgcgcaccaccucggc

SEQ ID NO: 889403 - RNA, 23 nt, Mycobacterium avium subsp. paratuberculosis
ucgcgcaccaccucggcgaucug

SEQ ID NO: 889404 - RNA, 21 nt, Mycobacterium avium subsp. paratuberculosis
ucgcgacgcggcucgcgcggu

SEQ ID NO: 889405 - RNA, 18 nt, Mycobacterium avium subsp. paratuberculosis
ucgcgacggccggggcca

SEQ ID NO: 889406 - RNA, 13 nt, Mycobacterium avium subsp. paratuberculosis
ucgcgagcgcgcu

SEQ ID NO: 889407 - RNA, 14 nt, Mycobacterium avium subsp. paratuberculosis
ucgcgaggccgcca

SEQ ID NO: 889408 - RNA, 12 nt, Mycobacterium avium subsp. paratuberculosis
ucgcgccgcgau

SEQ ID NO: 889409 - RNA, 16 nt, Mycobacterium avium subsp. paratuberculosis
ucgcgccgccacccca

SEQ ID NO: 889410 - RNA, 18 nt, Mycobacterium avium subsp. paratuberculosis
ucgcgccgccacgcggcg

SEQ ID NO: 889411 - RNA, 12 nt, Mycobacterium avium subsp. paratuberculosis
ucgcgccgccag

SEQ ID NO: 889412 - RNA, 14 nt, Mycobacterium avium subsp. paratuberculosis
ucgcgccggccgcc

SEQ ID NO: 889413 - RNA, 13 nt, Mycobacterium avium subsp. paratuberculosis
ucgcgccgggcgg

SEQ ID NO: 889414 - RNA, 21 nt, Mycobacterium avium subsp. paratuberculosis
ucgcgccgguaggcggccagc

SEQ ID NO: 889415 - RNA, 22 nt, Mycobacterium avium subsp. paratuberculosis
ucgcgccgguaggcggccagcg

SEQ ID NO: 889416 - RNA, 23 nt, Mycobacterium avium subsp. paratuberculosis
ucgcgccgguaggcggccagcgc

SEQ ID NO: 889417 - RNA, 15 nt, Mycobacterium avium subsp. paratuberculosis
ucgcgccgcggcgcu

SEQ ID NO: 889418 - RNA, 21 nt, Mycobacterium avium subsp. paratuberculosis
ucgcgccgcgucgcgccgccg

SEQ ID NO: 889419 - RNA, 19 nt, Mycobacterium avium subsp. paratuberculosis
ucgcgcaucgccucggcgg

SEQ ID NO: 889420 - RNA, 18 nt, Mycobacterium avium subsp. paratuberculosis
ucgcgcccuggaucgcgc

SEQ ID NO: 889421 - RNA, 13 nt, Mycobacterium avium subsp. paratuberculosis
ucgcgccgacccg

SEQ ID NO: 889422 - RNA, 15 nt, Mycobacterium avium subsp. paratuberculosis
ucgcgccgacccgcc

SEQ ID NO: 889423 - RNA, 18 nt, Mycobacterium avium subsp. paratuberculosis
ucgcgccgacccgcccgc

SEQ ID NO: 889424 - RNA, 23 nt, Mycobacterium avium subsp. paratuberculosis
ucgcgccgaccuggucgccgaac

SEQ ID NO: 889425 - RNA, 14 nt, Mycobacterium avium subsp. paratuberculosis
ucgcgccgagacac

SEQ ID NO: 889426 - RNA, 24 nt, Mycobacterium avium subsp. paratuberculosis
ucgcgccgagguggccgccagcac

SEQ ID NO: 889427 - RNA, 22 nt, Mycobacterium avium subsp. paratuberculosis
ucgcgccgaucugaccgagcag

SEQ ID NO: 889428 - RNA, 13 nt, Mycobacterium avium subsp. paratuberculosis
ucgcgcgguguuu

SEQ ID NO: 889429 - RNA, 20 nt, Mycobacterium avium subsp. paratuberculosis
ucgcgcgguguuuggccgcg

SEQ ID NO: 889430 - RNA, 14 nt, Mycobacterium avium subsp. paratuberculosis
ucgcgcgucacgcu

SEQ ID NO: 889431 - RNA, 21 nt, Mycobacterium avium subsp. paratuberculosis
ucgcgcgucacgcuggcguga

SEQ ID NO: 889432 - RNA, 18 nt, Mycobacterium avium subsp. paratuberculosis
ucgcgcgaaacccccggg

SEQ ID NO: 889433 - RNA, 15 nt, Mycobacterium avium subsp. paratuberculosis
ucgcgcggggcggcc

SEQ ID NO: 889434 - RNA, 19 nt, Mycobacterium avium subsp. paratuberculosis
ucgcgcggggcggccgccg

SEQ ID NO: 889435 - RNA, 22 nt, Mycobacterium avium subsp. paratuberculosis
ucgcgcggggcggccgccgggc

SEQ ID NO: 889436 - RNA, 16 nt, Mycobacterium avium subsp. paratuberculosis
ucgcgcggggucgggc

SEQ ID NO: 889437 - RNA, 19 nt, Mycobacterium avium subsp. paratuberculosis
ucgcgcggggugacgcccg

SEQ ID NO: 889438 - RNA, 21 nt, Mycobacterium avium subsp. paratuberculosis
ucgcgcggggugacgcccguc

SEQ ID NO: 889439 - RNA, 20 nt, Mycobacterium avium subsp. paratuberculosis
ucgcgccugcaccggcgacg

SEQ ID NO: 889440 - RNA, 24 nt, Mycobacterium avium subsp. paratuberculosis
ucgcgccugcaccggcgacggcgg

SEQ ID NO: 889441 - RNA, 18 nt, Mycobacterium avium subsp. paratuberculosis
ucgcgccgcucggccagc

SEQ ID NO: 889442 - RNA, 17 nt, Mycobacterium avium subsp. paratuberculosis
ucgcgcagggucagcgc

SEQ ID NO: 889443 - RNA, 20 nt, Mycobacterium avium subsp. paratuberculosis
ucgcgcagggccagcgccuc

SEQ ID NO: 889444 - RNA, 22 nt, Mycobacterium avium subsp. paratuberculosis
ucgcgcaggucgggccggccga

SEQ ID NO: 889445 - RNA, 23 nt, Mycobacterium avium subsp. paratuberculosis
ucgcgcaggugaugcggcccgac

SEQ ID NO: 889446 - RNA, 21 nt, Mycobacterium avium subsp. paratuberculosis
ucgcgcaccuggucggucagc

SEQ ID NO: 889447 - RNA, 16 nt, Mycobacterium avium subsp. paratuberculosis
ucgcgcaucacccggc

SEQ ID NO: 889448 - RNA, 22 nt, Mycobacterium avium subsp. paratuberculosis
ucgcgcaucagcaccuccggca

SEQ ID NO: 889449 - RNA, 19 nt, Mycobacterium avium subsp. paratuberculosis
ucgcgcagcugcgccgcgu

SEQ ID NO: 889450 - RNA, 23 nt, Mycobacterium avium subsp. paratuberculosis
ucgcgcaggaugcccagcaccac

SEQ ID NO: 889451 - RNA, 15 nt, Mycobacterium avium subsp. paratuberculosis
ucgcgcagcgcgucg

SEQ ID NO: 889452 - RNA, 16 nt, Mycobacterium avium subsp. paratuberculosis
ucgcgcagcgcgucgg

SEQ ID NO: 889453 - RNA, 17 nt, Mycobacterium avium subsp. paratuberculosis
ucgcgcagcgcgucggg

SEQ ID NO: 889454 - RNA, 19 nt, Mycobacterium avium subsp. paratuberculosis
ucgcgcacgccaucgccuc

SEQ ID NO: 889455 - RNA, 22 nt, Mycobacterium avium subsp. paratuberculosis
ucgcgcacgccaucgccucggc

SEQ ID NO: 889456 - RNA, 12 nt, Mycobacterium avium subsp. paratuberculosis
ucgcgcacgcug

SEQ ID NO: 889457 - RNA, 20 nt, Mycobacterium avium subsp. paratuberculosis
ucgcgcacgcuggccggcag

SEQ ID NO: 889458 - RNA, 14 nt, Mycobacterium avium subsp. paratuberculosis
ucgcgcacggcgcg

SEQ ID NO: 889459 - RNA, 15 nt, Mycobacterium avium subsp. paratuberculosis
ucgcgcacggcgcgc

SEQ ID NO: 889460 - RNA, 16 nt, Mycobacterium avium subsp. paratuberculosis
ucgcgcacggcgcgca

SEQ ID NO: 889461 - RNA, 18 nt, Mycobacterium avium subsp. paratuberculosis
ucgcgcaccuucccggcc

SEQ ID NO: 889462 - RNA, 20 nt, Mycobacterium avium subsp. paratuberculosis
ucgcgcaccuucccggccgc

SEQ ID NO: 889463 - RNA, 21 nt, Mycobacterium avium subsp. paratuberculosis
ucgcgcaccuucccggccgcc

SEQ ID NO: 889464 - RNA, 20 nt, Mycobacterium avium subsp. paratuberculosis
ucgcgcaaugccgccgcgac

SEQ ID NO: 889465 - RNA, 15 nt, Mycobacterium avium subsp. paratuberculosis
ucgcgcaccgcggcg

SEQ ID NO: 889466 - RNA, 16 nt, Mycobacterium avium subsp. paratuberculosis
ucgcgcaccgcggcgg

SEQ ID NO: 889467 - RNA, 16 nt, Mycobacterium avium subsp. paratuberculosis
ucgcgcaccgcgggcu

SEQ ID NO: 889468 - RNA, 12 nt, Mycobacterium avium subsp. paratuberculosis
ucgcgcaccggc

SEQ ID NO: 889469 - RNA, 14 nt, Mycobacterium avium subsp. paratuberculosis
ucgcgcaccgggac

SEQ ID NO: 889470 - RNA, 14 nt, Mycobacterium avium subsp. paratuberculosis
ucgcggcugcgcac

SEQ ID NO: 889471 - RNA, 17 nt, Mycobacterium avium subsp. paratuberculosis
ucgcggcugcgcacgua

SEQ ID NO: 889472 - RNA, 23 nt, Mycobacterium avium subsp. paratuberculosis
ucgcggcuggugccgccggcgau

SEQ ID NO: 889473 - RNA, 15 nt, Mycobacterium avium subsp. paratuberculosis
ucgcggcuggccgcg

SEQ ID NO: 889474 - RNA, 18 nt, Mycobacterium avium subsp. paratuberculosis
ucgcggcggucacgcccg

SEQ ID NO: 889475 - RNA, 20 nt, Mycobacterium avium subsp. paratuberculosis
ucgcggcggucacgcccggg

SEQ ID NO: 889476 - RNA, 22 nt, Mycobacterium avium subsp. paratuberculosis
ucgcggcggcgcuggucggcgg

SEQ ID NO: 889477 - RNA, 24 nt, Mycobacterium avium subsp. paratuberculosis
ucgcggcggcguacgcgauggcgg

SEQ ID NO: 889478 - RNA, 16 nt, Mycobacterium avium subsp. paratuberculosis
ucgcggcggcgucggc

SEQ ID NO: 889479 - RNA, 15 nt, Mycobacterium avium subsp. paratuberculosis
ucgcggcguaggcgg

SEQ ID NO: 889480 - RNA, 18 nt, Mycobacterium avium subsp. paratuberculosis
ucgcggcguaggcggcca

SEQ ID NO: 889481 - RNA, 22 nt, Mycobacterium avium subsp. paratuberculosis
ucgcggcguaggugggcagcgc

SEQ ID NO: 889482 - RNA, 23 nt, Mycobacterium avium subsp. paratuberculosis
ucgcggcgggccuugagcaccgc

SEQ ID NO: 889483 - RNA, 17 nt, Mycobacterium avium subsp. paratuberculosis
ucgcggcguugcccgcu

SEQ ID NO: 889484 - RNA, 13 nt, Mycobacterium avium subsp. paratuberculosis
ucgcggcgccggu

SEQ ID NO: 889485 - RNA, 22 nt, Mycobacterium avium subsp. paratuberculosis
ucgcggcgccgguuuccaggac

SEQ ID NO: 889486 - RNA, 14 nt, Mycobacterium avium subsp. paratuberculosis
ucgcggcggcccgu

SEQ ID NO: 889487 - RNA, 15 nt, Mycobacterium avium subsp. paratuberculosis
ucgcggcggcccguc

SEQ ID NO: 889488 - RNA, 14 nt, Mycobacterium avium subsp. paratuberculosis
ucgcggcggccggc

SEQ ID NO: 889489 - RNA, 13 nt, Mycobacterium avium subsp. paratuberculosis
ucgcggcggcgcc

SEQ ID NO: 889490 - RNA, 16 nt, Mycobacterium avium subsp. paratuberculosis
ucgcggcggcgccgca

SEQ ID NO: 889491 - RNA, 18 nt, Mycobacterium avium subsp. paratuberculosis
ucgcggcggcgccgcagc

SEQ ID NO: 889492 - RNA, 13 nt, Mycobacterium avium subsp. paratuberculosis
ucgcggcgcagcu

SEQ ID NO: 889493 - RNA, 15 nt, Mycobacterium avium subsp. paratuberculosis
ucgcggccguagccg

SEQ ID NO: 889494 - RNA, 13 nt, Mycobacterium avium subsp. paratuberculosis
ucgcggcgcacgg

SEQ ID NO: 889495 - RNA, 13 nt, Mycobacterium avium subsp. paratuberculosis
ucgcggcgcacgu

SEQ ID NO: 889496 - RNA, 14 nt, Mycobacterium avium subsp. paratuberculosis
ucgcggcgcagcac

SEQ ID NO: 889497 - RNA, 17 nt, Mycobacterium avium subsp. paratuberculosis
ucgcggcgcagcacggc

SEQ ID NO: 889498 - RNA, 18 nt, Mycobacterium avium subsp. paratuberculosis
ucgcggcgaucgcgagca

SEQ ID NO: 889499 - RNA, 13 nt, Mycobacterium avium subsp. paratuberculosis
ucgcggcgaucgg

SEQ ID NO: 889500 - RNA, 16 nt, Mycobacterium avium subsp. paratuberculosis
ucgcggcgaugguguc

SEQ ID NO: 889501 - RNA, 18 nt, Mycobacterium avium subsp. paratuberculosis
ucgcggcgcacccgggca

SEQ ID NO: 889502 - RNA, 19 nt, Mycobacterium avium subsp. paratuberculosis
ucgcggcgcacccgggcag

SEQ ID NO: 889503 - RNA, 14 nt, Mycobacterium avium subsp. paratuberculosis
ucgcggccggcgag

SEQ ID NO: 889504 - RNA, 18 nt, Mycobacterium avium subsp. paratuberculosis
ucgcggccggcgagucgc

SEQ ID NO: 889505 - RNA, 20 nt, Mycobacterium avium subsp. paratuberculosis
ucgcggccggcgagucgcgg

SEQ ID NO: 889506 - RNA, 17 nt, Mycobacterium avium subsp. paratuberculosis
ucgcggccuccgagcgg

SEQ ID NO: 889507 - RNA, 19 nt, Mycobacterium avium subsp. paratuberculosis
ucgcggccuccgagcggcg

SEQ ID NO: 889508 - RNA, 17 nt, Mycobacterium avium subsp. paratuberculosis
ucgcggccugcgggcgc

SEQ ID NO: 889509 - RNA, 21 nt, Mycobacterium avium subsp. paratuberculosis
ucgcggccugcgggcgccggc

SEQ ID NO: 889510 - RNA, 17 nt, Mycobacterium avium subsp. paratuberculosis
ucgcggccuugcgggcc

SEQ ID NO: 889511 - RNA, 15 nt, Mycobacterium avium subsp. paratuberculosis
ucgcggcgaaccagc

SEQ ID NO: 889512 - RNA, 14 nt, Mycobacterium avium subsp. paratuberculosis
ucgcggcgacccgc

SEQ ID NO: 889513 - RNA, 18 nt, Mycobacterium avium subsp. paratuberculosis
ucgcggcgagcagcgcga

SEQ ID NO: 889514 - RNA, 19 nt, Mycobacterium avium subsp. paratuberculosis
ucgcggcgagcagcgcgau

SEQ ID NO: 889515 - RNA, 15 nt, Mycobacterium avium subsp. paratuberculosis
ucgcggccgcccggu

SEQ ID NO: 889516 - RNA, 22 nt, Mycobacterium avium subsp. paratuberculosis
ucgcggcccacccgcagggcgc

SEQ ID NO: 889517 - RNA, 17 nt, Mycobacterium avium subsp. paratuberculosis
ucgcggcccaccgcguc

SEQ ID NO: 889518 - RNA, 13 nt, Mycobacterium avium subsp. paratuberculosis
ucgcggcccagca

SEQ ID NO: 889519 - RNA, 16 nt, Mycobacterium avium subsp. paratuberculosis
ucgcggcccagcacca

SEQ ID NO: 889520 - RNA, 12 nt, Mycobacterium avium subsp. paratuberculosis
ucgcggcccgcc

SEQ ID NO: 889521 - RNA, 16 nt, Mycobacterium avium subsp. paratuberculosis
ucgcggcccgccgcuc

SEQ ID NO: 889522 - RNA, 20 nt, Mycobacterium avium subsp. paratuberculosis
ucgcggcccuggaugucacg

SEQ ID NO: 889523 - RNA, 20 nt, Mycobacterium avium subsp. paratuberculosis
ucgcggccagcgugaacacc

SEQ ID NO: 889524 - RNA, 22 nt, Mycobacterium avium subsp. paratuberculosis
ucgcggccagcgugaacaccgc

SEQ ID NO: 889525 - RNA, 12 nt, Mycobacterium avium subsp. paratuberculosis
ucgcggccagcg

SEQ ID NO: 889526 - RNA, 15 nt, Mycobacterium avium subsp. paratuberculosis
ucgcggccaccacga

SEQ ID NO: 889527 - RNA, 20 nt, Mycobacterium avium subsp. paratuberculosis
ucgcggccaccacgacgccg

SEQ ID NO: 889528 - RNA, 21 nt, Mycobacterium avium subsp. paratuberculosis
ucgcggccaccacgacgccgg

SEQ ID NO: 889529 - RNA, 16 nt, Mycobacterium avium subsp. paratuberculosis
ucgcggccacgcccug

SEQ ID NO: 889530 - RNA, 22 nt, Mycobacterium avium subsp. paratuberculosis
ucgcggccacgcccuggccgcc

SEQ ID NO: 889531 - RNA, 14 nt, Mycobacterium avium subsp. paratuberculosis
ucgcggcaggcgac

SEQ ID NO: 889532 - RNA, 17 nt, Mycobacterium avium subsp. paratuberculosis
ucgcggcaucccuggug

SEQ ID NO: 889533 - RNA, 19 nt, Mycobacterium avium subsp. paratuberculosis
ucgcggcaucccuggugac

SEQ ID NO: 889534 - RNA, 17 nt, Mycobacterium avium subsp. paratuberculosis
ucgcggaugcgggcgcu

SEQ ID NO: 889535 - RNA, 20 nt, Mycobacterium avium subsp. paratuberculosis
ucgcggaugcgggcgcugcc

SEQ ID NO: 889536 - RNA, 20 nt, Mycobacterium avium subsp. paratuberculosis
ucgcggauguccgaccgguu

SEQ ID NO: 889537 - RNA, 21 nt, Mycobacterium avium subsp. paratuberculosis
ucgcggauguccgaccgguug

SEQ ID NO: 889538 - RNA, 18 nt, Mycobacterium avium subsp. paratuberculosis
ucgcggaucucgucgggc

SEQ ID NO: 889539 - RNA, 22 nt, Mycobacterium avium subsp. paratuberculosis
ucgcggcaaagggcuaggugac

SEQ ID NO: 889540 - RNA, 15 nt, Mycobacterium avium subsp. paratuberculosis
ucgcggcaaggcgca

SEQ ID NO: 889541 - RNA, 20 nt, Mycobacterium avium subsp. paratuberculosis
ucgcggcaaggcgcagaagc

SEQ ID NO: 889542 - RNA, 21 nt, Mycobacterium avium subsp. paratuberculosis
ucgcggaggaugccggccagc

SEQ ID NO: 889543 - RNA, 22 nt, Mycobacterium avium subsp. paratuberculosis
ucgcggaggaugccggccagcu

SEQ ID NO: 889544 - RNA, 22 nt, Mycobacterium avium subsp. paratuberculosis
ucgcggauacgcccggccaccu

SEQ ID NO: 889545 - RNA, 21 nt, Mycobacterium avium subsp. paratuberculosis
ucgcggaucaugauccggaag

SEQ ID NO: 889546 - RNA, 12 nt, Mycobacterium avium subsp. paratuberculosis
ucgcggauccgc

SEQ ID NO: 889547 - RNA, 22 nt, Mycobacterium avium subsp. paratuberculosis
ucgcggaucgaacagggcggcg

SEQ ID NO: 889548 - RNA, 14 nt, Mycobacterium avium subsp. paratuberculosis
ucgcggaucgaguu

SEQ ID NO: 889549 - RNA, 16 nt, Mycobacterium avium subsp. paratuberculosis
ucgcggaaccggccgg

SEQ ID NO: 889550 - RNA, 17 nt, Mycobacterium avium subsp. paratuberculosis
ucgcggaaccggccggg

SEQ ID NO: 889551 - RNA, 23 nt, Mycobacterium avium subsp. paratuberculosis
ucgcggaacugcucccaggcguc

SEQ ID NO: 889552 - RNA, 21 nt, Mycobacterium avium subsp. paratuberculosis
ucgcgcuggggugcucgauca

SEQ ID NO: 889553 - RNA, 14 nt, Mycobacterium avium subsp. paratuberculosis
ucgcgcucgacgau

SEQ ID NO: 889554 - RNA, 18 nt, Mycobacterium avium subsp. paratuberculosis
ucgcgcucgacgaugucg

SEQ ID NO: 889555 - RNA, 12 nt, Mycobacterium avium subsp. paratuberculosis
ucgcgcucgucc

SEQ ID NO: 889556 - RNA, 13 nt, Mycobacterium avium subsp. paratuberculosis
ucgcgcucccggc

SEQ ID NO: 889557 - RNA, 15 nt, Mycobacterium avium subsp. paratuberculosis
ucgcgcucccggcgc

SEQ ID NO: 889558 - RNA, 17 nt, Mycobacterium avium subsp. paratuberculosis
ucgcgcucccggcgccg

SEQ ID NO: 889559 - RNA, 19 nt, Mycobacterium avium subsp. paratuberculosis
ucgcgcucagugcacgcuc

SEQ ID NO: 889560 - RNA, 20 nt, Mycobacterium avium subsp. paratuberculosis
ucgcgcucagugcacgcucg

SEQ ID NO: 889561 - RNA, 16 nt, Mycobacterium avium subsp. paratuberculosis
ucgcgcucauaucccg

SEQ ID NO: 889562 - RNA, 18 nt, Mycobacterium avium subsp. paratuberculosis
ucgcgcuaggacgcgggc

SEQ ID NO: 889563 - RNA, 12 nt, Mycobacterium avium subsp. paratuberculosis
ucgcgcuggcgg

SEQ ID NO: 889564 - RNA, 21 nt, Mycobacterium avium subsp. paratuberculosis
ucgcgcuggcggccaucgccg

SEQ ID NO: 889565 - RNA, 19 nt, Mycobacterium avium subsp. paratuberculosis
ucgcgcugccgcgcgccga

SEQ ID NO: 889566 - RNA, 20 nt, Mycobacterium avium subsp. paratuberculosis
ucgcgcugcgggaagccgag

SEQ ID NO: 889567 - RNA, 17 nt, Mycobacterium avium subsp. paratuberculosis
ucgcgcugcaugccggu

SEQ ID NO: 889568 - RNA, 12 nt, Mycobacterium avium subsp. paratuberculosis
ucgcgcugacca

SEQ ID NO: 889569 - RNA, 15 nt, Mycobacterium avium subsp. paratuberculosis
ucgcgcugccagggc

SEQ ID NO: 889570 - RNA, 20 nt, Mycobacterium avium subsp. paratuberculosis
ucgcgcugccagggccgggc

SEQ ID NO: 889571 - RNA, 18 nt, Mycobacterium avium subsp. paratuberculosis
ucgcgcugccggcccgau

SEQ ID NO: 889572 - RNA, 15 nt, Mycobacterium avium subsp. paratuberculosis
uccuucaucgaucgg

SEQ ID NO: 889573 - RNA, 13 nt, Mycobacterium avium subsp. paratuberculosis
uccuucccggugg

SEQ ID NO: 889574 - RNA, 13 nt, Mycobacterium avium subsp. paratuberculosis
ucgaaaccgguca

SEQ ID NO: 889575 - RNA, 21 nt, Mycobacterium avium subsp. paratuberculosis
ucgaaaccgucuccggcgcgg

SEQ ID NO: 889576 - RNA, 12 nt, Mycobacterium avium subsp. paratuberculosis
ucgaaaccgccc

SEQ ID NO: 889577 - RNA, 23 nt, Mycobacterium avium subsp. paratuberculosis
uccuguuggcccugcucuucgcg

SEQ ID NO: 889578 - RNA, 15 nt, Mycobacterium avium subsp. paratuberculosis
uccuguuccccggcg

SEQ ID NO: 889579 - RNA, 19 nt, Mycobacterium avium subsp. paratuberculosis
uccuguuccccggcgggcu

SEQ ID NO: 889580 - RNA, 17 nt, Mycobacterium avium subsp. paratuberculosis
uccucggccagcgguug

SEQ ID NO: 889581 - RNA, 21 nt, Mycobacterium avium subsp. paratuberculosis
uccucggccagcucaccggcc

SEQ ID NO: 889582 - RNA, 21 nt, Mycobacterium avium subsp. paratuberculosis
uccucggccccaaaagccuug

SEQ ID NO: 889583 - RNA, 18 nt, Mycobacterium avium subsp. paratuberculosis
uccucgcugaccucgaca

SEQ ID NO: 889584 - RNA, 18 nt, Mycobacterium avium subsp. paratuberculosis
uccucgcgccgccacgcg

SEQ ID NO: 889585 - RNA, 13 nt, Mycobacterium avium subsp. paratuberculosis
uccucgcgcggca

SEQ ID NO: 889586 - RNA, 15 nt, Mycobacterium avium subsp. paratuberculosis
uccucggccagcccc

SEQ ID NO: 889587 - RNA, 13 nt, Mycobacterium avium subsp. paratuberculosis
uccucggccagcg

SEQ ID NO: 889588 - RNA, 14 nt, Mycobacterium avium subsp. paratuberculosis
uccucggacccgau

SEQ ID NO: 889589 - RNA, 15 nt, Mycobacterium avium subsp. paratuberculosis
uccucgccgcgccag

SEQ ID NO: 889590 - RNA, 19 nt, Mycobacterium avium subsp. paratuberculosis
uccucgccgagcagaucgg

SEQ ID NO: 889591 - RNA, 16 nt, Mycobacterium avium subsp. paratuberculosis
ucgaagaacgcguccc

SEQ ID NO: 889592 - RNA, 21 nt, Mycobacterium avium subsp. paratuberculosis
ucgaagaagagggcgugacgc

SEQ ID NO: 889593 - RNA, 18 nt, Mycobacterium avium subsp. paratuberculosis
ucgaagaagcggccgacg

SEQ ID NO: 889594 - RNA, 13 nt, Mycobacterium avium subsp. paratuberculosis
ucgaacgcgacga

SEQ ID NO: 889595 - RNA, 21 nt, Mycobacterium avium subsp. paratuberculosis
ucgaacgcgacgaagcggucg

SEQ ID NO: 889596 - RNA, 16 nt, Mycobacterium avium subsp. paratuberculosis
ucgaacgcgccgaucg

SEQ ID NO: 889597 - RNA, 15 nt, Mycobacterium avium subsp. paratuberculosis
ucgaacgcggcgccg

SEQ ID NO: 889598 - RNA, 22 nt, Mycobacterium avium subsp. paratuberculosis
ucgaacgcguacacggcccgcg

SEQ ID NO: 889599 - RNA, 14 nt, Mycobacterium avium subsp. paratuberculosis
ucgaacucaccggu

SEQ ID NO: 889600 - RNA, 15 nt, Mycobacterium avium subsp. paratuberculosis
ucgaacucaccggug

SEQ ID NO: 889601 - RNA, 20 nt, Mycobacterium avium subsp. paratuberculosis
ucgaacggcaaccugggcgg

SEQ ID NO: 889602 - RNA, 22 nt, Mycobacterium avium subsp. paratuberculosis
ucgaacggcaaccugggcggcg

SEQ ID NO: 889603 - RNA, 18 nt, Mycobacterium avium subsp. paratuberculosis
ucgaacggcaccucgauc

SEQ ID NO: 889604 - RNA, 17 nt, Mycobacterium avium subsp. paratuberculosis
ucgaacaacccggccgc

SEQ ID NO: 889605 - RNA, 18 nt, Mycobacterium avium subsp. paratuberculosis
ucgaacaacccggccgcg

SEQ ID NO: 889606 - RNA, 22 nt, Mycobacterium avium subsp. paratuberculosis
ucgaacacaucguggcgcauca

SEQ ID NO: 889607 - RNA, 23 nt, Mycobacterium avium subsp. paratuberculosis
ucgaacgccagcgccgcaacggc

SEQ ID NO: 889608 - RNA, 16 nt, Mycobacterium avium subsp. paratuberculosis
ucgaacgcccgcacca

SEQ ID NO: 889609 - RNA, 17 nt, Mycobacterium avium subsp. paratuberculosis
ucgaagaugucgcggcg

SEQ ID NO: 889610 - RNA, 15 nt, Mycobacterium avium subsp. paratuberculosis
ucgaagauggccagg

SEQ ID NO: 889611 - RNA, 16 nt, Mycobacterium avium subsp. paratuberculosis
ucgaagaccacgaacu

SEQ ID NO: 889612 - RNA, 17 nt, Mycobacterium avium subsp. paratuberculosis
ucgaagaccacgaacug

SEQ ID NO: 889613 - RNA, 22 nt, Mycobacterium avium subsp. paratuberculosis
ucgaagaguugggucgcguccg

SEQ ID NO: 889614 - RNA, 13 nt, Mycobacterium avium subsp. paratuberculosis
ucgaagccgaucg

SEQ ID NO: 889615 - RNA, 17 nt, Mycobacterium avium subsp. paratuberculosis
ucgaagccgaucgcggc

SEQ ID NO: 889616 - RNA, 18 nt, Mycobacterium avium subsp. paratuberculosis
ucgaagccgaucgcggcg

SEQ ID NO: 889617 - RNA, 21 nt, Mycobacterium avium subsp. paratuberculosis
ucgaagcagccuucuuggcgg

SEQ ID NO: 889618 - RNA, 19 nt, Mycobacterium avium subsp. paratuberculosis
ucgaaguccugcgccgcgg

SEQ ID NO: 889619 - RNA, 15 nt, Mycobacterium avium subsp. paratuberculosis
ucgaagugacgccgc

SEQ ID NO: 889620 - RNA, 16 nt, Mycobacterium avium subsp. paratuberculosis
ucgaagugacgccgcu

SEQ ID NO: 889621 - RNA, 20 nt, Mycobacterium avium subsp. paratuberculosis
ucgaagugacgccgcucggc

SEQ ID NO: 889622 - RNA, 21 nt, Mycobacterium avium subsp. paratuberculosis
ucgaagcccuucaccucggcc

SEQ ID NO: 889623 - RNA, 15 nt, Mycobacterium avium subsp. paratuberculosis
ucgaauccggcggcg

SEQ ID NO: 889624 - RNA, 20 nt, Mycobacterium avium subsp. paratuberculosis
ucgacaacgcgugaugcagc

SEQ ID NO: 889625 - RNA, 17 nt, Mycobacterium avium subsp. paratuberculosis
ucgacagccggucgcgc

SEQ ID NO: 889626 - RNA, 21 nt, Mycobacterium avium subsp. paratuberculosis
ucgacaggcagcccggcugcg

SEQ ID NO: 889627 - RNA, 23 nt, Mycobacterium avium subsp. paratuberculosis
ucgacaccccgcucggccagcgc

SEQ ID NO: 889628 - RNA, 16 nt, Mycobacterium avium subsp. paratuberculosis
ucgacacggugaacgu

SEQ ID NO: 889629 - RNA, 23 nt, Mycobacterium avium subsp. paratuberculosis
ucgacagguucuuggcggccugc

SEQ ID NO: 889630 - RNA, 15 nt, Mycobacterium avium subsp. paratuberculosis
ucgaccccgcccagc

SEQ ID NO: 889631 - RNA, 21 nt, Mycobacterium avium subsp. paratuberculosis
ucgaccccgcccagcgacucg

SEQ ID NO: 889632 - RNA, 14 nt, Mycobacterium avium subsp. paratuberculosis
ucgaccccgccggc

SEQ ID NO: 889633 - RNA, 15 nt, Mycobacterium avium subsp. paratuberculosis
ucgaccccgccggcc

SEQ ID NO: 889634 - RNA, 13 nt, Mycobacterium avium subsp. paratuberculosis
ucgacccggccgc

SEQ ID NO: 889635 - RNA, 18 nt, Mycobacterium avium subsp. paratuberculosis
ucgacccggccgcgccgg

SEQ ID NO: 889636 - RNA, 14 nt, Mycobacterium avium subsp. paratuberculosis
ucgacccgggccag

SEQ ID NO: 889637 - RNA, 14 nt, Mycobacterium avium subsp. paratuberculosis
ucgacccgcauccg

SEQ ID NO: 889638 - RNA, 23 nt, Mycobacterium avium subsp. paratuberculosis
ucgacccgcauccgccgggcggc

SEQ ID NO: 889639 - RNA, 14 nt, Mycobacterium avium subsp. paratuberculosis
ucgacccgccgcag

SEQ ID NO: 889640 - RNA, 15 nt, Mycobacterium avium subsp. paratuberculosis
ucgacccgcggcgcc

SEQ ID NO: 889641 - RNA, 20 nt, Mycobacterium avium subsp. paratuberculosis
ucgacccgcggcgccgcggc

SEQ ID NO: 889642 - RNA, 21 nt, Mycobacterium avium subsp. paratuberculosis
ucgacccgcuccccgauccgg

SEQ ID NO: 889643 - RNA, 15 nt, Mycobacterium avium subsp. paratuberculosis
ucgacccgcuccgac

SEQ ID NO: 889644 - RNA, 18 nt, Mycobacterium avium subsp. paratuberculosis
ucgacccgcuccgacgcg

SEQ ID NO: 889645 - RNA, 22 nt, Mycobacterium avium subsp. paratuberculosis
ucgacccguuccccggccgacg

SEQ ID NO: 889646 - RNA, 18 nt, Mycobacterium avium subsp. paratuberculosis
ucgacccguuccggcgag

SEQ ID NO: 889647 - RNA, 13 nt, Mycobacterium avium subsp. paratuberculosis
ucgaccgcgacga

SEQ ID NO: 889648 - RNA, 18 nt, Mycobacterium avium subsp. paratuberculosis
ucgaccgcgacgaccucg

SEQ ID NO: 889649 - RNA, 12 nt, Mycobacterium avium subsp. paratuberculosis
ucgaccgcgaug

SEQ ID NO: 889650 - RNA, 13 nt, Mycobacterium avium subsp. paratuberculosis
ucgaccgcgaugg

SEQ ID NO: 889651 - RNA, 18 nt, Mycobacterium avium subsp. paratuberculosis
ucgaccgcgcaccggcgc

SEQ ID NO: 889652 - RNA, 12 nt, Mycobacterium avium subsp. paratuberculosis
ucgaccgcgccg

SEQ ID NO: 889653 - RNA, 13 nt, Mycobacterium avium subsp. paratuberculosis
ucgaccgcgccgg

SEQ ID NO: 889654 - RNA, 13 nt, Mycobacterium avium subsp. paratuberculosis
ucgaccgccucgg

SEQ ID NO: 889655 - RNA, 13 nt, Mycobacterium avium subsp. paratuberculosis
ucgaccgccgcgu

SEQ ID NO: 889656 - RNA, 15 nt, Mycobacterium avium subsp. paratuberculosis
ucgaccgccgcgucg

SEQ ID NO: 889657 - RNA, 13 nt, Mycobacterium avium subsp. paratuberculosis
ucgacgacccgau

SEQ ID NO: 889658 - RNA, 22 nt, Mycobacterium avium subsp. paratuberculosis
ucgacgaacuuggacggaucgg

SEQ ID NO: 889659 - RNA, 20 nt, Mycobacterium avium subsp. paratuberculosis
ucgacgaacuccgcgcgcgg

SEQ ID NO: 889660 - RNA, 21 nt, Mycobacterium avium subsp. paratuberculosis
ucgacgaacuccgcgcgcggc

SEQ ID NO: 889661 - RNA, 19 nt, Mycobacterium avium subsp. paratuberculosis
ucgacgccggugaaaccgg

SEQ ID NO: 889662 - RNA, 16 nt, Mycobacterium avium subsp. paratuberculosis
ucgacgccgugcugcc

SEQ ID NO: 889663 - RNA, 16 nt, Mycobacterium avium subsp. paratuberculosis
ucgacgccucggugcg

SEQ ID NO: 889664 - RNA, 17 nt, Mycobacterium avium subsp. paratuberculosis
ucgacgccgauggugac

SEQ ID NO: 889665 - RNA, 15 nt, Mycobacterium avium subsp. paratuberculosis
ucgacgccgcugccg

SEQ ID NO: 889666 - RNA, 18 nt, Mycobacterium avium subsp. paratuberculosis
ucgacgcccugccacagc

SEQ ID NO: 889667 - RNA, 15 nt, Mycobacterium avium subsp. paratuberculosis
ucgacgccccgcgcc

SEQ ID NO: 889668 - RNA, 16 nt, Mycobacterium avium subsp. paratuberculosis
ucgacgccgaccgcgg

SEQ ID NO: 889669 - RNA, 21 nt, Mycobacterium avium subsp. paratuberculosis
ucgacgcccuuggcgcccagc

SEQ ID NO: 889670 - RNA, 16 nt, Mycobacterium avium subsp. paratuberculosis
ucgaccuucuugucca

SEQ ID NO: 889671 - RNA, 14 nt, Mycobacterium avium subsp. paratuberculosis
ucgaccugcgggug

SEQ ID NO: 889672 - RNA, 15 nt, Mycobacterium avium subsp. paratuberculosis
ucgaccucggcggcc

SEQ ID NO: 889673 - RNA, 17 nt, Mycobacterium avium subsp. paratuberculosis
ucgaccucgucggcggc

SEQ ID NO: 889674 - RNA, 18 nt, Mycobacterium avium subsp. paratuberculosis
ucgaccucgucggcggcg

SEQ ID NO: 889675 - RNA, 22 nt, Mycobacterium avium subsp. paratuberculosis
ucgaccucgucggcggcgacgg

SEQ ID NO: 889676 - RNA, 18 nt, Mycobacterium avium subsp. paratuberculosis
ucgaccucuucggcgccg

SEQ ID NO: 889677 - RNA, 19 nt, Mycobacterium avium subsp. paratuberculosis
ucgaccucgagcgucacgc

SEQ ID NO: 889678 - RNA, 18 nt, Mycobacterium avium subsp. paratuberculosis
ucgaccucgcgcgucacg

SEQ ID NO: 889679 - RNA, 20 nt, Mycobacterium avium subsp. paratuberculosis
ucgaccgcggcuccggccgc

SEQ ID NO: 889680 - RNA, 19 nt, Mycobacterium avium subsp. paratuberculosis
ucgaccggcaccagcagcc

SEQ ID NO: 889681 - RNA, 19 nt, Mycobacterium avium subsp. paratuberculosis
ucgaccggcggaaguagcc

SEQ ID NO: 889682 - RNA, 17 nt, Mycobacterium avium subsp. paratuberculosis
ucgaccggcucgccguu

SEQ ID NO: 889683 - RNA, 17 nt, Mycobacterium avium subsp. paratuberculosis
ucgaccggguuggcgcg

SEQ ID NO: 889684 - RNA, 18 nt, Mycobacterium avium subsp. paratuberculosis
ucgaccggguuggcgcgc

SEQ ID NO: 889685 - RNA, 15 nt, Mycobacterium avium subsp. paratuberculosis
ucgaccgucacgcug

SEQ ID NO: 889686 - RNA, 13 nt, Mycobacterium avium subsp. paratuberculosis
ucgaccgucaggu

SEQ ID NO: 889687 - RNA, 23 nt, Mycobacterium avium subsp. paratuberculosis
ucgaccgguucgucaacgccccg

SEQ ID NO: 889688 - RNA, 19 nt, Mycobacterium avium subsp. paratuberculosis
ucgaccgugaggcccggcg

SEQ ID NO: 889689 - RNA, 18 nt, Mycobacterium avium subsp. paratuberculosis
ucgaccuccacgagccgg

SEQ ID NO: 889690 - RNA, 21 nt, Mycobacterium avium subsp. paratuberculosis
ucgaccuccacgagccggucg

SEQ ID NO: 889691 - RNA, 12 nt, Mycobacterium avium subsp. paratuberculosis
ucgauugccgcg

SEQ ID NO: 889692 - RNA, 15 nt, Mycobacterium avium subsp. paratuberculosis
ucgauguugaucgcc

SEQ ID NO: 889693 - RNA, 13 nt, Mycobacterium avium subsp. paratuberculosis
ucgaugucgacgc

SEQ ID NO: 889694 - RNA, 15 nt, Mycobacterium avium subsp. paratuberculosis
ucgaugucgcccggc

SEQ ID NO: 889695 - RNA, 16 nt, Mycobacterium avium subsp. paratuberculosis
ucgaugucgcccggcg

SEQ ID NO: 889696 - RNA, 21 nt, Mycobacterium avium subsp. paratuberculosis
ucgaugucgcccggcgcggca

SEQ ID NO: 889697 - RNA, 13 nt, Mycobacterium avium subsp. paratuberculosis
ucgaugucgccgg

SEQ ID NO: 889698 - RNA, 14 nt, Mycobacterium avium subsp. paratuberculosis
ucgaugucgccggc

SEQ ID NO: 889699 - RNA, 17 nt, Mycobacterium avium subsp. paratuberculosis
ucgaugucgguggcgcg

SEQ ID NO: 889700 - RNA, 19 nt, Mycobacterium avium subsp. paratuberculosis
ucgaugucggugguggggc

SEQ ID NO: 889701 - RNA, 16 nt, Mycobacterium avium subsp. paratuberculosis
ucgaugucgucgucga

SEQ ID NO: 889702 - RNA, 17 nt, Mycobacterium avium subsp. paratuberculosis
ucgauggggauggugcg

SEQ ID NO: 889703 - RNA, 21 nt, Mycobacterium avium subsp. paratuberculosis
ucgauggggauggugcgccgg

SEQ ID NO: 889704 - RNA, 18 nt, Mycobacterium avium subsp. paratuberculosis
ucgauggucugcccgccg

SEQ ID NO: 889705 - RNA, 23 nt, Mycobacterium avium subsp. paratuberculosis
ucgauggucugcccgccgccgau

SEQ ID NO: 889706 - RNA, 16 nt, Mycobacterium avium subsp. paratuberculosis
ucgcacaaccgggcca

SEQ ID NO: 889707 - RNA, 17 nt, Mycobacterium avium subsp. paratuberculosis
ucgcacaccagcacggc

SEQ ID NO: 889708 - RNA, 20 nt, Mycobacterium avium subsp. paratuberculosis
ucgcacaccagcacggcggc

SEQ ID NO: 889709 - RNA, 15 nt, Mycobacterium avium subsp. paratuberculosis
ucgcaccccaccgac

SEQ ID NO: 889710 - RNA, 17 nt, Mycobacterium avium subsp. paratuberculosis
ucgcaccccaccgacag

SEQ ID NO: 889711 - RNA, 22 nt, Mycobacterium avium subsp. paratuberculosis
ucgcaccagcgcuuucgcgcac

SEQ ID NO: 889712 - RNA, 16 nt, Mycobacterium avium subsp. paratuberculosis
ucgcacccggucaggu

SEQ ID NO: 889713 - RNA, 15 nt, Mycobacterium avium subsp. paratuberculosis
ucgcaccgcgagcag

SEQ ID NO: 889714 - RNA, 16 nt, Mycobacterium avium subsp. paratuberculosis
ucgaucaucgccucgg

SEQ ID NO: 889715 - RNA, 16 nt, Mycobacterium avium subsp. paratuberculosis
ucgaucaucuccaccc

SEQ ID NO: 889716 - RNA, 15 nt, Mycobacterium avium subsp. paratuberculosis
ucgaugacgccgcgc

SEQ ID NO: 889717 - RNA, 23 nt, Mycobacterium avium subsp. paratuberculosis
ucgaugacgccgcgccgcccggc

SEQ ID NO: 889718 - RNA, 13 nt, Mycobacterium avium subsp. paratuberculosis
ucgaugacgccgg

SEQ ID NO: 889719 - RNA, 13 nt, Mycobacterium avium subsp. paratuberculosis
ucgaugacgcgcu

SEQ ID NO: 889720 - RNA, 21 nt, Mycobacterium avium subsp. paratuberculosis
ucgaugacggucuugcggccg

SEQ ID NO: 889721 - RNA, 13 nt, Mycobacterium avium subsp. paratuberculosis
ucgaucagcggca

SEQ ID NO: 889722 - RNA, 17 nt, Mycobacterium avium subsp. paratuberculosis
ucgaucagccacaccgc

SEQ ID NO: 889723 - RNA, 21 nt, Mycobacterium avium subsp. paratuberculosis
ucgaucagccacaccgccggc

SEQ ID NO: 889724 - RNA, 22 nt, Mycobacterium avium subsp. paratuberculosis
ucgaucagccacaccgccggcg

SEQ ID NO: 889725 - RNA, 18 nt, Mycobacterium avium subsp. paratuberculosis
ucgaugagcuggugcagc

SEQ ID NO: 889726 - RNA, 23 nt, Mycobacterium avium subsp. paratuberculosis
ucgaugagcuggugcagcgacuc

SEQ ID NO: 889727 - RNA, 15 nt, Mycobacterium avium subsp. paratuberculosis
ucgaugaucuggcgg

SEQ ID NO: 889728 - RNA, 14 nt, Mycobacterium avium subsp. paratuberculosis
ucgaugcgcucggc

SEQ ID NO: 889729 - RNA, 22 nt, Mycobacterium avium subsp. paratuberculosis
ucgauggaauucgucggcggug

SEQ ID NO: 889730 - RNA, 22 nt, Mycobacterium avium subsp. paratuberculosis
ucgauggacaggcacucgccca

SEQ ID NO: 889731 - RNA, 15 nt, Mycobacterium avium subsp. paratuberculosis
ucgauggacagggcg

SEQ ID NO: 889732 - RNA, 14 nt, Mycobacterium avium subsp. paratuberculosis
ucgauggacgccag

SEQ ID NO: 889733 - RNA, 13 nt, Mycobacterium avium subsp. paratuberculosis
ucgauggacgcgg

SEQ ID NO: 889734 - RNA, 22 nt, Mycobacterium avium subsp. paratuberculosis
ucgaugcggguguugcgcagcg

SEQ ID NO: 889735 - RNA, 17 nt, Mycobacterium avium subsp. paratuberculosis
ucgauggccucgucgau

SEQ ID NO: 889736 - RNA, 16 nt, Mycobacterium avium subsp. paratuberculosis
ucgauggccucgucgc

SEQ ID NO: 889737 - RNA, 16 nt, Mycobacterium avium subsp. paratuberculosis
ucgauggccaccaggu

SEQ ID NO: 889738 - RNA, 13 nt, Mycobacterium avium subsp. paratuberculosis
ucgauggcccgcu

SEQ ID NO: 889739 - RNA, 19 nt, Mycobacterium avium subsp. paratuberculosis
ucgauggcgcggcccaguu

SEQ ID NO: 889740 - RNA, 12 nt, Mycobacterium avium subsp. paratuberculosis
ucgauggcggcg

SEQ ID NO: 889741 - RNA, 16 nt, Mycobacterium avium subsp. paratuberculosis
ucgauggcggcgauga

SEQ ID NO: 889742 - RNA, 24 nt, Mycobacterium avium subsp. paratuberculosis
ucgauggcggcggcugccucgacg

SEQ ID NO: 889743 - RNA, 20 nt, Mycobacterium avium subsp. paratuberculosis
ucgaugcgacgcaccucggc

SEQ ID NO: 889744 - RNA, 11 nt, Mycobacterium avium subsp. paratuberculosis
ucgaugcgcgc

SEQ ID NO: 889745 - RNA, 13 nt, Mycobacterium avium subsp. paratuberculosis
ucgaugcgcaccu

SEQ ID NO: 889746 - RNA, 17 nt, Mycobacterium avium subsp. paratuberculosis
ucgaugcgcagcagcgg

SEQ ID NO: 889747 - RNA, 15 nt, Mycobacterium avium subsp. paratuberculosis
ucgaugcgcagggcg

SEQ ID NO: 889748 - RNA, 14 nt, Mycobacterium avium subsp. paratuberculosis
ucgaugccggcgac

SEQ ID NO: 889749 - RNA, 15 nt, Mycobacterium avium subsp. paratuberculosis
ucgaugccggcgacg

SEQ ID NO: 889750 - RNA, 23 nt, Mycobacterium avium subsp. paratuberculosis
ucgaugccggcgauccgcgcggc

SEQ ID NO: 889751 - RNA, 24 nt, Mycobacterium avium subsp. paratuberculosis
ucgaugccggcgauccgcgcggcg

SEQ ID NO: 889752 - RNA, 20 nt, Mycobacterium avium subsp. paratuberculosis
ucgaugccgaccgacagccg

SEQ ID NO: 889753 - RNA, 17 nt, Mycobacterium avium subsp. paratuberculosis
ucgaugccgagccggcc

SEQ ID NO: 889754 - RNA, 21 nt, Mycobacterium avium subsp. paratuberculosis
ucgaggccagcgcgaucgccg

SEQ ID NO: 889755 - RNA, 17 nt, Mycobacterium avium subsp. paratuberculosis
ucgaggcccucgacacc

SEQ ID NO: 889756 - RNA, 19 nt, Mycobacterium avium subsp. paratuberculosis
ucgaggcccucgacaccgg

SEQ ID NO: 889757 - RNA, 16 nt, Mycobacterium avium subsp. paratuberculosis
ucgagcgcgucgacca

SEQ ID NO: 889758 - RNA, 13 nt, Mycobacterium avium subsp. paratuberculosis
ucgagcggcccgc

SEQ ID NO: 889759 - RNA, 18 nt, Mycobacterium avium subsp. paratuberculosis
ucgagcggcccgucgccg

SEQ ID NO: 889760 - RNA, 20 nt, Mycobacterium avium subsp. paratuberculosis
ucgagcggcccgucgccgau

SEQ ID NO: 889761 - RNA, 15 nt, Mycobacterium avium subsp. paratuberculosis
ucgagcgucacgccg

SEQ ID NO: 889762 - RNA, 17 nt, Mycobacterium avium subsp. paratuberculosis
ucgagcgucacgccgcg

SEQ ID NO: 889763 - RNA, 20 nt, Mycobacterium avium subsp. paratuberculosis
ucgagcgucacgccgcgccc

SEQ ID NO: 889764 - RNA, 22 nt, Mycobacterium avium subsp. paratuberculosis
ucgagcgucacgccgcgcccgu

SEQ ID NO: 889765 - RNA, 15 nt, Mycobacterium avium subsp. paratuberculosis
ucgagggccaccggc

SEQ ID NO: 889766 - RNA, 22 nt, Mycobacterium avium subsp. paratuberculosis
ucgagggcuaaccaccggugac

SEQ ID NO: 889767 - RNA, 19 nt, Mycobacterium avium subsp. paratuberculosis
ucgaggggcuuggcgacga

SEQ ID NO: 889768 - RNA, 14 nt, Mycobacterium avium subsp. paratuberculosis
ucgaggcgcugcag

SEQ ID NO: 889769 - RNA, 21 nt, Mycobacterium avium subsp. paratuberculosis
ucgagcggcuugccgccgcag

SEQ ID NO: 889770 - RNA, 14 nt, Mycobacterium avium subsp. paratuberculosis
ucgagcgggcgggc

SEQ ID NO: 889771 - RNA, 13 nt, Mycobacterium avium subsp. paratuberculosis
ucgaggccggcca

SEQ ID NO: 889772 - RNA, 16 nt, Mycobacterium avium subsp. paratuberculosis
ucgaggccggccagcg

SEQ ID NO: 889773 - RNA, 22 nt, Mycobacterium avium subsp. paratuberculosis
ucgauaauggcggccgccgcga

SEQ ID NO: 889774 - RNA, 18 nt, Mycobacterium avium subsp. paratuberculosis
ucgauaacgcgcgcgccg

SEQ ID NO: 889775 - RNA, 20 nt, Mycobacterium avium subsp. paratuberculosis
ucgauaacgcgcgcgccguc

SEQ ID NO: 889776 - RNA, 16 nt, Mycobacterium avium subsp. paratuberculosis
ucgagggucgccaggc

SEQ ID NO: 889777 - RNA, 14 nt, Mycobacterium avium subsp. paratuberculosis
ucgaucaacgccgg

SEQ ID NO: 889778 - RNA, 15 nt, Mycobacterium avium subsp. paratuberculosis
ucgaucaacgccggg

SEQ ID NO: 889779 - RNA, 14 nt, Mycobacterium avium subsp. paratuberculosis
ucgaucagcaccgc

SEQ ID NO: 889780 - RNA, 19 nt, Mycobacterium avium subsp. paratuberculosis
ucgaucagcaccgccacgc

SEQ ID NO: 889781 - RNA, 15 nt, Mycobacterium avium subsp. paratuberculosis
ucgaucagagcgggc

SEQ ID NO: 889782 - RNA, 18 nt, Mycobacterium avium subsp. paratuberculosis
ucgaucagagcgggccga

SEQ ID NO: 889783 - RNA, 17 nt, Mycobacterium avium subsp. paratuberculosis
ucgagcaguagacgccg

SEQ ID NO: 889784 - RNA, 17 nt, Mycobacterium avium subsp. paratuberculosis
ucgagccuggugauccu

SEQ ID NO: 889785 - RNA, 21 nt, Mycobacterium avium subsp. paratuberculosis
ucgagccggugguuuugcggc

SEQ ID NO: 889786 - RNA, 12 nt, Mycobacterium avium subsp. paratuberculosis
ucgagcgcaccg

SEQ ID NO: 889787 - RNA, 17 nt, Mycobacterium avium subsp. paratuberculosis
ucgagcgcaccgcccaa

SEQ ID NO: 889788 - RNA, 15 nt, Mycobacterium avium subsp. paratuberculosis
ucgagcgcggcccgc

SEQ ID NO: 889789 - RNA, 17 nt, Mycobacterium avium subsp. paratuberculosis
ucgagcgcggcccgccg

SEQ ID NO: 889790 - RNA, 23 nt, Mycobacterium avium subsp. paratuberculosis
ucgagcgcgcucaaccgcccagc

SEQ ID NO: 889791 - RNA, 19 nt, Mycobacterium avium subsp. paratuberculosis
ucgagcaggaacagacaca

SEQ ID NO: 889792 - RNA, 19 nt, Mycobacterium avium subsp. paratuberculosis
ucgagcagcgcccggcgau

SEQ ID NO: 889793 - RNA, 20 nt, Mycobacterium avium subsp. paratuberculosis
ucgagcagcgcccggcgauc

SEQ ID NO: 889794 - RNA, 13 nt, Mycobacterium avium subsp. paratuberculosis
ucgagcacccggc

SEQ ID NO: 889795 - RNA, 14 nt, Mycobacterium avium subsp. paratuberculosis
ucgagcacgcccug

SEQ ID NO: 889796 - RNA, 16 nt, Mycobacterium avium subsp. paratuberculosis
ucgagcacgucgacgc

SEQ ID NO: 889797 - RNA, 18 nt, Mycobacterium avium subsp. paratuberculosis
ucgagcacgucgacgccg

SEQ ID NO: 889798 - RNA, 20 nt, Mycobacterium avium subsp. paratuberculosis
ucgagcacgucgacgccggu

SEQ ID NO: 889799 - RNA, 14 nt, Mycobacterium avium subsp. paratuberculosis
ucgagcacgugggu

SEQ ID NO: 889800 - RNA, 23 nt, Mycobacterium avium subsp. paratuberculosis
ucgagcacucgcgggacggcggc

SEQ ID NO: 889801 - RNA, 19 nt, Mycobacterium avium subsp. paratuberculosis
ucgagcagcagccgccggg

SEQ ID NO: 889802 - RNA, 20 nt, Mycobacterium avium subsp. paratuberculosis
ucgagcagcagccgccgggc

SEQ ID NO: 889803 - RNA, 12 nt, Mycobacterium avium subsp. paratuberculosis
ucgagcagccgc

SEQ ID NO: 889804 - RNA, 16 nt, Mycobacterium avium subsp. paratuberculosis
ucgagcagccgcaaca

SEQ ID NO: 889805 - RNA, 18 nt, Mycobacterium avium subsp. paratuberculosis
ucgagcaccggcagccgc

SEQ ID NO: 889806 - RNA, 14 nt, Mycobacterium avium subsp. paratuberculosis
ucgagcaccggcgg

SEQ ID NO: 889807 - RNA, 16 nt, Mycobacterium avium subsp. paratuberculosis
ucgagcaccgcgacca

SEQ ID NO: 889808 - RNA, 18 nt, Mycobacterium avium subsp. paratuberculosis
ucgagcaccgcgaccacg

SEQ ID NO: 889809 - RNA, 15 nt, Mycobacterium avium subsp. paratuberculosis
ucgagcaccgcgauc

SEQ ID NO: 889810 - RNA, 16 nt, Mycobacterium avium subsp. paratuberculosis
ucgagcaccgcgauca

SEQ ID NO: 889811 - RNA, 17 nt, Mycobacterium avium subsp. paratuberculosis
ucgacgguggccucggc

SEQ ID NO: 889812 - RNA, 19 nt, Mycobacterium avium subsp. paratuberculosis
ucgacgguggccucggcgc

SEQ ID NO: 889813 - RNA, 20 nt, Mycobacterium avium subsp. paratuberculosis
ucgagcaccagcgucgacgc

SEQ ID NO: 889814 - RNA, 22 nt, Mycobacterium avium subsp. paratuberculosis
ucgagcaccagcgucgacgcgg

SEQ ID NO: 889815 - RNA, 16 nt, Mycobacterium avium subsp. paratuberculosis
ucgacggugaccggcu

SEQ ID NO: 889816 - RNA, 20 nt, Mycobacterium avium subsp. paratuberculosis
ucgacggugaccggcucgag

SEQ ID NO: 889817 - RNA, 22 nt, Mycobacterium avium subsp. paratuberculosis
ucgacggugaccggcucgagca

SEQ ID NO: 889818 - RNA, 21 nt, Mycobacterium avium subsp. paratuberculosis
ucgacggugaccucgucgggc

SEQ ID NO: 889819 - RNA, 16 nt, Mycobacterium avium subsp. paratuberculosis
ucgacggugaucaggg

SEQ ID NO: 889820 - RNA, 15 nt, Mycobacterium avium subsp. paratuberculosis
ucgacggccgcgccg

SEQ ID NO: 889821 - RNA, 17 nt, Mycobacterium avium subsp. paratuberculosis
ucgacggccgcgccgaa

SEQ ID NO: 889822 - RNA, 12 nt, Mycobacterium avium subsp. paratuberculosis
ucgacggccggc

SEQ ID NO: 889823 - RNA, 18 nt, Mycobacterium avium subsp. paratuberculosis
ucgacggccggcccugca

SEQ ID NO: 889824 - RNA, 14 nt, Mycobacterium avium subsp. paratuberculosis
ucgacgcgaccggc

SEQ ID NO: 889825 - RNA, 23 nt, Mycobacterium avium subsp. paratuberculosis
ucgacgcgaccuguuugaacacc

SEQ ID NO: 889826 - RNA, 16 nt, Mycobacterium avium subsp. paratuberculosis
ucgacggcgaagccgg

SEQ ID NO: 889827 - RNA, 18 nt, Mycobacterium avium subsp. paratuberculosis
ucgacggcgaagccggcg

SEQ ID NO: 889828 - RNA, 20 nt, Mycobacterium avium subsp. paratuberculosis
ucgacggcgaagccggcguc

SEQ ID NO: 889829 - RNA, 17 nt, Mycobacterium avium subsp. paratuberculosis
ucgacggccgccgcgac

SEQ ID NO: 889830 - RNA, 18 nt, Mycobacterium avium subsp. paratuberculosis
ucgacggccgccgcgacg

SEQ ID NO: 889831 - RNA, 13 nt, Mycobacterium avium subsp. paratuberculosis
ucgacggcguggu

SEQ ID NO: 889832 - RNA, 17 nt, Mycobacterium avium subsp. paratuberculosis
uccucauagccggccgc

SEQ ID NO: 889833 - RNA, 22 nt, Mycobacterium avium subsp. paratuberculosis
uccucauagccggccgcgucgc

SEQ ID NO: 889834 - RNA, 18 nt, Mycobacterium avium subsp. paratuberculosis
uccucaguccgccccgau

SEQ ID NO: 889835 - RNA, 21 nt, Mycobacterium avium subsp. paratuberculosis
uccucagcacggccgcggcca

SEQ ID NO: 889836 - RNA, 22 nt, Mycobacterium avium subsp. paratuberculosis
uccucagcacggccgcggccag

SEQ ID NO: 889837 - RNA, 13 nt, Mycobacterium avium subsp. paratuberculosis
uccuccucggcgc

SEQ ID NO: 889838 - RNA, 13 nt, Mycobacterium avium subsp. paratuberculosis
uccuccucuucgc

SEQ ID NO: 889839 - RNA, 16 nt, Mycobacterium avium subsp. paratuberculosis
uccuccugcgccggca

SEQ ID NO: 889840 - RNA, 19 nt, Mycobacterium avium subsp. paratuberculosis
uccuccuggaugaagugac

SEQ ID NO: 889841 - RNA, 14 nt, Mycobacterium avium subsp. paratuberculosis
uccucccagcccuc

SEQ ID NO: 889842 - RNA, 20 nt, Mycobacterium avium subsp. paratuberculosis
uccucccagcccucgucgau

SEQ ID NO: 889843 - RNA, 20 nt, Mycobacterium avium subsp. paratuberculosis
uccuccaacggcaccaccac

SEQ ID NO: 889844 - RNA, 22 nt, Mycobacterium avium subsp. paratuberculosis
uccucgacgccgcgcaccccga

SEQ ID NO: 889845 - RNA, 13 nt, Mycobacterium avium subsp. paratuberculosis
uccucgacggugg

SEQ ID NO: 889846 - RNA, 16 nt, Mycobacterium avium subsp. paratuberculosis
uccucgaccagcgcgc

SEQ ID NO: 889847 - RNA, 22 nt, Mycobacterium avium subsp. paratuberculosis
uccucgaccagcgcgccgccca

SEQ ID NO: 889848 - RNA, 15 nt, Mycobacterium avium subsp. paratuberculosis
uccucgaccagcgcg

SEQ ID NO: 889849 - RNA, 21 nt, Mycobacterium avium subsp. paratuberculosis
uccucgaacaccgcaccgguc

SEQ ID NO: 889850 - RNA, 18 nt, Mycobacterium avium subsp. paratuberculosis
uccucgaaccucgcggcg

SEQ ID NO: 889851 - RNA, 18 nt, Mycobacterium avium subsp. paratuberculosis
uccucgaagaguuggguc

SEQ ID NO: 889852 - RNA, 15 nt, Mycobacterium avium subsp. paratuberculosis
uccucgagcgcgucg

SEQ ID NO: 889853 - RNA, 19 nt, Mycobacterium avium subsp. paratuberculosis
uccucgagcgcgucgacca

SEQ ID NO: 889854 - RNA, 18 nt, Mycobacterium avium subsp. paratuberculosis
uccucgagcuggccguug

SEQ ID NO: 889855 - RNA, 21 nt, Mycobacterium avium subsp. paratuberculosis
uccucgaucaucgcgucggug

SEQ ID NO: 889856 - RNA, 17 nt, Mycobacterium avium subsp. paratuberculosis
uccucgaucgacaccuc

SEQ ID NO: 889857 - RNA, 15 nt, Mycobacterium avium subsp. paratuberculosis
uccucgaucguccga

SEQ ID NO: 889858 - RNA, 15 nt, Mycobacterium avium subsp. paratuberculosis
uccucgauggcggcg

SEQ ID NO: 889859 - RNA, 17 nt, Mycobacterium avium subsp. paratuberculosis
uccucgauggucgucgg

SEQ ID NO: 889860 - RNA, 13 nt, Mycobacterium avium subsp. paratuberculosis
uccguucggcggu

SEQ ID NO: 889861 - RNA, 20 nt, Mycobacterium avium subsp. paratuberculosis
uccgugucgcccguggccca

SEQ ID NO: 889862 - RNA, 14 nt, Mycobacterium avium subsp. paratuberculosis
uccgugcugccggc

SEQ ID NO: 889863 - RNA, 16 nt, Mycobacterium avium subsp. paratuberculosis
uccgugccacggccgc

SEQ ID NO: 889864 - RNA, 18 nt, Mycobacterium avium subsp. paratuberculosis
uccgucaucucgucaacc

SEQ ID NO: 889865 - RNA, 13 nt, Mycobacterium avium subsp. paratuberculosis
uccguccggcgac

SEQ ID NO: 889866 - RNA, 19 nt, Mycobacterium avium subsp. paratuberculosis
uccguccuuggugauuucg

SEQ ID NO: 889867 - RNA, 14 nt, Mycobacterium avium subsp. paratuberculosis
uccgucgccccgca

SEQ ID NO: 889868 - RNA, 19 nt, Mycobacterium avium subsp. paratuberculosis
uccgucgcccgcgugggca

SEQ ID NO: 889869 - RNA, 15 nt, Mycobacterium avium subsp. paratuberculosis
uccgggaccggcguc

SEQ ID NO: 889870 - RNA, 17 nt, Mycobacterium avium subsp. paratuberculosis
uccgggaggccagcacc

SEQ ID NO: 889871 - RNA, 15 nt, Mycobacterium avium subsp. paratuberculosis
uccgggccgccgcgg

SEQ ID NO: 889872 - RNA, 14 nt, Mycobacterium avium subsp. paratuberculosis
uccgggccggcguc

SEQ ID NO: 889873 - RNA, 15 nt, Mycobacterium avium subsp. paratuberculosis
uccgggccggcgucg

SEQ ID NO: 889874 - RNA, 18 nt, Mycobacterium avium subsp. paratuberculosis
uccgggccggcgucgcgg

SEQ ID NO: 889875 - RNA, 18 nt, Mycobacterium avium subsp. paratuberculosis
uccgggcacccgacgucg

SEQ ID NO: 889876 - RNA, 19 nt, Mycobacterium avium subsp. paratuberculosis
uccgggccaccaccacggc

SEQ ID NO: 889877 - RNA, 22 nt, Mycobacterium avium subsp. paratuberculosis
uccgggccaccaccacggccgc

SEQ ID NO: 889878 - RNA, 14 nt, Mycobacterium avium subsp. paratuberculosis
uccgggccaccguc

SEQ ID NO: 889879 - RNA, 17 nt, Mycobacterium avium subsp. paratuberculosis
uccgggcccaccagguc

SEQ ID NO: 889880 - RNA, 16 nt, Mycobacterium avium subsp. paratuberculosis
uccgucagcgccgccc

SEQ ID NO: 889881 - RNA, 21 nt, Mycobacterium avium subsp. paratuberculosis
uccgggcugccguagaaccgc

SEQ ID NO: 889882 - RNA, 19 nt, Mycobacterium avium subsp. paratuberculosis
uccgggcugugggcgcagg

SEQ ID NO: 889883 - RNA, 17 nt, Mycobacterium avium subsp. paratuberculosis
uccgggcgcugcgcggu

SEQ ID NO: 889884 - RNA, 15 nt, Mycobacterium avium subsp. paratuberculosis
uccgggcggcaucgc

SEQ ID NO: 889885 - RNA, 17 nt, Mycobacterium avium subsp. paratuberculosis
uccgggcggcaucgcgc

SEQ ID NO: 889886 - RNA, 14 nt, Mycobacterium avium subsp. paratuberculosis
uccgggcgaccccg

SEQ ID NO: 889887 - RNA, 18 nt, Mycobacterium avium subsp. paratuberculosis
uccgggcgaccccggcca

SEQ ID NO: 889888 - RNA, 19 nt, Mycobacterium avium subsp. paratuberculosis
uccgggcgaccccggccag

SEQ ID NO: 889889 - RNA, 12 nt, Mycobacterium avium subsp. paratuberculosis
uccgggcgccau

SEQ ID NO: 889890 - RNA, 23 nt, Mycobacterium avium subsp. paratuberculosis
uccgggcgcccagaagccccggu

SEQ ID NO: 889891 - RNA, 16 nt, Mycobacterium avium subsp. paratuberculosis
uccgggcgccggccgg

SEQ ID NO: 889892 - RNA, 19 nt, Mycobacterium avium subsp. paratuberculosis
uccgggcgccggccggcgc

SEQ ID NO: 889893 - RNA, 13 nt, Mycobacterium avium subsp. paratuberculosis
uccgggcgccggu

SEQ ID NO: 889894 - RNA, 23 nt, Mycobacterium avium subsp. paratuberculosis
uccgcgcagcgucuugcccagcg

SEQ ID NO: 889895 - RNA, 18 nt, Mycobacterium avium subsp. paratuberculosis
uccgcgcagggacgggcg

SEQ ID NO: 889896 - RNA, 21 nt, Mycobacterium avium subsp. paratuberculosis
uccgcgcccuggugcaacacc

SEQ ID NO: 889897 - RNA, 12 nt, Mycobacterium avium subsp. paratuberculosis
uccgcgccgccg

SEQ ID NO: 889898 - RNA, 16 nt, Mycobacterium avium subsp. paratuberculosis
uccgcgccgccgccag

SEQ ID NO: 889899 - RNA, 15 nt, Mycobacterium avium subsp. paratuberculosis
uccggaggugccggc

SEQ ID NO: 889900 - RNA, 17 nt, Mycobacterium avium subsp. paratuberculosis
uccggaggugccggccg

SEQ ID NO: 889901 - RNA, 19 nt, Mycobacterium avium subsp. paratuberculosis
uccggaggugccggccggu

SEQ ID NO: 889902 - RNA, 22 nt, Mycobacterium avium subsp. paratuberculosis
uccggauagccgucggcggagg

SEQ ID NO: 889903 - RNA, 13 nt, Mycobacterium avium subsp. paratuberculosis
uccggagaaccgc

SEQ ID NO: 889904 - RNA, 22 nt, Mycobacterium avium subsp. paratuberculosis
uccggagcgcgguccacggugg

SEQ ID NO: 889905 - RNA, 13 nt, Mycobacterium avium subsp. paratuberculosis
uccggaacgacgc

SEQ ID NO: 889906 - RNA, 18 nt, Mycobacterium avium subsp. paratuberculosis
uccggaacgacgcguccg

SEQ ID NO: 889907 - RNA, 21 nt, Mycobacterium avium subsp. paratuberculosis
uccggacacggccagcgccgu

SEQ ID NO: 889908 - RNA, 14 nt, Mycobacterium avium subsp. paratuberculosis
uccggaaccgcgcc

SEQ ID NO: 889909 - RNA, 21 nt, Mycobacterium avium subsp. paratuberculosis
uccggaaccgggcacccggcg

SEQ ID NO: 889910 - RNA, 16 nt, Mycobacterium avium subsp. paratuberculosis
uccgccggugccagca

SEQ ID NO: 889911 - RNA, 14 nt, Mycobacterium avium subsp. paratuberculosis
uccgcgacgacacc

SEQ ID NO: 889912 - RNA, 16 nt, Mycobacterium avium subsp. paratuberculosis
uccgcgacgacaccac

SEQ ID NO: 889913 - RNA, 23 nt, Mycobacterium avium subsp. paratuberculosis
uccgcgacgacaccaccgugcug

SEQ ID NO: 889914 - RNA, 16 nt, Mycobacterium avium subsp. paratuberculosis
uccgcgacgccagcac

SEQ ID NO: 889915 - RNA, 17 nt, Mycobacterium avium subsp. paratuberculosis
uccgcgacgccagcacc

SEQ ID NO: 889916 - RNA, 19 nt, Mycobacterium avium subsp. paratuberculosis
uccgcgacgccagcaccuu

SEQ ID NO: 889917 - RNA, 16 nt, Mycobacterium avium subsp. paratuberculosis
uccgcgagccgagccg

SEQ ID NO: 889918 - RNA, 14 nt, Mycobacterium avium subsp. paratuberculosis
uccgcgaucagcuc

SEQ ID NO: 889919 - RNA, 16 nt, Mycobacterium avium subsp. paratuberculosis
uccgcgaucagcucgu

SEQ ID NO: 889920 - RNA, 21 nt, Mycobacterium avium subsp. paratuberculosis
uccgccgcgcccgucgagcgu

SEQ ID NO: 889921 - RNA, 22 nt, Mycobacterium avium subsp. paratuberculosis
uccgccggagacgacucuucca

SEQ ID NO: 889922 - RNA, 22 nt, Mycobacterium avium subsp. paratuberculosis
uccgccggcgaagcucgacgau

SEQ ID NO: 889923 - RNA, 23 nt, Mycobacterium avium subsp. paratuberculosis
uccgccggcgaagcucgacgaug

SEQ ID NO: 889924 - RNA, 15 nt, Mycobacterium avium subsp. paratuberculosis
uccgccggcggugcg

SEQ ID NO: 889925 - RNA, 19 nt, Mycobacterium avium subsp. paratuberculosis
uccgccggcggugcgggug

SEQ ID NO: 889926 - RNA, 23 nt, Mycobacterium avium subsp. paratuberculosis
uccgccggcuggcgggcgaucgc

SEQ ID NO: 889927 - RNA, 21 nt, Mycobacterium avium subsp. paratuberculosis
uccgccgggcggcagcacguc

SEQ ID NO: 889928 - RNA, 14 nt, Mycobacterium avium subsp. paratuberculosis
uccgccgggcggcg

SEQ ID NO: 889929 - RNA, 21 nt, Mycobacterium avium subsp. paratuberculosis
uccggcgcacggcgcccaggu

SEQ ID NO: 889930 - RNA, 17 nt, Mycobacterium avium subsp. paratuberculosis
uccggcgccgcgggcgc

SEQ ID NO: 889931 - RNA, 20 nt, Mycobacterium avium subsp. paratuberculosis
uccggcgccgcgggcgccgu

SEQ ID NO: 889932 - RNA, 13 nt, Mycobacterium avium subsp. paratuberculosis
uccggcgcccgau

SEQ ID NO: 889933 - RNA, 16 nt, Mycobacterium avium subsp. paratuberculosis
uccggcgcccgaucgg

SEQ ID NO: 889934 - RNA, 21 nt, Mycobacterium avium subsp. paratuberculosis
uccggcgcccgaugaaguacc

SEQ ID NO: 889935 - RNA, 13 nt, Mycobacterium avium subsp. paratuberculosis
uccggcgcccggc

SEQ ID NO: 889936 - RNA, 14 nt, Mycobacterium avium subsp. paratuberculosis
uccggcgcccggcu

SEQ ID NO: 889937 - RNA, 20 nt, Mycobacterium avium subsp. paratuberculosis
uccggcgcccggcuccccga

SEQ ID NO: 889938 - RNA, 12 nt, Mycobacterium avium subsp. paratuberculosis
uccggcgccgac

SEQ ID NO: 889939 - RNA, 13 nt, Mycobacterium avium subsp. paratuberculosis
uccggcgccgacc

SEQ ID NO: 889940 - RNA, 17 nt, Mycobacterium avium subsp. paratuberculosis
uccggcgccgacccccg

SEQ ID NO: 889941 - RNA, 17 nt, Mycobacterium avium subsp. paratuberculosis
uccggcgccagcccggu

SEQ ID NO: 889942 - RNA, 18 nt, Mycobacterium avium subsp. paratuberculosis
uccggcgccagcccggug

SEQ ID NO: 889943 - RNA, 19 nt, Mycobacterium avium subsp. paratuberculosis
uccggcuccacagcaguuc

SEQ ID NO: 889944 - RNA, 21 nt, Mycobacterium avium subsp. paratuberculosis
uccggcucugccugcaggaug

SEQ ID NO: 889945 - RNA, 17 nt, Mycobacterium avium subsp. paratuberculosis
uccggcugagcagcucg

SEQ ID NO: 889946 - RNA, 21 nt, Mycobacterium avium subsp. paratuberculosis
uccggcauguacaggaucaac

SEQ ID NO: 889947 - RNA, 17 nt, Mycobacterium avium subsp. paratuberculosis
uccggcgaauccgaccg

SEQ ID NO: 889948 - RNA, 19 nt, Mycobacterium avium subsp. paratuberculosis
uccggcgacacguccagcu

SEQ ID NO: 889949 - RNA, 16 nt, Mycobacterium avium subsp. paratuberculosis
uccggcaggcucagca

SEQ ID NO: 889950 - RNA, 18 nt, Mycobacterium avium subsp. paratuberculosis
uccggcaggcucagcagc

SEQ ID NO: 889951 - RNA, 21 nt, Mycobacterium avium subsp. paratuberculosis
uccggcaggcucagcagcacc

SEQ ID NO: 889952 - RNA, 23 nt, Mycobacterium avium subsp. paratuberculosis
uccggcaggcucagcagcaccgc

SEQ ID NO: 889953 - RNA, 13 nt, Mycobacterium avium subsp. paratuberculosis
uccggcagcgaaa

SEQ ID NO: 889954 - RNA, 13 nt, Mycobacterium avium subsp. paratuberculosis
uccggcagcgcgc

SEQ ID NO: 889955 - RNA, 14 nt, Mycobacterium avium subsp. paratuberculosis
uccggcagcgcucg

SEQ ID NO: 889956 - RNA, 21 nt, Mycobacterium avium subsp. paratuberculosis
uccggcagcgcucgucgucgg

SEQ ID NO: 889957 - RNA, 14 nt, Mycobacterium avium subsp. paratuberculosis
uccgaucagcagca

SEQ ID NO: 889958 - RNA, 15 nt, Mycobacterium avium subsp. paratuberculosis
uccgagucggcgucg

SEQ ID NO: 889959 - RNA, 19 nt, Mycobacterium avium subsp. paratuberculosis
uccgaggguucgguggccc

SEQ ID NO: 889960 - RNA, 23 nt, Mycobacterium avium subsp. paratuberculosis
uccgaguugauaggucacgccgg

SEQ ID NO: 889961 - RNA, 15 nt, Mycobacterium avium subsp. paratuberculosis
uccgauugcccgacu

SEQ ID NO: 889962 - RNA, 13 nt, Mycobacterium avium subsp. paratuberculosis
uccgauugcggcg

SEQ ID NO: 889963 - RNA, 13 nt, Mycobacterium avium subsp. paratuberculosis
uccgaugacgcug

SEQ ID NO: 889964 - RNA, 18 nt, Mycobacterium avium subsp. paratuberculosis
uccgaucguccggcgcca

SEQ ID NO: 889965 - RNA, 18 nt, Mycobacterium avium subsp. paratuberculosis
uccgagacguggucgggc

SEQ ID NO: 889966 - RNA, 23 nt, Mycobacterium avium subsp. paratuberculosis
uccgagcagcagccgcagcggcg

SEQ ID NO: 889967 - RNA, 13 nt, Mycobacterium avium subsp. paratuberculosis
uccgagccgccca

SEQ ID NO: 889968 - RNA, 17 nt, Mycobacterium avium subsp. paratuberculosis
uccgacuucgcgugccg

SEQ ID NO: 889969 - RNA, 21 nt, Mycobacterium avium subsp. paratuberculosis
uccgagccggugaugacgucg

SEQ ID NO: 889970 - RNA, 21 nt, Mycobacterium avium subsp. paratuberculosis
uccgacggcugcgguuggccg

SEQ ID NO: 889971 - RNA, 23 nt, Mycobacterium avium subsp. paratuberculosis
uccgagcggcgcaggccggucac

SEQ ID NO: 889972 - RNA, 22 nt, Mycobacterium avium subsp. paratuberculosis
uccgaggcguccuccucguccg

SEQ ID NO: 889973 - RNA, 16 nt, Mycobacterium avium subsp. paratuberculosis
ucccggucguagucgg

SEQ ID NO: 889974 - RNA, 18 nt, Mycobacterium avium subsp. paratuberculosis
ucccggucguagucggcc

SEQ ID NO: 889975 - RNA, 14 nt, Mycobacterium avium subsp. paratuberculosis
ucccggugccgcug

SEQ ID NO: 889976 - RNA, 17 nt, Mycobacterium avium subsp. paratuberculosis
ucccggugucgccgucg

SEQ ID NO: 889977 - RNA, 21 nt, Mycobacterium avium subsp. paratuberculosis
ucccggugucgccgucgccgc

SEQ ID NO: 889978 - RNA, 18 nt, Mycobacterium avium subsp. paratuberculosis
ucccgguucccggcacca

SEQ ID NO: 889979 - RNA, 23 nt, Mycobacterium avium subsp. paratuberculosis
uccgacaggaugcuggggucggc

SEQ ID NO: 889980 - RNA, 12 nt, Mycobacterium avium subsp. paratuberculosis
uccgaccagcac

SEQ ID NO: 889981 - RNA, 14 nt, Mycobacterium avium subsp. paratuberculosis
uccgaccagccggu

SEQ ID NO: 889982 - RNA, 22 nt, Mycobacterium avium subsp. paratuberculosis
uccgaccagcggcccaccgcga

SEQ ID NO: 889983 - RNA, 15 nt, Mycobacterium avium subsp. paratuberculosis
uccgacagcccccgc

SEQ ID NO: 889984 - RNA, 13 nt, Mycobacterium avium subsp. paratuberculosis
uccgacagcgccu

SEQ ID NO: 889985 - RNA, 20 nt, Mycobacterium avium subsp. paratuberculosis
ucccggugagcgugucgcgc

SEQ ID NO: 889986 - RNA, 16 nt, Mycobacterium avium subsp. paratuberculosis
uccgacgagucgacgc

SEQ ID NO: 889987 - RNA, 21 nt, Mycobacterium avium subsp. paratuberculosis
uccgacccguccagcgugugc

SEQ ID NO: 889988 - RNA, 16 nt, Mycobacterium avium subsp. paratuberculosis
uccgaccgguugcccg

SEQ ID NO: 889989 - RNA, 17 nt, Mycobacterium avium subsp. paratuberculosis
uccgaccguugaccgac

SEQ ID NO: 889990 - RNA, 16 nt, Mycobacterium avium subsp. paratuberculosis
uccgacuccagcagcg

SEQ ID NO: 889991 - RNA, 23 nt, Mycobacterium avium subsp. paratuberculosis
uccgacuccagcagcgccuugcc

SEQ ID NO: 889992 - RNA, 17 nt, Mycobacterium avium subsp. paratuberculosis
uccgacuuacggcguga

SEQ ID NO: 889993 - RNA, 18 nt, Mycobacterium avium subsp. paratuberculosis
uccgacgcgguggcgugc

SEQ ID NO: 889994 - RNA, 13 nt, Mycobacterium avium subsp. paratuberculosis
uccgcaccgcgac

SEQ ID NO: 889995 - RNA, 16 nt, Mycobacterium avium subsp. paratuberculosis
uccgcaccgcgacgag

SEQ ID NO: 889996 - RNA, 14 nt, Mycobacterium avium subsp. paratuberculosis
uccgcaccgggcag

SEQ ID NO: 889997 - RNA, 13 nt, Mycobacterium avium subsp. paratuberculosis
uccgcacgaccug

SEQ ID NO: 889998 - RNA, 21 nt, Mycobacterium avium subsp. paratuberculosis
uccgcagcugaucggggccca

SEQ ID NO: 889999 - RNA, 20 nt, Mycobacterium avium subsp. paratuberculosis
uccgcaggccgucgccgguc

SEQ ID NO: 890000 - RNA, 14 nt, Mycobacterium avium subsp. paratuberculosis
uccgcaggcgaagg

SEQ ID NO: 890001 - RNA, 14 nt, Mycobacterium avium subsp. paratuberculosis
uccgcaacgccggc

SEQ ID NO: 890002 - RNA, 15 nt, Mycobacterium avium subsp. paratuberculosis
uccgcaacgcggcgg

SEQ ID NO: 890003 - RNA, 16 nt, Mycobacterium avium subsp. paratuberculosis
uccgcaacgcggcggu

SEQ ID NO: 890004 - RNA, 18 nt, Mycobacterium avium subsp. paratuberculosis
uccgcaaccgccggcagc

SEQ ID NO: 890005 - RNA, 17 nt, Mycobacterium avium subsp. paratuberculosis
uccgcaacgugcgccgg

SEQ ID NO: 890006 - RNA, 20 nt, Mycobacterium avium subsp. paratuberculosis
uccgccagaucgccuggcag

SEQ ID NO: 890007 - RNA, 18 nt, Mycobacterium avium subsp. paratuberculosis
uccgccagggugccgcug

SEQ ID NO: 890008 - RNA, 17 nt, Mycobacterium avium subsp. paratuberculosis
uccgcccacuucgacgg

SEQ ID NO: 890009 - RNA, 15 nt, Mycobacterium avium subsp. paratuberculosis
uccgccgccggcgga

SEQ ID NO: 890010 - RNA, 14 nt, Mycobacterium avium subsp. paratuberculosis
uccgccgccgggcc

SEQ ID NO: 890011 - RNA, 20 nt, Mycobacterium avium subsp. paratuberculosis
uccgccgccgggccugucca

SEQ ID NO: 890012 - RNA, 12 nt, Mycobacterium avium subsp. paratuberculosis
uccgccgccguc

SEQ ID NO: 890013 - RNA, 22 nt, Mycobacterium avium subsp. paratuberculosis
uccgccacccgcugcucgaccu

SEQ ID NO: 890014 - RNA, 15 nt, Mycobacterium avium subsp. paratuberculosis
ucccgcccggcgccg

SEQ ID NO: 890015 - RNA, 16 nt, Mycobacterium avium subsp. paratuberculosis
ucccgcccggcgccgg

SEQ ID NO: 890016 - RNA, 17 nt, Mycobacterium avium subsp. paratuberculosis
ucccgcccggcgccggc

SEQ ID NO: 890017 - RNA, 18 nt, Mycobacterium avium subsp. paratuberculosis
ucccgcccggcgccggcc

SEQ ID NO: 890018 - RNA, 22 nt, Mycobacterium avium subsp. paratuberculosis
ucccggcagaacgacgccaguu

SEQ ID NO: 890019 - RNA, 17 nt, Mycobacterium avium subsp. paratuberculosis
ucccggcagaucgcggc

SEQ ID NO: 890020 - RNA, 15 nt, Mycobacterium avium subsp. paratuberculosis
ucccggccaccccgc

SEQ ID NO: 890021 - RNA, 23 nt, Mycobacterium avium subsp. paratuberculosis
ucccggccaccccgcagaacacc

SEQ ID NO: 890022 - RNA, 14 nt, Mycobacterium avium subsp. paratuberculosis
ucccggccgacgau

SEQ ID NO: 890023 - RNA, 16 nt, Mycobacterium avium subsp. paratuberculosis
ucccggccgccaaauc

SEQ ID NO: 890024 - RNA, 13 nt, Mycobacterium avium subsp. paratuberculosis
ucccggccgccgg

SEQ ID NO: 890025 - RNA, 18 nt, Mycobacterium avium subsp. paratuberculosis
ucccggccgcgacagccg

SEQ ID NO: 890026 - RNA, 11 nt, Mycobacterium avium subsp. paratuberculosis
ucccggccggu

SEQ ID NO: 890027 - RNA, 14 nt, Mycobacterium avium subsp. paratuberculosis
ucccgcagccgcga

SEQ ID NO: 890028 - RNA, 20 nt, Mycobacterium avium subsp. paratuberculosis
ucccgcagccgcgacggcgg

SEQ ID NO: 890029 - RNA, 19 nt, Mycobacterium avium subsp. paratuberculosis
ucccgcagcgccagcgcgc

SEQ ID NO: 890030 - RNA, 23 nt, Mycobacterium avium subsp. paratuberculosis
ucccgcagcgccagcgcgcccgc

SEQ ID NO: 890031 - RNA, 18 nt, Mycobacterium avium subsp. paratuberculosis
ucccgcagcggggcgcug

SEQ ID NO: 890032 - RNA, 19 nt, Mycobacterium avium subsp. paratuberculosis
ucccgcaauugcgccagca

SEQ ID NO: 890033 - RNA, 20 nt, Mycobacterium avium subsp. paratuberculosis
ucccgcaauugcgccagcag

SEQ ID NO: 890034 - RNA, 21 nt, Mycobacterium avium subsp. paratuberculosis
ucccgcaauugcgccagcagc

SEQ ID NO: 890035 - RNA, 21 nt, Mycobacterium avium subsp. paratuberculosis
ucccgguacggcucaacggcc

SEQ ID NO: 890036 - RNA, 18 nt, Mycobacterium avium subsp. paratuberculosis
ucccgguagagcggcacc

SEQ ID NO: 890037 - RNA, 20 nt, Mycobacterium avium subsp. paratuberculosis
ucccgguagaucgccggauc

SEQ ID NO: 890038 - RNA, 15 nt, Mycobacterium avium subsp. paratuberculosis
ucccgguaggcggcg

SEQ ID NO: 890039 - RNA, 21 nt, Mycobacterium avium subsp. paratuberculosis
ucccggucagcccccaccgcg

SEQ ID NO: 890040 - RNA, 23 nt, Mycobacterium avium subsp. paratuberculosis
ucccggucagguugacgccgaug

SEQ ID NO: 890041 - RNA, 21 nt, Mycobacterium avium subsp. paratuberculosis
ucccgguccacggugucgcug

SEQ ID NO: 890042 - RNA, 17 nt, Mycobacterium avium subsp. paratuberculosis
ucccgggugggcagcgc

SEQ ID NO: 890043 - RNA, 20 nt, Mycobacterium avium subsp. paratuberculosis
ucccgggugggcagcgcgau

SEQ ID NO: 890044 - RNA, 21 nt, Mycobacterium avium subsp. paratuberculosis
ucccgggugggcagcgcgauc

SEQ ID NO: 890045 - RNA, 19 nt, Mycobacterium avium subsp. paratuberculosis
ucccgggugcgcgucgcgg

SEQ ID NO: 890046 - RNA, 13 nt, Mycobacterium avium subsp. paratuberculosis
ucccgggcccgcu

SEQ ID NO: 890047 - RNA, 20 nt, Mycobacterium avium subsp. paratuberculosis
ucccgggccguucagcgggc

SEQ ID NO: 890048 - RNA, 14 nt, Mycobacterium avium subsp. paratuberculosis
ucccgggcgaacgu

SEQ ID NO: 890049 - RNA, 16 nt, Mycobacterium avium subsp. paratuberculosis
ucccgggcgaacgucg

SEQ ID NO: 890050 - RNA, 13 nt, Mycobacterium avium subsp. paratuberculosis
ucccgggcgauca

SEQ ID NO: 890051 - RNA, 19 nt, Mycobacterium avium subsp. paratuberculosis
ucccgggcgaucagcccgc

SEQ ID NO: 890052 - RNA, 14 nt, Mycobacterium avium subsp. paratuberculosis
ucccgggcggcgcc

SEQ ID NO: 890053 - RNA, 23 nt, Mycobacterium avium subsp. paratuberculosis
ucccgggcggucgcgucgucggc

SEQ ID NO: 890054 - RNA, 15 nt, Mycobacterium avium subsp. paratuberculosis
ucccggggcgcgcug

SEQ ID NO: 890055 - RNA, 16 nt, Mycobacterium avium subsp. paratuberculosis
ucccggggcgcgcugg

SEQ ID NO: 890056 - RNA, 19 nt, Mycobacterium avium subsp. paratuberculosis
ucccgggggaagcccagca

SEQ ID NO: 890057 - RNA, 22 nt, Mycobacterium avium subsp. paratuberculosis
ucccgggcacgcgagacgagcc

SEQ ID NO: 890058 - RNA, 13 nt, Mycobacterium avium subsp. paratuberculosis
ucccggcgccgcc

SEQ ID NO: 890059 - RNA, 15 nt, Mycobacterium avium subsp. paratuberculosis
ucccggcgagcacgc

SEQ ID NO: 890060 - RNA, 13 nt, Mycobacterium avium subsp. paratuberculosis
ucccggcgcacca

SEQ ID NO: 890061 - RNA, 14 nt, Mycobacterium avium subsp. paratuberculosis
ucccggcgccacgc

SEQ ID NO: 890062 - RNA, 17 nt, Mycobacterium avium subsp. paratuberculosis
ucccggcgccacgccgc

SEQ ID NO: 890063 - RNA, 19 nt, Mycobacterium avium subsp. paratuberculosis
ucccggcgccacgccgcga

SEQ ID NO: 890064 - RNA, 13 nt, Mycobacterium avium subsp. paratuberculosis
ucccgaguggcgc

SEQ ID NO: 890065 - RNA, 14 nt, Mycobacterium avium subsp. paratuberculosis
ucccgaguggcgcc

SEQ ID NO: 890066 - RNA, 16 nt, Mycobacterium avium subsp. paratuberculosis
ucccgaguggcgccgu

SEQ ID NO: 890067 - RNA, 17 nt, Mycobacterium avium subsp. paratuberculosis
ucccgaguggcgccguc

SEQ ID NO: 890068 - RNA, 18 nt, Mycobacterium avium subsp. paratuberculosis
ucccgagugggaccgucg

SEQ ID NO: 890069 - RNA, 18 nt, Mycobacterium avium subsp. paratuberculosis
ucccgacagcucgcgcug

SEQ ID NO: 890070 - RNA, 16 nt, Mycobacterium avium subsp. paratuberculosis
ucccgagcaucgccga

SEQ ID NO: 890071 - RNA, 18 nt, Mycobacterium avium subsp. paratuberculosis
ucccgagcaucgccgagc

SEQ ID NO: 890072 - RNA, 22 nt, Mycobacterium avium subsp. paratuberculosis
ucccgaggagguuuugcguggu

SEQ ID NO: 890073 - RNA, 15 nt, Mycobacterium avium subsp. paratuberculosis
ucccgaggaugccgc

SEQ ID NO: 890074 - RNA, 15 nt, Mycobacterium avium subsp. paratuberculosis
ucccgauccgcgccg

SEQ ID NO: 890075 - RNA, 19 nt, Mycobacterium avium subsp. paratuberculosis
ucccgauccgcgccgccgc

SEQ ID NO: 890076 - RNA, 16 nt, Mycobacterium avium subsp. paratuberculosis
ucccgaugccgcgcag

SEQ ID NO: 890077 - RNA, 17 nt, Mycobacterium avium subsp. paratuberculosis
ucccgaugccgcgcagg

SEQ ID NO: 890078 - RNA, 14 nt, Mycobacterium avium subsp. paratuberculosis
ucccgaugcggacg

SEQ ID NO: 890079 - RNA, 14 nt, Mycobacterium avium subsp. paratuberculosis
ucccgaugucggcg

SEQ ID NO: 890080 - RNA, 22 nt, Mycobacterium avium subsp. paratuberculosis
uccccugguccuuaaucgggac

SEQ ID NO: 890081 - RNA, 14 nt, Mycobacterium avium subsp. paratuberculosis
ucccgaacagggcg

SEQ ID NO: 890082 - RNA, 16 nt, Mycobacterium avium subsp. paratuberculosis
ucccgaacagggcgac

SEQ ID NO: 890083 - RNA, 21 nt, Mycobacterium avium subsp. paratuberculosis
ucccgaacagggcgacggcgg

SEQ ID NO: 890084 - RNA, 22 nt, Mycobacterium avium subsp. paratuberculosis
ucccgaacagggcgacggcggc

SEQ ID NO: 890085 - RNA, 15 nt, Mycobacterium avium subsp. paratuberculosis
ucccgaacugccgcg

SEQ ID NO: 890086 - RNA, 19 nt, Mycobacterium avium subsp. paratuberculosis
ucccgacuccucacaccuc

SEQ ID NO: 890087 - RNA, 12 nt, Mycobacterium avium subsp. paratuberculosis
ucccgacgcggc

SEQ ID NO: 890088 - RNA, 13 nt, Mycobacterium avium subsp. paratuberculosis
ucccgacgcggcg

SEQ ID NO: 890089 - RNA, 15 nt, Mycobacterium avium subsp. paratuberculosis
ucccgacgcggcgcg

SEQ ID NO: 890090 - RNA, 14 nt, Mycobacterium avium subsp. paratuberculosis
ucccgaccccgcca

SEQ ID NO: 890091 - RNA, 17 nt, Mycobacterium avium subsp. paratuberculosis
ucccgaccccgccagca

SEQ ID NO: 890092 - RNA, 19 nt, Mycobacterium avium subsp. paratuberculosis
ucccgaccccgccagcacc

SEQ ID NO: 890093 - RNA, 22 nt, Mycobacterium avium subsp. paratuberculosis
uccccguugaucuugaccgucg

SEQ ID NO: 890094 - RNA, 22 nt, Mycobacterium avium subsp. paratuberculosis
ucccacccgcaacgcugaccgc

SEQ ID NO: 890095 - RNA, 13 nt, Mycobacterium avium subsp. paratuberculosis
ucccacccggucu

SEQ ID NO: 890096 - RNA, 17 nt, Mycobacterium avium subsp. paratuberculosis
ucccacaccaccaccga

SEQ ID NO: 890097 - RNA, 21 nt, Mycobacterium avium subsp. paratuberculosis
ugcaagggcuugggcgcgauc

SEQ ID NO: 890098 - RNA, 19 nt, Mycobacterium avium subsp. paratuberculosis
ugcaacgcgucggcgccgg

SEQ ID NO: 890099 - RNA, 18 nt, Mycobacterium avium subsp. paratuberculosis
ugcaacuggucgugcagc

SEQ ID NO: 890100 - RNA, 21 nt, Mycobacterium avium subsp. paratuberculosis
ugcaacuaccgacggcaccuc

SEQ ID NO: 890101 - RNA, 18 nt, Mycobacterium avium subsp. paratuberculosis
ugcaacuagcgacggccg

SEQ ID NO: 890102 - RNA, 18 nt, Mycobacterium avium subsp. paratuberculosis
ugcaacucccgcgccgcg

SEQ ID NO: 890103 - RNA, 13 nt, Mycobacterium avium subsp. paratuberculosis
ugcaaccgguccg

SEQ ID NO: 890104 - RNA, 15 nt, Mycobacterium avium subsp. paratuberculosis
ugcacaccaccagcg

SEQ ID NO: 890105 - RNA, 18 nt, Mycobacterium avium subsp. paratuberculosis
ugcacaaccgcugcugcu

SEQ ID NO: 890106 - RNA, 16 nt, Mycobacterium avium subsp. paratuberculosis
ugcaaucucgucgggg

SEQ ID NO: 890107 - RNA, 22 nt, Mycobacterium avium subsp. paratuberculosis
ugcaaggcccccgccucgccgg

SEQ ID NO: 890108 - RNA, 15 nt, Mycobacterium avium subsp. paratuberculosis
ugcacaggccgccgc

SEQ ID NO: 890109 - RNA, 15 nt, Mycobacterium avium subsp. paratuberculosis
ugcacagugcgucgc

SEQ ID NO: 890110 - RNA, 20 nt, Mycobacterium avium subsp. paratuberculosis
ugcacagugcgucgcccauc

SEQ ID NO: 890111 - RNA, 13 nt, Mycobacterium avium subsp. paratuberculosis
ugcacaccggccu

SEQ ID NO: 890112 - RNA, 20 nt, Mycobacterium avium subsp. paratuberculosis
ugcacacccggugcgccggu

SEQ ID NO: 890113 - RNA, 21 nt, Mycobacterium avium subsp. paratuberculosis
ugcacacccggugcgccggua

SEQ ID NO: 890114 - RNA, 18 nt, Mycobacterium avium subsp. paratuberculosis
ugcacagcuucggcgccg

SEQ ID NO: 890115 - RNA, 14 nt, Mycobacterium avium subsp. paratuberculosis
ugcacacgccgagg

SEQ ID NO: 890116 - RNA, 15 nt, Mycobacterium avium subsp. paratuberculosis
ugcacccggacguga

SEQ ID NO: 890117 - RNA, 17 nt, Mycobacterium avium subsp. paratuberculosis
ugcaccgccagcgcggc

SEQ ID NO: 890118 - RNA, 21 nt, Mycobacterium avium subsp. paratuberculosis
ugcaccgccagcgcggcggcg

SEQ ID NO: 890119 - RNA, 15 nt, Mycobacterium avium subsp. paratuberculosis
ugcaccgcgauggcc

SEQ ID NO: 890120 - RNA, 16 nt, Mycobacterium avium subsp. paratuberculosis
ugcaccgcgcgcacca

SEQ ID NO: 890121 - RNA, 22 nt, Mycobacterium avium subsp. paratuberculosis
ugcaccgcggccaacccgggcg

SEQ ID NO: 890122 - RNA, 19 nt, Mycobacterium avium subsp. paratuberculosis
ugcaccgcgggcacggcga

SEQ ID NO: 890123 - RNA, 22 nt, Mycobacterium avium subsp. paratuberculosis
ugcaccguggugacccggaccg

SEQ ID NO: 890124 - RNA, 13 nt, Mycobacterium avium subsp. paratuberculosis
ugcaccggcacgu

SEQ ID NO: 890125 - RNA, 16 nt, Mycobacterium avium subsp. paratuberculosis
ugcaccggcgaguccg

SEQ ID NO: 890126 - RNA, 19 nt, Mycobacterium avium subsp. paratuberculosis
ugcaccggguacaccggcu

SEQ ID NO: 890127 - RNA, 15 nt, Mycobacterium avium subsp. paratuberculosis
ugaucaggucgccga

SEQ ID NO: 890128 - RNA, 14 nt, Mycobacterium avium subsp. paratuberculosis
ugaucaggcccucg

SEQ ID NO: 890129 - RNA, 14 nt, Mycobacterium avium subsp. paratuberculosis
ugaucagcgcgccc

SEQ ID NO: 890130 - RNA, 15 nt, Mycobacterium avium subsp. paratuberculosis
ugauccacgcccgga

SEQ ID NO: 890131 - RNA, 19 nt, Mycobacterium avium subsp. paratuberculosis
ugauccacuccagcaccgg

SEQ ID NO: 890132 - RNA, 22 nt, Mycobacterium avium subsp. paratuberculosis
ugaucccaggaacgcgcccggc

SEQ ID NO: 890133 - RNA, 18 nt, Mycobacterium avium subsp. paratuberculosis
ugauccgaugcagggccg

SEQ ID NO: 890134 - RNA, 14 nt, Mycobacterium avium subsp. paratuberculosis
ugaucccggugaug

SEQ ID NO: 890135 - RNA, 16 nt, Mycobacterium avium subsp. paratuberculosis
ugauccgcccggcccg

SEQ ID NO: 890136 - RNA, 21 nt, Mycobacterium avium subsp. paratuberculosis
ugaugccccgggugaccgccu

SEQ ID NO: 890137 - RNA, 15 nt, Mycobacterium avium subsp. paratuberculosis
ugaugccgagcgccg

SEQ ID NO: 890138 - RNA, 23 nt, Mycobacterium avium subsp. paratuberculosis
ugaugcacccggacgugaucgcg

SEQ ID NO: 890139 - RNA, 13 nt, Mycobacterium avium subsp. paratuberculosis
ugauccggccgcg

SEQ ID NO: 890140 - RNA, 15 nt, Mycobacterium avium subsp. paratuberculosis
ugauccggccgcgga

SEQ ID NO: 890141 - RNA, 15 nt, Mycobacterium avium subsp. paratuberculosis
ugaugaucgccgauc

SEQ ID NO: 890142 - RNA, 13 nt, Mycobacterium avium subsp. paratuberculosis
ugaugaucgccgg

SEQ ID NO: 890143 - RNA, 16 nt, Mycobacterium avium subsp. paratuberculosis
ugaucgaaacgccgcg

SEQ ID NO: 890144 - RNA, 21 nt, Mycobacterium avium subsp. paratuberculosis
ugauuccgcgucuugcgccga

SEQ ID NO: 890145 - RNA, 14 nt, Mycobacterium avium subsp. paratuberculosis
ugaugucgcgcggc

SEQ ID NO: 890146 - RNA, 18 nt, Mycobacterium avium subsp. paratuberculosis
ugaugucgcugccgccgc

SEQ ID NO: 890147 - RNA, 14 nt, Mycobacterium avium subsp. paratuberculosis
ugaugucggccggc

SEQ ID NO: 890148 - RNA, 16 nt, Mycobacterium avium subsp. paratuberculosis
ugaugucggcgggccg

SEQ ID NO: 890149 - RNA, 23 nt, Mycobacterium avium subsp. paratuberculosis
ugaugccggccagccgcgcgacg

SEQ ID NO: 890150 - RNA, 14 nt, Mycobacterium avium subsp. paratuberculosis
ugaugccggcggua

SEQ ID NO: 890151 - RNA, 14 nt, Mycobacterium avium subsp. paratuberculosis
ugaugucgcccggc

SEQ ID NO: 890152 - RNA, 15 nt, Mycobacterium avium subsp. paratuberculosis
ugagcggcgcgucca

SEQ ID NO: 890153 - RNA, 22 nt, Mycobacterium avium subsp. paratuberculosis
ugagcggcgcguccauggucga

SEQ ID NO: 890154 - RNA, 15 nt, Mycobacterium avium subsp. paratuberculosis
ugagcgucgccacca

SEQ ID NO: 890155 - RNA, 15 nt, Mycobacterium avium subsp. paratuberculosis
ugagcguggacaccg

SEQ ID NO: 890156 - RNA, 19 nt, Mycobacterium avium subsp. paratuberculosis
ugagcguggacaccgcacc

SEQ ID NO: 890157 - RNA, 13 nt, Mycobacterium avium subsp. paratuberculosis
ugagcucgcggcg

SEQ ID NO: 890158 - RNA, 14 nt, Mycobacterium avium subsp. paratuberculosis
ugagcuggccgcgc

SEQ ID NO: 890159 - RNA, 13 nt, Mycobacterium avium subsp. paratuberculosis
ugagcugggcggc

SEQ ID NO: 890160 - RNA, 21 nt, Mycobacterium avium subsp. paratuberculosis
ugagggccagcagucgugacg

SEQ ID NO: 890161 - RNA, 16 nt, Mycobacterium avium subsp. paratuberculosis
ugagggaacgccgauc

SEQ ID NO: 890162 - RNA, 17 nt, Mycobacterium avium subsp. paratuberculosis
ugaggcguuggcccgca

SEQ ID NO: 890163 - RNA, 20 nt, Mycobacterium avium subsp. paratuberculosis
ugaggcucaggccgguggcg

SEQ ID NO: 890164 - RNA, 16 nt, Mycobacterium avium subsp. paratuberculosis
ugagcuucccggcggu

SEQ ID NO: 890165 - RNA, 19 nt, Mycobacterium avium subsp. paratuberculosis
ugagcuucccggcggucgc

SEQ ID NO: 890166 - RNA, 16 nt, Mycobacterium avium subsp. paratuberculosis
ugaggcggcggcgggc

SEQ ID NO: 890167 - RNA, 19 nt, Mycobacterium avium subsp. paratuberculosis
ugagcauuggcgauggccu

SEQ ID NO: 890168 - RNA, 14 nt, Mycobacterium avium subsp. paratuberculosis
ugagccgccgcggc

SEQ ID NO: 890169 - RNA, 15 nt, Mycobacterium avium subsp. paratuberculosis
ugagccgccggggcg

SEQ ID NO: 890170 - RNA, 18 nt, Mycobacterium avium subsp. paratuberculosis
ugagccgccacagcgccu

SEQ ID NO: 890171 - RNA, 13 nt, Mycobacterium avium subsp. paratuberculosis
ugagcccggaccg

SEQ ID NO: 890172 - RNA, 17 nt, Mycobacterium avium subsp. paratuberculosis
ugagcccggaccggccg

SEQ ID NO: 890173 - RNA, 16 nt, Mycobacterium avium subsp. paratuberculosis
ugagcccgucgacguc

SEQ ID NO: 890174 - RNA, 17 nt, Mycobacterium avium subsp. paratuberculosis
ugagcccgucgacgucg

SEQ ID NO: 890175 - RNA, 22 nt, Mycobacterium avium subsp. paratuberculosis
ugagccuaugaggcgacccccg

SEQ ID NO: 890176 - RNA, 15 nt, Mycobacterium avium subsp. paratuberculosis
ugagccucagcgcgc

SEQ ID NO: 890177 - RNA, 17 nt, Mycobacterium avium subsp. paratuberculosis
ugagccucagggcgcgc

SEQ ID NO: 890178 - RNA, 17 nt, Mycobacterium avium subsp. paratuberculosis
ugagccggcgcaccgcg

SEQ ID NO: 890179 - RNA, 16 nt, Mycobacterium avium subsp. paratuberculosis
ugagccgggugcccgc

SEQ ID NO: 890180 - RNA, 17 nt, Mycobacterium avium subsp. paratuberculosis
ugagccgggugcccgcg

SEQ ID NO: 890181 - RNA, 20 nt, Mycobacterium avium subsp. paratuberculosis
ugagccggucgugcgacucc

SEQ ID NO: 890182 - RNA, 14 nt, Mycobacterium avium subsp. paratuberculosis
ugagcggccgcagc

SEQ ID NO: 890183 - RNA, 21 nt, Mycobacterium avium subsp. paratuberculosis
ugagcgggaacgcgucgaaca

SEQ ID NO: 890184 - RNA, 18 nt, Mycobacterium avium subsp. paratuberculosis
ugagcgggacgcgcagau

SEQ ID NO: 890185 - RNA, 19 nt, Mycobacterium avium subsp. paratuberculosis
ugaguguugaagccgcgga

SEQ ID NO: 890186 - RNA, 12 nt, Mycobacterium avium subsp. paratuberculosis
ugaucagcgcca

SEQ ID NO: 890187 - RNA, 20 nt, Mycobacterium avium subsp. paratuberculosis
ugaucagcgccguggcccgg

SEQ ID NO: 890188 - RNA, 18 nt, Mycobacterium avium subsp. paratuberculosis
ugaucagcauccgcaacg

SEQ ID NO: 890189 - RNA, 13 nt, Mycobacterium avium subsp. paratuberculosis
ugaucagccggcg

SEQ ID NO: 890190 - RNA, 17 nt, Mycobacterium avium subsp. paratuberculosis
ugagguagucgcgcagc

SEQ ID NO: 890191 - RNA, 22 nt, Mycobacterium avium subsp. paratuberculosis
ugagguagucgcgcagcugcgc

SEQ ID NO: 890192 - RNA, 17 nt, Mycobacterium avium subsp. paratuberculosis
ugaggucgcgaccgccg

SEQ ID NO: 890193 - RNA, 19 nt, Mycobacterium avium subsp. paratuberculosis
ugaggucgcgaccgccgga

SEQ ID NO: 890194 - RNA, 14 nt, Mycobacterium avium subsp. paratuberculosis
ugagguggcugggc

SEQ ID NO: 890195 - RNA, 20 nt, Mycobacterium avium subsp. paratuberculosis
ugagcacaaagccggucacg

SEQ ID NO: 890196 - RNA, 21 nt, Mycobacterium avium subsp. paratuberculosis
ugagcacaaagccggucacgc

SEQ ID NO: 890197 - RNA, 21 nt, Mycobacterium avium subsp. paratuberculosis
ugagcacacacaggucgcccg

SEQ ID NO: 890198 - RNA, 23 nt, Mycobacterium avium subsp. paratuberculosis
ugagcacacacaggucgcccggc

SEQ ID NO: 890199 - RNA, 17 nt, Mycobacterium avium subsp. paratuberculosis
ugagcaagucggcggug

SEQ ID NO: 890200 - RNA, 14 nt, Mycobacterium avium subsp. paratuberculosis
ugagcaccacgagg

SEQ ID NO: 890201 - RNA, 22 nt, Mycobacterium avium subsp. paratuberculosis
ugagcacccgcagcucgccgag

SEQ ID NO: 890202 - RNA, 16 nt, Mycobacterium avium subsp. paratuberculosis
ugagcacccgcccgga

SEQ ID NO: 890203 - RNA, 14 nt, Mycobacterium avium subsp. paratuberculosis
ugagcaccgccguc

SEQ ID NO: 890204 - RNA, 14 nt, Mycobacterium avium subsp. paratuberculosis
ugagcaccgcgauc

SEQ ID NO: 890205 - RNA, 13 nt, Mycobacterium avium subsp. paratuberculosis
ugagcaccggauc

SEQ ID NO: 890206 - RNA, 18 nt, Mycobacterium avium subsp. paratuberculosis
ugagcaccggaucgacca

SEQ ID NO: 890207 - RNA, 19 nt, Mycobacterium avium subsp. paratuberculosis
ugagcagcaugccgagcac

SEQ ID NO: 890208 - RNA, 16 nt, Mycobacterium avium subsp. paratuberculosis
ugagcagcccgaccac

SEQ ID NO: 890209 - RNA, 17 nt, Mycobacterium avium subsp. paratuberculosis
ugagcagggccagcggc

SEQ ID NO: 890210 - RNA, 21 nt, Mycobacterium avium subsp. paratuberculosis
ugagcaucgaggaucgccaac

SEQ ID NO: 890211 - RNA, 21 nt, Mycobacterium avium subsp. paratuberculosis
ugacccaacucaugggcccgg

SEQ ID NO: 890212 - RNA, 22 nt, Mycobacterium avium subsp. paratuberculosis
ugacccacggguuggggccgcg

SEQ ID NO: 890213 - RNA, 21 nt, Mycobacterium avium subsp. paratuberculosis
ugaccaucgggucgucggcgu

SEQ ID NO: 890214 - RNA, 23 nt, Mycobacterium avium subsp. paratuberculosis
ugaccaucgggucgucggcgucg

SEQ ID NO: 890215 - RNA, 14 nt, Mycobacterium avium subsp. paratuberculosis
ugaccaugacccac

SEQ ID NO: 890216 - RNA, 21 nt, Mycobacterium avium subsp. paratuberculosis
ugacccgauccagggcccgcu

SEQ ID NO: 890217 - RNA, 21 nt, Mycobacterium avium subsp. paratuberculosis
ugacccgcaacucgggcucgu

SEQ ID NO: 890218 - RNA, 12 nt, Mycobacterium avium subsp. paratuberculosis
ugacccgcccgg

SEQ ID NO: 890219 - RNA, 15 nt, Mycobacterium avium subsp. paratuberculosis
ugacccgccgugacc

SEQ ID NO: 890220 - RNA, 21 nt, Mycobacterium avium subsp. paratuberculosis
ugacccgcuccagcggccaca

SEQ ID NO: 890221 - RNA, 15 nt, Mycobacterium avium subsp. paratuberculosis
ugacccagcgcgggg

SEQ ID NO: 890222 - RNA, 23 nt, Mycobacterium avium subsp. paratuberculosis
ugaccaugucgacgcugagccgc

SEQ ID NO: 890223 - RNA, 21 nt, Mycobacterium avium subsp. paratuberculosis
ugacccaugccccaggugacg

SEQ ID NO: 890224 - RNA, 23 nt, Mycobacterium avium subsp. paratuberculosis
ugaccccgacggcgccgcggccg

SEQ ID NO: 890225 - RNA, 24 nt, Mycobacterium avium subsp. paratuberculosis
ugaccccgacggcgccgcggccgu

SEQ ID NO: 890226 - RNA, 14 nt, Mycobacterium avium subsp. paratuberculosis
ugacccagcccagc

SEQ ID NO: 890227 - RNA, 15 nt, Mycobacterium avium subsp. paratuberculosis
ugacguacuggcgcc

SEQ ID NO: 890228 - RNA, 14 nt, Mycobacterium avium subsp. paratuberculosis
ugacguagaucauu

SEQ ID NO: 890229 - RNA, 23 nt, Mycobacterium avium subsp. paratuberculosis
ugacguccaccaggguggccgcc

SEQ ID NO: 890230 - RNA, 13 nt, Mycobacterium avium subsp. paratuberculosis
ugacugacccgca

SEQ ID NO: 890231 - RNA, 22 nt, Mycobacterium avium subsp. paratuberculosis
ugacgucgcccacccggggccg

SEQ ID NO: 890232 - RNA, 14 nt, Mycobacterium avium subsp. paratuberculosis
ugacgucgcgccgc

SEQ ID NO: 890233 - RNA, 20 nt, Mycobacterium avium subsp. paratuberculosis
ugacgucgcgcggggugacg

SEQ ID NO: 890234 - RNA, 19 nt, Mycobacterium avium subsp. paratuberculosis
ugacgucgcgcugccggcc

SEQ ID NO: 890235 - RNA, 21 nt, Mycobacterium avium subsp. paratuberculosis
ugacgucgcgcugccggcccg

SEQ ID NO: 890236 - RNA, 14 nt, Mycobacterium avium subsp. paratuberculosis
ugacgucggucagc

SEQ ID NO: 890237 - RNA, 16 nt, Mycobacterium avium subsp. paratuberculosis
ugacgucgucgcggcg

SEQ ID NO: 890238 - RNA, 15 nt, Mycobacterium avium subsp. paratuberculosis
ugacgugcaccggcg

SEQ ID NO: 890239 - RNA, 21 nt, Mycobacterium avium subsp. paratuberculosis
ugacgugcgacaccggcguga

SEQ ID NO: 890240 - RNA, 13 nt, Mycobacterium avium subsp. paratuberculosis
ugacguggcggcc

SEQ ID NO: 890241 - RNA, 16 nt, Mycobacterium avium subsp. paratuberculosis
ugcauguagcggucgu

SEQ ID NO: 890242 - RNA, 13 nt, Mycobacterium avium subsp. paratuberculosis
ugcaugccgggca

SEQ ID NO: 890243 - RNA, 15 nt, Mycobacterium avium subsp. paratuberculosis
ugcaucucgacccgg

SEQ ID NO: 890244 - RNA, 15 nt, Mycobacterium avium subsp. paratuberculosis
ugcaucgccaccguc

SEQ ID NO: 890245 - RNA, 22 nt, Mycobacterium avium subsp. paratuberculosis
ugcaucggcaguccgcgccggu

SEQ ID NO: 890246 - RNA, 18 nt, Mycobacterium avium subsp. paratuberculosis
ugcauuucggacggcgac

SEQ ID NO: 890247 - RNA, 21 nt, Mycobacterium avium subsp. paratuberculosis
ugccaagacguccgcgucggc

SEQ ID NO: 890248 - RNA, 22 nt, Mycobacterium avium subsp. paratuberculosis
ugccaagacguccgcgucggcg

SEQ ID NO: 890249 - RNA, 22 nt, Mycobacterium avium subsp. paratuberculosis
ugccaagccauuucagcagcgc

SEQ ID NO: 890250 - RNA, 21 nt, Mycobacterium avium subsp. paratuberculosis
ugccaagcguauccggccagc

SEQ ID NO: 890251 - RNA, 15 nt, Mycobacterium avium subsp. paratuberculosis
ugccaaggucgccgg

SEQ ID NO: 890252 - RNA, 17 nt, Mycobacterium avium subsp. paratuberculosis
ugccaaggucgccggug

SEQ ID NO: 890253 - RNA, 19 nt, Mycobacterium avium subsp. paratuberculosis
ugccaaggucgccggugug

SEQ ID NO: 890254 - RNA, 15 nt, Mycobacterium avium subsp. paratuberculosis
ugccaacaccagggu

SEQ ID NO: 890255 - RNA, 18 nt, Mycobacterium avium subsp. paratuberculosis
ugcagguugauccggauc

SEQ ID NO: 890256 - RNA, 17 nt, Mycobacterium avium subsp. paratuberculosis
ugcagugcgaucgccgu

SEQ ID NO: 890257 - RNA, 22 nt, Mycobacterium avium subsp. paratuberculosis
ugcaggucguaguaggcgccga

SEQ ID NO: 890258 - RNA, 23 nt, Mycobacterium avium subsp. paratuberculosis
ugcaggucguaguaggcgccgaa

SEQ ID NO: 890259 - RNA, 21 nt, Mycobacterium avium subsp. paratuberculosis
ugcaguacgcaucggcgccgg

SEQ ID NO: 890260 - RNA, 22 nt, Mycobacterium avium subsp. paratuberculosis
ugcaguacgcaucggcgccgga

SEQ ID NO: 890261 - RNA, 16 nt, Mycobacterium avium subsp. paratuberculosis
ugcaggugcgcgguca

SEQ ID NO: 890262 - RNA, 23 nt, Mycobacterium avium subsp. paratuberculosis
ugcaggugcgcggucagcgcguc

SEQ ID NO: 890263 - RNA, 15 nt, Mycobacterium avium subsp. paratuberculosis
ugcaggcugacgcga

SEQ ID NO: 890264 - RNA, 16 nt, Mycobacterium avium subsp. paratuberculosis
ugcaggguccgccguc

SEQ ID NO: 890265 - RNA, 18 nt, Mycobacterium avium subsp. paratuberculosis
ugcaggguccgccgucga

SEQ ID NO: 890266 - RNA, 15 nt, Mycobacterium avium subsp. paratuberculosis
ugcagggggcgcagc

SEQ ID NO: 890267 - RNA, 19 nt, Mycobacterium avium subsp. paratuberculosis
ugcagggggcgcagccgau

SEQ ID NO: 890268 - RNA, 22 nt, Mycobacterium avium subsp. paratuberculosis
ugcagggucagcagcacccggu

SEQ ID NO: 890269 - RNA, 15 nt, Mycobacterium avium subsp. paratuberculosis
ugcagggccgggucg

SEQ ID NO: 890270 - RNA, 14 nt, Mycobacterium avium subsp. paratuberculosis
ugcaccucgacgaa

SEQ ID NO: 890271 - RNA, 20 nt, Mycobacterium avium subsp. paratuberculosis
ugcaggccgcggguggcgcc

SEQ ID NO: 890272 - RNA, 19 nt, Mycobacterium avium subsp. paratuberculosis
ugcaccuugcccgucgcgu

SEQ ID NO: 890273 - RNA, 16 nt, Mycobacterium avium subsp. paratuberculosis
ugcccaacgucgacuu

SEQ ID NO: 890274 - RNA, 16 nt, Mycobacterium avium subsp. paratuberculosis
ugcccaagccggccag

SEQ ID NO: 890275 - RNA, 18 nt, Mycobacterium avium subsp. paratuberculosis
ugcccaagccggccaggc

SEQ ID NO: 890276 - RNA, 23 nt, Mycobacterium avium subsp. paratuberculosis
ugcccaccaucccgccgccgaac

SEQ ID NO: 890277 - RNA, 15 nt, Mycobacterium avium subsp. paratuberculosis
ugcccaccagccggc

SEQ ID NO: 890278 - RNA, 17 nt, Mycobacterium avium subsp. paratuberculosis
ugcccaccagccggccg

SEQ ID NO: 890279 - RNA, 20 nt, Mycobacterium avium subsp. paratuberculosis
ugcccaccagccggccggcg

SEQ ID NO: 890280 - RNA, 14 nt, Mycobacterium avium subsp. paratuberculosis
ugcccccgaugaac

SEQ ID NO: 890281 - RNA, 22 nt, Mycobacterium avium subsp. paratuberculosis
ugcccaugucgaucggcucggc

SEQ ID NO: 890282 - RNA, 15 nt, Mycobacterium avium subsp. paratuberculosis
ugccccacggcccgg

SEQ ID NO: 890283 - RNA, 14 nt, Mycobacterium avium subsp. paratuberculosis
ugcccaccgggcag

SEQ ID NO: 890284 - RNA, 15 nt, Mycobacterium avium subsp. paratuberculosis
ugccaccaccacggc

SEQ ID NO: 890285 - RNA, 17 nt, Mycobacterium avium subsp. paratuberculosis
ugccacaggccgaacag

SEQ ID NO: 890286 - RNA, 14 nt, Mycobacterium avium subsp. paratuberculosis
ugccaccgccgaug

SEQ ID NO: 890287 - RNA, 20 nt, Mycobacterium avium subsp. paratuberculosis
ugccagcuucgggcgcgcgc

SEQ ID NO: 890288 - RNA, 15 nt, Mycobacterium avium subsp. paratuberculosis
ugccaccgcugggcg

SEQ ID NO: 890289 - RNA, 17 nt, Mycobacterium avium subsp. paratuberculosis
ugccaggcgguggccga

SEQ ID NO: 890290 - RNA, 23 nt, Mycobacterium avium subsp. paratuberculosis
ugccagggggaguagucggcgau

SEQ ID NO: 890291 - RNA, 20 nt, Mycobacterium avium subsp. paratuberculosis
ugccaguaccagcggccguc

SEQ ID NO: 890292 - RNA, 14 nt, Mycobacterium avium subsp. paratuberculosis
ugcccgacggcgcg

SEQ ID NO: 890293 - RNA, 20 nt, Mycobacterium avium subsp. paratuberculosis
ugcccgacggcgcgcccgac

SEQ ID NO: 890294 - RNA, 15 nt, Mycobacterium avium subsp. paratuberculosis
ugcccgacggcgucu

SEQ ID NO: 890295 - RNA, 20 nt, Mycobacterium avium subsp. paratuberculosis
ugcccgacuccucacaccuc

SEQ ID NO: 890296 - RNA, 18 nt, Mycobacterium avium subsp. paratuberculosis
ugcccgacgagucgccgu

SEQ ID NO: 890297 - RNA, 20 nt, Mycobacterium avium subsp. paratuberculosis
ugcccgacgagucgccguug

SEQ ID NO: 890298 - RNA, 14 nt, Mycobacterium avium subsp. paratuberculosis
ugcccgagaucacc

SEQ ID NO: 890299 - RNA, 17 nt, Mycobacterium avium subsp. paratuberculosis
ugcccgaacgcgcgucg

SEQ ID NO: 890300 - RNA, 13 nt, Mycobacterium avium subsp. paratuberculosis
ugcccgacccgca

SEQ ID NO: 890301 - RNA, 16 nt, Mycobacterium avium subsp. paratuberculosis
ugcccgacccgcacca

SEQ ID NO: 890302 - RNA, 18 nt, Mycobacterium avium subsp. paratuberculosis
ugcccgaccgcgccgaac

SEQ ID NO: 890303 - RNA, 22 nt, Mycobacterium avium subsp. paratuberculosis
ugcccgaccugaucuucgagac

SEQ ID NO: 890304 - RNA, 13 nt, Mycobacterium avium subsp. paratuberculosis
ugccccucgacga

SEQ ID NO: 890305 - RNA, 16 nt, Mycobacterium avium subsp. paratuberculosis
ugccccgcaccgccag

SEQ ID NO: 890306 - RNA, 22 nt, Mycobacterium avium subsp. paratuberculosis
ugccccgccguuucagcagcgc

SEQ ID NO: 890307 - RNA, 20 nt, Mycobacterium avium subsp. paratuberculosis
ugccccgcuccuccucgcgc

SEQ ID NO: 890308 - RNA, 18 nt, Mycobacterium avium subsp. paratuberculosis
ugcccucguagcggccgc

SEQ ID NO: 890309 - RNA, 16 nt, Mycobacterium avium subsp. paratuberculosis
ugcccucgucgaccag

SEQ ID NO: 890310 - RNA, 19 nt, Mycobacterium avium subsp. paratuberculosis
ugcccucgucgaccagggc

SEQ ID NO: 890311 - RNA, 16 nt, Mycobacterium avium subsp. paratuberculosis
ugcccucgugguggac

SEQ ID NO: 890312 - RNA, 17 nt, Mycobacterium avium subsp. paratuberculosis
ugcccuccuucccggug

SEQ ID NO: 890313 - RNA, 16 nt, Mycobacterium avium subsp. paratuberculosis
ugcccguugcccgauc

SEQ ID NO: 890314 - RNA, 18 nt, Mycobacterium avium subsp. paratuberculosis
ugcccguugcccgaucag

SEQ ID NO: 890315 - RNA, 16 nt, Mycobacterium avium subsp. paratuberculosis
ugccgaagaugucggu

SEQ ID NO: 890316 - RNA, 18 nt, Mycobacterium avium subsp. paratuberculosis
ugccgaagaugucggugc

SEQ ID NO: 890317 - RNA, 21 nt, Mycobacterium avium subsp. paratuberculosis
ugccgaagaugucggugccga

SEQ ID NO: 890318 - RNA, 23 nt, Mycobacterium avium subsp. paratuberculosis
ugccgaagaugucggugccgauc

SEQ ID NO: 890319 - RNA, 19 nt, Mycobacterium avium subsp. paratuberculosis
ugccgaaccgcuccccgag

SEQ ID NO: 890320 - RNA, 14 nt, Mycobacterium avium subsp. paratuberculosis
ugccgaacgcgauc

SEQ ID NO: 890321 - RNA, 16 nt, Mycobacterium avium subsp. paratuberculosis
ugccgaacuccgccga

SEQ ID NO: 890322 - RNA, 18 nt, Mycobacterium avium subsp. paratuberculosis
ugccgaacuccgccgaac

SEQ ID NO: 890323 - RNA, 12 nt, Mycobacterium avium subsp. paratuberculosis
ugccgcacaccg

SEQ ID NO: 890324 - RNA, 14 nt, Mycobacterium avium subsp. paratuberculosis
ugccgcacccgauc

SEQ ID NO: 890325 - RNA, 17 nt, Mycobacterium avium subsp. paratuberculosis
ugccgaugucggcguug

SEQ ID NO: 890326 - RNA, 18 nt, Mycobacterium avium subsp. paratuberculosis
ugccgaugccggccuggc

SEQ ID NO: 890327 - RNA, 18 nt, Mycobacterium avium subsp. paratuberculosis
ugccgaucggggcgcagc

SEQ ID NO: 890328 - RNA, 22 nt, Mycobacterium avium subsp. paratuberculosis
ugccgaucggggcgcagcccgg

SEQ ID NO: 890329 - RNA, 12 nt, Mycobacterium avium subsp. paratuberculosis
ugccgaucguga

SEQ ID NO: 890330 - RNA, 23 nt, Mycobacterium avium subsp. paratuberculosis
ugccgaucgugaauucggccggg

SEQ ID NO: 890331 - RNA, 13 nt, Mycobacterium avium subsp. paratuberculosis
ugccgaucugguc

SEQ ID NO: 890332 - RNA, 16 nt, Mycobacterium avium subsp. paratuberculosis
ugccgaucgccgcggc

SEQ ID NO: 890333 - RNA, 20 nt, Mycobacterium avium subsp. paratuberculosis
ugccgaucgccgcggcgauc

SEQ ID NO: 890334 - RNA, 17 nt, Mycobacterium avium subsp. paratuberculosis
ugccgaggauuucgcga

SEQ ID NO: 890335 - RNA, 21 nt, Mycobacterium avium subsp. paratuberculosis
ugccgaggauuucgcgaucga

SEQ ID NO: 890336 - RNA, 23 nt, Mycobacterium avium subsp. paratuberculosis
ugccgaucaccucgccggccggg

SEQ ID NO: 890337 - RNA, 18 nt, Mycobacterium avium subsp. paratuberculosis
ugccgaucacggugaucg

SEQ ID NO: 890338 - RNA, 16 nt, Mycobacterium avium subsp. paratuberculosis
ugccgagcaucagcug

SEQ ID NO: 890339 - RNA, 19 nt, Mycobacterium avium subsp. paratuberculosis
ugccgagcaucagcugccg

SEQ ID NO: 890340 - RNA, 22 nt, Mycobacterium avium subsp. paratuberculosis
ugccgagcaucagcugccgucc

SEQ ID NO: 890341 - RNA, 14 nt, Mycobacterium avium subsp. paratuberculosis
ugccgagcccgccg

SEQ ID NO: 890342 - RNA, 16 nt, Mycobacterium avium subsp. paratuberculosis
ugccgagcccgccggc

SEQ ID NO: 890343 - RNA, 20 nt, Mycobacterium avium subsp. paratuberculosis
ugccgagcccgccggcggcg

SEQ ID NO: 890344 - RNA, 20 nt, Mycobacterium avium subsp. paratuberculosis
ugccgagcccuuugcgcugc

SEQ ID NO: 890345 - RNA, 19 nt, Mycobacterium avium subsp. paratuberculosis
ugccgagccgcuugguggc

SEQ ID NO: 890346 - RNA, 20 nt, Mycobacterium avium subsp. paratuberculosis
ugccgagccgcuugguggcg

SEQ ID NO: 890347 - RNA, 16 nt, Mycobacterium avium subsp. paratuberculosis
ugccgagcagcaccgc

SEQ ID NO: 890348 - RNA, 19 nt, Mycobacterium avium subsp. paratuberculosis
ugccgagcagcucggcggc

SEQ ID NO: 890349 - RNA, 14 nt, Mycobacterium avium subsp. paratuberculosis
ugccgagcgccgcg

SEQ ID NO: 890350 - RNA, 22 nt, Mycobacterium avium subsp. paratuberculosis
ugccgagcacgcggccgcgccg

SEQ ID NO: 890351 - RNA, 12 nt, Mycobacterium avium subsp. paratuberculosis
ugccgagcaccc

SEQ ID NO: 890352 - RNA, 16 nt, Mycobacterium avium subsp. paratuberculosis
ugccgagcaccccguc

SEQ ID NO: 890353 - RNA, 20 nt, Mycobacterium avium subsp. paratuberculosis
ugccgagcaccccgucgagc

SEQ ID NO: 890354 - RNA, 21 nt, Mycobacterium avium subsp. paratuberculosis
ugccgagcaccucgucgccgu

SEQ ID NO: 890355 - RNA, 13 nt, Mycobacterium avium subsp. paratuberculosis
ugccgacgucggu

SEQ ID NO: 890356 - RNA, 14 nt, Mycobacterium avium subsp. paratuberculosis
ugccgacgucggug

SEQ ID NO: 890357 - RNA, 22 nt, Mycobacterium avium subsp. paratuberculosis
ugccgacaccccacaccguccg

SEQ ID NO: 890358 - RNA, 13 nt, Mycobacterium avium subsp. paratuberculosis
ugccgcgccaacg

SEQ ID NO: 890359 - RNA, 15 nt, Mycobacterium avium subsp. paratuberculosis
ugccgcgaugcccgc

SEQ ID NO: 890360 - RNA, 22 nt, Mycobacterium avium subsp. paratuberculosis
ugccgccguugcgagucaucgc

SEQ ID NO: 890361 - RNA, 17 nt, Mycobacterium avium subsp. paratuberculosis
ugccgcgacccgggccg

SEQ ID NO: 890362 - RNA, 17 nt, Mycobacterium avium subsp. paratuberculosis
ugccgcgacucgguguc

SEQ ID NO: 890363 - RNA, 18 nt, Mycobacterium avium subsp. paratuberculosis
ugccgcgacucggugucg

SEQ ID NO: 890364 - RNA, 16 nt, Mycobacterium avium subsp. paratuberculosis
ugccgccgucgacgac

SEQ ID NO: 890365 - RNA, 14 nt, Mycobacterium avium subsp. paratuberculosis
ugccgccggggugc

SEQ ID NO: 890366 - RNA, 20 nt, Mycobacterium avium subsp. paratuberculosis
ugccgccggucacggcgucg

SEQ ID NO: 890367 - RNA, 23 nt, Mycobacterium avium subsp. paratuberculosis
ugccgccggggacccgcaccgga

SEQ ID NO: 890368 - RNA, 14 nt, Mycobacterium avium subsp. paratuberculosis
ugccgccgggcacc

SEQ ID NO: 890369 - RNA, 19 nt, Mycobacterium avium subsp. paratuberculosis
ugccgccgggcaccucggc

SEQ ID NO: 890370 - RNA, 13 nt, Mycobacterium avium subsp. paratuberculosis
ugccgccgggcca

SEQ ID NO: 890371 - RNA, 15 nt, Mycobacterium avium subsp. paratuberculosis
ugccgccgggccagg

SEQ ID NO: 890372 - RNA, 17 nt, Mycobacterium avium subsp. paratuberculosis
ugccgccggcgcccugc

SEQ ID NO: 890373 - RNA, 16 nt, Mycobacterium avium subsp. paratuberculosis
ugccgccggcgcgguu

SEQ ID NO: 890374 - RNA, 14 nt, Mycobacterium avium subsp. paratuberculosis
ugccgccgcgacga

SEQ ID NO: 890375 - RNA, 13 nt, Mycobacterium avium subsp. paratuberculosis
ugccgccgcgcgc

SEQ ID NO: 890376 - RNA, 13 nt, Mycobacterium avium subsp. paratuberculosis
ugccgccgccggc

SEQ ID NO: 890377 - RNA, 14 nt, Mycobacterium avium subsp. paratuberculosis
ugccgccgccgcug

SEQ ID NO: 890378 - RNA, 14 nt, Mycobacterium avium subsp. paratuberculosis
ugccgccgaccgcc

SEQ ID NO: 890379 - RNA, 16 nt, Mycobacterium avium subsp. paratuberculosis
ugccgccgcagcgcag

SEQ ID NO: 890380 - RNA, 18 nt, Mycobacterium avium subsp. paratuberculosis
ugccgccgcccgucagcc

SEQ ID NO: 890381 - RNA, 18 nt, Mycobacterium avium subsp. paratuberculosis
ugccgcaacgggccgcag

SEQ ID NO: 890382 - RNA, 19 nt, Mycobacterium avium subsp. paratuberculosis
ugccgcaacgggccgcagc

SEQ ID NO: 890383 - RNA, 13 nt, Mycobacterium avium subsp. paratuberculosis
ugccgcacgacca

SEQ ID NO: 890384 - RNA, 22 nt, Mycobacterium avium subsp. paratuberculosis
ugccgcacgaccaugucggcga

SEQ ID NO: 890385 - RNA, 12 nt, Mycobacterium avium subsp. paratuberculosis
ugccgcaggcga

SEQ ID NO: 890386 - RNA, 18 nt, Mycobacterium avium subsp. paratuberculosis
ugccgcagcucgaucacc

SEQ ID NO: 890387 - RNA, 19 nt, Mycobacterium avium subsp. paratuberculosis
ugccgcagcggcggcacgg

SEQ ID NO: 890388 - RNA, 21 nt, Mycobacterium avium subsp. paratuberculosis
ugccgcagguggugggcgugc

SEQ ID NO: 890389 - RNA, 13 nt, Mycobacterium avium subsp. paratuberculosis
ugccgccaccgcg

SEQ ID NO: 890390 - RNA, 15 nt, Mycobacterium avium subsp. paratuberculosis
ugccgccaccgcgaa

SEQ ID NO: 890391 - RNA, 21 nt, Mycobacterium avium subsp. paratuberculosis
ugccgccgaagcggcgcacgc

SEQ ID NO: 890392 - RNA, 14 nt, Mycobacterium avium subsp. paratuberculosis
ugccgcccggaccg

SEQ ID NO: 890393 - RNA, 18 nt, Mycobacterium avium subsp. paratuberculosis
ugccgcccaacgacgucg

SEQ ID NO: 890394 - RNA, 21 nt, Mycobacterium avium subsp. paratuberculosis
ugccgcccaacgacgucggcg

SEQ ID NO: 890395 - RNA, 18 nt, Mycobacterium avium subsp. paratuberculosis
ugccgcccaccaccggcu

SEQ ID NO: 890396 - RNA, 12 nt, Mycobacterium avium subsp. paratuberculosis
ucuacggcgggc

SEQ ID NO: 890397 - RNA, 16 nt, Mycobacterium avium subsp. paratuberculosis
ucuacgucggcuggcg

SEQ ID NO: 890398 - RNA, 12 nt, Mycobacterium avium subsp. paratuberculosis
ucuccaccgucg

SEQ ID NO: 890399 - RNA, 14 nt, Mycobacterium avium subsp. paratuberculosis
ucuccacgccgacg

SEQ ID NO: 890400 - RNA, 12 nt, Mycobacterium avium subsp. paratuberculosis
ucuccacgcucg

SEQ ID NO: 890401 - RNA, 14 nt, Mycobacterium avium subsp. paratuberculosis
ucuccagcggccgc

SEQ ID NO: 890402 - RNA, 15 nt, Mycobacterium avium subsp. paratuberculosis
ucuccagcggccgca

SEQ ID NO: 890403 - RNA, 15 nt, Mycobacterium avium subsp. paratuberculosis
ucuccagcggccggg

SEQ ID NO: 890404 - RNA, 19 nt, Mycobacterium avium subsp. paratuberculosis
ucuccagcuccgcggccag

SEQ ID NO: 890405 - RNA, 20 nt, Mycobacterium avium subsp. paratuberculosis
ucuccagcuccgcggccagc

SEQ ID NO: 890406 - RNA, 17 nt, Mycobacterium avium subsp. paratuberculosis
ucuccaggcucgacaac

SEQ ID NO: 890407 - RNA, 14 nt, Mycobacterium avium subsp. paratuberculosis
ucuccaucccgcug

SEQ ID NO: 890408 - RNA, 13 nt, Mycobacterium avium subsp. paratuberculosis
ucguugucgucgc

SEQ ID NO: 890409 - RNA, 20 nt, Mycobacterium avium subsp. paratuberculosis
ucguugugaauccagccgug

SEQ ID NO: 890410 - RNA, 14 nt, Mycobacterium avium subsp. paratuberculosis
ucguuggugcgcac

SEQ ID NO: 890411 - RNA, 14 nt, Mycobacterium avium subsp. paratuberculosis
ucguugguggucga

SEQ ID NO: 890412 - RNA, 21 nt, Mycobacterium avium subsp. paratuberculosis
ucguuggugucgaagcugcgc

SEQ ID NO: 890413 - RNA, 15 nt, Mycobacterium avium subsp. paratuberculosis
ucguugccggcggcg

SEQ ID NO: 890414 - RNA, 12 nt, Mycobacterium avium subsp. paratuberculosis
ucguugcgccgc

SEQ ID NO: 890415 - RNA, 13 nt, Mycobacterium avium subsp. paratuberculosis
ucguugcgccgcc

SEQ ID NO: 890416 - RNA, 18 nt, Mycobacterium avium subsp. paratuberculosis
ucguugcgccgccagggc

SEQ ID NO: 890417 - RNA, 19 nt, Mycobacterium avium subsp. paratuberculosis
ucguucagcugaacggugc

SEQ ID NO: 890418 - RNA, 18 nt, Mycobacterium avium subsp. paratuberculosis
ucguucaugaucggcagg

SEQ ID NO: 890419 - RNA, 20 nt, Mycobacterium avium subsp. paratuberculosis
ucguucgaauuguggcggcc

SEQ ID NO: 890420 - RNA, 15 nt, Mycobacterium avium subsp. paratuberculosis
ucguucucgggggcg

SEQ ID NO: 890421 - RNA, 16 nt, Mycobacterium avium subsp. paratuberculosis
ucguucggccagcacc

SEQ ID NO: 890422 - RNA, 21 nt, Mycobacterium avium subsp. paratuberculosis
ucguugauuagugcgucuuuu

SEQ ID NO: 890423 - RNA, 16 nt, Mycobacterium avium subsp. paratuberculosis
ucguugagcaccacga

SEQ ID NO: 890424 - RNA, 22 nt, Mycobacterium avium subsp. paratuberculosis
ucguugagugcgcuguggugac

SEQ ID NO: 890425 - RNA, 19 nt, Mycobacterium avium subsp. paratuberculosis
ucguugaccgggucgccga

SEQ ID NO: 890426 - RNA, 20 nt, Mycobacterium avium subsp. paratuberculosis
ucguugaccgggucgccgau

SEQ ID NO: 890427 - RNA, 14 nt, Mycobacterium avium subsp. paratuberculosis
ucguugacgcccuc

SEQ ID NO: 890428 - RNA, 22 nt, Mycobacterium avium subsp. paratuberculosis
ucguugacgcccuccuggcggg

SEQ ID NO: 890429 - RNA, 17 nt, Mycobacterium avium subsp. paratuberculosis
ucguguucucacggcga

SEQ ID NO: 890430 - RNA, 16 nt, Mycobacterium avium subsp. paratuberculosis
ucguguggcgcacgcu

SEQ ID NO: 890431 - RNA, 20 nt, Mycobacterium avium subsp. paratuberculosis
ucgugugggcgcccgcggcg

SEQ ID NO: 890432 - RNA, 20 nt, Mycobacterium avium subsp. paratuberculosis
ucguggaaaucgagcgcgcu

SEQ ID NO: 890433 - RNA, 22 nt, Mycobacterium avium subsp. paratuberculosis
ucguggaaaucgagcgcgcugu

SEQ ID NO: 890434 - RNA, 19 nt, Mycobacterium avium subsp. paratuberculosis
ucguggaauccuuccucgc

SEQ ID NO: 890435 - RNA, 18 nt, Mycobacterium avium subsp. paratuberculosis
ucguggacaggaggacaa

SEQ ID NO: 890436 - RNA, 18 nt, Mycobacterium avium subsp. paratuberculosis
ucguggacgaacgcggcg

SEQ ID NO: 890437 - RNA, 12 nt, Mycobacterium avium subsp. paratuberculosis
ucgugucgaucg

SEQ ID NO: 890438 - RNA, 17 nt, Mycobacterium avium subsp. paratuberculosis
ucgugcucggcgagcac

SEQ ID NO: 890439 - RNA, 13 nt, Mycobacterium avium subsp. paratuberculosis
ucgugcggccggc

SEQ ID NO: 890440 - RNA, 15 nt, Mycobacterium avium subsp. paratuberculosis
ucgugcggccggcgc

SEQ ID NO: 890441 - RNA, 22 nt, Mycobacterium avium subsp. paratuberculosis
ucgugcggccggcgccggcggu

SEQ ID NO: 890442 - RNA, 19 nt, Mycobacterium avium subsp. paratuberculosis
ucgugcggcgccgcccggc

SEQ ID NO: 890443 - RNA, 22 nt, Mycobacterium avium subsp. paratuberculosis
ucgugcgggcuccgcacgaccu

SEQ ID NO: 890444 - RNA, 15 nt, Mycobacterium avium subsp. paratuberculosis
ucgugcgcccauccg

SEQ ID NO: 890445 - RNA, 17 nt, Mycobacterium avium subsp. paratuberculosis
ucgugcagccggcggcg

SEQ ID NO: 890446 - RNA, 14 nt, Mycobacterium avium subsp. paratuberculosis
ucgugcagcaccgc

SEQ ID NO: 890447 - RNA, 17 nt, Mycobacterium avium subsp. paratuberculosis
ucgugcagcaccgccag

SEQ ID NO: 890448 - RNA, 23 nt, Mycobacterium avium subsp. paratuberculosis
ucgugcacgccguggcggcgggc

SEQ ID NO: 890449 - RNA, 15 nt, Mycobacterium avium subsp. paratuberculosis
ucgugccgcacccga

SEQ ID NO: 890450 - RNA, 19 nt, Mycobacterium avium subsp. paratuberculosis
ucgugcauucaggucaccg

SEQ ID NO: 890451 - RNA, 16 nt, Mycobacterium avium subsp. paratuberculosis
ucgugcagugcgaucg

SEQ ID NO: 890452 - RNA, 17 nt, Mycobacterium avium subsp. paratuberculosis
ucgugcagugcgaucgc

SEQ ID NO: 890453 - RNA, 15 nt, Mycobacterium avium subsp. paratuberculosis
ucgugcaucggcgcc

SEQ ID NO: 890454 - RNA, 13 nt, Mycobacterium avium subsp. paratuberculosis
ucgucggccggca

SEQ ID NO: 890455 - RNA, 13 nt, Mycobacterium avium subsp. paratuberculosis
ucgucggccgucg

SEQ ID NO: 890456 - RNA, 23 nt, Mycobacterium avium subsp. paratuberculosis
ucgucggccugcacgucggcgcg

SEQ ID NO: 890457 - RNA, 15 nt, Mycobacterium avium subsp. paratuberculosis
ucgucggccagcgag

SEQ ID NO: 890458 - RNA, 13 nt, Mycobacterium avium subsp. paratuberculosis
ucgucggccacgc

SEQ ID NO: 890459 - RNA, 14 nt, Mycobacterium avium subsp. paratuberculosis
ucgucggccacgcu

SEQ ID NO: 890460 - RNA, 22 nt, Mycobacterium avium subsp. paratuberculosis
ucgucggccacgcucgccagac

SEQ ID NO: 890461 - RNA, 13 nt, Mycobacterium avium subsp. paratuberculosis
ucgugaucgccca

SEQ ID NO: 890462 - RNA, 16 nt, Mycobacterium avium subsp. paratuberculosis
ucgugaugguccagca

SEQ ID NO: 890463 - RNA, 19 nt, Mycobacterium avium subsp. paratuberculosis
ucgugcaaaccggaccgcc

SEQ ID NO: 890464 - RNA, 24 nt, Mycobacterium avium subsp. paratuberculosis
ucgugcaaaccggaccgccgcggc

SEQ ID NO: 890465 - RNA, 23 nt, Mycobacterium avium subsp. paratuberculosis
ucgugcaacucccgcgccgcggc

SEQ ID NO: 890466 - RNA, 22 nt, Mycobacterium avium subsp. paratuberculosis
ucgugcacaugcccgucgggcg

SEQ ID NO: 890467 - RNA, 14 nt, Mycobacterium avium subsp. paratuberculosis
ucgugcaccacgac

SEQ ID NO: 890468 - RNA, 22 nt, Mycobacterium avium subsp. paratuberculosis
ucguacagcagccccugcacca

SEQ ID NO: 890469 - RNA, 22 nt, Mycobacterium avium subsp. paratuberculosis
ucguaccugccccacacgcucg

SEQ ID NO: 890470 - RNA, 23 nt, Mycobacterium avium subsp. paratuberculosis
ucguacgacacgaugggucaggu

SEQ ID NO: 890471 - RNA, 13 nt, Mycobacterium avium subsp. paratuberculosis
ucguagagcgcga

SEQ ID NO: 890472 - RNA, 17 nt, Mycobacterium avium subsp. paratuberculosis
ucgucaaugauggucag

SEQ ID NO: 890473 - RNA, 23 nt, Mycobacterium avium subsp. paratuberculosis
ucgucaaugauggucagccgcac

SEQ ID NO: 890474 - RNA, 19 nt, Mycobacterium avium subsp. paratuberculosis
ucgucaccgaccccucggc

SEQ ID NO: 890475 - RNA, 18 nt, Mycobacterium avium subsp. paratuberculosis
ucgucaccgugggcggcg

SEQ ID NO: 890476 - RNA, 18 nt, Mycobacterium avium subsp. paratuberculosis
ucguagaccgcuugcgac

SEQ ID NO: 890477 - RNA, 19 nt, Mycobacterium avium subsp. paratuberculosis
ucguacgucuugcgcaccu

SEQ ID NO: 890478 - RNA, 13 nt, Mycobacterium avium subsp. paratuberculosis
ucgucagcagcga

SEQ ID NO: 890479 - RNA, 15 nt, Mycobacterium avium subsp. paratuberculosis
ucgucacuucgccgg

SEQ ID NO: 890480 - RNA, 16 nt, Mycobacterium avium subsp. paratuberculosis
ucgucagcgcgggcca

SEQ ID NO: 890481 - RNA, 23 nt, Mycobacterium avium subsp. paratuberculosis
ucgucaggccgugaucggccagc

SEQ ID NO: 890482 - RNA, 19 nt, Mycobacterium avium subsp. paratuberculosis
ucguccaaacuccggggga

SEQ ID NO: 890483 - RNA, 12 nt, Mycobacterium avium subsp. paratuberculosis
ucguccaccgac

SEQ ID NO: 890484 - RNA, 21 nt, Mycobacterium avium subsp. paratuberculosis
ucgucccaguccagccguucg

SEQ ID NO: 890485 - RNA, 14 nt, Mycobacterium avium subsp. paratuberculosis
ucguccccuccccg

SEQ ID NO: 890486 - RNA, 17 nt, Mycobacterium avium subsp. paratuberculosis
ucgucccggcgccucgg

SEQ ID NO: 890487 - RNA, 24 nt, Mycobacterium avium subsp. paratuberculosis
ucgucccggcgccucggcgccucg

SEQ ID NO: 890488 - RNA, 22 nt, Mycobacterium avium subsp. paratuberculosis
ucgucccggugaugacggggcg

SEQ ID NO: 890489 - RNA, 14 nt, Mycobacterium avium subsp. paratuberculosis
ucgucccgucggcg

SEQ ID NO: 890490 - RNA, 17 nt, Mycobacterium avium subsp. paratuberculosis
ucgucccgucggcgcga

SEQ ID NO: 890491 - RNA, 16 nt, Mycobacterium avium subsp. paratuberculosis
ucguccgcaaccgccg

SEQ ID NO: 890492 - RNA, 18 nt, Mycobacterium avium subsp. paratuberculosis
ucguccgcaaccgccggc

SEQ ID NO: 890493 - RNA, 20 nt, Mycobacterium avium subsp. paratuberculosis
ucguccgcaaccgccggcag

SEQ ID NO: 890494 - RNA, 22 nt, Mycobacterium avium subsp. paratuberculosis
ucguccgcaaccgccggcagcg

SEQ ID NO: 890495 - RNA, 15 nt, Mycobacterium avium subsp. paratuberculosis
ucguccgcggcggcg

SEQ ID NO: 890496 - RNA, 16 nt, Mycobacterium avium subsp. paratuberculosis
ucguccgcggcggcgu

SEQ ID NO: 890497 - RNA, 13 nt, Mycobacterium avium subsp. paratuberculosis
ucguccucccggc

SEQ ID NO: 890498 - RNA, 15 nt, Mycobacterium avium subsp. paratuberculosis
ucguccucccggccg

SEQ ID NO: 890499 - RNA, 20 nt, Mycobacterium avium subsp. paratuberculosis
ucguccucccggccgacgau

SEQ ID NO: 890500 - RNA, 15 nt, Mycobacterium avium subsp. paratuberculosis
ucguccggcgcgcag

SEQ ID NO: 890501 - RNA, 16 nt, Mycobacterium avium subsp. paratuberculosis
ucguccucgaucaccg

SEQ ID NO: 890502 - RNA, 17 nt, Mycobacterium avium subsp. paratuberculosis
ucguccucgcgccgugg

SEQ ID NO: 890503 - RNA, 15 nt, Mycobacterium avium subsp. paratuberculosis
ucgucgacggccgcg

SEQ ID NO: 890504 - RNA, 14 nt, Mycobacterium avium subsp. paratuberculosis
ucgucgacggcggc

SEQ ID NO: 890505 - RNA, 15 nt, Mycobacterium avium subsp. paratuberculosis
ucgucgacggcggcg

SEQ ID NO: 890506 - RNA, 13 nt, Mycobacterium avium subsp. paratuberculosis
ucgucgacgucgg

SEQ ID NO: 890507 - RNA, 15 nt, Mycobacterium avium subsp. paratuberculosis
ucgucgacgucggac

SEQ ID NO: 890508 - RNA, 15 nt, Mycobacterium avium subsp. paratuberculosis
ucgucgacgucgggg

SEQ ID NO: 890509 - RNA, 19 nt, Mycobacterium avium subsp. paratuberculosis
ucgucgagaagaccugguu

SEQ ID NO: 890510 - RNA, 13 nt, Mycobacterium avium subsp. paratuberculosis
ucgucgagcaccg

SEQ ID NO: 890511 - RNA, 19 nt, Mycobacterium avium subsp. paratuberculosis
ucgucgagcagcgcccggc

SEQ ID NO: 890512 - RNA, 20 nt, Mycobacterium avium subsp. paratuberculosis
ucgucgaguucgcggcgcag

SEQ ID NO: 890513 - RNA, 22 nt, Mycobacterium avium subsp. paratuberculosis
ucgucgaguucgcggcgcagca

SEQ ID NO: 890514 - RNA, 19 nt, Mycobacterium avium subsp. paratuberculosis
ucgucgcccgucucggcgu

SEQ ID NO: 890515 - RNA, 22 nt, Mycobacterium avium subsp. paratuberculosis
ucgucgcccgucucggcgugcu

SEQ ID NO: 890516 - RNA, 23 nt, Mycobacterium avium subsp. paratuberculosis
ucgucgcccugacacagcaccgg

SEQ ID NO: 890517 - RNA, 12 nt, Mycobacterium avium subsp. paratuberculosis
ucgucgccgacc

SEQ ID NO: 890518 - RNA, 21 nt, Mycobacterium avium subsp. paratuberculosis
ucgucgaguccguugggggcg

SEQ ID NO: 890519 - RNA, 14 nt, Mycobacterium avium subsp. paratuberculosis
ucgucgagcaccac

SEQ ID NO: 890520 - RNA, 18 nt, Mycobacterium avium subsp. paratuberculosis
ucgucgagggccaccggc

SEQ ID NO: 890521 - RNA, 16 nt, Mycobacterium avium subsp. paratuberculosis
ucgucgagcauccggc

SEQ ID NO: 890522 - RNA, 13 nt, Mycobacterium avium subsp. paratuberculosis
ucgucgagccgcu

SEQ ID NO: 890523 - RNA, 15 nt, Mycobacterium avium subsp. paratuberculosis
ucgucgagccgcucg

SEQ ID NO: 890524 - RNA, 14 nt, Mycobacterium avium subsp. paratuberculosis
ucgucgagccggcc

SEQ ID NO: 890525 - RNA, 15 nt, Mycobacterium avium subsp. paratuberculosis
ucgucgagccggccg

SEQ ID NO: 890526 - RNA, 16 nt, Mycobacterium avium subsp. paratuberculosis
ucgucgagccggccgg

SEQ ID NO: 890527 - RNA, 23 nt, Mycobacterium avium subsp. paratuberculosis
ucgucgcggaggaugccggccag

SEQ ID NO: 890528 - RNA, 13 nt, Mycobacterium avium subsp. paratuberculosis
ucgucgcggcggc

SEQ ID NO: 890529 - RNA, 17 nt, Mycobacterium avium subsp. paratuberculosis
ucgucgcggcggucacg

SEQ ID NO: 890530 - RNA, 17 nt, Mycobacterium avium subsp. paratuberculosis
ucgucgcggcugccggu

SEQ ID NO: 890531 - RNA, 22 nt, Mycobacterium avium subsp. paratuberculosis
ucgucgccguggcggcccgacc

SEQ ID NO: 890532 - RNA, 13 nt, Mycobacterium avium subsp. paratuberculosis
ucgucgcgcacca

SEQ ID NO: 890533 - RNA, 19 nt, Mycobacterium avium subsp. paratuberculosis
ucgucgcgcaccagcucga

SEQ ID NO: 890534 - RNA, 21 nt, Mycobacterium avium subsp. paratuberculosis
ucgucgcgcacccagccgcau

SEQ ID NO: 890535 - RNA, 18 nt, Mycobacterium avium subsp. paratuberculosis
ucgucgccgaugcgccgc

SEQ ID NO: 890536 - RNA, 15 nt, Mycobacterium avium subsp. paratuberculosis
ucgucgccgccaacg

SEQ ID NO: 890537 - RNA, 22 nt, Mycobacterium avium subsp. paratuberculosis
ucgucgccgcgcgcgucgacgu

SEQ ID NO: 890538 - RNA, 15 nt, Mycobacterium avium subsp. paratuberculosis
ucgucgccgcgguag

SEQ ID NO: 890539 - RNA, 15 nt, Mycobacterium avium subsp. paratuberculosis
ucgucgccggccgcc

SEQ ID NO: 890540 - RNA, 20 nt, Mycobacterium avium subsp. paratuberculosis
ucgucgccggccgcggugug

SEQ ID NO: 890541 - RNA, 16 nt, Mycobacterium avium subsp. paratuberculosis
ucgucgccggugagca

SEQ ID NO: 890542 - RNA, 19 nt, Mycobacterium avium subsp. paratuberculosis
ucgucgccgguggccgccg

SEQ ID NO: 890543 - RNA, 14 nt, Mycobacterium avium subsp. paratuberculosis
ucgucgccgucacc

SEQ ID NO: 890544 - RNA, 17 nt, Mycobacterium avium subsp. paratuberculosis
ucgucgcuaccucacca

SEQ ID NO: 890545 - RNA, 20 nt, Mycobacterium avium subsp. paratuberculosis
ucgucgcgguccacgccggc

SEQ ID NO: 890546 - RNA, 15 nt, Mycobacterium avium subsp. paratuberculosis
ucgucgcguccagca

SEQ ID NO: 890547 - RNA, 24 nt, Mycobacterium avium subsp. paratuberculosis
ucgucgcuguccucgagcgcgucg

SEQ ID NO: 890548 - RNA, 18 nt, Mycobacterium avium subsp. paratuberculosis
ucgucggacagcagcacc

SEQ ID NO: 890549 - RNA, 21 nt, Mycobacterium avium subsp. paratuberculosis
ucgucggacagcagcaccggc

SEQ ID NO: 890550 - RNA, 21 nt, Mycobacterium avium subsp. paratuberculosis
ucgucggagacguugccgcac

SEQ ID NO: 890551 - RNA, 15 nt, Mycobacterium avium subsp. paratuberculosis
ucgucggaggcgucg

SEQ ID NO: 890552 - RNA, 15 nt, Mycobacterium avium subsp. paratuberculosis
ucgucgcugaucgcg

SEQ ID NO: 890553 - RNA, 16 nt, Mycobacterium avium subsp. paratuberculosis
ucgucggcagcgacgc

SEQ ID NO: 890554 - RNA, 20 nt, Mycobacterium avium subsp. paratuberculosis
ucgucggcagcgacgcggug

SEQ ID NO: 890555 - RNA, 16 nt, Mycobacterium avium subsp. paratuberculosis
ucggugaagcggcgcg

SEQ ID NO: 890556 - RNA, 22 nt, Mycobacterium avium subsp. paratuberculosis
ucggugaagcggcgcgggucgc

SEQ ID NO: 890557 - RNA, 16 nt, Mycobacterium avium subsp. paratuberculosis
ucggugaacugcagcc

SEQ ID NO: 890558 - RNA, 20 nt, Mycobacterium avium subsp. paratuberculosis
ucggugaacugcagcccgau

SEQ ID NO: 890559 - RNA, 18 nt, Mycobacterium avium subsp. paratuberculosis
ucggugaagccgacgccg

SEQ ID NO: 890560 - RNA, 17 nt, Mycobacterium avium subsp. paratuberculosis
ucggugaagugccggcu

SEQ ID NO: 890561 - RNA, 20 nt, Mycobacterium avium subsp. paratuberculosis
ucggugaaguuggcggcggu

SEQ ID NO: 890562 - RNA, 15 nt, Mycobacterium avium subsp. paratuberculosis
ucggugaccacgguc

SEQ ID NO: 890563 - RNA, 16 nt, Mycobacterium avium subsp. paratuberculosis
ucggugaccucgaaga

SEQ ID NO: 890564 - RNA, 17 nt, Mycobacterium avium subsp. paratuberculosis
ucggugacgaacggcga

SEQ ID NO: 890565 - RNA, 15 nt, Mycobacterium avium subsp. paratuberculosis
ucggugacggcgucg

SEQ ID NO: 890566 - RNA, 14 nt, Mycobacterium avium subsp. paratuberculosis
ucggugacggugug

SEQ ID NO: 890567 - RNA, 16 nt, Mycobacterium avium subsp. paratuberculosis
ucggugacgaggaggg

SEQ ID NO: 890568 - RNA, 15 nt, Mycobacterium avium subsp. paratuberculosis
ucggugagcagcucg

SEQ ID NO: 890569 - RNA, 21 nt, Mycobacterium avium subsp. paratuberculosis
ucgguaaucggcgguggugaa

SEQ ID NO: 890570 - RNA, 15 nt, Mycobacterium avium subsp. paratuberculosis
ucgguaacugcgugu

SEQ ID NO: 890571 - RNA, 23 nt, Mycobacterium avium subsp. paratuberculosis
ucgguaacugcguguggcgcacg

SEQ ID NO: 890572 - RNA, 19 nt, Mycobacterium avium subsp. paratuberculosis
ucgguaccagggcagcgcc

SEQ ID NO: 890573 - RNA, 24 nt, Mycobacterium avium subsp. paratuberculosis
ucgguaccagggcagcgccucggc

SEQ ID NO: 890574 - RNA, 15 nt, Mycobacterium avium subsp. paratuberculosis
ucggucucggcggcg

SEQ ID NO: 890575 - RNA, 17 nt, Mycobacterium avium subsp. paratuberculosis
ucggucucggcggcgcc

SEQ ID NO: 890576 - RNA, 22 nt, Mycobacterium avium subsp. paratuberculosis
ucggucugccuggcgaacucgc

SEQ ID NO: 890577 - RNA, 16 nt, Mycobacterium avium subsp. paratuberculosis
ucggucucgacaccgg

SEQ ID NO: 890578 - RNA, 16 nt, Mycobacterium avium subsp. paratuberculosis
ucggguuucgcgggcu

SEQ ID NO: 890579 - RNA, 13 nt, Mycobacterium avium subsp. paratuberculosis
ucggcuggucggc

SEQ ID NO: 890580 - RNA, 15 nt, Mycobacterium avium subsp. paratuberculosis
ucggguguggcgccg

SEQ ID NO: 890581 - RNA, 13 nt, Mycobacterium avium subsp. paratuberculosis
ucggcucggcgac

SEQ ID NO: 890582 - RNA, 17 nt, Mycobacterium avium subsp. paratuberculosis
ucggguucgccggugac

SEQ ID NO: 890583 - RNA, 13 nt, Mycobacterium avium subsp. paratuberculosis
ucggcugcgggcc

SEQ ID NO: 890584 - RNA, 15 nt, Mycobacterium avium subsp. paratuberculosis
ucggcugcgggccag

SEQ ID NO: 890585 - RNA, 18 nt, Mycobacterium avium subsp. paratuberculosis
ucggcugcgggccagcgc

SEQ ID NO: 890586 - RNA, 17 nt, Mycobacterium avium subsp. paratuberculosis
ucggcucguagcgggcg

SEQ ID NO: 890587 - RNA, 19 nt, Mycobacterium avium subsp. paratuberculosis
ucggcucguguccgaugac

SEQ ID NO: 890588 - RNA, 17 nt, Mycobacterium avium subsp. paratuberculosis
ucggcuccagcgcccgc

SEQ ID NO: 890589 - RNA, 13 nt, Mycobacterium avium subsp. paratuberculosis
ucggcuccugccg

SEQ ID NO: 890590 - RNA, 23 nt, Mycobacterium avium subsp. paratuberculosis
ucggcuccugccguucggccagc

SEQ ID NO: 890591 - RNA, 13 nt, Mycobacterium avium subsp. paratuberculosis
ucggcucgcccgc

SEQ ID NO: 890592 - RNA, 23 nt, Mycobacterium avium subsp. paratuberculosis
ucggugaucaccaugaucagcgc

SEQ ID NO: 890593 - RNA, 15 nt, Mycobacterium avium subsp. paratuberculosis
ucggugaucacccgc

SEQ ID NO: 890594 - RNA, 19 nt, Mycobacterium avium subsp. paratuberculosis
ucggugagcgccaccccga

SEQ ID NO: 890595 - RNA, 20 nt, Mycobacterium avium subsp. paratuberculosis
ucggugagcgccaccccgaa

SEQ ID NO: 890596 - RNA, 21 nt, Mycobacterium avium subsp. paratuberculosis
ucggugagccaguucgccagc

SEQ ID NO: 890597 - RNA, 15 nt, Mycobacterium avium subsp. paratuberculosis
ucggugagccgcugg

SEQ ID NO: 890598 - RNA, 14 nt, Mycobacterium avium subsp. paratuberculosis
ucggugagcguggu

SEQ ID NO: 890599 - RNA, 17 nt, Mycobacterium avium subsp. paratuberculosis
ucggugagcuggccgcg

SEQ ID NO: 890600 - RNA, 20 nt, Mycobacterium avium subsp. paratuberculosis
ucggugagcuggccgcgcag

SEQ ID NO: 890601 - RNA, 20 nt, Mycobacterium avium subsp. paratuberculosis
ucggugaucucaccggcggc

SEQ ID NO: 890602 - RNA, 21 nt, Mycobacterium avium subsp. paratuberculosis
ucggugaucucaccggcggcg

SEQ ID NO: 890603 - RNA, 16 nt, Mycobacterium avium subsp. paratuberculosis
ucggugaucugcacca

SEQ ID NO: 890604 - RNA, 22 nt, Mycobacterium avium subsp. paratuberculosis
ucggugaucugcaccagcgugg

SEQ ID NO: 890605 - RNA, 13 nt, Mycobacterium avium subsp. paratuberculosis
ucggugaugccgg

SEQ ID NO: 890606 - RNA, 14 nt, Mycobacterium avium subsp. paratuberculosis
ucggugaugccgga

SEQ ID NO: 890607 - RNA, 14 nt, Mycobacterium avium subsp. paratuberculosis
ucggugaugccggc

SEQ ID NO: 890608 - RNA, 22 nt, Mycobacterium avium subsp. paratuberculosis
ucggugaugccggccagccgcg

SEQ ID NO: 890609 - RNA, 22 nt, Mycobacterium avium subsp. paratuberculosis
ucggugcacggcgccaccagcc

SEQ ID NO: 890610 - RNA, 16 nt, Mycobacterium avium subsp. paratuberculosis
ucggugcagaccccgg

SEQ ID NO: 890611 - RNA, 17 nt, Mycobacterium avium subsp. paratuberculosis
ucggugcagaccccggc

SEQ ID NO: 890612 - RNA, 18 nt, Mycobacterium avium subsp. paratuberculosis
ucggugcagaccccggcg

SEQ ID NO: 890613 - RNA, 17 nt, Mycobacterium avium subsp. paratuberculosis
ucggugcaggccgcgac

SEQ ID NO: 890614 - RNA, 19 nt, Mycobacterium avium subsp. paratuberculosis
ucggugcgcuccucgacgu

SEQ ID NO: 890615 - RNA, 16 nt, Mycobacterium avium subsp. paratuberculosis
ucggugcgccagauca

SEQ ID NO: 890616 - RNA, 23 nt, Mycobacterium avium subsp. paratuberculosis
ucggugcgccagaucagcguggu

SEQ ID NO: 890617 - RNA, 15 nt, Mycobacterium avium subsp. paratuberculosis
ucggugcgcgccgca

SEQ ID NO: 890618 - RNA, 20 nt, Mycobacterium avium subsp. paratuberculosis
ucggugcgaaaauggcugcc

SEQ ID NO: 890619 - RNA, 23 nt, Mycobacterium avium subsp. paratuberculosis
ucggugccucuucgucggccggc

SEQ ID NO: 890620 - RNA, 17 nt, Mycobacterium avium subsp. paratuberculosis
ucggugccggugaugaa

SEQ ID NO: 890621 - RNA, 18 nt, Mycobacterium avium subsp. paratuberculosis
ucggugauggccggcuac

SEQ ID NO: 890622 - RNA, 22 nt, Mycobacterium avium subsp. paratuberculosis
ucggugaugucgacgucgucga

SEQ ID NO: 890623 - RNA, 13 nt, Mycobacterium avium subsp. paratuberculosis
ucggugcccagca

SEQ ID NO: 890624 - RNA, 21 nt, Mycobacterium avium subsp. paratuberculosis
ucggugcccagcaccgccggc

SEQ ID NO: 890625 - RNA, 17 nt, Mycobacterium avium subsp. paratuberculosis
ucggugcccugugaggc

SEQ ID NO: 890626 - RNA, 20 nt, Mycobacterium avium subsp. paratuberculosis
ucgguggucgacgagcccgc

SEQ ID NO: 890627 - RNA, 18 nt, Mycobacterium avium subsp. paratuberculosis
ucggugggccgccgcggc

SEQ ID NO: 890628 - RNA, 23 nt, Mycobacterium avium subsp. paratuberculosis
ucgguggggacgugcacgcguuc

SEQ ID NO: 890629 - RNA, 16 nt, Mycobacterium avium subsp. paratuberculosis
ucggugggggccaggc

SEQ ID NO: 890630 - RNA, 12 nt, Mycobacterium avium subsp. paratuberculosis
ucgguggcggcg

SEQ ID NO: 890631 - RNA, 15 nt, Mycobacterium avium subsp. paratuberculosis
ucgguggcggugccg

SEQ ID NO: 890632 - RNA, 20 nt, Mycobacterium avium subsp. paratuberculosis
ucgguggcgguggccacggc

SEQ ID NO: 890633 - RNA, 14 nt, Mycobacterium avium subsp. paratuberculosis
ucgguggcgucggc

SEQ ID NO: 890634 - RNA, 17 nt, Mycobacterium avium subsp. paratuberculosis
ucgguggcgucggcggc

SEQ ID NO: 890635 - RNA, 14 nt, Mycobacterium avium subsp. paratuberculosis
ucgguggcccagcc

SEQ ID NO: 890636 - RNA, 17 nt, Mycobacterium avium subsp. paratuberculosis
ucgguggcccagccggc

SEQ ID NO: 890637 - RNA, 20 nt, Mycobacterium avium subsp. paratuberculosis
ucgguggcgauggugcugcc

SEQ ID NO: 890638 - RNA, 15 nt, Mycobacterium avium subsp. paratuberculosis
ucgguggacagcgcg

SEQ ID NO: 890639 - RNA, 16 nt, Mycobacterium avium subsp. paratuberculosis
ucgguggacagcgcga

SEQ ID NO: 890640 - RNA, 14 nt, Mycobacterium avium subsp. paratuberculosis
ucgguggacgccgc

SEQ ID NO: 890641 - RNA, 13 nt, Mycobacterium avium subsp. paratuberculosis
ucgguggacgcgg

SEQ ID NO: 890642 - RNA, 14 nt, Mycobacterium avium subsp. paratuberculosis
ucgguggacgcggu

SEQ ID NO: 890643 - RNA, 15 nt, Mycobacterium avium subsp. paratuberculosis
ucgguggacgcgguc

SEQ ID NO: 890644 - RNA, 13 nt, Mycobacterium avium subsp. paratuberculosis
ucgguggauccgg

SEQ ID NO: 890645 - RNA, 17 nt, Mycobacterium avium subsp. paratuberculosis
ucgguggauccggugac

SEQ ID NO: 890646 - RNA, 20 nt, Mycobacterium avium subsp. paratuberculosis
ucgguggcaccccgcgccgg

SEQ ID NO: 890647 - RNA, 22 nt, Mycobacterium avium subsp. paratuberculosis
ucgguggcaccccgcgccgggc

SEQ ID NO: 890648 - RNA, 17 nt, Mycobacterium avium subsp. paratuberculosis
ucgguggccaccgcgac

SEQ ID NO: 890649 - RNA, 23 nt, Mycobacterium avium subsp. paratuberculosis
ucgguggccaccgcgacgcccag

SEQ ID NO: 890650 - RNA, 15 nt, Mycobacterium avium subsp. paratuberculosis
ucggugcgggucaca

SEQ ID NO: 890651 - RNA, 18 nt, Mycobacterium avium subsp. paratuberculosis
ucggugcgggucacaccc

SEQ ID NO: 890652 - RNA, 21 nt, Mycobacterium avium subsp. paratuberculosis
ucuggucggccagcgcgcgca

SEQ ID NO: 890653 - RNA, 14 nt, Mycobacterium avium subsp. paratuberculosis
ucugguuccacagc

SEQ ID NO: 890654 - RNA, 13 nt, Mycobacterium avium subsp. paratuberculosis
ucugguaggcggc

SEQ ID NO: 890655 - RNA, 16 nt, Mycobacterium avium subsp. paratuberculosis
ucugguccagcgugcg

SEQ ID NO: 890656 - RNA, 17 nt, Mycobacterium avium subsp. paratuberculosis
ucugggugagcgacacc

SEQ ID NO: 890657 - RNA, 19 nt, Mycobacterium avium subsp. paratuberculosis
ucugguacccgauggugaa

SEQ ID NO: 890658 - RNA, 17 nt, Mycobacterium avium subsp. paratuberculosis
aauacggugcccgccgc

SEQ ID NO: 890659 - RNA, 21 nt, Mycobacterium avium subsp. paratuberculosis
ucugucgcgcucagugcacgc

SEQ ID NO: 890660 - RNA, 18 nt, Mycobacterium avium subsp. paratuberculosis
ucugcggugcgcccaggu

SEQ ID NO: 890661 - RNA, 20 nt, Mycobacterium avium subsp. paratuberculosis
ucugcggccggggcagaccc

SEQ ID NO: 890662 - RNA, 14 nt, Mycobacterium avium subsp. paratuberculosis
ucucgaagcgcagc

SEQ ID NO: 890663 - RNA, 15 nt, Mycobacterium avium subsp. paratuberculosis
ucucgaagcgcagca

SEQ ID NO: 890664 - RNA, 16 nt, Mycobacterium avium subsp. paratuberculosis
ucucgaagcgcagcag

SEQ ID NO: 890665 - RNA, 17 nt, Mycobacterium avium subsp. paratuberculosis
ucucgaagcgcagcagc

SEQ ID NO: 890666 - RNA, 18 nt, Mycobacterium avium subsp. paratuberculosis
ucucgacccgggccagca

SEQ ID NO: 890667 - RNA, 14 nt, Mycobacterium avium subsp. paratuberculosis
ucuccuggccgccg

SEQ ID NO: 890668 - RNA, 17 nt, Mycobacterium avium subsp. paratuberculosis
ucucgaacacgccgucg

SEQ ID NO: 890669 - RNA, 15 nt, Mycobacterium avium subsp. paratuberculosis
ucucgaaccgggcgg

SEQ ID NO: 890670 - RNA, 20 nt, Mycobacterium avium subsp. paratuberculosis
ucucgaaccgucuagcggcg

SEQ ID NO: 890671 - RNA, 12 nt, Mycobacterium avium subsp. paratuberculosis
ucugcucgaucu

SEQ ID NO: 890672 - RNA, 21 nt, Mycobacterium avium subsp. paratuberculosis
ucugcgggaagcccaccgcgg

SEQ ID NO: 890673 - RNA, 14 nt, Mycobacterium avium subsp. paratuberculosis
ucugcuccccguug

SEQ ID NO: 890674 - RNA, 13 nt, Mycobacterium avium subsp. paratuberculosis
ucugcucgccggc

SEQ ID NO: 890675 - RNA, 14 nt, Mycobacterium avium subsp. paratuberculosis
ucugcucggcgggu

SEQ ID NO: 890676 - RNA, 13 nt, Mycobacterium avium subsp. paratuberculosis
ucugcucgguguc

SEQ ID NO: 890677 - RNA, 18 nt, Mycobacterium avium subsp. paratuberculosis
ucuggcgugacgcucggc

SEQ ID NO: 890678 - RNA, 22 nt, Mycobacterium avium subsp. paratuberculosis
ucuggcggguguucagccccuc

SEQ ID NO: 890679 - RNA, 14 nt, Mycobacterium avium subsp. paratuberculosis
ucuggcucggcacc

SEQ ID NO: 890680 - RNA, 14 nt, Mycobacterium avium subsp. paratuberculosis
ucugggaggcggcg

SEQ ID NO: 890681 - RNA, 17 nt, Mycobacterium avium subsp. paratuberculosis
ucuggcuggugaccccg

SEQ ID NO: 890682 - RNA, 23 nt, Mycobacterium avium subsp. paratuberculosis
ucugggcgaccaugccgcgggcc

SEQ ID NO: 890683 - RNA, 14 nt, Mycobacterium avium subsp. paratuberculosis
ucugggcgggcucg

SEQ ID NO: 890684 - RNA, 17 nt, Mycobacterium avium subsp. paratuberculosis
ucugggcgggcucgagc

SEQ ID NO: 890685 - RNA, 13 nt, Mycobacterium avium subsp. paratuberculosis
ucuuugccggcca

SEQ ID NO: 890686 - RNA, 14 nt, Mycobacterium avium subsp. paratuberculosis
ucuuugcggccgug

SEQ ID NO: 890687 - RNA, 13 nt, Mycobacterium avium subsp. paratuberculosis
ucuugaacggcgc

SEQ ID NO: 890688 - RNA, 14 nt, Mycobacterium avium subsp. paratuberculosis
ucuugacgccgaug

SEQ ID NO: 890689 - RNA, 14 nt, Mycobacterium avium subsp. paratuberculosis
ucuugacggccgcg

SEQ ID NO: 890690 - RNA, 20 nt, Mycobacterium avium subsp. paratuberculosis
ucuugacggccgcggcggug

SEQ ID NO: 890691 - RNA, 14 nt, Mycobacterium avium subsp. paratuberculosis
ucuugacggcgacg

SEQ ID NO: 890692 - RNA, 14 nt, Mycobacterium avium subsp. paratuberculosis
ucuugucggcggcc

SEQ ID NO: 890693 - RNA, 14 nt, Mycobacterium avium subsp. paratuberculosis
ucuuggucagcggc

SEQ ID NO: 890694 - RNA, 15 nt, Mycobacterium avium subsp. paratuberculosis
ucuuggucagcggca

SEQ ID NO: 890695 - RNA, 20 nt, Mycobacterium avium subsp. paratuberculosis
ucuguugcacguaggcggcg

SEQ ID NO: 890696 - RNA, 21 nt, Mycobacterium avium subsp. paratuberculosis
ugaagucggugcccagcgcga

SEQ ID NO: 890697 - RNA, 17 nt, Mycobacterium avium subsp. paratuberculosis
ugaauaccacugcgcgc

SEQ ID NO: 890698 - RNA, 17 nt, Mycobacterium avium subsp. paratuberculosis
ugaagugcacucggcga

SEQ ID NO: 890699 - RNA, 17 nt, Mycobacterium avium subsp. paratuberculosis
ugaaguccggcggucgc

SEQ ID NO: 890700 - RNA, 16 nt, Mycobacterium avium subsp. paratuberculosis
ugaaggcgaacaccag

SEQ ID NO: 890701 - RNA, 17 nt, Mycobacterium avium subsp. paratuberculosis
ugaaggacuggcccacg

SEQ ID NO: 890702 - RNA, 15 nt, Mycobacterium avium subsp. paratuberculosis
ugaaggaggcggucg

SEQ ID NO: 890703 - RNA, 22 nt, Mycobacterium avium subsp. paratuberculosis
ugaagcuagcuucacgcucggc

SEQ ID NO: 890704 - RNA, 22 nt, Mycobacterium avium subsp. paratuberculosis
ugaagcuaguuucacgcucggc

SEQ ID NO: 890705 - RNA, 20 nt, Mycobacterium avium subsp. paratuberculosis
ugaagcuaguuucacguucg

SEQ ID NO: 890706 - RNA, 16 nt, Mycobacterium avium subsp. paratuberculosis
ugaagcugccgaccag

SEQ ID NO: 890707 - RNA, 22 nt, Mycobacterium avium subsp. paratuberculosis
ugaagcuggccaccgcaucgcc

SEQ ID NO: 890708 - RNA, 22 nt, Mycobacterium avium subsp. paratuberculosis
ugaagcggcgcgggucgcgguu

SEQ ID NO: 890709 - RNA, 20 nt, Mycobacterium avium subsp. paratuberculosis
ugaagcgggacagcaaucgg

SEQ ID NO: 890710 - RNA, 13 nt, Mycobacterium avium subsp. paratuberculosis
ugaagccgugccc

SEQ ID NO: 890711 - RNA, 15 nt, Mycobacterium avium subsp. paratuberculosis
ugaagaacgggcuga

SEQ ID NO: 890712 - RNA, 21 nt, Mycobacterium avium subsp. paratuberculosis
ugaagaauuccaugucgucga

SEQ ID NO: 890713 - RNA, 15 nt, Mycobacterium avium subsp. paratuberculosis
ugaagcccaccgccg

SEQ ID NO: 890714 - RNA, 15 nt, Mycobacterium avium subsp. paratuberculosis
ugaagcccagcgcgu

SEQ ID NO: 890715 - RNA, 15 nt, Mycobacterium avium subsp. paratuberculosis
ugaagccgacgccgu

SEQ ID NO: 890716 - RNA, 20 nt, Mycobacterium avium subsp. paratuberculosis
ugaacgcgguaccgaugacc

SEQ ID NO: 890717 - RNA, 19 nt, Mycobacterium avium subsp. paratuberculosis
ugaacgcgucgccgugccg

SEQ ID NO: 890718 - RNA, 21 nt, Mycobacterium avium subsp. paratuberculosis
ugaacggcaccccgcggucgg

SEQ ID NO: 890719 - RNA, 18 nt, Mycobacterium avium subsp. paratuberculosis
ugaacggcagcucgucga

SEQ ID NO: 890720 - RNA, 23 nt, Mycobacterium avium subsp. paratuberculosis
ugaacggcagcucgucgacgucc

SEQ ID NO: 890721 - RNA, 20 nt, Mycobacterium avium subsp. paratuberculosis
ugaacuguuuuuccgccgga

SEQ ID NO: 890722 - RNA, 20 nt, Mycobacterium avium subsp. paratuberculosis
ugaacuuaacuucacgcucg

SEQ ID NO: 890723 - RNA, 14 nt, Mycobacterium avium subsp. paratuberculosis
ugaacugccgcggc

SEQ ID NO: 890724 - RNA, 21 nt, Mycobacterium avium subsp. paratuberculosis
ugaacgucccguuggucucga

SEQ ID NO: 890725 - RNA, 16 nt, Mycobacterium avium subsp. paratuberculosis
ugaacucgccgaucgg

SEQ ID NO: 890726 - RNA, 22 nt, Mycobacterium avium subsp. paratuberculosis
ugaacucgcgggcgagcagcgc

SEQ ID NO: 890727 - RNA, 12 nt, Mycobacterium avium subsp. paratuberculosis
ugaacgggccgc

SEQ ID NO: 890728 - RNA, 19 nt, Mycobacterium avium subsp. paratuberculosis
ugaacggugcccgccgauc

SEQ ID NO: 890729 - RNA, 15 nt, Mycobacterium avium subsp. paratuberculosis
ugacaagccggcguc

SEQ ID NO: 890730 - RNA, 22 nt, Mycobacterium avium subsp. paratuberculosis
ugacaaccaucgaggcgaucau

SEQ ID NO: 890731 - RNA, 18 nt, Mycobacterium avium subsp. paratuberculosis
ugacaccgcggaccaccg

SEQ ID NO: 890732 - RNA, 15 nt, Mycobacterium avium subsp. paratuberculosis
ugaauucggccaccg

SEQ ID NO: 890733 - RNA, 16 nt, Mycobacterium avium subsp. paratuberculosis
ugaauucggccaccga

SEQ ID NO: 890734 - RNA, 18 nt, Mycobacterium avium subsp. paratuberculosis
ugaaugggcugcgcgucg

SEQ ID NO: 890735 - RNA, 19 nt, Mycobacterium avium subsp. paratuberculosis
ugaaugucguagcggucgg

SEQ ID NO: 890736 - RNA, 16 nt, Mycobacterium avium subsp. paratuberculosis
ugaccaacgccgccuc

SEQ ID NO: 890737 - RNA, 13 nt, Mycobacterium avium subsp. paratuberculosis
ugacagacccgau

SEQ ID NO: 890738 - RNA, 14 nt, Mycobacterium avium subsp. paratuberculosis
ugacagacccgauc

SEQ ID NO: 890739 - RNA, 17 nt, Mycobacterium avium subsp. paratuberculosis
ugaccacccggucgacg

SEQ ID NO: 890740 - RNA, 17 nt, Mycobacterium avium subsp. paratuberculosis
ugaccaccgaccggcuc

SEQ ID NO: 890741 - RNA, 13 nt, Mycobacterium avium subsp. paratuberculosis
ugaccaccgagcc

SEQ ID NO: 890742 - RNA, 13 nt, Mycobacterium avium subsp. paratuberculosis
ugaccaccgcguc

SEQ ID NO: 890743 - RNA, 14 nt, Mycobacterium avium subsp. paratuberculosis
ugaccaccgcgucg

SEQ ID NO: 890744 - RNA, 12 nt, Mycobacterium avium subsp. paratuberculosis
ugaccaccggca

SEQ ID NO: 890745 - RNA, 14 nt, Mycobacterium avium subsp. paratuberculosis
ugaccaccggcacc

SEQ ID NO: 890746 - RNA, 14 nt, Mycobacterium avium subsp. paratuberculosis
ugaccacggucggc

SEQ ID NO: 890747 - RNA, 18 nt, Mycobacterium avium subsp. paratuberculosis
ugaccacggucggcgggu

SEQ ID NO: 890748 - RNA, 13 nt, Mycobacterium avium subsp. paratuberculosis
ugaccacggugcg

SEQ ID NO: 890749 - RNA, 20 nt, Mycobacterium avium subsp. paratuberculosis
ugaccacgccgugcccggcg

SEQ ID NO: 890750 - RNA, 20 nt, Mycobacterium avium subsp. paratuberculosis
ugaccaggaagaugccgauc

SEQ ID NO: 890751 - RNA, 14 nt, Mycobacterium avium subsp. paratuberculosis
ugaccagcgugacc

SEQ ID NO: 890752 - RNA, 16 nt, Mycobacterium avium subsp. paratuberculosis
ugaccaggucgccggc

SEQ ID NO: 890753 - RNA, 12 nt, Mycobacterium avium subsp. paratuberculosis
ugaccagcgccu

SEQ ID NO: 890754 - RNA, 12 nt, Mycobacterium avium subsp. paratuberculosis
ugaccagcgcga

SEQ ID NO: 890755 - RNA, 19 nt, Mycobacterium avium subsp. paratuberculosis
ugaccagcgcgaacagcgc

SEQ ID NO: 890756 - RNA, 23 nt, Mycobacterium avium subsp. paratuberculosis
ucagaucguugaugucgguggug

SEQ ID NO: 890757 - RNA, 13 nt, Mycobacterium avium subsp. paratuberculosis
ucagcaucgccgu

SEQ ID NO: 890758 - RNA, 13 nt, Mycobacterium avium subsp. paratuberculosis
ucagaucgacgag

SEQ ID NO: 890759 - RNA, 14 nt, Mycobacterium avium subsp. paratuberculosis
ucagaucgccgacg

SEQ ID NO: 890760 - RNA, 21 nt, Mycobacterium avium subsp. paratuberculosis
ucagcauccgcaacgugcgcc

SEQ ID NO: 890761 - RNA, 20 nt, Mycobacterium avium subsp. paratuberculosis
ucagccacaccgccggcgcg

SEQ ID NO: 890762 - RNA, 16 nt, Mycobacterium avium subsp. paratuberculosis
ucagccacgccggcac

SEQ ID NO: 890763 - RNA, 20 nt, Mycobacterium avium subsp. paratuberculosis
ucagccagaucgaggccagc

SEQ ID NO: 890764 - RNA, 21 nt, Mycobacterium avium subsp. paratuberculosis
ucagccagaucgaggccagcg

SEQ ID NO: 890765 - RNA, 16 nt, Mycobacterium avium subsp. paratuberculosis
ucagccacgggcgguc

SEQ ID NO: 890766 - RNA, 22 nt, Mycobacterium avium subsp. paratuberculosis
ucagccacgggcggucggacgc

SEQ ID NO: 890767 - RNA, 15 nt, Mycobacterium avium subsp. paratuberculosis
ucagcgcgcccaggc

SEQ ID NO: 890768 - RNA, 19 nt, Mycobacterium avium subsp. paratuberculosis
ucagcgcgcccaggcccga

SEQ ID NO: 890769 - RNA, 12 nt, Mycobacterium avium subsp. paratuberculosis
ucagcgcgaccu

SEQ ID NO: 890770 - RNA, 13 nt, Mycobacterium avium subsp. paratuberculosis
ucagcgcgacauc

SEQ ID NO: 890771 - RNA, 15 nt, Mycobacterium avium subsp. paratuberculosis
ucagcgcgacaucgc

SEQ ID NO: 890772 - RNA, 18 nt, Mycobacterium avium subsp. paratuberculosis
ucagcgcgacaucgccgg

SEQ ID NO: 890773 - RNA, 12 nt, Mycobacterium avium subsp. paratuberculosis
ucagcgcgccgu

SEQ ID NO: 890774 - RNA, 22 nt, Mycobacterium avium subsp. paratuberculosis
ucagcgcgcaacgacgaagucg

SEQ ID NO: 890775 - RNA, 16 nt, Mycobacterium avium subsp. paratuberculosis
ucagcgcgcacagcgc

SEQ ID NO: 890776 - RNA, 17 nt, Mycobacterium avium subsp. paratuberculosis
ucagcgacucgaccccg

SEQ ID NO: 890777 - RNA, 18 nt, Mycobacterium avium subsp. paratuberculosis
ucagcgacuugccgccgg

SEQ ID NO: 890778 - RNA, 19 nt, Mycobacterium avium subsp. paratuberculosis
ucagcgacuugccgccggc

SEQ ID NO: 890779 - RNA, 20 nt, Mycobacterium avium subsp. paratuberculosis
ucagcgacuugccgccggcg

SEQ ID NO: 890780 - RNA, 20 nt, Mycobacterium avium subsp. paratuberculosis
ucagcgagcgguuggcgacg

SEQ ID NO: 890781 - RNA, 22 nt, Mycobacterium avium subsp. paratuberculosis
ucagcgaggcguagcugcaggc

SEQ ID NO: 890782 - RNA, 21 nt, Mycobacterium avium subsp. paratuberculosis
ucagcgccgucuccucgacca

SEQ ID NO: 890783 - RNA, 22 nt, Mycobacterium avium subsp. paratuberculosis
ucagcgccgucuccucgaccag

SEQ ID NO: 890784 - RNA, 19 nt, Mycobacterium avium subsp. paratuberculosis
ucagcgccugguccucccg

SEQ ID NO: 890785 - RNA, 23 nt, Mycobacterium avium subsp. paratuberculosis
ucagcgccugguccucccgggug

SEQ ID NO: 890786 - RNA, 14 nt, Mycobacterium avium subsp. paratuberculosis
ucagccgucgucgu

SEQ ID NO: 890787 - RNA, 12 nt, Mycobacterium avium subsp. paratuberculosis
ucagcccgcguc

SEQ ID NO: 890788 - RNA, 14 nt, Mycobacterium avium subsp. paratuberculosis
ucagccuagccuug

SEQ ID NO: 890789 - RNA, 23 nt, Mycobacterium avium subsp. paratuberculosis
ucagccugccuccacgucaccga

SEQ ID NO: 890790 - RNA, 17 nt, Mycobacterium avium subsp. paratuberculosis
ucagcgacggcccgccg

SEQ ID NO: 890791 - RNA, 23 nt, Mycobacterium avium subsp. paratuberculosis
ucagcgaaggcaugggcgugccg

SEQ ID NO: 890792 - RNA, 18 nt, Mycobacterium avium subsp. paratuberculosis
ucagccggguagcgccgc

SEQ ID NO: 890793 - RNA, 19 nt, Mycobacterium avium subsp. paratuberculosis
ucagccggguagcgccgcc

SEQ ID NO: 890794 - RNA, 22 nt, Mycobacterium avium subsp. paratuberculosis
ucagccccagggugcgccgcuc

SEQ ID NO: 890795 - RNA, 15 nt, Mycobacterium avium subsp. paratuberculosis
ucagcccgacccggc

SEQ ID NO: 890796 - RNA, 20 nt, Mycobacterium avium subsp. paratuberculosis
ucagcccgauucagccggcg

SEQ ID NO: 890797 - RNA, 14 nt, Mycobacterium avium subsp. paratuberculosis
ucagcccgcccacc

SEQ ID NO: 890798 - RNA, 22 nt, Mycobacterium avium subsp. paratuberculosis
ucagcucgucagcgcgggccag

SEQ ID NO: 890799 - RNA, 20 nt, Mycobacterium avium subsp. paratuberculosis
ucaggaacaccgagccggcg

SEQ ID NO: 890800 - RNA, 21 nt, Mycobacterium avium subsp. paratuberculosis
ucagcugaacggugcccgccg

SEQ ID NO: 890801 - RNA, 15 nt, Mycobacterium avium subsp. paratuberculosis
ucagcucggcggccu

SEQ ID NO: 890802 - RNA, 13 nt, Mycobacterium avium subsp. paratuberculosis
ucagcucgcgcau

SEQ ID NO: 890803 - RNA, 19 nt, Mycobacterium avium subsp. paratuberculosis
ucagcucgcgcaucagcgg

SEQ ID NO: 890804 - RNA, 16 nt, Mycobacterium avium subsp. paratuberculosis
ucagcucgcgcccggc

SEQ ID NO: 890805 - RNA, 18 nt, Mycobacterium avium subsp. paratuberculosis
ucagcugcugcgcggcgg

SEQ ID NO: 890806 - RNA, 15 nt, Mycobacterium avium subsp. paratuberculosis
ucagcugcagccggc

SEQ ID NO: 890807 - RNA, 17 nt, Mycobacterium avium subsp. paratuberculosis
ucagcugcagccggccg

SEQ ID NO: 890808 - RNA, 14 nt, Mycobacterium avium subsp. paratuberculosis
ucagcugccguccg

SEQ ID NO: 890809 - RNA, 15 nt, Mycobacterium avium subsp. paratuberculosis
ucaggaugacgccgc

SEQ ID NO: 890810 - RNA, 18 nt, Mycobacterium avium subsp. paratuberculosis
ucaggaugacgccgcggu

SEQ ID NO: 890811 - RNA, 14 nt, Mycobacterium avium subsp. paratuberculosis
ucaggaugauuucg

SEQ ID NO: 890812 - RNA, 23 nt, Mycobacterium avium subsp. paratuberculosis
ucaggaugauuucggcguggcgg

SEQ ID NO: 890813 - RNA, 17 nt, Mycobacterium avium subsp. paratuberculosis
ucaggagugcucggcgu

SEQ ID NO: 890814 - RNA, 16 nt, Mycobacterium avium subsp. paratuberculosis
ucaggagugguagggc

SEQ ID NO: 890815 - RNA, 14 nt, Mycobacterium avium subsp. paratuberculosis
ucaggaucgacguc

SEQ ID NO: 890816 - RNA, 13 nt, Mycobacterium avium subsp. paratuberculosis
ucagcgcggucag

SEQ ID NO: 890817 - RNA, 12 nt, Mycobacterium avium subsp. paratuberculosis
ucagcgcgucgg

SEQ ID NO: 890818 - RNA, 21 nt, Mycobacterium avium subsp. paratuberculosis
ucagcgcgucggcgaccgcgc

SEQ ID NO: 890819 - RNA, 18 nt, Mycobacterium avium subsp. paratuberculosis
ucagcgcgugaccccggc

SEQ ID NO: 890820 - RNA, 21 nt, Mycobacterium avium subsp. paratuberculosis
ucagcgcgugaccccggcgac

SEQ ID NO: 890821 - RNA, 23 nt, Mycobacterium avium subsp. paratuberculosis
ucagcgcgugaccccggcgacca

SEQ ID NO: 890822 - RNA, 16 nt, Mycobacterium avium subsp. paratuberculosis
ucagcgcuccuggccg

SEQ ID NO: 890823 - RNA, 21 nt, Mycobacterium avium subsp. paratuberculosis
ucagcgcguccaaccgcggac

SEQ ID NO: 890824 - RNA, 14 nt, Mycobacterium avium subsp. paratuberculosis
ucagcgcggcgggc

SEQ ID NO: 890825 - RNA, 18 nt, Mycobacterium avium subsp. paratuberculosis
ucagcgcugucgcgggcc

SEQ ID NO: 890826 - RNA, 20 nt, Mycobacterium avium subsp. paratuberculosis
ucagcgcuuccagcgcggcg

SEQ ID NO: 890827 - RNA, 19 nt, Mycobacterium avium subsp. paratuberculosis
ucagcggaaccgacaccuc

SEQ ID NO: 890828 - RNA, 15 nt, Mycobacterium avium subsp. paratuberculosis
ucagcgucagcacgu

SEQ ID NO: 890829 - RNA, 16 nt, Mycobacterium avium subsp. paratuberculosis
ucagcggguuugacgu

SEQ ID NO: 890830 - RNA, 18 nt, Mycobacterium avium subsp. paratuberculosis
ucagcggcaacacgccgg

SEQ ID NO: 890831 - RNA, 22 nt, Mycobacterium avium subsp. paratuberculosis
ucagcggcaacacgccggcggc

SEQ ID NO: 890832 - RNA, 16 nt, Mycobacterium avium subsp. paratuberculosis
ucagcggcaccgucac

SEQ ID NO: 890833 - RNA, 22 nt, Mycobacterium avium subsp. paratuberculosis
ucagcggagugaccgccagcac

SEQ ID NO: 890834 - RNA, 17 nt, Mycobacterium avium subsp. paratuberculosis
ucagcggauagaggcgg

SEQ ID NO: 890835 - RNA, 19 nt, Mycobacterium avium subsp. paratuberculosis
ucagcggauagaggcggcg

SEQ ID NO: 890836 - RNA, 20 nt, Mycobacterium avium subsp. paratuberculosis
ucagcggauagaggcggcgc

SEQ ID NO: 890837 - RNA, 24 nt, Mycobacterium avium subsp. paratuberculosis
ucagcggauagaggcggcgcauga

SEQ ID NO: 890838 - RNA, 22 nt, Mycobacterium avium subsp. paratuberculosis
ucagcucgaaaagcuucuugcu

SEQ ID NO: 890839 - RNA, 15 nt, Mycobacterium avium subsp. paratuberculosis
ucagcucgaucgccg

SEQ ID NO: 890840 - RNA, 16 nt, Mycobacterium avium subsp. paratuberculosis
ucagcucgaucgccgc

SEQ ID NO: 890841 - RNA, 16 nt, Mycobacterium avium subsp. paratuberculosis
ucagcucgauggugcc

SEQ ID NO: 890842 - RNA, 19 nt, Mycobacterium avium subsp. paratuberculosis
ucagcuccaccugcggcac

SEQ ID NO: 890843 - RNA, 18 nt, Mycobacterium avium subsp. paratuberculosis
ucagcgucucgccgggga

SEQ ID NO: 890844 - RNA, 15 nt, Mycobacterium avium subsp. paratuberculosis
ucagcgucucggcga

SEQ ID NO: 890845 - RNA, 20 nt, Mycobacterium avium subsp. paratuberculosis
ucagcgucgccaauccggcg

SEQ ID NO: 890846 - RNA, 13 nt, Mycobacterium avium subsp. paratuberculosis
ucagcgucgccgc

SEQ ID NO: 890847 - RNA, 15 nt, Mycobacterium avium subsp. paratuberculosis
ucagcguucacgucg

SEQ ID NO: 890848 - RNA, 16 nt, Mycobacterium avium subsp. paratuberculosis
ucagcguuccggcggc

SEQ ID NO: 890849 - RNA, 20 nt, Mycobacterium avium subsp. paratuberculosis
ucagcguggcgucggcgcgc

SEQ ID NO: 890850 - RNA, 22 nt, Mycobacterium avium subsp. paratuberculosis
ucagcguggcgucggcgcgcac

SEQ ID NO: 890851 - RNA, 14 nt, Mycobacterium avium subsp. paratuberculosis
ucagcguggucagc

SEQ ID NO: 890852 - RNA, 17 nt, Mycobacterium avium subsp. paratuberculosis
ucagcguguuggacgcc

SEQ ID NO: 890853 - RNA, 20 nt, Mycobacterium avium subsp. paratuberculosis
ucagcguguuggacgcccgc

SEQ ID NO: 890854 - RNA, 20 nt, Mycobacterium avium subsp. paratuberculosis
ucaccuucugcgcgccgucg

SEQ ID NO: 890855 - RNA, 24 nt, Mycobacterium avium subsp. paratuberculosis
ucaccuucugcgcgccgucggcgu

SEQ ID NO: 890856 - RNA, 14 nt, Mycobacterium avium subsp. paratuberculosis
ucaccuggucgggu

SEQ ID NO: 890857 - RNA, 22 nt, Mycobacterium avium subsp. paratuberculosis
ucaccugcguugcggcacaggc

SEQ ID NO: 890858 - RNA, 22 nt, Mycobacterium avium subsp. paratuberculosis
ucaccggagagcaacaccucgg

SEQ ID NO: 890859 - RNA, 19 nt, Mycobacterium avium subsp. paratuberculosis
ucaccugacagacccgauc

SEQ ID NO: 890860 - RNA, 21 nt, Mycobacterium avium subsp. paratuberculosis
ucaccucgggauagccgagcg

SEQ ID NO: 890861 - RNA, 18 nt, Mycobacterium avium subsp. paratuberculosis
ucacgcagaacucgucgc

SEQ ID NO: 890862 - RNA, 19 nt, Mycobacterium avium subsp. paratuberculosis
ucacgcagaacucgucgcc

SEQ ID NO: 890863 - RNA, 20 nt, Mycobacterium avium subsp. paratuberculosis
ucacgcagaacucgucgcca

SEQ ID NO: 890864 - RNA, 16 nt, Mycobacterium avium subsp. paratuberculosis
ucacgccagcgugacg

SEQ ID NO: 890865 - RNA, 17 nt, Mycobacterium avium subsp. paratuberculosis
ucacgccagcgugacgc

SEQ ID NO: 890866 - RNA, 20 nt, Mycobacterium avium subsp. paratuberculosis
ucacgccagcgugacgccgg

SEQ ID NO: 890867 - RNA, 21 nt, Mycobacterium avium subsp. paratuberculosis
ucacgccagcgugacgcucgg

SEQ ID NO: 890868 - RNA, 19 nt, Mycobacterium avium subsp. paratuberculosis
ucacgccaguguggccgcg

SEQ ID NO: 890869 - RNA, 20 nt, Mycobacterium avium subsp. paratuberculosis
ucacgcuggcgugacagucg

SEQ ID NO: 890870 - RNA, 16 nt, Mycobacterium avium subsp. paratuberculosis
ucacgcuggcgugacg

SEQ ID NO: 890871 - RNA, 17 nt, Mycobacterium avium subsp. paratuberculosis
ucacgcuggcgugacgc

SEQ ID NO: 890872 - RNA, 21 nt, Mycobacterium avium subsp. paratuberculosis
ucacgcuggcgugacgcucgg

SEQ ID NO: 890873 - RNA, 22 nt, Mycobacterium avium subsp. paratuberculosis
ucacgcuggcgugacgcucggc

SEQ ID NO: 890874 - RNA, 20 nt, Mycobacterium avium subsp. paratuberculosis
ucacgcuggcgugacggucg

SEQ ID NO: 890875 - RNA, 15 nt, Mycobacterium avium subsp. paratuberculosis
ucacgcuggcguggc

SEQ ID NO: 890876 - RNA, 21 nt, Mycobacterium avium subsp. paratuberculosis
ucacgcuggcguggcgccggc

SEQ ID NO: 890877 - RNA, 21 nt, Mycobacterium avium subsp. paratuberculosis
ucacgcugggcuccgaccgug

SEQ ID NO: 890878 - RNA, 16 nt, Mycobacterium avium subsp. paratuberculosis
ucacgcucggcgagca

SEQ ID NO: 890879 - RNA, 16 nt, Mycobacterium avium subsp. paratuberculosis
ucacgcucggcgccga

SEQ ID NO: 890880 - RNA, 19 nt, Mycobacterium avium subsp. paratuberculosis
ucacgcaucagggccagcc

SEQ ID NO: 890881 - RNA, 15 nt, Mycobacterium avium subsp. paratuberculosis
ucacgcuagcgugac

SEQ ID NO: 890882 - RNA, 20 nt, Mycobacterium avium subsp. paratuberculosis
ucacgcuagcgugacagucg

SEQ ID NO: 890883 - RNA, 13 nt, Mycobacterium avium subsp. paratuberculosis
ucacgcucggcag

SEQ ID NO: 890884 - RNA, 14 nt, Mycobacterium avium subsp. paratuberculosis
ucacgcucggcagg

SEQ ID NO: 890885 - RNA, 17 nt, Mycobacterium avium subsp. paratuberculosis
ucacgcucggcaggcgg

SEQ ID NO: 890886 - RNA, 20 nt, Mycobacterium avium subsp. paratuberculosis
ucacaccaccacgcgaucag

SEQ ID NO: 890887 - RNA, 15 nt, Mycobacterium avium subsp. paratuberculosis
ucaccgacggcugga

SEQ ID NO: 890888 - RNA, 22 nt, Mycobacterium avium subsp. paratuberculosis
ucaccgagauggccaccaucag

SEQ ID NO: 890889 - RNA, 13 nt, Mycobacterium avium subsp. paratuberculosis
ucaccgagauggu

SEQ ID NO: 890890 - RNA, 18 nt, Mycobacterium avium subsp. paratuberculosis
ucaccgagcugggccggc

SEQ ID NO: 890891 - RNA, 14 nt, Mycobacterium avium subsp. paratuberculosis
ucaccgaccagcug

SEQ ID NO: 890892 - RNA, 20 nt, Mycobacterium avium subsp. paratuberculosis
ucaccgaccccucggcggcc

SEQ ID NO: 890893 - RNA, 19 nt, Mycobacterium avium subsp. paratuberculosis
ucaccgcaucgaaccgccg

SEQ ID NO: 890894 - RNA, 23 nt, Mycobacterium avium subsp. paratuberculosis
ucaccgcaucgaaccgccgcgcu

SEQ ID NO: 890895 - RNA, 16 nt, Mycobacterium avium subsp. paratuberculosis
ucaccgccaccagcag

SEQ ID NO: 890896 - RNA, 19 nt, Mycobacterium avium subsp. paratuberculosis
ucaccgccaccagcaggcc

SEQ ID NO: 890897 - RNA, 17 nt, Mycobacterium avium subsp. paratuberculosis
ucaccgcgcuugccgcg

SEQ ID NO: 890898 - RNA, 13 nt, Mycobacterium avium subsp. paratuberculosis
ucaccgcggccac

SEQ ID NO: 890899 - RNA, 15 nt, Mycobacterium avium subsp. paratuberculosis
ucaccgcggccacca

SEQ ID NO: 890900 - RNA, 19 nt, Mycobacterium avium subsp. paratuberculosis
ucaccgcgggaauggccgc

SEQ ID NO: 890901 - RNA, 20 nt, Mycobacterium avium subsp. paratuberculosis
ucaccgcgggaauggccgcg

SEQ ID NO: 890902 - RNA, 22 nt, Mycobacterium avium subsp. paratuberculosis
ucaccgcgggaauggccgcgcc

SEQ ID NO: 890903 - RNA, 23 nt, Mycobacterium avium subsp. paratuberculosis
ucaccgcgggaauggccgcgccg

SEQ ID NO: 890904 - RNA, 16 nt, Mycobacterium avium subsp. paratuberculosis
ucaccgcgggccaggc

SEQ ID NO: 890905 - RNA, 20 nt, Mycobacterium avium subsp. paratuberculosis
ucaccgcggggugcccggcg

SEQ ID NO: 890906 - RNA, 22 nt, Mycobacterium avium subsp. paratuberculosis
ucaccgcggggugcccggcgag

SEQ ID NO: 890907 - RNA, 12 nt, Mycobacterium avium subsp. paratuberculosis
ucaccggcacgu

SEQ ID NO: 890908 - RNA, 15 nt, Mycobacterium avium subsp. paratuberculosis
ucaccggcacgugcg

SEQ ID NO: 890909 - RNA, 18 nt, Mycobacterium avium subsp. paratuberculosis
ucaccggcacgugcgggu

SEQ ID NO: 890910 - RNA, 17 nt, Mycobacterium avium subsp. paratuberculosis
ucaccggaccggccagc

SEQ ID NO: 890911 - RNA, 19 nt, Mycobacterium avium subsp. paratuberculosis
ucaccggaugcaccggcag

SEQ ID NO: 890912 - RNA, 16 nt, Mycobacterium avium subsp. paratuberculosis
ucaccggaugcacgug

SEQ ID NO: 890913 - RNA, 22 nt, Mycobacterium avium subsp. paratuberculosis
ucaccggaugcacgugcaccgc

SEQ ID NO: 890914 - RNA, 16 nt, Mycobacterium avium subsp. paratuberculosis
ucaccgcugccacggu

SEQ ID NO: 890915 - RNA, 19 nt, Mycobacterium avium subsp. paratuberculosis
ucaccgcguugucggcgac

SEQ ID NO: 890916 - RNA, 24 nt, Mycobacterium avium subsp. paratuberculosis
ucaccgcguugucggcgacggcgg

SEQ ID NO: 890917 - RNA, 18 nt, Mycobacterium avium subsp. paratuberculosis
ucaccgcguagcgccgcc

SEQ ID NO: 890918 - RNA, 23 nt, Mycobacterium avium subsp. paratuberculosis
ucaccgcgucagcagcgcgacgc

SEQ ID NO: 890919 - RNA, 22 nt, Mycobacterium avium subsp. paratuberculosis
ucaccgcguucucggcggacau

SEQ ID NO: 890920 - RNA, 20 nt, Mycobacterium avium subsp. paratuberculosis
aauaagaucgugcuugagca

SEQ ID NO: 890921 - RNA, 18 nt, Mycobacterium avium subsp. paratuberculosis
ucacgguccaucagcacc

SEQ ID NO: 890922 - RNA, 23 nt, Mycobacterium avium subsp. paratuberculosis
ucacgucguugagcacacccagc

SEQ ID NO: 890923 - RNA, 13 nt, Mycobacterium avium subsp. paratuberculosis
ucacggucggagc

SEQ ID NO: 890924 - RNA, 15 nt, Mycobacterium avium subsp. paratuberculosis
ucacggucggcgucc

SEQ ID NO: 890925 - RNA, 17 nt, Mycobacterium avium subsp. paratuberculosis
ucacguguccgucgccg

SEQ ID NO: 890926 - RNA, 18 nt, Mycobacterium avium subsp. paratuberculosis
ucacguguccgucgccgg

SEQ ID NO: 890927 - RNA, 12 nt, Mycobacterium avium subsp. paratuberculosis
ucacggcgucgg

SEQ ID NO: 890928 - RNA, 23 nt, Mycobacterium avium subsp. paratuberculosis
ucacggcgucggcgucgggcggg

SEQ ID NO: 890929 - RNA, 14 nt, Mycobacterium avium subsp. paratuberculosis
ucacgggcacaccg

SEQ ID NO: 890930 - RNA, 17 nt, Mycobacterium avium subsp. paratuberculosis
ucacgggucucagcgcc

SEQ ID NO: 890931 - RNA, 17 nt, Mycobacterium avium subsp. paratuberculosis
ucacgcugaucgaccgg

SEQ ID NO: 890932 - RNA, 19 nt, Mycobacterium avium subsp. paratuberculosis
ucacgcugaucgaccgguu

SEQ ID NO: 890933 - RNA, 22 nt, Mycobacterium avium subsp. paratuberculosis
ucacggcgaauauuucgccgau

SEQ ID NO: 890934 - RNA, 21 nt, Mycobacterium avium subsp. paratuberculosis
ucacggcgaggauggcgauca

SEQ ID NO: 890935 - RNA, 12 nt, Mycobacterium avium subsp. paratuberculosis
ucacggcgcgau

SEQ ID NO: 890936 - RNA, 14 nt, Mycobacterium avium subsp. paratuberculosis
ucacuuccgcggca

SEQ ID NO: 890937 - RNA, 14 nt, Mycobacterium avium subsp. paratuberculosis
ucacuaucgacaac

SEQ ID NO: 890938 - RNA, 20 nt, Mycobacterium avium subsp. paratuberculosis
ucacguucggcgagugaggc

SEQ ID NO: 890939 - RNA, 21 nt, Mycobacterium avium subsp. paratuberculosis
ucacguugauccgaugcaggg

SEQ ID NO: 890940 - RNA, 14 nt, Mycobacterium avium subsp. paratuberculosis
uccacgugcacggc

SEQ ID NO: 890941 - RNA, 16 nt, Mycobacterium avium subsp. paratuberculosis
uccacgugcacggcgc

SEQ ID NO: 890942 - RNA, 19 nt, Mycobacterium avium subsp. paratuberculosis
uccacgugucggcgucgau

SEQ ID NO: 890943 - RNA, 22 nt, Mycobacterium avium subsp. paratuberculosis
uccacguugaugccgcccagca

SEQ ID NO: 890944 - RNA, 16 nt, Mycobacterium avium subsp. paratuberculosis
uccacucgucggcggu

SEQ ID NO: 890945 - RNA, 17 nt, Mycobacterium avium subsp. paratuberculosis
uccagaacucggcggcg

SEQ ID NO: 890946 - RNA, 19 nt, Mycobacterium avium subsp. paratuberculosis
uccagaacucggcggcggu

SEQ ID NO: 890947 - RNA, 15 nt, Mycobacterium avium subsp. paratuberculosis
uccacauacgcggcg

SEQ ID NO: 890948 - RNA, 22 nt, Mycobacterium avium subsp. paratuberculosis
uccacacggcaggcggcccgcu

SEQ ID NO: 890949 - RNA, 15 nt, Mycobacterium avium subsp. paratuberculosis
uccacagccggcggc

SEQ ID NO: 890950 - RNA, 22 nt, Mycobacterium avium subsp. paratuberculosis
uccagcacgaaggccgccgggu

SEQ ID NO: 890951 - RNA, 18 nt, Mycobacterium avium subsp. paratuberculosis
uccagccauucgucgggg

SEQ ID NO: 890952 - RNA, 18 nt, Mycobacterium avium subsp. paratuberculosis
uccagcagcgccagcacc

SEQ ID NO: 890953 - RNA, 12 nt, Mycobacterium avium subsp. paratuberculosis
uccagccgugcg

SEQ ID NO: 890954 - RNA, 22 nt, Mycobacterium avium subsp. paratuberculosis
uccagccgugcggcacgccgca

SEQ ID NO: 890955 - RNA, 21 nt, Mycobacterium avium subsp. paratuberculosis
uccagccgugggugucggcga

SEQ ID NO: 890956 - RNA, 20 nt, Mycobacterium avium subsp. paratuberculosis
uccagccguucgcgcacggc

SEQ ID NO: 890957 - RNA, 14 nt, Mycobacterium avium subsp. paratuberculosis
uccagccgcgcggc

SEQ ID NO: 890958 - RNA, 11 nt, Mycobacterium avium subsp. paratuberculosis
uccagccgcuc

SEQ ID NO: 890959 - RNA, 16 nt, Mycobacterium avium subsp. paratuberculosis
uccagccggucgcagg

SEQ ID NO: 890960 - RNA, 20 nt, Mycobacterium avium subsp. paratuberculosis
uccagcccgcgccagcucgg

SEQ ID NO: 890961 - RNA, 17 nt, Mycobacterium avium subsp. paratuberculosis
uccagcaccacccgguc

SEQ ID NO: 890962 - RNA, 11 nt, Mycobacterium avium subsp. paratuberculosis
uccagcaccgg

SEQ ID NO: 890963 - RNA, 17 nt, Mycobacterium avium subsp. paratuberculosis
uccagcaccggcgccau

SEQ ID NO: 890964 - RNA, 19 nt, Mycobacterium avium subsp. paratuberculosis
uccagcaccggcgccauga

SEQ ID NO: 890965 - RNA, 13 nt, Mycobacterium avium subsp. paratuberculosis
uccagcaccggcu

SEQ ID NO: 890966 - RNA, 15 nt, Mycobacterium avium subsp. paratuberculosis
uccagcaacgccgac

SEQ ID NO: 890967 - RNA, 16 nt, Mycobacterium avium subsp. paratuberculosis
uccagaucgccgccca

SEQ ID NO: 890968 - RNA, 13 nt, Mycobacterium avium subsp. paratuberculosis
uccagaucggcgc

SEQ ID NO: 890969 - RNA, 19 nt, Mycobacterium avium subsp. paratuberculosis
uccagaucggcgcgcgggg

SEQ ID NO: 890970 - RNA, 19 nt, Mycobacterium avium subsp. paratuberculosis
uccagaucggccagcgcgg

SEQ ID NO: 890971 - RNA, 20 nt, Mycobacterium avium subsp. paratuberculosis
uccagaucggccagcgcggc

SEQ ID NO: 890972 - RNA, 14 nt, Mycobacterium avium subsp. paratuberculosis
uccagaugccgggu

SEQ ID NO: 890973 - RNA, 14 nt, Mycobacterium avium subsp. paratuberculosis
uccagaccggccgg

SEQ ID NO: 890974 - RNA, 18 nt, Mycobacterium avium subsp. paratuberculosis
uccagaccggccggggcg

SEQ ID NO: 890975 - RNA, 21 nt, Mycobacterium avium subsp. paratuberculosis
uccagaccggccggggcgggc

SEQ ID NO: 890976 - RNA, 22 nt, Mycobacterium avium subsp. paratuberculosis
uccagaccggccggggcgggca

SEQ ID NO: 890977 - RNA, 23 nt, Mycobacterium avium subsp. paratuberculosis
uccagaccggcggcgaucggcgc

SEQ ID NO: 890978 - RNA, 19 nt, Mycobacterium avium subsp. paratuberculosis
uccaguugcggcacgccga

SEQ ID NO: 890979 - RNA, 22 nt, Mycobacterium avium subsp. paratuberculosis
uccaguugcgaccccgccgucg

SEQ ID NO: 890980 - RNA, 19 nt, Mycobacterium avium subsp. paratuberculosis
uccaguucggccagcgcgg

SEQ ID NO: 890981 - RNA, 22 nt, Mycobacterium avium subsp. paratuberculosis
uccagugcaguucgaugccgau

SEQ ID NO: 890982 - RNA, 18 nt, Mycobacterium avium subsp. paratuberculosis
uccagugcaugccggccu

SEQ ID NO: 890983 - RNA, 14 nt, Mycobacterium avium subsp. paratuberculosis
uccagucgcgccga

SEQ ID NO: 890984 - RNA, 15 nt, Mycobacterium avium subsp. paratuberculosis
uccagucgcgccgag

SEQ ID NO: 890985 - RNA, 14 nt, Mycobacterium avium subsp. paratuberculosis
uccagucggcgccg

SEQ ID NO: 890986 - RNA, 16 nt, Mycobacterium avium subsp. paratuberculosis
uccagucggcgccgau

SEQ ID NO: 890987 - RNA, 18 nt, Mycobacterium avium subsp. paratuberculosis
uccagucggcgccgaugc

SEQ ID NO: 890988 - RNA, 15 nt, Mycobacterium avium subsp. paratuberculosis
uccaguacaccgcga

SEQ ID NO: 890989 - RNA, 15 nt, Mycobacterium avium subsp. paratuberculosis
uccagguucgccgcc

SEQ ID NO: 890990 - RNA, 20 nt, Mycobacterium avium subsp. paratuberculosis
uccagcggcaccgccaucgg

SEQ ID NO: 890991 - RNA, 10 nt, Mycobacterium avium subsp. paratuberculosis
uccagcggcg

SEQ ID NO: 890992 - RNA, 21 nt, Mycobacterium avium subsp. paratuberculosis
uccagcggccacaccggggcc

SEQ ID NO: 890993 - RNA, 18 nt, Mycobacterium avium subsp. paratuberculosis
uccagcggccgcagcgcg

SEQ ID NO: 890994 - RNA, 16 nt, Mycobacterium avium subsp. paratuberculosis
uccagcggguccagcc

SEQ ID NO: 890995 - RNA, 17 nt, Mycobacterium avium subsp. paratuberculosis
uccagcggguugccgcu

SEQ ID NO: 890996 - RNA, 18 nt, Mycobacterium avium subsp. paratuberculosis
uccagcggguugccgcug

SEQ ID NO: 890997 - RNA, 15 nt, Mycobacterium avium subsp. paratuberculosis
uccagcucagcgcgc

SEQ ID NO: 890998 - RNA, 19 nt, Mycobacterium avium subsp. paratuberculosis
uccagcucgcgaagcgcga

SEQ ID NO: 890999 - RNA, 20 nt, Mycobacterium avium subsp. paratuberculosis
uccagcucgcgaagcgcgau

SEQ ID NO: 891000 - RNA, 24 nt, Mycobacterium avium subsp. paratuberculosis
uccagcucgcgaagcgcgaugcgg

SEQ ID NO: 891001 - RNA, 13 nt, Mycobacterium avium subsp. paratuberculosis
uccagcgucgcgg

SEQ ID NO: 891002 - RNA, 22 nt, Mycobacterium avium subsp. paratuberculosis
uccagcgugaacguguggguga

SEQ ID NO: 891003 - RNA, 23 nt, Mycobacterium avium subsp. paratuberculosis
uccagcucgcguucgggcccggc

SEQ ID NO: 891004 - RNA, 22 nt, Mycobacterium avium subsp. paratuberculosis
uccaggucguuggagucguccg

SEQ ID NO: 891005 - RNA, 22 nt, Mycobacterium avium subsp. paratuberculosis
uccaggugaacagcagccacga

SEQ ID NO: 891006 - RNA, 21 nt, Mycobacterium avium subsp. paratuberculosis
uccaggugaaugcucagcggg

SEQ ID NO: 891007 - RNA, 15 nt, Mycobacterium avium subsp. paratuberculosis
uccaugaacggcagc

SEQ ID NO: 891008 - RNA, 14 nt, Mycobacterium avium subsp. paratuberculosis
uccauccgccgucg

SEQ ID NO: 891009 - RNA, 18 nt, Mycobacterium avium subsp. paratuberculosis
uccauguaguucagcagc

SEQ ID NO: 891010 - RNA, 14 nt, Mycobacterium avium subsp. paratuberculosis
uccaucagcgcccg

SEQ ID NO: 891011 - RNA, 16 nt, Mycobacterium avium subsp. paratuberculosis
uccaucagcgcccgcg

SEQ ID NO: 891012 - RNA, 14 nt, Mycobacterium avium subsp. paratuberculosis
uccaucgacgcuga

SEQ ID NO: 891013 - RNA, 17 nt, Mycobacterium avium subsp. paratuberculosis
uccaucgauggcggugu

SEQ ID NO: 891014 - RNA, 15 nt, Mycobacterium avium subsp. paratuberculosis
uccaucugggcgcgc

SEQ ID NO: 891015 - RNA, 19 nt, Mycobacterium avium subsp. paratuberculosis
uccaucugggcgcgcaccc

SEQ ID NO: 891016 - RNA, 17 nt, Mycobacterium avium subsp. paratuberculosis
uccaucgggcccagcag

SEQ ID NO: 891017 - RNA, 15 nt, Mycobacterium avium subsp. paratuberculosis
ucauagccggccgcg

SEQ ID NO: 891018 - RNA, 13 nt, Mycobacterium avium subsp. paratuberculosis
ucauacagcggcg

SEQ ID NO: 891019 - RNA, 15 nt, Mycobacterium avium subsp. paratuberculosis
ucauacagcggcgcg

SEQ ID NO: 891020 - RNA, 16 nt, Mycobacterium avium subsp. paratuberculosis
ucauacagcggcgcgc

SEQ ID NO: 891021 - RNA, 13 nt, Mycobacterium avium subsp. paratuberculosis
ucauacggcggcu

SEQ ID NO: 891022 - RNA, 20 nt, Mycobacterium avium subsp. paratuberculosis
ucauaccagugcccgagcac

SEQ ID NO: 891023 - RNA, 18 nt, Mycobacterium avium subsp. paratuberculosis
ucaggcccucaucgucga

SEQ ID NO: 891024 - RNA, 19 nt, Mycobacterium avium subsp. paratuberculosis
ucaguucguucauccgggu

SEQ ID NO: 891025 - RNA, 16 nt, Mycobacterium avium subsp. paratuberculosis
ucaggcccagcgaggc

SEQ ID NO: 891026 - RNA, 22 nt, Mycobacterium avium subsp. paratuberculosis
ucaggcccagcgaggcggccag

SEQ ID NO: 891027 - RNA, 15 nt, Mycobacterium avium subsp. paratuberculosis
ucaggcccaggcgac

SEQ ID NO: 891028 - RNA, 15 nt, Mycobacterium avium subsp. paratuberculosis
ucaggccccacccgc

SEQ ID NO: 891029 - RNA, 16 nt, Mycobacterium avium subsp. paratuberculosis
ucaggccccacccgca

SEQ ID NO: 891030 - RNA, 11 nt, Mycobacterium avium subsp. paratuberculosis
ucaggcccgcg

SEQ ID NO: 891031 - RNA, 18 nt, Mycobacterium avium subsp. paratuberculosis
ucaggcccucgucggcga

SEQ ID NO: 891032 - RNA, 15 nt, Mycobacterium avium subsp. paratuberculosis
ucaguucgcggcgca

SEQ ID NO: 891033 - RNA, 16 nt, Mycobacterium avium subsp. paratuberculosis
ucaguucgcggcgcac

SEQ ID NO: 891034 - RNA, 16 nt, Mycobacterium avium subsp. paratuberculosis
ucauccgucgcccgcg

SEQ ID NO: 891035 - RNA, 14 nt, Mycobacterium avium subsp. paratuberculosis
ucauccucgccgcg

SEQ ID NO: 891036 - RNA, 16 nt, Mycobacterium avium subsp. paratuberculosis
ucauccucgccgcgcc

SEQ ID NO: 891037 - RNA, 20 nt, Mycobacterium avium subsp. paratuberculosis
ucauccucgccgcgccagca

SEQ ID NO: 891038 - RNA, 23 nt, Mycobacterium avium subsp. paratuberculosis
ucauccgggccaccaccacggcc

SEQ ID NO: 891039 - RNA, 13 nt, Mycobacterium avium subsp. paratuberculosis
ucaucagcgacac

SEQ ID NO: 891040 - RNA, 15 nt, Mycobacterium avium subsp. paratuberculosis
ucaucagcgacguca

SEQ ID NO: 891041 - RNA, 19 nt, Mycobacterium avium subsp. paratuberculosis
ucaucuacgucgucgccgg

SEQ ID NO: 891042 - RNA, 23 nt, Mycobacterium avium subsp. paratuberculosis
ucaucgugacgcgaagucgccgc

SEQ ID NO: 891043 - RNA, 19 nt, Mycobacterium avium subsp. paratuberculosis
ucaucguggcgcgacgcgg

SEQ ID NO: 891044 - RNA, 20 nt, Mycobacterium avium subsp. paratuberculosis
ucaucgugugggcgcccgcg

SEQ ID NO: 891045 - RNA, 16 nt, Mycobacterium avium subsp. paratuberculosis
ucaucguccacaccgg

SEQ ID NO: 891046 - RNA, 20 nt, Mycobacterium avium subsp. paratuberculosis
ucaucguccacaccgggaag

SEQ ID NO: 891047 - RNA, 16 nt, Mycobacterium avium subsp. paratuberculosis
ucaucgucgacccggc

SEQ ID NO: 891048 - RNA, 22 nt, Mycobacterium avium subsp. paratuberculosis
ucaucgagccgagcaccggcag

SEQ ID NO: 891049 - RNA, 17 nt, Mycobacterium avium subsp. paratuberculosis
ucaucgacuugccgccg

SEQ ID NO: 891050 - RNA, 18 nt, Mycobacterium avium subsp. paratuberculosis
ucaucgacuugccgccgc

SEQ ID NO: 891051 - RNA, 15 nt, Mycobacterium avium subsp. paratuberculosis
ucaucgagggcgucc

SEQ ID NO: 891052 - RNA, 23 nt, Mycobacterium avium subsp. paratuberculosis
ucaucgaggucgaaccacgcggc

SEQ ID NO: 891053 - RNA, 19 nt, Mycobacterium avium subsp. paratuberculosis
ucaucgacaccgaacccac

SEQ ID NO: 891054 - RNA, 20 nt, Mycobacterium avium subsp. paratuberculosis
ucaucgacucgaagaaccgc

SEQ ID NO: 891055 - RNA, 15 nt, Mycobacterium avium subsp. paratuberculosis
uccaauacggcccgg

SEQ ID NO: 891056 - RNA, 20 nt, Mycobacterium avium subsp. paratuberculosis
uccaaaaacugcgcgucgga

SEQ ID NO: 891057 - RNA, 18 nt, Mycobacterium avium subsp. paratuberculosis
ucauugaucuccgcggcg

SEQ ID NO: 891058 - RNA, 19 nt, Mycobacterium avium subsp. paratuberculosis
ucauugagccgcucgccgg

SEQ ID NO: 891059 - RNA, 20 nt, Mycobacterium avium subsp. paratuberculosis
ucaucucggcgaaguagcgg

SEQ ID NO: 891060 - RNA, 15 nt, Mycobacterium avium subsp. paratuberculosis
ucauguagcgcuggu

SEQ ID NO: 891061 - RNA, 17 nt, Mycobacterium avium subsp. paratuberculosis
ucauguaccaggcgacg

SEQ ID NO: 891062 - RNA, 16 nt, Mycobacterium avium subsp. paratuberculosis
ucauggucggcgacgc

SEQ ID NO: 891063 - RNA, 22 nt, Mycobacterium avium subsp. paratuberculosis
ucauggucggcgacgccgucgg

SEQ ID NO: 891064 - RNA, 13 nt, Mycobacterium avium subsp. paratuberculosis
ucauggucgucgu

SEQ ID NO: 891065 - RNA, 14 nt, Mycobacterium avium subsp. paratuberculosis
ucaugguggcggcg

SEQ ID NO: 891066 - RNA, 17 nt, Mycobacterium avium subsp. paratuberculosis
ucaugguggcggcgccg

SEQ ID NO: 891067 - RNA, 18 nt, Mycobacterium avium subsp. paratuberculosis
ucauguugugcaggcagc

SEQ ID NO: 891068 - RNA, 19 nt, Mycobacterium avium subsp. paratuberculosis
uaggucaucagcgacguca

SEQ ID NO: 891069 - RNA, 14 nt, Mycobacterium avium subsp. paratuberculosis
uaggucacccgguc

SEQ ID NO: 891070 - RNA, 23 nt, Mycobacterium avium subsp. paratuberculosis
uagggcgagcucguucucggcga

SEQ ID NO: 891071 - RNA, 16 nt, Mycobacterium avium subsp. paratuberculosis
uagggcuccgcgcuga

SEQ ID NO: 891072 - RNA, 11 nt, Mycobacterium avium subsp. paratuberculosis
uaucagcucgc

SEQ ID NO: 891073 - RNA, 22 nt, Mycobacterium avium subsp. paratuberculosis
uaucccaucagugcggcccgcc

SEQ ID NO: 891074 - RNA, 23 nt, Mycobacterium avium subsp. paratuberculosis
ucaaaccgggccugcgcgccgau

SEQ ID NO: 891075 - RNA, 18 nt, Mycobacterium avium subsp. paratuberculosis
ucaaaccguugaccacca

SEQ ID NO: 891076 - RNA, 19 nt, Mycobacterium avium subsp. paratuberculosis
ucaagaacgaaucgucgcc

SEQ ID NO: 891077 - RNA, 15 nt, Mycobacterium avium subsp. paratuberculosis
ucaacgacccggauc

SEQ ID NO: 891078 - RNA, 22 nt, Mycobacterium avium subsp. paratuberculosis
ucaacgagacacccucgcgcag

SEQ ID NO: 891079 - RNA, 13 nt, Mycobacterium avium subsp. paratuberculosis
ucaaccgcccagc

SEQ ID NO: 891080 - RNA, 16 nt, Mycobacterium avium subsp. paratuberculosis
ucaacccgagcaccgg

SEQ ID NO: 891081 - RNA, 21 nt, Mycobacterium avium subsp. paratuberculosis
ucaacccgaucgaggacaccg

SEQ ID NO: 891082 - RNA, 14 nt, Mycobacterium avium subsp. paratuberculosis
ucaacccgucgcgg

SEQ ID NO: 891083 - RNA, 16 nt, Mycobacterium avium subsp. paratuberculosis
ucaacccgucgcgggu

SEQ ID NO: 891084 - RNA, 13 nt, Mycobacterium avium subsp. paratuberculosis
ucaaguccgcgag

SEQ ID NO: 891085 - RNA, 23 nt, Mycobacterium avium subsp. paratuberculosis
ucaagaugauugcgugcccggcc

SEQ ID NO: 891086 - RNA, 16 nt, Mycobacterium avium subsp. paratuberculosis
ucaagauaccggccgg

SEQ ID NO: 891087 - RNA, 17 nt, Mycobacterium avium subsp. paratuberculosis
ucaagauaccggccggc

SEQ ID NO: 891088 - RNA, 18 nt, Mycobacterium avium subsp. paratuberculosis
ucaagauaccggccggcg

SEQ ID NO: 891089 - RNA, 15 nt, Mycobacterium avium subsp. paratuberculosis
ucaagauggugugca

SEQ ID NO: 891090 - RNA, 14 nt, Mycobacterium avium subsp. paratuberculosis
ucaagccgccgauc

SEQ ID NO: 891091 - RNA, 15 nt, Mycobacterium avium subsp. paratuberculosis
ucaagccggccagca

SEQ ID NO: 891092 - RNA, 18 nt, Mycobacterium avium subsp. paratuberculosis
ucaauugccacagccggu

SEQ ID NO: 891093 - RNA, 17 nt, Mycobacterium avium subsp. paratuberculosis
ucaaugccgcagccgau

SEQ ID NO: 891094 - RNA, 18 nt, Mycobacterium avium subsp. paratuberculosis
uacggcgggccggcgccg

SEQ ID NO: 891095 - RNA, 20 nt, Mycobacterium avium subsp. paratuberculosis
uacggcgggccggcgccggu

SEQ ID NO: 891096 - RNA, 19 nt, Mycobacterium avium subsp. paratuberculosis
uacggcgggugcgacggca

SEQ ID NO: 891097 - RNA, 19 nt, Mycobacterium avium subsp. paratuberculosis
uacggguugccgucgacga

SEQ ID NO: 891098 - RNA, 16 nt, Mycobacterium avium subsp. paratuberculosis
uacgcaucgccgagag

SEQ ID NO: 891099 - RNA, 18 nt, Mycobacterium avium subsp. paratuberculosis
uacgcgauggcggcgcgc

SEQ ID NO: 891100 - RNA, 20 nt, Mycobacterium avium subsp. paratuberculosis
uacgcgccggccagccggcu

SEQ ID NO: 891101 - RNA, 18 nt, Mycobacterium avium subsp. paratuberculosis
uacgcggcguugccgccg

SEQ ID NO: 891102 - RNA, 14 nt, Mycobacterium avium subsp. paratuberculosis
uacgcggcuggcgg

SEQ ID NO: 891103 - RNA, 16 nt, Mycobacterium avium subsp. paratuberculosis
uacgcacccgacacgc

SEQ ID NO: 891104 - RNA, 20 nt, Mycobacterium avium subsp. paratuberculosis
uacgacguccgggccgccuc

SEQ ID NO: 891105 - RNA, 17 nt, Mycobacterium avium subsp. paratuberculosis
uacgacucggccuccgc

SEQ ID NO: 891106 - RNA, 15 nt, Mycobacterium avium subsp. paratuberculosis
uaccagaucgagcug

SEQ ID NO: 891107 - RNA, 13 nt, Mycobacterium avium subsp. paratuberculosis
uaccacugcgcgc

SEQ ID NO: 891108 - RNA, 18 nt, Mycobacterium avium subsp. paratuberculosis
uaccacugcgcgcccgag

SEQ ID NO: 891109 - RNA, 17 nt, Mycobacterium avium subsp. paratuberculosis
uaccagcgcucgacgag

SEQ ID NO: 891110 - RNA, 22 nt, Mycobacterium avium subsp. paratuberculosis
uaccagcgccacggguugagcc

SEQ ID NO: 891111 - RNA, 19 nt, Mycobacterium avium subsp. paratuberculosis
uagacccacagcugccggc

SEQ ID NO: 891112 - RNA, 16 nt, Mycobacterium avium subsp. paratuberculosis
uagaccgauggcggcg

SEQ ID NO: 891113 - RNA, 16 nt, Mycobacterium avium subsp. paratuberculosis
uagaccuugaccaccg

SEQ ID NO: 891114 - RNA, 14 nt, Mycobacterium avium subsp. paratuberculosis
uagacgccgccgug

SEQ ID NO: 891115 - RNA, 15 nt, Mycobacterium avium subsp. paratuberculosis
uagacgaucaccggc

SEQ ID NO: 891116 - RNA, 16 nt, Mycobacterium avium subsp. paratuberculosis
uagacgaugcccagcc

SEQ ID NO: 891117 - RNA, 18 nt, Mycobacterium avium subsp. paratuberculosis
uagacgaugcccagcccc

SEQ ID NO: 891118 - RNA, 20 nt, Mycobacterium avium subsp. paratuberculosis
uacuugaugacgcacgucgg

SEQ ID NO: 891119 - RNA, 18 nt, Mycobacterium avium subsp. paratuberculosis
uacuugcguugcgcggcg

SEQ ID NO: 891120 - RNA, 16 nt, Mycobacterium avium subsp. paratuberculosis
uacuuggccagcugcg

SEQ ID NO: 891121 - RNA, 15 nt, Mycobacterium avium subsp. paratuberculosis
uacgucacggugacg

SEQ ID NO: 891122 - RNA, 14 nt, Mycobacterium avium subsp. paratuberculosis
uacgucgucgccgg

SEQ ID NO: 891123 - RNA, 19 nt, Mycobacterium avium subsp. paratuberculosis
uacgugcucccgccgagau

SEQ ID NO: 891124 - RNA, 17 nt, Mycobacterium avium subsp. paratuberculosis
uacgugucccugcggcu

SEQ ID NO: 891125 - RNA, 15 nt, Mycobacterium avium subsp. paratuberculosis
aaguugaucgcggcg

SEQ ID NO: 891126 - RNA, 17 nt, Mycobacterium avium subsp. paratuberculosis
aaguugguguccacccg

SEQ ID NO: 891127 - RNA, 14 nt, Mycobacterium avium subsp. paratuberculosis
uagcucgccgcggc

SEQ ID NO: 891128 - RNA, 22 nt, Mycobacterium avium subsp. paratuberculosis
uagcucgccgcggccacgcucg

SEQ ID NO: 891129 - RNA, 14 nt, Mycobacterium avium subsp. paratuberculosis
uagcucgcgccgac

SEQ ID NO: 891130 - RNA, 13 nt, Mycobacterium avium subsp. paratuberculosis
uagcugcaggcga

SEQ ID NO: 891131 - RNA, 15 nt, Mycobacterium avium subsp. paratuberculosis
uagcggacgacggcc

SEQ ID NO: 891132 - RNA, 20 nt, Mycobacterium avium subsp. paratuberculosis
uagcggaucaggucggucac

SEQ ID NO: 891133 - RNA, 17 nt, Mycobacterium avium subsp. paratuberculosis
uagcggaagcugccguu

SEQ ID NO: 891134 - RNA, 18 nt, Mycobacterium avium subsp. paratuberculosis
uagcggaagcugccguug

SEQ ID NO: 891135 - RNA, 20 nt, Mycobacterium avium subsp. paratuberculosis
uagcgcggcggccucggugg

SEQ ID NO: 891136 - RNA, 21 nt, Mycobacterium avium subsp. paratuberculosis
uagcagcagaccgcgaucagc

SEQ ID NO: 891137 - RNA, 15 nt, Mycobacterium avium subsp. paratuberculosis
uagccgaagccgccg

SEQ ID NO: 891138 - RNA, 17 nt, Mycobacterium avium subsp. paratuberculosis
uagccgaccgacccggc

SEQ ID NO: 891139 - RNA, 21 nt, Mycobacterium avium subsp. paratuberculosis
uagccgaccgacccggccagc

SEQ ID NO: 891140 - RNA, 24 nt, Mycobacterium avium subsp. paratuberculosis
uagccgaccgacccggccagcggc

SEQ ID NO: 891141 - RNA, 17 nt, Mycobacterium avium subsp. paratuberculosis
uagccgaccaacgggcg

SEQ ID NO: 891142 - RNA, 18 nt, Mycobacterium avium subsp. paratuberculosis
uagccgaccaacgggcgg

SEQ ID NO: 891143 - RNA, 21 nt, Mycobacterium avium subsp. paratuberculosis
uagcccgucgacgggccacca

SEQ ID NO: 891144 - RNA, 11 nt, Mycobacterium avium subsp. paratuberculosis
uagccgccgua

SEQ ID NO: 891145 - RNA, 16 nt, Mycobacterium avium subsp. paratuberculosis
uagccgccgagcguca

SEQ ID NO: 891146 - RNA, 19 nt, Mycobacterium avium subsp. paratuberculosis
uagccgccgagcgucacgc

SEQ ID NO: 891147 - RNA, 13 nt, Mycobacterium avium subsp. paratuberculosis
uagccgucggcgg

SEQ ID NO: 891148 - RNA, 15 nt, Mycobacterium avium subsp. paratuberculosis
uagccgucggcggag

SEQ ID NO: 891149 - RNA, 14 nt, Mycobacterium avium subsp. paratuberculosis
uagccgucggcggc

SEQ ID NO: 891150 - RNA, 16 nt, Mycobacterium avium subsp. paratuberculosis
uagccgucggcggccu

SEQ ID NO: 891151 - RNA, 18 nt, Mycobacterium avium subsp. paratuberculosis
uaggacaccacgguggcg

SEQ ID NO: 891152 - RNA, 19 nt, Mycobacterium avium subsp. paratuberculosis
uaggacagcagccgcucac

SEQ ID NO: 891153 - RNA, 16 nt, Mycobacterium avium subsp. paratuberculosis
uaggacccggcgagcg

SEQ ID NO: 891154 - RNA, 17 nt, Mycobacterium avium subsp. paratuberculosis
uaggacccggcgagcgg

SEQ ID NO: 891155 - RNA, 13 nt, Mycobacterium avium subsp. paratuberculosis
uaggcggcgagcu

SEQ ID NO: 891156 - RNA, 14 nt, Mycobacterium avium subsp. paratuberculosis
uaggcgucgaacgg

SEQ ID NO: 891157 - RNA, 13 nt, Mycobacterium avium subsp. paratuberculosis
uaggcggccagca

SEQ ID NO: 891158 - RNA, 18 nt, Mycobacterium avium subsp. paratuberculosis
uaggcggccagcagcacc

SEQ ID NO: 891159 - RNA, 19 nt, Mycobacterium avium subsp. paratuberculosis
uaggcggccagcagcacca

SEQ ID NO: 891160 - RNA, 19 nt, Mycobacterium avium subsp. paratuberculosis
uaggcgaagagcggcacga

SEQ ID NO: 891161 - RNA, 19 nt, Mycobacterium avium subsp. paratuberculosis
uaggcgaccaugcccagca

SEQ ID NO: 891162 - RNA, 17 nt, Mycobacterium avium subsp. paratuberculosis
uaggcgaggaccgagau

SEQ ID NO: 891163 - RNA, 18 nt, Mycobacterium avium subsp. paratuberculosis
uaggcgcaccgccgggca

SEQ ID NO: 891164 - RNA, 19 nt, Mycobacterium avium subsp. paratuberculosis
uaggccucguggaacaccg

SEQ ID NO: 891165 - RNA, 17 nt, Mycobacterium avium subsp. paratuberculosis
uaggccuggaaccgggu

SEQ ID NO: 891166 - RNA, 13 nt, Mycobacterium avium subsp. paratuberculosis
uaggccggauccc

SEQ ID NO: 891167 - RNA, 17 nt, Mycobacterium avium subsp. paratuberculosis
uaggccgcgcuggccag

SEQ ID NO: 891168 - RNA, 22 nt, Mycobacterium avium subsp. paratuberculosis
uaggccgcguagcucgccgcgg

SEQ ID NO: 891169 - RNA, 22 nt, Mycobacterium avium subsp. paratuberculosis
uacacauagcccaucagcacgc

SEQ ID NO: 891170 - RNA, 19 nt, Mycobacterium avium subsp. paratuberculosis
uacacagcccccacgcucg

SEQ ID NO: 891171 - RNA, 21 nt, Mycobacterium avium subsp. paratuberculosis
uacaccaccgcggcgaugauc

SEQ ID NO: 891172 - RNA, 20 nt, Mycobacterium avium subsp. paratuberculosis
uacaccagggugccgccggg

SEQ ID NO: 891173 - RNA, 23 nt, Mycobacterium avium subsp. paratuberculosis
uacacgaugcccuuggccagcag

SEQ ID NO: 891174 - RNA, 13 nt, Mycobacterium avium subsp. paratuberculosis
uacaccggcucgc

SEQ ID NO: 891175 - RNA, 20 nt, Mycobacterium avium subsp. paratuberculosis
uacaccgugcccgagccgau

SEQ ID NO: 891176 - RNA, 22 nt, Mycobacterium avium subsp. paratuberculosis
uaauucguuguuggcggugguu

SEQ ID NO: 891177 - RNA, 20 nt, Mycobacterium avium subsp. paratuberculosis
uacaucguucccugcgcggc

SEQ ID NO: 891178 - RNA, 23 nt, Mycobacterium avium subsp. paratuberculosis
uacaucguucccugcgcggcgau

SEQ ID NO: 891179 - RNA, 20 nt, Mycobacterium avium subsp. paratuberculosis
uacaucgacgcgaccggccc

SEQ ID NO: 891180 - RNA, 14 nt, Mycobacterium avium subsp. paratuberculosis
uacacguggccgau

SEQ ID NO: 891181 - RNA, 19 nt, Mycobacterium avium subsp. paratuberculosis
uacagcgacuccagcgcga

SEQ ID NO: 891182 - RNA, 14 nt, Mycobacterium avium subsp. paratuberculosis
uacagcaccgccgc

SEQ ID NO: 891183 - RNA, 16 nt, Mycobacterium avium subsp. paratuberculosis
uacagcaccgccgcgg

SEQ ID NO: 891184 - RNA, 18 nt, Mycobacterium avium subsp. paratuberculosis
uacagcugguccggccgg

SEQ ID NO: 891185 - RNA, 19 nt, Mycobacterium avium subsp. paratuberculosis
uacagcggcgcgcgccgca

SEQ ID NO: 891186 - RNA, 16 nt, Mycobacterium avium subsp. paratuberculosis
uaaguggcgccgcggu

SEQ ID NO: 891187 - RNA, 16 nt, Mycobacterium avium subsp. paratuberculosis
uaagucgaugccgccc

SEQ ID NO: 891188 - RNA, 14 nt, Mycobacterium avium subsp. paratuberculosis
uaacuucacgcucg

SEQ ID NO: 891189 - RNA, 22 nt, Mycobacterium avium subsp. paratuberculosis
uaagccggcgucgggaccgucg

SEQ ID NO: 891190 - RNA, 15 nt, Mycobacterium avium subsp. paratuberculosis
uaaccaccggugacg

SEQ ID NO: 891191 - RNA, 14 nt, Mycobacterium avium subsp. paratuberculosis
uaaaccagcagcgc

SEQ ID NO: 891192 - RNA, 14 nt, Mycobacterium avium subsp. paratuberculosis
uaacgugcccggcc

SEQ ID NO: 891193 - RNA, 16 nt, Mycobacterium avium subsp. paratuberculosis
uaacgguaggcgcggu

SEQ ID NO: 891194 - RNA, 14 nt, Mycobacterium avium subsp. paratuberculosis
uaaccgcgcggcgc

SEQ ID NO: 891195 - RNA, 13 nt, Mycobacterium avium subsp. paratuberculosis
uaacccaccccga

SEQ ID NO: 891196 - RNA, 21 nt, Mycobacterium avium subsp. paratuberculosis
guuuucgggccggucagcgcg

SEQ ID NO: 891197 - RNA, 17 nt, Mycobacterium avium subsp. paratuberculosis
guuuugcgucugcucgg

SEQ ID NO: 891198 - RNA, 13 nt, Mycobacterium avium subsp. paratuberculosis
guuuugcggaucg

SEQ ID NO: 891199 - RNA, 17 nt, Mycobacterium avium subsp. paratuberculosis
guuuugaucagcccggg

SEQ ID NO: 891200 - RNA, 15 nt, Mycobacterium avium subsp. paratuberculosis
guuuugaugccgccg

SEQ ID NO: 891201 - RNA, 22 nt, Mycobacterium avium subsp. paratuberculosis
guuuucggcgcgcagcucgcgc

SEQ ID NO: 891202 - RNA, 17 nt, Mycobacterium avium subsp. paratuberculosis
guuuucggcgcgcgccg

SEQ ID NO: 891203 - RNA, 15 nt, Mycobacterium avium subsp. paratuberculosis
guuucugccggccgc

SEQ ID NO: 891204 - RNA, 17 nt, Mycobacterium avium subsp. paratuberculosis
guuucugccggccgccg

SEQ ID NO: 891205 - RNA, 20 nt, Mycobacterium avium subsp. paratuberculosis
guuugcaggcgaucucgccg

SEQ ID NO: 891206 - RNA, 15 nt, Mycobacterium avium subsp. paratuberculosis
guuuggggaugcgca

SEQ ID NO: 891207 - RNA, 16 nt, Mycobacterium avium subsp. paratuberculosis
guuuguccugcucggc

SEQ ID NO: 891208 - RNA, 21 nt, Mycobacterium avium subsp. paratuberculosis
guuuguccugcucggcgacgc

SEQ ID NO: 891209 - RNA, 16 nt, Mycobacterium avium subsp. paratuberculosis
guuuggucagcgcccc

SEQ ID NO: 891210 - RNA, 18 nt, Mycobacterium avium subsp. paratuberculosis
guuuggcugucgcgcuga

SEQ ID NO: 891211 - RNA, 14 nt, Mycobacterium avium subsp. paratuberculosis
guuuggugguggcg

SEQ ID NO: 891212 - RNA, 11 nt, Mycobacterium avium subsp. paratuberculosis
guuugcgccgg

SEQ ID NO: 891213 - RNA, 13 nt, Mycobacterium avium subsp. paratuberculosis
guuugcgccggcu

SEQ ID NO: 891214 - RNA, 20 nt, Mycobacterium avium subsp. paratuberculosis
guuuggccgcgcagcucggg

SEQ ID NO: 891215 - RNA, 23 nt, Mycobacterium avium subsp. paratuberculosis
guuuggccugaaccagcucgugc

SEQ ID NO: 891216 - RNA, 19 nt, Mycobacterium avium subsp. paratuberculosis
guuuccuggugcaccaggu

SEQ ID NO: 891217 - RNA, 16 nt, Mycobacterium avium subsp. paratuberculosis
guuucggucggcgucg

SEQ ID NO: 891218 - RNA, 16 nt, Mycobacterium avium subsp. paratuberculosis
guuucgcucgucggcg

SEQ ID NO: 891219 - RNA, 21 nt, Mycobacterium avium subsp. paratuberculosis
guuucggaguggaacagccgg

SEQ ID NO: 891220 - RNA, 20 nt, Mycobacterium avium subsp. paratuberculosis
guuucgugugcucagcuccc

SEQ ID NO: 891221 - RNA, 21 nt, Mycobacterium avium subsp. paratuberculosis
guuucgugugguacagcgcca

SEQ ID NO: 891222 - RNA, 21 nt, Mycobacterium avium subsp. paratuberculosis
guuguagcaggcggugguggg

SEQ ID NO: 891223 - RNA, 12 nt, Mycobacterium avium subsp. paratuberculosis
guugguggucga

SEQ ID NO: 891224 - RNA, 21 nt, Mycobacterium avium subsp. paratuberculosis
guugguugcggccccgccagc

SEQ ID NO: 891225 - RNA, 20 nt, Mycobacterium avium subsp. paratuberculosis
guugggucucaucccgccga

SEQ ID NO: 891226 - RNA, 16 nt, Mycobacterium avium subsp. paratuberculosis
guuggucaccaccaac

SEQ ID NO: 891227 - RNA, 18 nt, Mycobacterium avium subsp. paratuberculosis
guuggucaccaggucgcg

SEQ ID NO: 891228 - RNA, 14 nt, Mycobacterium avium subsp. paratuberculosis
guuggucagccuga

SEQ ID NO: 891229 - RNA, 23 nt, Mycobacterium avium subsp. paratuberculosis
guuggugcggugcaucgucgcgg

SEQ ID NO: 891230 - RNA, 17 nt, Mycobacterium avium subsp. paratuberculosis
guuggugacgcucaccc

SEQ ID NO: 891231 - RNA, 19 nt, Mycobacterium avium subsp. paratuberculosis
guuggugaucagccccgcc

SEQ ID NO: 891232 - RNA, 14 nt, Mycobacterium avium subsp. paratuberculosis
guuggucggcgcgg

SEQ ID NO: 891233 - RNA, 15 nt, Mycobacterium avium subsp. paratuberculosis
guuggucggcgcggc

SEQ ID NO: 891234 - RNA, 21 nt, Mycobacterium avium subsp. paratuberculosis
guuggugaacagguaggcggc

SEQ ID NO: 891235 - RNA, 17 nt, Mycobacterium avium subsp. paratuberculosis
guucuucgaccacgcgc

SEQ ID NO: 891236 - RNA, 22 nt, Mycobacterium avium subsp. paratuberculosis
guucuucgcgaagaacgacgcc

SEQ ID NO: 891237 - RNA, 19 nt, Mycobacterium avium subsp. paratuberculosis
guucuucugcgcgaugucg

SEQ ID NO: 891238 - RNA, 23 nt, Mycobacterium avium subsp. paratuberculosis
guucuucucacaggugacgacgc

SEQ ID NO: 891239 - RNA, 16 nt, Mycobacterium avium subsp. paratuberculosis
guugaaaaacgcggug

SEQ ID NO: 891240 - RNA, 17 nt, Mycobacterium avium subsp. paratuberculosis
guugaacggcaccccgc

SEQ ID NO: 891241 - RNA, 23 nt, Mycobacterium avium subsp. paratuberculosis
guugaacgacaucaccaccgccg

SEQ ID NO: 891242 - RNA, 14 nt, Mycobacterium avium subsp. paratuberculosis
guucgaccggcguc

SEQ ID NO: 891243 - RNA, 17 nt, Mycobacterium avium subsp. paratuberculosis
guucugguaggcggccg

SEQ ID NO: 891244 - RNA, 19 nt, Mycobacterium avium subsp. paratuberculosis
guugagggcggggcagcag

SEQ ID NO: 891245 - RNA, 14 nt, Mycobacterium avium subsp. paratuberculosis
guugaggcggcggc

SEQ ID NO: 891246 - RNA, 23 nt, Mycobacterium avium subsp. paratuberculosis
guugaggaucugcacgucggcgg

SEQ ID NO: 891247 - RNA, 23 nt, Mycobacterium avium subsp. paratuberculosis
guugacgcauucaaugucgcccu

SEQ ID NO: 891248 - RNA, 16 nt, Mycobacterium avium subsp. paratuberculosis
guugacgcccccggug

SEQ ID NO: 891249 - RNA, 19 nt, Mycobacterium avium subsp. paratuberculosis
guugacgcccccggugacg

SEQ ID NO: 891250 - RNA, 20 nt, Mycobacterium avium subsp. paratuberculosis
guugacgcccccggugacga

SEQ ID NO: 891251 - RNA, 12 nt, Mycobacterium avium subsp. paratuberculosis
guugacgcccuc

SEQ ID NO: 891252 - RNA, 14 nt, Mycobacterium avium subsp. paratuberculosis
guugacgccgaugc

SEQ ID NO: 891253 - RNA, 18 nt, Mycobacterium avium subsp. paratuberculosis
guugacggugaccggcgc

SEQ ID NO: 891254 - RNA, 19 nt, Mycobacterium avium subsp. paratuberculosis
guugacccucagcagggcg

SEQ ID NO: 891255 - RNA, 17 nt, Mycobacterium avium subsp. paratuberculosis
guugaccgacgccucca

SEQ ID NO: 891256 - RNA, 14 nt, Mycobacterium avium subsp. paratuberculosis
guugaccgccgaca

SEQ ID NO: 891257 - RNA, 21 nt, Mycobacterium avium subsp. paratuberculosis
guugaccgcgaagguggcacg

SEQ ID NO: 891258 - RNA, 18 nt, Mycobacterium avium subsp. paratuberculosis
guugaccgggucgccgau

SEQ ID NO: 891259 - RNA, 20 nt, Mycobacterium avium subsp. paratuberculosis
guugaccuucucgaccaggc

SEQ ID NO: 891260 - RNA, 14 nt, Mycobacterium avium subsp. paratuberculosis
guugaccuugacca

SEQ ID NO: 891261 - RNA, 18 nt, Mycobacterium avium subsp. paratuberculosis
guugcacggucugguggc

SEQ ID NO: 891262 - RNA, 18 nt, Mycobacterium avium subsp. paratuberculosis
guugcacguaggcggcga

SEQ ID NO: 891263 - RNA, 14 nt, Mycobacterium avium subsp. paratuberculosis
guugcagcgccgcg

SEQ ID NO: 891264 - RNA, 16 nt, Mycobacterium avium subsp. paratuberculosis
guugcagcgccgcggc

SEQ ID NO: 891265 - RNA, 17 nt, Mycobacterium avium subsp. paratuberculosis
guugcaggcgcccagga

SEQ ID NO: 891266 - RNA, 12 nt, Mycobacterium avium subsp. paratuberculosis
guugcaggcgga

SEQ ID NO: 891267 - RNA, 14 nt, Mycobacterium avium subsp. paratuberculosis
guugcaggccacgc

SEQ ID NO: 891268 - RNA, 14 nt, Mycobacterium avium subsp. paratuberculosis
guugaugccgugcg

SEQ ID NO: 891269 - RNA, 14 nt, Mycobacterium avium subsp. paratuberculosis
guugaugcgcaccg

SEQ ID NO: 891270 - RNA, 14 nt, Mycobacterium avium subsp. paratuberculosis
guugaugucgcgcg

SEQ ID NO: 891271 - RNA, 15 nt, Mycobacterium avium subsp. paratuberculosis
guugaugaucgccga

SEQ ID NO: 891272 - RNA, 15 nt, Mycobacterium avium subsp. paratuberculosis
guugauugcgcccgc

SEQ ID NO: 891273 - RNA, 14 nt, Mycobacterium avium subsp. paratuberculosis
guugauccggaucg

SEQ ID NO: 891274 - RNA, 15 nt, Mycobacterium avium subsp. paratuberculosis
guugaucgagcaccg

SEQ ID NO: 891275 - RNA, 19 nt, Mycobacterium avium subsp. paratuberculosis
guugaucgagcaccgggcg

SEQ ID NO: 891276 - RNA, 14 nt, Mycobacterium avium subsp. paratuberculosis
guugaucucgucga

SEQ ID NO: 891277 - RNA, 21 nt, Mycobacterium avium subsp. paratuberculosis
guugaucucgucgaugacgau

SEQ ID NO: 891278 - RNA, 21 nt, Mycobacterium avium subsp. paratuberculosis
guugaugaaacuuccgcccgg

SEQ ID NO: 891279 - RNA, 20 nt, Mycobacterium avium subsp. paratuberculosis
guugaugaagaccuggccgg

SEQ ID NO: 891280 - RNA, 21 nt, Mycobacterium avium subsp. paratuberculosis
guugaucacguguccgucgcc

SEQ ID NO: 891281 - RNA, 22 nt, Mycobacterium avium subsp. paratuberculosis
guugaucacguguccgucgccg

SEQ ID NO: 891282 - RNA, 16 nt, Mycobacterium avium subsp. paratuberculosis
guugaucacaccgucg

SEQ ID NO: 891283 - RNA, 15 nt, Mycobacterium avium subsp. paratuberculosis
guugauccagcggcg

SEQ ID NO: 891284 - RNA, 20 nt, Mycobacterium avium subsp. paratuberculosis
guugauccagcggcgcaccg

SEQ ID NO: 891285 - RNA, 23 nt, Mycobacterium avium subsp. paratuberculosis
guugauccagcggcgcaccgugu

SEQ ID NO: 891286 - RNA, 13 nt, Mycobacterium avium subsp. paratuberculosis
guugauccgcgcg

SEQ ID NO: 891287 - RNA, 16 nt, Mycobacterium avium subsp. paratuberculosis
guugaucagggcggcg

SEQ ID NO: 891288 - RNA, 21 nt, Mycobacterium avium subsp. paratuberculosis
guugaucagguucaccagcac

SEQ ID NO: 891289 - RNA, 16 nt, Mycobacterium avium subsp. paratuberculosis
guugaucauccggcgg

SEQ ID NO: 891290 - RNA, 17 nt, Mycobacterium avium subsp. paratuberculosis
guugaucauccggcggg

SEQ ID NO: 891291 - RNA, 18 nt, Mycobacterium avium subsp. paratuberculosis
guugagucccucggcgag

SEQ ID NO: 891292 - RNA, 15 nt, Mycobacterium avium subsp. paratuberculosis
guugagugcgccgug

SEQ ID NO: 891293 - RNA, 21 nt, Mycobacterium avium subsp. paratuberculosis
guugcguuccagcauccggca

SEQ ID NO: 891294 - RNA, 14 nt, Mycobacterium avium subsp. paratuberculosis
guugcuccggcguc

SEQ ID NO: 891295 - RNA, 20 nt, Mycobacterium avium subsp. paratuberculosis
guugcgucccgcgccggagu

SEQ ID NO: 891296 - RNA, 17 nt, Mycobacterium avium subsp. paratuberculosis
guugcgugacuugucgg

SEQ ID NO: 891297 - RNA, 19 nt, Mycobacterium avium subsp. paratuberculosis
guugcgugacuugucgggc

SEQ ID NO: 891298 - RNA, 14 nt, Mycobacterium avium subsp. paratuberculosis
guugcgugcagccg

SEQ ID NO: 891299 - RNA, 20 nt, Mycobacterium avium subsp. paratuberculosis
guugcggugcucgucgagca

SEQ ID NO: 891300 - RNA, 13 nt, Mycobacterium avium subsp. paratuberculosis
guugcgguggccg

SEQ ID NO: 891301 - RNA, 19 nt, Mycobacterium avium subsp. paratuberculosis
guugcgguguugcgcagcg

SEQ ID NO: 891302 - RNA, 17 nt, Mycobacterium avium subsp. paratuberculosis
guugcgggccaggucga

SEQ ID NO: 891303 - RNA, 20 nt, Mycobacterium avium subsp. paratuberculosis
guugcgguacaucccgccgg

SEQ ID NO: 891304 - RNA, 18 nt, Mycobacterium avium subsp. paratuberculosis
guugcucggggcucgcgg

SEQ ID NO: 891305 - RNA, 19 nt, Mycobacterium avium subsp. paratuberculosis
guugcucggggcucgcggu

SEQ ID NO: 891306 - RNA, 21 nt, Mycobacterium avium subsp. paratuberculosis
guugcucggggcucgcggugu

SEQ ID NO: 891307 - RNA, 15 nt, Mycobacterium avium subsp. paratuberculosis
guugcucgggugacg

SEQ ID NO: 891308 - RNA, 19 nt, Mycobacterium avium subsp. paratuberculosis
guugcugagccgccgagcc

SEQ ID NO: 891309 - RNA, 12 nt, Mycobacterium avium subsp. paratuberculosis
guugcucgucgg

SEQ ID NO: 891310 - RNA, 14 nt, Mycobacterium avium subsp. paratuberculosis
guuggccgucgaac

SEQ ID NO: 891311 - RNA, 13 nt, Mycobacterium avium subsp. paratuberculosis
guuggccgucgcg

SEQ ID NO: 891312 - RNA, 14 nt, Mycobacterium avium subsp. paratuberculosis
guuggccgucgcgu

SEQ ID NO: 891313 - RNA, 13 nt, Mycobacterium avium subsp. paratuberculosis
guuggccggcggg

SEQ ID NO: 891314 - RNA, 20 nt, Mycobacterium avium subsp. paratuberculosis
guuggccggcuucucggcgu

SEQ ID NO: 891315 - RNA, 14 nt, Mycobacterium avium subsp. paratuberculosis
guuggccggcccgc

SEQ ID NO: 891316 - RNA, 16 nt, Mycobacterium avium subsp. paratuberculosis
guuggccggcccgccc

SEQ ID NO: 891317 - RNA, 20 nt, Mycobacterium avium subsp. paratuberculosis
guuggcgaucagggcggcgc

SEQ ID NO: 891318 - RNA, 17 nt, Mycobacterium avium subsp. paratuberculosis
guuggcgccguccgcgg

SEQ ID NO: 891319 - RNA, 20 nt, Mycobacterium avium subsp. paratuberculosis
guuggccucccacaggucga

SEQ ID NO: 891320 - RNA, 21 nt, Mycobacterium avium subsp. paratuberculosis
guuggcgaagucaucgagaug

SEQ ID NO: 891321 - RNA, 22 nt, Mycobacterium avium subsp. paratuberculosis
guuggcgacggcgcuguggccg

SEQ ID NO: 891322 - RNA, 13 nt, Mycobacterium avium subsp. paratuberculosis
guugggcggcggc

SEQ ID NO: 891323 - RNA, 23 nt, Mycobacterium avium subsp. paratuberculosis
guugggcggcggccaccucgccg

SEQ ID NO: 891324 - RNA, 23 nt, Mycobacterium avium subsp. paratuberculosis
guuggggccgauguucaccccga

SEQ ID NO: 891325 - RNA, 14 nt, Mycobacterium avium subsp. paratuberculosis
guuggggccgcgga

SEQ ID NO: 891326 - RNA, 20 nt, Mycobacterium avium subsp. paratuberculosis
guuggggccggccgcccgca

SEQ ID NO: 891327 - RNA, 18 nt, Mycobacterium avium subsp. paratuberculosis
guugggggccagcgccga

SEQ ID NO: 891328 - RNA, 23 nt, Mycobacterium avium subsp. paratuberculosis
guugggccagcggcgccggguca

SEQ ID NO: 891329 - RNA, 19 nt, Mycobacterium avium subsp. paratuberculosis
guugggccggcgcccguca

SEQ ID NO: 891330 - RNA, 18 nt, Mycobacterium avium subsp. paratuberculosis
guugggcgccugcgguga

SEQ ID NO: 891331 - RNA, 16 nt, Mycobacterium avium subsp. paratuberculosis
guugggcagcucggcg

SEQ ID NO: 891332 - RNA, 17 nt, Mycobacterium avium subsp. paratuberculosis
guugggcagcucggcgg

SEQ ID NO: 891333 - RNA, 20 nt, Mycobacterium avium subsp. paratuberculosis
guuggcuuuucgggccggcc

SEQ ID NO: 891334 - RNA, 18 nt, Mycobacterium avium subsp. paratuberculosis
guugcauuucggcguccu

SEQ ID NO: 891335 - RNA, 23 nt, Mycobacterium avium subsp. paratuberculosis
guugcccaggaaguagccggcca

SEQ ID NO: 891336 - RNA, 19 nt, Mycobacterium avium subsp. paratuberculosis
guugccccaaaacgggcga

SEQ ID NO: 891337 - RNA, 13 nt, Mycobacterium avium subsp. paratuberculosis
guugccccacccc

SEQ ID NO: 891338 - RNA, 18 nt, Mycobacterium avium subsp. paratuberculosis
guugcggaucaugcgcgu

SEQ ID NO: 891339 - RNA, 18 nt, Mycobacterium avium subsp. paratuberculosis
guugcggaucgaacggcg

SEQ ID NO: 891340 - RNA, 14 nt, Mycobacterium avium subsp. paratuberculosis
guugcggcaccggc

SEQ ID NO: 891341 - RNA, 15 nt, Mycobacterium avium subsp. paratuberculosis
guugcggcaccggcg

SEQ ID NO: 891342 - RNA, 22 nt, Mycobacterium avium subsp. paratuberculosis
guugcggcaccggcgaauccga

SEQ ID NO: 891343 - RNA, 16 nt, Mycobacterium avium subsp. paratuberculosis
guugcggcagggccac

SEQ ID NO: 891344 - RNA, 21 nt, Mycobacterium avium subsp. paratuberculosis
guugcggcagggccaccguca

SEQ ID NO: 891345 - RNA, 17 nt, Mycobacterium avium subsp. paratuberculosis
guugcggcccacgguga

SEQ ID NO: 891346 - RNA, 19 nt, Mycobacterium avium subsp. paratuberculosis
guugcggcgcagcgucucg

SEQ ID NO: 891347 - RNA, 14 nt, Mycobacterium avium subsp. paratuberculosis
guugcggcggccgg

SEQ ID NO: 891348 - RNA, 21 nt, Mycobacterium avium subsp. paratuberculosis
guugcggccgcuucccacccg

SEQ ID NO: 891349 - RNA, 13 nt, Mycobacterium avium subsp. paratuberculosis
guugcggccggcc

SEQ ID NO: 891350 - RNA, 19 nt, Mycobacterium avium subsp. paratuberculosis
guugcgcuggaugaagguc

SEQ ID NO: 891351 - RNA, 18 nt, Mycobacterium avium subsp. paratuberculosis
guugcggccccgccagca

SEQ ID NO: 891352 - RNA, 15 nt, Mycobacterium avium subsp. paratuberculosis
guugccgaguaccga

SEQ ID NO: 891353 - RNA, 18 nt, Mycobacterium avium subsp. paratuberculosis
guugccgauggcggucca

SEQ ID NO: 891354 - RNA, 14 nt, Mycobacterium avium subsp. paratuberculosis
guugcccgccgcgg

SEQ ID NO: 891355 - RNA, 15 nt, Mycobacterium avium subsp. paratuberculosis
guugcccgccgcggc

SEQ ID NO: 891356 - RNA, 23 nt, Mycobacterium avium subsp. paratuberculosis
guugcccggaagccgcauggugc

SEQ ID NO: 891357 - RNA, 18 nt, Mycobacterium avium subsp. paratuberculosis
guugcccgguuccgcgac

SEQ ID NO: 891358 - RNA, 17 nt, Mycobacterium avium subsp. paratuberculosis
guugcccgucgccuccg

SEQ ID NO: 891359 - RNA, 13 nt, Mycobacterium avium subsp. paratuberculosis
gugcucgagcaca

SEQ ID NO: 891360 - RNA, 20 nt, Mycobacterium avium subsp. paratuberculosis
gugcucgagcaucucggugc

SEQ ID NO: 891361 - RNA, 15 nt, Mycobacterium avium subsp. paratuberculosis
gugcucgaucggcgc

SEQ ID NO: 891362 - RNA, 16 nt, Mycobacterium avium subsp. paratuberculosis
gugcucgaucggcgcg

SEQ ID NO: 891363 - RNA, 19 nt, Mycobacterium avium subsp. paratuberculosis
gugcucgauggccagcgcg

SEQ ID NO: 891364 - RNA, 13 nt, Mycobacterium avium subsp. paratuberculosis
gugcucgccccgc

SEQ ID NO: 891365 - RNA, 16 nt, Mycobacterium avium subsp. paratuberculosis
gugcucgccggcgcgg

SEQ ID NO: 891366 - RNA, 19 nt, Mycobacterium avium subsp. paratuberculosis
gugcucggccacgacgcgc

SEQ ID NO: 891367 - RNA, 20 nt, Mycobacterium avium subsp. paratuberculosis
gugcucggccacgacgcgcc

SEQ ID NO: 891368 - RNA, 24 nt, Mycobacterium avium subsp. paratuberculosis
gugcucggccacgacgcgccacgc

SEQ ID NO: 891369 - RNA, 17 nt, Mycobacterium avium subsp. paratuberculosis
gugcucggcgagcaccg

SEQ ID NO: 891370 - RNA, 21 nt, Mycobacterium avium subsp. paratuberculosis
gugcucggcgagcaccgugcc

SEQ ID NO: 891371 - RNA, 18 nt, Mycobacterium avium subsp. paratuberculosis
gugcucgcgccgggcggc

SEQ ID NO: 891372 - RNA, 15 nt, Mycobacterium avium subsp. paratuberculosis
gugcucggcgcgcgg

SEQ ID NO: 891373 - RNA, 15 nt, Mycobacterium avium subsp. paratuberculosis
gugcucggcggcgca

SEQ ID NO: 891374 - RNA, 22 nt, Mycobacterium avium subsp. paratuberculosis
gugcucggugauccacgcggug

SEQ ID NO: 891375 - RNA, 22 nt, Mycobacterium avium subsp. paratuberculosis
gugcucgucgagcauccggcgc

SEQ ID NO: 891376 - RNA, 14 nt, Mycobacterium avium subsp. paratuberculosis
gugcucgucggcgg

SEQ ID NO: 891377 - RNA, 19 nt, Mycobacterium avium subsp. paratuberculosis
gugcucgucggcgggcacc

SEQ ID NO: 891378 - RNA, 20 nt, Mycobacterium avium subsp. paratuberculosis
gugcuugccgaugucggcgu

SEQ ID NO: 891379 - RNA, 17 nt, Mycobacterium avium subsp. paratuberculosis
gugcuuggccagcucgg

SEQ ID NO: 891380 - RNA, 21 nt, Mycobacterium avium subsp. paratuberculosis
gugcuugaacgccgcccccgc

SEQ ID NO: 891381 - RNA, 19 nt, Mycobacterium avium subsp. paratuberculosis
guggaaaucgagcgcgcug

SEQ ID NO: 891382 - RNA, 20 nt, Mycobacterium avium subsp. paratuberculosis
guggaaaucgagcgcgcugu

SEQ ID NO: 891383 - RNA, 20 nt, Mycobacterium avium subsp. paratuberculosis
guggaaauugcugaccauga

SEQ ID NO: 891384 - RNA, 20 nt, Mycobacterium avium subsp. paratuberculosis
gugcuuucgcgucugcucgc

SEQ ID NO: 891385 - RNA, 18 nt, Mycobacterium avium subsp. paratuberculosis
guggaacacgucggcgau

SEQ ID NO: 891386 - RNA, 20 nt, Mycobacterium avium subsp. paratuberculosis
gugcuuuugcgucugcucgc

SEQ ID NO: 891387 - RNA, 20 nt, Mycobacterium avium subsp. paratuberculosis
gugcuuuugugucugcucgc

SEQ ID NO: 891388 - RNA, 17 nt, Mycobacterium avium subsp. paratuberculosis
guggaaggcgccggcgc

SEQ ID NO: 891389 - RNA, 14 nt, Mycobacterium avium subsp. paratuberculosis
guggaagccgcgau

SEQ ID NO: 891390 - RNA, 23 nt, Mycobacterium avium subsp. paratuberculosis
guggaagauguugccgccacuca

SEQ ID NO: 891391 - RNA, 16 nt, Mycobacterium avium subsp. paratuberculosis
guggaacgcgucgcgc

SEQ ID NO: 891392 - RNA, 23 nt, Mycobacterium avium subsp. paratuberculosis
guggaauucuggccgaccgccgc

SEQ ID NO: 891393 - RNA, 13 nt, Mycobacterium avium subsp. paratuberculosis
guggacaccgcga

SEQ ID NO: 891394 - RNA, 21 nt, Mycobacterium avium subsp. paratuberculosis
guggacaccgcgaucaccacc

SEQ ID NO: 891395 - RNA, 17 nt, Mycobacterium avium subsp. paratuberculosis
guggauggccggccggg

SEQ ID NO: 891396 - RNA, 22 nt, Mycobacterium avium subsp. paratuberculosis
guggauugucggccgcccgucc

SEQ ID NO: 891397 - RNA, 21 nt, Mycobacterium avium subsp. paratuberculosis
guggaucaccaucacgucgcg

SEQ ID NO: 891398 - RNA, 16 nt, Mycobacterium avium subsp. paratuberculosis
guggaucuccagcagc

SEQ ID NO: 891399 - RNA, 20 nt, Mycobacterium avium subsp. paratuberculosis
guggaggcguagugcgccca

SEQ ID NO: 891400 - RNA, 20 nt, Mycobacterium avium subsp. paratuberculosis
guggacggucagcgcgccgu

SEQ ID NO: 891401 - RNA, 16 nt, Mycobacterium avium subsp. paratuberculosis
guggacgucaggccgu

SEQ ID NO: 891402 - RNA, 16 nt, Mycobacterium avium subsp. paratuberculosis
guggacgcgaccaggc

SEQ ID NO: 891403 - RNA, 19 nt, Mycobacterium avium subsp. paratuberculosis
guggacgcggucgccgccc

SEQ ID NO: 891404 - RNA, 24 nt, Mycobacterium avium subsp. paratuberculosis
guggacgucguuuuccagccggcg

SEQ ID NO: 891405 - RNA, 19 nt, Mycobacterium avium subsp. paratuberculosis
guggacuccagcaccagca

SEQ ID NO: 891406 - RNA, 22 nt, Mycobacterium avium subsp. paratuberculosis
guggacuccagcaccagcacgg

SEQ ID NO: 891407 - RNA, 14 nt, Mycobacterium avium subsp. paratuberculosis
guggagauggccag

SEQ ID NO: 891408 - RNA, 16 nt, Mycobacterium avium subsp. paratuberculosis
guggagcacagcacgg

SEQ ID NO: 891409 - RNA, 14 nt, Mycobacterium avium subsp. paratuberculosis
guggaccgcgcagu

SEQ ID NO: 891410 - RNA, 14 nt, Mycobacterium avium subsp. paratuberculosis
guggacgagcagcc

SEQ ID NO: 891411 - RNA, 17 nt, Mycobacterium avium subsp. paratuberculosis
guggacgagcagccgca

SEQ ID NO: 891412 - RNA, 23 nt, Mycobacterium avium subsp. paratuberculosis
guggacgaugcggggccggcggc

SEQ ID NO: 891413 - RNA, 14 nt, Mycobacterium avium subsp. paratuberculosis
guggacgcccgcga

SEQ ID NO: 891414 - RNA, 18 nt, Mycobacterium avium subsp. paratuberculosis
guggacgccgcgcacgac

SEQ ID NO: 891415 - RNA, 19 nt, Mycobacterium avium subsp. paratuberculosis
guggacgccgcgcacgacg

SEQ ID NO: 891416 - RNA, 16 nt, Mycobacterium avium subsp. paratuberculosis
guggacagguagcggu

SEQ ID NO: 891417 - RNA, 16 nt, Mycobacterium avium subsp. paratuberculosis
guggacaggucgauga

SEQ ID NO: 891418 - RNA, 20 nt, Mycobacterium avium subsp. paratuberculosis
guggacagaugccagacgaa

SEQ ID NO: 891419 - RNA, 22 nt, Mycobacterium avium subsp. paratuberculosis
guggacagcgcgacgggcaccc

SEQ ID NO: 891420 - RNA, 22 nt, Mycobacterium avium subsp. paratuberculosis
guggacaugcagccgccgcgga

SEQ ID NO: 891421 - RNA, 16 nt, Mycobacterium avium subsp. paratuberculosis
gugcgacaccggcgug

SEQ ID NO: 891422 - RNA, 13 nt, Mycobacterium avium subsp. paratuberculosis
gugcgacgcccac

SEQ ID NO: 891423 - RNA, 17 nt, Mycobacterium avium subsp. paratuberculosis
gugcgacgccgcgcagc

SEQ ID NO: 891424 - RNA, 20 nt, Mycobacterium avium subsp. paratuberculosis
gugcgacgccgcgcagcggg

SEQ ID NO: 891425 - RNA, 15 nt, Mycobacterium avium subsp. paratuberculosis
gugcgagccgagcac

SEQ ID NO: 891426 - RNA, 15 nt, Mycobacterium avium subsp. paratuberculosis
gugcgacuugguggc

SEQ ID NO: 891427 - RNA, 22 nt, Mycobacterium avium subsp. paratuberculosis
gugcgagaaaaucgcccgcgaa

SEQ ID NO: 891428 - RNA, 21 nt, Mycobacterium avium subsp. paratuberculosis
gugcgaugguggucgccgucg

SEQ ID NO: 891429 - RNA, 22 nt, Mycobacterium avium subsp. paratuberculosis
gugcgaugguggucgccgucgu

SEQ ID NO: 891430 - RNA, 15 nt, Mycobacterium avium subsp. paratuberculosis
gugcgaugucggugc

SEQ ID NO: 891431 - RNA, 16 nt, Mycobacterium avium subsp. paratuberculosis
gugcggauggccccgg

SEQ ID NO: 891432 - RNA, 18 nt, Mycobacterium avium subsp. paratuberculosis
gugcggauggccccggcg

SEQ ID NO: 891433 - RNA, 17 nt, Mycobacterium avium subsp. paratuberculosis
gugcgcuugucggcgug

SEQ ID NO: 891434 - RNA, 13 nt, Mycobacterium avium subsp. paratuberculosis
gugcgccgcccac

SEQ ID NO: 891435 - RNA, 14 nt, Mycobacterium avium subsp. paratuberculosis
gugcgccgcccaca

SEQ ID NO: 891436 - RNA, 20 nt, Mycobacterium avium subsp. paratuberculosis
gugcgccgcccacaccgaca

SEQ ID NO: 891437 - RNA, 16 nt, Mycobacterium avium subsp. paratuberculosis
gugcggaacaccgccu

SEQ ID NO: 891438 - RNA, 20 nt, Mycobacterium avium subsp. paratuberculosis
gugcggaacaccgccuugcc

SEQ ID NO: 891439 - RNA, 15 nt, Mycobacterium avium subsp. paratuberculosis
gugcgcccggccagc

SEQ ID NO: 891440 - RNA, 16 nt, Mycobacterium avium subsp. paratuberculosis
gugcgcccggccagcc

SEQ ID NO: 891441 - RNA, 12 nt, Mycobacterium avium subsp. paratuberculosis
gugcgcccgacg

SEQ ID NO: 891442 - RNA, 13 nt, Mycobacterium avium subsp. paratuberculosis
gugcgcccgacgc

SEQ ID NO: 891443 - RNA, 18 nt, Mycobacterium avium subsp. paratuberculosis
gugcgcccgacgccggac

SEQ ID NO: 891444 - RNA, 20 nt, Mycobacterium avium subsp. paratuberculosis
gugcgcccgacgccggaccc

SEQ ID NO: 891445 - RNA, 17 nt, Mycobacterium avium subsp. paratuberculosis
gugcgccaggcaggcgg

SEQ ID NO: 891446 - RNA, 18 nt, Mycobacterium avium subsp. paratuberculosis
gugcgccaggcaggcggc

SEQ ID NO: 891447 - RNA, 22 nt, Mycobacterium avium subsp. paratuberculosis
gugcgccaguugcucgggugac

SEQ ID NO: 891448 - RNA, 15 nt, Mycobacterium avium subsp. paratuberculosis
gugcgccagcgugaa

SEQ ID NO: 891449 - RNA, 17 nt, Mycobacterium avium subsp. paratuberculosis
gugcgccagcgugaaca

SEQ ID NO: 891450 - RNA, 20 nt, Mycobacterium avium subsp. paratuberculosis
gugcgccauguccggcaggc

SEQ ID NO: 891451 - RNA, 18 nt, Mycobacterium avium subsp. paratuberculosis
gugcgcccauccggcgcc

SEQ ID NO: 891452 - RNA, 22 nt, Mycobacterium avium subsp. paratuberculosis
gugcgcccauccggcgccgcgc

SEQ ID NO: 891453 - RNA, 17 nt, Mycobacterium avium subsp. paratuberculosis
gugcgcaaguagcgcuc

SEQ ID NO: 891454 - RNA, 14 nt, Mycobacterium avium subsp. paratuberculosis
gugcgccacgcccg

SEQ ID NO: 891455 - RNA, 15 nt, Mycobacterium avium subsp. paratuberculosis
gugcgccacugcggg

SEQ ID NO: 891456 - RNA, 16 nt, Mycobacterium avium subsp. paratuberculosis
gugcgccagaucagcg

SEQ ID NO: 891457 - RNA, 19 nt, Mycobacterium avium subsp. paratuberculosis
gugcgccagaucagcgugg

SEQ ID NO: 891458 - RNA, 17 nt, Mycobacterium avium subsp. paratuberculosis
gugcgccagcgaccgca

SEQ ID NO: 891459 - RNA, 23 nt, Mycobacterium avium subsp. paratuberculosis
gugcgccagcgaccgcaggucga

SEQ ID NO: 891460 - RNA, 19 nt, Mycobacterium avium subsp. paratuberculosis
gugcgauggcaacgccggu

SEQ ID NO: 891461 - RNA, 23 nt, Mycobacterium avium subsp. paratuberculosis
gugcggcacgauggacgcccaac

SEQ ID NO: 891462 - RNA, 20 nt, Mycobacterium avium subsp. paratuberculosis
gugcggacccguugggccag

SEQ ID NO: 891463 - RNA, 13 nt, Mycobacterium avium subsp. paratuberculosis
gugcggcaacccg

SEQ ID NO: 891464 - RNA, 20 nt, Mycobacterium avium subsp. paratuberculosis
gugcggcaacccgaucgccg

SEQ ID NO: 891465 - RNA, 16 nt, Mycobacterium avium subsp. paratuberculosis
gugcggcagcucggcg

SEQ ID NO: 891466 - RNA, 13 nt, Mycobacterium avium subsp. paratuberculosis
gugcggcccgccg

SEQ ID NO: 891467 - RNA, 14 nt, Mycobacterium avium subsp. paratuberculosis
gugcggcccgccgg

SEQ ID NO: 891468 - RNA, 13 nt, Mycobacterium avium subsp. paratuberculosis
gugcggcccgcgg

SEQ ID NO: 891469 - RNA, 15 nt, Mycobacterium avium subsp. paratuberculosis
gugcggcccgcggca

SEQ ID NO: 891470 - RNA, 22 nt, Mycobacterium avium subsp. paratuberculosis
gugcggccgcauuuggcguaac

SEQ ID NO: 891471 - RNA, 13 nt, Mycobacterium avium subsp. paratuberculosis
gugcggccgcgau

SEQ ID NO: 891472 - RNA, 15 nt, Mycobacterium avium subsp. paratuberculosis
gugcggccgcgcagc

SEQ ID NO: 891473 - RNA, 19 nt, Mycobacterium avium subsp. paratuberculosis
gugcggccggcgccggcgg

SEQ ID NO: 891474 - RNA, 14 nt, Mycobacterium avium subsp. paratuberculosis
gugcggcucgggcg

SEQ ID NO: 891475 - RNA, 18 nt, Mycobacterium avium subsp. paratuberculosis
gugcgggaugccgagcag

SEQ ID NO: 891476 - RNA, 14 nt, Mycobacterium avium subsp. paratuberculosis
gugcggcgugcggu

SEQ ID NO: 891477 - RNA, 20 nt, Mycobacterium avium subsp. paratuberculosis
gugcggcuugcccguucgau

SEQ ID NO: 891478 - RNA, 16 nt, Mycobacterium avium subsp. paratuberculosis
gugcggcggugacgau

SEQ ID NO: 891479 - RNA, 19 nt, Mycobacterium avium subsp. paratuberculosis
gugcggcguucggugcccg

SEQ ID NO: 891480 - RNA, 14 nt, Mycobacterium avium subsp. paratuberculosis
gugcggcgcggcgg

SEQ ID NO: 891481 - RNA, 16 nt, Mycobacterium avium subsp. paratuberculosis
gugcggcgcggucgca

SEQ ID NO: 891482 - RNA, 15 nt, Mycobacterium avium subsp. paratuberculosis
gugcggcgcucggug

SEQ ID NO: 891483 - RNA, 17 nt, Mycobacterium avium subsp. paratuberculosis
gugcggcgcugccggcg

SEQ ID NO: 891484 - RNA, 20 nt, Mycobacterium avium subsp. paratuberculosis
gugcguccaggacucggggu

SEQ ID NO: 891485 - RNA, 17 nt, Mycobacterium avium subsp. paratuberculosis
gugcgucacgcugguga

SEQ ID NO: 891486 - RNA, 19 nt, Mycobacterium avium subsp. paratuberculosis
gugcgucacgcuggugacg

SEQ ID NO: 891487 - RNA, 18 nt, Mycobacterium avium subsp. paratuberculosis
gugcgucagaaccggggc

SEQ ID NO: 891488 - RNA, 13 nt, Mycobacterium avium subsp. paratuberculosis
gugcguagcggcc

SEQ ID NO: 891489 - RNA, 16 nt, Mycobacterium avium subsp. paratuberculosis
gugcguagcggcccga

SEQ ID NO: 891490 - RNA, 20 nt, Mycobacterium avium subsp. paratuberculosis
gugcgucgggcgccggcgcg

SEQ ID NO: 891491 - RNA, 23 nt, Mycobacterium avium subsp. paratuberculosis
gugcgucuuuucccacacgcucg

SEQ ID NO: 891492 - RNA, 23 nt, Mycobacterium avium subsp. paratuberculosis
gugcucccagcucagacugccga

SEQ ID NO: 891493 - RNA, 18 nt, Mycobacterium avium subsp. paratuberculosis
gugcucccccggaccugc

SEQ ID NO: 891494 - RNA, 13 nt, Mycobacterium avium subsp. paratuberculosis
gugcucccgccga

SEQ ID NO: 891495 - RNA, 23 nt, Mycobacterium avium subsp. paratuberculosis
gugcucccgccgagauccaccgc

SEQ ID NO: 891496 - RNA, 22 nt, Mycobacterium avium subsp. paratuberculosis
gugcguacuucgcguuccgcca

SEQ ID NO: 891497 - RNA, 19 nt, Mycobacterium avium subsp. paratuberculosis
gugcggggccgcggccggc

SEQ ID NO: 891498 - RNA, 17 nt, Mycobacterium avium subsp. paratuberculosis
gugcgguucacgcggcu

SEQ ID NO: 891499 - RNA, 22 nt, Mycobacterium avium subsp. paratuberculosis
gugcgguugagcaccagcccgg

SEQ ID NO: 891500 - RNA, 13 nt, Mycobacterium avium subsp. paratuberculosis
gugcgggccagca

SEQ ID NO: 891501 - RNA, 17 nt, Mycobacterium avium subsp. paratuberculosis
gugcgggccagcagccg

SEQ ID NO: 891502 - RNA, 23 nt, Mycobacterium avium subsp. paratuberculosis
gugcgggcucgauguugaucgcc

SEQ ID NO: 891503 - RNA, 17 nt, Mycobacterium avium subsp. paratuberculosis
gugcgggcugacgucga

SEQ ID NO: 891504 - RNA, 23 nt, Mycobacterium avium subsp. paratuberculosis
gugcgggcugcaccagggcgucg

SEQ ID NO: 891505 - RNA, 16 nt, Mycobacterium avium subsp. paratuberculosis
gugcgguggucggcgu

SEQ ID NO: 891506 - RNA, 18 nt, Mycobacterium avium subsp. paratuberculosis
gugcgguggucggcguca

SEQ ID NO: 891507 - RNA, 23 nt, Mycobacterium avium subsp. paratuberculosis
gugccgggcgguacgcgccgcgc

SEQ ID NO: 891508 - RNA, 14 nt, Mycobacterium avium subsp. paratuberculosis
gugccgggccagcu

SEQ ID NO: 891509 - RNA, 18 nt, Mycobacterium avium subsp. paratuberculosis
gugccgcgaugcccgccg

SEQ ID NO: 891510 - RNA, 16 nt, Mycobacterium avium subsp. paratuberculosis
gugccgcgcaccaccu

SEQ ID NO: 891511 - RNA, 17 nt, Mycobacterium avium subsp. paratuberculosis
gugccgcgcaccaccuc

SEQ ID NO: 891512 - RNA, 13 nt, Mycobacterium avium subsp. paratuberculosis
gugccgccgugcg

SEQ ID NO: 891513 - RNA, 13 nt, Mycobacterium avium subsp. paratuberculosis
gugccgccguugc

SEQ ID NO: 891514 - RNA, 18 nt, Mycobacterium avium subsp. paratuberculosis
gugccgccgggcaccucg

SEQ ID NO: 891515 - RNA, 22 nt, Mycobacterium avium subsp. paratuberculosis
gugccgccgggcaccucggcgu

SEQ ID NO: 891516 - RNA, 13 nt, Mycobacterium avium subsp. paratuberculosis
gugccgccgggga

SEQ ID NO: 891517 - RNA, 19 nt, Mycobacterium avium subsp. paratuberculosis
gugccgccggggacccgca

SEQ ID NO: 891518 - RNA, 15 nt, Mycobacterium avium subsp. paratuberculosis
gugccgccggugaac

SEQ ID NO: 891519 - RNA, 12 nt, Mycobacterium avium subsp. paratuberculosis
gugccgccggcg

SEQ ID NO: 891520 - RNA, 13 nt, Mycobacterium avium subsp. paratuberculosis
gugccgccggcgc

SEQ ID NO: 891521 - RNA, 16 nt, Mycobacterium avium subsp. paratuberculosis
gugccgccgaugacgg

SEQ ID NO: 891522 - RNA, 13 nt, Mycobacterium avium subsp. paratuberculosis
gugccgccgcccg

SEQ ID NO: 891523 - RNA, 22 nt, Mycobacterium avium subsp. paratuberculosis
gugccgcccgucgccuccugcu

SEQ ID NO: 891524 - RNA, 20 nt, Mycobacterium avium subsp. paratuberculosis
gugccgguguugccgacggc

SEQ ID NO: 891525 - RNA, 18 nt, Mycobacterium avium subsp. paratuberculosis
gugccggugcagcaccuc

SEQ ID NO: 891526 - RNA, 23 nt, Mycobacterium avium subsp. paratuberculosis
gugccggugcagcaccucgaucu

SEQ ID NO: 891527 - RNA, 19 nt, Mycobacterium avium subsp. paratuberculosis
gugccgggucgcagcggca

SEQ ID NO: 891528 - RNA, 22 nt, Mycobacterium avium subsp. paratuberculosis
gugcgaaaauggcugcccggca

SEQ ID NO: 891529 - RNA, 18 nt, Mycobacterium avium subsp. paratuberculosis
gugcgaaacucaccgcgu

SEQ ID NO: 891530 - RNA, 15 nt, Mycobacterium avium subsp. paratuberculosis
gugccuuacgccggg

SEQ ID NO: 891531 - RNA, 16 nt, Mycobacterium avium subsp. paratuberculosis
gugccuugcacccagc

SEQ ID NO: 891532 - RNA, 16 nt, Mycobacterium avium subsp. paratuberculosis
gugccguccagcuccg

SEQ ID NO: 891533 - RNA, 21 nt, Mycobacterium avium subsp. paratuberculosis
gugccugggugcgcggcgccg

SEQ ID NO: 891534 - RNA, 13 nt, Mycobacterium avium subsp. paratuberculosis
gugcccgcccagc

SEQ ID NO: 891535 - RNA, 24 nt, Mycobacterium avium subsp. paratuberculosis
gugcccgcccagcugcacccaccg

SEQ ID NO: 891536 - RNA, 14 nt, Mycobacterium avium subsp. paratuberculosis
gugcccgcgcccac

SEQ ID NO: 891537 - RNA, 21 nt, Mycobacterium avium subsp. paratuberculosis
gugcccgcgggacacggcggc

SEQ ID NO: 891538 - RNA, 22 nt, Mycobacterium avium subsp. paratuberculosis
gugcccgcgggacacggcggcg

SEQ ID NO: 891539 - RNA, 21 nt, Mycobacterium avium subsp. paratuberculosis
gugcccgcguacagcgggucg

SEQ ID NO: 891540 - RNA, 17 nt, Mycobacterium avium subsp. paratuberculosis
gugcccgccgaccagga

SEQ ID NO: 891541 - RNA, 16 nt, Mycobacterium avium subsp. paratuberculosis
gugcccgccgcgaccg

SEQ ID NO: 891542 - RNA, 13 nt, Mycobacterium avium subsp. paratuberculosis
gugcccggcguug

SEQ ID NO: 891543 - RNA, 16 nt, Mycobacterium avium subsp. paratuberculosis
gugcccggcugggcgc

SEQ ID NO: 891544 - RNA, 13 nt, Mycobacterium avium subsp. paratuberculosis
gugcccggcgccg

SEQ ID NO: 891545 - RNA, 19 nt, Mycobacterium avium subsp. paratuberculosis
gugcccggcgccggacggc

SEQ ID NO: 891546 - RNA, 20 nt, Mycobacterium avium subsp. paratuberculosis
gugcccgccucgcagcgaca

SEQ ID NO: 891547 - RNA, 12 nt, Mycobacterium avium subsp. paratuberculosis
gugcccggccaa

SEQ ID NO: 891548 - RNA, 13 nt, Mycobacterium avium subsp. paratuberculosis
gugcccggccagc

SEQ ID NO: 891549 - RNA, 18 nt, Mycobacterium avium subsp. paratuberculosis
gugccgaucaccucgccg

SEQ ID NO: 891550 - RNA, 14 nt, Mycobacterium avium subsp. paratuberculosis
gugccgagcacgcg

SEQ ID NO: 891551 - RNA, 18 nt, Mycobacterium avium subsp. paratuberculosis
gugccgagcacgcggccg

SEQ ID NO: 891552 - RNA, 21 nt, Mycobacterium avium subsp. paratuberculosis
gugccgagcacgcggccgcgc

SEQ ID NO: 891553 - RNA, 22 nt, Mycobacterium avium subsp. paratuberculosis
gugccgagcacgcggccgcgcc

SEQ ID NO: 891554 - RNA, 15 nt, Mycobacterium avium subsp. paratuberculosis
gugccgagcccgccg

SEQ ID NO: 891555 - RNA, 13 nt, Mycobacterium avium subsp. paratuberculosis
gugccgagcgcgc

SEQ ID NO: 891556 - RNA, 14 nt, Mycobacterium avium subsp. paratuberculosis
gugccgagcgcgcu

SEQ ID NO: 891557 - RNA, 19 nt, Mycobacterium avium subsp. paratuberculosis
gugcccguugcccgaucag

SEQ ID NO: 891558 - RNA, 16 nt, Mycobacterium avium subsp. paratuberculosis
gugcccucaauagcgg

SEQ ID NO: 891559 - RNA, 14 nt, Mycobacterium avium subsp. paratuberculosis
gugccgacggugcg

SEQ ID NO: 891560 - RNA, 15 nt, Mycobacterium avium subsp. paratuberculosis
gugccgacggugcgu

SEQ ID NO: 891561 - RNA, 18 nt, Mycobacterium avium subsp. paratuberculosis
gugccgacggugcgugcc

SEQ ID NO: 891562 - RNA, 12 nt, Mycobacterium avium subsp. paratuberculosis
gugcccgggucg

SEQ ID NO: 891563 - RNA, 21 nt, Mycobacterium avium subsp. paratuberculosis
gugcccgggucgugcggcggc

SEQ ID NO: 891564 - RNA, 13 nt, Mycobacterium avium subsp. paratuberculosis
gugccgcaggcga

SEQ ID NO: 891565 - RNA, 14 nt, Mycobacterium avium subsp. paratuberculosis
gugccgcaggcgaa

SEQ ID NO: 891566 - RNA, 16 nt, Mycobacterium avium subsp. paratuberculosis
gugccgcaggcgaaca

SEQ ID NO: 891567 - RNA, 15 nt, Mycobacterium avium subsp. paratuberculosis
gugccgcagccgucc

SEQ ID NO: 891568 - RNA, 16 nt, Mycobacterium avium subsp. paratuberculosis
gugccgcagcggcggc

SEQ ID NO: 891569 - RNA, 17 nt, Mycobacterium avium subsp. paratuberculosis
gugccgcagcggcggca

SEQ ID NO: 891570 - RNA, 17 nt, Mycobacterium avium subsp. paratuberculosis
gugccgcagcucgauca

SEQ ID NO: 891571 - RNA, 22 nt, Mycobacterium avium subsp. paratuberculosis
gugccgauccgcaccggacgca

SEQ ID NO: 891572 - RNA, 16 nt, Mycobacterium avium subsp. paratuberculosis
gugccgaucgagacca

SEQ ID NO: 891573 - RNA, 14 nt, Mycobacterium avium subsp. paratuberculosis
gugccgcaccagca

SEQ ID NO: 891574 - RNA, 17 nt, Mycobacterium avium subsp. paratuberculosis
gugccgcaccagcaccc

SEQ ID NO: 891575 - RNA, 16 nt, Mycobacterium avium subsp. paratuberculosis
gugccgcacccgaucc

SEQ ID NO: 891576 - RNA, 14 nt, Mycobacterium avium subsp. paratuberculosis
gugccgcaccuggu

SEQ ID NO: 891577 - RNA, 15 nt, Mycobacterium avium subsp. paratuberculosis
gugccgcccaacgac

SEQ ID NO: 891578 - RNA, 23 nt, Mycobacterium avium subsp. paratuberculosis
gugccgcccaacgacgucggcgu

SEQ ID NO: 891579 - RNA, 20 nt, Mycobacterium avium subsp. paratuberculosis
gugccgaguucgaccucggu

SEQ ID NO: 891580 - RNA, 14 nt, Mycobacterium avium subsp. paratuberculosis
gugccgcccggacc

SEQ ID NO: 891581 - RNA, 18 nt, Mycobacterium avium subsp. paratuberculosis
gugccgcccggaccgcgg

SEQ ID NO: 891582 - RNA, 19 nt, Mycobacterium avium subsp. paratuberculosis
gugccgcccggaccgcggu

SEQ ID NO: 891583 - RNA, 18 nt, Mycobacterium avium subsp. paratuberculosis
gugaguucaucgacgucg

SEQ ID NO: 891584 - RNA, 20 nt, Mycobacterium avium subsp. paratuberculosis
gugaggcguuggcccgcacc

SEQ ID NO: 891585 - RNA, 22 nt, Mycobacterium avium subsp. paratuberculosis
gugagggaacgccgaucaccgg

SEQ ID NO: 891586 - RNA, 14 nt, Mycobacterium avium subsp. paratuberculosis
gugagggaccucca

SEQ ID NO: 891587 - RNA, 17 nt, Mycobacterium avium subsp. paratuberculosis
gugaggggauccagcgg

SEQ ID NO: 891588 - RNA, 20 nt, Mycobacterium avium subsp. paratuberculosis
gugaggggauccagcggcgg

SEQ ID NO: 891589 - RNA, 17 nt, Mycobacterium avium subsp. paratuberculosis
gugaggguuuccacgug

SEQ ID NO: 891590 - RNA, 20 nt, Mycobacterium avium subsp. paratuberculosis
gugauagaucaucccggcca

SEQ ID NO: 891591 - RNA, 23 nt, Mycobacterium avium subsp. paratuberculosis
gugauagaucaucccggccaccc

SEQ ID NO: 891592 - RNA, 15 nt, Mycobacterium avium subsp. paratuberculosis
gugauagcggccgcg

SEQ ID NO: 891593 - RNA, 21 nt, Mycobacterium avium subsp. paratuberculosis
gugauaggggcagaccaggac

SEQ ID NO: 891594 - RNA, 16 nt, Mycobacterium avium subsp. paratuberculosis
gugauacgccgacgca

SEQ ID NO: 891595 - RNA, 19 nt, Mycobacterium avium subsp. paratuberculosis
gugauaguggucgucgucg

SEQ ID NO: 891596 - RNA, 19 nt, Mycobacterium avium subsp. paratuberculosis
gugauacaggagggccagg

SEQ ID NO: 891597 - RNA, 22 nt, Mycobacterium avium subsp. paratuberculosis
gugauacaggagggccagggcu

SEQ ID NO: 891598 - RNA, 19 nt, Mycobacterium avium subsp. paratuberculosis
gugaguucgucggcgaucg

SEQ ID NO: 891599 - RNA, 13 nt, Mycobacterium avium subsp. paratuberculosis
gugcacaggccgc

SEQ ID NO: 891600 - RNA, 14 nt, Mycobacterium avium subsp. paratuberculosis
gugcacaccggccu

SEQ ID NO: 891601 - RNA, 15 nt, Mycobacterium avium subsp. paratuberculosis
gugcacaccggccuu

SEQ ID NO: 891602 - RNA, 21 nt, Mycobacterium avium subsp. paratuberculosis
gugcaccacccaggccacccg

SEQ ID NO: 891603 - RNA, 17 nt, Mycobacterium avium subsp. paratuberculosis
gugcacccacgccagcc

SEQ ID NO: 891604 - RNA, 22 nt, Mycobacterium avium subsp. paratuberculosis
gugcacccgaugcucccggucg

SEQ ID NO: 891605 - RNA, 15 nt, Mycobacterium avium subsp. paratuberculosis
gugcacccgcggcgc

SEQ ID NO: 891606 - RNA, 16 nt, Mycobacterium avium subsp. paratuberculosis
gugcaccgccagcgcg

SEQ ID NO: 891607 - RNA, 18 nt, Mycobacterium avium subsp. paratuberculosis
gugcaccgccagcgcggc

SEQ ID NO: 891608 - RNA, 21 nt, Mycobacterium avium subsp. paratuberculosis
gugcaccgccagcgcggcggc

SEQ ID NO: 891609 - RNA, 13 nt, Mycobacterium avium subsp. paratuberculosis
gugcaccgcggcc

SEQ ID NO: 891610 - RNA, 23 nt, Mycobacterium avium subsp. paratuberculosis
gugcaccgcggccaacccgggcg

SEQ ID NO: 891611 - RNA, 20 nt, Mycobacterium avium subsp. paratuberculosis
gugcaccgcggcgcgcaucg

SEQ ID NO: 891612 - RNA, 22 nt, Mycobacterium avium subsp. paratuberculosis
gugcaccugugaggcaccgaac

SEQ ID NO: 891613 - RNA, 20 nt, Mycobacterium avium subsp. paratuberculosis
gugcacccgguucugggcgg

SEQ ID NO: 891614 - RNA, 16 nt, Mycobacterium avium subsp. paratuberculosis
gugcaccggcacgucg

SEQ ID NO: 891615 - RNA, 21 nt, Mycobacterium avium subsp. paratuberculosis
gugcaccggcacgucgagcuc

SEQ ID NO: 891616 - RNA, 14 nt, Mycobacterium avium subsp. paratuberculosis
gugcaccucgacga

SEQ ID NO: 891617 - RNA, 15 nt, Mycobacterium avium subsp. paratuberculosis
gugcaccucgacgaa

SEQ ID NO: 891618 - RNA, 15 nt, Mycobacterium avium subsp. paratuberculosis
gugcaccugcagccg

SEQ ID NO: 891619 - RNA, 16 nt, Mycobacterium avium subsp. paratuberculosis
gugcaccugcagccgg

SEQ ID NO: 891620 - RNA, 13 nt, Mycobacterium avium subsp. paratuberculosis
gugcagccccgca

SEQ ID NO: 891621 - RNA, 17 nt, Mycobacterium avium subsp. paratuberculosis
gugcacgaacgcggcca

SEQ ID NO: 891622 - RNA, 22 nt, Mycobacterium avium subsp. paratuberculosis
gugcacgaacgcggccagcggg

SEQ ID NO: 891623 - RNA, 14 nt, Mycobacterium avium subsp. paratuberculosis
gugcagcgccagca

SEQ ID NO: 891624 - RNA, 15 nt, Mycobacterium avium subsp. paratuberculosis
gugcagcgccagcac

SEQ ID NO: 891625 - RNA, 17 nt, Mycobacterium avium subsp. paratuberculosis
gugcagcgccagcaccg

SEQ ID NO: 891626 - RNA, 14 nt, Mycobacterium avium subsp. paratuberculosis
gugcagcgcccagc

SEQ ID NO: 891627 - RNA, 13 nt, Mycobacterium avium subsp. paratuberculosis
gugcagccggcgg

SEQ ID NO: 891628 - RNA, 15 nt, Mycobacterium avium subsp. paratuberculosis
gugcagccggcggcg

SEQ ID NO: 891629 - RNA, 16 nt, Mycobacterium avium subsp. paratuberculosis
gugcagccggcggcgc

SEQ ID NO: 891630 - RNA, 13 nt, Mycobacterium avium subsp. paratuberculosis
gugcagccgggcg

SEQ ID NO: 891631 - RNA, 19 nt, Mycobacterium avium subsp. paratuberculosis
gugcagccgggcggcgccg

SEQ ID NO: 891632 - RNA, 20 nt, Mycobacterium avium subsp. paratuberculosis
gugcagcgacucguuggccg

SEQ ID NO: 891633 - RNA, 17 nt, Mycobacterium avium subsp. paratuberculosis
gugccaguaccagcggc

SEQ ID NO: 891634 - RNA, 22 nt, Mycobacterium avium subsp. paratuberculosis
gugccaguaccagcggccgucg

SEQ ID NO: 891635 - RNA, 16 nt, Mycobacterium avium subsp. paratuberculosis
gugccagggcagcgcg

SEQ ID NO: 891636 - RNA, 22 nt, Mycobacterium avium subsp. paratuberculosis
gugccagggcagcgcgaccagc

SEQ ID NO: 891637 - RNA, 20 nt, Mycobacterium avium subsp. paratuberculosis
gugccaagcguauccggcca

SEQ ID NO: 891638 - RNA, 17 nt, Mycobacterium avium subsp. paratuberculosis
gugccaaggucgccggu

SEQ ID NO: 891639 - RNA, 15 nt, Mycobacterium avium subsp. paratuberculosis
gugccacaggccgaa

SEQ ID NO: 891640 - RNA, 18 nt, Mycobacterium avium subsp. paratuberculosis
gugccagccggccgcuga

SEQ ID NO: 891641 - RNA, 16 nt, Mycobacterium avium subsp. paratuberculosis
gugccagccgugcggc

SEQ ID NO: 891642 - RNA, 22 nt, Mycobacterium avium subsp. paratuberculosis
gugccagcgcaguucaccgaag

SEQ ID NO: 891643 - RNA, 16 nt, Mycobacterium avium subsp. paratuberculosis
gugccaucgugggcgc

SEQ ID NO: 891644 - RNA, 21 nt, Mycobacterium avium subsp. paratuberculosis
gugccaucgugggcgccgucg

SEQ ID NO: 891645 - RNA, 18 nt, Mycobacterium avium subsp. paratuberculosis
gugcccaacacgccccga

SEQ ID NO: 891646 - RNA, 12 nt, Mycobacterium avium subsp. paratuberculosis
gugcccaccagc

SEQ ID NO: 891647 - RNA, 13 nt, Mycobacterium avium subsp. paratuberculosis
gugcccaccagca

SEQ ID NO: 891648 - RNA, 14 nt, Mycobacterium avium subsp. paratuberculosis
gugcccaccagccg

SEQ ID NO: 891649 - RNA, 15 nt, Mycobacterium avium subsp. paratuberculosis
gugcccaccagccgg

SEQ ID NO: 891650 - RNA, 20 nt, Mycobacterium avium subsp. paratuberculosis
gugcccaccagccggccggc

SEQ ID NO: 891651 - RNA, 13 nt, Mycobacterium avium subsp. paratuberculosis
gugcccaccgggc

SEQ ID NO: 891652 - RNA, 15 nt, Mycobacterium avium subsp. paratuberculosis
gugcaggauccgcuc

SEQ ID NO: 891653 - RNA, 14 nt, Mycobacterium avium subsp. paratuberculosis
gugcaggaucggcu

SEQ ID NO: 891654 - RNA, 19 nt, Mycobacterium avium subsp. paratuberculosis
gugcaggaugaccgcgucg

SEQ ID NO: 891655 - RNA, 21 nt, Mycobacterium avium subsp. paratuberculosis
gugcaggaugaccgcgucggc

SEQ ID NO: 891656 - RNA, 19 nt, Mycobacterium avium subsp. paratuberculosis
gugcaggaccuugucgggc

SEQ ID NO: 891657 - RNA, 15 nt, Mycobacterium avium subsp. paratuberculosis
gugcaggccgaacac

SEQ ID NO: 891658 - RNA, 20 nt, Mycobacterium avium subsp. paratuberculosis
gugcaucgccaccgucgucg

SEQ ID NO: 891659 - RNA, 15 nt, Mycobacterium avium subsp. paratuberculosis
gugcaucgggcgcuc

SEQ ID NO: 891660 - RNA, 15 nt, Mycobacterium avium subsp. paratuberculosis
gugcaugcgcuggcg

SEQ ID NO: 891661 - RNA, 20 nt, Mycobacterium avium subsp. paratuberculosis
gugcauguagcggucguaga

SEQ ID NO: 891662 - RNA, 18 nt, Mycobacterium avium subsp. paratuberculosis
gugcaugugcucggcgag

SEQ ID NO: 891663 - RNA, 20 nt, Mycobacterium avium subsp. paratuberculosis
gugcauguggccgucgccga

SEQ ID NO: 891664 - RNA, 17 nt, Mycobacterium avium subsp. paratuberculosis
gugccaacacggcggcg

SEQ ID NO: 891665 - RNA, 18 nt, Mycobacterium avium subsp. paratuberculosis
gugccaacacggcggcgc

SEQ ID NO: 891666 - RNA, 14 nt, Mycobacterium avium subsp. paratuberculosis
guucagcagccggc

SEQ ID NO: 891667 - RNA, 15 nt, Mycobacterium avium subsp. paratuberculosis
guucagcagcgcggu

SEQ ID NO: 891668 - RNA, 23 nt, Mycobacterium avium subsp. paratuberculosis
guucagcccggcgcugcgcccgg

SEQ ID NO: 891669 - RNA, 24 nt, Mycobacterium avium subsp. paratuberculosis
guucagcccggcgcugcgcccggu

SEQ ID NO: 891670 - RNA, 19 nt, Mycobacterium avium subsp. paratuberculosis
guucagcgcgcgggagcgc

SEQ ID NO: 891671 - RNA, 17 nt, Mycobacterium avium subsp. paratuberculosis
guucagcggcaccguca

SEQ ID NO: 891672 - RNA, 18 nt, Mycobacterium avium subsp. paratuberculosis
guucagcggcaccgucac

SEQ ID NO: 891673 - RNA, 14 nt, Mycobacterium avium subsp. paratuberculosis
guucagcugcagcc

SEQ ID NO: 891674 - RNA, 15 nt, Mycobacterium avium subsp. paratuberculosis
guucagcugcagccg

SEQ ID NO: 891675 - RNA, 19 nt, Mycobacterium avium subsp. paratuberculosis
guucagcugcagccggccg

SEQ ID NO: 891676 - RNA, 21 nt, Mycobacterium avium subsp. paratuberculosis
guucagcugcagccggccggc

SEQ ID NO: 891677 - RNA, 16 nt, Mycobacterium avium subsp. paratuberculosis
guuaugccgucaccca

SEQ ID NO: 891678 - RNA, 23 nt, Mycobacterium avium subsp. paratuberculosis
guucaccaguuucacgucggcga

SEQ ID NO: 891679 - RNA, 21 nt, Mycobacterium avium subsp. paratuberculosis
guucaccaccgcgcugcgcgc

SEQ ID NO: 891680 - RNA, 21 nt, Mycobacterium avium subsp. paratuberculosis
guucaccaccggagcggcggu

SEQ ID NO: 891681 - RNA, 13 nt, Mycobacterium avium subsp. paratuberculosis
guucaccagcggg

SEQ ID NO: 891682 - RNA, 14 nt, Mycobacterium avium subsp. paratuberculosis
guucaccccggcgc

SEQ ID NO: 891683 - RNA, 16 nt, Mycobacterium avium subsp. paratuberculosis
guucaccccggcgcgg

SEQ ID NO: 891684 - RNA, 20 nt, Mycobacterium avium subsp. paratuberculosis
guucaccccguugagcagcg

SEQ ID NO: 891685 - RNA, 16 nt, Mycobacterium avium subsp. paratuberculosis
guucaccccgaucaac

SEQ ID NO: 891686 - RNA, 14 nt, Mycobacterium avium subsp. paratuberculosis
guucaccgccacca

SEQ ID NO: 891687 - RNA, 17 nt, Mycobacterium avium subsp. paratuberculosis
guucacccgcgcccgca

SEQ ID NO: 891688 - RNA, 14 nt, Mycobacterium avium subsp. paratuberculosis
guucacccuggcga

SEQ ID NO: 891689 - RNA, 14 nt, Mycobacterium avium subsp. paratuberculosis
guucaccggcguca

SEQ ID NO: 891690 - RNA, 17 nt, Mycobacterium avium subsp. paratuberculosis
guucaccucuucgggca

SEQ ID NO: 891691 - RNA, 15 nt, Mycobacterium avium subsp. paratuberculosis
guucacgcggcuggc

SEQ ID NO: 891692 - RNA, 23 nt, Mycobacterium avium subsp. paratuberculosis
guuauccaccagguugcggauca

SEQ ID NO: 891693 - RNA, 20 nt, Mycobacterium avium subsp. paratuberculosis
guuaggcauccugcuggccg

SEQ ID NO: 891694 - RNA, 17 nt, Mycobacterium avium subsp. paratuberculosis
guuagggcgucaggcgc

SEQ ID NO: 891695 - RNA, 22 nt, Mycobacterium avium subsp. paratuberculosis
guguugucgugccgggugaugc

SEQ ID NO: 891696 - RNA, 16 nt, Mycobacterium avium subsp. paratuberculosis
guguugccgacggcgc

SEQ ID NO: 891697 - RNA, 19 nt, Mycobacterium avium subsp. paratuberculosis
guguugccgacggcgccgg

SEQ ID NO: 891698 - RNA, 13 nt, Mycobacterium avium subsp. paratuberculosis
guguugcgcaccc

SEQ ID NO: 891699 - RNA, 13 nt, Mycobacterium avium subsp. paratuberculosis
guguugcgcagcg

SEQ ID NO: 891700 - RNA, 21 nt, Mycobacterium avium subsp. paratuberculosis
guuccucgaacaggcuggcca

SEQ ID NO: 891701 - RNA, 15 nt, Mycobacterium avium subsp. paratuberculosis
guuccucgacggcga

SEQ ID NO: 891702 - RNA, 17 nt, Mycobacterium avium subsp. paratuberculosis
guuccugcgaccgccgc

SEQ ID NO: 891703 - RNA, 12 nt, Mycobacterium avium subsp. paratuberculosis
guuccucggcgu

SEQ ID NO: 891704 - RNA, 16 nt, Mycobacterium avium subsp. paratuberculosis
guuccuuacgccgacg

SEQ ID NO: 891705 - RNA, 19 nt, Mycobacterium avium subsp. paratuberculosis
guuccuugauccggccgcg

SEQ ID NO: 891706 - RNA, 15 nt, Mycobacterium avium subsp. paratuberculosis
guuccuugcgcagca

SEQ ID NO: 891707 - RNA, 18 nt, Mycobacterium avium subsp. paratuberculosis
guuccuugcggccgccga

SEQ ID NO: 891708 - RNA, 15 nt, Mycobacterium avium subsp. paratuberculosis
guuccgccacggcgg

SEQ ID NO: 891709 - RNA, 13 nt, Mycobacterium avium subsp. paratuberculosis
guuccgcgucggc

SEQ ID NO: 891710 - RNA, 14 nt, Mycobacterium avium subsp. paratuberculosis
guuccgcgucggcc

SEQ ID NO: 891711 - RNA, 18 nt, Mycobacterium avium subsp. paratuberculosis
guuccgcgucggccccca

SEQ ID NO: 891712 - RNA, 13 nt, Mycobacterium avium subsp. paratuberculosis
guuccggcgagau

SEQ ID NO: 891713 - RNA, 18 nt, Mycobacterium avium subsp. paratuberculosis
guuccgacaucagugcgg

SEQ ID NO: 891714 - RNA, 22 nt, Mycobacterium avium subsp. paratuberculosis
guuccgaugaagaacaccccga

SEQ ID NO: 891715 - RNA, 21 nt, Mycobacterium avium subsp. paratuberculosis
guucccggcagaacgacgcca

SEQ ID NO: 891716 - RNA, 23 nt, Mycobacterium avium subsp. paratuberculosis
guucccggcagaacgacgccagu

SEQ ID NO: 891717 - RNA, 13 nt, Mycobacterium avium subsp. paratuberculosis
guucccggccggu

SEQ ID NO: 891718 - RNA, 20 nt, Mycobacterium avium subsp. paratuberculosis
guucccgacagcucgcgcug

SEQ ID NO: 891719 - RNA, 18 nt, Mycobacterium avium subsp. paratuberculosis
guuccccccauacacggg

SEQ ID NO: 891720 - RNA, 13 nt, Mycobacterium avium subsp. paratuberculosis
guuccccggccga

SEQ ID NO: 891721 - RNA, 22 nt, Mycobacterium avium subsp. paratuberculosis
guuccccgggcgagcgucgccg

SEQ ID NO: 891722 - RNA, 15 nt, Mycobacterium avium subsp. paratuberculosis
guuccagccgaucgc

SEQ ID NO: 891723 - RNA, 19 nt, Mycobacterium avium subsp. paratuberculosis
guuccagccgaucgcggug

SEQ ID NO: 891724 - RNA, 14 nt, Mycobacterium avium subsp. paratuberculosis
guuccagccgugcu

SEQ ID NO: 891725 - RNA, 17 nt, Mycobacterium avium subsp. paratuberculosis
guuccaguggcugucgg

SEQ ID NO: 891726 - RNA, 19 nt, Mycobacterium avium subsp. paratuberculosis
guuccagguccgcgguggu

SEQ ID NO: 891727 - RNA, 15 nt, Mycobacterium avium subsp. paratuberculosis
guuccaucagcgccc

SEQ ID NO: 891728 - RNA, 16 nt, Mycobacterium avium subsp. paratuberculosis
guuccaaccaccgugg

SEQ ID NO: 891729 - RNA, 19 nt, Mycobacterium avium subsp. paratuberculosis
guuccaccagcggccgucg

SEQ ID NO: 891730 - RNA, 17 nt, Mycobacterium avium subsp. paratuberculosis
guucauguagcagcgcg

SEQ ID NO: 891731 - RNA, 20 nt, Mycobacterium avium subsp. paratuberculosis
guucauguggaagccgcgau

SEQ ID NO: 891732 - RNA, 19 nt, Mycobacterium avium subsp. paratuberculosis
guuccacgugucggcgucg

SEQ ID NO: 891733 - RNA, 16 nt, Mycobacterium avium subsp. paratuberculosis
guuccagaccggcggc

SEQ ID NO: 891734 - RNA, 17 nt, Mycobacterium avium subsp. paratuberculosis
guuccagcacgcccaga

SEQ ID NO: 891735 - RNA, 23 nt, Mycobacterium avium subsp. paratuberculosis
guuccagcacccggcccacgccg

SEQ ID NO: 891736 - RNA, 22 nt, Mycobacterium avium subsp. paratuberculosis
guuccagcuccguccaccggca

SEQ ID NO: 891737 - RNA, 20 nt, Mycobacterium avium subsp. paratuberculosis
guucauccacucggccacca

SEQ ID NO: 891738 - RNA, 20 nt, Mycobacterium avium subsp. paratuberculosis
guucauccccgcggccaccc

SEQ ID NO: 891739 - RNA, 17 nt, Mycobacterium avium subsp. paratuberculosis
guucagguaaucgauga

SEQ ID NO: 891740 - RNA, 16 nt, Mycobacterium avium subsp. paratuberculosis
gugguagaugucgcga

SEQ ID NO: 891741 - RNA, 17 nt, Mycobacterium avium subsp. paratuberculosis
guggguuccgccgucga

SEQ ID NO: 891742 - RNA, 20 nt, Mycobacterium avium subsp. paratuberculosis
guggguggagacguaccagc

SEQ ID NO: 891743 - RNA, 20 nt, Mycobacterium avium subsp. paratuberculosis
gugggugccgacgagcucgc

SEQ ID NO: 891744 - RNA, 15 nt, Mycobacterium avium subsp. paratuberculosis
guggguggucugcug

SEQ ID NO: 891745 - RNA, 18 nt, Mycobacterium avium subsp. paratuberculosis
gugggugucgaaaccgcc

SEQ ID NO: 891746 - RNA, 14 nt, Mycobacterium avium subsp. paratuberculosis
gugggugucggcga

SEQ ID NO: 891747 - RNA, 16 nt, Mycobacterium avium subsp. paratuberculosis
gugggcggcgcccgac

SEQ ID NO: 891748 - RNA, 13 nt, Mycobacterium avium subsp. paratuberculosis
gugggcggcggga

SEQ ID NO: 891749 - RNA, 14 nt, Mycobacterium avium subsp. paratuberculosis
gugggcgcuggucc

SEQ ID NO: 891750 - RNA, 11 nt, Mycobacterium avium subsp. paratuberculosis
gugggcggcca

SEQ ID NO: 891751 - RNA, 20 nt, Mycobacterium avium subsp. paratuberculosis
gugggcggccaccaacggca

SEQ ID NO: 891752 - RNA, 13 nt, Mycobacterium avium subsp. paratuberculosis
gugggcgccguca

SEQ ID NO: 891753 - RNA, 20 nt, Mycobacterium avium subsp. paratuberculosis
gugggcgccgucgccgccgu

SEQ ID NO: 891754 - RNA, 22 nt, Mycobacterium avium subsp. paratuberculosis
gugggcgccgucgccgccguga

SEQ ID NO: 891755 - RNA, 18 nt, Mycobacterium avium subsp. paratuberculosis
gugggcgccccuggcguc

SEQ ID NO: 891756 - RNA, 17 nt, Mycobacterium avium subsp. paratuberculosis
gugggcgacgucgucgc

SEQ ID NO: 891757 - RNA, 13 nt, Mycobacterium avium subsp. paratuberculosis
gugguccuggcgg

SEQ ID NO: 891758 - RNA, 18 nt, Mycobacterium avium subsp. paratuberculosis
gugguccaccgccgcgcc

SEQ ID NO: 891759 - RNA, 19 nt, Mycobacterium avium subsp. paratuberculosis
gugguccaccgccgcgccg

SEQ ID NO: 891760 - RNA, 16 nt, Mycobacterium avium subsp. paratuberculosis
gugguccagccggucg

SEQ ID NO: 891761 - RNA, 18 nt, Mycobacterium avium subsp. paratuberculosis
gugguccagccggucgca

SEQ ID NO: 891762 - RNA, 18 nt, Mycobacterium avium subsp. paratuberculosis
gugguccaggcgccgggu

SEQ ID NO: 891763 - RNA, 18 nt, Mycobacterium avium subsp. paratuberculosis
guggucccaggaccacuc

SEQ ID NO: 891764 - RNA, 13 nt, Mycobacterium avium subsp. paratuberculosis
guggucgaugccc

SEQ ID NO: 891765 - RNA, 17 nt, Mycobacterium avium subsp. paratuberculosis
guggucgacgagcccgc

SEQ ID NO: 891766 - RNA, 20 nt, Mycobacterium avium subsp. paratuberculosis
guggucgacgagcccgcgcc

SEQ ID NO: 891767 - RNA, 14 nt, Mycobacterium avium subsp. paratuberculosis
guggucgacgccgu

SEQ ID NO: 891768 - RNA, 14 nt, Mycobacterium avium subsp. paratuberculosis
guggucgacgcgcc

SEQ ID NO: 891769 - RNA, 12 nt, Mycobacterium avium subsp. paratuberculosis
guggucagcacc

SEQ ID NO: 891770 - RNA, 13 nt, Mycobacterium avium subsp. paratuberculosis
guggucaccgugu

SEQ ID NO: 891771 - RNA, 21 nt, Mycobacterium avium subsp. paratuberculosis
guggucaccguguuggugacg

SEQ ID NO: 891772 - RNA, 14 nt, Mycobacterium avium subsp. paratuberculosis
guggucaccaccac

SEQ ID NO: 891773 - RNA, 15 nt, Mycobacterium avium subsp. paratuberculosis
guggucaccagcgcg

SEQ ID NO: 891774 - RNA, 17 nt, Mycobacterium avium subsp. paratuberculosis
guggucaccagcgcggu

SEQ ID NO: 891775 - RNA, 16 nt, Mycobacterium avium subsp. paratuberculosis
guggucacccgcagcc

SEQ ID NO: 891776 - RNA, 19 nt, Mycobacterium avium subsp. paratuberculosis
guggucagcggcgccaccg

SEQ ID NO: 891777 - RNA, 22 nt, Mycobacterium avium subsp. paratuberculosis
guggucagcggcgccaccggga

SEQ ID NO: 891778 - RNA, 16 nt, Mycobacterium avium subsp. paratuberculosis
guggucagcgucucgc

SEQ ID NO: 891779 - RNA, 17 nt, Mycobacterium avium subsp. paratuberculosis
guggucagcgucucgcc

SEQ ID NO: 891780 - RNA, 18 nt, Mycobacterium avium subsp. paratuberculosis
guggucagcgucucggcg

SEQ ID NO: 891781 - RNA, 18 nt, Mycobacterium avium subsp. paratuberculosis
guggucaggcccaggcga

SEQ ID NO: 891782 - RNA, 23 nt, Mycobacterium avium subsp. paratuberculosis
guggucaggcccaggcgaccucg

SEQ ID NO: 891783 - RNA, 17 nt, Mycobacterium avium subsp. paratuberculosis
guggcagggccagcagc

SEQ ID NO: 891784 - RNA, 18 nt, Mycobacterium avium subsp. paratuberculosis
guggcagggccagcagcc

SEQ ID NO: 891785 - RNA, 13 nt, Mycobacterium avium subsp. paratuberculosis
guggcacccgggu

SEQ ID NO: 891786 - RNA, 20 nt, Mycobacterium avium subsp. paratuberculosis
guggcaacgugccacaggcc

SEQ ID NO: 891787 - RNA, 19 nt, Mycobacterium avium subsp. paratuberculosis
guggcagcggacccggucg

SEQ ID NO: 891788 - RNA, 21 nt, Mycobacterium avium subsp. paratuberculosis
guggcagcggacccggucggc

SEQ ID NO: 891789 - RNA, 18 nt, Mycobacterium avium subsp. paratuberculosis
guggcagcggucggcggc

SEQ ID NO: 891790 - RNA, 21 nt, Mycobacterium avium subsp. paratuberculosis
guggcagcggucggcggcuga

SEQ ID NO: 891791 - RNA, 19 nt, Mycobacterium avium subsp. paratuberculosis
guggcaggccaucagcccg

SEQ ID NO: 891792 - RNA, 22 nt, Mycobacterium avium subsp. paratuberculosis
guggcaggcgauggcgucggcc

SEQ ID NO: 891793 - RNA, 13 nt, Mycobacterium avium subsp. paratuberculosis
gugggcgaacagc
